United States Patent 9,782,462 (MODIFIED POLYNUCLEOTIDES FOR THE PRODUCTION OF PROTEINS ASSOCIATED WITH HUMAN DISEASE) - sequence listing, part 29

SEQ ID NO: 32469 - DNA, 4825 bp, Homo sapiens
gaggtctaagggcgcgagggaagtggcgggcggggactaaggcggggcgtgcaggtagccggccggccgggggtcgcgggtatggccgaggccaggaagcggcgggagctacttcccctgatctaccaccatctgctgcgggctggctatgtgcgtgcggcgcgggaagtgaaggagcagagcggccagaagtgtttcctggctcagcccgtaacccttctggacatctatacacactggcaacaaacctcagagcttggtcggaagcggaaggcagaggaagatgcggcactgcaagctaagaaaacccgtgtgtcagaccccatcagcacctcggagagctcggaagaggaggaagaagcagaagccgaaaccgccaaagccaccccaagactagcatctaccaactcctcagtcctgggggcggacttgccatcaagcatgaaagaaaaagccaaggcagagacagagaaagctggcaagactgggaattccatgccacaccctgccactgggaagacggtggccaaccttctttctgggaagtctcccaggaagtcagcagagccctcagcaaatactacgttggtctcagaaactgaggaggagggcagcgtcccggcctttggagctgctgccaagcctgggatggtgtcagcgggccaggccgacagctccagcgaggacacctccagctccagtgatgagacagacgtggaggtaaaggcctctgaaaaaattctccaggtcagagctgcctcagcccctgccaaggggacccctgggaaaggggctaccccagcaccccctgggaaggcaggggctgtagcctcccagaccaaggcagggaagccagaggaggactcagagagcagcagcgaggagtcatctgacagtgaggaggagacgccagctgccaaggccctgcttcaggcgaaggcctcaggaaaaacctctcaggtcggagctgcctcagcccctgccaaggagtcccccaggaaaggagctgccccagcgccccctgggaagacagggcctgcagttgccaaggcccaggcggggaagcgggaggaggactcgcagagcagcagcgaggaatcggacagtgaggaggaggcgcctgctcaggcgaagccttcagggaaggccccccaggtcagagccgcctcggcccctgccaaggagtcccccaggaaaggggctgccccagcacctcctaggaaaacagggcctgcagccgcccaggtccaggtggggaagcaggaggaggactcaagaagcagcagcgaggagtcagacagtgacagagaggcactggcagccatgaatgcagctcaggtgaagcccttggggaaaagcccccaggtgaaacctgcctctaccatgggcatggggcccttggggaaaggcgccggcccagtgccacccgggaaggtggggcctgcaaccccctcagcccaggtggggaagtgggaggaggactcagagagcagtagtgaggagtcatcagacagcagtgatggagaggtgcccacagctgtggccccggctcaggaaaagtccttggggaacatcctccaggccaaacccacctccagtcctgccaaggggccccctcagaaggcagggcctgtagccgtccaggtcaaggctgaaaagcccatggacaactcggagagcagcgaggagtcatcggacagtgcggacagtgaggaggcaccagcagccatgactgcagctcaggcaaaaccagctctgaaaattcctcagaccaaggcctgcccaaagaaaaccaataccactgcatctgccaaggtcgcccctgtgcgagtgggcacccaagccccccggaaagcaggaactgcgacttctccagcaggctcatccccagctgtggctgggggcacccagagaccagcagaggattcttcaagcagtgaggaatcagatagtgaggaagagaagacaggtcttgcagtaaccgtgggacaggcaaagtctgtggggaaaggcctccaggtgaaagcagcctcagtgcctgtcaaggggtccttggggcaagggactgctccagtactccctgggaagacggggcctacagtcacccaggtgaaagctgaaaagcaggaagactctgagagcagtgaggaggaatcagacagtgaggaagcagctgcatctccagcacaggtgaaaacctcagtaaagaaaacccaggccaaagccaacccagctgccgccagagcaccttcagcaaaagggacaatttcagcccctggaaaagttgtcactgcagctgctcaagccaagcagaggtctccatccaaggtgaagccaccagtgagaaacccccagaacagtaccgtcttggcgaggggcccagcatctgtgccatctgtggggaaggccgtggctacagcagctcaggcccagacagggccagaggaggactcagggagcagtgaggaggagtcagacagtgaggaggaggcggagacgctggctcaggtgaagccttcagggaagacccaccagatcagagctgccttggctcctgccaaggagtcccccaggaaaggggctgccccaacacctcctgggaagacagggccttcggctgcccaggcagggaagcaggatgactcagggagcagcagcgaggaatcagacagtgatggggaggcaccggcagctgtgacctctgcccaggtgattaaaccccctctgatttttgtcgaccctaatcgtagtccagctggcccagctgctacacccgcacaagcccaggctgcaagcaccccgaggaaggcccgagcctcggagagcacagccaggagctcctcctccgagagcgaggatgaggacgtgatccccgctacacagtgcttgactcctggcatcagaaccaatgtggtgaccatgcccactgcccacccaagaatagcccccaaagccagcatggctggggccagcagcagcaaggagtccagtcggatatcagatggcaagaaacaggagggaccagccactcaggtgtcaaagaagaacccagcttccctcccactgacccaggctgccctgaaggtcctcgcccagaaagccagtgaggctcagcctcctgttgccaggacccagccttcaagtggggttgacagtgctgtgggaacactccctgcaacaagtccccagagcacctccgtccaggccaaagggaccaacaagctcagaaaacctaagcttcctgaggtccagcaggccaccaaagcccctgagagctcagatgacagtgaggacagcagcgacagttcttcagggagtgaggaagatggtgaagggccccagggggccaagtcagcccacacgctggtaggtcccaccccctccaggacagagaccctggtggaggagaccgcagcagagtccagcgaggatgatgtggtggcgccatcccagtctctcctctcaggttatatgacccctggactaaccccagccaattcccaggcctcaaaagccactcccaagctagactccagcccctcagtttcctctactctggccgccaaagatgacccagatggcaagcaggaggcaaagccccaacaggcagcaggcatgttgtcccctaaaacaggtggaaaagaggctgcttcaggcaccacacctcagaagtcccggaagcccaagaaaggggctgggaacccccaagcctcaaccctggcgctgcaaagcaacatcacccagtgcctcctgggccaaccctggcccctgaatgaggcccaggtgcaggcctcagtggtgaaggtcctgactgagctgctggaacaggaaagaaagaaggtggtggacaccaccaaggagagcagcaggaagggctgggagagccgcaagcggaagctatcgggagaccagccagctgccaggacccccaggagcaagaagaagaagaagctgggggccggggaaggtggggaggcctctgtttccccagaaaagacctccacgacttccaaggggaaagcaaagagagacaaagcaagtggtgatgtcaaggagaagaaagggaaggggtctcttggctcccaaggggccaaggacgagccagaagaggagcttcagaaggggatggggacggttgaaggtggagatcaaagcaacccaaagagcaagaaggagaagaagaaatccgacaagagaaaaaaagacaaagaaaaaaaagaaaagaagaagaaagcaaaaaaggcctcaaccaaagattctgagtcaccgtcccagaagaaaaagaagaaaaagaagaagacagcagagcagactgtatgacgagcaccagcaccaggcacagggatttcctagccgagcagtggccatccccatgcctctgacctccaccgacctctgcccaccatgggttggaactaaactgttaccttccctcgctccacagaagaagacagccagcttcaggggtccctgtgctggccaagccagtgagcctgcggggaggctggtccaaggagaaagtggaccagctcccatgacctcaccccactcccccaacacaggacgcttcatatagatgtgtacagtatatgtatttttttaagtgacctcctctccttccacagaccccacatgcccaaaggcctcgggacttcccaccaccttgctccacagatccagctaggcctgacctgtgcctcatcccgtgccgctcggtctctggctgatcccgaggctttgtcttcctctcgtcagttcttttggttgtgttttttgttttttttttaataactcaaaaaaaaaataaaagacttggaggaagggt

SEQ ID NO: 32470 - DNA, 5206 bp, Homo sapiens
gaaagaggagccggaagtgtggcgcgcgaggtctaagggcgcgagggaagtggcgggcggggactaaggcggggcgtgcaggtagccggccggccgggggtcgcgggtatggccgaggccaggaagcggcgggagctacttcccctgatctaccaccatctgctgcgggctggctatgtgcgtgcggcgcgggaagtgaaggagcagagcggccagaagtgtttcctggctcagcccgtaacccttctggacatctatacacactggcaacaaacctcagagcttggtcggaagcggaaggcagaggaagatgcggcactgcaagctaagaaaacccgtgtgtcagaccccatcagcacctcggagagctcggaagaggaggaagaagcagaagccgaaaccgccaaagccaccccaagactagcatctaccaactcctcagtcctgggggcggacttgccatcaagcatgaaagaaaaagccaaggcagagacagagaaagctggcaagactgggaattccatgccacaccctgccactgggaagacggtggccaaccttctttctgggaagtctcccaggaagtcagcagagccctcagcaaatactacgttggtctcagaaactgaggaggagggcagcgtcccggcctttggagctgctgccaagcctgggatggtgtcagcgggccaggccgacagctccagcgaggacacctccagctccagtgatgagacagacgtggaggggaaaccctcagtaaaaccagcccaggtcaaagcctcatcagtttctactaaggagtctccagcaagaaaggcggccccagcccctgggaaggtgggggatgtgacaccccaggtcaaaggaggggccctgcccccagccaagagggccaagaagccagaagaggagtcagagagtagtgaggagggatctgaaagtgaggaggaggcccctgcagggacacgaagccaggtaaaggcctctgaaaaaattctccaggtcagagctgcctcagcccctgccaaggggacccctgggaaaggggctaccccagcaccccctgggaaggcaggggctgtagcctcccagaccaaggcagggaagccagaggaggactcagagagcagcagcgaggagtcatctgacagtgaggaggagacgccagctgccaaggccctgcttcaggcgaaggcctcaggaaaaacctctcaggtcggagctgcctcagcccctgccaaggagtcccccaggaaaggagctgccccagcgccccctgggaagacagggcctgcagttgccaaggcccaggcggggaagcgggaggaggactcgcagagcagcagcgaggaatcggacagtgaggaggaggcgcctgctcaggcgaagccttcagggaaggccccccaggtcagagccgcctcggcccctgccaaggagtcccccaggaaaggggctgccccagcacctcctaggaaaacagggcctgcagccgcccaggtccaggtggggaagcaggaggaggactcaagaagcagcagcgaggagtcagacagtgacagagaggcactggcagccatgaatgcagctcaggtgaagcccttggggaaaagcccccaggtgaaacctgcctctaccatgggcatggggcccttggggaaaggcgccggcccagtgccacccgggaaggtggggcctgcaaccccctcagcccaggtggggaagtgggaggaggactcagagagcagtagtgaggagtcatcagacagcagtgatggagaggtgcccacagctgtggccccggctcaggaaaagtccttggggaacatcctccaggccaaacccacctccagtcctgccaaggggccccctcagaaggcagggcctgtagccgtccaggtcaaggctgaaaagcccatggacaactcggagagcagcgaggagtcatcggacagtgcggacagtgaggaggcaccagcagccatgactgcagctcaggcaaaaccagctctgaaaattcctcagaccaaggcctgcccaaagaaaaccaataccactgcatctgccaaggtcgcccctgtgcgagtgggcacccaagccccccggaaagcaggaactgcgacttctccagcaggctcatccccagctgtggctgggggcacccagagaccagcagaggattcttcaagcagtgaggaatcagatagtgaggaagagaagacaggtcttgcagtaaccgtgggacaggcaaagtctgtggggaaaggcctccaggtgaaagcagcctcagtgcctgtcaaggggtccttggggcaagggactgctccagtactccctgggaagacggggcctacagtcacccaggtgaaagctgaaaagcaggaagactctgagagcagtgaggaggaatcagacagtgaggaagcagctgcatctccagcacaggtgaaaacctcagtaaagaaaacccaggccaaagccaacccagctgccgccagagcaccttcagcaaaagggacaatttcagcccctggaaaagttgtcactgcagctgctcaagccaagcagaggtctccatccaaggtgaagccaccagtgagaaacccccagaacagtaccgtcttggcgaggggcccagcatctgtgccatctgtggggaaggccgtggctacagcagctcaggcccagacagggccagaggaggactcagggagcagtgaggaggagtcagacagtgaggaggaggcggagacgctggctcaggtgaagccttcagggaagacccaccagatcagagctgccttggctcctgccaaggagtcccccaggaaaggggctgccccaacacctcctgggaagacagggccttcggctgcccaggcagggaagcaggatgactcagggagcagcagcgaggaatcagacagtgatggggaggcaccggcagctgtgacctctgcccagaaggacagtaactccaaacctgccagaagcaagaccctggccccagcacccccagagaggaacacggaggggtcctcggagagcagtgaggaagagctgccactgacccaggtgattaaaccccctctgatttttgtcgaccctaatcgtagtccagctggcccagctgctacacccgcacaagcccaggctgcaagcaccccgaggaaggcccgagcctcggagagcacagccaggagctcctcctccgagagcgaggatgaggacgtgatccccgctacacagtgcttgactcctggcatcagaaccaatgtggtgaccatgcccactgcccacccaagaatagcccccaaagccagcatggctggggccagcagcagcaaggagtccagtcggatatcagatggcaagaaacaggagggaccagccactcaggtgtcaaagaagaacccagcttccctcccactgacccaggctgccctgaaggtcctcgcccagaaagccagtgaggctcagcctcctgttgccaggacccagccttcaagtggggttgacagtgctgtgggaacactccctgcaacaagtccccagagcacctccgtccaggccaaagggaccaacaagctcagaaaacctaagcttcctgaggtccagcaggccaccaaagcccctgagagctcagatgacagtgaggacagcagcgacagttcttcagggagtgaggaagatggtgaagggccccagggggccaagtcagcccacacgctgggtcccaccccctccaggacagagaccctggtggaggagaccgcagcagagtccagcgaggatgatgtggtggcgccatcccagtctctcctctcaggttatatgacccctggactaaccccagccaattcccaggcctcaaaagccactcccaagctagactccagcccctcagtttcctctactctggccgccaaagatgacccagatggcaagcaggaggcaaagccccaacaggcagcaggcatgttgtcccctaaaacaggtggaaaagaggctgcttcaggcaccacacctcagaagtcccggaagcccaagaaaggggctgggaacccccaagcctcaaccctggcgctgcaaagcaacatcacccagtgcctcctgggccaaccctggcccctgaatgaggcccaggtgcaggcctcagtggtgaaggtcctgactgagctgctggaacaggaaagaaagaaggtggtggacaccaccaaggagagcagcaggaagggctgggagagccgcaagcggaagctatcgggagaccagccagctgccaggacccccaggagcaagaagaagaagaagctgggggccggggaaggtggggaggcctctgtttccccagaaaagacctccacgacttccaaggggaaagcaaagagagacaaagcaagtggtgatgtcaaggagaagaaagggaaggggtctcttggctcccaaggggccaaggacgagccagaagaggagcttcagaaggggatggggacggttgaaggtggagatcaaagcaacccaaagagcaagaaggagaagaagaaatccgacaagagaaaaaaagacaaagaaaaaaaagaaaagaagaagaaagcaaaaaaggcctcaaccaaagattctgagtcaccgtcccagaagaaaaagaagaaaaagaagaagacagcagagcagactgtatgacgagcaccagcaccaggcacagggatttcctagccgagcagtggccatccccatgcctctgacctccaccgacctctgcccaccatgggttggaactaaactgttaccttccctcgctccacagaagaagacagccagcttcaggggtccctgtgctggccaagccagtgagcctgcggggaggctggtccaaggagaaagtggaccagctcccatgacctcaccccactcccccaacacaggacgcttcatatagatgtgtacagtatatgtatttttttaagtgacctcctctccttccacagaccccacatgcccaaaggcctcgggacttcccaccaccttgctccacagatccagctaggcctgacctgtgcctcatcccgtgccgctcggtctctggctgatcccgaggctttgtcttcctctcgtcagttcttttggttgtgttttttgttttttttttaataactcaaaaaaaaaataaaagacttggaggaagggtgcaagctcccagtgc

SEQ ID NO: 32471 - DNA, 4467 bp, Homo sapiens
atggccgaggccaggaagcggcgggagctacttcccctgatctaccaccatctgctgcgggctggctatgtgcgtgcggcgcgggaagtgaaggagcagagcggccagaagtgtttcctggctcagcccgtaacccttctggacatctatacacactggcaacaaacctcagagcttggtcggaagcggaaggcagaggaagatgcggcactgcaagctaagaaaacccgtgtgtcagaccccatcagcacctcggagagctcggaagaggaggaagaagcagaagccgaaaccgccaaagccaccccaagactagcatctaccaactcctcagtcctgggggcggacttgccatcaagcatgaaagaaaaagccaaggcagagacagagaaagctggcaagactgggaattccatgccacaccctgccactgggaagacggtggccaaccttctttctgggaagtctcccaggaagtcagcagagccctcagcaaatactacgttggtctcagaaactgaggaggagggcagcgtcccggcctttggagctgctgccaagcctgggatggtgtcagcgggccaggccgacagctccagcgaggacacctccagctccagtgatgagacagacgtggaggggaaaccctcagtaaaaccagcccaggtcaaagcctcatcagtttctactaaggagtctccagcaagaaaggcggccccagcccctgggaaggtgggggatgtgacaccccaggtcaaaggaggggccctgcccccagccaagagggccaagaagccagaagaggagtcagagagtagtgaggagggatctgaaagtgaggaggaggcccctgcagggacacgaagccaggtaaaggcctctgaaaaaattctccaggtcagagctgcctcagcccctgccaaggggacccctgggaaaggggctaccccagcaccccctgggaaggcaggggctgtagcctcccagaccaaggcagggaagccagaggaggactcagagagcagcagcgaggagtcatctgacagtgaggaggagacgccagctgccaaggccctgcttcaggcgaaggcctcaggaaaaacctctcaggtcggagctgcctcagcccctgccaaggagtcccccaggaaaggagctgccccagcgccccctgggaagacagggcctgcagttgccaaggcccaggcggggaagcgggaggaggactcgcagagcagcagcgaggaatcggacagtgaggaggaggcgcctgctcaggcgaagccttcagggaaggccccccaggtcagagccgcctcggcccctgccaaggagtcccccaggaaaggggctgccccagcacctcctaggaaaacagggcctgcagccgcccaggtccaggtggggaagcaggaggaggactcaagaagcagcagcgaggagtcagacagtgacagagaggcactggcagccatgaatgcagctcaggtgaagcccttggggaaaagcccccaggtgaaacctgcctctaccatgggcatggggcccttggggaaaggcgccggcccagtgccacccgggaaggtggggcctgcaaccccctcagcccaggtggggaagtgggaggaggactcagagagcagtagtgaggagtcatcagacagcagtgatggagaggtgcccacagctgtggccccggctcaggaaaagtccttggggaacatcctccaggccaaacccacctccagtcctgccaaggggccccctcagaaggcagggcctgtagccgtccaggtcaaggctgaaaagcccatggacaactcggagagcagcgaggagtcatcggacagtgcggacagtgaggaggcaccagcagccatgactgcagctcaggcaaaaccagctctgaaaattcctcagaccaaggcctgcccaaagaaaaccaataccactgcatctgccaaggtcgcccctgtgcgagtgggcacccaagccccccggaaagcaggaactgcgacttctccagcaggctcatccccagctgtggctgggggcacccagagaccagcagaggattcttcaagcagtgaggaatcagatagtgaggaagagaagacaggtcttgcagtaaccgtgggacaggcaaagtctgtggggaaaggcctccaggtgaaagcagcctcagtgcctgtcaaggggtccttggggcaagggactgctccagtactccctgggaagacggggcctacagtcacccaggtgaaagctgaaaagcaggaagactctgagagcagtgaggaggaatcagacagtgaggaagcagctgcatctccagcacaggtgaaaacctcagtaaagaaaacccaggccaaagccaacccagctgccgccagagcaccttcagcaaaagggacaatttcagcccctggaaaagttgtcactgcagctgctcaagccaagcagaggtctccatccaaggtgaagccaccagtgagaaacccccagaacagtaccgtcttggcgaggggcccagcatctgtgccatctgtggggaaggccgtggctacagcagctcaggcccagacagggccagaggaggactcagggagcagtgaggaggagtcagacagtgaggaggaggcggagacgctggctcaggtgaagccttcagggaagacccaccagatcagagctgccttggctcctgccaaggagtcccccaggaaaggggctgccccaacacctcctgggaagacagggccttcggctgcccaggcagggaagcaggatgactcagggagcagcagcgaggaatcagacagtgatggggaggcaccggcagctgtgacctctgcccaggtgattaaaccccctctgatttttgtcgaccctaatcgtagtccagctggcccagctgctacacccgcacaagcccaggctgcaagcaccccgaggaaggcccgagcctcggagagcacagccaggagctcctcctccgagagcgaggatgaggacgtgatccccgctacacagtgcttgactcctggcatcagaaccaatgtggtgaccatgcccactgcccacccaagaatagcccccaaagccagcatggctggggccagcagcagcaaggagtccagtcggatatcagatggcaagaaacaggagggaccagccactcaggtgtcaaagaagaacccagcttccctcccactgacccaggctgccctgaaggtcctcgcccagaaagccagtgaggctcagcctcctgttgccaggacccagccttcaagtggggttgacagtgctgtgggaacactccctgcaacaagtccccagagcacctccgtccaggccaaagggaccaacaagctcagaaaacctaagcttcctgaggtccagcaggccaccaaagcccctgagagctcagatgacagtgaggacagcagcgacagttcttcagggagtgaggaagatggtgaagggccccagggggccaagtcagcccacacgctgggtcccaccccctccaggacagagaccctggtggaggagaccgcagcagagtccagcgaggatgatgtggtggcgccatcccagtctctcctctcaggttatatgacccctggactaaccccagccaattcccaggcctcaaaagccactcccaagctagactccagcccctcagtttcctctactctggccgccaaagatgacccagatggcaagcaggaggcaaagccccaacaggcagcaggcatgttgtcccctaaaacaggtggaaaagaggctgcttcaggcaccacacctcagaagtcccggaagcccaagaaaggggctgggaacccccaagcctcaaccctggcgctgcaaagcaacatcacccagtgcctcctgggccaaccctggcccctgaatgaggcccaggtgcaggcctcagtggtgaaggtcctgactgagctgctggaacaggaaagaaagaaggtggtggacaccaccaaggagagcagcaggaagggctgggagagccgcaagcggaagctatcgggagaccagccagctgccaggacccccaggagcaagaagaagaagaagctgggggccggggaaggtggggaggcctctgtttccccagaaaagacctccacgacttccaaggggaaagcaaagagagacaaagcaagtggtgatgtcaaggagaagaaagggaaggggtctcttggctcccaaggggccaaggacgagccagaagaggagcttcagaaggggatggggacggttgaaggtggagatcaaagcaacccaaagagcaagaaggagaagaagaaatccgacaagagaaaaaaagacaaagaaaaaaaagaaaagaagaagaaagcaaaaaaggcctcaaccaaagattctgagtcaccgtcccagaagaaaaagaagaaaaagaagaagacagcagagcagactgtatga

SEQ ID NO: 32472 - DNA, 551 bp, Homo sapiens
taacgctctttaagcaaacagagcctgccctataaaatccggggctcgggcggcctctcatccctgactcggggtcgcctttggagcagagaggaggcaatggccaccatggagaacaaggtgatctgcgccctggtcctggtgtccatgctggccctcggcaccctggccgaggcccagacagagacgtgtacagtggccccccgtgaaagacagaattgtggttttcctggtgtcacgccctcccagtgtgcaaataagggctgctgtttcgacgacaccgttcgtggggtcccctggtgcttctatcctaataccatcgacgtccctccagaagaggagtgtgaattttagacacttctgcagggatctgcctgcatcctgacgcggtgccgtccccagcacggtgattagtcccagagctcggctgccacctccaccggacacctcagacacgcttctgcagctgtgcctcggctcacaacacagattgactgctctgactttgactactcaaaattggcctaaaaattaaaagagatcgatattaa

SEQ ID NO: 32473 - DNA, 737 bp, Homo sapiens
acagctgcctcttgcctcctcttcgcctccacggtggaagggctggggccacggggcagagaagaaaggttatctctgcttgttggacaaacagaggggagattataaaacatacccggcagtggacaccatgcattctgcaagccaccctggggtgcagctgagctagacatgggacggcgagacgcccagctcctggcagcgctcctcgtcctggggctatgtgccctggcggggagtgagaaaccctccccctgccagtgctccaggctgagcccccataacaggacgaactgcggcttccctggaatcaccagtgaccagtgttttgacaatggatgctgtttcgactccagtgtcactggggtcccctggtgtttccaccccctcccaaagcaagagtcggatcagtgcgtcatggaggtctcagaccgaagaaactgtggctacccgggcatcagccccgaggaatgcgcctctcggaagtgctgcttctccaacttcatctttgaagtgccctggtgcttcttcccgaagtctgtggaagactgccattactaagagaggctggttccagaggatgcatctggctcaccgggtgttccgaaaccaaagaagaaacttcgccttatcagcttcatacttcatgaaatcctgggttttcttaaccatcttttcctcattttcaatggtttaacatataatttctttaaataaaacccttaaaatctgctaaa

SEQ ID NO: 32474 - DNA, 1851 bp, Homo sapiens
ccgaaggtgcctgggcttgctcattcagtcacagtcacagccaccatgccagggaggacctgggagctgtgcctgctactgctgctggggctgggactggggtcccaggaggccctacccccaccctgtgagagtgagatttactgccacggggagctcctaaaccaagttcaaatggccaagctctaccaggatgacaagcagtttgtggacatgccactgtctatagctccagaacaagtcctgcagaccttcactgagctgtccagggaccacaatcacagcatccccagggagcagctgcaggcgtttgtccacgaacacttccaggccaaggggcaggagctgcagccctggacccctgcagactggaaagacagcccccagttcctgcagaagatttcagatgccaaactgcgtgcctgggcagggcagctgcatcagctctggaagaagctggggaagaagatgaagccagaggttctcagccaccctgagcggttctctctcatctactcagaacatcccttcattgtgcctggcggtcgctttgttgagttctactactgggactcctactgggtcatggagggtctgctcctctcagagatggctgagacggtgaagggcatgctgcagaacttcttggacctggtgaaaacctatgggcatgtccccaatggtgggcgcgtgtactacctgcagcggagccagcccccactcttgaccctcatgatggattgctacttgactcacaccaatgacaccgcctttctacaggaaaacattgaaacactagccttggaattggacttttggaccaagaacaggactgtctctgtgagcttggagggaaagaactacctcctgaatcgctattatgtcccttatgggggacccaggcctgagtcctacagcaaagatgtggagttggctgacaccttgccagaaggagaccgggaggctctgtgggctgagctcaaggctggggctgagtctggctgggacttctcttcacgctggctcattggaggcccaaaccccaactcgcttagcggcatccgaacaagcaaactggtgcctgttgacctgaatgccttcctatgccaagcagaggagctgatgagcaacttctattccaggctggggaacgactcccaggccacgaagtacagaatcctgcggtcgcagcgcttggccgccctgaacacagtcctgtgggatgagcagaccggagcctggttcgattacgaccttgagaagaagaagaaaaaccgggagttttacccatccaacctcactccactctgggccgggtgtttctctgaccctggcgtggcggacaaggctctgaaatacctggaggacaaccggatcctgacttaccagtatgggatcccgacctctctccagaagacaggccagcagtgggatttccccaatgcctgggcccccctgcaggacctggtcatcagaggcctggccaaggcacctttacgtcgggcccaggaagtggctttccagctggctcagaattggatccgaaccaattttgatgtctactcgcagaagtcagccatgtatgagaagtatgacgtcagcaacggtggacagcccggtgggggaggagaatatgaagttcaggagggatttggctggacgaatggcgtggtcctgatgctgctggaccgctatggtgaccggctgacctcagggcccaagctgcctttcctggagccccactgcctggccacccttctgcccagcctcctgctaagcctcctgccatggtgacagccctcctctcctcacctggccccagctcctgccccattaaacctctgcaccagt

SEQ ID NO: 32475 - DNA, 1701 bp, Homo sapiens
ccgaaggtgcctgggcttgctcattcagtcacagtcacagccaccatgccagggaggacctgggagctgtgcctgctactgctgctggggctgggactggggtcccaggaggccctacccccaccctgtgagagtgagatttactgccacggggagctcctaaaccaagttcaaatggccaagctctaccaggatgacaagcagtttgtggacatgccactgtctatagctccagaacaagtcctgcagaccttcactgagctgtccagggaccacaatcacagcatccccagggagcagctgcaggcgtttgtccacgaacacttccaggccaaggggcaggagctgcagccctggacccctgcagactggaaagacagcccccagttcctgcagaagatttcagatgccaaactgcgtgcctgggcagggcagctgcatcagctctggaagaagctggggaagaagatgaagccagaggttctcagccaccctgagcggttctctctcatctactcagaacatcccttcattgtgcctggcggtcgctttgttgagttctactactgctatgggcatgtccccaatggtgggcgcgtgtactacctgcagcggagccagcccccactcttgaccctcatgatggattgctacttgactcacaccaatgacaccgcctttctacaggaaaacattgaaacactagccttggaattggacttttggaccaagaacaggactgtctctgtgagcttggagggaaagaactacctcctgaatcgctattatgtcccttatgggggacccaggcctgagtcctacagcaaagatgtggagttggctgacaccttgccagaaggagaccgggaggctctgtgggctgagctcaaggctggggctgagtctggctgggacttctcttcacgctggctcattggaggcccaaaccccaactcgcttagcggcatccgaacaagcaaactggtgcctgttgacctgaatgccttcctatgccaagcagaggagctgatgagcaacttctattccaggctggggaacgactcccaggccacgaagtacagaatcctgcggtcgcagcgcttggccgccctgaacacagtcctgtgggatgagcagaccggagcctggttcgattacgaccttgagaagaagaagaaaaaccgggagttttacccatccaacctcactccactctgggccgggtgtttctctgaccctggcgtggcggacaaggctctgaaatacctggaggacaaccggatcctgacttaccagtatgggatcccgacctctctccagaagacaggccagcagtgggatttccccaatgcctgggcccccctgcaggacctggtcatcagaggcctggccaaggcacctttacgtcgggcccaggaagtggctttccagctggctcagaattggatccgaaccaattttgatgtctactcgcagaagtcagccatgtatgagaagtatgacgtcagcaacggtggacagcccggtgggggaggagaatatgaagttcaggagggatttggctggacgaatggcgtggtcctgatgctgctggaccgctatggtgaccggctgacctcagggcccaagctgcctttcctggagccccactgcctggccacccttctgcccagcctcctgctaagcctcctgccatggtga

SEQ ID NO: 32476 - DNA, 1720 bp, Homo sapiens
attcagtcacagtcacagccaccatgccagggaggacctgggagctgtgcctgctactgctgctggggctgggactggggtcccaggaggccctacccccaccctgtgagagaacaagtcctgcagaccttcactgagctgtccagggaccacaatcacagcatccccagggagcagctgcaggcgtttgtccacgaacacttccaggccaaggggcaggagctgcagccctggacccctgcagactggaaagacagcccccagttcctgcagaagatttcagatgccaaactgcgtgcctgggcagggcagctgcatcagctctggaagaagctggggaagaaggtatcagcgtcctgggcctgcccaaggcctgaccaagggaactgaagagaggaatgtgcctggggcccacagtgtcttcggagcacagatcagggactcctactgggtcatggagggtctgctcctctcagagatggctgagacggtgaagggcatgctgcagaacttcttggacctggtgaaaacctatgggcatgtccccaatggtgggcgcgtgtactacctgcagcggagccagcccccactcttgaccctcatgatggattgctacttgactcacaccaatgacaccgcctttctacaggaaaacattgaaacactagccttggaattggacttttggaccaagaacaggactgtctctgtgagcttggagggaaagaactacctcctgaatcgctattatgtcccttatgggggacccaggcctgagtcctacagcaaagatgtggagttggctgacaccttgccagaaggagaccgggaggctctgtgggctgagctcaaggctggggctgagtctggctgggacttctcttcacgctggctcattggaggcccaaaccccaactcgcttagcggcatccgaacaagcaaactggtgcctgttgacctgaatgccttcctatgccaagcagaggagctgatgagcaacttctattccaggctggggaacgactcccaggccacgaagtacagaatcctgcggtcgcagcgcttggccgccctgaacacagtcctgtgggatgagcagaccggagcctggttcgattacgaccttgagaagaagaagaaaaaccgggagttttacccatccaacctcactccactctgggccgggtgtttctctgaccctggcgtggcggacaaggctctgaaatacctggaggacaaccggatcctgacttaccagtatgggatcccgacctctctccagaagacaggccagcagtgggatttccccaatgcctgggcccccctgcaggacctggtcatcagaggcctggccaaggcacctttacgtcgggcccaggaagtggctttccagctggctcagaattggatccgaaccaattttgatgtctactcgcagaagtcagccatgtatgagaagtatgacgtcagcaacggtggacagcccggtgggggaggagaatatgaagttcaggagggatttggctggacgaatggcgtggtcctgatgctgctggaccgctatggtgaccggctgacctcagggcccaagctgcctttcctggagccccactgcctggccacccttctgcccagcctcctgctaagcctcctgccatggtgacagccctcctctcctcacctggccccagctcctgccccattaaacctctgcaccagt

SEQ ID NO: 32477 - DNA, 1717 bp, Homo sapiens
gtgcctgggcttgctcattcagtcacagtcacagccaccatgccagggaggacctgggagctgtgcctgctactgctgctggggctgggactggggtcccaggaggccctacccccaccctgtgagagtgagatttactgccacggggagctcctaaaccaagttcaaatggccaagctctaccaggatgacaagcagtttgtggacatgccactgtctatagctccagaacaagtcctgcagaccttcactgagctgtccagggaccacaatcacagcatccccagggagcagctgcaggcgtttgtccacgaacacttccaggccaaggggcaggagctgcagccctggacccctgcagactggaaagacagcccccagttcctgcagaagatttcagatgccaaactgcgtgcctgggcagggcagctgcatcagctctggaagaagctggggaagaagatgaagccagaggttctcagccaccctgagcggttctctctcatctactcagaacatcccttcattgtgcctggcggtcgctttgttgagttctactactgctatgggcatgtccccaatggtgggcgcgtgtactacctgcagcggagccagcccccactcttgaccctcatgatggattgctacttgactcacaccaatgacaccgcctttctacaggaaaacattgaaacactagccttggaattggacttttggaccaagaacaggactgtctctgtgagcttggagggaaagaactacctcctgaatcgctattatgtcccttatgggggacccaggcctgagtcctacagcaaagatgtggagttggctgacaccttgccagaaggagaccgggaggctctgtgggctgagctcaaggctggggctgagtctggctgggacttctcttcacgctggctcattggaggcccaaaccccaactcgcttagcggcatccgaacaagcaaactggtgcctgttgacctgaatgccttcctatgccaagcagaggagctgatgagcaacttctattccaggctggggaacgactcccaggccacgaagtacagaatcctgcggtcgcagcgcttggccgccctgaacacagtcctgtgggatgagcagaccggagcctggttcgattacgaccttgagaagaagaagaaaaaccgggagttttacccatccaacctcactccactctgggccgggtgtttctctgaccctggcgtggcggacaaggctctgaaatacctggaggacaaccggatcctgacttaccagtatgggatcccgacctctctccagaagacaggccagcagtgggatttccccaatgcctgggcccccctgcaggacctggtcatcagaggcctggccaaggcacctttacgtcgggcccaggaagtggctttccagctggctcagaattggatccgaaccaattttgatgtctactcgcagaagtcagccatgtatgagaagtatgacgtcagcaacggtggacagcccggtgggggaggagaatatgaagttcaggagggatttggctggacgaatggcgtggtcctgatgctgctggaccgctatggtgaccggctgacctcagggcccaagctgcctttcctggagccccactgcctggggccacccttctgcccagcctcctgctaagcctcctgccatggtgacagccctcctctcctcacct

SEQ ID NO: 32478 - DNA, 2770 bp, Homo sapiens
gccgaaggtgcctgggcttgctcattcagtcacagtcacagccaccatgccagggaggacctgggagctgtgcctgctactgctgctggggctgggactggggtcccaggaggccctacccccaccctgtgagagtgagatttactgccacggggagctcctaaaccaagttcaaatggccaagctctaccaggatgacaagcagtttgtggacatgccactgtctatagctccagaacaagtcctgcagaccttcactgagctgtccagggaccacaatcacagcatccccagggagcagctgcaggcgtttgtccacgaacacttccaggccaaggggcaggagctgcagccctggacccctgcagactggaaagacagcccccagttcctgcagaagatttcagatgccaaactgcgtgcctgggcagggcagctgcatcagctctggaagaagctggggaagaagatgaagccagaggttctcagccaccctgagcggttctctctcatctactcagaacatcccttcattgtgcctggcggtcgctttgttgagttctactactgggactcctactgggtcatggagggtctgctcctctcagagatggctgagacggtgaagggcatgctgcagaacttcttggacctggtgaaaacctatgggcatgtccccaatggtgggcgcgtgtactacctgcagcggagccagcccccactcttgaccctcatgatggattgctacttgactcacaccaatgacaccgcctttctacaggaaaacattgaaacactagccttggaattggacttttggaccaagaacaggactgtctctgtgagcttggagggaaagaactacctcctgaatcgctattatgtcccttatgggggacccaggcctgagtcctacagcaaagatgtggagttggctgacaccttgccagaaggagaccgggaggctctgtgggctgagctcaaggctggggctgagtctggctgggacttctcttcacgctggctcattggaggcccaaaccccaactcgcttagcggcatccgaacaagcaaactggtgcctgttgacctgaatgccttcctatgccaagcagaggagctgatgagcaacttctattccaggctggggaacgactcccaggccacgaagtacagaatcctgcggtcgcagcgcttggccgccctgaacacagtcctgtgggatgagcagaccggagcctggttcgattacgaccttgagaagaagaagaaaaaccgggagttttacccatccaacctcactccactctgggccgggtgtttctctgaccctggcgtggcggacaaggctctgaaatacctggaggacaaccggatcctgacttaccagtatgggatcccgacctctctccagaagacaggccagcagtgggatttccccaatgcctgggcccccctgcaggacctggtcatcagaggcctggccaaggcacctttacgtcgggcccaggaagtggctttccagctggctcagaattggatccgaaccaattttgatgtctactcgcagaagtcagccatgtatgagaagtatgacgtcagcaacggtggacagcccggtgggggaggagaatatgaagttcaggagggatttggctggacgaatggcgtggtcctgatgctgctggaccgctatggtgaccggctgacctcagggcccaagctgcctttcctggagccccactgcctggggccacccttctgcccagcctcctgctaagcctcctgccatggtgacagccctcctctcctcacctggccccagctcctgccccattaaacctctgcaccagttcctgccttcccctgcctcttcatgccctcctacctcccagcctgtcctcagagcgaagtggagggcagggtcacgacctggaggtcatgggtaggggcctagctccctcctggaaccttgaatagggtggaaatcctgctctggagggaagacctatccccaagtgcctcagcgccaagccccacaccggccttccactcacttccgtagtccaaaggctttattgttctgctgaaatgcttacaaatactgaaaacccccagcctgggcccaggcaaccaagggctcaatgctgggaaggagagcaggggaggtgggcttagtgttaaggcgtgaagggcgaggccagacagctggaggcctggtcctccactctccatttccatcacccttcggaggctgaaggaagggcggcggcaccacagggcccttcccctctgctgcatcatctcctgctcaggctttctctctaggagcattggaggaatcctctttccctgtcggaaactcaacactgtacagaactccaaccataacccttctagcttcctctcccaactgcatcgctcctcctctgttccatagatcccccggcttcatcccttctggctctaagcaaggcaccagtggaagggagagggctggactggggggctggcagcctgtgcatcagggctgaagacacaggcagggggaaggaaaaaggtattcagtcccttccccccagcatgagatgcccaggggcctgggctggagagatgatggcacgtaccctcagatggcccacagctgaagcagtgggctgggccacagagctgcagcaattagtatgtaaccatggcaatgaagcagtcactatggtaaccatggtgatgagtctgcaactaggggatggagctgggacctcaaggttga

SEQ ID NO: 32479 - DNA, 735 bp, Homo sapiens
gcagaggagaggcaaagttcaacaggacaacaaagaagcagcagaaacagccaggaaaacgaagagcccccaggttttgacacagaaccctccaccagagttctcaaatccccaaatactctgcaaagtgcaacttgacgggaacttttcaactgacttttacttttgacgaccaccatgactgagatcactgctgaaggaaatgcatctacaaccacaactgtgatagacagcaaaaatggatctgtgcccaaatcccccggaaaagtgctgaagaggacagtcacagaagacatagtgacgacgttcagctcccctgcagcctggcttctggtcattgccctgataatcacgtggtcagctgttgccatcgttatgtttgatttagtggattacaaaaacttttcagcaagctctattgccaagattggctcagatcctttaaaactggtacgtgatgctatggaggaaaccacggactggatctatggcttcttttctttgttatctgacatcatctcatctgaagatgaagaagatgatgatggtgacgaagatactgataaaggagaaatagatgagcctcccttgagaaaaaaagaaatacacaaagataagactgaaaaacaagagaaacctgaaaggaaaatacaaactaaagattggtcagccaattcttcaacaatcagaacattgaagctcactcagttgaaacctatttatatttgtacttag

SEQ ID NO: 32480 - DNA, 961 bp, Homo sapiens
acttttacttttgacgaccaccatgactgagatcactgctgaaggaaatgcatctacaaccacaactgtgatagacagcaaaaatggatctgtgcccaaatcccccggaaaagtgctgaagaggacagtcacagaagacatagtgacgacgttcagctcccctgcagcctggcttctggtcattgccctgataatcacgtggtcagctgttgccatcgttatgtttgatttagtggattacaaaaacttttcagcaagctctattgccaagattggctcagatcctttaaaactggtacgtgatgctatggaggaaaccacggactggatctatggcttcttttctttgttatctgacatcatctcatctgaagatgaagaagatgatgatggtgacgaagatactgataaaggagaaatagatgagcctcccttgagaaaaaaagaaatacacaaagataagactgaaaaacaagagaaacctgaaaggaaaatacaaactaaagttacacacaaagaaaaagaaaaaggaaaagaaaaagtaagagaaaaagaaaaacctgaaaagaaagcaactcacaaggaaaaaattgagaaaaaagaaaaaccagaaacaaagacactggcgaaagaacagaagaaagctaagactgcagaaaagagtgaagaaaagactaaaaaggaagtgaaaggtggaaaacaggagaaagtgaagcaaacagctgcaaaagtaaaagaagtacagaaaacaccatcaaaacccaaagaaaaggaggacaaagagaaagcagctgtgtcaaagcatgaacagaaagggttcccaggtcctgggatcagaaactccagctattactgccagtacatcaaagggcaaatcaatgcatggaatgacctgaggactagcctccttcccattccctacctctcctgtgggaaaatgtgctccaatttcaacaactaa

SEQ ID NO: 32481 - DNA, 4746 bp, Homo sapiens
ctctagagtgccaaaaaagaaaaaaaaaagtgctgaagagtcctagggagatgaggctatttttgtttgaagctgatacttctagctgagccacaagtgctgcttggaaagggcttaggttgtttccagggggagaactctgcagaggagaggcaaagttcaacaggacaacaaagaagcagcagaaacagccaggaaaacgaagagcccccaggttttgacacagaaccctccaccagagttctcaaatccccaaatactctgcaaagtgcaacttgacgggaacttttcaactgacttttacttttgacgaccaccatgactgagatcactgctgaaggaaatgcatctacaaccacaactgtgatagacagcaaaaatggatctgtgcccaaatcccccggaaaagtgctgaagaggacagtcacagaagacatagtgacgacgttcagctcccctgcagcctggcttctggtcattgccctgataatcacgtggtcagctgttgccatcgttatgtttgatttagtggattacaaaaacttttcagcaagctctattgccaagattggctcagatcctttaaaactggtacgtgatgctatggaggaaaccacggactggatctatggcttcttttctttgttatctgacatcatctcatctgaagatgaagaagatgatgatggtgacgaagatactgataaaggagaaatagatgagcctcccttgagaaaaaaagaaatacacaaagataagactgaaaaacaagagaaacctgaaaggaaaatacaaactaaagttacacacaaagaaaaagaaaaaggaaaagaaaaagtaagagaaaaagaaaaacctgaaaagaaagcaactcacaaggaaaaaattgagaaaaaagaaaaaccagaaacaaagacactggcgaaagaacagaagaaagctaagactgcagaaaagagtgaagaaaagactaaaaaggaagtgaaaggtggaaaacaggagaaagtgaagcaaacagctgcaaaagtaaaagaagtacagaaaacaccatcaaaacccaaagaaaaggaggacaaagagaaagcagctgtgtcaaagcatgaacagaaagatcagtatgcattctgtcgatatatgattgacatatttgtccatggggatttaaaaccaggacaaagcccagccattccacctcccttaccgacagaacaagcttccagacccactccggcatcacctgcccttgaagaaaaagaaggggaaaagaagaaggctgagaagaaagttacttctgaaacaaaaaagaaagaaaaagaagatatcaaaaagaaaagtgagaaggaaactgccattgatgtggaaaaaaaagagccgggaaaagcttctgaaaccaaacaagggactgtaaaaattgcagcacaagcagcagctaagaaggatgaaaagaaggaagattccaagaaaacaaaaaaacctgcagaagtagaacaacccaagggaaaaaaacaggaaaagaaagaaaaacatgtggaaccagcaaagtcaccaaagaaagaacactcagttccaagtgacaaacaagtaaaagcaaaaactgaacgagccaaagaggagattggtgcggtttcaattaaaaaagctgtacctggaaagaaggaagagaaaacaaccaagacagtggagcaagaaattagaaaagaaaaatctgggaagacttcttcaattctgaaagataaagaacctattaaagggaaagaagagaaagttccagcttccctaaaggaaaaagaacctgaaactaaaaaagatgaaaagatgtccaaagcaggcaaagaagtcaagcctaaacctccacaactacaaggaaaaaaggaagagaagccagagccccaaattaaaaaagaagcaaaaccagctatatctgaaaaagtgcaaatacacaaacaagacatagtgaaaccagaaaagactgtttctcatggtaaaccagaagaaaaagttctcaagcaggtaaaagctgtcacaatagaaaaaacagccaagcccaaaccaacaaaaaaagctgaacatcgagaaagagaacctccatctataaaaacagacaaaccaaaaccaactccaaaaggaacatcagaagtcacagaatcaggaaagaagaaaactgaaatatctgaaaaagaaagtaaagaaaaagcagacatgaagcatcttagagaagaaaaagtctcaacaagaaaagaaagtcttcaattacacaatgtgacaaaagaagatgttgaagatgtaccagcttcaaagaaagctaaagaaggaactgaagatgtgtctcccacaaagcagaaaagtcccatcagtttcttccagtgtgtctacttggatgggtacaatggctatggatttcagtttcctttcactcctgcagaccgccctggagagagctctggtcaagcaaattctccaggacagaagcaacaaggacagtaaacacacatgtatgacccttacaagtgctttaagattttaaaaatgtgatgttttgtccacagtagttcaggcaattaagaatatgcaacccagagaatttctgtgaaaacattttgctctttggcctggtgtggacggaaagggtggccaaatggattgagtgatgagcagacatgtttaagggtctaagtctcaagaatctgttatgtgtgtttgctgcggtgggagggggtgcttgtatttatcttatttccagtcactataaggttgtacacaaactaatttaaagtttacttaataatggtatctttaaaataattgacacaattgcaaaatgaattcctggcttcagttagctattatttttttaatgacaacatagactgtgctctaagtttaaaagatggggaagcttatataaaagtgacccttttgcatcatatgggtatctaaacttaatttacccaataagttgatgcttaatgattttattttatttttgtctatttctattttagttgtggctttgctctaagaatgggtaatagttgtactacagactgctataaatttcttgtgatactcttttagagctcaaaatatctctgagctttagacatggtaaggtggagagtaaatgcttgataaatctttaagatatgtcttgaatgataattaggacattcagtccagtggaaatacaccattcaattagtcaggtctggtgaatcgtttgtttaaaatattagcaaatgagatgtggaattctgaaatttctccagactgtgtcttaataaaaatgtcacctgggtgaaattttagatcaatcactaaatttgggtgacaaatataaaaatattttcatttcactttaatacattctttctgtgaagtaaaatgtttttctttctcataatggcaaaatatgaatgccatcaaagtttaaggaattcattttagccttaaatgccttcgtgagatgtcttacttgtattttaggtaactggtcatcagtgccaatgacatggataacaatttttaatctactcgacagtgcatccctgggaatgactgttatgtttttgtcatattcctggtaatataaatactcgtgttctttactacattgtttttatcaactctaaaagtcatgcctctgtgacctttatcatgtttacaattgcaactgaacttatgacaaattaactcaggaaataaattgagttatcctttctagcattgtaattaccatcagcaaggcctgagatagccagagccaatactagccaagtgatttattttcaaggattgccactaactacggttctttaggaccaagatataaaacagtcactaaaaatcattaggctaggtatcagtaatacattcattactaataatgcatttttggagacttttgtgaaagaagttggtctctgccaaaagctggtggaccacattcacaccacgaaagccagtgtcacatgaaccagattaatgactctctttatggggtatgtgggacatcctggaagtgtataatttcaggaatgaccagacaataccatcttgcaaagccccttcaggtgacaatctaaacttgtgggtaggagagtgcataaagtttattgctcaactgctcctccagcctgctgaatttactgagtaaagaaatagcaaatatgatagatgttttagatttcatagaacagaatggtttgtccattaattctttcattcaatgactgtttattgaatacctactcttttagggcgctgtgttaggtgctgtattgtacaagaaaaatataataaattagattcccagcgctattctgacatagtgaatgaccttgaaaaatttactaaacatactatgtttgtttctccatgagtaaaatagggatatagggacaaacagtctaatatctcatagaaataccatggagacaaataaaatattttaatataaatatgatattaaagtaaatttctgaagtaatacttttgggtatggcactagtttttcctctgactattttactgtttctttcactctcaatataaaaactatttgataagataaaacgatatattttattgtaattagaatttagacaaatcagctataatgtaaaaatgttaataataattacgttttatctgattaaagttacaatgatcatagcactttaaaaatattatctgaactgtcatttgtttatatattaccgtctaataaaatagttatagatcttccaa

SEQ ID NO: 32482 - DNA, 766 bp, Homo sapiens
aaatacacaaagataagactgaaaaacaagagaaacctgaaaggaaaatacaaactaaagaagttggacacagctcttgagtacggattgactaagcgaaccatgactgaactggctctgtgtttctatctgctgaaggttaaacagaaactcaactggttccacaccatttgggtccctgctgtttttttcttgcagactgtgctattaatttaataacagtgctgctggagtggcggtagtaatgtagatggcaccatttgcattttggacctggctatattagaattctgatgtcaaagaccgagcagtgggctgtagagtaggtttattaaactagcaagtcttccataattaagacagtgaatttggctgaagtctaaaataaatttctcaaagactgagctggagattatcaacctgaatatatttcttgagtagaccaaatatgttttgtaaaagtaactatttcttaagaaagtgaaagtagagcttcagttgctccacactgagctggaaatcagagagagcttatgttttccacagtttttctgtgtgaatatgaacaaaagatttcactttattgcttagtttcccgtctgtaaatggggtagactaatgcctgctctttattctcaaatagttcagtgaaaataaatgttttgctttacaactgctcttgtatgtggataaatactgttttctgtatgccatgttccatgtcagttatggttgtatgtgatggatagttaggaatttaagttat

SEQ ID NO: 32483 - DNA, 766 bp, Homo sapiens
ttacacacaaagaaaaagaaaaaggaaaagaaaaagtaagagaaaaagaaaaacctgaaaagaaagcaactcacaaggaaaaaattgagaaaaaagaaaaaccagaaacaaagacactggcgaaagaacagaagaaagctaagactgcagaaaagagtgaagaaaagactaaaaaggaagtgaaaggtggaaaacaggagaaagtgaagcaaacagctgcaaaagtaaaagaagtacagaaaacaccatcaaaacccaaagaaaaggaggacaaagagaaagcagctgtgtcaaagcatgaacagaaagggttcccaggtcctgggatcagaaactccagctattactgccagtacatcaaagggcaaatcaatgcatggaatgacctgaggactagcctccttcccattccctacctctcctgtgggaaaatgtgctccaatttcaacaactaaaatacatctaaatttttggaactttatgagttttggcctgcccttatttaggtattaatgaaaaagattatatttttatatcttcttcaataactatatttattttttaaagacctaacagaatttcataataaaatggattcctctaaaaatgctgttactactctaaaaagaacgagatttacaaaaatccttagaggtgtatctgtttagtaacaagctttgttatttcatatgtttgatatgcataatttggagcaattaagaatgtaacatgttgcttaaattcaataaactctcttggtcctaaa

SEQ ID NO: 32484 - DNA, 4459 bp, Homo sapiens
atcgtggaaatctatcctcaaggaaatgcatctacaaccacaactgtgatagacagcaaaaatggatctgtgcccaaatcccccggaaaagtgctgaagaggacagtcacagaagacatagtgacgacgttcagctcccctgcagcctggcttctggtcattgccctgataatcacgtggtcagctgttgccatcgttatgtttgatttagtggattacaaaaacttttcagcaagctctattgccaagattggctcagatcctttaaaactggtacgtgatgctatggaggaaaccacggactggatctatggcttcttttctttgttatctgacatcatctcatctgaagatgaagaagatgatgatggtgacgaagatactgataaaggagaaatagatgagcctcccttgagaaaaaaagaaatacacaaagataagactgaaaaacaagagaaacctgaaaggaaaatacaaactaaagttacacacaaagaaaaagaaaaaggaaaagaaaaagtaagagaaaaagaaaaacctgaaaagaaagcaactcacaaggaaaaaattgagaaaaaagaaaaaccagaaacaaagacactggcgaaagaacagaagaaagctaagactgcagaaaagagtgaagaaaagactaaaaaggaagtgaaaggtggaaaacaggagaaagtgaagcaaacagctgcaaaagtaaaagaagtacagaaaacaccatcaaaacccaaagaaaaggaggacaaagagaaagcagctgtgtcaaagcatgaacagaaagatcagtatgcattctgtcgatatatgattgacatatttgtccatggggatttaaaaccaggacaaagcccagccattccacctcccttaccgacagaacaagcttccagacccactccggcatcacctgcccttgaagaaaaagaaggggaaaagaagaaggctgagaagaaagttacttctgaaacaaaaaagaaagaaaaagaagatatcaaaaagaaaagtgagaaggaaactgccattgatgtggaaaaaaaagtccaagagccgggaaaagcttctgaaaccaaacaagggactgtaaaaattgcagcacaagcagcagctaagaaggatgaaaagaaggaagattccaagaaaacaaaaaaacctgcagaagtagaacaacccaagggaaaaaaacaggaaaagaaagaaaaacatgtggaaccagcaaagtcaccaaagaaagaacactcagttccaagtgacaaacaagtaaaagcaaaaactgaacgagccaaagaggagattggtgcggtttcaattaaaaaagctgtacctggaaagaaggaagagaaaacaaccaagacagtggagcaagaaattagaaaagaaaaatctgggaagacttcttcaattctgaaagataaagaacctattaaagggaaagaagagaaagttccagcttccctaaaggaaaaagaacctgaaactaaaaaagatgaaaagatgtccaaagcaggcaaagaagtcaagcctaaacctccacaactacaaggaaaaaaggaagagaagccagagccccaaattaaaaaagaagcaaaaccagctatatctgaaaaagtgcaaatacacaaacaagacatagtgaaaccagaaaagactgtttctcatggtaaaccagaagaaaaagttctcaagcaggtaaaagctgtcacaatagaaaaaacagccaagcccaaaccaacaaaaaaagctgaacatcgagaaagagaacctccatctataaaaacagacaaaccaaaaccaactccaaaaggaacatcagaagtcacagaatcaggaaagaagaaaactgaaatatctgaaaaagaaagtaaagaaaaagcagacatgaagcatcttagagaagaaaaagtctcaacaagaaaagaaagtcttcaattacacaatgtgacaaaagcagaggaagtggacagtactctagaagatgttgaagatgtaccagcttcaaagaaagctaaagaaggaactgaagatgtgtctcccacaaagcagaaaagtcccatcagtttcttccagtgtgtctacttggatgggtacaatggctatggatttcagtttcctttcactcctgcagaccgccctggagagagctctggtcaagcaaattctccaggacagaagcaacaaggacagtaaacacacatgtatgacccttacaagtgctttaagattttaaaaatgtgatgttttgtccacagtagttcaggcaattaagaatatgcaacccagagaatttctgtgaaaacattttgctctttggcctggtgtggacggaaagggtggccaaatggattgagtgatgagcagacatgtttaagggtctaagtctcaagaatctgttatgtgtgtttgctgcggtgggagggggtgcttgtatttatcttatttccagtcactataaggttgtacacaaactaatttaaagtttacttaataatggtatctttaaaataattgacacaattgcaaaatgaattcctggcttcagttagctattatttttttaatgacaacatagactgtgctctaagtttaaaagatggggaagcttatataaaagtgacccttttgcatcatatgggtatctaaacttaatttacccaataagttgatgcttaatgattttattttatttttgtctatttctattttagttgtggctttgctctaagaatgggtaatagttgtactacagactgctataaatttcttgtgatactcttttagagctcaaaatatctctgagctttagacatggtaaggtggagagtaaatgcttgataaatctttaagatatgtcttgaatgataattaggacattcagtccagtggaaatacaccattcaattagtcaggtctggtgaatcgtttgtttaaaatattagcaaatgagatgtggaattctgaaatttctccagactgtgtcttaataaaaatgtcacctgggtgaaattttagatcaatcactaaatttgggtgacaaatataaaaatattttcatttcactttaatacattctttctgtgaagtaaaatgtttttctttctcataatggcaaaatatgaatgccatcaaagtttaaggaattcattttagccttaaatgccttcgtgagatgtcttacttgtattttaggtaactggtcatcagtgccaatgacatggataacaatttttaatctactcgacagtgcatccctgggaatgactgttatgtttttgtcatattcctggtaatataaatactcgtgttctttactacattgtttttatcaactctaaaagtcatgcctctgtgacctttatcatgtttacaattgcaactgaacttatgacaaattaactcaggaaataaattgagttatcctttctagcattgtaattaccatcagcaaggcctgagatagccagagccaatactagccaagtgatttattttcaaggattgccactaactacggttctttaggaccaagatataaaacagtcactaaaaatcattaggctaggtatcagtaatacattcattactaataatgcatttttggagacttttgtgaaagaagttggtctctgccaaaagctggtggaccacattcacaccacgaaagccagtgtcacatgaaccagattaatgactctctttatggggtatgtgggacatcctggaagtgtataatttcaggaatgaccagacaataccatcttgcaaagccccttcaggtgacaatctaaacttgtgggtaggagagtgcataaagtttattgctcaactgctcctccagcctgctgaatttactgagtaaagaaatagcaaatatgatagatgttttagatttcatagaacagaatggtttgtccattaattctttcattcaatgactgtttattgaatacctactcttttagggcgctgtgttaggtgctgtattgtacaagaaaaatataataaattagattcccagcgctattctgacatagtgaatgaccttgaaaaatttactaaacatactatgtttgtttctccatgagtaaaatagggatatagggacaaacagtctaatatctcatagaaataccatggagacaaataaaatattttaatataaatatgatattaaagtaaatttctgaagtaatacttttgggtatggcactagtttttcctctgactattttactgtttctttcactctcaatataaaaactatttgataagataaaacgatatattttattgtaattagaatttagacaaatcagctataatgtaaaaatgttaataataattacgttttatctgattaaagttacaatgatcatagcactttaaaaatattatctgaactgtcatttgtttatatattaccgtctaataaaatagttatagatcttccaag

SEQ ID NO: 32485 - DNA, 4475 bp, Homo sapiens
acttttacttttgacgaccaccatgactgagatcactgctgaaggaaatgcatctacaaccacaactgtgatagacagcaaaaatggatctgtgcccaaatcccccggaaaagtgctgaagaggacagtcacagaagacatagtgacgacgttcagctcccctgcagcctggcttctggtcattgccctgataatcacgtggtcagctgttgccatcgttatgtttgatttagtggattacaaaaacttttcagcaagctctattgccaagattggctcagatcctttaaaactggtacgtgatgctatggaggaaaccacggactggatctatggcttcttttctttgttatctgacatcatctcatctgaagatgaagaagatgatgatggtgacgaagatactgataaaggagaaatagatgagcctcccttgagaaaaaaagaaatacacaaagataagactgaaaaacaagagaaacctgaaaggaaaatacaaactaaagttacacacaaagaaaaagaaaaaggaaaagaaaaagtaagagaaaaagaaaaacctgaaaagaaagcaactcacaaggaaaaaattgagaaaaaagaaaaaccagaaacaaagacactggcgaaagaacagaagaaagctaagactgcagaaaagagtgaagaaaagactaaaaaggaagtgaaaggtggaaaacaggagaaagtgaagcaaacagctgcaaaagtaaaagaagtacagaaaacaccatcaaaacccaaagaaaaggaggacaaagagaaagcagctgtgtcaaagcatgaacagaaagatcagtatgcattctgtcgatatatgattgacatatttgtccatggggatttaaaaccaggacaaagcccagccattccacctcccttaccgacagaacaagcttccagacccactccggcatcacctgcccttgaagaaaaagaaggggaaaagaagaaggctgagaagaaagttacttctgaaacaaaaaagaaagaaaaagaagatatcaaaaagaaaagtgagaaggaaactgccattgatgtggaaaaaaaagagccgggaaaagcttctgaaaccaaacaagggactgtaaaaattgcagcacaagcagcagctaagaaggatgaaaagaaggaagattccaagaaaacaaaaaaacctgcagaagtagaacaacccaagggaaaaaaacaggaaaagaaagaaaaacatgtggaaccagcaaagtcaccaaagaaagaacactcagttccaagtgacaaacaagtaaaagcaaaaactgaacgagccaaagaggagattggtgcggtttcaattaaaaaagctgtacctggaaagaaggaagagaaaacaaccaagacagtggagcaagaaattagaaaagaaaaatctgggaagacttcttcaattctgaaagataaagaacctattaaagggaaagaagagaaagttccagcttccctaaaggaaaaagaacctgaaactaaaaaagatgaaaagatgtccaaagcaggcaaagaagtcaagcctaaacctccacaactacaaggaaaaaaggaagagaagccagagccccaaattaaaaaagaagcaaaaccagctatatctgaaaaagtgcaaatacacaaacaagacatagtgaaaccagaaaagactgtttctcatggtaaaccagaagaaaaagttctcaagcaggtaaaagctgtcacaatagaaaaaacagccaagcccaaaccaacaaaaaaagctgaacatcgagaaagagaacctccatctataaaaacagacaaaccaaaaccaactccaaaaggaacatcagaagtcacagaatcaggaaagaagaaaactgaaatatctgaaaaagaaagtaaagaaaaagcagacatgaagcatcttagagaagaaaaagtctcaacaagaaaagaaagtcttcaattacacaatgtgacaaaagcagaaaaacctgcaagagtatcaaaagatgttgaagatgtaccagcttcaaagaaagctaaagaaggaactgaagatgtgtctcccacaaagcagaaaagtcccatcagtttcttccagtgtgtctacttggatgggtacaatggctatggatttcagtttcctttcactcctgcagaccgccctggagagagctctggtcaagcaaattctccaggacagaagcaacaaggacagtaaacacacatgtatgacccttacaagtgctttaagattttaaaaatgtgatgttttgtccacagtagttcaggcaattaagaatatgcaacccagagaatttctgtgaaaacattttgctctttggcctggtgtggacggaaagggtggccaaatggattgagtgatgagcagacatgtttaagggtctaagtctcaagaatctgttatgtgtgtttgctgcggtgggagggggtgcttgtatttatcttatttccagtcactataaggttgtacacaaactaatttaaagtttacttaataatggtatctttaaaataattgacacaattgcaaaatgaattcctggcttcagttagctattatttttttaatgacaacatagactgtgctctaagtttaaaagatggggaagcttatataaaagtgacccttttgcatcatatgggtatctaaacttaatttacccaataagttgatgcttaatgattttattttatttttgtctatttctattttagttgtggctttgctctaagaatgggtaatagttgtactacagactgctataaatttcttgtgatactcttttagagctcaaaatatctctgagctttagacatggtaaggtggagagtaaatgcttgataaatctttaagatatgtcttgaatgataattaggacattcagtccagtggaaatacaccattcaattagtcaggtctggtgaatcgtttgtttaaaatattagcaaatgagatgtggaattctgaaatttctccagactgtgtcttaataaaaatgtcacctgggtgaaattttagatcaatcactaaatttgggtgacaaatataaaaatattttcatttcactttaatacattctttctgtgaagtaaaatgtttttctttctcataatggcaaaatatgaatgccatcaaagtttaaggaattcattttagccttaaatgccttcgtgagatgtcttacttgtattttaggtaactggtcatcagtgccaatgacatggataacaatttttaatctactcgacagtgcatccctgggaatgactgttatgtttttgtcatattcctggtaatataaatactcgtgttctttactacattgtttttatcaactctaaaagtcatgcctctgtgacctttatcatgtttacaattgcaactgaacttatgacaaattaactcaggaaataaattgagttatcctttctagcattgtaattaccatcagcaaggcctgagatagccagagccaatactagccaagtgatttattttcaaggattgccactaactacggttctttaggaccaagatataaaacagtcactaaaaatcattaggctaggtatcagtaatacattcattactaataatgcatttttggagacttttgtgaaagaagttggtctctgccaaaagctggtggaccacattcacaccacgaaagccagtgtcacatgaaccagattaatgactctctttatggggtatgtgggacatcctggaagtgtataatttcaggaatgaccagacaataccatcttgcaaagccccttcaggtgacaatctaaacttgtgggtaggagagtgcataaagtttattgctcaactgctcctccagcctgctgaatttactgagtaaagaaatagcaaatatgatagatgttttagatttcatagaacagaatggtttgtccattaattctttcattcaatgactgtttattgaatacctactcttttagggcgctgtgttaggtgctgtattgtacaagaaaaatataataaattagattcccagcgctattctgacatagtgaatgaccttgaaaaatttactaaacatactatgtttgtttctccatgagtaaaatagggatatagggacaaacagtctaatatctcatagaaataccatggagacaaataaaatattttaatataaatatgatattaaagtaaatttctgaagtaatacttttgggtatggcactagtttttcctctgactattttactgtttctttcactctcaatataaaaactatttgataagataaaacgatatattttattgtaattagaatttagacaaatcagctataatgtaaaaatgttaataataattacgttttatctgattaaagttacaatgatcatagcactttaaaaatattatctgaactgtcatttgtttatatattaccgtctaataaaatagttatagatcttccaag

SEQ ID NO: 32486 - DNA, 776 bp, Homo sapiens
aaatacacaaagataagactgaaaaacaagagaaacctgaaaggaaaatacaaactaaagattggtcagccaattcttcaacaatcagaacattgaagctcactcagttgaaacctatttatatttgtacttaggaaactaatgtctccttactgttctctttccttttttcggttcttaattcctttgatcacagaagttggacacagctcttgagtacggattgactaagcgaaccatgactgaactggctctgtgtttctatctgctgaaggttaaacagaaactcaactggttccacaccatttgggtccctgctgtttttttcttgcagactgtgctattaatttaataacagtgctgctggagtggcggtagtaatgtagatggcaccatttgcattttggacctggctatattagaattctgatgtcaaagaccgagcagtgggctgtagagtaggtttattaaactagcaagtcttccataattaagacagtgaatttggctgaagtctaaaataaatttctcaaagactgagctggagattatcaacctgaatatatttcttgagtagaccaaatatgttttgtaaaagtaactatttcttaagaaagtgaaagtagagcttcagttgctccacactgagctggaaatcagagagagcttatgttttccacagtttttctgtgtgaatatgaacaaaagatttcactttattgcttagtttcccgtctgtaaatggggtagactaatgcctgctctttattctcaaa

SEQ ID NO: 32487 - DNA, 1035 bp, Homo sapiens
atcgtggaaatctatcctcaaggaaatgcatctacaaccacaactgtgatagacagcaaaaatggatctgtgcccaaatcccccggaaaagtgctgaagaggacagtcacagaagacatagtgacgacgttcagctcccctgcagcctggcttctggtcattgccctgataatcacgtggtcagctgttgccatcgttatgtttgatttagtggattacaaaaacttttcagcaagctctattgccaagattggctcagatcctttaaaactggtacgtgatgctatggaggaaaccacggactggatctatggcttcttttctttgttatctgacatcatctcatctgaagatgaagaagatgatgatggtgacgaagatactgataaaggagaaatagatgagcctcccttgagaaaaaaagaaatacacaaagataagactgaaaaacaagagaaacctgaaaggaaaatacaaactaaagttacacacaaagaaaaagaaaaaggaaaagaaaaagtaagagaaaaagaaaaacctgaaaagaaagcaactcacaaggaaaaaattgagaaaaaagaaaaaccagaaacaaagacactggcgaaagaacagaagaaagctaagactgcagaaaagagtgaagaaaagactaaaaaggaagtgaaaggtggaaaacaggagaaagtgaagcaaacagctgcaaaagtaaaagaagtacagaaaacaccatcaaaacccaaagaaaaggaggacaaagagaaagcagctgtgtcaaagcatgaacagaaagatcagtatgcattctgtcgatatatgattgacatatttgtccatggggatttaaaaccaggacaaagcccagccattccacctcccttaccgacagaacaagcttccagacccactccggcatcacctgcccttgaagaaaaagaaggggaaaagaagaaggctgagaagaaagttacttctgaaacaaaaaagaaagaaaaagaagatatcaaaaagaaaaaaaaaaaaaaaaaaaaaaaa

SEQ ID NO: 32488 - DNA, 1292 bp, Homo sapiens
gtttccagggggagaactctgcagaggagaggcaaagttcaacaggacaacaaagaagcagcagaaacagccaggaaaacgaagagcccccaggttttgacacagaaccctccaccagagttctcaaatccccaaatactctgcaaagtgcaacttgacgggaacttttcaactgacttttacttttgacgaccaccatgactgagatcactgctgaaggaaatgcatctacaaccacaactgtgatagacagcaaaaatggatctgtgcccaaatcccccggaaaagtgctgaagaggacagtcacagaagacatagtgacgacgttcagctcccctgcagcctggcttctggtcattgccctgataatcacgtggtcagctgttgccatcgttatgtttgatttagtggattacaaaaacttttcagcaagctctattgccaagattggctcagatcctttaaaactggtacgtgatgctatggaggaaaccacggactggatctatggcttcttttctttgttatctgacatcatctcatctgaagatgaagaagatgatgatggtgacgaagatactgataaaggagaaatagatgagcctcccttgagaaaaaaagaaatacacaaagataagactgaaaaacaagagaaacctgaaaggaaaatacaaactaaagaagttggacacagctcttgagtacggattgactaagcgaaccatgactgaactggctctgtgtttctatctgctgaaggttaaacagaaactcaactggttccacaccatttgggtccctgctgtttttttcttgcagactgtgctattaatttaataacagtgctgctggagtggcggtagtaatgtagatggcaccatttgcattttggacctggctatattagaattctgatgtcaaagaccgagcagtgggctgtagagtaggtttattaaactagcaagtcttccataattaagacagtgaatttggctgaagtctaaaataaatttctcaaagactgagctggagattatcaacctgaatatatttcttgagtagaccaaatatgttttgtaaaagtaactatttcttaagaaagtgaaagtagagcttcagttgctccacactgagctggaaatcagagagagcttatgttttccacagtttttctgtgtgaatatgaacaaaagatttcactttattgcttagtttcccgtctgtaaatggggtagactaatgcctgctctttattctcaaatagttcagtgaaaataaatgttttgctttac

SEQ ID NO: 32489 - DNA, 1006 bp, Homo sapiens
acttttacttttgacgaccaccatgactgagatcactgctgaaggaaatgcatctacaaccacaactgtgatagacagcaaaaatggatctgtgcccaaatcccccggaaaagtgctgaagaggacagtcacagaagacatagtgacgacgttcagctcccctgcagcctggcttctggtcattgccctgataatcacgtggtcagctgttgccatcgttatgtttgatttagtggattacaaaaacttttcagcaagctctattgccaagattggctcagatcctttaaaactggtacgtgatgctatggaggaaaccacggactggatctatggcttcttttctttgttatctgacatcatctcatctgaagatgaagaagatgatgatggtgacgaagatactgataaaggagaaatagatgagcctcccttgagaaaaaaagaaatacacaaagataagactgaaaaacaagagaaacctgaaaggaaaatacaaactaaagttacacacaaagaaaaagaaaaaggaaaagaaaaagtaagagaaaaagaaaaacctgaaaagaaagcaactcacaaggaaaaaattgagaaaaaagaaaaaccagaaacaaagacactggcgaaagaacagaagaaagctaagactgcagaaaagagtgaagaaaagactaaaaaggaagtgaaaggtggaaaacaggagaaagtgaagcaaacagctgcaaaagtaaaagaagtacagaaaacaccatcaaaacccaaagaaaaggaggacaaagagaaagcagctgtgtcaaagcatgaacagaaagatcagtatgcattctgtcgatatatgattgacatatttgtccatggggatttaaaaccaggacaaagcccagccattccacctcccttaccgacagaacaagcttccagacccactccggcatcacctgcccttgaaggtgacaaagcatcaaaagaaaaaaaaaggaaaatgaaaagaatgagtgagaaa

SEQ ID NO: 32490 - DNA, 1658 bp, Homo sapiens
gaaacagccaggaaaacgaagagcccccaggttttgacacagaaccctccaccagagttctcaaatccccaaatactctgcaaagtgcaacttgacgggaacttttcaactgacttttacttttgacgaccaccatgactgagatcactgctgaaggaaatgcatctacaaccacaactgtgatagacagcaaaaatggatctgtgcccaaatcccccggaaaagtgctgaagaggacagtcacagaagacatagtgacgacgttcagctcccctgcagcctggcttctggtcattgccctgataatcacgtggtcagctgttgccatcgttatgtttgatttagtggattacaaaaacttttcagcaagctctattgccaagattggctcagatcctttaaaactggtacgtgatgctatggaggaaaccacggactggatctatggcttcttttctttgttatctgacatcatctcatctgaagatgaagaagatgatgatggtgacgaagatactgataaaggagaaatagatgagcctcccttgagaaaaaaagaaatacacaaagataagactgaaaaacaagagaaacctgaaaggaaaatacaaactaaagttacacacaaagaaaaagaaaaaggaaaagaaaaagtaagagaaaaagaaaaacctgaaaagaaagcaactcacaaggaaaaaattgagaaaaaagaaaaaccagaaacaaagacactggcgaaagaacagaagaaagctaagactgcagaaaagagtgaagaaaagactaaaaaggaagtgaaaggtggaaaacaggagaaagtgaagcaaacagctgcaaaagtaaaagaagtacagaaaacaccatcaaaacccaaagaaaaggaggacaaagagaaagcagctgtgtcaaagcatgaacagaaaggacaaagcccagccattccacctcccttaccgacagaacaagcttccagacccactccggcatcacctgcccttgaaggcaagtacttttttttttcttaaagatctctattgtagataaaatagaatgtagaggaacagcaacaacaaaaatagtcacaaagaaacagcaaaatccaatattttcttaaatacttttagtatgtctaaactatacttttcctaaaattgcaatttgcttcttttagaaaaccaaaaatgtccccttaagattctatattggtgaccctcagcttccagaaggatgcccactctagcactttgggaatcaagcaaaaaaatatagggacaaatagataaggctatgccttgcaactctgggagttttaccacaacttgatcaatttagtctctgaagaggctggtgccagatttgctgggtttgaatctgagctccaccttttcctagctttgtaaatttggaaagttatttaaattaactcttcatgagttttgccatctctaagatgatataagcagagcactgatctcctagcgttattgtgaggattgaaatatatatatacacacacactcacacacacacaaatactgttttatgtatatgtatagtttataagtactatatacaactggtggttaatactactaataattcttgaaaatatgatgtctcaagatcagctttgtaataaattttgctggaacgtt

SEQ ID NO: 32491 - DNA, 6900 bp, Homo sapiens
atgtctccacttctgagaagcatctgtgacatcactgaaattttcaatcagtatgtctctcatgattgtgatggagcagcattaactaagaaagacctgaagaacctccttgaaagggaatttggagctgtgcttcggagaccacatgaccctaagacggtagatctgatcctggaacttctggatcttgacagtaatgggcgtgtcgatttcaacgaattcctcctatttattttcaaagtggctcaagcttgttactatgctctcggccaggccacgggactggatgaggagaagcgagcccggtgtgacggaaaggagagcctgttacaagatcgcaggcaagaagaagaccaaaggagattcgagccccgggacagacaactggaagaagaacctgggcaacgacgcaggcagaagaggcaggaacaggagagggagctagctgagggagaggagcaaagtgagaaacaagagcgacttgaacagcgcgacaggcagcgccgcgacgaggagctgtggcggcaaaggcaagaatggcaagaacgggaagagcgccgtgcagaggaagagcagctgcagagttgcaaaggtcacgaaactgaggagtttccagacgaagagcaactgcgaaggcgggagctgctggagctgaggaggaagggccgcgaggagaaacagcagcaaaggcgagagcggcaagacagagtgttccaggaggaagaagagaaagagtggaggaagcgcgagacagtgctccggaaggaagaagagaagttgcaggaagaggagccgcagcggcaaagagagctccaggaggaagaagagcagctacggaagctggagcggcaagagctgaggagggagcgccaggaggaagagcagcagcagcaaaggctgaggcgcgagcagcaactaaggcgcaagcaggaggaggagaggcgcgagcagcaggaggagaggcgcgagcagcaggagaggcgcgagcagcaggaggagaggcgcgagcagcagctgaggcgcgagcaggaggagaggcgcgagcagcagctgaggcgcgagcaggaggaggagaggcgcgagcagcagctgaggcgcgagcaggaggaggagaggcgcgagcagcagctgaggcgcgagcagcagctgaggcgcgagcagcagctgaggcgcgagcagcagctgaggcgcgagcagcagctgaggcgcgagcagcagctgaggcgcgagcagcagctgaggcgcgagcagcagctgaggcgcgagcagcagctgaggcgcgagcaggaggaggagaggcacgagcagaagcacgagcaggagaggcgcgagcagcggctgaagcgcgagcaggaggagaggcgcgattggctgaagcgcgaggaggagacggagaggcacgagcaggagaggcgcaagcagcagctgaagcgcgaccaggaggaggagaggcgcgaacgttggctgaagctcgaggaggaggagaggcgcgagcagcaggagaggcgcgagcagcaactaaggcgggagcaagaggagaggcgcgagcagcggctgaagcgccaggaggaggaagagaggctccagcagcggttgaggagcgagcaacaactaagacgcgagcaggaggagaggcgcgagcagctgctgaagcgcgaggaggagaagaggctcgagcaggagaggcgagagcagcggctgaagcgcgagcaggaggagaggcgcgatcagctgctgaagcgcgaggaggagaggcgccagcagcggctgaagcgcgagcaggaagagaggctcgagcagcgactgaagcgcgaggaggtggagagactcgagcaggaggagaggcgcgagcagcggctgaagcgcgaggagccggaggaagagaggcgccagcagctgctgaagagcgaggagcaggaggagaggcgccagcagcaactaaggcgcgagcagcaggaaaggcgcgagcagcggctgaagcgcgaggaggaggaagagaggctcgagcagcggctgaagcgcgagcatgaggaagagaggcgcgagcaggagctagctgaggaggagcaggaacaggcccgggagcggattaagagccgcatcccgaagtggcagtggcagctagaaagcgaggccgacgcacggcaaagcaaagtctactcgaggccccgcaagcaggaagggcagaggcgccgccaagagcaggaggaaaagaggcggcgccgggagagtgagctgcaatggcaggaggaggaacgggctcaccggcagcagcaggaagaggagcagcgccgggacttcacatggcagtggcaggcggaggaaaagagcgagaggggccgtcagaggctgtcggccaggcccccattgcgggagcagcgggagaggcagctgagggccgaggagcgccagcagcgggaacaacggtttctcccggaggaggaggagaaggagcagcggcgccgccagcgacgcgagagggagaaagagctgcagttcctggaggaagaggagcagctccagcggcgggagcgtgcccaacagctccaggaggaggaggacggcctccaggaggatcaggagaggaggcgaagccaggagcagcgccgcgaccaaaaatggaggtggcaactagaagaagaaaggaagagacgccgccacacgctgtacgccaagccagccctacaagagcagctgaggaaggaacagcagctgctgcaggaggaggaggaggagctacagagagaggagcgcgagaagagaaggcgccaagaacaggagagacaataccgcgaggaagagcagctgcagcaggaggaagagcagctgctgagagaggaacgggagaaaagaagacgccaggagcgggaaaggcaatatcggaaggataagaagctgcagcagaaggaagagcagctgctgggagaggaaccggagaagagaaggcgccaggagcgggagaaaaaataccgcgaggaagaggagttgcagcaggaggaagagcagctgctgagagaggaacgggagaagagaaggcgccaggagtgggagaggcagtaccgcaaaaaagacgagctgcagcaggaagaagagcagctgctgagagaggaacgggagaaaagaagactccaggagcgggagaggcaatatcgggaggaagaggagctgcagcaggaggaagagcagctgctgggagaggaacgggagacgagaaggcgccaggagctggagaggcaatatcggaaggaagaggagctgcagcaggaggaagagcagctgctgagagaggaaccggagaagagaaggcgccaggagcgggagaggcaatgtcgggaggaagaggagctgcagcaggaggaagagcagctgctgagagaggaacgggagaagagaaggcgccaggagctggagaggcaatatcgggaggaagaggaggtgcagcaggaggaagagcagctgctgagagaggaaccggagaagagaaggcgccaggagctggagaggcaataccgcgaggaagaggagctgcagcaggaggaagagcagctgctgagagaggaacaggagaaaaggcgccaggagcgggagaggcagtatcgggaggaggaagagcttcagcgccagaaaaggaagcagcgataccgggatgaggatcagcgcagtgatctgaaatggcagtgggaaccagaaaaagaaaatgcagttcgtgataacaaggtttactgcaaaggcagagagaatgaacagttccggcagttggaagattcccagctgcgcgacagacaatcccagcaagatctgcagcacctgctgggtgaacagcaagagcgagatcgtgagcaagagaggaggcgctggcagcagcgcgacaggcatttcccagaggaagaacagctggagcgagaagagcaaaaggaagccaaaaggcgcgacaggaagtcccaagaggaaaagcagttgctgagagaggaaagagaagagaagagacgccgtcaagagacagacagaaaattccgcgaggaggaacagctgctccaggaaagggaggaacagccgctgcgccgccaagagcgtgacagaaaattccgcgaagaggaactgcgccatcaggaacaagggagaaaattcctcgaggaggaacagcggctgcgccgccaggaacgggagagaaaattccttaaggaggaacagcagctgcgctgccaggagcgcgagcaacagctgcgtcaggaccgcgacagaaaattccgcgaggaggaacagcagctgagccgccaagagcgtgacagaaaattccgtgaagaggaacagcaggtgcgccgccaggaacgagagagaaaattcctggaggaggaacagcagctgcgccaggagcgtcacagaaaattccgcgaagaggaacagctgctccaggaaagggaagaacagcagctgcaccgccaagagcgtgacagaaaattcctggaggaggaacaacagctgcgccgccaagagcgtgacagaaaattccgcgaacaggaactgcgcagtcaggaaccagagagaaaattcctcgaggaggaacagcagctgcaccgccagcaacggcagagaaaattcctccaggaggaacagcagctgcgccgccaggagcgcgggcaacagcggcgtcaggaccgtgacagaaaattccgcgaggaggaacagctgcgccaggagagggaggaacagcagctgagccgccaagagcgtgacagaaaattccgtttagaggaacagaaagtgcgccgccaggaacaagagagaaaattcatggaggacgaacagcagctgcgccgccaggagggccaacaacagctgcgccaggagcgcgacagaaaattccgcgaagacgaacagctgctccaggaaagggaagaacagcagctgcaccgccaagagcgtgacagaaaattcctcgaggaggaaccgcagctgcgccgccaggagcgcgaacaacagctgcgtcacgaccgcgacagaaaattccgtgaagaggaacagctgctccaggaaggggaggaacagcagctgcgccgccaagagcgtgacagaaaattccgcgaagaggaacagcagctccgccgtcaggaacgagagagaaaattcctccaggaggaacagcagctgcgccgccaggaactggagagaaaattccgtgaggaggaacagctgcgccaagaaacggagcaagagcagctgcgccgccaagaacgctacagaaaaatcctagaggaagagcagctccgtccggaaagggaagaacagcagctgcgccgccaggagcgcgacagaaaattccgcgaggaggaacagctccgccaggagagggaggaacagcagctgcgcagccaagagtctgacagaaaattccgcgaggaggaacagctacgccaggagagggaagaacagcagctgcgcccccaacagcgtgacggaaagtatcgctgggaagaagagcagctccaacttgaggaacaagagcagaggctgcggcaggagcgagaccggcagtaccgggcggaggagcagtttgccacgcaggagaagagtcgtcgtgaggaacaagaactatggcaagaagaggagcagaaacgtcgccaggaacgggaaaggaaattacgggaagaacacatccgccgccagcagaaggaggaacagaggcaccgccaagtcggggagataaaatcccaagaagggaagggccatgggcggcttctggagcccggcactcatcagtttgccagtgtcccagtgcgctccagccctctctatgagtacatccaagagcagagatctcaataccgcccttaagtgatgttgccaatatcttgacacctgccaaagcttcgagcacgggaaaatgagaaacactgggtaccaagtgataactcagatgtttctggttgtgggaaaactctctgatattagaatgtcttttcttccaaaatcttaaactacgctcattttacgcactttgtacttctgctttttattcttcctcaagtagttctttactgcaagatgtctttcttttgctctttgatgcagatgtggtgtgcatttaaaaaaaatataaatcatttaatttgtttaagaaattttgtttgaggaacatgttcatttattgctttcagaagtaacaagagtaataggatgatttgagattctaaacaatgggtcggtttgtttaatgactgacccatcttgtggaaagtgcagatacttttaatgttcaagttgctatttcttcttgaacctaaattgatcattgcctccaaacagcatttcatcttttgtggcatagttagcacaaattccaggtaactaaatttttataacccttgaatagtgcagggggagtgacctctgcataaaaacttcctgtaaaatcagcccattactggaagaaatatctgttaagaataggtttagctttgaagatttagaatttaaattagattttttttaaactcaactccacttaaacacataatctcatgaagaaataatgaggtgtttctcaacttcagagttcaaattttaaaactgtgtctgttgtagtctatagtgttcattctacttccccaagttttgatgagtttcagaatattatgaacctttgttaattttagcttgttagaaggaagctgctcagaatcccataaacatctgtcttactctagggccaataagagatcacatagagcatgttgggggtgtaaaagggaaaaatgtgtgaacataggggcaaatttctagaggccctttgacaagacccatttgcccacaatcatttgaggcctattgataataccttagatatattcttgttgaaataattggactgtgaaaaattaataataaatgtttggcaagtaa

SEQ ID NO: 32492 - DNA, 5480 bp, Homo sapiens
ggggagggaaaggggggggaggcaggaaagacctttttctctcccccccgcaataatccaagatcaactctgcaaacaacagaagacggttcatggctttggccgccgcgccaccatctttcgggctgccgagggtgttcttgacgattaatcaacagatatggtccggaaaaagaacccccctctgagaaacgttgcaagtgaaggcgagggccagatcctggagcctataggtacagaaagcaaggtatctggaaagaacaaagaattttctgcagatcagatgtcagaaaatacggatcagagtgatgctgcagaactaaatcataaggaggaacatagcttgcatgttcaagatccatcttctagcagtaagaaggacttgaaaagcgcagttctgagtgagaaggctggcttcaattatgaaagccccagtaagggaggaaactttccctcctttccgcatgatgaggtgacagacagaaatatgttggctttctcatctccagctgctgggggagtctgtgagcccttgaagtctccgcaaagagcagaggcagatgaccctcaagatatggcctgcaccccctcaggggactcactggagacaaaggaagatcagaagatgtcaccaaaggctacagaggaaacagggcaagcacagagtggtcaagccaattgtcaaggtttgagcccagtttcagtggcctcaaaaaacccacaagtgccttcagatgggggtgtaagactgaataaatccaaaactgacttactggtgaatgacaacccagacccggcacctctgtctccagagcttcaggactttaaatgcaatatctgtggatatggttactacggcaacgaccccacagatctgattaagcacttccgaaagtatcacttaggactgcataaccgcaccaggcaagatgctgagctggacagcaaaatcttggcccttcataacatggtgcagttcagccattccaaagacttccagaaggtcaaccgttctgtgttttctggtgtgctgcaggacatcaattcttcaaggcctgttttactaaatgggacctatgatgtgcaggtgacttcaggtggaacattcattggcattggacggaaaacaccagattgccaagggaacaccaagtatttccgctgtaaattctgcaatttcacttatatgggcaactcatccaccgaattagaacaacattttcttcagactcacccaaacaaaataaaagcttctctcccctcctctgaggttgcaaaaccttcagagaaaaactctaacaagtccatccctgcacttcaatccagtgattctggagacttgggaaaatggcaggacaagataacagtcaaagcaggagatgacactcctgttgggtactcagtgcccataaagcccctcgattcctctagacaaaatggtacagaggccaccagttactactggtgtaaattttgtagtttcagctgtgagtcatctagctcacttaaactgctagaacattatggcaagcagcacggagcagtgcagtcaggcggccttaatccagagttaaatgataagctttccaggggctctgtcattaatcagaatgatctagccaaaagttcagaaggagagacaatgaccaagacagacaagagctcgagtggggctaaaaagaaggacttctccagcaagggagccgaggataatatggtaacgagctataattgtcagttctgtgacttccgatattccaaaagccatggccctgatgtaattgtagtggggccacttctccgtcattatcaacagctccataacattcacaagtgtaccattaaacactgtccattctgtcccagaggactttgcagcccagaaaagcaccttggagaaattacttatccgtttgcttgtagaaaaagtaattgttcccactgtgcactcttgcttctgcacttgtctcctggggcggctggaagctcgcgagtcaaacatcagtgccatcagtgttcattcaccacccctgacgtagatgtactcctctttcactatgaaagtgtgcatgagtcccaagcatcggatgtcaaacaagaagcaaatcacctgcaaggatcggatgggcagcagtctgtcaaggaaagcaaagaacactcatgtaccaaatgtgattttattacccaagtggaagaagagatttcccgacactacaggagagcacacagctgctacaaatgccgtcagtgcagttttacagctgccgatactcagtcactactggagcacttcaacactgttcactgccaggaacaggacatcactacagccaacggcgaagaggacggtcatgccatatccaccatcaaagaggagcccaaaattgacttcagggtctacaatctgctaactccagactctaaaatgggagagccagtttctgagagtgtggtgaagagagagaagctggaagagaaggacgggctcaaagagaaagtttggaccgagagttccagtgatgaccttcgcaatgtgacttggagaggggcagacatcctgcgggggagtccgtcatacacccaagcaagcctggggctgctgacgcctgtgtctggcacccaagagcagacaaagactctaagggatagtcccaatgtggaggccgcccatctggcgcgacctatttatggcttggctgtggaaaccaagggattcctgcagggggcgccagctggcggagagaagtctggggccctcccccagcagtatcctgcatcgggagaaaacaagtccaaggatgaatcccagtccctgttacggaggcgtagaggctccggtgttttttgtgccaattgcctgaccacaaagacctctctctggcgaaagaatgcaaatggcggatatgtatgcaacgcgtgtggcctctaccagaagcttcactcgactcccaggcctttaaacatcattaaacaaaacaacggtgagcagattattaggaggagaacaagaaagcgccttaacccagaggcacttcaggctgagcagctcaacaaacagcagaggggcagcaatgaggagcaagtcaatggaagcccgttagagaggaggtcagaagatcatctaactgaaagtcaccagagagaaattccactccccagcctaagtaaatacgaagcccagggttcattgactaaaagccattctgctcagcagccagtcctggtcagccaaactctggatattcacaaaaggatgcaacctttgcacattcagataaaaagtcctcaggaaagtactggagatccaggaaatagttcatccgtatctgaagggaaaggaagttctgagagaggcagtcctatagaaaagtacatgagacctgcgaaacacccaaattattcaccaccaggcagccctattgaaaagtaccagtacccactttttggacttccctttgtacataatgacttccagagtgaagctgattggctgcggttctggagtaaatataagctctccgttcctgggaatccgcactacttgagtcacgtgcctggcctaccaaatccttgccaaaactatgtgccttatcccaccttcaatctgcctcctcatttttcagctgttggatcagacaatgacattcctctagatttggcgatcaagcattccagacctgggccaactgcaaacggtgcctccaaggagaaaacgaaggcaccaccaaatgtaaaaaatgaaggtcccttgaatgtagtaaaaacagagaaagttgatagaagtactcaagatgaactttcaacaaaatgtgtgcactgtggcattgtctttctggatgaagtgatgtatgctttgcatatgagttgccatggtgacagtggacctttccagtgcagcatatgccagcatctttgcacggacaaatatgacttcacaacacatatccagaggggcctgcataggaacaatgcacaagtggaaaaaaatggaaaacctaaagagtaaaaccttagcacttagcacaattaaatagaaataggttttcttgatgggaattcaatagcttgtaatgtcttatgaagacctattaaaaaaatacttcatagagcctgccttatccaacatgaaattcccttcttttgttattctttcttttgatgagtaggttaccaagattaaaaagtgagataaatggtcaatgagaaagaatggaagatggtaaacaatcactttttaaaacctgttaagtcaaaaccatcttggctaatatgtactggggaaataatccataagagatatcaccagactagaattaatatatttataaagaaagagaccaaaactgtctagaatttgaaagggtttacatattattatactaaagcagtactggactggccattggaccatttgttccaaaacccataaattgttgcctaaatttataatgatcatgaaaccctaggcagaggaggagaaattgaaggtccagggcaatgaaagaaaaatggcgccctctcaatttagtcttctctcattggccatgtttcagattttgacctagaaatgcgagctgtggttaggcttggttagagtgcagcaagcaacatgacagatggtggcacgctgtttttacccagccctgcctgtacatacacatgcacaccctctctgatatttttgtcctttagatgttcaaatactcagtagtccttttgtttgcggtttagattcattttgtccacacatgtacccattttaaaaaacaatgtcctcgatgcttctgtagtgatttcattttagccaggtatttctttcttgtgtgtgatgaaccagtatggatttgcttttctaagcctcctgttggttactaatctcacttggcacattataactaaaggaatcccctcaattcaaaagcatagatggatacaaatgtcagaccgtgggtttaatttgtttagaacacatggcatttcttcacaaggtaacctgctgtatttatttattttcttttggttaaatataatttccaaactttgtggtcaggcagcgtctaaggttacgttaccacagactgacagttggtatatgtaccagccaatcccttcattaaatgtatacagatttagttaagtagcattaaataggattcttagaagtatgtcctcatagaacttttaatacttaaggctttgtaaaaactatccatgaagggaaagctcctcagcataactgctcagggaaatagggctaaataactgaacattaaataattggttaaaggtgctgttagtcgagcctcaatgcttgctacaaggatgtatgtacaaggactgactttaataatttgcattatattgtcccaaccagtagtttattttttgccacggagatgtagaagatattacaagctactggatgcactgtcagattaacttatttcattaaagaagttgggagaacaaataggaaaaaa

SEQ ID NO: 32493 - DNA, 9990 bp, Homo sapiens
aatagtgttggtgtcttgaaactgacgtaatgcgcggagactgaggtcctgacaagcgataacatttctgataaagacccgatcttactgcaatctctagcgtcctcttttttggtgctgctggtttctccagacctcgcgtcctctcgattgctctctcgccttcctatttcttttttttttttttaaacaaaaaacaacaccccctcccctctcccacccggcaccgggcacatccttgctctatttcctttctctttctctctctctctctctctctctcttttttaataagggtgggggagggaaaggggggggaggcaggaaagacctttttctctcccccccgcaataatccaagatcaactctgcaaacaacagaagacggttcatggctttggccgccgcgccaccatctttcgggctgccgagggtgttcttgacgattaatcaacagatgtacagatcagctctcaaaatgtcttctgtgtcttctgagcgtcttctaagacaattgcattagcctcctgctagttgactaatagaattaataattgtaaaaagcactctaaagccacatgccttatgaagtcaatgctgggtatgattttacaaatatggtccggaaaaagaacccccctctgagaaacgttgcaagtgaaggcgagggccagatcctggagcctataggtacagaaagcaaggtatctggaaagaacaaagaattttctgcagatcagatgtcagaaaatacggatcagagtgatgctgcagaactaaatcataaggaggaacatagcttgcatgttcaagatccatcttctagcagtaagaaggacttgaaaagcgcagttctgagtgagaaggctggcttcaattatgaaagccccagtaagggaggaaactttccctcctttccgcatgatgaggtgacagacagaaatatgttggctttctcatctccagctgctgggggagtctgtgagcccttgaagtctccgcaaagagcagaggcagatgaccctcaagatatggcctgcaccccctcaggggactcactggagacaaaggaagatcagaagatgtcaccaaaggctacagaggaaacagggcaagcacagagtggtcaagccaattgtcaaggtttgagcccagtttcagtggcctcaaaaaacccacaagtgccttcagatgggggtgtaagactgaataaatccaaaactgacttactggtgaatgacaacccagacccggcacctctgtctccagagcttcaggactttaaatgcaatatctgtggatatggttactacggcaacgaccccacagatctgattaagcacttccgaaagtatcacttaggactgcataaccgcaccaggcaagatgctgagctggacagcaaaatcttggcccttcataacatggtgcagttcagccattccaaagacttccagaaggtcaaccgttctgtgttttctggtgtgctgcaggacatcaattcttcaaggcctgttttactaaatgggacctatgatgtgcaggtgacttcaggtggaacattcattggcattggacggaaaacaccagattgccaagggaacaccaagtatttccgctgtaaattctgcaatttcacttatatgggcaactcatccaccgaattagaacaacattttcttcagactcacccaaacaaaataaaagcttctctcccctcctctgaggttgcaaaaccttcagagaaaaactctaacaagtccatccctgcacttcaatccagtgattctggagacttgggaaaatggcaggacaagataacagtcaaagcaggagatgacactcctgttgggtactcagtgcccataaagcccctcgattcctctagacaaaatggtacagaggccaccagttactactggtgtaaattttgtagtttcagctgtgagtcatctagctcacttaaactgctagaacattatggcaagcagcacggagcagtgcagtcaggcggccttaatccagagttaaatgataagctttccaggggctctgtcattaatcagaatgatctagccaaaagttcagaaggagagacaatgaccaagacagacaagagctcgagtggggctaaaaagaaggacttctccagcaagggagccgaggataatatggtaacgagctataattgtcagttctgtgacttccgatattccaaaagccatggccctgatgtaattgtagtggggccacttctccgtcattatcaacagctccataacattcacaagtgtaccattaaacactgtccattctgtcccagaggactttgcagcccagaaaagcaccttggagaaattacttatccgtttgcttgtagaaaaagtaattgttcccactgtgcactcttgcttctgcacttgtctcctggggcggctggaagctcgcgagtcaaacatcagtgccatcagtgttcattcaccacccctgacgtagatgtactcctctttcactatgaaagtgtgcatgagtcccaagcatcggatgtcaaacaagaagcaaatcacctgcaaggatcggatgggcagcagtctgtcaaggaaagcaaagaacactcatgtaccaaatgtgattttattacccaagtggaagaagagatttcccgacactacaggagagcacacagctgctacaaatgccgtcagtgcagttttacagctgccgatactcagtcactactggagcacttcaacactgttcactgccaggaacaggacatcactacagccaacggcgaagaggacggtcatgccatatccaccatcaaagaggagcccaaaattgacttcagggtctacaatctgctaactccagactctaaaatgggagagccagtttctgagagtgtggtgaagagagagaagctggaagagaaggacgggctcaaagagaaagtttggaccgagagttccagtgatgaccttcgcaatgtgacttggagaggggcagacatcctgcgggggagtccgtcatacacccaagcaagcctggggctgctgacgcctgtgtctggcacccaagagcagacaaagactctaagggatagtcccaatgtggaggccgcccatctggcgcgacctatttatggcttggctgtggaaaccaagggattcctgcagggggcgccagctggcggagagaagtctggggccctcccccagcagtatcctgcatcgggagaaaacaagtccaaggatgaatcccagtccctgttacggaggcgtagaggctccggtgttttttgtgccaattgcctgaccacaaagacctctctctggcgaaagaatgcaaatggcggatatgtatgcaacgcgtgtggcctctaccagaagcttcactcgactcccaggcctttaaacatcattaaacaaaacaacggtgagcagattattaggaggagaacaagaaagcgccttaacccagaggcacttcaggctgagcagctcaacaaacagcagaggggcagcaatgaggagcaagtcaatggaagcccgttagagaggaggtcagaagatcatctaactgaaagtcaccagagagaaattccactccccagcctaagtaaatacgaagcccagggttcattgactaaaagccattctgctcagcagccagtcctggtcagccaaactctggatattcacaaaaggatgcaacctttgcacattcagataaaaagtcctcaggaaagtactggagatccaggaaatagttcatccgtatctgaagggaaaggaagttctgagagaggcagtcctatagaaaagtacatgagacctgcgaaacacccaaattattcaccaccaggcagccctattgaaaagtaccagtacccactttttggacttccctttgtacataatgacttccagagtgaagctgattggctgcggttctggagtaaatataagctctccgttcctgggaatccgcactacttgagtcacgtgcctggcctaccaaatccttgccaaaactatgtgccttatcccaccttcaatctgcctcctcatttttcagctgttggatcagacaatgacattcctctagatttggcgatcaagcattccagacctgggccaactgcaaacggtgcctccaaggagaaaacgaaggcaccaccaaatgtaaaaaatgaaggtcccttgaatgtagtaaaaacagagaaagttgatagaagtactcaagatgaactttcaacaaaatgtgtgcactgtggcattgtctttctggatgaagtgatgtatgctttgcatatgagttgccatggtgacagtggacctttccagtgcagcatatgccagcatctttgcacggacaaatatgacttcacaacacatatccagaggggcctgcataggaacaatgcacaagtggaaaaaaatggaaaacctaaagagtaaaaccttagcacttagcacaattaaatagaaataggttttcttgatgggaattcaatagcttgtaatgtcttatgaagacctattaaaaaaatacttcatagagcctgccttatccaacatgaaattcccttcttttgttattctttcttttgatgagtaggttaccaagattaaaaagtgagataaatggtcaatgagaaagaatggaagatggtaaacaatcactttttaaaacctgttaagtcaaaaccatcttggctaatatgtactggggaaataatccataagagatatcaccagactagaattaatatatttataaagaaagagaccaaaactgtctagaatttgaaagggtttacatattattatactaaagcagtactggactggccattggaccatttgttccaaaacccataaattgttgcctaaatttataatgatcatgaaaccctaggcagaggaggagaaattgaaggtccagggcaatgaaagaaaaatggcgccctctcaatttagtcttctctcattggccatgtttcagattttgacctagaaatgcgagctgtggttaggcttggttagagtgcagcaagcaacatgacagatggtggcacgctgtttttacccagccctgcctgtacatacacatgcacaccctctctgatatttttgtcctttagatgttcaaatactcagtagtccttttgtttgcggtttagattcattttgtccacacatgtacccattttaaaaaacaatgtcctcgatgcttctgtagtgatttcattttagccaggtatttctttcttgtgtgtgatgaaccagtatggatttgcttttctaagcctcctgttggttactaatctcacttggcacattataactaaaggaatcccctcaattcaaaagcatagatggatacaaatgtcagaccgtgggtttaatttgtttagaacacatggcatttcttcacaaggtaacctgctgtatttatttattttcttttggttaaatataatttccaaactttgtggtcaggcagcgtctaaggttacgttaccacagactgacagttggtatatgtaccagccaatcccttcattaaatgtatacagatttagttaagtagcattaaataggattcttagaagtatgtcctcatagaacttttaatacttaaggctttgtaaaaactatccatgaagggaaagctcctcagcataactgctcagggaaatagggctaaataactgaacattaaataattggttaaaggtgctgttagtcgagcctcaatgcttgctacaaggatgtatgtacaaggactgactttaataatttgcattatattgtcccaaccagtagtttattttttgccacggagatgtagaagatattacaagctactggatgcactgtcagattaacttatttcattaaagaagttgggagaacaaataggaaaaaaaaaacttatttttctagtaaatattaatgtattacatttcaaataatggtgcctgacatattgaataattattttctacagtgtacgtatgcaacaaagatattccatcatgcattagagtcagttctggctctgcctagctgtttacatttgcaaatgtagcaaacaaggtaatgaagcaactatttctattgcagtagatatccttttgtgtgtgtgtgtgtgcattaaagttgtaaacggtaacatgaaacaaatgaaagttcttgctataatggtatggaaaacaagaaggaaatgaaaatatttttatgcctacttaggaaaaaaagggtagcacttattcattccaagtacttttttttttttaatttttaagctcttaactcacattgttatgcttaagatgataaacatatatcctctttttattgctttgtctatgtttcatatgaaacatttcagaaattattttgataagtgttgctggaatctgcaacgctgatttttttttgcattctgtagtcgcatttgcactccatttttacattaattcgcagttgctttgtatcattgttttgtttgggttttgtttctttttcacagtgccgggtcttcgtttcttaaagttggatggcaggtagagttcaaccagttcgtgactgttgtagcgaatgaagttaaaaaaatgtctttctgatgttgtgttgtcattttcatttttgcatttttttgtttgcatattaaaaaaagagaaaagagaaagcaagagacagaaatcaggactaagtcctctgcttcagtttcattgttaacgggccttattctgatctcacctgtcgcgtagctctaatattcacataaactgaaataaagaagtggaatgaggagctttgacattcaaattatgtgatgtaatttatcttccttaggaattttgatggatgcatctcaaaatgtatagccagacttgagaggtgacaattaaagatctaaaaaagagaggagattcccccaaacaacaatatttaattttcttagtaaaaagaataacagaatgcatcgtggcaatccttaagcaacattatctatgtggactgcttaaatcagcaaaacaccagaagtttggttaacttgggcaatatgacaagtattactttttgggcaaaactactcattaagcaatttctctagtgtgtcggacacaaataggttctttatttttggcatgtatgcctttttattttcattcaattttttttttttctcagacagacatagtagtatcgactagcattggaaaatacatatcactattcttggaatatttatggtcagtctactttttagtaaaatatttttggatagcgttgacacgatagatcttattccatacttctttattattgataattttattttcattttttgctttcattattatacatattttggtggagaagaggttgggcttttttgaaagagacaaaaatttattataacactaaacactccttttttgacatattaaagcctttattccatctctcaagatatattataaaatttatttttttaatttaagatttctgaattattttatcttaaattgtgattttaaacgagctattatggtacggaactttttttaatgaggaatttcatgatgatttaggaattttctctcttggaaaaggcttcccctgtgatgaaaatgatgtgccagctaaaattgtgtgccatttaaaaactgaaaatattttaaaattatttgtctatattctaaattgagctttggatcaaactttaggccaggaccagctcatgcgttctcattcttccttttctcactctttctctcatcactcacctctgtattcattctgttgtttgggatagaaaaatcataaagagccaacccatctcagaacgttgtggattgagagagacactacatgactccaagtatatgagaaaaggacagagctctaattgataactctgtagttcaaaaggaaaagagtatgcccaattctctctacatgacatattgagattttttttaatcaacttttaagatagtgatgttctgttctaaactgttctgttttagtgaaggtagatttttataaaacaagcatggggattcttttctaaggtaatattaatgagaagggaaaaaagtatctttaacagctctttgttgaagcctgtggtagcacattatgtttataattgcacatgtgcacataatctattatgatccaatgcaaatacagctccaaaaatattaaatgtatatatattttaaaatgcctgaggaaatacatttttcttaataaactgaagagtctcagtatggctattaaaataattattagcctcctgttgtgtggctgcaaaacatcacaaagtgaccggtcttgagacctgtgaactgctgccctgtttagtaaataaaattaatgcatttctagagggggaatatctgccatccagtggtggaaatgtggagtaaagaagctggtggtctgcttctgtgctgtatgccagccttttgccttaagttgagaggaggtcaactttagctactgtctttggtttgagagccatggcaaaaaaaaaaaaagaaaaaaagatcaagtcgtctttggtgagccagtaaggtgaaagcttgctgactgtccaaggcacaagagaaaattgaggaattgaaatgcaacctgagtatcaaactaaatattctaatcaaaggtaggtactgttaggtggaattctatcagcaggcaactgcaaatgagaagaagatagaaggacgcccgtcgggactttggagggcattgttattttcccaaagaaagacggccaagggcagaggcatggattctttgcagagcacttccttttggtttttcagtactgtttcatagacagtgggctcacatgttcctgatagtgctgcagttgcttagaaagcatcccagttaattgcagtaattagaacttctggaatatgctagggcagaagtatgtcaagtatgtcacatgaagaaaatgtgaaattcaagagtaatccacacgtgagaaactagacaatgtacattcatgtgttctcttgaaaggaaagggagagctgtaagcttcactctgtcctacaccggagaaaagcaggaataactttaccgtggaaataatgtttagcttttatcagagaaaattgtccttctagagcatagagtcccaaaactcaattctggttttcccctgttttttttttttttttttttcccaacatataaactgcagcatatcactttttctttttgtgcctcaggttcctcacctgtaaaattgaaaaatatatgtattaataatattattaataataataatggtaatgtagtacttgtttgtaaagcactttgagatccttggttgaaaggcaccataggagtgccaagtattattatgtggccaagggggttatttaaactgtcagttcccaaaggccaggaaaggttggggtcatttttcttaaagacgagctgtaaatatcaactaggcagccaatagtgttgactatgaagatgcaaaactattactaggctgataaaatcatagtttcttaatggctaccaataaggcaaatatcacaataataaacgccaaattccttagggcggactatttgacaaccacatggaaaactttgggggaggcatgaggggggaacatctcaaaatgccaatgtaaaatttaacttacagcaatattcaccagcagaaaatgtctttcatatggaatgatttcatgttgctaagaaaaagaattcaatttgtagtcctgatttgaatactagaatgttggctataatagttctgttcttacaacacatgaaattttttcgttttattttattttgttttcatagtgcatgttcatttctactcacaaacatgttcttggtgtatttcttatgcaaacaatcttcaggcagcaaagatgtctgttacatctaaacttgaataataaagttttaccaccagttacaca

SEQ ID NO: 32494 - DNA, 4083 bp, Homo sapiens
aattctctcctaccgggcgcagcggaggagctggaggtggttggacccgaggggccgccgccgccgccgccactgcaagttttctgggggctcgtgacaagcggggcgcagactaggcaccagcatgcagagtaatatggtccggaaaaagaacccccctctgagaaacgttgcaagtgaaggcgagggccagatcctggagcctataggtacagaaagcaaggtatctggaaagaacaaagaattttctgcagatcagatgtcagaaaatacggatcagagtgatgctgcagaactaaatcataaggaggaacatagcttgcatgttcaagatccatcttctagcagtaagaaggacttgaaaagcgcagttctgagtgagaaggctggcttcaattatgaaagccccagtaagggaggaaactttccctcctttccgcatgatgaggtgacagacagaaatatgttggctttctcatctccagctgctgggggagtctgtgagcccttgaagtctccgcaaagagcagaggcagatgaccctcaagatatggcctgcaccccctcaggggactcactggagacaaaggaagatcagaagatgtcaccaaaggctacagaggaaacagggcaagcacagagtggtcaagccaattgtcaaggtttgagcccagtttcagtggcctcaaaaaacccacaagtgccttcagatgggggtgtaagactgaataaatccaaaactgacttactggtgaatgacaacccagacccggcacctctgtctccagagcttcaggactttaaatgcaatatctgtggatatggttactacggcaacgaccccacagatctgattaagcacttccgaaagtatcacttaggactgcataaccgcaccaggcaagatgctgagctggacagcaaaatcttggcccttcataacatggtgcagttcagccattccaaagacttccagaaggtcaaccgttctgtgttttctggtgtgctgcaggacatcaattcttcaaggcctgttttactaaatgggacctatgatgtgcaggtgacttcaggtggaacattcattggcattggacggaaaacaccagattgccaagggaacaccaagtatttccgctgtaaattctgcaatttcacttatatgggcaactcatccaccgaattagaacaacattttcttcagactcacccaaacaaaataaaagcttctctcccctcctctgaggttgcaaaaccttcagagaaaaactctaacaagtccatccctgcacttcaatccagtgattctggagacttgggaaaatggcaggacaagataacagtcaaagcaggagatgacactcctgttgggtactcagtgcccataaagcccctcgattcctctagacaaaatggtacagaggccaccagttactactggtgtaaattttgtagtttcagctgtgagtcatctagctcacttaaactgctagaacattatggcaagcagcacggagcagtgcagtcaggcggccttaatccagagttaaatgataagctttccaggggctctgtcattaatcagaatgatctagccaaaagttcagaaggagagacaatgaccaagacagacaagagctcgagtggggctaaaaagaaggacttctccagcaagggagccgaggataatatggtaacgagctataattgtcagttctgtgacttccgatattccaaaagccatggccctgatgtaattgtagtggggccacttctccgtcattatcaacagctccataacattcacaagtgtaccattaaacactgtccattctgtcccagaggactttgcagcccagaaaagcaccttggagaaattacttatccgtttgcttgtagaaaaagtaattgttcccactgtgcactcttgcttctgcacttgtctcctggggcggctggaagctcgcgagtcaaacatcagtgccatcagtgttcattcaccacccctgacgtagatgtactcctctttcactatgaaagtgtgcatgagtcccaagcatcggatgtcaaacaagaagcaaatcacctgcaaggatcggatgggcagcagtctgtcaaggaaagcaaagaacactcatgtaccaaatgtgattttattacccaagtggaagaagagatttcccgacactacaggagagcacacagctgctacaaatgccgtcagtgcagttttacagctgccgatactcagtcactactggagcacttcaacactgttcactgccaggaacaggacatcactacagccaacggcgaagaggacggtcatgccatatccaccatcaaagaggagcccaaaattgacttcagggtctacaatctgctaactccagactctaaaatgggagagccagtttctgagagtgtggtgaagagagagaagctggaagagaaggacgggctcaaagagaaagtttggaccgagagttccagtgatgaccttcgcaatgtgacttggagaggggcagacatcctgcgggggagtccgtcatacacccaagcaagcctggggctgctgacgcctgtgtctggcacccaagagcagacaaagactctaagggatagtcccaatgtggaggccgcccatctggcgcgacctatttatggcttggctgtggaaaccaagggattcctgcagggggcgccagctggcggagagaagtctggggccctcccccagcagtatcctgcatcgggagaaaacaagtccaaggatgaatcccagtccctgttacggaggcgtagaggctccggtgttttttgtgccaattgcctgaccacaaagacctctctctggcgaaagaatgcaaatggcggatatgtatgcaacgcgtgtggcctctaccagaagcttcactcgactcccaggcctttaaacatcattaaacaaaacaacggtgagcagattattaggaggagaacaagaaagcgccttaacccagaggcacttcaggctgagcagctcaacaaacagcagaggggcagcaatgaggagcaagtcaatggaagcccgttagagaggaggtcagaagatcatctaactgaaagtcaccagagagaaattccactccccagcctaagtaaatacgaagcccagggttcattgactaaaagccattctgctcagcagccagtcctggtcagccaaactctggatattcacaaaaggatgcaacctttgcacattcagataaaaagtcctcaggaaagtactggagatccaggaaatagttcatccgtatctgaagggaaaggaagttctgagagaggcagtcctatagaaaagtacatgagacctgcgaaacacccaaattattcaccaccaggcagccctattgaaaagtaccagtacccactttttggacttccctttgtacataatgacttccagagtgaagctgattggctgcggttctggagtaaatataagctctccgttcctgggaatccgcactacttgagtcacgtgcctggcctaccaaatccttgccaaaactatgtgccttatcccaccttcaatctgcctcctcatttttcagctgttggatcagacaatgacattcctctagatttggcgatcaagcattccagacctgggccaactgcaaacggtgcctccaaggagaaaacgaaggcaccaccaaatgtaaaaaatgaaggtcccttgaatgtagtaaaaacagagaaagttgatagaagtactcaagatgaactttcaacaaaatgtgtgcactgtggcattgtctttctggatgaagtgatgtatgctttgcatatgagttgccatggtgacagtggacctttccagtgcagcatatgccagcatctttgcacggacaaatatgacttcacaacacatatccagaggggcctgcataggaacaatgcacaagtggaaaaaaatggaaaacctaaagagtaaaaccttagcacttagcacaattaaatagaaataggttttcttgatgggaattcaatagcttgtaatgtcttatgaagacctattaaaaaaatacttcatag

SEQ ID NO: 32495 - DNA, 920 bp, Homo sapiens
attgtggtgccttgtagctgtcccgggagccctcagcagcagttggagctggtgcacaggaaggatgaggaagaccaggctctgggggctgctgtggatgctctttgtctcagaactccgagctgcaactaaattaactgaggaaaagtatgaactgaaagaggggcagaccctggatgtgaaatgtgactacacgctagagaagtttgccagcagccagaaagcttggcagataataagggacggagagatgcccaagaccctggcatgcacagagaggccttcaaagaattcccatccagtccaagtggggaggatcatactagaagactaccatgatcatggtttactgcgcgtccgaatggtcaaccttcaagtggaagattctggactgtatcagtgtgtgatctaccagcctcccaaggagcctcacatgctgttcgatcgcatccgcttggtggtgaccaagggtttttcagggacccctggctccaatgagaattctacccagaatgtgtataagattcctcctaccaccactaaggccttgtgcccactctataccagccccagaactgtgacccaagctccacccaagtcaactgccgatgtctccactcctgactctgaaatcaaccttacaaatgtgacagatatcatcagggttccggtgttcaacattgtcattctcctggctggtggattcctgagtaagagcctggtcttctctgtcctgtttgctgtcacgctgaggtcatttgtaccctaggcccacgaacccacgagaatgtcctctgacttccagccacatccatctggcagttgtgccaagggaggagggaggaggtaaaaggcagggagttaataacatgaattaaatctgtaatcaccggctatttctaaagtcagcgtctcacctt

SEQ ID NO: 32496 - DNA, 727 bp, Homo sapiens
attgtggtgccttgtagctgtcccgggagccctcagcagcagttggagctggtgcacaggaaggatgaggaagaccaggctctgggggctgctgtggatgctctttgtctcagaactccgagctgcaactaaattaactgaggaaaagtatgaactgaaagaggggcagaccctggatgtgaaatgtgactacacgctagagaagtttgccagcagccagaaagcttggcagataataagggacggagagatgcccaagaccctggcatgcacagagaggccttcaaagaattcccatccagtccaagtggggaggatcatactagaagactaccatgatcatggtttactgcgcgtccgaatggtcaaccttcaagtggaagattctggactgtatcagtgtgtgatctaccagcctcccaaggagcctcacatgctgttcgatcgcatccgcttggtggtgaccaaggggttccggtgttcaacattgtcattctcctggctggtggattcctgagtaagagcctggtcttctctgtcctgtttgctgtcacgctgaggtcatttgtaccctaggcccacgaacccacgagaatgtcctctgacttccagccacatccatctggcagttgtgccaagggaggagggaggaggtaaaaggcagggagttaataacatgaattaaatctgtaatcaccggctatttctaaagtcagcgtctcacctt

SEQ ID NO: 32497 - DNA, 2048 bp, Homo sapiens
agcagttggagctggtgcacaggaaggatgaggaagaccaggctctgggggctgctgtggatgctctttgtctcagaactccgagctgcaactaaattaactgaggaaaagtatgaactgaaagaggggcagaccctggatgtgaaatgtgactacacgctagagaagtttgccagcagccagaaagcttggcagataataagggacggagagatgcccaagaccctggcatgcacagagaggccttcaaagaattcccatccagtccaagtggggaggatcatactagaagactaccatgatcatggtttactgcgcgtccgaatggtcaaccttcaagtggaagattctggactgtatcagtgtgtgatctaccagcctcccaaggagcctcacatgctgttcgatcgcatccgcttggtggtgaccaagggtttttcagggacccctggctccaatgagaattctacccagaatgtgtataagattcctcctaccaccactaaggccttgtgcccactctataccagccccagaactgtgacccaagctccacccaagtcaactgccgatgtctccactcctgactctgaaatcaaccttacaaatgtgacagatatcatcaggtatagtttccaggtccctgggcccctggtttggacactgagccctttgtttcccagtctgtgtgctgagaggatgtgaaagtgagggaaaggggagggtggggcaggagaagacttgagtcacattagtctgggtagaaatgtccaggggaagaaggaagtggtgatggagaataggggaggctctcagccaggctgtccttctccccagttcaccttctttgtttccttgcaacctgagtattaaagagagggaaatggcatcttccccaagttccagtggagctcatccaaccccaggggcctgatgggcagtgggaaagcactctgagtgaggggccctggatctagtgttggcctgactaactgaatgtgactttgggtgagtcaggaaccctctctggctttagcttctttgacaattcagtaggcatggtagaaacccaaagctggaagacattgtccacctaataactctcagcaggagctggagctggggctaaatgcagtattggtttttgccttattgttttttaaataacattgttgcatgtgcccaattatagataaatagaatcagaatttttgcagatgaggtccctctcagtatttttaataagatgtttaggagatttctaatgtgtaggcaaacttaagaaccactaacttagcaatttcacacctctttacagttattaaatgttgatttatattagaatgtgtttatcattaaatactgaattatcaggatggaaatacttttccacatcaccactagtctaacatgtcttttttctcatattctcttctagtctttattcatgtttatacatattttaatatggcagtaagtctaattatacatgtttttattcttttccttgctgaaattattctttgatgctgctacctaaatttcataaatataatttcaatgagtgcatatttttctatcaattgggaaagccataacttacataaccattggcctgttcttagacattgatatagtgttgataactctgagataaacatattcttgcagatatatttttcttcttttaaataattaactcgaaatttccatgagataatttaaacactgatatcattttgtatacaaatagcatctaccaatggtcttccaaaagattggaaacaatttgcagtgtgatccattaagcataaataaagcagtgtcatggcaggcttacagacacggatttagtcttttaaatcattaaatagtgtgagttaaatcacattcctgctaaaacaaatgtgaactggtgcctgctctaatttctctatgagtgtagactccacctccatatgggtagtggcagtgcctttttccccattatgttgtttggggaacaaagtgctcattaaacttctgtggaataaatcaaacgaatgatc

SEQ ID NO: 32498 - DNA, 860 bp, Homo sapiens
gggcagcgcctgacatgcctgatcctctcttttctgcagttcaagggaaagacgagatcttgcacaaggcactctgcttctgcccttggctggggaagggtggcatggagcctctccggctgctcatcttactctttgtcacagagctgtccggagcccacaacaccacagtgttccagggcgtggcgggccagtccctgcaggtgtcttgcccctatgactccatgaagcactgggggaggcgcaaggcctggtgccgccagctgggagagaagggcccatgccagcgtgtggtcagcacgcacaacttgtggctgctgtccttcctgaggaggtggaatgggagcacagccatcacagacgataccctgggtggcactctcaccattacgctgcggaatctacaaccccatgatgcgggtctctaccagtgccagagcctccatggcagtgaggctgacaccctcaggaaggtcctggtggaggtgctggcagaccccctggatcaccgggatgctggagatctctggttccccggggagtctgagagcttcgaggatgcccatgtggagcacagcatctccagggctgagagacacgtgaaggaagatgatgggaggaaaagcccaggagaagtcccaccagggaccagcccagcctgcatacttgccacttggccaccaggactccttgttctgctctggcaagagactactctgcctgaacactgcttctcctggaccctggaagcagggactggttgagggagtggggaggtggtaagaacacctgacaacttctgaatattggacattttaaacacttacaaataaatccaagactgtcatatttagctggat

SEQ ID NO: 32499 - DNA, 1044 bp, Homo sapiens
tgacatgcctgatcctctcttttctgcagttcaagggaaagacgagatcttgcacaaggcactctgcttctgcccttggctggggaagggtggcatggagcctctccggctgctcatcttactctttgtcacagagctgtccggagcccacaacaccacagtgttccagggcgtggcgggccagtccctgcaggtgtcttgcccctatgactccatgaagcactgggggaggcgcaaggcctggtgccgccagctgggagagaagggcccatgccagcgtgtggtcagcacgcacaacttgtggctgctgtccttcctgaggaggtggaatgggagcacagccatcacagacgataccctgggtggcactctcaccattacgctgcggaatctacaaccccatgatgcgggtctctaccagtgccagagcctccatggcagtgaggctgacaccctcaggaaggtcctggtggaggtgctggcagaccccctggatcaccgggatgctggagatctctggttccccggggagtctgagagcttcgaggatgcccatgtggagcacagcatctccaggagcctcttggaaggagaaatccccttcccacccacttccatccttctcctcctggcctgcatctttctcatcaagattctagcagccagcgccctctgggctgcagcctggcatggacagaagccagggacacatccacccagtgaactggactgtggccatgacccagggtatcagctccaaactctgccagggctgagagacacgtgaaggaagatgatgggaggaaaagcccaggagaagtcccaccagggaccagcccagcctgcatacttgccacttggccaccaggactccttgttctgctctggcaagagactactctgcctgaacactgcttctcctggaccctggaagcagggactggttgagggagtggggaggtggtaagaacacctgacaacttctgaatattggacattttaaacacttacaaataaatccaagactgtcatatttagctggat

SEQ ID NO: 32500 - DNA, 856 bp, Homo sapiens
gcagcgcctgacatgcctgatcctctcttttctgcagttcaagggaaagacgagatcttgcacaaggcactctgcttctgcccttggctggggaagggtggcatggagcctctccggctgctcatcttactctttgtcacagagctgtccggagcccacaacaccacagtgttccagggcgtggcgggccagtccctgcaggtgtcttgcccctatgactccatgaagcactgggggaggcgcaaggcctggtgccgccagctgggagagaagggcccatgccagcgtgtggtcagcacgcacaacttgtggctgctgtccttcctgaggaggtggaatgggagcacagccatcacagacgataccctgggtggcactctcaccattacgctgcggaatctacaaccccatgatgcgggtctctaccagtgccagagcctccatggcagtgaggctgacaccctcaggaaggtcctggtggaggtgctggcagaccccctggatcaccgggatgctggagatctctggttccccggggagtctgagagcttcgaggatgcccatgtggagcacagcatctccagggctgagagacacgtgaaggaagatgatgggaggaaaagcccaggagaagtcccaccagggaccagcccagcctgcatacttgccacttggccaccaggactccttgttctgctctggcaagagactactctgcctgaacactgcttctcctggaccctggaagcagggactggttgagggagtggggaggtggtaagaacacctgacaacttctgaatattggacattttaaacacttacaaataaatccaagactgtcatatttagctgg

SEQ ID NO: 32501 - DNA, 1287 bp, Homo sapiens
ctgcccagccatgggcctcaccctgctcttgctgctgctcctgggactagaaggtcagggcatagttggcagcctccctgaggtgctgcaggcacccgtgggaagctccattctggtgcagtgccactacaggctccaggatgtcaaagctcagaaggtgtggtgccggttcttgccggaggggtgccagcccctggtgtcctcagctgtggatcgcagagctccagcgggcaggcgtacgtttctcacagacctgggtgggggcctgctgcaggtggaaatggttaccctgcaggaagaggatgctggcgagtatggctgcatggtggatggggccagggggccccagattttgcacagagtctctctgaacatactgcccccagaggaagaagaagagacccataagattggcagtctggctgagaacgcattctcagaccctgcaggcagtgccaaccctttggaacccagccaggatgagaagagcatccccttgatctggggtgctgtgctcctggtaggtctgctggtggcagcggtggtgctgtttgctgtgatggccaagaggaaacaagggaacaggcttggtgtctgtggccgattcctgagcagcagagtttcaggcatgaatccctcctcagtggtccaccacgtcagtgactctggaccggctgctgaattgcctttggatgtaccacacattaggcttgactcaccaccttcatttgacaataccacctacaccagcctacctcttgattccccatcaggaaaaccttcactcccagctccatcctcattgccccctctacctcctaaggtcctggtctgctccaagcctgtgacatatgccacagtaatcttcccgggagggaacaagggtggagggacctcgtgtgggccagcccagaatccacctaacaatcagactccatccagctaagctgctcatcacactttaaactcatgaggaccatccctaggggttctgtgcatccatccagccagctcatgccctaggatccttaggatatctgagcaaccagggactttaagatctaatccaatgtcctaactttactagggaaagtgacgctcagacatgactgagatgtcttggggaagacctccctgcacccaactcccccactggttcttctaccattacacactgggctaaataaaccctaataatgatgtgcaaactcttaatggctgaatgggaaaggaaactgcccaagtttgactaattgcttggcctgtgaatggaaaagactctggtct

SEQ ID NO: 32502 - DNA, 927 bp, Homo sapiens
cagtgcccaggcaagcccaggagttgacatttctctgcccagccatgggcctcaccctgctcttgctgctgctcctgggactagaaggtcagggcatagttggcagcctccctgaggtgctgcaggcacccgtgggaagctccattctggtgcagtgccactacaggctccaggatgtcaaagctcagaaggtgtggtgccggttcttgccggaggggtgccagcccctggtgtcctcagctgtggatcgcagagctccagcgggcaggcgtacgtttctcacagacctgggtgggggcctgctgcaggtggaaatggttaccctgcaggaagaggatgctggcgagtatggctgcatggtggatggggccagggggccccagattttgcacagagtctctctgaacatactgcccccagaggaagaagaagagacccataagattggcagtctggctgagaacgcattctcagaccctgcaggcagtgccaaccctttggaacccagccaggatgagaagagcatccccttgatctggggtgctgtgctcctggtaggtctgctggtggcagcggtggtgctgtttgctgtgatggccaagaggaaacaagaatccctcctcagtggtccaccacgtcagtgactctggaccggctgctgaattgcctttggatgtaccacacattaggcttgactcaccaccttcatttgacaataccacctacaccagcctacctcttgattccccatcaggaaaaccttcactcccagctccatcctcattgccccctctacctcctaaggtcctggtctgctccaagcctgtgacatatgccacagtaatcttcccgggagggaacaagggtggagggacctcgtgtgggccagcccagaatccacctaacaatcagactccatccagctaa

SEQ ID NO: 32503 - DNA, 911 bp, Homo sapiens
tgcatcagtgcccaggcaagcccaggagttgacatttctctgcccagccatgggcctcaccctgctcttgctgctgctcctgggactagaagaggaagaagaagagacccataagattggcagtctggctgagaacgcattctcagaccctgcaggcagtgccaaccctttggaacccagccaggatgagaagagcatccccttgatctggggtgctgtgctcctggtaggtctgctggtggcagcggtggtgctgtttgctgtgatggccaagaggaaacaagggaacaggcttggtgtctgtggccgattcctgagcagcagagtttcaggcatgaatccctcctcagtggtccaccacgtcagtgactctggaccggctgctgaattgcctttggatgtaccacacattaggcttgactcaccaccttcatttgacaataccacctacaccagcctacctcttgattccccatcaggaaaaccttcactcccagctccatcctcattgccccctctacctcctaaggtcctggtctgctccaagcctgtgacatatgccacagtaatcttcccgggagggaacaagggtggagggacctcgtgtgggccagcccagaatccacctaacaatcagactccatccagctaagctgctcatcacactttaaactcatgaggaccatccctaggggttctgtgcatccatccagccagctcatgccctaggatccttaggatatctgagcaaccagggactttaagatctaatccaatgtcctaactttactagggaaagtgacgctcagacatgactgagatgtcttggggaagacctccctgcacccaactcccccactggttcttctaccattacacactgggctaaataaaccctaataatgatgtgc

SEQ ID NO: 32504 - DNA, 3302 bp, Homo sapiens
ataggctcaatgaatccctgcggttggctgggggcagtgggtcccacactgcctcacttccctaaatgggcagcttcacttttagaaccccgggtccttccctggcaggcccaggtggcacatcctgtgtcgggtgggccctcaccttggatctccaggcctgacactgcccagctggatggaaccatggccccagccttcctgctgctgctgctgctgtggccacagggttgcgtctcaggcccctctgctgacagtgtatacacaaaagtgaggctccttgaaggggagactctgtctgtgcagtgctcctataagggctacaaaaaccgcgtggagggcaaggtttggtgcaaaatcaggaagaagaagtgtgagcctggctttgcccgagtctgggtgaaagggccccgctacttgctgcaggacgatgcccaggccaaggtggtcaacatcaccatggtggccctcaagctccaggactcaggccgatactggtgcatgcgcaacacctctgggatcctgtaccccttgatgggcttccagctggatgtgtctccagctccccaaactgagaggaacattcctttcacacatctggacaacatcctcaagagtggaactgtcacaactggccaagcccctacctcaggccctgatgccccttttaccactggtgtgatggtgttcaccccaggactcatcaccttgcctaggctcttagcctccaccagacctgcctccaagacaggctacagcttcactgctaccagcaccaccagccagggacccaggaggaccatggggtcccagacagtgaccgcgtctcccagcaatgccagggactcctctgctggcccagaatccatctccactaagtctggggacctcagcaccagatcgcccaccacagggctctgcctcaccagcagatctctcctcaacagactaccctccatgccctccatcaggcaccaggatgtttactccactgtgcttggggtggtgctgaccctcctggtgctgatgctgatcatggtctatgggttttggaagaagagacacatggcaagctacagcatgtgcagcgatccttctacacgtgacccacctggaagaccagagccctatgtggaagtctacttgatctgaggccacttaagcatggggtggggagcttctcccagagtggccccagggggttagaggaggggtgaagattggggccagtatcgatcttatgaagctggaggacttgtgcagtgctggactcacccaggacttcccaaacccagaggctgccatcctaagcagccccacagcccagtgttctccttgggggcaggaacctggggaggggcccagagcaaagggcatcagggagaaagtcccgaggaaatgtgaccagtggtttctgctcggagctgcagaccccagggctcttggtggaggcaggggaaccctgagagtgctgtttacagagaacctcagctcccgtctgcctcagaaaccctattgggctgagctgccctccccaccagggccactgtgtcctctgcttccctccgttctgcttcagcttcccctaaggttagggaagaaagaatcgggctcacgaatgccagaggcagtgatgtcccatcctggaggagaggaaacagtgactaaaagctggggacccacagaggggttggcagcttctcttgtcgggacaggtgtcctttgctgggcctctggatggccctgccctgactggggctgctcctccctcctgtcctgggaccgcgcagagcccacgctctcactgctgcctcctgctggccgctgcctccttagaaagctgtgaccaggcagctaagagcctctgggctgcagggtcagcctctcccaagactgaagtgcagaggctggacttggggctctctcccccagcttctacacctgggctccaagtctgagttcccacaggggacccagcagcctccaggaagtccataccctggggtggctgagaccttggctctgtatggaggctgctcaccccacagacactggtggggagaccatggctcagaggaagggtggagcaaccctcctcctacccctcaggatagagagagaagacacacttgggacacagtgaagacagtaacttggaactgaccacggcctggaggactggcccaggcagggggacagggaaaatggagcccaagtagcctctggccagggacccaatgtcccgaggaatctgcctcccacccactgactcagggctcagactcagcctctattgtccagagcactggcttggcgtccagcaatgaaggctggagaatgcagcctggattcccctacacacacacacacacacacacacacacacacacacacacacacacacacacaggtgtctactgacctggagtgactggaatagcacctggggataaatgtgacaactgtgcattgaaccctgggtcagggacgttccaatggccaagagagtgacacagccaggaccctggtggacagccagaggggccacttcaggatggatgtggggagagtggaagaggcagggagtaatcctgggggacagcagggaggaggcacttcttccctatgtccaggagagggcaatagagggaagactgaggctgaagaattgacggctctggacccaggacagacagacagacagacagacagacagacagacagacacgcacacacacccatctctgtctagcaagcagcctcctaagatagctgttctccctatcatgacggtgtagccaccatcctgttgtatactaggagagaacttaacccacctgggggaaaatagctccccaagagctggcaccagtaccactgatggccctgcttcctctgagtgagatgcccaggaggaggagccctagggaagaagtcagggacagggaccaggataccactctgtcactgtgtgaccctcagcaagtcactaacccttggcctcatttttcctgtcttgtgaaagaggacaataattcctacttctcaagattgttttcaagataaaataacattagcattgtacaatgatgcaaatgcctcattaccattattccttaagttgttttccagctctaatgttgtttccaacattacatttaagaccttaggattctgtttcttgcttttgtcatatctcttcccaagtgtcatcactatatggatgttgagggcccccgatgacagtccctttggtaaggtcctcttttgaggaggggagggtacagggtggactcatctca

SEQ ID NO: 32505 - DNA, 3782 bp, Homo sapiens
tgggagaccggacgcgcgcggcctccgccgctcccagtcccgccagacccgatgccgggctggagaagcgcgggggccgacgcacctcggataggcgggggcaggggcaggggcagctctcctttaccctagagcggcgacagaagctcttcgggggatcagtggccaagggggcggacagatttgcacggcggattcctccgaagcaacccgtgtgaaagaagccaagcggcggctgcagcccgggccgcgatgggggtgacaccgcccgtggtcccgccccttcccgtggcccctcggagccacttccggcggcagcgtccgggctagttcccggcgcgagcggccgcgggccagtttctatctcctcatccagggcttgcgggcgaggcctgttttaagtctccagtaaccgagcggaggcccggcaggcgcgacccgggctgcgtacgtcagagctgcctccgaagtggtaaaatgtgctgcgagaagtggagccgcgtggcggaaatgtttctcttcattgaggagcgggaggattgtaagatactgtgcctttgctccagggcatttgtggaggatcgaaaattgtacaatttgggattaaaaggctattacatcagagacagtggcaacaattcaggagaccaggcgacagaagaagaggaaggtggttattcctgtggtactgcagaatcacatgacagcaaaggcataggcctggatgaaagtgaacttgattctgaggctgaactcatgagaagtatgggattgccacttcaatttggtaggataactgcacataaggattttgaggtatctatgaatactagaaataaagttaaaataaaaaagaaaaaacatcaaaagaaatacttagatgaaattgtgcaagaatcttggagaaaagaatatgaagaagacgacattttggcttcagatgatccatcttcaattgaacagtatgagaacaccagaacatatgaacttcaaagcaaaaaagatactgagacagaaaatcctccagttgaaaacacattatctccaaagctagaaattacagagaaatgggaaaagtattggaatgaatatggaggaggactattgtggcaaagttggcaagaaaaacatccgggtcaagcactatcttctgaaccttggaactttcctgatacaaaggaagaatgggagcaacattatagtcaactttattggtattatttggaacaatttcagtattgggaagctcagggttggacttttgatgcctcgcaaagctgtgatacagatacttacacatctaaaacagaagctgatgacaagaacgatgaaaaatgcatgaaagttgacttagtatcttttccatcttcacctattatggttgataatgatagctctggtacaagtgataaggatcatagtgaaatacttgatggaattagtaacataaaactgaattcagaggaagtaacacagagccaattagattcctgtacaagtcatgatggtcatcaacagctaagtgaagttagtagcaaaagagagtgccctgcttccggccaaagtgaaccacgtaatggaggaaccaatgaggaaagcaactcatcggggaatacaaacacagacccaccagctgaggattcacagaagtcttcaggagcaaacacaagcaaagacagaccacatgccagtggtactgatggagatgaaagtgaggaagacccacctgagcataagccaagcaaactgaagaggagccatgaactggacattgatgaaaacccagcttcagactttgatgacagtggttcccttctaggattcaagtatggctcaggacaaaaatatggtggaatcccaaatttcagtcatcggcaggtcaggtatttagagaagaatgtgaagcttaagtctaagtacctagacatgcgcagacaaataaagatgaaaaacaaacacatcttctttaccaaagagtcagaaaaaccatttttcaagaaaagcaaaattctgagtaaggtagaaaaattcctcacatgggttaataaaccaatggatgaagaagcatcacaggaatcatcttctcatgacaatgtgcacgacgcttccacaagtagtgattcagaggaacaagacatgtctgttaaaaaaggtgatgacctactggagactaataatccagaacctgaaaagtgtcagagcgtatcttcagctggtgaacttgaaacagaaaactatgaaagagacagcttgctagcaactgttccagatgagcaggattgtgttactcaagaagtgccagactcccgccaggcagaaactgaagctgaagtgaaaaagaagaagaacaagaagaagaacaaaaaggtgaatggtctgcctcctgaaatagctgctgttcctgagctggcaaaatactgggcccagaggtacaggctcttctcccgttttgatgatgggattaagttggacagagagggctggttttcagttacacccgagaagattgctgaacacattgctggccgtgttagtcagtccttcaagtgtgacgttgtagtagacgcattctgtggagttggaggaaataccattcagtttgccttaacaggaatgagagtgattgccattgatatcgatcctgttaagattgcccttgctcgcaataatgcagaagtttatgggatagcagataagatagagttcatctgtggagatttcttgctgctggcttcttttttaaaggctgatgttgtgttcctcagcccaccttggggagggccagactatgccactgcagagacctttgacattagaacaatgatgtctcctgatggctttgaaattttcagactttctaagaagatcactaataatattgtttattttcttccaagaaatgctgatattgaccaggtggcatccttagctgggcctggagggcaagtggaaatagaacagaacttccttaacaacaaattgaagacaatcactgcatattttggtgacctaattcgaagaccagcctctgaaacctaactatgcagcagtgcgaggacaaaagatcatggagtggtcaaaatattcagatgagacatttggcatgtcttcctttattcactgatattttctacccatggtcttatatcaccgtatgaaatggaaacttacaggacttaaatatcagtgaaatattttgagatctttgaataattcctttagaggaattatacaaaattaatatatatgagtcctttgtaatttatttttttttgagacaggatctcacttttaccgcccaggctggagtgcagtgccatgatcacagctcactgcaggttcagccttctgagttcaagcaatccttctgtctcagtctcctcagtagctggggctttaggtgggcactgccacaccgtactaatttttgtattttttgtagagacgaggtcccaccatgttgcccaggctggtgtcaaactcctgggctcagtcagtccccccatctcaccctccccaagtgctggaattacaggcgtgagctactgtgcccagccttacggacatccttttgaattatctttttcactcatagaatatgaatacatttatttagactttttctagaactttcctgttttcatgtctttgcttcatctggaattggcttaacacccttttataaagtttgtgtttgtaaaatttccattgtgacatcaatacgcaatatattttgtaatataggagtttctatttttttattaaaatggcaatgaaagcaa

SEQ ID NO: 32506 - DNA, 2832 bp, Homo sapiens
ccgagcgggctgggggaggggagcgtggggccgacagttttgggggtgaaaaggcaaaaggcgggtgaaaggctgcctcccgagactctccttgcttggaattctgcccactctgcggagttagcagtcacgacctccagcacaggatgtggtaccacagattgtcccacctacacagcaggcttcaggacttgctgaagggaggagtcatatatccggcccttccacagcccaacttcaaaagcttacttcctttagctgtccattggcaccatacagcctccaagtctctgacttgtgcttggcagcaacatgaagatcattttgagctgaaatatgctaataccgtgatgcgctttgattacgtctggcttcgagaccactgccgctcagcatcgtgctacaactctaagactcaccagcgcagcctggatactgccagtgtggatttatgtatcaagccaaagaccattcgtctggatgagaccacactctttttcacttggccagatggtcatgtgactaaatatgatttgaattggctggtgaaaaacagctatgaagggcagaaacaaaaagtcatccagcctagaatactatggaatgctgaaatctaccagcaagcccaagttccatcggtagattgccagagcttcttagaaaccaacgagggactgaagaagtttctgcaaaactttctgctctatggaattgcattcgtagaaaatgtccctcccactcaagagcacacagagaagttggcagaaaggatcagcttaatcagagaaaccatttatgggaggatgtggtatttcacttcagacttctccagaggtgacactgcgtacaccaagctagctctggatcggcacactgacactacctattttcaagagccctgtggcattcaagtgtttcattgtcttaaacatgaaggaactggtggcaggacactgctagtagatggattctatgcagcagaacaggtacttcaaaaggcacctgaggaatttgaactcctcagtaaagtgccattgaagcatgaatatattgaagatgttggagaatgtcacaaccacatgattgggattgggccagtcttaaatatctacccatggaataaagagctgtatttgatcaggtacaacaactatgaccgggctgtcatcaataccgttccttatgatgtcgtccatcgctggtatacagcacaccggactctaacgatagagttgaggagacctgagaatgagttttgggtcaaactaaagcctggcagggtcctatttatagacaactggcgtgtcctacatggcagggaatgcttcactggctaccgccaactgtgtggctgctatttaacaagagatgatgtattaaacactgctcgcctcttggggcttcaggcttaaaattgacagcatctggattatgaatacacctggcaccctggctaccagaatttcatatgggcagaataatattgtgtcaaactctacttcagattgtctccttatcccatcccacaaaacagaatctgtccgtttctctagtaagggagacttgttggagaggcgggactctgagttatctaatgtcagacatctagtggggcagctctcttcctcatgttataacatggatccacttgtttgatttaaaccttttaatataattttggtcagtctccttcagaaatataatctccatattgataggaaagcaataattgccatgaggtaacgatttttttcccaagtagatcagttagaaagaaatgcattctagaaataacaaaaatcctgataaagcaacaatttgcaaaatgtttggtcttaggacaccttaacactcttaaaagttattgaaggccccaaggagttcttgggtgtgggttctatctattgatactaattattttaggtattaagactgagaaatatttaaagctcaagaagaacacagaagcacacatccctcagctatgagagagatgacataaccatatgtcatgtagcctctggaaaagtcctctgtatcctcatgagataacgagagggggaaaaaaagctactactgcctttgtaacttccacttagcctactacagggctatgcacatcttagtttccaaaagtctgcttaatttcaaaagaaaaatgcctaattgaatgtaactcatcttggtgttattatacaaaataatttttaatctgcagacccacgaaaagggtctcagggactcctccaggggtcttcagaccatactttgagaacccatgggctagcgactaccttgagacagtcctttacctaggcctgtggattaaagggtttagctgaaaccctagattcttctctgtagtctaatagaactccaaacattgtaagaattgcttggtagcataagctcagggataaggtgggaattgagttcaaatatagtgttttatcttccacacaaatcatctctataggagttaaattaggaagtcacaacagcgcctgttgaacaaactcatcagtgtggtaatcctatgagggataattgcagaaaggttttagagacttgtgaggttccatatgataattctttacacctccccccccaagagaaagtacacagggctattctgtaatattgttcagggaaatcagcatgatagatgctgtgcctccagagagttctctggagattactacccaaatgtgtattttggcaatttggtggtatttaggatgtaatatgttttcctccatttctgctaattttctctctctctctctcataacatactatacatgctaattgccaagatttgaatgagtcaaa

SEQ ID NO: 32507 - DNA, 1248 bp, Homo sapiens
ggcgggtgaaaggctgcctcccgagactctccttgcttggaattctgcccactctgcggagttagcagtcacgacctccagcacaggatgtggtaccacagattgtcccacctacacagcaggcttcaggacttgctgaagggaggagtcatatatccggcccttccacagcccaacttcaaaagcttacttcctttagctgtccattggcaccatacagcctccaagtctctgacttgtgcttggcagcaacatgaagatcattttgagctgaaatatgctaataccgtgatgcgctttgattacgtctggcttcgagaccactgccgctcagcatcgtgctacaactctaagactcaccagcgcagcctggatactgccagtgtggatttatgtatcaagccaaagaccattcgtctggatgagaccacactctttttcacttggccagatggtcatgtgactaaatatgatttgaattggctggtgaaaaacagctatgaagggcagaaacaaaaagtcatccagcctagaatactatggaatgctgaaatctaccagcaagcccaagttccatcggtagattgccagagcttcttagaaaccaacgagggactgaagaagtttctgcaaaactttctgctctatggaattgcattcgtagaaaatgtccctcccactcaagagcacacagagaagttggcagaaaggatcagcttaatcagagaaaccatttatgggaggatgtggtatttcacttcagacttctccagaggtgacactgcgtacaccaagctagctctggatcggcacactgacactacctattttcaagagccctgtggcattcaagtgtttcattgtcttaaacatgaaggaactggtggcaggacactgctagtagatggattctatgcagcagaacaggtacttcaaaaggcacctgaggaatttgaactcctcagtaaagtgccattgaagcatgaatatattgaagatgttggagaatgtcacaaccacatgattgggattgggccagtcttaaatatctacccatggaataaagagctgtatttgatcagattattcaaagaaaaacaaaacacggtcaacaggcagtggaactcctcactccaatgtgatattcctgagagaatattgacttatcgtcacttcgtctctgggacaagtattgaacataggggaagccttatataaaattgttcaataaacaaaagatgtctttaa

SEQ ID NO: 32508 - DNA, 8438 bp, Homo sapiens
ggcggcagcgggtcggtgtagaaaatggcgctggtgcagcggctcgggcctctccccgcggcgctgcggagggcttgaggctcgcgagcctccttcgccgcgccccacttgctcgtgcactttacacacatgagagaattggaagctaaagctaccaaagacgtagaaagaaatcttagcagggatttagtgcaagaagaagaacagttgatggaagaaaagaaaaagaaaaaagacgacaagaaaaagaaggaagctgctcaaaagaaggccactgaacaaaaaatcaaagtgccagaacagataaagcccagtgtaagccagcctcagcctgccaactctaataacggcacttccacagcaaccagcactaataataatgccaagcgagctacagccaacaatcagcagccacagcagcagcagcaacagcagcagccgcagcagcagcagccacagcagcagccacagccgcagccgcagcagcagcagccacagcagcagccacaggccttgcctcggtatcctcgtgaagtacctccacgatttcgccaccaggaacacaaacagcttctaaagaggggtcagcattttcctgttatagcagcaaaccttggatctgctgttaaggtgttaaacagccagtcagaaagcagtgctttaacaaatcaacagccacaaaataacggagaggtgcagaacagcaaaaaccagtcagatataaaccacagtacttcaggatcccattatgaaaattcccagcggggacctgtgtcttctacaagtgattctagcacaaactgtaagaatgctgttgtaagtgacttgtcggaaaaagaagcatggccctcagcccctggcagtgatccggagttggcttcagaatgtatggatgctgattctgcctccagttctgaatcagagagaaacatcactatcatggcttcagggaacacaggtggtgaaaaagatggccttcggaatagcactggacttggttcccaaaacaagtttgtagttggtagcagcagcaataatgtgggccatggaagtagtactgggccatggggtttttcccatggagccataataagcacatgtcaggtctctgtggatgctcctgaaagcaaatctgaaagtagcaacaatagaatgaatgcttggggcactgtaagttcttcatcaaatggagggttaaatccaagcactttgaattcagctagcaaccatggtgcctggccagtattagagaacaatggacttgccctaaaagggcctgtagggagtggtagttctggcattaatattcagtgcagtactataggccagatgcctaacaatcagagtattaactctaaagtgagtggtggttctacccatggtacctggggaagccttcaggaaacttgtgaatctgaagtaagtggtacacagaaggtttcattcagtggtcaacctcaaaatattaccactgaaatgactggaccaaataacactactaactttatgacctctagtttaccaaactccggttcagtgcagaataatgagctgcctagtagtaacacaggggcctggcgtgtgagcacaatgaatcatcctcagatgcaggctccatcaggtatgaatggcacttccctttctcaccttagcaatggagagtcaaaaagtggaggctcttatggtactacatggggtgcctatggttctaattactctggagacaaatgttcaggccctaatggccaagctaatggtgacactgtgaatgcaactctaatgcagcctggcgtaaatggtcctatgggcactaactttcaagttaacacaaacaaaggaggtggtgtgtgggaatctggtgcagcaaactcccagagtacatcatggggaagtggaaatggcgcaaattctggaggaagtcgaagaggatggggaacccctgcacaaaacactggcactaatttacccagcgttgagtggaacaaactgcctagcaatcagcattccaatgatagtgcaaatggcaatggtaagacgtttacaaatggatggaaatctactgaggaagaggatcagggttctgccacatctcagacaaatgagcaaagcagtgtgtgggccaaaacaggaggtacagtggagagcgatggtagtacagaaagcactggacgccttgaggaaaaaggaactggggaaagtcagagtagagacagaagaaaaattgatcagcacacattactccaaagcattgtaaacagaactgacttagatccacgtgtcctgtccaactctggttggggacagactcctattaagcagaatactgcctgggatacagaaacatcacctagaggggaacgaaagactgacaatgggacagaggcctggggaagctctgcaacacagacttttaactcaggggcatgtatagataagactagccctaatggtaatgatacctcatctgtatcagggtggggcgatcccaaacctgctctgaggtggggagattccaaaggctcaaactgccagggggggtgggaagatgattctgctgctacaggaatggtcaagagcaatcagtgggggaattgcaaagaggagaaggctgcatggaatgactcgcaaaagaataaacagggatggggtgatggacaaaaatcaagccaagggtggtctgtttctgccagtgataactggggagaaacttcaaggaataaccattggggtgaggccaataagaaatccagctcaggaggtagtgacagtgacaggtccgtttccggttggaacgaacttggtaaaactagttctttcacttggggaaacaacataaatccaaataattcatcaggatgggatgaatcttctaaacctactccttcccagggatggggagaccctccaaagtctaatcagtctctaggttggggagattcgtcaaagccagtcagctctccagactggaacaagcaacaagacattgttggatcttggggaatcccaccagctacaggcaaacctcctggtacaggctggctggggggacctataccagccccagcaaaagaagaagaacccacaggctgggaggaaccatccccagaatctatacgtcgcaaaatggagattgatgatggaacttcagcttggggagatccaagcaaatacaactacaaaaatgtgaacatgtggaacaaaaacgtcccaaatggcaacagccgttcagaccagcaagcacaggtacatcagctgctaacgcctgcaagtgccatctcaaacaaagaggcaagcagtggctctggctggggtgagccctggggggagccttctactccagccacaactgtggataatggtacttcagcatggggtaagcccatagacagtggtcccagctggggggaacccattgctgcggcatccagcacatccacgtggggctccagctctgttggtccacaagcattaagcaaatctgggccaaaatctatgcaagatggctggtgtggtgatgatatgccattgcctggaaatcgccccactggctgggaagaggaagaggatgtggagattggaatgtggaatagtaattcatctcaagagcttaactcatctttaaattggccaccatatacaaagaaaatgtcatcgaagggtctgagtggcaaaaaaaggagaagggaaaggggaatgatgaaaggtggaaacaaacaagaagaagcgtggataaatccatttgttaaacagttttcaaacatcagtttttcgagagactcaccagaggaaaatgtacaaagcaataagatggacctttctggaggaatgttacaagacaaacgaatggagatagataaacatagcctaaatattggtgattacaatcgaacggtcgggaaaggccctggttctcggcctcagatttccaaagagtcttccatggagcgcaatccttattttgataaggatggcattgtagcagatgaatcccaaaacatgcagtttatgtccagtcaaagcatgaagcttcccccttcaaatagtgcactacctaaccaggcccttggctccatagcagggctgggtatgcaaaacttgaattctgttagacagaatggcaatcccagtatgtttggtgttggaaacacagcagcacaaccccggggcatgcagcagcctccagcacaacctcttagttcatctcagcctaatctccgtgctcaagtgcctcctccattactctcccctcaggttccagtttcattgctgaagtatgcaccaaacaacggtggcctgaatccactctttggccctcaacaggtagccatgctgaaccagctatcccagctaaaccagctttctcagatctcccagttacagcgattgttagcgcagcagcaaagggcgcagagtcagagaagcgtgccttctgggaaccggccgcagcaagaccagcagggtcgacctcttagtgtgcagcagcaaatgatgcaacaatctcgtcaacttgatccaaacctgttggtgaagcagcagactccaccatctcagcagcagccactccatcagccagccatgaagtctttccttgacaatgtcatgccccacactacacctgagctgcaaaaagggccatcaccaataaatgctttcagcaacttccctataggcttgaactcaaacttgaatgtaaatatggatatgaacagtattaaagagccacagtcaagactaaggaagtggacgacagtggacagcatttctgtgaacacatctttggatcaaaactccagcaaacatggtgctatttcaagtggtttcaggctggaagagtctccatttgttccctatgactttatgaacagcagtacttcaccagccagtcctccaggttcaataggagatggctggccacgtgccaaatcgcctaacggctctagcagtgttaattggccaccagaatttcgtcctggtgagccatggaaaggttatccaaacattgaccctgaaactgacccttacgtcactcctggcagtgtcataaacaatctttcaattaatactgtgcgggaagttgaccacctcagggacaggaacagtgggtcatcctcatccttgaacaccacgctgccttcaactagtgcctggtcatccattcgtgcctccaactacaacgttcccctcagcagtacagcacaaagcacttcagccagaaatagtgattccaaattgacatggtctcctggttcagttacaaacacctctctggctcatgagctgtggaaggtccctttgccacctaaaaacatcactgctccgtcccgcccacctccgggactgactggtcagaagccacccttgtctacgtgggataattctccccttcgtataggtggaggatggggaaattctgacgccagatataccccaggttccagctggggtgagagcagctcagggagaataacaaattggcttgttctaaaaaaccttacacctcagatcgatggctcaactctgcgcactctgtgcatgcagcacggcccgctgatcacattccacctgaacctccctcacggaaatgctctggtccgctacagttcaaaagaagaggtagtgaaggcacaaaagtctctgcacatgtgtgtactggggaacactactattcttgctgagtttgccagtgaagaggagatcagtcgtttctttgcacaaagccagtctctgaccccttctcccggctggcagtctctcgggtccagccagagccggctgggctccctcgactgttcccactcattctccagccggaccgatctcaatcactggaatggtgctgggctgtcgggaactaactgtggagaccttcacggcacttcactctgggggaccccgcattattccacaagcctgtggggtcccccaagcagcagcgacccccgaggaattagcagcccatctcccattaacgcttttctttctgttgaccacctgggtgggggtggagagtccatgtaacagtgtagatgcagactcaccgaccgggacctcagacgcgagggaaaggagcactaagtggggctcgccgcctgcagccaggggccgcctgtgggaacagctattctctgcacattttccactttgttttccccaaaacatatcagtttgaatacttgaatcatgcaggccaatattataatgtgaaaaggtatctactctatttacactcccaaatagcgccatacatgctaaaccgtagagaatgagctcgcttgtgtctattcatcatgtttagcctttggattctttttttttttttccttctattcctccccaacccccccccccgcccctttttttctctcttgcaaaaccattttttgggctgataacgtatgagcttttccctttgcactgaatgatgttctctccgtctcatcggcagtatggggggcagctgtcccagtgtcaatgtttactcaagggtgttcttaggaggcgtgcgctctctactatgccttgatgttgcctaccttattgtggtatcgtggagtttaaaagatcaagttaggatgctgacttaggattattaatgaaagtgttgcaccagttttttcatgttgtaaaactaaagaatttcgctctgcagtttgaaaaactgtggccacagctgtgacttgcagcccacctgccacccaggacgggccctgcactttgaataggctttccattttgttttggaggttctcactttgaaccttcttgtttacagatttttttgtttgttttttgagaaaaaaaaatgtttactcttccatcatttaaaaaaaatgtaaaagacaaaaaaaaaatggaggatgatttaaaagatgctttctatctctgggaaaaaggagcagcatttggccatgttcttttgtttttctattcctgtcccaaatcaaagagcatggttctcaggaaaaccagttccccagtttaaaaaaaaaaaaaaaaattccttgtagtttcttagaggaaaaaaagaaaaaccccaacttttagcactgatactacatattgctctgttaaagaattttctctgccaaaaaaaaagaaaaaacaaaaaaacgcttaaagctggagtttgacattctgctttcagatgctgtctttttattagtgagtgatgatggtttgctaataatcaataggtaataattttttgtaatcccatcaagtggctccatatgtttctgctctctcgtgactgtgttaatgtttaactgttgtaccttaaagccgaaatcagtaactatgcatactgtaaccaaggtattgggcttacagagttgtttgttgtataaagaaaattttaaatgttgttgcaaactaacgagttacaccattttaaactttctttcctcccccctttttttgcccacaaatggtattataatgcttgcttagtcaaagaagagagactaaacaagggtaaaaattttaacagtacagaatttgccatcatatcattgccttgattctaactgtttgtgtcctaagatgcaaaagaagtcagtggcttttaactgtttacaaatagaatgtgattgtaaaatgtacagtttggttgtgtttgaattatgaaatttcttcagatataataaaccatgactttttggctgctcaacattaattgtctcctttttgtgaatttatttgtaggctcttttttataatgaaagtttcaaagttgctatgtatgagggttctcatagagcaaccgattaaaaatctaagcaaatatttgaacattttatctgaactcatcacaatttcaccctgaaataatgtgagaacaatgggaaactgtagcttgctccttcccaccctctctgagcatctttgggatcttgttgctcaaaactcttctgtgacttcatcttccccaccatttgtgcccatctcaagcctcagcaagaaaccatgtggaacatgaagcttaatgacttgacagtgtactagtgttaaactctcatacctctgttacaaagcgagaaacgccacacccggactggccttttcttcccccttcacggccctcgcttctccctgcaggagctcgggggcgaaacctgtgtatggatttcagtgtatgacttcagatcatgctccaacttgccaggtgtgagctaatgttgtcggacaccttactataagcaaatgttattcagtgcgttcaatgtatattgacttccatactggtttttccaaaaaccaaaggtagctttgaaaaaccatgtctggaaatgtttggagcgttaagctgattgaccttctgaccttggggctttgagtagtatataattcataactgcgttaattgtattgttaaagtgtttgggagttttttgcgcttgttatgtggaaataaagtgtttgatttaaaattttttaaa

SEQ ID NO: 32509 - DNA, 2398 bp, Homo sapiens
taaatatggatatgaacagtattaaagagccacagtcaagactaaggaagtggacgacagtggacagcatttctgtgaacacatctttggatcaaaactccagcaaacatggtgctatttcaagtggtttcaggctggaagagtctccatttgttccctatgactttatgaacagcagtacttcaccagccagtcctccaggttcaataggagatggctggccacgtgccaaatcgcctaacggctctagcagtgttaattggccaccagaatttcgtcctggtgagccatggaaaggttatccaaacattgaccctgaaactgacccttacgtcactcctggcagtgtcataaacaatctttcaattaatactgtgcgggaagttgaccacctcagggacaggaacagtgggtcatcctcatccttgaacaccacgctgccttcaactagtgcctggtcatccattcgtgcctccaactacaacgttcccctcagcagtacagcacaaagcacttcagccagaaatagtgattccaaattgacatggtctcctggttcagttacaaacacctctctggctcatgagctgtggaaggtccctttgccacctaaaaacatcactgctccgtcccgcccacctccgggactgactggtcagaagccacccttgtctacgtgggataattctccccttcgtataggtggaggatggggaaattctgacgccagatataccccaggttccagctggggtgagagcagctcagggagaataacaaattggcttgttctaaaaaaccttacacctcagatcgatggctcaactctgcgcactctgtgcatgcagcacggcccgctgatcacattccacctgaacctccctcacggaaatgctctggtccgctacagttcaaaagaagaggtagtgaaggcacaaaagtctctgcacatgtgtgtactggggaacactactattcttgctgagtttgccagtgaagaggagatcagtcgtttctttgcacaaagccagtctctgaccccttctcccggctggcagtctctcgggtccagccagagccggctgggctccctcgactgttcccactcattctccagccggaccgatctcaatcactggaatggtgctgggctgtcgggaactaactgtggagaccttcacggcacttcactctgggggaccccgcattattccacaagcctgtggggtcccccaagcagcagcgacccccgaggaattagcagcccatctcccattaacgcttttctttctgttgaccacctgggtgggggtggagagtccatgtaacagtgtagatgcagactcaccgaccgggacctcagacgcgagggaaaggagcactaagtggggctcgccgcctgcagccaggggccgcctgtgggaacagctattctctgcactttgaataggctttccattttgttttggaggttctcactttgaaccttcttgtttacagatttttttgtttgttttttgagaaaaaaaaatgtttactcttccatcatttaaaaaaaatgtaaaagacaaaaaaaaaatggaggatgatttaaaagatgctttctatctctgggaaaaaggagcagcatttggccatgttcttttgtttttctattcctgtcccaaatcaaagagcatggttctcaggaaaaccagttccccagtttaaaaaaaaaaaaaaaaattccttgtagtttcttagaggaaaaaaagaaaaaccccaacttttagcactgatactacatattgctctgttaaagaattttctctgccaaaaaaaaagaaaaaacaaaaaaacgcttaaagctggagtttgacattctgctttcagatgctgtctttttattagtgagtgatgatggtttgctaataatcaataggtaataattttttgtaatcccatcaagtggctccatatgtttctgctctctcgtgactgtgttaatgtttaactgttgtaccttaaagccgaaatcagtaactatgcatactgtaaccaaggtattgggcttacagagttgtttgttgtataaagaaaattttaaatgttgttgcaaactaacgagttacaccattttaaactttctttcctcccccctttttttgcccacaaatggtattataatgcttgcttagtcaaagaagagagactaaacaagggtaaaaattttaacagtacagaatttgccatcatatcattgccttgattctaactgtttgtgtcctaagatgcaaaagaagtcagtggcttttaactgtttacaaatagaatgtgattgtaaaatgtacagtttggttgtgtttgaattatgaaatttcttcagatataataaaccatgactttttggctgctcaac

SEQ ID NO: 32510 - DNA, 9632 bp, Homo sapiens
aggctgctgatcaaaaaaccaaagtgccagaacctactaagacctgttcaagccagccccaacctgccggtaccagtaccagtacttccaccagcactatctcaagcagcaacaatggcaaacgtgcatctgccagtggccagcagccagctgcatcccgttacctgcctcgtgaggtgcctccacgcttccgccagcaagaacagaagcagctattaaagagaggccagccattgcctacggggactctaaccagtgtgagcccaacccagggtgctgggcctgcaggggtaagcccacctcccctacctggagccggaacacagcatcatcccagtaagctccaaccagatctcagtcatagtggattggcagatcattatgaaaattcccactggggacagcagcctacttacagaagcgaagccaactgcagctgggataaagtgataatagataggactgacaaggaggcgtggccttccatcacaggaacagagactgaatctgcctcagaatgtactacagacactgactctgcctccaactgtggctcagagaacagtagcatggctacagggagtgcccagggcaacttcactggacataccaagaagacaaatggcaataatggcaccaatggcgcactcgtccaaagcccttctaatcagagtgcccttggagcagggggagcgaacagtaatggaagtgcggccagagtgtggggtgtagccacaggctccagctctggcctggctcactgctctgtcagtggtggggatggaaaaatggacactatgattggagatgggagaagtcagaattgctggggtgcttccaactccaatgctggcattaatcttaaccttaatcctaatgccaacccagctgcctggcctgtacttggacatgaaggaaccgtggcgacaggcaacccttccagtatttgcagtccagtcagtgccataggtcaaaatatgggcaaccagaacgggaacccaacaggcactttaggtgcttggggaaacttgctgccacaagagagcacagaaccacaaacgtccacttctcagaatgtgtctttcagcgcacaacctcagaaccttaacactgatggaccaaataacactaaccccatgaactcttcacccaaccctatcaatgcaatgcagacaaatggactgccaaactggggcatggctgttggtatgggggccatcatcccgccccacctgcaaggccttcctggtgctaatggatcatcagtttctcaagtcagtgggggcagtgctgaaggaataagcaattctgtgtggggactgtccccaggtaaccctgccacaggaaatagcaattctgggttcagtcaggggaatggagacactgtgaactcagcattaagtgctaaacaaaatggatccagcagtgctgtgcaaaaggaaggaagtggaggaaatgcttgggattcaggacctcctgctggtcctggaatactcgcctggggaaggggcagtggcaacaatggcgttggtaatatccattcaggagcttggggccaccccagccgaagcacctctaacggtgtgaatggggaatggggaaagcccccaaaccagcattccaacagtgacatcaatgggaaaggatcaacagggtgggagagtcctagtgtcaccagccagaaccctaccgtacagcctggtggtgaacacatgaactcctgggccaaagcggcatcttctggaactacagcaagtgaaggaagtagtgatggttctggcaaccacaatgaaggaagcactgggagggaaggaacgggagaaggccgaaggcgagataaagggattatagaccaagggcacatccagttgccaaggaatgatcttgacccaagagttctgtctaatactggttggggacagactcctgtaaagcaaaacactgcctgggaatttgaagaatcccctaggtctgaaaggaaaaatgacaatgggacagaggcctggggttgtgcagctactcaggcttcaaactcaggggggaagaacgatgggtccatcatgaacagtacaaatacctcttcagtatctgggtgggtcaacgcgccacctgccgctgtgccagcaaacacaggttggggagacagcaacaacaaagcgccaagtggcccgggggtttggggggactcgataagctctactgctgttagtactgctgctgctgccaagagtggccatgcttggagtggggccgcaaatcaggaggacaagtcacccacctggggtgagcctccaaagcccaaatcccaacactggggagatggacaaagatcaaatccagcctggagtgcaggagggggagattgggcagattcatcgtctgtccttggacacttgggggatgggaaaaaaaatggatctggatgggatgctgacagtaataggtcagggtctggttggaatgacaccacgagatctgggaacagtggctggggcaacagcacaaatacaaaggccaatccaggtacaaactggggggagactttaaaacctggcccccaacagaactgggctagcaaaccccaagacaacaatgtgagtaactggggaggagctgcttctgtgaaacagacaggaacagggtggatcggggggccggtaccggtcaaacagaaggacagcagtgaagcaactggctgggaagaaccctctccaccgtccattcgccgcaaaatggaaattgatgatggtacctcagcttggggggacccaagcaactataacaataaaactgtaaacatgtgggatagaaacaacccggtcatccagagcagtaccacgaccaataccaccaccaccaccaccactaccacgagcaacaccacacacagggtcgagacgccgcccccgcaccaggccggtactcagctgaatcgatcaccgttgcttggtccaggtaggaaagtttcatcaggctggggagaaatgcctaatgttcactcaaagactgaaaactcttggggagaaccatcctccccttctaccctggtggataatggcacagcagcatgggggaagccacccagcagtggcagcgggtggggagatcaccctgcagagccgccggtggcatttggaagagctggcgcacctgttgctgcctcagccctgtgcaaaccagcttcaaaatctatgcaagaaggctggggcagtggtggggatgaaatgaacctcagtaccagccagtgggaggatgaagaaggggacgtgtggaataatgctgcttcccaagaaagcacctcctcctgcagctcctgggggaacgcccccaaaaaaggacttcaaaagggcatgaagacgtctggcaagcaggatgaggcctggatcatgagccggctgatcaaacaactcacagacatgggcttcccgagagagccagctgaggaggccttgaagagtaacaatatgaatcttgatcaggccatgagcgctctgctggaaaagaaggtggacgtggacaagcgtgggctgggagtgaccgaccataatggaatggccgccaagcccctcggctgccgcccgccaatctccaaagagtcttccgtggaccgccccacctttcttgacaaggatggcggcctcgtggaagagcccacgccttcaccgttcttgccttccccaagcctgaagctccccctttcacacagtgcactccccagtcaggccctgggtgggattgcctccgggctgggcatgcaaaacttgaattcttctagacagataccgagtggcaatctgggtatgtttggcaatagtggagcagcacaagccaggaccatgcagcagccgccacagccaccagtgcagcctcttaactcttcccagcccagtctccgtgctcaagtgcctcagtttctatcccctcaggttcaagcacagcttttgcagtttgcagcaaaaaacattggtctcaaccctgcactattaacctcgccaattaatcctcaacatatgacgatgttgaaccagctctatcagctgcagctggcataccaacgtttacaaatccagcagcagatgttacaggcccagcgtaatgtgtccggatccatgagacaacaggagcagcaagttgcgcgcacaatcactaatctgcagcagcagatccagcagcaccagcgccagctggcccaggccctgctcgtgaagcagccaccaccgccaccgcccccgccgcacctgtctctgcacccctctgcaggcaaatcggccatggacagcttcccctcgcacccacagactcccggcctacctgacctgcagaccaaagagcagcagtcttcacccaacacctttgctccttaccctctcgctggactgaacccaaacatgaatgtcaacagcatggacatgaccggtggcttgtcggtgaaggacccatcccagtcccagtcacgcctcccccagtggacgcaccccaactccatggataacttgcccagtgccgcttcccccctggagcagaaccctagcaagcatggtgctatccctggaggtctaagcattgggcctccaggtaagtcctccattgatgactcctatggccggtacgatttaatccagaacagtgagtcaccagccagtcctcccgtagctgttccccatagctggtcacgtgccaaatctgacagtgataaaatctcaaatggctctagcatcaactggcccccagaattccatccgggagttccatggaaaggactgcagaatattgaccctgagaatgaccctgacgtcactcctggcagtgtccccactgggcctaccatcaacaccaccatccaggatgtcaaccgctacctcctcaagagtggaggtaaactgtcagacatcaaatcgacgtggtcctctggccctacctcccacacgcaagcctctctgtctcatgaactatggaaggtgcccagaaacagtactgcacccacgaggccacctccagggttaaccaatcccaagccctcctccacctggggtgccagccccctcggctggaccagctcctactcctcgggttctgcctggagcaccgacacctcaggaagaaccagcagctggctcgttcttcgaaacctcactccccagattgatggttctacactgcggacattgtgtttgcaacatgggcctcttatcacattccacctgaatctgactcaaggcaatgctgtggtccggtacagctccaaggaggaggctgccaaggcccagaagtctctgcacatgtgcgtcctgggaaacactaccatcctggccgagttcgctggtgaagaagaagtgaatcgcttcttagcccaaggccaggcgctgccacccacttccagctggcagtccagcagcgcgtccagccagccgcggctcagcgcagcgggcagctcccatggcctggtacgcagcgacgctggccactggaacgccccgtgcctgggtggcaaggggagcagtgagctgctgtggggcggggtgccccagtactccagcagcctgtggggcccgcccagcgccgacgacagcagggtgataggcagccccacgccgctaaccaccctgctgcctggggacctgctcagcggggagtccctgtaggctctgccatcatcagcaccaggagagccgacccctcccgggacccctcccggctgggcggccccacagacccgctggaacccagcagcggccgcccttttgagtacctctgtccaggactgaagacgaaccttggccgcagtccttgcgaactgttcgcaaaacagtgcgggctgcggtgggtcagcgtcacatgctaatgacaggatgttcctcgtagctttttattttgtgcgtcttatgtttgtatagtgtgttgtcattttgattttttttttttttttaagtataaaagctgcttagaatagttctatcatgaagggcacttttcagattgtgggctggaaagggttattttatctgtgggggagggagggagacgtgaagcctatttaaaatgagcctgtgacgattatgcacatgaccagaggcggccggtaatcagggcagagtctggtgtggaccgccgggcgcagagcggctccgcggcgggagctgagcggaaggcgcgggctgcgatctgctctctgttcccctggatccgcctatgcacattacccttgtttcattactttttcatgtcatttttttatcccaaaaaatattttttaaaagttaaaaaaagacatatcaaacatgcaaatacttgaatccagcaggccaatagtgaaatgtgaacactttctaattctacacttccaggttgacatcagtacacagaaacaggctctaggaaaaatttctaagttcatagcctacgtgtgtgtatgtgtgcgtgttgaaacagaagtgtgtgtgtgtgtgcatgtgtggcgcgtgctcctgcacggcgtgcagttttctgtgtttgtgtgtttgaaagcgtgtgaggatttaactgtgggttttcccttgtattcagtatacgctttttttttggcgcattggtcaaacggttgttattattagcttctaactttgcactgagtgtcctcgcccttcctttagctaatcctatacattacagagaattcctaggacagggctggcgacaattcatgtgtaaatgtttactcaaggactctgtgactgcgtttaaaaagtacagtgtatatctctggagaaataacatgtatacctacctttagcagctttttattgtggactaatgcaagaaaattattaccagagtattgcaccatttttccatttggaatataaagttaaagagaaaaaaaaaaaaaactgttgttgaactgtggccatagatacttgtaaagaatggatggttccgtggaaggaacagaaacaagcacttgggcgtgggttgtgactgcttttgggggagcctggggtttgggctcccacctgtttacagacctttttttctccttcagactttaaaattttaaaaatttaaaaaggaattaaaaaaaaaaaaagacttccgtcgtaaagaaacctattttcagaatgcagatgcgttccttcagagctctgggacgggacagtgttgttccctcggccatcgtcgtggactctgtcgattgctttcgccccttcgtcaaggtgacaggcgttgtggccactgtcttgcacatgccggacgcgctctcaggaaagccagggctcccgagggcagctccacaccatttcatgtatttttaaacccaactcctagcactgaagatgttatttaaaaaaaaaaaaaacaaaacaaaacaaaaaaatgaaaaaaaagaaaaagaggaaaaaaaaacacaaagaagaaaaatacctaatctctaatgtgtagcagttacatatttaccaaataatggactcaaaagaaatagatgtttgaagagtgctttatatattaaaaattgctttatgttttaaaaatgatcaatgttttgattgttttgcaaggaagaaagacaatggaataacataccttcaagtatgttttaaaaaatatatatatgaacattgtgctccctgcctgcttgatcaggaaacttgtgcattacatttttttaattagctttttaatggttttatcaaaacaaaaaaaatacaaaaaaaaaaaaaaaagtcctgcaagactgcagatccacaaaagctggttttatagaggatcatgaactatgcacaaactgggttcaagactttttttctcaagtttagtaggatatttagaaaaaccaaccttcctcagagtgactgcatctcattgccattacatgcgttctatatattcgatggacatacacctgcgtatgtatatccaatatgtgtgcgtgtgagcatgcgtgtgcgtatgtgcgtccgacataccacttcccgtgctgccggcgagcattgagttgtagaaaaactgttgttttaaaattggggatggaagtcaagaatatgtttgtttgtttttgggttttgttgggtttgaggggttttttgtttgtttgttttttgttttttttaccttttattttgaacttaatatgtctgtaactctgagattaaacaacaagttcgtggctcttaatgttttcctcatagaatgtgactgttgaagaacatgcatcgaaagttgctttcgaaagtacaacgctttattgaatcttaataaattgcaatttttttcttggctgttcaaagtaatgtgtttttcatttttcaaaagacactatggatgtctactttgcacgctgcgattgggagagctgtcccgctgcatgcgttccctctgtaatttcctcagagctcacatacgtacctctctcacgagtgaactcagattttccattgttttgctttattctatcatttgctttgtggttttgctgtaaatattgaaatcttaatcatcatcgagaggcacagccaagctttccagctctccacccccgtggcccatccaagtctgttcatctggtaacttctgttgtctgggacggcagcaagaagatgccggggcttgcctggagtcctggcagaggagtgccactcacttttgcctagggtccagttggggcttaaaaaatatttggagagaagagtaatgaggattttttgtgtttcctagacattttatgcatctatttttgtaaaatcaccttcgctaactttcaccaagcactttgagcacagtggaacttcagaagcacaaccagcctaaccccagaatctcaggtggcacagctagaaattgagtcccttcctaggacactggccgtggccttcagggtgaccagtcagtgccaccgggttggcattggtgttacagacaggcctctgaagacaaaccgagcaccccagcggcccctcaaactaagcaaggatcttttttctgtctgcgctccctggggcaaggtcaaaggtggacccgcccactgtgggtcaattccttcgaaaagatgggacccgcacccccgccacaggctggcccccccccacccatggggaaggtggtgtgctgctggctctgaccatactcttttggaaattgagaaggaaagcattgagtgggacctaatccggagaagaaattaaagaccagaaaaagaaggaagctgggaatgaaactcaaaatgcacttgaacctggaagcggcaaccctcagctctgcgcggccgagcctcagcaagagttcgttttgtgcctgagttactactacaggggcaaactgtacccgtgcctgtgcgctgggagaacaaggtcagcgcccaagggtgtgcaaaggatgtggcaggcttcatggaggaggtggcatttgccctgggcctgggagaccaggttggattttgacagactgggaactcgggggacaggagggcagcacagtgtaagctaaagccctgtgtagggaccccacgcaaagacctcgtgggcctgggtgtccagggcaccatttccacccatgggtgaaaaagaggcttgaggaagacaacaggttcttcacctgcatctgtggatatatatttttttaagtttattaaatttttttttaaatggcagtttcagacctgc

SEQ ID NO: 32511 - DNA, 9740 bp, Homo sapiens
aggctgctgatcaaaaaaccaaagtgccagaacctactaagacctgttcaagccagccccaacctgccggtaccagtaccagtacttccaccagcactatctcaagcagcaacaatggcaaacgtgcatctgccagtggccagcagccagctgcatcccgttacctgcctcgtgaggtgcctccacgcttccgccagcaagaacagaagcagctattaaagagaggccagccattgcctacggggactctaaccagtgtgagcccaacccagggtgctgggcctgcaggggtaagcccacctcccctacctggagccggaacacagcatcatcccagtaagctccaaccagatctcagtcatagtggattggcagatcattatgaaaattcccactggggacagcagcctacttacagaagcgaagccaactgcagctgggataaagtgataatagataggactgacaaggaggcgtggccttccatcacaggaacagagactgaatctgcctcagaatgtactacagacactgactctgcctccaactgtggctcagagaacagtagcatggctacagggagtgcccagggcaacttcactggacataccaagaagacaaatggcaataatggcaccaatggcgcactcgtccaaagcccttctaatcagagtgcccttggagcagggggagcgaacagtaatggaagtgcggccagagtgtggggtgtagccacaggctccagctctggcctggctcactgctctgtcagtggtggggatggaaaaatggacactatgattggagatgggagaagtcagaattgctggggtgcttccaactccaatgctggcattaatcttaaccttaatcctaatgccaacccagctgcctggcctgtacttggacatgaaggaaccgtggcgacaggcaacccttccagtatttgcagtccagtcagtgccataggtcaaaatatgggcaaccagaacgggaacccaacaggcactttaggtgcttggggaaacttgctgccacaagagagcacagaaccacaaacgtccacttctcagaatgtgtctttcagcgcacaacctcagaaccttaacactgatggaccaaataacactaaccccatgaactcttcacccaaccctatcaatgcaatgcagacaaatggactgccaaactggggcatggctgttggtatgggggccatcatcccgccccacctgcaaggccttcctggtgctaatggatcatcagtttctcaagtcagtgggggcagtgctgaaggaataagcaattctgtgtggggactgtccccaggtaaccctgccacaggaaatagcaattctgggttcagtcaggggaatggagacactgtgaactcagcattaagtgctaaacaaaatggatccagcagtgctgtgcaaaaggaaggaagtggaggaaatgcttgggattcaggacctcctgctggtcctggaatactcgcctggggaaggggcagtggcaacaatggcgttggtaatatccattcaggagcttggggccaccccagccgaagcacctctaacggtgtgaatggggaatggggaaagcccccaaaccagcattccaacagtgacatcaatgggaaaggatcaacagggtgggagagtcctagtgtcaccagccagaaccctaccgtacagcctggtggtgaacacatgaactcctgggccaaagcggcatcttctggaactacagcaagtgaaggaagtagtgatggttctggcaaccacaatgaaggaagcactgggagggaaggaacgggagaaggccgaaggcgagataaagggattatagaccaagggcacatccagttgccaaggaatgatcttgacccaagagttctgtctaatactggttggggacagactcctgtaaagcaaaacactgcctgggaatttgaagaatcccctaggtctgaaaggaaaaatgacaatgggacagaggcctggggttgtgcagctactcaggcttcaaactcaggggggaagaacgatgggtccatcatgaacagtacaaatacctcttcagtatctgggtgggtcaacgcgccacctgccgctgtgccagcaaacacaggttggggagacagcaacaacaaagcgccaagtggcccgggggtttggggggactcgataagctctactgctgttagtactgctgctgctgccaagagtggccatgcttggagtggggccgcaaatcaggaggacaagtcacccacctggggtgagcctccaaagcccaaatcccaacactggggagatggacaaagatcaaatccagcctggagtgcaggagggggagattgggcagattcatcgtctgtccttggacacttgggggatgggaaaaaaaatggatctggatgggatgctgacagtaataggtcagggtctggttggaatgacaccacgagatctgggaacagtggctggggcaacagcacaaatacaaaggccaatccaggtacaaactggggggagactttaaaacctggcccccaacagaactgggctagcaaaccccaagacaacaatgtgagtaactggggaggagctgcttctgtgaaacagacaggaacagggtggatcggggggccggtaccggtcaaacagaaggacagcagtgaagcaactggctgggaagaaccctctccaccgtccattcgccgcaaaatggaaattgatgatggtacctcagcttggggggacccaagcaactataacaataaaactgtaaacatgtgggatagaaacaacccggtcatccagagcagtaccacgaccaataccaccaccaccaccaccactaccacgagcaacaccacacacagggtcgagacgccgcccccgcaccaggccggtactcagctgaatcgatcaccgttgcttggtccagtttcatcaggctggggagaaatgcctaatgttcactcaaagactgaaaactcttggggagaaccatcctccccttctaccctggtggataatggcacagcagcatgggggaagccacccagcagtggcagcgggtggggagatcaccctgcagagccgccggtggcatttggaagagctggcgcacctgttgctgcctcagccctgtgcaaaccagcttcaaaatctatgcaagaaggctggggcagtggtggggatgaaatgaacctcagtaccagccagtgggaggatgaagaaggggacgtgtggaataatgctgcttcccaagaaagcacctcctcctgcagctcctgggggaacgcccccaaaaaaggacttcaaaagggcatgaagacgtctggcaagcaggatgaggcctggatcatgagccggctgatcaaacaactcacagacatgggcttcccgagagagccagctgaggaggccttgaagagtaacaatatgaatcttgatcaggccatgagcgctctgctggaaaagaaggtggacgtggacaagcgtgggctgggagtgaccgaccataatggaatggccgccaagcccctcggctgccgcccgccaatctccaaagagtcttccgtggaccgccccacctttcttgacaaggatggcggcctcgtggaagagcccacgccttcaccgttcttgccttccccaagcctgaagctccccctttcacacagtgcactccccagtcaggccctgggtgggattgcctccgggctgggcatgcaaaacttgaattcttctagacagataccgagtggcaatctgggtatgtttggcaatagtggagcagcacaagccaggaccatgcagcagccgccacagccaccagtgcagcctcttaactcttcccagcccagtctccgtgctcaagtgcctcagtttctatcccctcaggttcaagcacagcttttgcagtttgcagcaaaaaacattggtctcaaccctgcactattaacctcgccaattaatcctcaacatatgacgatgttgaaccagctctatcagctgcagctggcataccaacgtttacaaatccagcagcagatgttacaggcccagcgtaatgtgtccggatccatgagacaacaggagcagcaagttgcgcgcacaatcactaatctgcagcagcagatccagcagcaccagcgccagctggcccaggccctgctcgtgaagcagccaccaccgccaccgcccccgccgcacctgtctctgcacccctctgcaggcaaatcggccatggacagcttcccctcgcacccacagactcccggcctacctgacctgcagaccaaagagcagcagtcttcacccaacacctttgctccttaccctctcgctggactgaacccaaacatgaatgtcaacagcatggacatgaccggtggcttgtcggtgaaggacccatcccagtcccagtcacgcctcccccagtggacgcaccccaactccatggataacttgcccagtgccgcttcccccctggagcagaaccctagcaagcatggtgctatccctggaggtctaagcattgggcctccaggtaagtcctccattgatgactcctatggccggtacgatttaatccagaacagtgagtcaccagccagtcctcccgtagctgttccccatagctggtcacgtgccaaatctgacagtgataaaatctcaaatggctctagcatcaactggcccccagaattccatccgggagttccatggaaaggactgcagaatattgaccctgagaatgaccctgacgtcactcctggcagtgtccccactgggcctaccatcaacaccaccatccaggatgtcaaccgctacctcctcaagagtggagggtcctccccgccatcatctcagaatgccacgctgccttcttcgagtgcctggccactcagtgcctccggctacagtagctctttcagcagcattgcatccgcacctagtgttgcaggtaaactgtcagacatcaaatcgacgtggtcctctggccctacctcccacacgcaagcctctctgtctcatgaactatggaaggtgcccagaaacagtactgcacccacgaggccacctccagggttaaccaatcccaagccctcctccacctggggtgccagccccctcggctggaccagctcctactcctcgggttctgcctggagcaccgacacctcaggaagaaccagcagctggctcgttcttcgaaacctcactccccagattgatggttctacactgcggacattgtgtttgcaacatgggcctcttatcacattccacctgaatctgactcaaggcaatgctgtggtccggtacagctccaaggaggaggctgccaaggcccagaagtctctgcacatgtgcgtcctgggaaacactaccatcctggccgagttcgctggtgaagaagaagtgaatcgcttcttagcccaaggccaggcgctgccacccacttccagctggcagtccagcagcgcgtccagccagccgcggctcagcgcagcgggcagctcccatggcctggtacgcagcgacgctggccactggaacgccccgtgcctgggtggcaaggggagcagtgagctgctgtggggcggggtgccccagtactccagcagcctgtggggcccgcccagcgccgacgacagcagggtgataggcagccccacgccgctaaccaccctgctgcctggggacctgctcagcggggagtccctgtaggctctgccatcatcagcaccaggagagccgacccctcccgggacccctcccggctgggcggccccacagacccgctggaacccagcagcggccgcccttttgagtacctctgtccaggactgaagacgaaccttggccgcagtccttgcgaactgttcgcaaaacagtgcgggctgcggtgggtcagcgtcacatgctaatgacaggatgttcctcgtagctttttattttgtgcgtcttatgtttgtatagtgtgttgtcattttgattttttttttttttttaagtataaaagctgcttagaatagttctatcatgaagggcacttttcagattgtgggctggaaagggttattttatctgtgggggagggagggagacgtgaagcctatttaaaatgagcctgtgacgattatgcacatgaccagaggcggccggtaatcagggcagagtctggtgtggaccgccgggcgcagagcggctccgcggcgggagctgagcggaaggcgcgggctgcgatctgctctctgttcccctggatccgcctatgcacattacccttgtttcattactttttcatgtcatttttttatcccaaaaaatattttttaaaagttaaaaaaagacatatcaaacatgcaaatacttgaatccagcaggccaatagtgaaatgtgaacactttctaattctacacttccaggttgacatcagtacacagaaacaggctctaggaaaaatttctaagttcatagcctacgtgtgtgtatgtgtgcgtgttgaaacagaagtgtgtgtgtgtgtgcatgtgtggcgcgtgctcctgcacggcgtgcagttttctgtgtttgtgtgtttgaaagcgtgtgaggatttaactgtgggttttcccttgtattcagtatacgctttttttttggcgcattggtcaaacggttgttattattagcttctaactttgcactgagtgtcctcgcccttcctttagctaatcctatacattacagagaattcctaggacagggctggcgacaattcatgtgtaaatgtttactcaaggactctgtgactgcgtttaaaaagtacagtgtatatctctggagaaataacatgtatacctacctttagcagctttttattgtggactaatgcaagaaaattattaccagagtattgcaccatttttccatttggaatataaagttaaagagaaaaaaaaaaaaaactgttgttgaactgtggccatagatacttgtaaagaatggatggttccgtggaaggaacagaaacaagcacttgggcgtgggttgtgactgcttttgggggagcctggggtttgggctcccacctgtttacagacctttttttctccttcagactttaaaattttaaaaatttaaaaaggaattaaaaaaaaaaaaagacttccgtcgtaaagaaacctattttcagaatgcagatgcgttccttcagagctctgggacgggacagtgttgttccctcggccatcgtcgtggactctgtcgattgctttcgccccttcgtcaaggtgacaggcgttgtggccactgtcttgcacatgccggacgcgctctcaggaaagccagggctcccgagggcagctccacaccatttcatgtatttttaaacccaactcctagcactgaagatgttatttaaaaaaaaaaaaaacaaaacaaaacaaaaaaatgaaaaaaaagaaaaagaggaaaaaaaaacacaaagaagaaaaatacctaatctctaatgtgtagcagttacatatttaccaaataatggactcaaaagaaatagatgtttgaagagtgctttatatattaaaaattgctttatgttttaaaaatgatcaatgttttgattgttttgcaaggaagaaagacaatggaataacataccttcaagtatgttttaaaaaatatatatatgaacattgtgctccctgcctgcttgatcaggaaacttgtgcattacatttttttaattagctttttaatggttttatcaaaacaaaaaaaatacaaaaaaaaaaaaaaaagtcctgcaagactgcagatccacaaaagctggttttatagaggatcatgaactatgcacaaactgggttcaagactttttttctcaagtttagtaggatatttagaaaaaccaaccttcctcagagtgactgcatctcattgccattacatgcgttctatatattcgatggacatacacctgcgtatgtatatccaatatgtgtgcgtgtgagcatgcgtgtgcgtatgtgcgtccgacataccacttcccgtgctgccggcgagcattgagttgtagaaaaactgttgttttaaaattggggatggaagtcaagaatatgtttgtttgtttttgggttttgttgggtttgaggggttttttgtttgtttgttttttgttttttttaccttttattttgaacttaatatgtctgtaactctgagattaaacaacaagttcgtggctcttaatgttttcctcatagaatgtgactgttgaagaacatgcatcgaaagttgctttcgaaagtacaacgctttattgaatcttaataaattgcaatttttttcttggctgttcaaagtaatgtgtttttcatttttcaaaagacactatggatgtctactttgcacgctgcgattgggagagctgtcccgctgcatgcgttccctctgtaatttcctcagagctcacatacgtacctctctcacgagtgaactcagattttccattgttttgctttattctatcatttgctttgtggttttgctgtaaatattgaaatcttaatcatcatcgagaggcacagccaagctttccagctctccacccccgtggcccatccaagtctgttcatctggtaacttctgttgtctgggacggcagcaagaagatgccggggcttgcctggagtcctggcagaggagtgccactcacttttgcctagggtccagttggggcttaaaaaatatttggagagaagagtaatgaggattttttgtgtttcctagacattttatgcatctatttttgtaaaatcaccttcgctaactttcaccaagcactttgagcacagtggaacttcagaagcacaaccagcctaaccccagaatctcaggtggcacagctagaaattgagtcccttcctaggacactggccgtggccttcagggtgaccagtcagtgccaccgggttggcattggtgttacagacaggcctctgaagacaaaccgagcaccccagcggcccctcaaactaagcaaggatcttttttctgtctgcgctccctggggcaaggtcaaaggtggacccgcccactgtgggtcaattccttcgaaaagatgggacccgcacccccgccacaggctggcccccccccacccatggggaaggtggtgtgctgctggctctgaccatactcttttggaaattgagaaggaaagcattgagtgggacctaatccggagaagaaattaaagaccagaaaaagaaggaagctgggaatgaaactcaaaatgcacttgaacctggaagcggcaaccctcagctctgcgcggccgagcctcagcaagagttcgttttgtgcctgagttactactacaggggcaaactgtacccgtgcctgtgcgctgggagaacaaggtcagcgcccaagggtgtgcaaaggatgtggcaggcttcatggaggaggtggcatttgccctgggcctgggagaccaggttggattttgacagactgggaactcgggggacaggagggcagcacagtgtaagctaaagccctgtgtagggaccccacgcaaagacctcgtgggcctgggtgtccagggcaccatttccacccatgggtgaaaaagaggcttgaggaagacaacaggttcttcacctgcatctgtggatatatatttttttaagtttattaaatttttttttaaatggcagtttcagacctgc

SEQ ID NO: 32512 - DNA, 6003 bp, Homo sapiens
agggagaaagagcaagaaacacaagaagaggaacgtttgatggaagaaaagaaaaagaaaaagcaggaagaaaagaaaaagaaggaaggtgctcagaaaaaggctgctgatcaaaaaaccaaagattggtttctgatactaaattggcctctagagttgggcagaaagactcatcgctacagtgccagaacctactaagacctgttcaagccagccccaacctgccggtaccagtaccagtacttccaccagcactatctcaagcagcaacaatggcaaacgtgcatctgccagtggccagcagccagctgcatcccgttacctgcctcgtgaggtgcctccacgcttccgccagcaagaacagaagcagctattaaagagaggccagccattgcctacggggactctaaccagtgtgagcccaacccagggtgctgggcctgcaggggtaagcccacctcccctacctggagccggaacacagcatcatcccagtaagctccaaccagatctcagtcatagtggattggcagatcattatgaaaattcccactggggacagcagcctacttacagaagcgaagccaactgcagctgggataaagtgataatagataggactgacaaggaggcgtggccttccatcacaggaacagagactgaatctgcctcagaatgtactacagacactgactctgcctccaactgtggctcagagaacagtagcatggctacagggagtgcccagggcaacttcactggacataccaagaagacaaatggcaataatggcaccaatggcgcactcgtccaaagcccttctaatcagagtgcccttggagcagggggagcgaacagtaatggaagtgcggccagagtgtggggtgtagccacaggctccagctctggcctggctcactgctctgtcagtggtggggatggaaaaatggacactatgattggagatgggagaagtcagaattgctggggtgcttccaactccaatgctggcattaatcttaaccttaatcctaatgccaacccagctgcctggcctgtacttggacatgaaggaaccgtggcgacaggcaacccttccagtatttgcagtccagtcagtgccataggtcaaaatatgggcaaccagaacgggaacccaacaggcactttaggtgcttggggaaacttgctgccacaagagagcacagaaccacaaacgtccacttctcagaatgtgtctttcagcgcacaacctcagaaccttaacactgatggaccaaataacactaaccccatgaactcttcacccaaccctatcaatgcaatgcagacaaatggactgccaaactggggcatggctgttggtatgggggccatcatcccgccccacctgcaaggccttcctggtgctaatggatcatcagtttctcaagtcagtgggggcagtgctgaaggaataagcaattctgtgtggggactgtccccaggtaaccctgccacaggaaatagcaattctgggttcagtcaggggaatggagacactgtgaactcagcattaagtgctaaacaaaatggatccagcagtgctgtgcaaaaggaaggaagtggaggaaatgcttgggattcaggacctcctgctggtcctggaatactcgcctggggaaggggcagtggcaacaatggcgttggtaatatccattcaggagcttggggccaccccagccgaagcacctctaacggtgtgaatggggaatggggaaagcccccaaaccagcattccaacagtgacatcaatgggaaaggatcaacagggtgggagagtcctagtgtcaccagccagaaccctaccgtacagcctggtggtgaacacatgaactcctgggccaaagcggcatcttctggaactacagcaagtgaaggaagtagtgatggttctggcaaccacaatgaaggaagcactgggagggaaggaacgggagaaggccgaaggcgagataaagggattatagaccaagggcacatccagttgccaaggaatgatcttgacccaagagttctgtctaatactggttggggacagactcctgtaaagcaaaacactgcctgggaatttgaagaatcccctaggtctgaaaggaaaaatgacaatgggacagaggcctggggttgtgcagctactcaggcttcaaactcaggggggaagaacgatgggtccatcatgaacagtacaaatacctcttcagtatctgggtgggtcaacgcgccacctgccgctgtgccagcaaacacaggttggggagacagcaacaacaaagcgccaagtggcccgggggtttggggggactcgataagctctactgctgttagtactgctgctgctgccaagagtggccatgcttggagtggggccgcaaatcaggaggacaagtcacccacctggggtgagcctccaaagcccaaatcccaacactggggagatggacaaagatcaaatccagcctggagtgcaggagggggagattgggcagattcatcgtctgtccttggacacttgggggatgggaaaaaaaatggatctggatgggatgctgacagtaataggtcagggtctggttggaatgacaccacgagatctgggaacagtggctggggcaacagcacaaatacaaaggccaatccaggtacaaactggggggagactttaaaacctggcccccaacagaactgggctagcaaaccccaagacaacaatgtgagtaactggggaggagctgcttctgtgaaacagacaggaacagggtggatcggggggccggtaccggtcaaacagaaggacagcagtgaagcaactggctgggaagaaccctctccaccgtccattcgccgcaaaatggaaattgatgatggtacctcagcttggggggacccaagcaactataacaataaaactgtaaacatgtgggatagaaacaacccggtcatccagagcagtaccacgaccaataccaccaccaccaccaccactaccacgagcaacaccacacacagggtcgagacgccgcccccgcaccaggccggtactcagctgaatcgatcaccgttgcttggtccagtttcatcaggctggggagaaatgcctaatgttcactcaaagactgaaaactcttggggagaaccatcctccccttctaccctggtggataatggcacagcagcatgggggaagccacccagcagtggcagcgggtggggagatcaccctgcagagccgccggtggcatttggaagagctggcgcacctgttgctgcctcagccctgtgcaaaccagcttcaaaatctatgcaagaaggctggggcagtggtggggatgaaatgaacctcagtaccagccagtgggaggatgaagaaggggacgtgtggaataatgctgcttcccaagaaagcacctcctcctgcagctcctgggggaacgcccccaaaaaaggacttcaaaagggcatgaagacgtctggcaagcaggatgaggcctggatcatgagccggctgatcaaacaactcacagacatgggcttcccgagagagccagctgaggaggccttgaagagtaacaatatgaatcttgatcaggccatgagcgctctgctggaaaagaaggtggacgtggacaagcgtgggctgggagtgaccgaccataatggaatggccgccaagcccctcggctgccgcccgccaatctccaaagagtcttccgtggaccgccccacctttcttgacaaggatggcggcctcgtggaagagcccacgccttcaccgttcttgccttccccaagcctgaagctccccctttcacacagtgcactccccagtcaggccctgggtgggattgcctccgggctgggcatgcaaaacttgaattcttctagacagataccgagtggcaatctgggtatgtttggcaatagtggagcagcacaagccaggaccatgcagcagccgccacagccaccagtgcagcctcttaactcttcccagcccagtctccgtgctcaagtgcctcagtttctatcccctcaggttcaagcacagcttttgcagtttgcagcaaaaaacattggtctcaaccctgcactattaacctcgccaattaatcctcaacatatgacgatgttgaaccagctctatcagctgcagctggcataccaacgtttacaaatccagcagcagatgttacaggcccagcgtaatgtgtccggatccatgagacaacaggagcagcaagttgcgcgcacaatcactaatctgcagcagcagatccagcagcaccagcgccagctggcccaggccctgctcgtgaagcagccaccaccgccaccgcccccgccgcacctgtctctgcacccctctgcaggcaaatcggccatggacagcttcccctcgcacccacagactcccggcctacctgacctgcagaccaaagagcagcagtcttcacccaacacctttgctccttaccctctcgctggactgaacccaaacatgaatgtcaacagcatggacatgaccggtggcttgtcggtgaaggacccatcccagtcccagtcacgcctcccccagtggacgcaccccaactccatggataacttgcccagtgccgcttcccccctggagcagaaccctagcaagcatggtgctatccctggaggtctaagcattgggcctccaggtaagtcctccattgatgactcctatggccggtacgatttaatccagaacagtgagtcaccagccagtcctcccgtagctgttccccatagctggtcacgtgccaaatctgacagtgataaaatctcaaatggctctagcatcaactggcccccagaattccatccgggagttccatggaaaggactgcagaatattgaccctgagaatgaccctgacgtcactcctggcagtgtccccactgggcctaccatcaacaccaccatccaggatgtcaaccgctacctcctcaagagtggagggtcctccccgccatcatctcagaatgccacgctgccttcttcgagtgcctggccactcagtgcctccggctacagtagctctttcagcagcattgcatccgcacctagtgttgcaggtaaactgtcagacatcaaatcgacgtggtcctctggccctacctcccacacgcaagcctctctgtctcatgaactatggaaggtgcccagaaacagtactgcacccacgaggccacctccagggttaaccaatcccaagccctcctccacctggggtgccagccccctcggctggaccagctcctactcctcgggttctgcctggagcaccgacacctcaggaagaaccagcagctggctcgttcttcgaaacctcactccccagattgatggttctacactgcggacattgtgtttgcaacatgggcctcttatcacattccacctgaatctgactcaaggcaatgctgtggtccggtacagctccaaggaggaggctgccaaggcccagaagtctctgcacatgtgcgtcctgggaaacactaccatcctggccgagttcgctggtgaagaagaagtgaatcgcttcttagcccaaggccaggcgctgccacccacttccagctggcagtccagcagcgcgtccagccagccgcggctcagcgcagcgggcagctcccatggcctggtacgcagcgacgctggccactggaacgccccgtgcctgggtggcaaggggagcagtgagctgctgtggggcggggtgccccagtactccagcagcctgtggggcccgcccagcgccgacgacagcagggtgataggcagccccacgccgctaaccaccctgctgcctggggacctgctcagcggggagtccctgtaggctctgccatcatcagcaccaggagagccgacccctcccgggacccctcccggctgggcggccccacagacccgctggaacccagcagcggccgc

SEQ ID NO: 32513 - DNA, 5895 bp, Homo sapiens
agggagaaagagcaagaaacacaagaagaggaacgtttgatggaagaaaagaaaaagaaaaagcaggaagaaaagaaaaagaaggaaggtgctcagaaaaaggctgctgatcaaaaaaccaaagattggtttctgatactaaattggcctctagagttgggcagaaagactcatcgctacagtgccagaacctactaagacctgttcaagccagccccaacctgccggtaccagtaccagtacttccaccagcactatctcaagcagcaacaatggcaaacgtgcatctgccagtggccagcagccagctgcatcccgttacctgcctcgtgaggtgcctccacgcttccgccagcaagaacagaagcagctattaaagagaggccagccattgcctacggggactctaaccagtgtgagcccaacccagggtgctgggcctgcaggggtaagcccacctcccctacctggagccggaacacagcatcatcccagtaagctccaaccagatctcagtcatagtggattggcagatcattatgaaaattcccactggggacagcagcctacttacagaagcgaagccaactgcagctgggataaagtgataatagataggactgacaaggaggcgtggccttccatcacaggaacagagactgaatctgcctcagaatgtactacagacactgactctgcctccaactgtggctcagagaacagtagcatggctacagggagtgcccagggcaacttcactggacataccaagaagacaaatggcaataatggcaccaatggcgcactcgtccaaagcccttctaatcagagtgcccttggagcagggggagcgaacagtaatggaagtgcggccagagtgtggggtgtagccacaggctccagctctggcctggctcactgctctgtcagtggtggggatggaaaaatggacactatgattggagatgggagaagtcagaattgctggggtgcttccaactccaatgctggcattaatcttaaccttaatcctaatgccaacccagctgcctggcctgtacttggacatgaaggaaccgtggcgacaggcaacccttccagtatttgcagtccagtcagtgccataggtcaaaatatgggcaaccagaacgggaacccaacaggcactttaggtgcttggggaaacttgctgccacaagagagcacagaaccacaaacgtccacttctcagaatgtgtctttcagcgcacaacctcagaaccttaacactgatggaccaaataacactaaccccatgaactcttcacccaaccctatcaatgcaatgcagacaaatggactgccaaactggggcatggctgttggtatgggggccatcatcccgccccacctgcaaggccttcctggtgctaatggatcatcagtttctcaagtcagtgggggcagtgctgaaggaataagcaattctgtgtggggactgtccccaggtaaccctgccacaggaaatagcaattctgggttcagtcaggggaatggagacactgtgaactcagcattaagtgctaaacaaaatggatccagcagtgctgtgcaaaaggaaggaagtggaggaaatgcttgggattcaggacctcctgctggtcctggaatactcgcctggggaaggggcagtggcaacaatggcgttggtaatatccattcaggagcttggggccaccccagccgaagcacctctaacggtgtgaatggggaatggggaaagcccccaaaccagcattccaacagtgacatcaatgggaaaggatcaacagggtgggagagtcctagtgtcaccagccagaaccctaccgtacagcctggtggtgaacacatgaactcctgggccaaagcggcatcttctggaactacagcaagtgaaggaagtagtgatggttctggcaaccacaatgaaggaagcactgggagggaaggaacgggagaaggccgaaggcgagataaagggattatagaccaagggcacatccagttgccaaggaatgatcttgacccaagagttctgtctaatactggttggggacagactcctgtaaagcaaaacactgcctgggaatttgaagaatcccctaggtctgaaaggaaaaatgacaatgggacagaggcctggggttgtgcagctactcaggcttcaaactcaggggggaagaacgatgggtccatcatgaacagtacaaatacctcttcagtatctgggtgggtcaacgcgccacctgccgctgtgccagcaaacacaggttggggagacagcaacaacaaagcgccaagtggcccgggggtttggggggactcgataagctctactgctgttagtactgctgctgctgccaagagtggccatgcttggagtggggccgcaaatcaggaggacaagtcacccacctggggtgagcctccaaagcccaaatcccaacactggggagatggacaaagatcaaatccagcctggagtgcaggagggggagattgggcagattcatcgtctgtccttggacacttgggggatgggaaaaaaaatggatctggatgggatgctgacagtaataggtcagggtctggttggaatgacaccacgagatctgggaacagtggctggggcaacagcacaaatacaaaggccaatccaggtacaaactggggggagactttaaaacctggcccccaacagaactgggctagcaaaccccaagacaacaatgtgagtaactggggaggagctgcttctgtgaaacagacaggaacagggtggatcggggggccggtaccggtcaaacagaaggacagcagtgaagcaactggctgggaagaaccctctccaccgtccattcgccgcaaaatggaaattgatgatggtacctcagcttggggggacccaagcaactataacaataaaactgtaaacatgtgggatagaaacaacccggtcatccagagcagtaccacgaccaataccaccaccaccaccaccactaccacgagcaacaccacacacagggtcgagacgccgcccccgcaccaggccggtactcagctgaatcgatcaccgttgcttggtccaggtaggaaagtttcatcaggctggggagaaatgcctaatgttcactcaaagactgaaaactcttggggagaaccatcctccccttctaccctggtggataatggcacagcagcatgggggaagccacccagcagtggcagcgggtggggagatcaccctgcagagccgccggtggcatttggaagagctggcgcacctgttgctgcctcagccctgtgcaaaccagcttcaaaatctatgcaagaaggctggggcagtggtggggatgaaatgaacctcagtaccagccagtgggaggatgaagaaggggacgtgtggaataatgctgcttcccaagaaagcacctcctcctgcagctcctgggggaacgcccccaaaaaaggacttcaaaagggcatgaagacgtctggcaagcaggatgaggcctggatcatgagccggctgatcaaacaactcacagacatgggcttcccgagagagccagctgaggaggccttgaagagtaacaatatgaatcttgatcaggccatgagcgctctgctggaaaagaaggtggacgtggacaagcgtgggctgggagtgaccgaccataatggaatggccgccaagcccctcggctgccgcccgccaatctccaaagagtcttccgtggaccgccccacctttcttgacaaggatggcggcctcgtggaagagcccacgccttcaccgttcttgccttccccaagcctgaagctccccctttcacacagtgcactccccagtcaggccctgggtgggattgcctccgggctgggcatgcaaaacttgaattcttctagacagataccgagtggcaatctgggtatgtttggcaatagtggagcagcacaagccaggaccatgcagcagccgccacagccaccagtgcagcctcttaactcttcccagcccagtctccgtgctcaagtgcctcagtttctatcccctcaggttcaagcacagcttttgcagtttgcagcaaaaaacattggtctcaaccctgcactattaacctcgccaattaatcctcaacatatgacgatgttgaaccagctctatcagctgcagctggcataccaacgtttacaaatccagcagcagatgttacaggcccagcgtaatgtgtccggatccatgagacaacaggagcagcaagttgcgcgcacaatcactaatctgcagcagcagatccagcagcaccagcgccagctggcccaggccctgctcgtgaagcagccaccaccgccaccgcccccgccgcacctgtctctgcacccctctgcaggcaaatcggccatggacagcttcccctcgcacccacagactcccggcctacctgacctgcagaccaaagagcagcagtcttcacccaacacctttgctccttaccctctcgctggactgaacccaaacatgaatgtcaacagcatggacatgaccggtggcttgtcggtgaaggacccatcccagtcccagtcacgcctcccccagtggacgcaccccaactccatggataacttgcccagtgccgcttcccccctggagcagaaccctagcaagcatggtgctatccctggaggtctaagcattgggcctccaggtaagtcctccattgatgactcctatggccggtacgatttaatccagaacagtgagtcaccagccagtcctcccgtagctgttccccatagctggtcacgtgccaaatctgacagtgataaaatctcaaatggctctagcatcaactggcccccagaattccatccgggagttccatggaaaggactgcagaatattgaccctgagaatgaccctgacgtcactcctggcagtgtccccactgggcctaccatcaacaccaccatccaggatgtcaaccgctacctcctcaagagtggaggtaaactgtcagacatcaaatcgacgtggtcctctggccctacctcccacacgcaagcctctctgtctcatgaactatggaaggtgcccagaaacagtactgcacccacgaggccacctccagggttaaccaatcccaagccctcctccacctggggtgccagccccctcggctggaccagctcctactcctcgggttctgcctggagcaccgacacctcaggaagaaccagcagctggctcgttcttcgaaacctcactccccagattgatggttctacactgcggacattgtgtttgcaacatgggcctcttatcacattccacctgaatctgactcaaggcaatgctgtggtccggtacagctccaaggaggaggctgccaaggcccagaagtctctgcacatgtgcgtcctgggaaacactaccatcctggccgagttcgctggtgaagaagaagtgaatcgcttcttagcccaaggccaggcgctgccacccacttccagctggcagtccagcagcgcgtccagccagccgcggctcagcgcagcgggcagctcccatggcctggtacgcagcgacgctggccactggaacgccccgtgcctgggtggcaaggggagcagtgagctgctgtggggcggggtgccccagtactccagcagcctgtggggcccgcccagcgccgacgacagcagggtgataggcagccccacgccgctaaccaccctgctgcctggggacctgctcagcggggagtccctgtaggctctgccatcatcagcaccaggagagccgacccctcccgggacccctcccggctgggcggccccacagacccgctggaacccagcagcggccgc

SEQ ID NO: 32514 - DNA, 5318 bp, Homo sapiens
agcgaagccaactgcagctgggataaagtgataatagataggactgacaaggaggcgtggccttccatcacaggaacagagactgaatctgcctcagaatgtactacagacactgactctgcctccaactgtggctcagagaacagtagcatggctacagggagtgcccagggcaacttcactggacataccaagaagacaaatggcaataatggcaccaatggcgcactcgtccaaagcccttctaatcagagtgcccttggagcagggggagcgaacagtaatggaagtgcggccagagtgtggggtgtagccacaggctccagctctggcctggctcactgctctgtcagtggtggggatggaaaaatggacactatgattggagatgggagaagtcagaattgctggggtgcttccaactccaatgctggcattaatcttaaccttaatcctaatgccaacccagctgcctggcctgtacttggacatgaaggaaccgtggcgacaggcaacccttccagtatttgcagtccagtcagtgccataggtcaaaatatgggcaaccagaacgggaacccaacaggcactttaggtgcttggggaaacttgctgccacaagagagcacagaaccacaaacgtccacttctcagaatgtgtctttcagcgcacaacctcagaaccttaacactgatggaccaaataacactaaccccatgaactcttcacccaaccctatcaatgcaatgcagacaaatggactgccaaactggggcatggctgttggtatgggggccatcatcccgccccacctgcaaggccttcctggtgctaatggatcatcagtttctcaagtcagtgggggcagtgctgaaggaataagcaattctgtgtggggactgtccccaggtaaccctgccacaggaaatagcaattctgggttcagtcaggggaatggagacactgtgaactcagcattaagtgctaaacaaaatggatccagcagtgctgtgcaaaaggaaggaagtggaggaaatgcttgggattcaggacctcctgctggtcctggaatactcgcctggggaaggggcagtggcaacaatggcgttggtaatatccattcaggagcttggggccaccccagccgaagcacctctaacggtgtgaatggggaatggggaaagcccccaaaccagcattccaacagtgacatcaatgggaaaggatcaacagggtgggagagtcctagtgtcaccagccagaaccctaccgtacagcctggtggtgaacacatgaactcctgggccaaagcggcatcttctggaactacagcaagtgaaggaagtagtgatggttctggcaaccacaatgaaggaagcactgggagggaaggaacgggagaaggccgaaggcgagataaagggattatagaccaagggcacatccagttgccaaggaatgatcttgacccaagagttctgtctaatactggttggggacagactcctgtaaagcaaaacactgcctgggaatttgaagaatcccctaggtctgaaaggaaaaatgacaatgggacagaggcctggggttgtgcagctactcaggcttcaaactcaggggggaagaacgatgggtccatcatgaacagtacaaatacctcttcagtatctgggtgggtcaacgcgccacctgccgctgtgccagcaaacacaggttggggagacagcaacaacaaagcgccaagtggcccgggggtttggggggactcgataagctctactgctgttagtactgctgctgctgccaagagtggccatgcttggagtggggccgcaaatcaggaggacaagtcacccacctggggtgagcctccaaagcccaaatcccaacactggggagatggacaaagatcaaatccagcctggagtgcaggagggggagattgggcagattcatcgtctgtccttggacacttgggggatgggaaaaaaaatggatctggatgggatgctgacagtaataggtcagggtctggttggaatgacaccacgagatctgggaacagtggctggggcaacagcacaaatacaaaggccaatccaggtacaaactggggggagactttaaaacctggcccccaacagaactgggctagcaaaccccaagacaacaatgtgagtaactggggaggagctgcttctgtgaaacagacaggaacagggtggatcggggggccggtaccggtcaaacagaaggacagcagtgaagcaactggctgggaagaaccctctccaccgtccattcgccgcaaaatggaaattgatgatggtacctcagcttggggggacccaagcaactataacaataaaactgtaaacatgtgggatagaaacaacccggtcatccagagcagtaccacgaccaataccaccaccaccaccaccactaccacgagcaacaccacacacagggtcgagacgccgcccccgcaccaggccggtactcagctgaatcgatcaccgttgcttggtccaggtaggaaagtttcatcaggctggggagaaatgcctaatgttcactcaaagactgaaaactcttggggagaaccatcctccccttctaccctggtggataatggcacagcagcatgggggaagccacccagcagtggcagcgggtggggagatcaccctgcagagccgccggtggcatttggaagagctggcgcacctgttgctgcctcagccctgtgcaaaccagcttcaaaatctatgcaagaaggctggggcagtggtggggatgaaatgaacctcagtaccagccagtgggaggatgaagaaggggacgtgtggaataatgctgcttcccaagaaagcacctcctcctgcagctcctgggggaacgcccccaaaaaaggacttcaaaagggcatgaagacgtctggcaagcaggatgaggcctggatcatgagccggctgatcaaacaactcacagacatgggcttcccgagagagccagctgaggaggccttgaagagtaacaatatgaatcttgatcaggccatgagcgctctgctggaaaagaaggtggacgtggacaagcgtgggctgggagtgaccgaccataatggaatggccgccaagcccctcggctgccgcccgccaatctccaaagagtcttccgtggaccgccccacctttcttgacaaggatggcggcctcgtggaagagcccacgccttcaccgttcttgccttccccaagcctgaagctccccctttcacacagtgcactccccagtcaggccctgggtgggattgcctccgggctgggcatgcaaaacttgaattcttctagacagataccgagtggcaatctgggtatgtttggcaatagtggagcagcacaagccaggaccatgcagcagccgccacagccaccagtgcagcctcttaactcttcccagcccagtctccgtgctcaagtgcctcagtttctatcccctcaggttcaagcacagcttttgcagtttgcagcaaaaaacattggtctcaaccctgcactattaacctcgccaattaatcctcaacatatgacgatgttgaaccagctctatcagctgcagctggcataccaacgtttacaaatccagcagcagatgttacaggcccagcgtaatgtgtccggatccatgagacaacaggagcagcaagttgcgcgcacaatcactaatctgcagcagcagatccagcagcaccagcgccagctggcccaggccctgctcgtgaagcagccaccaccgccaccgcccccgccgcacctgtctctgcacccctctgcaggcaaatcggccatggacagcttcccctcgcacccacagactcccggcctacctgacctgcagaccaaagagcagcagtcttcacccaacacctttgctccttaccctctcgctggactgaacccaaacatgaatgtcaacagcatggacatgaccggtggcttgtcggtgaaggacccatcccagtcccagtcacgcctcccccagtggacgcaccccaactccatggataacttgcccagtgccgcttcccccctggagcagaaccctagcaagcatggtgctatccctggaggtctaagcattgggcctccaggtaagtcctccattgatgactcctatggccggtacgatttaatccagaacagtgagtcaccagccagtcctcccgtagctgttccccatagctggtcacgtgccaaatctgacagtgataaaatctcaaatggctctagcatcaactggcccccagaattccatccgggagttccatggaaaggactgcagaatattgaccctgagaatgaccctgacgtcactcctggcagtgtccccactgggcctaccatcaacaccaccatccaggatgtcaaccgctacctcctcaagagtggaggtaaactgtcagacatcaaatcgacgtggtcctctggccctacctcccacacgcaagcctctctgtctcatgaactatggaaggtgcccagaaacagtactgcacccacgaggccacctccagggttaaccaatcccaagccctcctccacctggggtgccagccccctcggctggaccagctcctactcctcgggttctgcctggagcaccgacacctcaggaagaaccagcagctggctcgttcttcgaaacctcactccccagattgatggttctacactgcggacattgtgtttgcaacatgggcctcttatcacattccacctgaatctgactcaaggcaatgctgtggtccggtacagctccaaggaggaggctgccaaggcccagaagtctctgcacatgtgcgtcctgggaaacactaccatcctggccgagttcgctggtgaagaagaagtgaatcgcttcttagcccaaggccaggcgctgccacccacttccagctggcagtccagcagcgcgtccagccagccgcggctcagcgcagcgggcagctcccatggcctggtacgcagcgacgctggccactggaacgccccgtgcctgggtggcaaggggagcagtgagctgctgtggggcggggtgccccagtactccagcagcctgtggggcccgcccagcgccgacgacagcagggtgataggcagccccacgccgctaaccaccctgctgcctggggacctgctcagcggggagtccctgtaggctctgccatcatcagcaccaggagagccgacccctcccgggacccctcccggctgggcggccccacagacccgctggaacccagcagcggccgc

SEQ ID NO: 32515 - DNA, 5276 bp, Homo sapiens
atggctacagggagtgcccagggcaacttcactggacataccaagaagacaaatggcaataatggcaccaatggcgcactcgtccaaagcccttctaatcagagtgcccttggagcagggggagcgaacagtaatggaagtgcggccagagtgtggggtgtagccacaggctccagctctggcctggctcactgctctgtcagtggtggggatggaaaaatggacactatgattggagatgggagaagtcagaattgctggggtgcttccaactccaatgctggcattaatcttaaccttaatcctaatgccaacccagctgcctggcctgtacttggacatgaaggaaccgtggcgacaggcaacccttccagtatttgcagtccagtcagtgccataggtcaaaatatgggcaaccagaacgggaacccaacaggcactttaggtgcttggggaaacttgctgccacaagagagcacagaaccacaaacgtccacttctcagaatgtgtctttcagcgcacaacctcagaaccttaacactgatggaccaaataacactaaccccatgaactcttcacccaaccctatcaatgcaatgcagacaaatggactgccaaactggggcatggctgttggtatgggggccatcatcccgccccacctgcaaggccttcctggtgctaatggatcatcagtttctcaagtcagtgggggcagtgctgaaggaataagcaattctgtgtggggactgtccccaggtaaccctgccacaggaaatagcaattctgggttcagtcaggggaatggagacactgtgaactcagcattaagtgctaaacaaaatggatccagcagtgctgtgcaaaaggaaggaagtggaggaaatgcttgggattcaggacctcctgctggtcctggaatactcgcctggggaaggggcagtggcaacaatggcgttggtaatatccattcaggagcttggggccaccccagccgaagcacctctaacggtgtgaatggggaatggggaaagcccccaaaccagcattccaacagtgacatcaatgggaaaggatcaacagggtgggagagtcctagtgtcaccagccagaaccctaccgtacagcctggtggtgaacacatgaactcctgggccaaagcggcatcttctggaactacagcaagtgaaggaagtagtgatggttctggcaaccacaatgaaggaagcactgggagggaaggaacgggagaaggccgaaggcgagataaagggattatagaccaagggcacatccagttgccaaggaatgatcttgacccaagagttctgtctaatactggttggggacagactcctgtaaagcaaaacactgcctgggaatttgaagaatcccctaggtctgaaaggaaaaatgacaatgggacagaggcctggggttgtgcagctactcaggcttcaaactcaggggggaagaacgatgggtccatcatgaacagtacaaatacctcttcagtatctgggtgggtcaacgcgccacctgccgctgtgccagcaaacacaggttggggagacagcaacaacaaagcgccaagtggcccgggggtttggggggactcgataagctctactgctgttagtactgctgctgctgccaagagtggccatgcttggagtggggccgcaaatcaggaggacaagtcacccacctggggtgagcctccaaagcccaaatcccaacactggggagatggacaaagatcaaatccagcctggagtgcaggagggggagattgggcagattcatcgtctgtccttggacacttgggggatgggaaaaaaaatggatctggatgggatgctgacagtaataggtcagggtctggttggaatgacaccacgagatctgggaacagtggctggggcaacagcacaaatacaaaggccaatccaggtacaaactggggggagactttaaaacctggcccccaacagaactgggctagcaaaccccaagacaacaatgtgagtaactggggaggagctgcttctgtgaaacagacaggaacagggtggatcggggggccggtaccggtcaaacagaaggacagcagtgaagcaactggctgggaagaaccctctccaccgtccattcgccgcaaaatggaaattgatgatggtacctcagcttggggggacccaagcaactataacaataaaactgtaaacatgtgggatagaaacaacccggtcatccagagcagtaccacgaccaataccaccaccaccaccaccactaccacgagcaacaccacacacagggtcgagacgccgcccccgcaccaggccggtactcagctgaatcgatcaccgttgcttggtccagtttcatcaggctggggagaaatgcctaatgttcactcaaagactgaaaactcttggggagaaccatcctccccttctaccctggtggataatggcacagcagcatgggggaagccacccagcagtggcagcgggtggggagatcaccctgcagagccgccggtggcatttggaagagctggcgcacctgttgctgcctcagccctgtgcaaaccagcttcaaaatctatgcaagaaggctggggcagtggtggggatgaaatgaacctcagtaccagccagtgggaggatgaagaaggggacgtgtggaataatgctgcttcccaagaaagcacctcctcctgcagctcctgggggaacgcccccaaaaaaggacttcaaaagggcatgaagacgtctggcaagcaggatgaggcctggatcatgagccggctgatcaaacaactcacagacatgggcttcccgagagagccagctgaggaggccttgaagagtaacaatatgaatcttgatcaggccatgagcgctctgctggaaaagaaggtggacgtggacaagcgtgggctgggagtgaccgaccataatggaatggccgccaagcccctcggctgccgcccgccaatctccaaagagtcttccgtggaccgccccacctttcttgacaaggatggcggcctcgtggaagagcccacgccttcaccgttcttgccttccccaagcctgaagctccccctttcacacagtgcactccccagtcaggccctgggtgggattgcctccgggctgggcatgcaaaacttgaattcttctagacagataccgagtggcaatctgggtatgtttggcaatagtggagcagcacaagccaggaccatgcagcagccgccacagccaccagtgcagcctcttaactcttcccagcccagtctccgtgctcaagtgcctcagtttctatcccctcaggttcaagcacagcttttgcagtttgcagcaaaaaacattggtctcaaccctgcactattaacctcgccaattaatcctcaacatatgacgatgttgaaccagctctatcagctgcagctggcataccaacgtttacaaatccagcagcagatgttacaggcccagcgtaatgtgtccggatccatgagacaacaggagcagcaagttgcgcgcacaatcactaatctgcagcagcagatccagcagcaccagcgccagctggcccaggccctgctcgtgaagcagccaccaccgccaccgcccccgccgcacctgtctctgcacccctctgcaggcaaatcggccatggacagcttcccctcgcacccacagactcccggcctacctgacctgcagaccaaagagcagcagtcttcacccaacacctttgctccttaccctctcgctggactgaacccaaacatgaatgtcaacagcatggacatgaccggtggcttgtcggtgaaggacccatcccagtcccagtcacgcctcccccagtggacgcaccccaactccatggataacttgcccagtgccgcttcccccctggagcagaaccctagcaagcatggtgctatccctggaggtctaagcattgggcctccaggtaagtcctccattgatgactcctatggccggtacgatttaatccagaacagtgagtcaccagccagtcctcccgtagctgttccccatagctggtcacgtgccaaatctgacagtgataaaatctcaaatggctctagcatcaactggcccccagaattccatccgggagttccatggaaaggactgcagaatattgaccctgagaatgaccctgacgtcactcctggcagtgtccccactgggcctaccatcaacaccaccatccaggatgtcaaccgctacctcctcaagagtggagggtcctccccgccatcatctcagaatgccacgctgccttcttcgagtgcctggccactcagtgcctccggctacagtagctctttcagcagcattgcatccgcacctagtgttgcaggtaaactgtcagacatcaaatcgacgtggtcctctggccctacctcccacacgcaagcctctctgtctcatgaactatggaaggtgcccagaaacagtactgcacccacgaggccacctccagggttaaccaatcccaagccctcctccacctggggtgccagccccctcggctggaccagctcctactcctcgggttctgcctggagcaccgacacctcaggaagaaccagcagctggctcgttcttcgaaacctcactccccagattgatggttctacactgcggacattgtgtttgcaacatgggcctcttatcacattccacctgaatctgactcaaggcaatgctgtggtccggtacagctccaaggaggaggctgccaaggcccagaagtctctgcacatgtgcgtcctgggaaacactaccatcctggccgagttcgctggtgaagaagaagtgaatcgcttcttagcccaaggccaggcgctgccacccacttccagctggcagtccagcagcgcgtccagccagccgcggctcagcgcagcgggcagctcccatggcctggtacgcagcgacgctggccactggaacgccccgtgcctgggtggcaaggggagcagtgagctgctgtggggcggggtgccccagtactccagcagcctgtggggcccgcccagcgccgacgacagcagggtgataggcagccccacgccgctaaccaccctgctgcctggggacctgctcagcggggagtccctgtaggctctgccatcatcagcaccaggagagccgacccctcccgggacccctcccggctgggcggccccacagacccgctggaacccagcagcggccgc

SEQ ID NO: 32516 - DNA, 2324 bp, Homo sapiens
gttttatgggcggatggaaggggccggggcagcgtcggggaaaggaagggccggaggcgcggcggcgggcggccgagaggggcggcggcggcggcggcggcggggttcccgcgccgcggagcccggcccgagagccgcgtccacgttcctgcctcctgctcccgccgccctggggcgccgccatgacgcccgatctgctcaacttcaagaagggatggatgtcgatcttggacgagcctggagagcctccctccccctcgctcaccaccacctctacttcgcagtggaagaaacattggtttgtgctgacagattcaagtctcaaatattacagagactccactgctgaggaggcagatgagctggatggtgagatcgacctgcgttcctgcacggatgtcactgagtacgcggtgcagcgcaactatggcttccagatccacaccaaggatgctgtctataccttgtcggccatgacctcaggcatccggcggaactggatcgaggctctgagaaagaccgtacgtccaacttcagccccagatgtcaccaagctctcggactctaacaaggagaacgcgctgcacagctacagcacccagaagggccccctgaaggcaggggagcagcgggcgggctctgaggtcatcagccggggtggccctcggaaggcggacgggcagcgtcaggccttggactacgtggagctctcgccgctgacccaggcttccccgcagcgggcccgcaccccagcccgcactcctgaccgcctggccaagcaggaggagctggagcgggacctggcccagcgctccgaggagcggcgcaagtggtttgaggccacagacagcaggaccccagaggtgcctgctggtgaggggccgcgccggggcctgggtgcccccctgactgaggaccagcaaaaccggcttagtgaggagatcgagaagaagtggcaggagctggagaagctgcccctgcgggagaataagcgggtgcccctcactgccctgctcaaccaaagccgcggagagcgccgagggcccccaagtgacggccacgaggcactggagaaggaggttcaggctcttcgggcccagctggaggcgtggcgtctccaaggggaggctcctcagagtgcactgagatcccaggaggatggccacatccccccgggctacatctcacaggaggcatgtgagcgcagcctggcagagatggagtcctcgcaccagcaggtgatggaggagctgcagcggcaccacgagcgggagctgcagcgcctgcagcaggagaaggagtggctcctggctgaggagacggcagccacggcctcagccattgaagccatgaagaaggcctaccaggaagagctgagccgagagctgagcaaaacacggagtctccagcagggcccggatggcctccggaagcagcaccagtcagatgtggaggcactgaagcgagagctgcaggtgctatcggagcagtactcgcagaagtgcctggagattggggcactcatgcggcaggctgaggagcgcgagcacacgctgcgccgctgccagcaggagggccaggagctgctgcgccacaaccaggagctgcatggccgcctgtcagaggagatagaccagctgcgcggcttcattgcctcgcagggcatgggcaatggctgcgggcgcagcaacgagcggagttcctgcgagctagaggtgctgcttcgcgtaaaagaaaacgaactccagtacctaaagaaggaggtgcagtgcctccgggacgagctccagatgatgcagaaggacaagcgcttcacctcgggaaagtaccaggacgtctatgtggagctgagccacatcaagacacggtctgagcgggagatcgagcagctgaaggagcacctgcgtcttgccatggccgccctccaggagaaggagtcgatgcgcaacagcctggctgagtagaggtcccgcccagctgcagaccctccaggctggaggaccagccgccctccttccctcctggatggaagtaaaaagccaagctttctccccaccctctgtgggccacacgtgcacttgcacccaccacacacacacacacacacacacacacacacacagacacacagacacatacgcacacacgtgcacacatgtacacacggatacacacacacacacacacactgcatatctgagcgcgcccctcgcactgggtctcaccttgcaccttcttcaggattttatatgtgaagagatttttatatagatttttttcctttttttccaaaacactttatactttaaaaaaaaaaaaaaaaa

SEQ ID NO: 32517 - DNA, 10129 bp, Homo sapiens
atcgctctgattcattgttaaaataaagaggccatgaccctggcactcccaccccggcagcccctgtgcgtggaaacccagccaaggtctgatgatggaggagccttggccctggctgtcccaggggaggaggtgaaattcctcagctctccaccaagattggccacaaaagcctgatcccctggaacacagcaggcctcacatagacggtcagccattggatcataggaactgccctggcctgactcacccaatatggaggaggtgcctggggatgccctgtgtgaacactttgaggccaacatacttacccagaaccgctgtcaaaactgcttccaccctgaggaggcccatggagcaagataccaggagctcaggagcccttcaggtgctgaggtgccctactgcgacctgcctcgatgtccacctgcccctgaggacccactcagcgcctcaacctccggctgccagtctgtggtggacccaggcctcaggccagggcccaagaggggcccatccccctcagcagggctcccagaagagggtcccacagctgcccccaggagcaggagccgggagcttgaggcagtaccctatctggagggcctgaccacttccttgtgtggcagctgcaacgaggaccccggctctgaccccacctccagccctgactccgccacccctgatgataccagcaactcgtcctctgtggactgggacactgttgagaggcaggaggaggaggcccccagctgggacgagctcgcagtgatgatcccgaggaggcctcgggaggggccgagagctgacagctcccaaagggctccgtctctcctcaccaggtcccctgtgggaggagatgctgcaggccagaaaaaggaggacaccggcggtgggggccggagcgcaggacagcactgggcaaggctccggggagaaagcgggttgtccctggagcggcaccggtcaacactgacccaggcttcctccatgacaccacacagtggacctcgaagcaccacgtctcaggcttctcctgcccaaagggacactgctcaggctgcctctacacgtgaaatccccagagcctcctctccccatcgaatcacccaaagggacacctccagggcctcatccacccaacaggaaatctccagggcctcatccacccaacaggaaacctccagggcctcatccacccaagaggacacccctagggcctcatccacccaagaggacacccccagggcctcatctacacagtggaacacccccagagcttcctctccctcacgaagcacccaactggataaccccagaacctcttctacccagcaggacaacccccaaacttcttttcctacttgtactccccagcgggaaaaccccaggacaccctgtgtccagcaggacgatcccagagcctcctctcccaacagaaccactcaacgagagaattccagaacatcctgtgcccagcgggacaatcccaaagcctccagaacctcctctcccaatagagccacacgagacaaccccagaacatcctgcgcccagcgggacaatcccagagcctcctctcccagtagagctacacgagacaaccccacaacatcctgtgcccagcgggacaatcccagagcctccagaacctcctctcccaatagagccacacgagacaaccccagaacatcctgtgcccagcgggacaatcccagagcctcctctcccagtagagctacacgagacaaccccacaacatcctgtgcccagcgggacaatcccagagcctccagaacctcctctcccaatagagccacacgagacaaccccagaacatcctgcgcccagcgggacaatcccagagcctcctctcccaatagagctgcacgagacaaccccacaacatcctgtgcccagcgggacaatcccagagcctccagaacctcctctcccaatagagccacacgagacaaccccagaacatcctgtgcccagcgggacaatcccagagcctcctctcccaatagagctacacgagacaaccccacaacatcctgtgcccagcgggacaatcccagagcctccagaacctcctctcccaatagagccacacgagataaccccagaacatcctgtgcccagcgggacaatcccagagcctcctctcccaacagaaccacccaacaagacagccccagaacatcctgtgcccgacgggacgatcccagagcctcctctcctaacagaaccatccaacaagagaaccccagaacatcctgtgccctacgggacaatcccagagcctcctctcccagcagaaccatccaacaagagaaccccagaacatcctgtgcccaacgggacgatcccagagcctcctctcctaacagaaccacccaacaagagaaccccagaacatcctgtgcccgacgggacaatcccagagcctcctctcgcaacagaaccatccagcgagacaaccccagaacatcctgtgcccagcgggacaatcccagagcctcctctcctaacagaaccatccaacaagagaacctcagaacatcctgtacccgacaggacaatcccaggacctcctctcccaatagagccacacgagacaaccccagaacatcctgtgcccagcgggacaatctcagagcctcctctcccatcagagccacccaacaggacaaccccagaacttgtattcaacagaacatccccagatcatcttctacccaacaagacaaccctaaaacctcttgtaccaaacgagataacctcagacccacttgtacacagcgggaccgcacacagtccttttcctttcaacgagacaaccctggaacctcctcatctcaatgctgcacccaaaaggagaatctgagaccatcatctccccaccgctccactcaatggaacaatcccaggaattcatctccccatcgtactaacaaagacatcccctgggcctcgtttcccctccggccaactcagagtgatggtccccgaacctcttccccatctcgctccaagcaaagcgaggttccctgggcatccatcgccctccggccaacccaaggtgacaggcctcagacatcctctcccagcaggccagcccagcatgacccaccccagtcctcctttggccccacccagtacaacttgccatcccgggccacctcttcctcccataacccaggccaccagagcacctcccgaacttcctcacctgtgtaccccgctgcctatggggctcccctgacctctcctgagccctcccagcctccatgtgctgtgtgcattgggcaccgggatgcccctcgagcctcttcgccccctcgctatttgcagcacgaccccttccccttcttcccagagccccgcgcccctgagagtgaaccgccccaccacgagcctccctatataccacctgctgtgtgcattggacaccgagatgccccccgggcgtcctcgcccccccgccacacccaatttgaccccttccccttcctcccagacacatcagatgccgagcatcagtgtcagtccccccaacacgagccccttcagctccctgcacctgtgtgtattgggtaccgagatgcaccccgggcctcctccccaccacgccaggccccagagccttccctcttattccaggacctccccagggccagcacagagagccttgtcccttccatggactctctgcacgagtgcccccacatccccacccctgtgtgcattgggcaccgggatgcaccctccttctcatccccaccacgccaggctcctgagccatccctcttcttccaggatccccctggaactagtatggagagcctggccccctccactgactctctgcatggctccccagtgctgatcccccaagtgtgcatcgggcaccgggatgcaccccgagcctcctccccaccccgccacccacccagtgacctagcgttcctggcaccctcaccttcaccgggcagctctgggggctcccggggctcagcgcctcccggggagaccaggcacaacttggagcgggaggagtacactgtgctggccgacctgcccccacccaggaggctggcccagagacagccagggccccaggcgcagtgcagcagcgggggccgcacccacagccctggccgtgcagaggtggagcgcctcttcgggcaagagcgcaggaagtccgaggcagcgggggccttccaggcccaggacgagggacggtcacagcagcccagccaaggccagagccaacttctccgaagacagtccagccctgcccccagcaggcaggtgaccatgctccctgccaaacaggcagaactgacccggcggagccaagcagagccccctcatccttggagtcctgagaagagacctgagggagatcggcagctccaggggtccccgctgccccccaggacatcagccaggacccctgagagggagctgcggacacagagacctctggagagtggccaagcaggcccaagacagcctctgggggtgtggcagagtcaggaggaaccgccagggtcccagggccctcatagacacctagaaaggagctggagcagccaggagggaggcctgggccctgggggctggtggggatgtggagagcccagcctgggggcagccaaagccccggagggagcatgggggggcacttccagggagtacaaggagagctgggggcagccagaggcctgggaggagaagcccactcatgagctccccagagaactaggaaagagaagcccactcacgagcccccctgagaactggggaggccccgcagagtcctcacaatcctggcactctgggacacccactgctgtgggctggggggcagagggagcgtgtccatacccgcgtggctctgagaggcgacccgagcttgactggagggatctgcttggccttctccgggcaccaggagagggggtctgggcccgtgtccccagcctggactgggagggcctcttggagctcctgcaggccaggctgccccgcaaggacccagctggacacagggatgacctggccagggctttagggccagagctgggtcccccaggcacaaacgatgtccctgagcaggagtcacacagccagccagaaggctgggccgaggccaccccagtcaatggacacagccccgcactgcagtcccagagcccggtccagctgcccagccctgcctgcacctccacccagtggccaaagatcaaagtgacaagaggaccagcgaccgcaactctggcaggcctggagcagacgggccccctggggagcaggagcactgcgaagggccccagcttgccagagctgcagttccaaccagaggagcctgaggagtcagaaccaagcagaggccaagaccccctgactgaccagaagcaggcagactcggcagacaagaggccagcagagggcaaggctgggagcccgctcaagggccgactggtgacctcatggcggatgcccggggaccggcccacgctgttcaatccgttcctgctgtctctgggggtcctcaggtggcgaaggcccgatctgctcaacttcaagaagggatggatgtcgatcttggacgagcctggagagcctccctccccctcgctcaccaccacctctacttcgcagtggaagaaacattggtttgtgctgacagattcaagtctcaaatattacagagactccactgctgaggaggcagatgagctggatggtgagatcgacctgcgttcctgcacggatgtcactgagtacgcggtgcagcgcaactatggcttccagatccacaccaaggatgctgtctataccttgtcggccatgacctcaggcatccggcggaactggatcgaggctctgagaaagaccgtacgtccaacttcagccccagatgtcaccaagctctcggactctaacaaggagaacgcgctgcacagctacagcacccagaagggccccctgaaggcaggggagcagcgggcgggctctgaggtcatcagccggggtggccctcggaaggcggacgggcagcgtcaggccttggactacgtggagctctcgccgctgacccaggcttccccgcagcgggcccgcaccccagcccgcactcctgaccgcctggccaagcaggaggagctggagcgggacctggcccagcgctccgaggagcggcgcaagtggtttgaggccacagacagcaggaccccagaggtgcctgctggtgaggggccgcgccggggcctgggtgcccccctgactgaggaccagcaaaaccggcttagtgaggagatcgagaagaagtggcaggagctggagaagctgcccctgcgggagaataagcgggtgcccctcactgccctgctcaaccaaagccgcggagagcgccgagggcccccaagtgacggccacgaggcactggagaaggaggttcaggctcttcgggcccagctggaggcgtggcgtctccaaggggaggctcctcagagtgcactgagatcccaggaggatggccacatccccccgggctacatctcacaggaggcatgtgagcgcagcctggcagagatggagtcctcgcaccagcaggtgatggaggagctgcagcggcaccacgagcgggagctgcagcgcctgcagcaggagaaggagtggctcctggctgaggagacggcagccacggcctcagccattgaagccatgaagaaggcctaccaggaagagctgagccgagagctgagcaaaacacggagtctccagcagggcccggatggcctccggaagcagcaccagtcagatgtggaggcactgaagcgagagctgcaggtgctatcggagcagtactcgcagaagtgcctggagattggggcactcatgcggcaggctgaggagcgcgagcacacgctgcgccgctgccagcaggagggccaggagctgctgcgccacaaccaggagctgcatggccgcctgtcagaggagatagaccagctgcgcggcttcattgcctcgcagggcatgggcaatggctgcgggcgcagcaacgagcggagttcctgcgagctagaggtgctgcttcgcgtaaaagaaaacgaactccagtacctaaagaaggaggtgcagtgcctccgggacgagctccagatgatgcagaaggacaagcgcttcacctcgggaaagtaccaggacgtctatgtggagctgagccacatcaagacacggtctgagcgggagatcgagcagctgaaggagcacctgcgtcttgccatggccgccctccaggagaaggagtcgatgcgcaacagcctggctgagtagaggtcccgcccagctgcagaccctccaggctggaggaccagccgccctccttccctcctggatggaagtaaaaagccaagctttctccccaccctctgtgggccacacgtgcacttgcacccaccacacacacacacacacacacacacacacacacagacacacagacacatacgcacacacgtgcacacatgtacacacggatacacacacacacacacacactgcatatctgagcgcgcccctcgcactgggtctcaccttgcaccttcttcaggattttatatgtgaagagatttttatatagatttttttcctttttttccaaaacactttatactttaaaaaaaaaaaaaaaaagcaattcctggtggctgtgtgcctccaaccctggtccccctctgtctccagccaccctctgcttgggcttctgagctggtggccctggcccagaggtctggcggaggcccaggcagcagccatggcggggtgtctctacaggggagaggcgggagcctgccaccctcttcctgccctacctcctactaacacttcctgccccatttggacccgtaccatggggctcaggacagagggagctagcagctggcctccatggccccacagcctccttcgaggctgtgctgggtgcagaaccgccagagccacccaaaaggtgtttctcttctgctccctgaacctcttaacttaataaaacgttccagcagctctggtgtcctagatggctggcagaacaggaatggagattggggtttcttgaagtggcttccccactcacaccctacccacaccccacccttcctaaagcagcggcctctaggcttctgagggtggggctgaaaatccaaggtctcccttagtacagactgtgacgcccccagtgtggcttgcaggctagtggcagcggaagcatgtgggaaatagcaagtccagtcccaccccaacctactgaaccagcgtctgcattttaacagggtgccccagtgattcacgtgaccttcaaagtctgaggagccctggagtagggcccagggcccaggcctgagagagaggcctggggctaagactagccctgaccatgaccttgggcaagtcacacccctcactgagcctcagtttgcttctccatcaaatgggtgtttttctttcagtcccagtcctctcctgaggcttttcccagaggtcatgcccagccctgggcaggggtgagggcagggttgtggctgccaggcacaggtccagcgggctgggagtcctcaccatggctggctgtgctgattatggttgcatggggctgggaagaggtcccatttctgagccacagaaacaggccacatccagtaggggtcctggaaggctgtgagaacccagaggagaccctgacccagcctgcaggtagaagactgcctttggaggcagctttgaaagatgactcttccagatggaagaatcaggaagggccttcccacgtggaggcaccagcaggagcaaacgtccctggtgtgttcaggcaaagagccacaggagagtgacctcgtggagtgggaagagattgtttcccattcccttgccagggattggttgaggaatggacaaggcttgcagttcacgcaagccagtgaaatgcgaggggaagtcttgggagtggggtggaggaggtcatctgggaagggtgtccttggtcttaaaaagaggcacaagaggccgggcgcggtggctcttgcctattatcctagcactttgggaggccaaggcagggggatcacttgaggtcaggagttcgagaccagcctggccaacatggtgaaaccccgtctctactaaaaatacaaaaaattagccagacgtggtgccaagcacctgtaatcccagctactcaggaggctgaggcaggagaatcacttgaacccaggaggcagaagttgcagtgagccaagatcgcgccactgcactccagcctgtgtgacaagggcgaaactccatctcaaaaaaaaagggggagggtggcgcaaggagaggacacctctctcctggccctgtcgccatcttccctcatcaatagctaaaaatggcaaagaagaaagagccaggaccccgtgccatcaaatcctccggccttgtgctgccctgtctcggcactgcttgccttaggagatcaggagtgttcctagccactgggagatgggatgcctgccactggcagctctgccgtccatcctcaccatcccaccgtccccccaagacagctctccatcccatcctctgcctcccttctagcctcaacctaactcagggctcccccgtctcacacctgggttgcaggaacatcctcttcaccaacccccctcccatccctcctcagggctgcctagggcagctacaaaaaccaggccagcctctgaaaggtgctccacatctcattaaaaaccgtgaaatcgcactgccccactatcagaatagctcagaggagaaggtctgccagtaccaagtgctggtggggatacggagaagagcagctcccaggcgctgctggtgcaaatgtgctttgttgcacccacggcaggaaactgaccagcttctcatcaagttaaatacgcatctaccctatggcctagcatttccactcttgcttacacatccaggagaaatgagtccttacatgcacaaaaggatgagtaccgtaatactcacatcagcaaataaacaatacagctgtgtgtcagtagtagaatgaataaattgtggtcgattcata

SEQ ID NO: 32518 - DNA, 2125 bp, Homo sapiens
aaaaagttttatgggcggatggaaggggccggggcagcgtcggggaaaggaagggccggaggcgcggcggcgggcggccgagaggggcggcggcggcggcggcggcggggttcccgcgccgcggagcccggcccgagagccgcgtccacgttcctgcctcctgctcccgccgccctggggcgccgccatgacgcccgatctgctcaacttcaagaagggatggatgtcgatcttggacgagcctggagagcctccctccccctcgctcaccaccacctctacttcgcagtggaagaaacattggtttgtgctgacagattcaagtctcaaatattacagagactccactgctgaggaggcagatgagctggatggtgagatcgacctgcgttcctgcacggatgtcactgagtacgcggtgcagcgcaactatggcttccagatccacaccaaggatgctgtctataccttgtcggccatgacctcaggcatccggcggaactggatcgaggctctgagaaagaccgtacgtccaacttcagccccagatgtcaccaagctctcggactctaacaaggagaacgcgctgcacagctacagcacccagaagggccccctgaaggcaggggagcagcgggcgggctctgaggtcatcagccggggtggccctcggaaggcggacgggcagcgtcaggccttggactacgtggagctctcgccgctgacccaggcttccccgcagcgggcccgcaccccagcccgcactcctgaccgcctggccaagcaggaggagctggagcgggacctggcccagcgctccgaggagcggcgcaagtggtttgaggccacagacagcaggaccccagaggtgcctgctggtgaggggccgcgccggggcctgggtgcccccctgactgaggaccagcaaaaccggcttagtgaggagatcgagaagaagtggcaggagctggagaagctgcccctgcgggagaataagcgggtgcccctcactgccctgctcaaccaaagccgcggagagcgccgagggcccccaagtgacggccacgaggcactggagaaggaggttcaggctcttcgggcccagctggaggcgtggcgtctccaaggggaggctcctcagagtgcactgagatcccaggaggatggccacatccccccgggctacatctcacagctggtgggcgtgatcactgtgcccgttttacagacaaggccactgagctctgagaggttatgtgacttgcccaaggtcaccccgcctgcaggtctcaaaggtgggatttgagcgagggtccggctgactgcagagcctgtgtgtgagtccccgtgtgacactctgcacttggacccttgccccggggaagtggggggctagtggccccgagagtcactccctgaacacagggaaatcctgccgaggcccactgggccaaggccccacacaaggaggtctgcaggacaggggagcctccagtagccctcagagaatgcaccgtccgcctaggacagcggttctcaacggggtccattttgtcccccttggggacatttggctgtgtctgggaatacttctggttgtcacaactaggacaaactaactctctagaaaaaacgtgtgtgtgtacacatatataagtttattataaattttaccaataaaaacaatgcttagtacacaatttacaaataaaaatatataattttattgtgaattccgtacagcaaatggatttttctcagaatgctttcagtgattttttccatactcttgtatccacaactgattaacaaagggggttgttctaacgtgtgctggttgacatttttgtttatggtaatgagtaagatgagaagacatttgtcgaaactttactggtccatgttgtcagctacttctttgctagatcggatagtagttttctattgagaatatttgagaatattctattaagaatatttttgcaattttttgttctatttacaatgtaatggttatagatgtgagatacttctaagtttaatctgcattattagcattttcttatcacttgcttaagtctagacaatcaacaaaacaataaatcaagccctgatgtgtaatgtt

SEQ ID NO: 32519 - DNA, 5322 bp, Homo sapiens
atcgctctgattcattgttaaaataaagaggccatgaccctggcactcccaccccggcagcccctgtgcgtggaaacccagccaaggtctgatgatggaggagccttggccctggctgtcccaggggaggaggtgaaattcctcagctctccaccaagattggccacaaaagcctgatcccctggaacacagcaggcctcacatagacggtcagccattggatcataggaactgccctggcctgactcacccaatatggaggaggtgcctggggatgccctgtgtgaacactttgaggccaacatacttacccagaaccgctgtcaaaactgcttccaccctgaggaggcccatggagcaagataccaggagctcaggagcccttcaggtgctgaggtgccctactgcgacctgcctcgatgtccacctgcccctgaggacccactcagcgcctcaacctccggctgccagtctgtggtggacccaggcctcaggccagggcccaagaggggcccatccccctcagcagggctcccagaagagggtcccacagctgcccccaggagcaggagccgggagcttgaggcagtaccctatctggagggcctgaccacttccttgtgtggcagctgcaacgaggaccccggctctgaccccacctccagccctgactccgccacccctgatgataccagcaactcgtcctctgtggactgggacactgttgagaggcaggaggaggaggcccccagctgggacgagctcgcagtgatgatcccgaggaggcctcgggaggggccgagagctgacagctcccaaagggctccgtctctcctcaccaggtcccctgtgggaggagatgctgcaggccagaaaaaggaggacaccggcggtgggggccggagcgcaggacagcactgggcaaggctccggggagaaagcgggttgtccctggagcggcaccggtcaacactgacccaggcttcctccatgacaccacacagtggacctcgaagcaccacgtctcaggcttctcctgcccaaagggacactgctcaggctgcctctacacgtgaaatccccagagcctcctctccccatcgaatcacccaaagggacacctccagggcctcatccacccaacaggaaatctccagggcctcatccacccaacaggaaacctccagggcctcatccacccaagaggacacccctagggcctcatccacccaagaggacacccccagggcctcatctacacagtggaacacccccagagcttcctctccctcacgaagcacccaactggataaccccagaacctcttctacccagcaggacaacccccaaacttcttttcctacttgtactccccagcgggaaaaccccaggacaccctgtgtccagcaggacgatcccagagcctcctctcccaacagaaccactcaacgagagaattccagaacatcctgtgcccagcgggacaatcccaaagcctccagaacctcctctcccaatagagccacacgagacaaccccagaacatcctgcgcccagcgggacaatcccagagcctcctctcccagtagagctacacgagacaaccccacaacatcctgtgcccagcgggacaatcccagagcctccagaacctcctctcccaatagagccacacgagacaaccccagaacatcctgtgcccagcgggacaatcccagagcctcctctcccagtagagctacacgagacaaccccacaacatcctgtgcccagcgggacaatcccagagcctccagaacctcctctcccaatagagccacacgagacaaccccagaacatcctgcgcccagcgggacaatcccagagcctcctctcccaatagagctgcacgagacaaccccacaacatcctgtgcccagcgggacaatcccagagcctccagaacctcctctcccaatagagccacacgagacaaccccagaacatcctgtgcccagcgggacaatcccagagcctcctctcccaatagagctacacgagacaaccccacaacatcctgtgcccagcgggacaatcccagagcctccagaacctcctctcccaatagagccacacgagataaccccagaacatcctgtgcccagcgggacaatcccagagcctcctctcccaacagaaccacccaacaagacagccccagaacatcctgtgcccgacgggacgatcccagagcctcctctcctaacagaaccatccaacaagagaaccccagaacatcctgtgccctacgggacaatcccagagcctcctctcccagcagaaccatccaacaagagaaccccagaacatcctgtgcccaacgggacgatcccagagcctcctctcctaacagaaccacccaacaagagaaccccagaacatcctgtgcccgacgggacaatcccagagcctcctctcgcaacagaaccatccagcgagacaaccccagaacatcctgtgcccagcgggacaatcccagagcctcctctcctaacagaaccatccaacaagagaacctcagaacatcctgtacccgacaggacaatcccaggacctcctctcccaatagagccacacgagacaaccccagaacatcctgtgcccagcgggacaatctcagagcctcctctcccatcagagccacccaacaggacaaccccagaacttgtattcaacagaacatccccagatcatcttctacccaacaagacaaccctaaaacctcttgtaccaaacgagataacctcagacccacttgtacacagcgggaccgcacacagtccttttcctttcaacgagacaaccctggaacctcctcatctcaatgctgcacccaaaaggagaatctgagaccatcatctccccaccgctccactcaatggaacaatcccaggaattcatctccccatcgtactaacaaagacatcccctgggcctcgtttcccctccggccaactcagagtgatggtccccgaacctcttccccatctcgctccaagcaaagcgaggttccctgggcatccatcgccctccggccaacccaaggtgacaggcctcagacatcctctcccagcaggccagcccagcatgacccaccccagtcctcctttggccccacccagtacaacttgccatcccgggccacctcttcctcccataacccaggccaccagagcacctcccgaacttcctcacctgtgtaccccgctgcctatggggctcccctgacctctcctgagccctcccagcctccatgtgctgtgtgcattgggcaccgggatgcccctcgagcctcttcgccccctcgctatttgcagcacgaccccttccccttcttcccagagccccgcgcccctgagagtgaaccgccccaccacgagcctccctatataccacctgctgtgtgcattggacaccgagatgccccccgggcgtcctcgcccccccgccacacccaatttgaccccttccccttcctcccagacacatcagatgccgagcatcagtgtcagtccccccaacacgagccccttcagctccctgcacctgtgtgtattgggtaccgagatgcaccccgggcctcctccccaccacgccaggccccagagccttccctcttattccaggacctccccagggccagcacagagagccttgtcccttccatggactctctgcacgagtgcccccacatccccacccctgtgtgcattgggcaccgggatgcaccctccttctcatccccaccacgccaggctcctgagccatccctcttcttccaggatccccctggaactagtatggagagcctggccccctccactgactctctgcatggctccccagtgctgatcccccaagtgtgcatcgggcaccgggatgcaccccgagcctcctccccaccccgccacccacccagtgacctagcgttcctggcaccctcaccttcaccgggcagctctgggggctcccggggctcagcgcctcccggggagaccaggcacaacttggagcgggaggagtacactgtgctggccgacctgcccccacccaggaggctggcccagagacagccagggccccaggcgcagtgcagcagcgggggccgcacccacagccctggccgtgcagaggtggagcgcctcttcgggcaagagcgcaggaccatgctccctgccaaacaggcagaactgacccggcggagccaagcagagccccctcatccttggagtcctgagaagagacctgagggagatcggcagctccaggggtccccgctgccccccaggacatcagccaggacccctgagagggagctgcggacacagagacctctggagagtggccaagcaggcccaagacagcctctgggggtgtggcagagtcaggaggaaccgccagggtcccagggccctcatagacacctagaaaggagctggagcagccaggagggaggcctgggccctgggggctggtggggatgtggagagcccagcctgggggcagccaaagccccggagggagcatgggggggcacttccagggagtacaaggagagctgggggcagccagaggcctgggaggagaagcccactcatgagctccccagagaactaggaaagagaagcccactcacgagcccccctgagaactggggaggccccgcagagtcctcacaatcctggcactctgggacacccactgctgtgggctggggggcagagggagcgtgtccatacccgcgtggctctgagaggcgacccgagcttgactggagggatctgcttggccttctccgggcaccaggagagggggtctgggcccgtgtccccagcctggactgggagggcctcttggagctcctgcaggccaggctgccccgcaaggacccagctggacacagggatgacctggccagggctttagggccagagctgggtcccccaggcacaaacgatgtccctgagcaggagtcacacagccagccagaaggctgggccgaggccaccccagtcaatggacacagccccgcactgcagtcccagagcccggtccagctgcccagccctgcctgcacctccacccagtggccaaagatcaaagtgacaagaggaccagcgaccgcaactctggcaggcctggagcagacgggccccctggggagcaggagcactgcgaagggccccagcttgccagagctgcagttccaaccagaggagcctgaggagtcagaaccaagcagaggccaagaccccctgactgaccagaagcaggcagactcg

SEQ ID NO: 32520 - DNA, 919 bp, Homo sapiens
gctggtctggactgccctctgagctctcagggggtctctatgcaggcagagtcctcccagcccctctctcccattcttgggcgaggggtcggctggagagaggcccctgggacatctggcccgatctgctcaacttcaagaagggatggatgtcgatcttggacgagcctggagagcctccctccccctcgctcaccaccacctctacttcgcagtggaagaaacattggtttgtgctgacagattcaagtctcaaatattacagagactccactgctgaggaggcagatgagctggatggtgagatcgacctgcgttcctgcacggatgtcactgagtacgcggtgcagcgcaactatggcttccagatccacaccaaggatgctgtctataccttgtcggccatgacctcaggcatccggcggaactggatcgaggctctgagaaagaccgtacgtccaacttcagccccagatgtcaccaagctctcggactctaacaaggagaacgcgctgcacagctacagcacccagaagggccccctgaaggcaggggagcagcgggcgggctctgaggtcatcagccggggtggccctcggaaggcggacgggcagcgtcaggccttggactacgtggagctctcgccgctgacccaggcttccccgcagcgggcccgcaccccagcccgcactcctgaccgcctggccaagcaggaggagctggagcgggacctggcccagcgctccgaggagcggcgcaagtggtttgaggccacagacagcaggaccccagaggtgcctgctggtgaggggccgcgccggggcctgggtgcccccctgactgaggaccagcaaaaccggcttagtgaggagatcgagaagaagtggcaggagctggagaagctgcccctgcgggagaa

SEQ ID NO: 32521 - DNA, 586 bp, Homo sapiens
ttcgcgcagtgctgctggtctggactgccctctgagctctcagggggtctctatgcaggcagagtcctcccagcccctctctcccattcttgggcgaggggtcggctggagagaggcccctgggacatctgggtgtgtgtgccagccacccagcccaacttcttggctctctgagtgccactatcaggaaaggggccagggctgcctcagtggctgggaggcctgcttggacttgggggttacctagggccttagccctcttggctggcttcccaggagctcggtcccacaggacttggggacaggcccgatctgctcaacttcaagaagggatggatgtcgatcttggacgagcctggagagcctccctccccctcgctcaccaccacctctacttcgcagtggaagaaacattggtttgtgctgacagattcaagtctcaaatattacagagactccactgctgaggaggcagatgagctggatggtgagatcgacctgcgttcctgcacggatgtcactgagtacgcggtgcagcgcaactatggcttccagatccacaccaaggatgctgtctataccttgt

SEQ ID NO: 32522 - DNA, 1763 bp, Homo sapiens
ggaggttgtctatcccacagttggagaggggccctctctgccccagtgggcgatctgggctacggccaagttgccaccagctagttccgcttgaaaaccacttctggccccgtgggggactcaagtcgccaagcgagggttcccctgagcgccggagctcacaggtctcgccttgtcccgaaagccccgcaatcgaggcggaggcgaccgagcccccgactctcctagaacgttgccacaagaagggggaacgtcggaacagtgcatcatcgggcggcggccggggcggcggcaggagggcgggcggggggcagggctccgggggactgggcgggccatggcggaggacggcgaggaggcggagttccacttcgcggcgctctatataagtgggcagtggccgcgactgcgcgcagacactgaccttcagcgcctcggctccagcgccatggcgccctccaggaagttcttcgttgggggaaactggaagatgaacgggcggaagcagagtctgggggagctcatcggcactctgaacgcggccaaggtgccggccgacaccgaggtggtttgtgctccccctactgcctatatcgacttcgcccggcagaagctagatcccaagattgctgtggctgcgcagaactgctacaaagtgactaatggggcttttactggggagatcagccctggcatgatcaaagactgcggagccacgtgggtggtcctggggcactcagagagaaggcatgtctttggggagtcagatgagctgattgggcagaaagtggcccatgctctggcagagggactcggagtaatcgcctgcattggggagaagctagatgaaagggaagctggcatcactgagaaggttgttttcgagcagacaaaggtcatcgcagataacgtgaaggactggagcaaggtcgtcctggcctatgagcctgtgtgggccattggtactggcaagactgcaacaccccaacaggcccaggaagtacacgagaagctccgaggatggctgaagtccaacgtctctgatgcggtggctcagagcacccgtatcatttatggaggctctgtgactggggcaacctgcaaggagctggccagccagcctgatgtggatggcttccttgtgggtggtgcttccctcaagcccgaattcgtggacatcatcaatgccaaacaatgagccccatccatcttccctacccttcctgccaagccagggactaagcagcccagaagcccagtaactgccctttccctgcatatgcttctgatggtgtcatctgctccttcctgtggcctcatccaaactgtatcttcctttactgtttatatcttcaccctgtaatggttgggaccaggccaatcccttctccacttactataatggttggaactaaacgtcaccaaggtggcttctccttggctgagagatggaaggcgtggtgggatttgctcctgggttccctaggccctagtgagggcagaagagaaaccatcctctcccttcttacaccgtgaggccaagatcccctcagaaggcaggagtgctgccctctcccatggtgcccgtgcctctgtgctgtgtatgtgaaccacccatgtgagggaataaacctggcactaggtcttgtggtttgtctgccttcactggacttgcccagataatcttcctttttgaggcagctatataaatgatcatttgtgcaagaaaaaaaaaaaaacaagaacaggtttctataacaaca

SEQ ID NO: 32523 - DNA, 1344 bp, Homo sapiens
gcgcagacactgaccttcagcgcctcggctccagcgccatggcgccctccaggaagttcttcgttgggggaaactggaagatgaacgggcggaagcagagtctgggggagctcatcggcactctgaacgcggccaaggtgccggccgacaccgaggtggtttgtgctccccctactgcctatatcgacttcgcccggcagaagctagatcccaagattgctgtggctgcgcagaactgctacaaagtgactaatggggcttttactggggagatcagccctggcatgatcaaagactgcggagccacgtgggtggtcctggggcactcagagagaaggcatgtctttggggagtcagatgagctgattgggcagaaagtggcccatgctctggcagagggactcggagtaatcgcctgcattggggagaagctagatgaaagggaagctggcatcactgagaaggttgttttcgagcagacaaaggtcatcgcagataacgtgaaggactggagcaaggtcgtcctggcctatgagcctgtgtgggccattggtactggcaagactgcaacaccccaacaggcccaggaagtacacgagaagctccgaggatggctgaagtccaacgtctctgatgcggtggctcagagcacccgtatcatttatggaggctctgtgactggggcaacctgcaaggagctggccagccagcctgatgtggatggcttccttgtgggtggtgcttccctcaagcccgaattcgtggacatcatcaatgccaaacaatgagccccatccatcttccctacccttcctgccaagccagggactaagcagcccagaagcccagtaactgccctttccctgcatatgcttctgatggtgtcatctgctccttcctgtggcctcatccaaactgtatcttcctttactgtttatatcttcaccctgtaatggttgggaccaggccaatcccttctccacttactataatggttggaactaaacgtcaccaaggtggcttctccttggctgagagatggaaggcgtggtgggatttgctcctgggttccctaggccctagtgagggcagaagagaaaccatcctctcccttcttacaccgtgaggccaagatcccctcagaaggcaggagtgctgccctctcccatggtgcccgtgcctctgtgctgtgtatgtgaaccacccatgtgagggaataaacctggcactaggtcttgtggtttgtctgccttcactggacttgcccagataatcttcctttttgaggcagctatataaatgatcatttgtgcaagaaaaaaaaaaaaacaagaacaggtttct

SEQ ID NO: 32524 - DNA, 1476 bp, Homo sapiens
ctcgccggcgtccgcgtccccgcgccgagctgctcgggctccctgagccccagatctgaccccttcccttcggcaacctgaacgactcccgccttccacggaagggaccgagcccgtgccaaacaggctgagcgatttgggagtgaggagccatcctaccgctttccccaacctggaaacagcaaagcgcaaggcctctgagtcagttaggtctctgccacccacgggcaaaggatgctctcctccatcctccttcctccctccaccgaaatcggagagccgcgggcctgatccaaagaggcatccccttctcgttcattccccagaggcctcaatacaaaccccaggagttggcccctctccttttgctacaaatccttgccttgcaaaggggagaggtggtttgtgctccccctactgcctatatcgacttcgcccggcagaagctagatcccaagattgctgtggctgcgcagaactgctacaaagtgactaatggggcttttactggggagatcagccctggcatgatcaaagactgcggagccacgtgggtggtcctggggcactcagagagaaggcatgtctttggggagtcagatgagctgattgggcagaaagtggcccatgctctggcagagggactcggagtaatcgcctgcattggggagaagctagatgaaagggaagctggcatcactgagaaggttgttttcgagcagacaaaggtcatcgcagataacgtgaaggactggagcaaggtcgtcctggcctatgagcctgtgtgggccattggtactggcaagactgcaacaccccaacaggcccaggaagtacacgagaagctccgaggatggctgaagtccaacgtctctgatgcggtggctcagagcacccgtatcatttatggaggctctgtgactggggcaacctgcaaggagctggccagccagcctgatgtggatggcttccttgtgggtggtgcttccctcaagcccgaattcgtggacatcatcaatgccaaacaatgagccccatccatcttccctacccttcctgccaagccagggactaagcagcccagaagcccagtaactgccctttccctgcatatgcttctgatggtgtcatctgctccttcctgtggcctcatccaaactgtatcttcctttactgtttatatcttcaccctgtaatggttgggaccaggccaatcccttctccacttactataatggttggaactaaacgtcaccaaggtggcttctccttggctgagagatggaaggcgtggtgggatttgctcctgggttccctaggccctagtgagggcagaagagaaaccatcctctcccttcttacaccgtgaggccaagatcccctcagaaggcaggagtgctgccctctcccatggtgcccgtgcctctgtgctgtgtatgtgaaccacccatgtgagggaataaacctggcactagg

SEQ ID NO: 32525 - DNA, 1238 bp, Homo sapiens
atggatgtgatggagctgcttgaagaagatctcacatgccctatttgttgtagtctgtttgatgatccacgggttttgccttgctcccacaacttctgcaaaaaatgcttagaaggtatcttagaagggagtgtgcggaattccttgtggagaccagctccattcaagtgtcctacatgccgtaaggaaacttcagctactggaattaatagcctgcaggttaattactccctgaagggtattgtggaaaagtataacaagatcaagatctctcccaaaatgccagtatgcaaaggacacttggggcagcctctcaacattttctgcctgactgatatgcagctgatttgtgggatctgtgctactcgtggggagcacaccaaacatgtcttctgttctattgaagatgcctatgctcaggaaagggatgcctttgagtccctcttccagagctttgagacctggcgtcggggagatgctctttctcgcttggataccttggaaactagtaagaggaaatccctacagttactgactaaagattcagataaagtgaaggaattttttgagaagttacaacacacactggatcaaaagaagaatgaaattctgtctgactttgagaccatgaaacttgctgttatgcaagcatatgacccagagatcaacaaactcaacaccatcttgcaggagcaacggatggcctttaacattgctgaggctttcaaagatgtgtcagaacccattgtatttctgcaacagatgcaggagtttagagagaaaatcaaagtaatcaaggaaactcctttacctccctctaatttgcctgcaagccctttaatgaagaactttgataccagtcagtgggaagacataaaactagtcgatgtggataaactttctttgcctcaagacactggcacattcattagcaagattccctggagcttttataagttatttttgctaatccttctgcttggccttgtcattgtctttggtcctaccatgttcctagaatggtcattatttgatgacctggcaacttggaaaggctgtctttcaaacttcagttcctatctgactaaaacagccgatttcatagaacaatcagttttttactgggaacaggtgacagatgggtttttcattttcaatgaaagattcaagaattttactttggtggtactgaacaatgtggcagaatttgtgtgcaaatataaactattataaaatct

SEQ ID NO: 32526 - DNA, 1637 bp, Homo sapiens
gccgcgagtccattttggggctgtgcttggcgcgtaccgtgcggtccctgtagttggaggacgggcggtcgcgcggcctttcccactagccggaggtcggagataagtacccgccgcccggctcctctcgggaaagcggggtggtcctcgaaccttcagcgagggtggggagttgcccagtagcctctagttcgttagtcaaaacgtgaaaaaaaagacctgctttgccctgggaaatagtaaccctgccaaatacatcagcttgtaggagacagagaataacagcacctggccgggtgcagtggctcaggcctgtaatcgcagcactttgggaggctgaggtgggcggatcacctgaggtcaggagctcgagaccagcctggccaaaatggatgtgatggagctgcttgaagaagatctcacatgccctatttgttgtagtctgtttgatgatccacgggttttgccttgctcccacaacttctgcaaaaaatgcttagaaggtatcttagaagggagtgtgcggaattccttgtggagaccagctccattcaagtgtcctacatgccgtaaggaaacttcagctactggaattaatagcctgcaggttaattactccctgaagggtattgtggaaaagtataacaagatcaagatctctcccaaaatgccagtatgcaaaggacacttggggcagcctctcaacattttctgcctgactgatatgcagctgatttgtgggatctgtgctactcgtggggagcacaccaaacatgtcttctgttctattgaagatgcctatgctcaggaaagggatgcctttgagtccctcttccagagctttgagacctggcgtcggggagatgctctttctcgcttggataccttggaaactagtaagaggaaatccctacagttactgactaaagattcagataaagtgaaggaattttttgagaagttacaacacacactggatcaaaagaagaatgaaattctgtctgactttgagaccatgaaacttgctgttatgcaagcatatgacccagagatcaacaaactcaacaccatcttgcaggagcaacggatggcctttaacattgctgaggctttcaaagatgtgtcagaacccattgtatttctgcaacagatgcaggagtttagagagaaaatcaaagtaatcaaggaaactcctttacctccctctaatttgcctgcaagccctttaatgaagaactttgataccagtcagtgggaagacataaaactagtcgatgtggataaactttctttgcctcaagacactggcacattcattagcaagattccctggagcttttataagttatttttgctaatccttctgcttggccttgtcattgtctttggtcctaccatgttcctagaatggtcattatttgatgacctggcaacttggaaaggctgtctttcaaacttcagttcctatctgactaaaacagccgatttcatagaacaatcagttttttactgggaacaggtgacagatgggtttttcattttcaatgaaagattcaagaattttactttggtggtactgaacaatgtggcagaatttgtgtgcaaatataaactattataaaatctgtttcaagtat

SEQ ID NO: 32527 - DNA, 7249 bp, Homo sapiens
ccggagccgcgagtccattttggggctgtgcttggcgcgtaccgtgcggtccctgtagttggaggacgggcggtcgcgcggcctttcccactagccggaggtcggagataagtacccgccgcccggctcctctcgggaaagcggggtggtcctcgaaccttcagcgagggtggggagttgcccaggtcagcagggatctgcgtgggttgggggggctggcgaaggccgtctgagctccagtccggcagcgcggcagaaaccagcggggcactgtcatgggcctggggaggagcggcctgcggagggcgccggggcagtgtgtctgtggtccagaaaacctgctccgtccggagccttcctggccccgctaccagcgtctccacatcccctagaaaagaaaagacgggtgtgggccttaggttacagcgcgccgccagcgtttggttgcatggcgccgggggagggcgccctaaccgagaagctgcttaatacaaagagctccaggctcctggcggttcaccaggtctaaacagccgggctttatttgtgggggcgattgaaaaaattgagggtcaagattggggtgctgtgcaaataaatgcgttaatactgttctttttcttctttctttgcagtagcctctagttcgttagtcaaaacgtgaaaaaaaagacctgctttgccctgggaaatagtaaccctgccaaatacatcagcttgtaggagacagaggatgtgatggagctgcttgaagaagatctcacatgccctatttgttgtagtctgtttgatgatccacgggttttgccttgctcccacaacttctgcaaaaaatgcttagaaggtatcttagaagggagtgtgcggaattccttgtggagaccagctccattcaagtgtcctacatgccgtaaggaaacttcagctactggaattaatagcctgcaggttaattactccctgaagggtattgtggaaaagtataacaagatcaagatctctcccaaaatgccagtatgcaaaggacacttggggcagcctctcaacattttctgcctgactgatatgcagctgatttgtgggatctgtgctactcgtggggagcacaccaaacatgtcttctgttctattgaagatgcctatgctcaggaaagggatgcctttgagtccctcttccagagctttgagacctggcgtcggggagatgctctttctcgcttggataccttggaaactagtaagaggaaatccctacagttactgactaaagattcagataaagtgaaggaattttttgagaagttacaacacacactggatcaaaagaagaatgaaattctgtctgactttgagaccatgaaacttgctgttatgcaagcatatgacccagagatcaacaaactcaacaccatcttgcaggagcaacggatggcctttaacattgctgaggctttcaaagatgtgtcagaacccattgtatttctgcaacagatgcaggagtttagagagaaaatcaaagtaatcaaggaaactcctttacctccctctaatttgcctgcaagccctttaatgaagaactttgataccagtcagtgggaagacataaaactagtcgatgtggataaactttctttgcctcaagacactggcacattcattagcaagattccctggagcttttataagttatttttgctaatccttctgcttggccttgtcattgtctttggtcctaccatgttcctagaatggtcattatttgatgacctggcaacttggaaaggctgtctttcaaacttcagttcctatctgactaaaacagccgatttcatagaacaatcagttttttactgggaacaggtgacagatgggtttttcattttcaatgaaagattcaagaattttactttggtggtactgaacaatgtggcagaatttgtgtgcaaatataaactattataaaatctgtttcaagtatgcagttttcttttgttagaaattgttagagaatagagagtggtaattcagatttggtcaacgattctagtcacatattttcctccaaaagtattccttccaaaaataatctatacatgttcaaattaggtagcataaagataaaagtgaaatttagtagtataggcctgaacctttttttgtttaaaagagtgcttttgaaataagcatccaccccaaatgttggttgtatttatgctgtgataaaaataggtgagagatcatatgatctaatattgtattgatggaagtataggtagtatagtagtgattgttcttcaagcatgcagtaaagatcacttttttttttttttttttttttgagatggagtcttgctctgtcgcccaggctggagtgcagtgatgcaatcttggctcactgcagcctctacctcccaggttcaagtgattatcctgccttagcctcctgagtagctgggattacaggcgcgtgccaccacgcccagctaattttttgtatttttagttgagacagggtttcactgtcccttaagaccatcctgttagccaagatggtcttgatctcctgacctcgtgatccgcctgcctcggcctcccaaagtgctgggattacaggtgtgagccaccgtgcccagccaaagactgctcttaaagcacctttttgacagtgaacatggtctaaaaaagggaagatattgtagaagatttcacacacacacgcgtgtgtgggagacaactaaaggtattgaaggtactaattaattagatttccaaaattttctacagagagttaattatcaccaaaatgtgaatggtacatacaaaacctggcattttcttgtgataagtttacatttttaggagagtggagctttcaatctgcccttttctcctttgtttttgtagttttcaccaaagatgatcaactagaaatgttaagtggctatgcaagcaaaagcatagataggttaaaaaaaaggatcagctggctgggcagggtggctcatgtctataatctcagcattctaggacagtgatgtgggaggattatttgaggctaggagttccagttcgaaaccagcttcgtaaacatagcaagacccagtctctaccaaaaaaaaaaaaaaaaaaaaaaaaaaaaaaaatatatatatatatatacacacacacacacacatatgtacacatacatatatatacatatatatgtatatatagaacacatggcaagagcaggaaatgggaagactaccttttttctggcagctatgtgttgttttgttcgaaagatggcaagtgtacaaccaaaccaatccacttgcttacagaaagaatgtttagtgtagttaagactaatttgacaacagataaaacagtctgtcagctattacaaagtaatcagctgaacactaatgctgttctgtctgctcacaagagataaagataccctctcatggaataaacaccttgcttagaattcatataacaaagaagtaaccttataactgctctctagtctgccttatttgtgtcatagagtaagatattccttgaaagcccattaagtggaatagactttctgaaaataagagttctttacctcagtcctcctctaatttggttgagaggaggtaatgaaaatggggacaggataaaaggtggcaactaaatttaaagcacagaagaaatgatttccttctagctatgagaatagtcaaattgagcttgccaggctgtctcattcctaacatgtaattcatgatttagccactaaatttctaaggagatcataagaaattaagaaaaacgtttaagtctagcctctgcgtggtagacaggtatggggagggagaatgcttttcccctcccagtaataaaaaaaaaaaaaaaaaaaatatatatatatatatatatatatatatatatatatatatatatatatatatatatagttttactaggttttcatggataagtttttaaatgtaagacaggaaagggatctatttgatgtctatcttcagatatattggcagttttccttaagctatttagttcctcatctgttgctttttcattttgtatactgcaagttcccaggcaactcgaatttgcaaacacagccatggatacactatttaccttacagtagtttcctgggaatctaagtctggtttttgttattcttccctcccctccactgcataatcatgtataactagcaacatttatggttataggttgatttcctaagtgtggctgatggtagcctctagtttgaagtgagggaagaatgagtagtcaggaactggtcactttgaatgtgggagggaagatattcacgacaaggttttctacgataaagcagtttcctgcttctcgtttggcacgcatgttagatggcagagaccaagaattcaagatggttggtggccagatttttgtagacagagatggtgatttgtttagtttcatcttagattttttgagaactcaccagcttttattacccactgaattttcagactatcttaggcttcagagagaggctcttttctatgaacttcgttctctagttgatctcttaaacccatacctgctacagccaagacctgctcttgtggaggtacatttcctaagccggaacactcaagcttttttcagggtgtttggctcttgcagcaaaacaattgagatgctaacagggaggattacagtgtttacagaacaaccttcagcgccgacctggaatggtaactttttccctcctcagatgaccttacttccactgcctccacaaagaccttcttaccatgacctggttttccagtgtggttctgacagcactactgataaccaaactggagtcaggtattttgtactttgcagtatttctcttgtataccagtttgtgatgttttctctaaaaacttgaagttcctcaggcctgtaacttctggaaaagatgattattcaaaataatgttttggggtaaccagtggagttgggtagaatgaccaaataattattttccaaactgggatactttttagagtgaaaggggctattattaggtgggacaaaaggaataaatgaagactgcccagaaaaaactgagactatggacattcaaatcatgggagaaaataattttgtagattatgttccattgctaatgaatttgacttagaaaagaattgccttatttttaagagattgtttcagtggttcacataaaggctcgctcactggtttctcttgagttccttacacactatataagttgttctttcagttttatgattcaactactgtttttccttcagctgactttatttttaaacacccttaaagacagatatatctcatggcaaatttggtatcctgttacagccttggctcttaaacaactcaaaatattgggataggctgtcagtatgttaaggatagttgctcctgagtcaattcttcacttactccctctgttgttcttggctggatcctaacgctgatttccactctgctgtcacaaacatttttccccccgtaaaatgtcttaatgctgtcctaccattattttaccaactgtgaaagctggctttaatttttaggaggaaaagaaaagcctgcatgtgttctttattggtatcatttaaaatatacttttttttttttttttggtaaaggtaggcgtattttaagatattttcttaacttgagcagtagccaacaggaaggataccagtgtctctctctcttagcgacacactccttggtcttgcttaccaactggaggacactaggtagaataaccgagtatgacaattcttaattgtttacattttataacttcctgtccttcaaaagagtttgaaatgtcattttgggaaaagagagccagtcaagctagtaggctgattgtgaagaaaatctaataccttatctttatctcaaacctctgtacaactttattttcattgatgggatactttaacaaaaatgaaattttttttggtttttaaaatatgagtgattatgacctctttggggatcatgcttcaaaaagtcagaaacctagagacaaaactgtcattgatttttaagaagaaacacactaggtcaaaagaagatgtcctggaaatatgaagtactctttaaaaaccatgcatttggagaaagtaattgtttccttgaaaaacatgattaaaaactaaaactgggatgttcctgtgtgtacacagtgccaaatggttttccctttttatgttgtgttttagaaacagcacgaaagttttttccattttaaagtgagaaaacattatatttagacttccataattccaaaatcagaagctatttttaaaattagcattttcttgcatcaccaaatggtattcaattgtttgaagctcaaaatttttaccattccataaatgtttgtgaatttttagacagtgccaatttaaaagtagagatagccaatctgaatacggtgaaattatggggatctctggtgattgggatgaaaactctggccttaaaaggtccacttttagtatataattgcctaattagcaatcatttttattttttgctcactccctggtctgaatctatctgtctattcagatattttttggtaggtttggaaaatggagaagtgagcctaattggtgcctaattgtctggtgtatcattcactttattcagtttgttctatcaatatgatttacccctcaaggttaacctagcaggttgctcagttattatctctcaaggtcacagtactagaaatacttggcttgcatctttcagatgccattcatgttatcaagctcaaattatagttggtcacaggattctaaagtctttatttgacttctcctttttgaactggctcaaatggaaaagtgtagttgcttttaaatgttaaaaataagtttaaactttatatttcccattggtttcccctattttgtcctttctttgtgtgcttgaaatattttatttttcagtttgtcctcatagggaatcaagtattttagctaggtgatgtcttgcaagtacgttccactttgttacaatctactatctgtatatactatttgtatcttaattcttttatgagatgttctgtaacatttttctcactttgacaaatgtttttagactgtacagtcaagatctggcgcttgggggtaagtggaatgatttgctaatattgagaatctgttgtatcaaacataataaa

SEQ ID NO: 32528 - DNA, 1251 bp, Homo sapiens
cttaattgcacggcagcttaactgggagactttcttcccgggcggccccacccgggaccgcgccgcttcagtcgagcccaccgtctgggcaaacggcgtccacttcccggagccgctgcccagcctctgcgggggggctttgggcgggcgcaggactctggaagggagaaaagcccgcagcccggccctccccgtcccaggcggcccgcgcgggtggacggcgggagcaggcggcggttggagacgccggaaggaacgcggtctcaccacccggctccctccgccaaggcgaggcgcggccggggaggcgggacacaggcgaagcgggacggggaggcggggccggagtagcctctagttcgttagtcaaaacgtgaaaaaaaagacctgctttgccctgggaaatagtaaccctgccaaatacatcagcttgtaggagacagaggatgtgatggagctgcttgaagaagatctcacatgccctatttgttgtagtctgtttgatgatccacgggttttgccttgctcccacaacttctgcaaaaaatgcttagaaggtatcttagaagggagtgtgcggaattccttgtggagaccagctccattcaagtgtcctacatgccgtaaggaaacttcagctactggaattaatagcctgcaggttaattactccctgaagggtattgtggaaaagtataacaagatcaagatctctcccaaaatgccagtatgcaaaggacacttggggcagcctctcaacattttctgcctgactgatatgcagctgatttgtgggatctgtgctactcgtggggagcacaccaaacatgtcttctgttctattgaagatgcctatgctcaggaaagggatgcctttgagtccctcttccagagctttgagacctggcgtcggggagatgctctttctcgcttggataccttggaaactagtaagaggaaatccctacagttactgactaaagattcagataaagtgaaggaattttttgagaagttacaacacacactggatcaaaagaagaatgaaattctgtctgactttgagaccatgaaacttgctgttatgcaagcatatgacccagagatcaacaaactcaacaccatcttgcaggagcaacggatggcctttaacattgctgaggctttcaaagatgtgtcagaacccattgtatttctgcaacagatgcaggagtttagagagaaaatcaaagtaatcaaggaaactccttt

SEQ ID NO: 32529 - DNA, 2607 bp, Homo sapiens
ggggcggagctagccggagccgcgagtccattttggggctgtgcttggcgcgtaccgtgcggtccctgtagttggaggacgggcggtcgcgcggcctttcccactagccggagtagcctctagttcgttagtcaaaacgtgaaaaaaaagacctgctttgccctgggaaatagtaaccctgccaaatacatcagcttgtaggagacagaggatgtgatggagctgcttgaagaagatctcacatgccctatttgttgtagtctgtttgatgatccacgggttttgccttgctcccacaacttctgcaaaaaatgcttagaaggtatcttagaagggagtgtgcggaattccttgtggagaccagctccattcaagtgtcctacatgccgtaaggaaacttcagctactggaattaatagcctgcaggttaattactccctgaagggtattgtggaaaagtataacaagatcaagatctctcccaaaatgccagtatgcaaaggacacttggggcagcctctcaacattttctgcctgactgatatgcagctgatttgtgggatctgtgctactcgtggggagcacaccaaacatgtcttctgttctattgaagatgcctatgctcaggaaagggatgcctttgagtccctcttccagagctttgagacctggcgtcggggagatgctctttctcgcttggataccttggaaactagtaagaggaaatccctacagttactgactaaagattcagataaagtgaaggaattttttgagaagttacaacacacactggatcaaaagaagaatgaaattctgtctgactttgagaccatgaaacttgctgttatgcaagcatatgacccagagatcaacaaactcaacaccatcttgcaggagcaacggatggcctttaacattgctgaggctttcaaagatgtgtcagaacccattgtatttctgcaacagatgcaggagtttagagagaaaatcaaagtaatcaaggaaactcctttacctccctctaatttgcctgcaagccctttaatgaagaactttgataccagtcagtgggaagacataaaactagtcgatgtggataaactttctttgcctcaagacactggcacattcattagcaagattccctggagcttttataagttatttttgctaatccttctgcttggccttgtcattgtctttggtcctaccatgttcctagaatggtcattatttgatgacctggcaacttggaaaggctgtctttcaaacttcagttcctatctgactaaaacagccgatttcatagaacaatcagttttttactgggaacaggtgacagatgggtttttcattttcaatgaaagattcaagaattttactttggtggtactgaacaatgtggcagaatttgtgtgcaaatataaactattataaaatctgtttcaagtatgcagttttcttttgttagaaattgttagagaatagagagtggtaattcagatttggtcaacgattctagtcacatattttcctccaaaagtattccttccaaaaataatctatacatgttcaaattaggtagcataaagataaaagtgaaatttagtagtataggcctgaacctttttttgtttaaaagagtgcttttgaaataagcatccaccccaaatgttggttgtatttatgctgtgataaaaataggtgagagatcatatgatctaatattgtattgatggaagtataggtagtatagtagtgattgttcttcaagcatgcagtaaagatcacttttttttttttttttttttttgagatggagtcttgctctgtcgcccaggctggagtgcagtgatgcaatcttggctcactgcagcctctacctcccaggttcaagtgattatcctgccttagcctcctgagtagctgggattacaggcgcgtgccaccacgcccagctaattttttgtatttttagttgagacagggtttcactgtcccttaagaccatcctgttagccaagatggtcttgatctcctgacctcgtgatccgcctgcctcggcctcccaaagtgctgggattacaggtgtgagccaccgtgcccagccaaagactgctcttaaagcacctttttgacagtgaacatggtctaaaaaagggaagatattgtagaagatttcacacacacacgcgtgtgtgggagacaactaaaggtattgaaggtactaattaattagatttccaaaattttctacagagagttaattatcaccaaaatgtgaatggtacatacaaaacctggcattttcttgtgataagtttacatttttaggagagtggagctttcaatctgcccttttctcctttgtttttgtagttttcaccaaagatgatcaactagaaatgttaagtggctatgcaagcaaaagcatagataggttaaaaaaaaggatcagctggctgggcagggtggctcatgtctataatctcagcattctaggacagtgatgtgggaggattatttgaggctaggagttccagttcgaaaccagcttcgtaaacatagcaagacccagtctctaccaaaaaaaaaaaaaaaaaa

SEQ ID NO: 32530 - DNA, 692 bp, Homo sapiens
acttctcccaagatcgtaaattctggaggagccattccttcatcatccatgtttgcatccttcacaccgttcactggttaagtgcttatagcctctagttcgttagtcaaaacgtgaaaaaaaagacctgctttgccctgggaaatagtaaccctgccaaatacatcagcttgtaggagacagagaataacagcacctggccgggtgcagtggctcaggcctgtaatcgcagcactttgggaggctgaggtgggcggatcacctgaggtcaggagctcgagaccagcctggccaaaatggatgtgatggagctgcttgaagaagatctcacatgccctatttgttgtagtctgtttgatgatccacgggttttgccttgctcccacaacttctgcaaaaaatgcttagaaggtatcttagaagggagtgtgcggaattccttgtggagaccagctccattcaagtgtcctacatgccgtaaggaaacttcagctactggaattaatagcctgcaggttaattactccctgaagggtattgtggaaaagtataacaagatcaagatctctcccaaaatgccagtatgcaaaggacacttggggcagcctctcaacattttctgcctgactgatatgcagctgatttgtgggatctgtgctactcgtggggagcacaccaaacatgtcttctgt

SEQ ID NO: 32531 - DNA, 1489 bp, Homo sapiens
gtgcttggcgcgtaccgtgcggtccctgtagttggaggacgggcggtcgcgcggcctttcccactagccggaggtcggagataagtacccgccgcccggctcctctcgggaaagcggggtggtcctcgaaccttcagcgagggtggggagttgcccagtagcctctagttcgttagtcaaaacgtgaaaaaaaagacctgctttgccctgggaaatagtaaccctgccaaatacatcagcttgtaggagacagaggatgtgatggagctgcttgaagaagatctcacatgccctatttgttgtagtctgtttgatgatccacgggttttgccttgctcccacaacttctgcaaaaaatgcttagaaggtatcttagaagggagtgtgcggaattccttgtggagaccagctccattcaagtgtcctacatgccgtaaggaaacttcagctactggaattaatagcctgcaggttaattactccctgaagggtattgtggaaaagtataacaagatcaagatctctcccaaaatgccagtatgcaaaggacacttggggcagcctctcaacattttctgcctgactgatatgcagctgatttgtgggatctgtgctactcgtggggagcacaccaaacatgtcttctgttctattgaagatgcctatgctcaggaaagggatgcctttgagtccctcttccagagctttgagacctggcgtcggggagatgctctttctcgcttggataccttggaaactagtaagaggaaatccctacagttactgactaaagattcagataaagtgaaggaattttttgagaagttacaacacacactggatcaaaagaagaatgaaattctgtctgactttgagaccatgaaacttgctgttatgcaagcatatgacccagagatcaacaaactcaacaccatcttgcaggagcaacggatggcctttaacattgctgaggctttcaaagatgtgtcagaacccattgtatttctgcaacagatgcaggagtttagagagaaaatcaaagtaatcaaggaaactcctttacctccctctaatttgcctgcaagccctttaatgaagaactttgataccagtcagtgggaagacataaaactagtcgatgtggataaactttctttgcctcaagacactggcacattcattagcaagattccctggagcttttataagttatttttgctaatccttctgcttggccttgtcattgtctttggtcctaccatgttcctagaatggtcattatttgatgacctggcaacttggaaaggctgtctttcaaacttcagttcctatctgactaaaacagccgatttcatagaacaatcagttttttactgggaacaggtgacagatgggtttttcattttcaatgaaagattcaagaattttactttggtggtactgaacaatgtggcagaatttgtgtgcaaatataaactattataaaatc

SEQ ID NO: 32532 - DNA, 2387 bp, Homo sapiens
ataacggccgaggagggggcgtgcctggccgtggccagtggcgggttacaacctggaaaccaaaggtgccccagagggcgtctaagcggtcgaccgaaagttcagagcgggagcctgagacccaaggaagggcaaaggcgagccaaagccatcagttgagcttcagaaaagtcccacttgaaaggctggaaaagcaagtcacaggcaagacttgtcctagataaagtaaagtgtgaggaaggggtgcaaatcaagattagaggcatacctgatgtggacctccgaggatcagagatgtcctagtcccagctcatccaccaacttgccatatgactttgggcaagttacctcaccttcagatgcctccattggaaaagaatacaaggaaactcagccaagaaattcattgataaaaacacgcagcttaccctccaggtgtacagggaacaagctgactcttgcagagagcaacttgacatcatgaatgatctctccaacagggtctggagtatcagccaggagcccgatcctgtccagaggcttcaggcatacacggccaccgagcaggagatgcagcagcagatgagcctcggggagctgtgccatcccgtgcccctctcctttgagcccgtcaagagcttctttaagggcctcgtggaagccgtggagagtacattacagacgccattggacattcgccttaaggaaagcataaactgccagctctcagacccttccagcaccaagccaggtaccttgttgaaaaccagcccctcaccagagcgatcgctattgctgaaatcctgctgggcagcctggggcccgtgcccgtgctgcggttcgacgcgctctggcaagtgctggctcgtgactgcttcgccaccggccgccactactgggaggttgacgtgcaggaggcgggcgccggctggtgggtgggcgcggcctacgcctcccttcggcgccgcggggcctcggccgccgcccgcctgggctgcaaccgccagtcctggtgcctcaagcgctacgaccttgagtactgggccttccacgacggccagcgcagccgcctgcggccccgcgacgacctcgaccggctcggcgtcttcctggactacgaggccggcgtcctcgccttctacgacgtgacgggcggcatgagccacctgcataccttccgcgccacgttccaggagccgctctacccggccctgcggctctgggagggggccatcagcatcccccggctgccctaggggccaggaccggcgtgacagcctccagataaggaaaattattagtgtctccagatccaactttgaaaaatggaacattcagttcatgcaggaattcaactgccatctacaaaaatcaaagagggagctccttttcaccattgtccaaaaacactgttgttatgacaggcaaggaataacatacaagtagaaaaacccctcatcttaggcagtagagggacgctcagcaacttgaaagcaggcaaagatttgttctcagtcatttcattcaaatgcaaacattcatttgcatccacccatccattagcccaacaaacgtttggtgctggtctttgctggctacaggaatctggaaaagggctgggcgtggtggctcatgcctgcactttgggaggccgaggcgggcagatcacctgaggtcaggagtttgagactagcctgaccaacatggtgaaaccccgtctctactaaaaatataaaaattagccgggtgtggtggcgggcacctgtgatcccagctactcagaaggctgaggcaggagaatcacttgaacctgggaggcggaggttgcagtgagctgagatcatgccactgcactccagcctgggccacagagcgagactccatctcaaaaaaaaaaaagaatctggaaaagaacctttcccctggccagaccctacctgccccaggggcccaaggccaaatgaacaaacatgaaacggtcatgacctaatcctgacccagaaaaccaggcagtgaaaacatgaatagcctcaaaggctttcccttctactcggccaaacgagcaggaaaaggggctatttcaattcttggcgaaagggggaaaatggagcatttttttgcccagcctctacataaggatccatggctggcagggcccattcaacccgagccctttcaggcctcaaagcacgctgcctacttaaaagtgaacctcagtcacttttttcagatataacgtcactgcttgaggttacctatttagtgctcttcaacatccttctctagtattcatcaacaagactcaggaaattggtaaatgtcagcaaatgcttgctgaaggaatcagtggatcacaagttataagagtaaaatctcagtttgctgtc

SEQ ID NO: 32533 - DNA, 4454 bp, Homo sapiens
gtggagatgaatggcgggcgcggcgaccgggagccggacccctgggaggtcggagcttgtcgagggatgcggctggcgctgcccggagcatggcgaccgcgtggctgagctcttctgtcgccgctgccgccgctgcgtgtgcgcgctttgcccggtgctgggcgcgcaccgtggccaccctgtgggcctggcgctggaggcagcggtgcacgtgcagaaactcagccaagaatgtttaaagcagctggcaatcaagaagcagcagcacattgacaacataacccagatagaagatgccaccgagaagctcaaggctaatgcagagtcaagtaaaacctggctgaaggggaaattcactgaactcagattactacttgacgaagaggaagcgctggccaagaaattcattgataaaaacacgcagcttaccctccaggtgtacagggaacaagctgactcttgcagagagcaacttgacatcatgaatgatctctccaacagggtctggagtatcagccaggagcccgatcctgtccagaggcttcaggcatacacggccaccgagcaggagatgcagcagcagatgagcctcggggagctgtgccatcccgtgcccctctcctttgagcccgtcaagagcttctttaagggcctcgtggaagccgtggagagtacattacagacgccattggacattcgccttaaggaaagcataaactgccagctctcagacccttccagcaccaagccaggtaccttgttgaaaaccagcccctcaccagagcgatcgctattgctgaaatacgcgcgcacgcccacgctggatcctgacacgatgcacgcgcgcctgcgcctgtccgccgatcgcctgacggtgcgctgcggcctgctgggcagcctggggcccgtgcccgtgctgcggttcgacgcgctctggcaagtgctggctcgtgactgcttcgccaccggccgccactactgggaggttgacgtgcaggaggcgggcgccggctggtgggtgggcgcggcctacgcctcccttcggcgccgcggggcctcggccgccgcccgcctgggctgcaaccgccagtcctggtgcctcaagcgctacgaccttgagtactgggccttccacgacggccagcgcagccgcctgcggccccgcgacgacctcgaccggctcggcgtcttcctggactacgaggccggcgtcctcgccttctacgacgtgacgggcggcatgagccacctgcataccttccgcgccacgttccaggagccgctctacccggccctgcggctctgggagggggccatcagcatcccccggctgccctaggggccaggaccggcgtgacagcctccaggtacgccgcagctgcccagtctcgcctaatctacctagatcagcgtggctggtccccttactgcctgcttcttagggccctctccctgccccagctttccccgaccaatcacgcctacagtgctttgaaggtttcctctcctaggctagtttcaaacaggccctaaacaagtctgctgctgccctctcatcagacctccgcaccctcaccccaccatcacttacactactttaatccagttccttcaaagtgatacccccacaggtaagccctcagcatcctgaatacatcatccgcagcctgggaaccttctccctcgtacagcacaggaacctgacacatagtaggcacacagtaaacgtttgtgaatgaatgggagtcatccagtcctgactcttctgtctcttgaggtcccttgaatcttccgcttcctccccaccgatttcagcgtgtccacatcacagctccctccagaagctgcaagagcttcttagcagttcctggtctgaaccctctcccagtcctcatcttccaccctaaaactagagtgatcttcctaaaacttcacttaacccctcagctatgaaaaggcttccaggagtttccatgaaataacaaaaaaaaatacaagcgcctcaccttagcattcaaggcttgtctagtctgcccaaaattacttatcctcacctagctcctaccactcttcttagagactctccagtcagaaatgtgtcgcatagttccacctccacacctctctgctgccagcacattcatgcagaaaagtcttttcacctgtctcagtcttccgcaggcttacctgcgccaggaagtctaaccaaggaacaagaatctcactatcagagccacaaatctgggacctgtctttccaactaaattggaggctttggaagggcagctttgtcctatactctctccaccctgaaaagttcccagaaagccccttccctcccaagcagtgaattaataaccagcaggtgcctatcactgagtaacagaagagctgagttaggcgggcctcacaggtcacccagccagatctcatctggggagtctgaggtcctgaaagaaagcagagctgcgtaaagttaccccggggtgatataggggggccagacgtgtgccccgttcacccacccccaggcaagcatctgacctgtcccctggcccagcccttaggcccagctttcaacctgcttactcatttctcaggggattttgggaaggaatcagcaggtgacagttgctaagcaaccaaagggggtggtgtttcccaactgtcttgggacaaaaagggtaagagcacccttagatccagatgttgccaaggaaacccagagtgcccagctgtctggaatgaagtgacagaggtagaaaacagtaggccctcacaggaggccaccttcgctagcagggagtgggaggcttctttccagggatttgtgtctccgttctgaaggttctgcgtcctgttttgtcaattccctagacggttttgaagttatattctgttaaagcatcttcataggtgcttggtgggaggccaaggtcgccgaatcctcgtggtttaaatagactttcagtgcattagtttgaaccatataaaactgacaattttcaatagtttttgagttaaaaatggcacttttgatatgagacaatgtagcagaataccaggcagacagaaccttgcaaacaccttaacttctaaccaaagactttaaaactctggctggacagagttttaagcactatgctgcaggaatcctgagaaaaaggggaaattaattctattaggaatggcccaaactgaattgtgacaggcagagggtgttcctgacagagggaagatgaatacacttgaccccaacatttctgcccatccctgatgaccaagacctcttcccagacccacagctgcaggggccaagtaataacagctcttaatagtttataatgcactgttttaatgctttacgactaaactcatctgatcctttcatcagccctagagggtagaaagttttcccaattctacacatggcaaaatggagacccagagtcacttgcccaaggtcgcacagctagtggtggagctggagtctgggcccaggctgtgagttccaggtctgtgctcatggccaccaggccctactgctcagggtgaatgcagctggtctctggccagtgcctggtgctctggcccctctcgtggagctactgcccatgatgctttcctagtgcctggttactctgcgagacttgagtctacctttggactgccttccttgggggtctgagatgaggccttatggcccagaggggaacttgattcaaaaatttgggattcatgtagcagagacagagctagactgtaaaggtcacaaactagctgtgtcaaggcccgtgatagccagaaagcggcagtttcagtccatatcaattgtgtgaccagggctagtcactttttacttctcagtgccatctataaaatggggataatagcactacctaccaagtgctgtgaggctcaaatgagccaaaggttataaacttgccttaaaactatagtcctatacaaaaattagctgggcgtggtggtgcatgcctgtaatcccagctactagggaggctgaggcaagagagttgcttgaacccaggaggcggagattgcagtgagctgagattgcaccactgcactccagcctggggacagagcaagactcttgtctcaaaaaaaacaaaaaaaacatatatactgctgtatcatgccaggatttatcagcattcccaagggagcttgcacggtactgaccgagtgctgagactactggtattcccagctgccatgtggcagcagcaggagctactagaatattctcagcacaggaatgaggcttccttggtttccatgtctgtaagggttactgatcacttaccttcttctctttcagacttgaatctgtagacatttctttattgatatggcaaattgcttgcagatatttttaaatgacagcaattttctaatatttggtttaataaaatgtgaataatgtccctttt

SEQ ID NO: 32534 - DNA, 1479 bp, Homo sapiens
gtggagatgaatggcgggcgcggcgaccgggagccggacccctgggaggtcggagcttgtcgagggatgcggctggcgctgcccggagcatggcgaccgcgtggctgagctcttctgtcgccgctgccgccgctgcgtgtgcgcgctttgcccggtgctgggcgcgcaccgtggccaccctgtgggcctggcgctggaggcagcggtgcacgtgcagaaactcagccaagaatgtttaaagcagctggcaatcaagaagcagcagcacattgacaacataacccagatagaagatgccaccgagaagctcaaggctaatgcagagtcaagtaaaacctggctgaaggggaaattcactgaactcagattactacttgacgaagaggaagcgctggccaagaaattcattgataaaaacacgcagcttaccctccaggtgtacagggaacaagctgactcttgcagagagcaacttgacatcatgaatgatctctccaacagggtctggagtatcagccaggagcccgatcctgtccagaggcttcaggcatacacggccaccgagcaggagatgcagcagcagatgagcctcggggagctgtgccatcccgtgcccctctcctttgagcccgtcaagagcttctttaagggcctcgtggaagccgtggagagtacattacagacgccattggacattcgccttaaggaaagcataaactgccagctctcagacccttccagcaccaagccaggtaccttgttgaaaaccagcccctcaccagagcgatcgctattgctgaaatacgcgcgcacgcccacgctggatcctgacacgatgcacgcgcgcctgcgcctgtccgccgatcgcctgacggtgcgctgcggcctgctgggcagcctggggcccgtgcccgtgctgcggttcgacgcgctctggcaagtgctggctcgtgactgcttcgccaccggccgccactactgggaggttgacgtgcaggaggcgggcgccggctggtgggtgggcgcggcctacgcctcccttcggcgccgcggggcctcggccgccgcccgcctgggctgcaaccgccagtcctggtgcctcaagcgctacgaccttgagtactgggccttccacgacggccagcgcagccgcctgcggccccgcgacgacctcgaccggctcggcgtcttcctggactacgaggccggcgtcctcgccttctacgacgtgacgggcggcatgagccacctgcataccttccgcgccacgttccaggagccgctctacccggccctgcggctctgggagggggccatcagcatcccccggctgccctaggggccaggaccggcgtgacagcctccagacttgaatctgtagacatttctttattgatatggcaaattgcttgcagatatttttaaatgacagcaattttctaatatttggtttaataaaatgtgaataatgtccctttt

SEQ ID NO: 32535 - DNA, 1478 bp, Homo sapiens
gtggagatgaatggcgggcgcggcgaccgggagccggacccctgggaggtcggagcttgtcgagggatgcggctggcgctgcccggagcatggcgaccgcgtggctgagctcttctgtcgccgctgccgccgctgcgtgtgcgcgctttgcccggtgctgggcgcgcaccgtggccaccctgtgggcctggcgctggaggcagcggtgcacgtgcagaaactcagccaagaatgtttaaagcagctggcaatcaagaagcagcagcacattgacaacataacccagatagaagatgccaccgagaagctcaaggctaatgcagagtcaagtaaaacctggctgaaggggaaattcactgaactcagattactacttgacgaagaggaagcgctggccaagaaattcattgataaaaacacgcagcttaccctccaggtgtacagggaacaagctgactcttgcagagagcaacttgacatcatgaatgatctctccaacagggtctggagtatcagccaggagcccgatcctgtccagaggcttcaggcatacacggccaccgagcaggagatgcagcagcagatgagcctcggggagctgtgccatcccgtgcccctctcctttgagcccgtcaagagcttctttaagggcctcgtggaagccgtggagagtacattacagacgccattggacattcgccttaaggaaagcataaactgccagctctcagacccttccagcaccaagccaggtaccttgttgaaaaccagcccctcaccagagcgatcgctattgctgaaatacgcgcgcacgcccacgctggatcctgacacgatgcacgcgcgcctgcgcctgtccgccgatcgcctgacggtgcgctgcggcctgctgggcagcctggggcccgtgcccgtgctgcggttcgacgcgctctggcaagtgctggctcgtgactgcttcgccaccggccgccactactgggaggttgacgtgcaggaggcgggcgccggctggtgggtgggcgcggcctacgcctcccttcggcgccgcggggcctcggccgccgcccgcctgggctgcaaccgccagtcctggtgcctcaagcgctacgaccttgagtactgggccttccacgacggccagcgcagcgcctgcggccccgcgacgacctcgaccggctcggcgtcttcctggactacgaggccggcgtcctcgccttctacgacgtgacgggcggcatgagccacctgcataccttccgcgccacgttccaggagccgctctacccggccctgcggctctgggagggggccatcagcatcccccggctgccctaggggccaggaccggcgtgacagcctccagacttgaatctgtagacatttctttattgatatggcaaattgcttgcagatatttttaaatgacagcaattttctaatatttggtttaataaaatgtgaataatgtccctttt

SEQ ID NO: 32536 - DNA, 780 bp, Homo sapiens
cggaggaggtggagatgaatggcgggcgcggcgaccgggagccggacccctgggaggtcggagcttgtcgagggatgcggctggcgctgcccggagcatggcgaccgcgtggctgagctcttctgtcgccgctgccgccgctgcgtgtgcgcgctttgcccggtgctgggcgcgcaccgtggccaccctgtgggcctggcgctggaggcagcggtgcacgtgcagaaactcagccaagaatgtttaaagcagctggcaatcaagaagcagcagcacattgacaacataacccagatagaagatgccaccgagaagctcaaggctaatgcagagtcaagtaaaacctggctgaaggggaaattcactgaactcagattactacttgacgaagaggaagcgctggccaagaaattcattgataaaaacacgcagcttaccctccaggtgtacagggaacaagctgactcttgcagagagcaacttgacatcatgaatgatctctccaacagggtctggagtatcagccaggagcccgatcctgtccagaggcttcaggcatacacggccaccgagcaggagatgcagcagcagatgagcctcggggagctgtgccatcccgtgcccctctcctttgagcccgtcaagagcttctttaagggcctcgtggaagccgtggagagtacattacagacgccattggacattcgcctttccccgaccaatcacgcctacagtgctttgaaggtttcctctcctaggctagtttcaaacaggccctaa

SEQ ID NO: 32537 - DNA, 1792 bp, Homo sapiens
gagccggaggaggtggagatgaatggcgggcgcggcgaccgggagccggacccctgggaggtcggagcttgtcgagggatgcggctggcgctgcccggagcatggcgaccgcgtggctgagctcttctgtcgccgctgccgccgctgcgtgtgcgcgctttgcccggtgctgggcgcgcaccgtggccaccctgtgggcctggcgctggaggcagcggtgcacgtgcagaaactcagccaagaatgtttaaagcagctggcaatcaagaagcagcagcacattgacaacataacccagatagaagatgccaccgagaagctcaaggctaatgcagagtcaagtaaaacctggctgaaggggaaattcactgaactcagattactacttgacgaagaggaagcgctggccaagaaattcattgataaaaacacgcagcttaccctccaggtgtacagggaacaagctgactcttgcagagagcaacttgacatcatgaatgatctctccaacagggtctggagtatcagccaggagcccgatcctgtccagaggcttcaggcatacacggccaccgagcaggagatgcagcagcagatgagcctcggggagctgtgccatcccgtgcccctctcctttgagcccgtcaagagcttctttaagggcctcgtggaagccgtggagagtacattacagacgccattggacattcgccttaaggaaagcataaactgccagctctcagacccttccagcaccaagccaggtaccttgttgaaaaccagcccctcaccagagcgatcgctattgctgaaatacgcgcgcacgcccacgctggatcctgacacgatgcacgcgcgcctgcgcctgtccgccgatcgcctgacggtgcgctgcggcctgctgggcagcctggggcccgtgcccgtgctgcggttcgacgcgctctggcaagtgctggctcgtgactgcttcgccaccggccgccactactgggaggttgacgtgcaggaggcgggcgccggctggtgggtgggcgcggcctacgcctcccttcggcgccgcggggcctcggccgccgcccgcctgggctgcaaccgccagtcctggtgcctcaagcgctacgaccttgagtactgggccttccacgacggccagcgcagccgcctgcggccccgcgacgacctcgaccggctcggcgtcttcctggactacgaggccggcgtcctcgccttctacgacgtgacgggcggcatgagccacctgcataccttccgcgccacgttccaggagccgctctacccggccctgcggctctgggagggggccatcagcatcccccggctgccctaggggccaggaccggcgtgacagcctccagaatgtcatggaagcagaatcgtacagtatgttcccttctgcatatgctgctttctcactcagcatcatttccttgagatgcatccaggctgctgcacgcatcaatagttcattcctggctgggcgcggtggctcacgcctgtaatcccagcgctttgggaggccgatgtgggtggatcacaaggtcaggagtttgagactagcctggccaagatggtgaaaccccatctctgcaaaaaatacaaaaattagccgggcaccatggcatgtgcctgtaatccctgctactcaggaggctgaggaaggagaatcacttgaacccgggcagcggaggttgcagtgagccgagatcacaccactgcactccagcctgggcaatagagtgagactccgtttcaaaaaaaaaaagaaaaa

SEQ ID NO: 32538 - DNA, 1336 bp, Homo sapiens
agatctctacaggcccctgtgatgagtgctgggagtgatgggggcggaaggcacttctgcggaggcataaactgccagctctcagacccttccagcaccaagccaggtaccttgttgaaaaccagcccctcaccagagcgatcgctattgctgaaatacgcgcgcacgcccacgctggatcctgacacgatgcacgcgcgcctgcgcctgtccgccgatcgcctgacggtgcgctgcggcctgctgggcagcctggggcccgtgcccgtgctgcggttcgacgcgctctggcaagtgctggctcgtgactgcttcgccaccggccgccactactgggaggttgacgtgcaggaggcgggcgccggctggtgggtgggcgcggcctacgcctcccttcggcgccgcggggcctcggccgccgcccgcctgggctgcaaccgccagtcctggtgcctcaagcgctacgaccttgagtactgggccttccacgacggccagcgcagccgcctgcggccccgcgacgacctcgaccggctcggcgtcttcctggactacgaggccggcgtcctcgccttctacgacgtgacgggcggcatgagccacctgcataccttccgcgccacgttccaggagccgctctacccggccctgcggctctgggagggggccatcagcatcccccggctgccctaggggccaggaccggcgtgacagcctccaggtacgccgcagctgcccagtctcgcctaatctacctagatcagcgtggctggtccccttactgcctgcttcttagggccctctccctgccccagctttccccgaccaatcacgcctacagtgctttgaaggtttcctctcctaggctagtttcaaacaggccctaaacaagtctgctgctgccctctcatcagacctccgcaccctcaccccaccatcacttacactactttaatccagttccttcaaagtgatacccccacaggtaagccctcagcatcctgaatacatcatccgcagcctgggaaccttctccctcgtacagcacaggaacctgacacatagtaggcacacagtaaacgtttgtgaatgaatgggagtcatccagtcctgactcttctgtctcttgaggtcccttgaatcttccgcttcctccccaccgatttcagcgtgtccacatcacagctccctccagaagctgcaagagcttcttagcagttcctggtctgaaccctctcccagtcctcatcttccaccctaaaactagagtgatcttcctaaaacttcacttaacccctcagctatgaaaaggcttccaggagtttccatgaaataa

SEQ ID NO: 32539 - DNA, 6735 bp, Homo sapiens
cccagttgtctgcgggctgcggggagctaagtccccagattggaggaggctggctctggtcttcgatgcacaggagtggccgttatggaacgcagcagcagcgtgcagggtcaaagacagccggccccccatgtcagtggtctaggatggccagtgaaggcaccaacatcccaagtcctgtggtgcgccagattgacaagcagtttctgatttgcagtatatgcctggaacggtacaagaatcccaaggttctcccctgtctgcacactttctgcgagaggtgcctgcagaactacattcctgcccacagtttaaccctctcctgcccagtgtgccgccagacctccatcctgcccgagaaaggggtggccgcgctccagaacaatttcttcatcacaaacctgatggacgtgctgcagcgaactccaggcagcaacgctgaggagtcttccatcctggagacagtcactgctgtggctgcgggaaagcctctctcttgcccaaaccacgatgggaatgtgatggaattttactgccagtcctgtgagactgccatgtgtcgggagtgcacggagggggagcacgcagagcaccccacagttccactcaaggatgtggtggaacagcacaaggcctcgctccaggtccagctggatgctgtcaacaaaaggctcccagaaatagattctgctcttcagttcatctctgaaatcattcatcagttaaccaaccaaaaggccagcatcgtggatgacattcattccacctttgatgagctccagaagactttaaatgtgcgcaagagtgtgctgcttatggaattggaggtcaactatggcctcaaacacaaagtcctccagtcgcagctggatactctgctccaggggcaggagagcattaagagctgcagcaacttcacagcgcaggccctcaaccatggcacggagaccgaggtcctactggtgaagaagcagatgagcgagaagctgaacgagctggccgaccaggacttccccttgcacccgcgggagaacgaccagctggatttcatcgtggaaaccgaggggctgaagaagtccatccacaacctcgggacgatcttaaccaccaacgccgttgcctcagagacagtggccacgggcgaggggctgcggcagaccatcatcgggcagcccatgtccgtcaccatcaccaccaaggacaaagacggtgagctgtgcaaaaccggcaacgcctacctcaccgccgaactgagcacccccgacgggagcgtggcagacggggagatcctggacaacaagaacggcacctatgagtttttgtacactgtccagaaggaaggggactttaccctgtctctgagactctatgaccagcacatccgaggcagcccgtttaagctgaaagtgatccgatccgctgatgtgtctcccaccacagaaggcgtgaagaggcgcgttaagtccccggggagcggccacgtcaagcagaaagctgtgaaaagacccgcaagcatgtacagcactggaaaacgaaaagagaatcccatcgaagacgatttgatctttcgagtgggtaccaaaggaagaaataaaggagagtttacaaatcttcagggggtagctgcatctacaaatggaaagatattaattgcagacagtaacaaccaatgtgtgcagatattttccaatgatggccagttcaaaagtcgttttggcatacggggacgctctccggggcagctgcagcggcccacaggagtggctgtacatcccagtggggacataatcattgccgattatgataataaatgggtcagcattttctcctccgatgggaaatttaagacaaaaattggatcaggaaagctgatgggacccaaaggagtttctgtggaccgcaatgggcacattattgttgtggacaacaaggcgtgctgcgtgtttatcttccagccaaacgggaaaatagtcaccaggtttggtagccgaggaaatggggacaggcagtttgcaggtccccattttgcagctgtaaatagcaataatgagattattattacagatttccataatcattctgtcaaggtgtttaatcaggaaggagaattcatgttgaagtttggctcaaatggagaaggaaatgggcagtttaatgctccaacaggtgtagcagtggattcaaatggaaacatcattgtggccgactggggaaacagcaggatccaggtttttgatgggagtggatcatttttgtcctacattaacacatctgctgacccactctatggcccccaaggcctggccctaacttcagatggtcatgttgtggttgcagactctggaaatcactgtttcaaagtctatcgatacttacagtaatggtgggcaggtggatacccgcttccatggtcttgcactataaactggaatggatttctcaatgcgggaccagattatgactagagtttttatgccagaaggaatcattggtgaactttccaaggttatttctgaatgtaacaatttccttaaaaatgacttatccaatttctgtatttcacctttagggttaaaaaaaactcttctactgaatctataaaaactgcagttttacatctgtgaactatggcttaagggacaggatttatgtagctaaactaattttgcaaatcaaacagacacttaaaaaactagcatatgtaaaggtattcgttaatcctgtgaatggtagcttttgcacagaacttccaaaagcaaaacaaaaacaaaatctattgtagttatatacttcatttaacctaggtcacaagacccagggaatcttctaacctcacttttacagtaggtattactcttgtgacatttttttggttatcaacaactaaatataaattactttggaaaaagtaaggctgtcttgcaaaatgatcccagctctgattagcagccctctggagttcagaacttaagtatcagtgcaaatttctcaacctttctgggttagacaaagatccttttttgtgtgttcttttcaccacccctttggctcaccttgtatcagcaaacaaagtacttcttcagggaaacctgaaatttctaatgccttgaaaagcatattacaaaagtaatgctaccttttgggaaacaaactgccccgttaactccagatcattgcactggaatgtaatcaagaaagttagtcatgttttatgtaccatgttttcacacgtgtctcttctcttcgacttcctgaaagcgaaagctttacctcctgcaaatgtcagcacatgtagtaggacaccagtatcctaggacagagagccataagtagccctttggaggactgatggtgtcaaccaaaggcatgtgattgattaatgattcccccttagaaagcaagtgttaccaaagttgtgttatcttgaaagcattacaggtaagggcatgttatggttatttatcattgtttaatgaatagtagaggtgtcaagggactatgtatacatgattagggtaagatagaatgtattatatatatatatatatacacacacacatatatatagctgaatctttggtgtattgaaataggcagcactctgaaagacagaagcttcgtccagccactcttcagcacattcctttactaagcagtttaaagccgtcctagtggagcaagccctaaagcagatttaatttttgccattttccaagaatgacggtggtggcttttagtcagaaaatggccttctgtgctttcaaaaaaaaaaacaaaaaaaaaaccacacacacacataaaaaacccaacaggtcaaaataaaagttgaacttgagttacatttaatttaaatataaatgcattttgagaaatgttaagaacaatttagtcaatcgttcatctgtcattggtactgtaaaataagctgtggtctatttccactgtttaattttctactcagttctaccaaataggatgtcatgtttgacatttttgatagtgactttggggtcttcttcactgaaagcaccttagaactgtactataagaaaacatttcccctatgtataattatatgaatgtgatgtttattgcttattaatttataattcagtcattctctatataggacttcttaaaatttagaagggaaatctagctacttcaaattgtctgttaaatttattatgcccaaatcaacctctgaaaaaaggtttttccaggaagatttacatttaggtttaatatttttttagttaggtagagttttaaaaaatacttgagcctgtccgtgataaagctataaaattcaataactttttagaatgttaaatgaagacactgtttcctaacatcagtgagatacatctttgaatttaaacattcatatttactgagtacctactaggtaccaagtactcttttaggcactggaaatacagtgatggacaaaacaggtaaaaaatcgctgccccctcagagctgacattctggggtgggaatttcattttgccacgtactaacgttctgcacaaaagacaggctagactcttgtctagattgtttaaaagaaacttttcaaattggttacattaattttagtttattttcacaagtaaaaatggctttttatttagattctttctgtcccaggctgttgatcttaaaactagttgatttaaagagtttttttgcacaacatttcaattatatttgtgaacttagaaattaacttacaatctaaccagccatcatatcatatcctatcaggctagatatctcaatagtagactgaatacaaagctaattttttttacatgtcaatattggcacaaactggaatgaaagaatagtttgattcagacctgctccactatgtgttgctaaaacacatgctatgagcactccaggaaacactatattttttccaaaaaatatgtgattatatatgttaaagtatagataacatttcacacttggatacatatgtgcatttactgtatttcttggtaagcatatttttgggggaaagtgctgctgatatgatacaagtagacaaaatttaaatgaaattttgtcacattctatggaaaatggtttctggtaaactgagaaggatattaaaataagtggcttttttctgggctaccattattgtttgatttctctttgtcaagtgtatagaacctgtcatacattcatgataagtagcactgaaaaattactcattcaaatttcccctgggcacgtaaggcaaaatattgccggttgggatttcaaggtcagtgacgacgcatttcctcccagtacagaccccccagccccccttgctggacatggggaggcagagagtcacttgaccatccagaaatacatgactacaagtcctttatgactgtttgccattttttttaatggtacttagtattttgatcaaactttagtctccagaactaaacaagtccctaagtttccttattttaatttactgtgactagatttgaagcaaataaatactccagatccatgcagctagaacacacttgcttccactactaaatatacagggtatgtcctaacatggagttaactggaatagcagtacactagcaagtatctgtgaatccttagcactgacgggttaacagaaatgctttggtaatacctacttagttaattggaggaagtagtaaataaacattaggtaatctgcagattacttcaaatgggaaaaatctttttgtagactctatagtaccctctctattcactagcttctgaaaagggaggagtatttttagtttgacaatttaataatttaaaaacaagacatctccaggtaggaaaaaatgaaagctatttcatgcaaacattatctaatttagcttaaaagtgaaagtggtaatactgttggtttctgtaaatgttgcagggttttaaactttataattactttaatatttttgataactagaaatctagtattgccataaaggaaactaagtgcccatcaaagatttgtttggtataaataaagaattatttgttttgttttcaatgacagtaagctacaaatcatgatgcttaaaaactttctaaagatgaattgtgtggcagtgattggtctgtttgtggagaatgtatgaaagctattaatattctagaatagattaataaattggctatgttgttccaatgaatgtacagcacttccattaacttttgaaagcaacacagccttaaactcaatgcttttgctttatgacatgggaatgttctgtcatcaatggagtgtattcttgtaatagaattctttatatcgttctcaattctatagactttcaagcctatgtatgaatatgaaggggttttttttttttgctttgttttctttttagattttgtacattccatctttataggtctgtttcatatgttttatgtatagaacactaagtcttgcactctctgacattgatactgatatattctcgtcatttgttcttttatgaatcaaaatgttgactgcctatttaaagaaaagaatgaacgctgtgcatcaaagtgtttgtatgttcgtagctacatacgtaccacagtattttggatgctttagtctacaatgaaactttcaattaattctgtcttgaaacataggagaaacaggattcatgtgtatctctttaccatgcacaaaatctcaaatcattataataaagcttgttttctccattt

SEQ ID NO: 32540 - DNA, 3832 bp, Homo sapiens
agcattttgagtgagcttgcagaaaatgaggggctttcagctggtcgcctgcttgtcacctctcgctgcctgaaaggcagctctcagagccctttcctgtccttctaattacagcggcgggggcagtgcgcgcttcgggacgcaattggaaaccagcgtgcagggtcaaagacagccggccccccatgtcagtggtctaggatggccagtgaaggcaccaacatcccaagtcctgtggtgcgccagattgacaagcagtttctgatttgcagtatatgcctggaacggtacaagaatcccaaggttctcccctgtctgcacactttctgcgagaggtgcctgcagaactacattcctgcccacagtttaaccctctcctgcccagtgtgccgccagacctccatcctgcccgagaaaggggtggccgcgctccagaacaatttcttcatcacaaacctgatggacgtgctgcagcgaactccaggcagcaacgctgaggagtcttccatcctggagacagtcactgctgtggctgcgggaaagcctctctcttgcccaaaccacgatgggaatgtgatggaattttactgccagtcctgtgagactgccatgtgtcgggagtgcacggagggggagcacgcagagcaccccacagttccactcaaggatgtggtggaacagcacaaggcctcgctccaggtccagctggatgctgtcaacaaaaggctcccagaaatagattctgctcttcagttcatctctgaaatcattcatcagttaaccaaccaaaaggccagcatcgtggatgacattcattccacctttgatgagctccagaagactttaaatgtgcgcaagagtgtgctgcttatggaattggaggtcaactatggcctcaaacacaaagtcctccagtcgcagctggatactctgctccaggggcaggagagcattaagagctgcagcaacttcacagcgcaggccctcaaccatggcacggagaccgaggtcctactggtgaagaagcagatgagcgagaagctgaacgagctggccgaccaggacttccccttgcacccgcgggagaacgaccagctggatttcatcgtggaaaccgaggggctgaagaagtccatccacaacctcgggacgatcttaaccaccaacgccgttgcctcagagacagtggccacgggcgaggggctgcggcagaccatcatcgggcagcccatgtccgtcaccatcaccaccaaggacaaagacggtgagctgtgcaaaaccggcaacgcctacctcaccgccgaactgagcacccccgacgggagcgtggcagacggggagatcctggacaacaagaacggcacctatgagtttttgtacactgtccagaaggaaggggactttaccctgtctctgagactctatgaccagcacatccgaggcagcccgtttaagctgaaagtgatccgatccgctgatgtgtctcccaccacagaaggcgtgaagaggcgcgttaagtccccggggagcggccacgtcaagcagaaagctgtgaaaagacccgcaagcatgtacagcactggaaaacgaaaagagaatcccatcgaagacgatttgatctttcgagtgggtaccaaaggaagaaataaaggagagtttacaaatcttcagggggtagctgcatctacaaatggaaagatattaattgcagacagtaacaaccaatgtgtgcagatattttccaatgatggccagttcaaaagtcgttttggcatacggggacgctctccggggcagctgcagcggcccacaggagtggctgtacatcccagtggggacataatcattgccgattatgataataaatgggtcagcattttctcctccgatgggaaatttaagacaaaaattggatcaggaaagctgatgggacccaaaggagtttctgtggaccgcaatgggcacattattgttgtggacaacaaggcgtgctgcgtgtttatcttccagccaaacgggaaaatagtcaccaggtttggtagccgaggaaatggggacaggcagtttgcaggtccccattttgcagctgtaaatagcaataatgagattattattacagatttccataatcattctgtcaaggtgtttaatcaggaaggagaattcatgttgaagtttggctcaaatggagaaggaaatgggcagtttaatgctccaacaggtgtagcagtggattcaaatggaaacatcattgtggccgactggggaaacagcaggatccaggtttttgatgggagtggatcatttttgtcctacattaacacatctgctgacccactctatggcccccaaggcctggccctaacttcagatggtcatgttgtggttgcagactctggaaatcactgtttcaaagtctatcgatacttacagtaatggtgggcaggtggatacccgcttccatggtcttgcactataaactggaatggatttctcaatgcgggaccagattatgactagagtttttatgccagaaggaatcattggtgaactttccaaggttatttctgaatgtaacaatttccttaaaaatgacttatccaatttctgtatttcacctttagggttaaaaaaaactcttctactgaatctataaaaactgcagttttacatctgtgaactatggcttaagggacaggatttatgtagctaaactaattttgcaaatcaaacagacacttaaaaaactagcatatgtaaaggtattcgttaatcctgtgaatggtagcttttgcacagaacttccaaaagcaaaacaaaaacaaaatctattgtagttatatacttcatttaacctaggtcacaagacccagggaatcttctaacctcacttttacagtaggtattactcttgtgacatttttttggttatcaacaactaaatataaattactttggaaaaagtaaggctgtcttgcaaaatgatcccagctctgattagcagccctctggagttcagaacttaagtatcagtgcaaatttctcaacctttctgggttagacaaagatccttttttgtgtgttcttttcaccacccctttggctcaccttgtatcagcaaacaaagtacttcttcagggaaacctgaaatttctaatgccttgaaaagcatattacaaaagtaatgctaccttttgggaaacaaactgccccgttaactccagatcattgcactggaatgtaatcaagaaagttagtcatgttttatgtaccatgttttcacacgtgtctcttctcttcgacttcctgaaagcgaaagctttacctcctgcaaatgtcagcacatgtagtaggacaccagtatcctaggacagagagccataagtagccctttggaggactgatggtgtcaaccaaaggcatgtgattgattaatgattcccccttagaaagcaagtgttaccaaagttgtgttatcttgaaagcattacaggtaagggcatgttatggttatttatcattgtttaatgaatagtagaggtgtcaagggactatgtatacatgattagggtaagatagaatgtattatatatatatatatatacacacacacatatatatagctgaatctttggtgtattgaaataggcagcactctgaaagacagaagcttcgtccagccactcttcagcacattcctttactaagcagtttaaagccgtcctagtggagcaagccctaaagcagatttaatttttgccattttccaagaatgacggtggtggcttttagtcagaaaatggccttctgtgctttcaaaaaaaaaaacaaa

SEQ ID NO: 32541 - DNA, 1924 bp, Homo sapiens
gcttctgagcggaaactgaaagtgaaatagggagctggctaccagcgttgagtcccctgtaaagccaaaccccctaaaggtctccacactgctgtttaacggcacacttgacaatggcttcagcagcacgcttgacaatgatgtgggaggaggtcacatgccctatctgcctggaccccttcgtggagcctgtgagcatcgagtgtggccacagcttctgccaggaatgcatctctcaggttgggaaaggtgggggcagcgtctgtcctgtgtgccggcagcgctttctgctcaagaatctccggcccaatcgacagctagccaacatggtgaacaaccttaaagaaatcagccaggaggccagagagggcacacagggggaacggtgtgcagtgcatggagagagacttcacctgttctgtgagaaagatgggaaggccctttgctgggtatgtgcccagtctcggaaacaccgtgaccacgccatggtccctcttgaggaggctgcacaggagtaccaggagaagctccaggtggcattaggggaactgagaagaaagcaggagttggctgagaagttggaagtggaaattgcaataaagagagcagactggaagaaaacagtggaaacacagaaatctaggattcacgcagagtttgtgcagcaaaaaaacttcctggttgaagaagaacagaggcagctgcaggagctggagaaggatgagagggagcagctgagaatcctgggggagaaagaggccaagctggcccagcagagccaggccctacaggagctcatctcagagctagatcgaaggtgccacagctcagcactggaactgctgcaggaggtgataattgtcctggaaaggagtgagtcctggaacctgaaggacctggatattacctctccagaactcaggagtgtgtgccatgtgccagggctgaagaagatgctgaggacatgtgcagtccacatcactctggatccagacacagccaatccgtggctgatactttcagaagatcggagacaagtgaggcttggagacacccagcagagcatacctggaaatgaagagagatttgatagttatcctatggtcctgggtgcccagcactttcactctggaaaacattactgggaggtagatgtgacaggaaaggaggcctgggacctgggtgtctgcagagactctgtgcgcaggaaggggcactttttgcttagttccaagagtggcttctggacaatttggttgtggaacaaacaaaaatatgaggctggcacctacccccagactcccctccaccttcaggtgcctccatgccaagttgggattttcctggactatgaggctggcatggtctccttctacaacatcactgaccatggctccctcatctactccttctctgaatgtgcctttacaggacctctgcggcccttcttcagtcctggtttcaatgatggaggaaaaaacacagcccctctaaccctctgtccactgaatattggatcacaaggatccactgactattgatggctttctctggacactgccactctccccattggcaccgcttctcagccacaaaccctgcctcttttccccatgaactctgaaccacctttgtctctgcagaggcatccggatcccagcaagcgagctttagcagggaagtcacttcaccatcaacattcctgccccagatggctttgtgattccctccagtgaagcagcctccttatatttggcccaaactcatcttgatcaaccaaaaacatgtttctgccttctttatgggacttaagttttttttttctcctctccatctctaggatgtcgtctttggtgagatctctattatatcttgtatggtttgcaaaagggcttcctaaaaataaaaaataaaatttaaaaaa

SEQ ID NO: 32542 - DNA, 1898 bp, Homo sapiens
gcttctgagcggaaactgaaagtgaaatagggagctggctaccagcgttgagtcccctgtaaagccaaaccccctaaaggtctccacactgctgtttaacggcacacttgacaatggcttcagcagcacgcttgacaatgatgtgggaggaggtcacatgccctatctgcctggaccccttcgtggagcctgtgagcatcgagtgtggccacagcttctgccaggaatgcatctctcaggttgggaaaggtgggggcagcgtctgtcctgtgtgccggcagcgctttctgctcaagaatctccggcccaatcgacagctagccaacatggtgaacaaccttaaagaaatcagccaggaggccagagagggcacacagggggaacggtgtgcagtgcatggagagagacttcacctgttctgtgagaaagatgggaaggccctttgctgggtatgtgcccagtctcggaaacaccgtgaccacgccatggtccctcttgaggaggctgcacaggagtaccaggagaagctccaggtggcattaggggaactgagaagaaagcaggagttggctgagaagttggaagtggaaattgcaataaagagagcagactggaagaaaacagtggaaacacagaaatctaggattcacgcagagtttgtgcagcaaaaaaacttcctggttgaagaagaacagaggcagctgcaggagctggagaaggatgagagggagcagctgagaatcctgggggagaaagaggccaagctggcccagcagagccaggccctacaggagctcatctcagagctagatcgaaggtgccacagctcagcactggaactgctgcaggaggttatagtgttaggccccaggagtgagtcctggaacctgaaggacctggatattacctctccagaactcaggagtgtgtgccatgtgccagggctgaagaagatgctgaggacatgtgcagtccacatcactctggatccagacacagccaatccgtggctgatactttcagaagatcggagacaagtgaggcttggagacacccagcagagcatacctggaaatgaagagagatttgatagttatcctatggtcctgggtgcccagcactttcactctggaaaacattactgggaggtagatgtgacaggaaaggaggcctgggacctgggtgtctgcagagactctgtgcgcaggaaggggcactttttgcttagttccaagagtggcttctggacaatttggttgtggaacaaacaaaaatatgaggctggcacctacccccagactcccctccaccttcaggtgcctccatgccaagttgggattttcctggactatgaggctggcatggtctccttctacaacatcactgaccatggctccctcatctactccttctctgaatgtgcctttacaggacctctgcggcccttcttcagtcctggtttcaatgatggaggaaaaaacacagcccctctaaccctctgtccactgaatattggatcacaaggatccactgactattgatggctttctctggacactgccactctccccattggcaccgcttctcagccacaaaccctgcctcttttccccatgaactctgaaccacctttgtctctgcagaggcatccggatcccagcaagcgagctttagcagggaagtcacttcaccatcaacattcctgccccagatggctttgtgattccctccagtgaagcagcctccttatatttggcccaaactcatcttgatcaaccaaaaacatgtttctgccttctttatgggacttaagttttttttttctcctctccatctctaggatgtcgtctttggtgagatctctattatatcttgtatggtttgcaaaagggcttcct

SEQ ID NO: 32543 - DNA, 2989 bp, Homo sapiens
cagggtttattgttatgtaagttcttgttcagcttcctttgttttctttcacttctgagaatttaactttcgtttctcactcagctcctgtggggaaactcatttgtggagaccagccctctggcttggtgagtgaatctggtttacaccggctcctgccctgccttcactcttctcccctgattcaagactcctctgctttggactgaagcactgcaggagtttgtgaccaagaacttcaagagtcaagacagaaggaagccaagggagcagtgcaatggatttctcagtaaaggtagacatagagaaggaggtgacctgccccatctgcctggagctcctgacagaacctctgagcctagattgtggccacagcttctgccaagcctgcatcactgcaaagatcaaggagtcagtgatcatctcaagaggggaaagcagctgtcctgtgtgtcagaccagattccagcctgggaacctccgacctaatcggcatctggccaacatagttgagagagtcaaagaggtcaagatgagcccacaggaggggcagaagagagatgtctgtgagcaccatggaaaaaaactccagatcttctgtaaggaggatggaaaagtcatttgctgggtttgtgaactgtctcaggaacaccaaggtcaccaaacattccgcataaacgaggtggtcaaggaatgtcaggaaaagctgcaggtagccctgcagaggctgataaaggaggatcaagaggctgagaagctggaagatgacatcagacaagagagaaccgcctggaagaattatatccagatcgagagacagaagattctgaaagggttcaatgaaatgagagtcatcttggacaatgaggagcagagagagctgcaaaagctggaggaaggtgaggtgaatgtgctggataacctggcagcagctacagaccagctggtccagcagaggcaggatgccagcacgctcatctcagatctccagcggaggttgaggggatcgtcagtagagatgctgcaggatgtgattgacgtcatgaaaaggagtgaaagctggacattgaagaagccaaaatctgtttccaagaaactaaagagtgtattccgagtaccagatctgagtgggatgctgcaagttcttaaagagctgacagatgtccagtactactgggtggacgtgatgctgaatccaggcagtgccacttcgaatgttgctatttctgtggatcagagacaagtgaaaactgtacgcacctgcacatttaagaattcaaatccatgtgatttttctgcttttggtgtcttcggctgccaatatttctcttcggggaaatattactgggaagtagatgtgtctggaaagattgcctggatcctgggcgtacacagtaaaataagtagtctgaataaaaggaagagctctgggtttgcttttgatccaagtgtaaattattcaaaagtttactccagatatagacctcaatatggctactgggttataggattacagaatacatgtgaatataatgcttttgaggactcctcctcttctgatcccaaggttttgactctctttatggctgtgcctccctgtcgtattggggttttcctagactatgaggcaggcattgtctcatttttcaatgtcacaaaccacggagcactcatctacaagttctctggatgtcgcttttctcgacctgcttatccgtatttcaatccttggaactgcctagtccccatgactgtgtgcccaccgagctcctgagtgttctcattcctttacccacttctgcatagtagcccttgtgctgagactcagattctgcacctgagttcatctctactgagaccatctcttcctttctttccccttcttttacttagaatgtctttgtattcatttgctagggcttccatagcaaagcatcatagattgctgatttaaactgtaattgtattgccgtactgtgggctggaaatcccaaatctagattccagcagagttggttctttctgaggtctgcaaggaagggctctgttccatgcctctctccttggcttgtagaaggcatcttgtccctatgactcttcacattgtctttatgtacatctctgtgcccaagttttccctttttattaagacaccagtcatactggctcagggcccaccgctaatgccttaatgaaatcattttaacattatattctctacaaagaccttatttccaaataagataatatttggaggtattgggaataaaaactccaacatataaatttgaggaaggcacgatttcactcataacaatcttaccctttcttgcaagagatgcttgtacattattttcctaataccttggtttcactagtagtaaacattattattttttttatatttgcaaaggaaacatatctaatccttcctatagaaagaacagtattgctgtaattccttttcttttcttcctcatttcctctgccccttaaaagattgaagaaagagaaacttgtcaactcatatccacgttatctagcaaagtacataagaatctatcactaagtaatgtatccttcagaatgtgttggtttaccagtgacaccccatattcatcacaaaattaaagcaagaagtccatagtaatttatttgctaatagtggatttttaatgctcagagtttctgaggtcaaattttatcttttcacttacaagctctatgatcttaaataatttacttaatgtattttggtgtattttcctcaaattaatattggtgttcaagactatatctaattcctctgatcactttgagaaacaaacttttattaaatgtaaggcacttttctatgaattttaaatataaaaataaatattgttctgattattactgaaaagatgtcagccatttcaatgtcttgggaaacaattttttgtttttgttctgttttctttttgcttcaataaaacaatagctggctcta

SEQ ID NO: 32544 - DNA, 897 bp, Homo sapiens
gacgggcagactgctgctcatctctgcagctccactttggtctcttgtctctgaaggtccagtcacagggaacttgttcttctgagtacccacagcttactcttcctttgtagcaggaccagccacagaaaaaactcctcagacaccgagcactgcaggagtttgtgaccaagaacttcaagagtcaagacagaaggaagccaagggagcagtgcaatggatttctcagtaaaggtagacatagagaaggaggtgacctgccccatctgcctggagctcctgacagaacctctgagcctagattgtggccacagcttctgccaagcctgcatcactgcaaagatcaaggagtcagtgatcatctcaagaggggaaagcagctgtcctgtgtgtcagaccagattccagcctgggaacctccgacctaatcggcatctggccaacatagttgagagagtcaaagaggtcaagatgagcccacaggaggggcagaagagagatgtctgtgagcaccatggaaaaaaactccagatcttctgtaaggaggatggaaaagtcatttgctgggtttgtgaactgtctcaggaacaccaaggtcaccaaacattccgcataaacgaggtggtcaaggaatgtcaggaaaagctgcaggtagccctgcagaggctgataaaggaggatcaagaggctgagaagctggaagatgacatcagacaagagagaaccgcctggaagaattatatccagatcgagagacagaagattctgaaagggttcaatgaaatgagagtcatcttggacaatgaggagcagagagagctgcaaaagctggaggaaggtgaggtgaatgtgctggataacctggcagcagctacagaccagctggtccagcagagg

SEQ ID NO: 32545 - DNA, 812 bp, Homo sapiens
attgttatctcctgtggggaaactcatttgtggagaccagccctctggcttggtgagtgaatctggtttacaccggctcctgccctgccttcactcttctcccctgattcaagactcctctgctttggactgaagcactgcaggagtttgtgaccaagaacttcaagagtcaagacagaaggaagccaagggagcagtgcaatggatttctcagtaaaggtagacatagagaaggaggtgacctgccccatctgcctggagctcctgacagaacctctgagcctagattgtggccacagcttctgccaagcctgcatcactgcaaagatcaaggagtcagtgatcatctcaagaggggaaagcagctgtcctgtgtgtcagaccagattccagcctgggaacctccgacctaatcggcatctggccaacatagttgagagagtcaaagaggtcaagatgagcccacaggaggggcagaagagagatgtctgtgagcaccatggaaaaaaactccagatcttctgtaaggaggatggaaaagtcatttgctgggtttgtgaactgtctcaggaacaccaaggtcaccaaacattccgcataaacgaggtggtcaaggaatgtcaggaaaagctgcaggtagccctgcagaggctgataaaggaggatcaagaggctgagaagctggaagatgacatcagacaagagagaaccgcctggaagaattatatccagatcgagagacagaagattctgaaagggttcaatgaaatgagagtcatcttggacaatgaggagcagagagagctgcaaaa

SEQ ID NO: 32546 - DNA, 2477 bp, Homo sapiens
atggatttctcagtaaaggtagacatagagaaggaggtgacctgccccatctgcctggagctcctgacagaacctctgagcctagattgtggccacagcttctgccaagcctgcatcactgcaaagatcaaggagtcagtgatcatctcaagaggggaaagcagctgtcctgtgtgtcagaccagattccagcctgggaacctccgacctaatcggcatctggccaacatagttgagagagtcaaagaggtcaagatgagcccacaggaggggcagaagagagatgtctgtgagcaccatggaaaaaaactccagatcttctgtaaggaggatggaaaagtcatcttggacaatgaggagcagagagagctgcaaaagctggaggaaggtgaggtgaatgtgctggataacctggcagcagctacagaccagctggtccagcagaggcaggatgccagcacgctcatctcagatctccagcggaggttgaggggatcgtcagtagagatgctgcaggatgtgattgacgtcatgaaaaggagtgaaagctggacattgaagaagccaaaatctgtttccaagaaactaaagagtgtattccgagtaccagatctgagtgggatgctgcaagttcttaaagagctgacagatgtccagtactactgggtggacgtgatgctgaatccaggcagtgccacttcgaatgttgctatttctgtggatcagagacaagtgaaaactgtacgcacctgcacatttaagaattcaaatccatgtgatttttctgcttttggtgtcttcggctgccaatatttctcttcggggaaatattactgggaagtagatgtgtctggaaagattgcctggatcctgggcgtacacagtaaaataagtagtctgaataaaaggaagagctctgggtttgcttttgatccaagtgtaaattattcaaaagtttactccagatatagacctcaatatggctactgggttataggattacagaatacatgtgaatataatgcttttgaggactcctcctcttctgatcccaaggttttgactctctttatggctgtgcctccctgtcgtattggggttttcctagactatgaggcaggcattgtctcatttttcaatgtcacaaaccacggagcactcatctacaagttctctggatgtcgcttttctcgacctgcttatccgtatttcaatccttggaactgcctagtccccatgactgtgtgcccaccgagctcctgagtgttctcattcctttacccacttctgcatagtagcccttgtgctgagactcagattctgcacctgagttcatctctactgagaccatctcttcctttctttccccttcttttacttagaatgtctttgtattcatttgctagggcttccatagcaaagcatcatagattgctgatttaaactgtaattgtattgccgtactgtgggctggaaatcccaaatctagattccagcagagttggttctttctgaggtctgcaaggaagggctctgttccatgcctctctccttggcttgtagaaggcatcttgtccctatgactcttcacattgtctttatgtacatctctgtgcccaagttttccctttttattaagacaccagtcatactggctcagggcccaccgctaatgccttaatgaaatcattttaacattatattctctacaaagaccttatttccaaataagataatatttggaggtattgggaataaaaactccaacatataaatttgaggaaggcacgatttcactcataacaatcttaccctttcttgcaagagatgcttgtacattattttcctaataccttggtttcactagtagtaaacattattattttttttatatttgcaaaggaaacatatctaatccttcctatagaaagaacagtattgctgtaattccttttcttttcttcctcatttcctctgccccttaaaagattgaagaaagagaaacttgtcaactcatatccacgttatctagcaaagtacataagaatctatcactaagtaatgtatccttcagaatgtgttggtttaccagtgacaccccatattcatcacaaaattaaagcaagaagtccatagtaatttatttgctaatagtggatttttaatgctcagagtttctgaggtcaaattttatcttttcacttacaagctctatgatcttaaataatttacttaatgtattttggtgtattttcctcaaattaatattggtgttcaagactatatctaattcctctgatcactttgagaaacaaacttttattaaatgtaaggcacttttctatgaattttaaatataaaaataaatattgttctgattattactgaaaagatgtcagccatttcaatgtcttgggaaacaattttttgtttttgttctgttttctttttgcttcaataaaacaatagctggctct

SEQ ID NO: 32547 - DNA, 1688 bp, Homo sapiens
aatctggtttacaccggctcctgccctgccttcactcttctcccctgattcaagactcctctgctttggactgaagcactgcaggagtttgtgaccaagaacttcaagagtcaagacagaaggaagccaagggagcagtgcaatggatttctcagtaaaggtagacatagagaaggaggtgacctgccccatctgcctggagctcctgacagaacctctgagcctagattgtggccacagcttctgccaagcctgcatcactgcaaagatcaaggagtcagtgatcatctcaagaggggaaagcaggggcagaagagagatgtctgtgagcaccatggaaaaaaactccagatcttctgtaaggaggatggaaaagtcatttgctgggtttgtgaactgtctcaggaacaccaaggtcaccaaacattccgcataaacgaggtggtcaaggaatgtcaggaaaagctgcaggtagccctgcagaggctgataaaggaggatcaagaggctgagaagctggaagatgacatcagacaagagagaaccgcctggaagaattatatccagatcgagagacagaagattctgaaagggttcaatgaaatgagagtcatcttggacaatgaggagcagagagagctgcaaaagctggaggaaggtgaggtgaatgtgctggataacctggcagcagctacagaccagctggtccagcagaggcaggatgccagcacgctcatctcagatctccagcggaggttgaggggatcgtcagtagagatgctgcaggatgtgattgacgtcatgaaaaggagtgaaagctggacattgaagaagccaaaatctgtttccaagaaactaaagagtgtattccgagtaccagatctgagtgggatgctgcaagttcttaaagagctgacagatgtccagtactactgggtggacgtgatgctgaatccaggcagtgccacttcgaatgttgctatttctgtggatcagagacaagtgaaaactgtacgcacctgcacatttaagaattcaaatccatgtgatttttctgcttttggtgtcttcggctgccaatatttctcttcggggaaatattactgggaagtagatgtgtctggaaagattgcctggatcctgggcgtacacagtaaaataagtagtctgaataaaaggaagagctctgggtttgcttttgatccaagtgtaaattattcaaaagtttactccagatatagacctcaatatggctactgggttataggattacagaatacatgtgaatataatgcttttgaggactcctcctcttctgatcccaaggttttgactctctttatggctgtgcctccctgtcgtattggggttttcctagactatgaggcaggcattgtctcatttttcaatgtcacaaaccacggagcactcatctacaagttctctggatgtcgcttttctcgacctgcttatccgtatttcaatccttggaactgcctagtccccatgactgtgtgcccaccgagctcctgagtgttctcattcctttacccacttctgcatagtagcccttgtgctgagactcagattctgcacctgagttcatctctactgagaccatctcttcctttctttccccttcttttacttagaatgtctttgtattcatttgctagggcttccatagc

SEQ ID NO: 32548 - DNA, 5744 bp, Homo sapiens
gtttcctcggcggcctcggagcgcgggtgcagcagttgtgtcccgacccctgggagcgccatggcagagctgtgccccctggccgaggagctgtcgtgctccatctgcctggagcccttcaaggagccggtcaccactccgtgcggccacaacttctgcgggtcgtgcctgaatgagacgtgggcagtccagggctcgccatacctgtgcccgcagtgccgcgccgtctaccaggcgcgaccgcagctgcacaagaacacggtgctgtgcaacgtggtggagcagttcctgcaggccgacctggcccgggagccacccgccgacgtctggacgccgcccgcccgcgcctctgcacccagcccgaatgcccaggtggcctgcgaccactgcctgaaggaggccgccgtgaagacgtgcttggtgtgcatggcctccttctgtcaggagcacctgcagccgcacttcgacagccccgccttccaggaccacccgctgcagccgcccgttcgcgacctgttgcgccgcaaatgttcccagcacaatcggctgcgggaatttttctgccccgagcacagcgagtgcatctgccacatctgcctggtggagcataagacctgctctcccgcgtccctgagccaggccagcgccgacctggaggccaccctgaggcacaaactaactgtcatgtacagtcagatcaacggggcgtcgagagcactggatgatgtgagaaacaggcagcaggatgtgcggatgactgcaaacagaaaggtggagcagctacaacaagaatacacggaaatgaaggctctcttggacgcctcagagaccacctcgacaaggaagataaaggaagaggagaagagggtcaacagcaagtttgacaccatttatcagattctcctcaagaagaagagtgagatccagaccttgaaggaggagattgaacagagcctgaccaagagggatgagttcgagtttctggagaaagcatcaaaactgcgaggaatctcaacaaagccagtctacatccccgaggtggaactgaaccacaagctgataaaaggcatccaccagagcaccatagacctcaaaaacgagctgaagcagtgcatcgggcggctccaggagcccacccccagttcaggtgaccctggagagcatgacccagcgtccacacacaaatccacacgccctgtgaagaaggtctccaaagaggaaaagaaatccaagaaacctccccctgtccctgccttacccagcaagcttcccacgtttggagccccggaacagttagtggatttaaaacaagctggcttggaggctgcagccaaagccaccagctcacatccgaactcaacatctctcaaggccaaggtgctggagaccttcctggccaagtccagacctgagctcctggagtattacattaaagtcatcctggactacaacaccgcccacaacaaagtggctctgtcagagtgctatacagtagcttctgtggctgagatgcctcagaactaccggccgcatccccagaggttcacatactgctctcaggtgctgggcctgcactgctacaagaaggggatccactactgggaggtggagctgcagaagaacaacttctgtggggtaggcatctgctacggaagcatgaaccggcagggcccagaaagcaggctcggccgcaacagcgcctcctggtgcgtggagtggttcaacaccaagatctctgcctggcacaataacgtggagaaaaccctgccctccaccaaggccacgcgggtgggcgtgcttctcaactgtgaccacggctttgtcatcttcttcgctgttgccgacaaggtccacctgatgtataagttcagggtggactttactgaggctttgtacccggctttctgggtattttctgctggtgccacactctccatctgctcccccaagtaggcaggctgtaggcacttgggctgactgcctgcagaagtcccaagaccctagtgaaaatacagcaggcagaactctccttggataattccccaagaggtcccaaggattgggagcatgggaggggagctggcgggagggtgggaggtgggatttagccaggaaaggggtgagagtgattgtgttgtgggcgaggaggcgtttccaccccctggtgcctatcagggcagggtgacctactccccattgttctggaaatctccaggctgctgggcagctgggcagagctctgggaagtgaagtcatgagtgcccgattcctcttagagaaaatccatagctactgtaggttctgtcttgggccacttggatctgaaggctgcccctttgctctctggggtagccttcagatcttggtgttttgaattcttactatagatgtttttaaagttccaaagtcattgagtttcaatgttacataaactccattacccgcatgttggggcttgatctcctggttattatctgtgcttgaggaaacacccacagcagtctctacccagaacagtttcctaaagaggcataccctcttcctccactggaaaatagtgcgttcccttcctaccctgcacacccatcgcccccacattgatggttttcaaacagcaaacttttcagctaaagcttcaaaccatgattggaatcagcctgtgttggatttgtgattcagggtcatggtgaccctgatccagtttgggtggaaatccttcctaagtatcataagaagcatcttggcagagatgctttggtggcagccatgagctttgctggaggccttgcttcccatagccttggctgtggggcaaggaactctgccaggcgagggggatgctgccctggatcaacagaagcctggtgggtttgctcgtgttagagtgtcctgccttcttactgacaactcttctcggtgatagcctctcttccctggattgtgacatatggaatgacagtgcaggtaccaccgaggctagcacagtcaagcctccagctaagctggatccctgaagcctgctatcatgcagacaggctatgcggctgcctcggaccatgctaggccacttgctggggtgtcaacctaccaccaaaggggtcttttagcaaacctcatggggaacaggaacattcctgttcatccctggccacaggctgcagacccagcactggcccttgcgtgagtcagagcctggggctggccctagccccttctactgacttcctcatttaagccaattatataagctcacattgatcagggagggagggaaagagctaaagagggtcacacaagtggctattttccctgcagtgtttctgtgtggtgaaaataacccagtccactaaggggcgggagtgaatggatggctggattttccccaagctccttatagcctaatgttgtcaggatgtgagtatgaggaatttagcctcttatagtgaaatgagtccaactctgggctttgcttagaggagagctcctgtcaggcttcctataatatgaaaagaagtcaccattggggaactagagaccccagaccttttcatatggatatttgagaatgtaatgcatctcaggcctcgtgctggaactctagggcactctaggcaggctcagaacacttgatattcctgacagctacacacctgacatgcaggtacatacctgatcggtgtcatctcctaacaaggattttcagttcctcgggagagcaataatctttgtaggaaagacatccctgcaataggtgatatgtggtccttagaagttttattcctttactacttggaagaaaagttctttggtgattcttctctgcttttgaagatgatcaaaagcatcttcattgattttctgaaacgaaagccttgtctgaaaccaattaatacttgggaaacagctgggcttggaggagtagaatgccagagataaatccatggctcctgctctggctctcttctgcagaaatgagggcaacagtgaggccacttccctggcaaatgtgcagctcaggatagggaagcataagaccctctgtttaaaagagagtcaagtaggtaaccaaagccaagctctgtgcaaggtgctttggagttgtaaattgaggagtgcatccttgctgtcttgaaccattctgtttgcaatggtgagaccttacataacctagccttgcagggccgccacacaaccctggagtcctagagttggaggaacctttgtatccatctgacttctcattttgcagaatatgatgagaaagtagaggatcgctctgttcaccactcttgctattccattagtggggagatgcctgctagcatgtgtgaggggaacactctgatacactgggaagtatcggaaattcccagaaacacaaacataaaataactctcctagacccaggtactggggactgtctcagtccgtgtggcatgataaataaaaggttaggatcaagtctttgtatttttcaagatgtggtagctgattattcctgttttaagtactctgaaattgatctgtgatcaataatactaatatgttatcttttaccgtattctgcctctcactattgattttaattagttaggagtatttgagctgttatttcttgagcttaatatttttttagagttaactctttaaggagataatcatggctgtagacaaggccagggctggctgacgtgccttagaaggtttgaatgcaataaagcggtgtttggcgttctcctgcattgtagtgcgggtacaaaatgctatttgttcgtcatactgttgtcagcagatgagccgcccactacagacggctactgcccagggacctgcccaggccccacccaagggctcccaagggttgagatttctgcagacctatagccagcacacttagtcctgccctatatagagttcctcttcgggaagcttttgataaggaattctcagaccgataggatgtctgtctgggctttgctgcgggacagtctaactgtgggggctaggggaaagcaggagagtatcgatcaaagagtaagccacacacggataatcagttactagggatggaggtgtgagggttcattatattattcattttactgttgtatatgtttgaaaatgtctataataaaaagctttaaaaaaaaaaaagaaacaaaaatagttcaggccagcaatgggccctccatgttcagtggattttatccttgtttcaattggggtaggagttccaggaggtgtggattggaggttgtctaaagaattgaactggcctttgtccctgcttcctgggagggagactttcagtccttgacatttccagggtaataggagtgtctttgttatttgtgaggccatgggatcacacctgagcttatgctaaaaggtgggatgactcagagctggggctggtcaccagacagactgaccatgtgattagaggtttgaggctttgagtcagcctgacctatggggcgggggactggaggctgagtttaatcatctggccagtgctttaatcagtacatcatgaaaccctaataaaaactctggacactaaagctcagcatagcttcctgggtggtgaagctgtggctatgccggcagggcagtgtgccctaattccacgaagagggggcatgggagcactgtgctcaagacccttccagacctttccctgtgtcttccttggcttgtggagctgatttgtatcctttataataaaactaatcataagtata

SEQ ID NO: 32549 - DNA, 2294 bp, Homo sapiens
cgcgggtgcagcagttgtgtcccgacccctgggagcgccatggcagagctgtgccccctggccgaggagctgtcgtgctccatctgcctggagcccttcaaggagccggtcaccactccgtgcggccacaacttctgcgggtcgtgcctgaatgagacgtgggcagtccagggctcgccatacctgtgcccgcagtgccgcgccgtctaccaggcgcgaccgcagctgcacaagaacacggtgctgtgcaacgtggtggagcagttcctgcaggccgacctggcccgggagccacccgccgacgtctggacgccgcccgcccgcgcctctgcacccagcccgaatgcccaggtggcctgcgaccactgcctgaaggaggccgccgtgaagacgtgcttggtgtgcatggcctccttctgtcaggagcacctgcagccgcacttcgacagccccgccttccaggaccacccgctgcagccgcccgttcgcgacctgttgcgccgcaaatgttcccagcacaatcggctgcgggaatttttctgccccgagcacagcgagtgcatctgccacatctgcctggtggagcataagacctgctctcccgcgtccctgagccaggccagcgccgacctggaggccaccctgaggcacaaactaactgtcatgtacagtcagatcaacggggcgtcgagagcactggatgatgtgagaaacaggcagcaggatgtgcggatgactgcaaacagaaaggtggagcagctacaacaagaatacacggaaatgaaggctctcttggacgcctcagagaccacctcgacaaggaagataaaggaagaggagaagagggtcaacagcaagtttgacaccatttatcagattctcctcaagaagaagagtgagatccagaccttgaaggaggagattgaacagagcctgaccaagagggatgagttcgagtttctggagaaagcatcaaaactgcgaggaatctcaacaaagccagtctacatccccgaggtggaactgaaccacaagctgataaaaggcatccaccagagcaccatagacctcaaaaacgagctgaagcagtgcatcgggcggctccaggagcccacccccagttcaggtgaccctggagagcatgacccagcgtccacacacaaatccacacgccctgtgaagaaggtctccaaagaggaaaagaaatccaagaaacctccccctgtccctgccttacccagcaagcttcccacgtttggagccccggaacagttagtggatttaaaacaagctggcttggaggctgcagccaaagccaccagctcacatccgaactcaacatctctcaaggccaaggtgctggagaccttcctggccaagtccagacctgagctcctggagtattacattaaagtcatcctggactacaacaccgcccacaacaaagtggctctgtcagagtgctatacagtagcttctgtggctgagatgcctcagaactaccggccgcatccccagaggttcacatactgctctcaggtgctgggcctgcactgctacaagaaggggatccactactgggaggtggagctgcagaagaacaacttctgtggggtaggcatctgctacggaagcatgaaccggcagggcccagaaagcaggctcggccgcaacagcgcctcctggtgcgtggagtggttcaacaccaagatctctgcctggcacaataacgtggagaaaaccctgccctccaccaaggccacgcgggtgggcgtgcttctcaactgtgaccacggctttgtcatcttcttcgctgttgccgacaaggtccacctgatgtataagttcagggtggactttactgaggctttgtacccggctttctgggtattttctgctggtgccacactctccatctgctcccccaagtaggcaggctgtaggcacttgggctgactgcctgcagaagtcccaagaccctagtgaaaatacagcaggcagaactctccttggataattccccaagaggtcccaaggattgggagcatgggaggggagctggcgggagggtgggaggtgggatttagccaggaaaggggtgagagtgattgtgttgtgggcgaggaggcgtttccaccccctggtgcctatcagggcagggtgacctactccccattgttctggaaatctccaggctgctgggcagctgggcagagctctgggaagtgaagtcatgagtgcccgattcctcttagagaaaatccatagccttcagatcttggtgttttgaattc

SEQ ID NO: 32550 - DNA, 2686 bp, Homo sapiens
tttacgctgccgccggcatccgctcggacgcggccacgttgtcttgcgcgctttgcccgcctggccctgggactctgaccctcggctaccctttcctgccccactagcgtggccgcgagcctcggtgagccggccgtattcccgctctcgcttagggggcacaggcgcaggcatcggcccggccactccaagccttcggtgcgcgggcgcgtctgggatacgggcccgggaggcgccgccctccgtccgcccggtgcctctcaggaacagcgaaccggagagagcgccggagagttgggctcagtgcagagctcggcgccggggcccatgcccgtgcgcccccgcaggccggcgccatggcctccgggagtgtggccgagtgcctgcagcaggagaccacctgccccgtgtgcctgcagtacttcgcagagcccatgatgctcgactgcggccataacatctgttgcgcgtgcctcgcccgctgctggggcacggcagagactaacgtgtcgtgcccgcagtgccgggagaccttcccgcagaggcacatgcggcccaaccggcacctggccaacgtgacccaactggtaaagcagctgcgcaccgagcggccgtcggggcccggcggcgagatgggcgtgtgcgagaagcaccgcgagcccctgaagctgtactgcgaggaggaccagatgcccatctgcgtggtgtgcgaccgctcccgcgagcaccgcggccacagcgtgctgccgctcgaggaggcggtggagggcttcaaggagcaaatccagaaccagctcgaccatttaaaaagagtgaaagatttaaagaagagacgtcgggcccagggggaacaggcacgagctgaactcttgagcctaacccagatggagagggagaagattgtttgggagtttgagcagctgtatcactccttaaaggagcatgagtatcgcctcctggcccgccttgaggagctagacttggccatctacaatagcatcaatggtgccatcacccagttctcttgcaacatctcccacctcagcagcctgatcgctcagctagaagagaagcagcagcagcccaccagggagctcctgcaggacattggggacacattgagcagggctgaaagaatcaggattcctgaaccttggatcacacctccagatttgcaagagaaaatccacatttttgcccaaaaatgtctattcttgacggagagtctaaagcagttcacagaaaaaatgcagtcagatatggagaaaatccaagaattaagagaggctcagttatactcagtggacgtgactctggacccagacacggcctaccccagcctgatcctctctgataatctgcggcaagtgcggtacagttacctccaacaggacctgcctgacaaccccgagaggtctccttctacaacgtgacagagaggtgtcacaccttcactttctctcatgctaccttttgtgggcctgtccggccctacttcagtctgagttactcgggagggaaaagtgcagctcctctgatcatctgccccatgagtgggatagatgggttttctggccatgttgggaatcatggtcattccatggagacctccccttgaggaggtgaattcaggccaaaagggctgttggctgtaatcctacgccaggcacaaggcatcttgttgccttgccacgtcctgtcacagctgggtatccttaccatgttccacgcccttgcagtgggagacaggatgtccatgttctctaccatccttttccttcccatgcagattgtgaaatgtaatgagatgtatcaagatatcctagaaataaaaaccagatgtccacctccagtgtttcatactttctggttttacacatcgctggagggataaagagtatggataatctttggatttggagagccgttcaagatacttccagcttcttggctcagcctggcttcctctggttcagccccacataatgattatggctatttgctgtcatttctgggctagggctcctttctaacaacctagactggaataaggccctgtcagcatggctccctttatcccagttttccgtctgggaacagtacctctgcccctgattcccaatgtgccatagttttattaactccattaaagaagcctgtatgtgttttggttagttacagttattttacaataatggtgggtaatggccccacctctgttatgagataatgttctaatcaatgtctctgcctttgtatcttttctgagggctttgtctgttctcttcattctaatgaaaggtgtattctagtgctgggtgcatatcatccaggataatattctgcccaactccatcctctgttactagatcccttaccagtcacatttgtggactggtggccagtcgtataccatccctggaaggattctgggacaatattccagggattcattgacttcttggctccttttctccatttcctttgggggaagggggaattgaccatgcttaagtgcatcctatcaaggggcagctccgtccccatggccattggatcatgagacactctgaagtcagaaggctggggcagatcacttcaagcaagcccccatgatggttctcagtcctgcttctctgtgggtacgtgcccctctgtttaaaaataaactgaatatggatgttta

SEQ ID NO: 32551 - DNA, 2967 bp, Homo sapiens
gtttacgctgccgccggcatccgctcggacgcggccacgttgtcttgcgcgctttgcccgcctggccctgggactctgaccctcggctaccctttcctgccccactagcgtggccgcgagcctcggtgagccggccgtattcccgctctcgcttagggggcacaggcgcaggcatcggcccggccactccaagccttcggtgcgcgggcgcgtctgggatacgggcccgggaggcgccgccctccgtccgcccggtgcctctcaggaacagcgaaccggagagagcgccggagagttgggctcagtgcagagctcggcgccggggcccatgcccgtgcgcccccgcaggccggcgccatggcctccgggagtgtggccgagtgcctgcagcaggagaccacctgccccgtgtgcctgcagtacttcgcagagcccatgatgctcgactgcggccataacatctgttgcgcgtgcctcgcccgctgctggggcacggcagagactaacgtgtcgtgcccgcagtgccgggagaccttcccgcagaggcacatgcggcccaaccggcacctggccaacgtgacccaactggtaaagcagctgcgcaccgagcggccgtcggggcccggcggcgagatgggcgtgtgcgagaagcaccgcgagcccctgaagctgtactgcgaggaggaccagatgcccatctgcgtggtgtgcgaccgctcccgcgagcaccgcggccacagcgtgctgccgctcgaggaggcggtggagggcttcaaggagcaaatccagaaccagctcgaccatttaaaaagagtgaaagatttaaagaagagacgtcgggcccagggggaacaggcacgagctgaactcttgagcctaacccagatggagagggagaagattgtttgggagtttgagcagctgtatcactccttaaaggagcatgagtatcgcctcctggcccgccttgaggagctagacttggccatctacaatagcatcaatggtgccatcacccagttctcttgcaacatctcccacctcagcagcctgatcgctcagctagaagagaagcagcagcagcccaccagggagctcctgcaggacattggggacacattgagcagggctgaaagaatcaggattcctgaaccttggatcacacctccagatttgcaagagaaaatccacatttttgcccaaaaatgtctattcttgacggagagtctaaagcagttcacagaaaaaatgcagtcagatatggagaaaatccaagaattaagagaggctcagttatactcagtggacgtgactctggacccagacacggcctaccccagcctgatcctctctgataatctgcggcaagtgcggtacagttacctccaacaggacctgcctgacaaccccgagaggttcaatctgtttccctgtgtcttgggctctccatgcttcatcgccgggagacattattgggaggtagaggtgggagataaagccaagtggaccataggtgtctgtgaagactcagtgtgcagaaaaggtggagtaacctcagccccccagaatggattctgggcagtgtctttgtggtatgggaaagaatattgggctcttacctccccaatgactgccctacccctgcggaccccgctccagcgggtggggattttcttggactatgatgctggtgaggtctccttctacaacgtgacagagaggtgtcacaccttcactttctctcatgctaccttttgtgggcctgtccggccctacttcagtctgagttactcgggagggaaaagtgcagctcctctgatcatctgccccatgagtgggatagatgggttttctggccatgttgggaatcatggtcattccatggagacctccccttgaggaggtgaattcaggccaaaagggctgttggctgtaatcctacgccaggcacaaggcatcttgttgccttgccacgtcctgtcacagctgggtatccttaccatgttccacgcccttgcagtgggagacaggatgtccatgttctctaccatccttttccttcccatgcagattgtgaaatgtaatgagatgtatcaagatatcctagaaataaaaaccagatgtccacctccagtgtttcatactttctggttttacacatcgctggagggataaagagtatggataatctttggatttggagagccgttcaagatacttccagcttcttggctcagcctggcttcctctggttcagccccacataatgattatggctatttgctgtcatttctgggctagggctcctttctaacaacctagactggaataaggccctgtcagcatggctccctttatcccagttttccgtctgggaacagtacctctgcccctgattcccaatgtgccatagttttattaactccattaaagaagcctgtatgtgttttggttagttacagttattttacaataatggtgggtaatggccccacctctgttatgagataatgttctaatcaatgtctctgcctttgtatcttttctgagggctttgtctgttctcttcattctaatgaaaggtgtattctagtgctgggtgcatatcatccaggataatattctgcccaactccatcctctgttactagatcccttaccagtcacatttgtggactggtggccagtcgtataccatccctggaaggattctgggacaatattccagggattcattgacttcttggctccttttctccatttcctttgggggaagggggaattgaccatgcttaagtgcatcctatcaaggggcagctccgtccccatggccattggatcatgagacactctgaagtcagaaggctggggcagatcacttcaagcaagcccccatgatggttctcagtcctgcttctctgtgggtacgtgcccctctgtttaaaaataaactgaatatggatgttta

SEQ ID NO: 32552 - DNA, 2967 bp, Homo sapiens; identical to SEQ ID NO: 32551

SEQ ID NO: 32553 - DNA, 2686 bp, Homo sapiens; identical to SEQ ID NO: 32550

SEQ ID NO: 32554 - DNA, 1813 bp, Homo sapiens
tctaaagcagttcacagaaaaaatgcagtcagatatggagaaaatccaagaatcagctgactcactggaaggtggaattcttgatcttggctcagttttatcccatattctaccagtctcagaattaagagaggctcagttatactcagtggacgtgactctggacccagacacggcctaccccagcctgatcctctctgataatctgcggcaagtgcggtacagttacctccaacaggacctgcctgacaaccccgagaggttcaatctgtttccctgtgtcttgggctctccatgcttcatcgccgggagacattattgggaggtagaggtgggagataaagccaagtggaccataggtgtctgtgaagactcagtgtgcagaaaaggtggagtaacctcagccccccagaatggattctgggcagtgtctttgtggtatgggaaagaatattgggctcttacctccccaatgactgccctacccctgcggaccccgctccagcgggtggggattttcttggactatgatgctggtgaggtctccttctacaacgtgacagagaggtgtcacaccttcactttctctcatgctaccttttgtgggcctgtccggccctacttcagtctgagttactcgggagggaaaagtgcagctcctctgatcatctgccccatgagtgggatagatgggttttctggccatgttgggaatcatggtcattccatggagacctccccttgaggaggtgaattcaggccaaaagggctgttggctgtaatcctacgccaggcacaaggcatcttgttgccttgccacgtcctgtcacagctgggtatccttaccatgttccacgcccttgcagtgggagacaggatgtccatgttctctaccatccttttccttcccatgcagattgtgaaatgtaatgagatgtatcaagatatcctagaaataaaaaccagatgtccacctccagtgtttcatactttctggttttacacatcgctggagggataaagagtatggataatctttggatttggagagccgttcaagatacttccagcttcttggctcagcctggcttcctctggttcagccccacataatgattatggctatttgctgtcatttctgggctagggctcctttctaacaacctagactggaataaggccctgtcagcatggctccctttatcccagttttccgtctgggaacagtacctctgcccctgattcccaatgtgccatagttttattaactccattaaagaagcctgtatgtgttttggttagttacagttattttacaataatggtgggtaatggccccacctctgttatgagataatgttctaatcaatgtctctgcctttgtatcttttctgagggctttgtctgttctcttcattctaatgaaaggtgtattctagtgctgggtgcatatcatccaggataatattctgcccaactccatcctctgttactagatcccttaccagtcacatttgtggactggtggccagtcgtataccatccctggaaggattctgggacaatattccagggattcattgacttcttggctccttttctccatttcctttgggggaagggggaattgaccatgcttaagtgcatcctatcaaggggcagctccgtccccatggccattggatcatgagacactctgaagtcagaaggctggggcagatcacttcaagcaagcccccatgatggttctcagtcctgcttctctgtgggtacgtgcccctctgtttaaaaataaactgaatatggatgttta

SEQ ID NO: 32555 - DNA, 2686 bp, Homo sapiens; identical to SEQ ID NO: 32550

SEQ ID NO: 32556 - DNA, 1813 bp, Homo sapiens; identical to SEQ ID NO: 32554

SEQ ID NO: 32557 - DNA, 2686 bp, Homo sapiens
tttacgctgccgccggcatccgctcggacgcggccacgttgtcttgcgcgctttgcccgcctggccctgggactctgaccctcggctaccctttcctgccccactagcgtggccgcgagcctcggtgagccggccgtattcccgctctcgcttagggggcacaggcgcaggcatcggcccggccactccaagccttcggtgcgcgggcgcgtctgggatacgggcccgggaggcgccgccctccgtccgcccggtgcctctcaggaacagcgaaccggagagagcgccggagagttgggctcagtgcagagctcggcgccggggcccatgcccgtgcgcccccgcaggccggcgccatggcctccgggagtgtggccgagtgcctgcagcaggagaccacctgccccgtgtgcctgcagtacttcgcagagcccatgatgctcgactgcggccataacatctgttgcgcgtgcctcgcccgctgctggggcacggcagagactaacgtgtcgtgcccgcagtgccgggagaccttcccgcagaggcacatgcggcccaaccggcacctggccaacgtgacccaactggtgaagcagctgcgcaccgagcggccgtcggggcccggcggcgagatgggcgtgtgcgagaagcaccgcgagcccctgaagctgtactgcgaggaggaccagatgcccatctgcgtggtgtgcgaccgctcccgcgagcaccgcggccacagcgtgctgccgctcgaggaggcggtggagggcttcaaggagcaaatccagaaccagctcgaccatttaaaaagagtgaaagatttaaagaagagacgtcgggcccagggggaacaggcacgagctgaactcttgagcctaacccagatggagagggagaagattgtttgggagtttgagcagctgtatcactccttaaaggagcatgagtatcgcctcctggcccgccttgaggagctagacttggccatctacaatagcatcaatggtgccatcacccagttctcttgcaacatctcccacctcagcagcctgatcgctcagctagaagagaagcagcagcagcccaccagggagctcctgcaggacattggggacacattgagcagggctgaaagaatcaggattcctgaaccttggatcacacctccagatttgcaagagaaaatccacatttttgcccaaaaatgtctattcttgacggagagtctaaagcagttcacagaaaaaatgcagtcagatatggagaaaatccaagaattaagagaggctcagttatactcagtggacgtgactctggacccagacacggcctaccccagcctgatcctctctgataatctgcggcaagtgcggtacagttacctccaacaggacctgcctgacaaccccgagaggtctccttctacaacgtgacagagaggtgtcacaccttcactttctctcatgctaccttttgtgggcctgtccggccctacttcagtctgagttactcgggagggaaaagtgcagctcctctgatcatctgccccatgagtgggatagatgggttttctggccatgttgggaatcatggtcattccatggagacctccccttgaggaggtgaattcaggccaaaagggctgttggctgtaatcctacgccaggcacaaggcatcttgttgccttgccacgtcctgtcacagctgggtatccttaccatgttccacgcccttgcagtgggagacaggatgtccatgttctctaccatccttttccttcccatgcagattgtgaaatgtaatgagatgtatcaagatatcctagaaataaaaaccagatgtccacctccagtgtttcatactttctggttttacacatcgctggagggataaagagtatggataatctttggatttggagagccgttcaagatacttccagcttcttggctcagcctggcttcctctggttcagccccacataatgattatggctatttgctgtcatttctgggctagggctcctttctaacaacctagactggaataaggccctgtcagcatggctccctttatcccagttttccgtctgggaacagtacctctgcccctgattcccaatgtgccatagttttattaactccattaaagaagcctgtatgtgttttggttagttacagttattttacaataatggtgggtaatggccccacctctgttatgagataatgttctaatcaatgtctctgcctttgtatcttttctgagggctttgtctgttctcttcattctaatgaaaggtgtattctagtgctgggtgcatatcatccaggataatattctgcccaactccatcctctgttactagatcccttaccagtcacatttgtggactggtggccagtcgtataccatccctggaaggattctgggacaatattccagggattcattgacttcttggctccttttctccatttcctttgggggaagggggaattgaccatgcttaagtgcatcctatcaaggggcagctccgtccccatggccattggatcatgagacactctgaagtcagaaggctggggcagatcacttcaagcaagcccccatgatggttctcagtcctgcttctctgtgggtacgtgcccctctgtttaaaaataaactgaatatggatgttta

SEQ ID NO: 32558 - DNA, 1813 bp, Homo sapiens; identical to SEQ ID NO: 32554

SEQ ID NO: 32559 - DNA, 1103 bp, Homo sapiens
tttacgctgccgccggcatccgctcggacgcggccacgttgtcttgcgcgctttgcccgcctggccctgggactctgaccctcggctaccctttcctgccccactagcgtggccgcgagcctcggtgagccggccgtattcccgctctcgcttagggggcacaggcgcaggcatcggcccggccactccaagccttcggtgcgcgggcgcgtctgggatacgggcccgggaggcgccgccctccgtccgcccggtgcctctcaggaacagcgaaccggagagagcgccggagagttgggctcagtgcggagctcggcgccggggcccatgcccgtgcgcccccgcaggccggcgccatggcctccgggagtgtggccgagtgcctgcagcaggagaccacctgccccgtgtgcctgcagtacttcgcagagcccatgatgctcgactgcggccataacatctgttgcgcgtgcctcgcccgctgctggggcacggcagagactaacgtgtcgtgcccgcagtgccgggagaccttcccgcagaggcacatgcggcccaaccggcacctggccaacgtgacccaactggtaaagcagctgcgcaccgagcggccgtcggggcccggcggcgagatgggcgtgtgcgagaagcaccgcgagcccctgaagctgtactgcgaggaggaccagatgcccatctgcgtggtgtgcgaccgctcccgcgagcaccgcggccacagcgtgctgccgctcgaggaggcggtggagggcttcaaggagcaaatccagaaccagctcgaccatttaaaaagagtgaaagatttaaagaagagacgtcgggcccagggggaacaggcacgagctgaactcttgagcctaacccagatggagagggagaagattgtttgggagtttgagcagctgtatcactccttaaaggagcatgagtatcgcctcctggcccgccttgaggagctagacttggccatctacaatagcatcaatggtgccatcacccagttctcttgcaacatctcccacctcagcagcctgatcgctcagctagaagagaagcagcagcagcccaccagggagctcctgcag

SEQ ID NO: 32560 - DNA, 2901 bp, Homo sapiens
cctgggactctgaccctcggctaccctttcctgccccactagcgtggccgcgagcctcggtgagccggccgtattcccgctctcgcttagggggcacaggcgcaggcatcggcccggccactccaagccttcggtgcgcgggcgcgtctgggatacgggcccgggaggcgccgccctccgtccgcccggtgcctctcaggaacagcgaaccggagagagcgccggagagttgggctcagtgcggagctcggcgccggggcccatgcccgtgcgcccccgcaggccggcgccatggcctccgggagtgtggccgagtgcctgcagcaggagaccacctgccccgtgtgcctgcagtacttcgcagagcccatgatgctcgactgcggccataacatctgttgcgcgtgcctcgcccgctgctggggcacggcagagactaacgtgtcgtgcccgcagtgccgggagaccttcccgcagaggcacatgcggcccaaccggcacctggccaacgtgacccaactggtaaagcagctgcgcaccgagcggccgtcggggcccggcggcgagatgggcgtgtgcgagaagcaccgcgagcccctgaagctgtactgcgaggaggaccagatgcccatctgcgtggtgtgcgaccgctcccgcgagcaccgcggccacagcgtgctgccgctcgaggaggcggtggagggcttcaaggagcaaatccagaaccagctcgaccatttaaaaagagtgaaagatttaaagaagagacgtcgggcccagggggaacaggcacgagctgaactcttgagcctaacccagatggagagggagaagattgtttgggagtttgagcagctgtatcactccttaaaggagcatgagtatcgcctcctggcccgccttgaggagctagacttggccatctacaatagcatcaatggtgccatcacccagttctcttgcaacatctcccacctcagcagcctgatcgctcagctagaagagaagcagcagcagcccaccagggagctcctgcaggacattggggacacattgagcagggctgaaagaatcaggattcctgaaccttggatcacacctccagatttgcaagagaaaatccacatttttgcccaaaaatgtctattcttgacggagagtctaaagcagttcacagaaaaaatgcagtcagatatggagaaaatccaagaattaagagaggctcagttatactcagtggacgtgactctggacccagacacggcctaccccagcctgatcctctctgataatctgcggcaagtgcggtacagttacctccaacaggacctgcctgacaaccccgagaggttcaatctgtttccctgtgtcttgggctctccatgcttcatcgccgggagacattattgggaggtagaggtgggagataaagccaagtggaccataggtgtctgtgaagactcagtgtgcagaaaaggtggagtaacctcagccccccagaatggattctgggcagtgtctttgtggtatgggaaagaatattgggctcttacctccccaatgactgccctacccctgcggaccccgctccagcgggtggggattttcttggactatgatgctggtgaggtctccttctacaacgtgacagagaggtgtcacaccttcactttctctcatgctaccttttgtgggcctgtccggccctacttcagtctgagttactcgggagggaaaagtgcagctcctctgatcatctgccccatgagtgggatagatgggttttctggccatgttgggaatcatggtcattccatggagacctccccttgaggaggtgaattcaggccaaaagggctgttggctgtaatcctacgccaggcacaaggcatcttgttgccttgccacgtcctgtcacagctgggtatccttaccatgttccacgcccttgcagtgggagacaggatgtccatgttctctaccatccttttccttcccatgcagattgtgaaatgtaatgagatgtatcaagatatcctagaaataaaaaccagatgtccacctccagtgtttcatactttctggttttacacatcgctggagggataaagagtatggataatctttggatttggagagccgttcaagatacttccagcttcttggctcagcctggcttcctctggttcagccccacataatgattatggctatttgctgtcatttctgggctagggctcctttctaacaacctagactggaataaggccctgtcagcatggctccctttatcccagttttccgtctgggaacagtacctctgcccctgattcccaatgtgccatagttttattaactccattaaagaagcctgtatgtgttttggttagttacagttattttacaataatggtgggtaatggccccacctctgttatgagataatgttctaatcaatgtctctgcctttgtatcttttctgagggctttgtctgttctcttcattctaatgaaaggtgtattctagtgctgggtgcatatcatccaggataatattctgcccaactccatcctctgttactagatcccttaccagtcacatttgtggactggtggccagtcgtataccatccctggaaggattctgggacaatattccagggattcattgacttcttggctccttttctccatttcctttgggggaagggggaattgaccatgcttaagtgcatcctatcaaggggcagctccgtccccatggccattggatcatgagacactctgaagtcagaaggctggggcagatcacttcaagcaagcccccatgatggttctcagtcctgcttctctgtgggtacgtgcccctctgtttaaaaataaactgaatatggatgttta

SEQ ID NO: 32561 - DNA, 2967 bp, Homo sapiens
gtttacgctgccgccggcatccgctcggacgcggccacgttgtcttgcgcgctttgcccgcctggccctgggactctgaccctcggctaccctttcctgccccactagcgtggccgcgagcctcggtgagccggccgtattcccgctctcgcttagggggcacaggcgcaggcatcggcccggccactccaagccttcggtgcgcgggcgcgtctgggatacgggcccgggaggcgccgccctccgtccgcccggtgcctctcaggaacagcgaaccggagagagcgccggagagttgggctcagtgcagagctcggcgccggggcccatgcccgtgcgcccccgcaggccggcgccatggcctccgggagtgtggccgagtgcctgcagcaggagaccacctgccccgtgtgcctgcagtacttcgcagagcccatgatgctcgactgcggccataacatctgttgcgcgtgcctcgcccgctgctggggcacggcagagactaacgtgtcgtgcccgcagtgccgggagaccttcccgcagaggcacatgcggcccaaccggcacctggccaacgtgacccaactggtgaagcagctgcgcaccgagcggccgtcggggcccggcggcgagatgggcgtgtgcgagaagcaccgcgagcccctgaagctgtactgcgaggaggaccagatgcccatctgcgtggtgtgcgaccgctcccgcgagcaccgcggccacagcgtgctgccgctcgaggaggcggtggagggcttcaaggagcaaatccagaaccagctcgaccatttaaaaagagtgaaagatttaaagaagagacgtcgggcccagggggaacaggcacgagctgaactcttgagcctaacccagatggagagggagaagattgtttgggagtttgagcagctgtatcactccttaaaggagcatgagtatcgcctcctggcccgccttgaggagctagacttggccatctacaatagcatcaatggtgccatcacccagttctcttgcaacatctcccacctcagcagcctgatcgctcagctagaagagaagcagcagcagcccaccagggagctcctgcaggacattggggacacattgagcagggctgaaagaatcaggattcctgaaccttggatcacacctccagatttgcaagagaaaatccacatttttgcccaaaaatgtctattcttgacggagagtctaaagcagttcacagaaaaaatgcagtcagatatggagaaaatccaagaattaagagaggctcagttatactcagtggacgtgactctggacccagacacggcctaccccagcctgatcctctctgataatctgcggcaagtgcggtacagttacctccaacaggacctgcctgacaaccccgagaggttcaatctgtttccctgtgtcttgggctctccatgcttcatcgccgggagacattattgggaggtagaggtgggagataaagccaagtggaccataggtgtctgtgaagactcagtgtgcagaaaaggtggagtaacctcagccccccagaatggattctgggcagtgtctttgtggtatgggaaagaatattgggctcttacctccccaatgactgccctacccctgcggaccccgctccagcgggtggggattttcttggactatgatgctggtgaggtctccttctacaacgtgacagagaggtgtcacaccttcactttctctcatgctaccttttgtgggcctgtccggccctacttcagtctgagttactcgggagggaaaagtgcagctcctctgatcatctgccccatgagtgggatagatgggttttctggccatgttgggaatcatggtcattccatggagacctccccttgaggaggtgaattcaggccaaaagggctgttggctgtaatcctacgccaggcacaaggcatcttgttgccttgccacgtcctgtcacagctgggtatccttaccatgttccacgcccttgcagtgggagacaggatgtccatgttctctaccatccttttccttcccatgcagattgtgaaatgtaatgagatgtatcaagatatcctagaaataaaaaccagatgtccacctccagtgtttcatactttctggttttacacatcgctggagggataaagagtatggataatctttggatttggagagccgttcaagatacttccagcttcttggctcagcctggcttcctctggttcagccccacataatgattatggctatttgctgtcatttctgggctagggctcctttctaacaacctagactggaataaggccctgtcagcatggctccctttatcccagttttccgtctgggaacagtacctctgcccctgattcccaatgtgccatagttttattaactccattaaagaagcctgtatgtgttttggttagttacagttattttacaataatggtgggtaatggccccacctctgttatgagataatgttctaatcaatgtctctgcctttgtatcttttctgagggctttgtctgttctcttcattctaatgaaaggtgtattctagtgctgggtgcatatcatccaggataatattctgcccaactccatcctctgttactagatcccttaccagtcacatttgtggactggtggccagtcgtataccatccctggaaggattctgggacaatattccagggattcattgacttcttggctccttttctccatttcctttgggggaagggggaattgaccatgcttaagtgcatcctatcaaggggcagctccgtccccatggccattggatcatgagacactctgaagtcagaaggctggggcagatcacttcaagcaagcccccatgatggttctcagtcctgcttctctgtgggtacgtgcccctctgtttaaaaataaactgaatatggatgttta

SEQ ID NO: 32562 - DNA, 1103 bp, Homo sapiens
tttacgctgccgccggcatccgctcggacgcggccacgttgtcttgcgcgctttgcccgcctggccctgggactctgaccctcggctaccctttcctgccccactagcgtggccgcgagcctcggtgagccggccgtattcccgctctcgcttagggggcacaggcgcaggcatcggcccggccactccaagccttcggtgcgcgggcgcgtctgggatacgggcccgggaggcgccgccctccgtccgcccggtgcctctcaggaacagcgaaccggagagagcgccggagagttgggctcagtgcagagctcggcgccggggcccatgcccgtgcgcccccgcaggccggcgccatggcctccgggagtgtggccgagtgcctgcagcaggagaccacctgccccgtgtgcctgcagtacttcgcagagcccatgatgctcgactgcggccataacatctgttgcgcgtgcctcgcccgctgctggggcacggcagagactaacgtgtcgtgcccgcagtgccgggagaccttcccgcagaggcacatgcggcccaaccggcacctggccaacgtgacccaactggtaaagcagctgcgcaccgagcggccgtcggggcccggcggcgagatgggcgtgtgcgagaagcaccgcgagcccctgaagctgtactgcgaggaggaccagatgcccatctgcgtggtgtgcgaccgctcccgcgagcaccgcggccacagcgtgctgccgctcgaggaggcggtggagggcttcaaggagcaaatccagaaccagctcgaccatttaaaaagagtgaaagatttaaagaagagacgtcgggcccagggggaacaggcacgagctgaactcttgagcctaacccagatggagagggagaagattgtttgggagtttgagcagctgtatcactccttaaaggagcatgagtatcgcctcctggcccgccttgaggagctagacttggccatctacaatagcatcaatggtgccatcacccagttctcttgcaacatctcccacctcagcagcctgatcgctcagctagaagagaagcagcagcagcccaccagggagctcctgcag

SEQ ID NO: 32563 - DNA, 2967 bp, Homo sapiens; identical to SEQ ID NO: 32551

SEQ ID NO: 32564 - DNA, 1812 bp, Homo sapiens
ctaaagcagttcacagaaaaaatgcagtcagatatggagaaaatccaagaatcagctgactcactggaaggtggaattcttgatcttggctcagttttatcccatattctaccagtctcagaattaagagaggctcagttatactcagtggacgtgactctggacccagacacggcctaccccagcctgatcctctctgataatctgcggcaagtgcggtacagttacctccaacaggacctgcctgacaaccccgagaggttcaatctgtttccctgtgtcttgggctctccatgcttcatcgccgggagacattattgggaggtagaggtgggagataaagccaagtggaccataggtgtctgtgaagactcagtgtgcagaaaaggtggagtaacctcagccccccagaatggattctgggcagtgtctttgtggtatgggaaagaatattgggctcttacctccccaatgactgccctacccctgcggaccccgctccagcgggtggggattttcttggactatgatgctggtgaggtctccttctacaacgtgacagagaggtgtcacaccttcactttctctcatgctaccttttgtgggcctgtccggccctacttcagtctgagttactcgggagggaaaagtgcagctcctctgatcatctgccccatgagtgggatagatgggttttctggccatgttgggaatcatggtcattccatggagacctccccttgaggaggtgaattcaggccaaaagggctgttggctgtaatcctacgccaggcacaaggcatcttgttgccttgccacgtcctgtcacagctgggtatccttaccatgttccacgcccttgcagtgggagacaggatgtccatgttctctaccatccttttccttcccatgcagattgtgaaatgtaatgagatgtatcaagatatcctagaaataaaaaccagatgtccacctccagtgtttcatactttctggttttacacatcgctggagggataaagagtatggataatctttggatttggagagccgttcaagatacttccagcttcttggctcagcctggcttcctctggttcagccccacataatgattatggctatttgctgtcatttctgggctagggctcctttctaacaacctagactggaataaggccctgtcagcatggctccctttatcccagttttccgtctgggaacagtacctctgcccctgattcccaatgtgccatagttttattaactccattaaagaagcctgtatgtgttttggttagttacagttattttacaataatggtgggtaatggccccacctctgttatgagataatgttctaatcaatgtctctgcctttgtatcttttctgagggctttgtctgttctcttcattctaatgaaaggtgtattctagtgctgggtgcatatcatccaggataatattctgcccaactccatcctctgttactagatcccttaccagtcacatttgtggactggtggccagtcgtataccatccctggaaggattctgggacaatattccagggattcattgacttcttggctccttttctccatttcctttgggggaagggggaattgaccatgcttaagtgcatcctatcaaggggcagctccgtccccatggccattggatcatgagacactctgaagtcagaaggctggggcagatcacttcaagcaagcccccatgatggttctcagtcctgcttctctgtgggtacgtgcccctctgtttaaaaataaactgaatatggatgttta

SEQ ID NO: 32565 - DNA, 1104 bp, Homo sapiens
gtttacgctgccgccggcatccgctcggacgcggccacgttgtcttgcgcgctttgcccgcctggccctgggactctgaccctcggctaccctttcctgccccactagcgtggccgcgagcctcggtgagccggccgtattcccgctctcgcttagggggcacaggcgcaggcatcggcccggccactccaagccttcggtgcgcgggcgcgtctgggatacgggcccgggaggcgccgccctccgtccgcccggtgcctctcaggaacagcgaaccggagagagcgccggagagttgggctcagtgcagagctcggcgccggggcccatgcccgtgcgcccccgcaggccggcgccatggcctccgggagtgtggccgagtgcctgcagcaggagaccacctgccccgtgtgcctgcagtacttcgcagagcccatgatgctcgactgcggccataacatctgttgcgcgtgcctcgcccgctgctggggcacggcagagactaacgtgtcgtgcccgcagtgccgggagaccttcccgcagaggcacatgcggcccaaccggcacctggccaacgtgacccaactggtaaagcagctgcgcaccgagcggccgtcggggcccggcggcgagatgggcgtgtgcgagaagcaccgcgagcccctgaagctgtactgcgaggaggaccagatgcccatctgcgtggtgtgcgaccgctcccgcgagcaccgcggccacagcgtgctgccgctcgaggaggcggtggagggcttcaaggagcaaatccagaaccagctcgaccatttaaaaagagtgaaagatttaaagaagagacgtcgggcccagggggaacaggcacgagctgaactcttgagcctaacccagatggagagggagaagattgtttgggagtttgagcagctgtatcactccttaaaggagcatgagtatcgcctcctggcccgccttgaggagctagacttggccatctacaatagcatcaatggtgccatcacccagttctcttgcaacatctcccacctcagcagcctgatcgctcagctagaagagaagcagcagcagcccaccagggagctcctgcag

SEQ ID NO: 32566 - DNA, 1411 bp, Homo sapiens
aattaagagaggctcagttatactcagtggacgtgactctggacccagacacggcctaccccagcctgatcctctctgataatctgcggcaagtgcggtacagttacctccaacaggacctgcctgacaaccccgagaggtctccttctacaacgtgacagagaggtgtcacaccttcactttctctcatgctaccttttgtgggcctgtccggccctacttcagtctgagttactcgggagggaaaagtgcagctcctctgatcatctgccccatgagtgggatagatgggttttctggccatgttgggaatcatggtcattccatggagacctccccttgaggaggtgaattcaggccaaaagggctgttggctgtaatcctacgccaggcacaaggcatcttgttgccttgccacgtcctgtcacagctgggtatccttaccatgttccacgcccttgcagtgggagacaggatgtccatgttctctaccatccttttccttcccatgcagattgtgaaatgtaatgagatgtatcaagatatcctagaaataaaaaccagatgtccacctccagtgtttcatactttctggttttacacatcgctggagggataaagagtatggataatctttggatttggagagccgttcaagatacttccagcttcttggctcagcctggcttcctctggttcagccccacataatgattatggctatttgctgtcatttctgggctagggctcctttctaacaacctagactggaataaggccctgtcagcatggctccctttatcccagttttccgtctgggaacagtacctctgcccctgattcccaatgtgccatagttttattaactccattaaagaagcctgtatgtgttttggttagttacagttattttacaataatggtgggtaatggccccacctctgttatgagataatgttctaatcaatgtctctgcctttgtatcttttctgagggctttgtctgttctcttcattctaatgaaaggtgtattctagtgctgggtgcatatcatccaggataatattctgcccaactccatcctctgttactagatcccttaccagtcacatttgtggactggtggccagtcgtataccatccctggaaggattctgggacaatattccagggattcattgacttcttggctccttttctccatttcctttgggggaagggggaattgaccatgcttaagtgcatcctatcaaggggcagctccgtccccatggccattggatcatgagacactctgaagtcagaaggctggggcagatcacttcaagcaagcccccatgatggttctcagtcctgcttctctgtgggtacgtgcccctctgtttaaaaataaactgaatatggatgttta

SEQ ID NO: 32567 - DNA, 1763 bp, Homo sapiens
aatcagctgactcactggaaggtggaattcttgatcttggctcagttttatcccatattctaccagtctcagaattaagagaggctcagttatactcagtggacgtgactctggacccagacacggcctaccccagcctgatcctctctgataatctgcggcaagtgcggtacagttacctccaacaggacctgcctgacaaccccgagaggttcaatctgtttccctgtgtcttgggctctccatgcttcatcgccgggagacattattgggaggtagaggtgggagataaagccaagtggaccataggtgtctgtgaagactcagtgtgcagaaaaggtggagtaacctcagccccccagaatggattctgggcagtgtctttgtggtatgggaaagaatattgggctcttacctccccaatgactgccctacccctgcggaccccgctccagcgggtggggattttcttggactatgatgctggtgaggtctccttctacaacgtgacagagaggtgtcacaccttcactttctctcatgctaccttttgtgggcctgtccggccctacttcagtctgagttactcgggagggaaaagtgcagctcctctgatcatctgccccatgagtgggatagatgggttttctggccatgttgggaatcatggtcattccatggagacctccccttgaggaggtgaattcaggccaaaagggctgttggctgtaatcctacgccaggcacaaggcatcttgttgccttgccacgtcctgtcacagctgggtatccttaccatgttccacgcccttgcagtgggagacaggatgtccatgttctctaccatccttttccttcccatgcagattgtgaaatgtaatgagatgtatcaagatatcctagaaataaaaaccagatgtccacctccagtgtttcatactttctggttttacacatcgctggagggataaagagtatggataatctttggatttggagagccgttcaagatacttccagcttcttggctcagcctggcttcctctggttcagccccacataatgattatggctatttgctgtcatttctgggctagggctcctttctaacaacctagactggaataaggccctgtcagcatggctccctttatcccagttttccgtctgggaacagtacctctgcccctgattcccaatgtgccatagttttattaactccattaaagaagcctgtatgtgttttggttagttacagttattttacaataatggtgggtaatggccccacctctgttatgagataatgttctaatcaatgtctctgcctttgtatcttttctgagggctttgtctgttctcttcattctaatgaaaggtgtattctagtgctgggtgcatatcatccaggataatattctgcccaactccatcctctgttactagatcccttaccagtcacatttgtggactggtggccagtcgtataccatccctggaaggattctgggacaatattccagggattcattgacttcttggctccttttctccatttcctttgggggaagggggaattgaccatgcttaagtgcatcctatcaaggggcagctccgtccccatggccattggatcatgagacactctgaagtcagaaggctggggcagatcacttcaagcaagcccccatgatggttctcagtcctgcttctctgtgggtacgtgcccctctgtttaaaaataaactgaatatggatgttta

SEQ ID NO: 32568 - DNA, 1691 bp, Homo sapiens
aattaagagaggctcagttatactcagtggacgtgactctggacccagacacggcctaccccagcctgatcctctctgataatctgcggcaagtgcggtacagttacctccaacaggacctgcctgacaaccccgagaggttcaatctgtttccctgtgtcttgggctctccatgcttcatcgccgggagacattattgggaggtagaggtgggagataaagccaagtggaccataggtgtctgtgaagactcagtgtgcagaaaaggtggagtaacctcagccccccagaatggattctgggcagtgtctttgtggtatgggaaagaatattgggctcttacctccccaatgactgccctacccctgcggaccccgctccagcgggtggggattttcttggactatgatgctggtgaggtctccttctacaacgtgacagagaggtgtcacaccttcactttctctcatgctaccttttgtgggcctgtccggccctacttcagtctgagttactcgggagggaaaagtgcagctcctctgatcatctgccccatgagtgggatagatgggttttctggccatgttgggaatcatggtcattccatggagacctccccttgaggaggtgaattcaggccaaaagggctgttggctgtaatcctacgccaggcacaaggcatcttgttgccttgccacgtcctgtcacagctgggtatccttaccatgttccacgcccttgcagtgggagacaggatgtccatgttctctaccatccttttccttcccatgcagattgtgaaatgtaatgagatgtatcaagatatcctagaaataaaaaccagatgtccacctccagtgtttcatactttctggttttacacatcgctggagggataaagagtatggataatctttggatttggagagccgttcaagatacttccagcttcttggctcagcctggcttcctctggttcagccccacataatgattatggctatttgctgtcatttctgggctagggctcctttctaacaacctagactggaataaggccctgtcagcatggctccctttatcccagttttccgtctgggaacagtacctctgcccctgattcccaatgtgccatagttttattaactccattaaagaagcctgtatgtgttttggttagttacagttattttacaataatggtgggtaatggccccacctctgttatgagataatgttctaatcaatgtctctgcctttgtatcttttctgagggctttgtctgttctcttcattctaatgaaaggtgtattctagtgctgggtgcatatcatccaggataatattctgcccaactccatcctctgttactagatcccttaccagtcacatttgtggactggtggccagtcgtataccatccctggaaggattctgggacaatattccagggattcattgacttcttggctccttttctccatttcctttgggggaagggggaattgaccatgcttaagtgcatcctatcaaggggcagctccgtccccatggccattggatcatgagacactctgaagtcagaaggctggggcagatcacttcaagcaagcccccatgatggttctcagtcctgcttctctgtgggtacgtgcccctctgtttaaaaataaactgaatatggatgttta

SEQ ID NO: 32569 - DNA, 2686 bp, Homo sapiens
tttacgctgccgccggcatccgctcggacgcggccacgttgtcttgcgcgctttgcccgcctggccctgggactctgaccctcggctaccctttcctgccccactagcgtggccgcgagcctcggtgagccggccgtattcccgctctcgcttagggggcacaggcgcaggcatcggcccggccactccaagccttcggtgcgcgggcgcgtctgggatacgggcccgggaggcgccgccctccgtccgcccggtgcctctcaggaacagcgaaccggagagagcgccggagagttgggctcagtgcggagctcggcgccggggcccatgcccgtgcgcccccgcaggccggcgccatggcctccgggagtgtggccgagtgcctgcagcaggagaccacctgccccgtgtgcctgcagtacttcgcagagcccatgatgctcgactgcggccataacatctgttgcgcgtgcctcgcccgctgctggggcacggcagagactaacgtgtcgtgcccgcagtgccgggagaccttcccgcagaggcacatgcggcccaaccggcacctggccaacgtgacccaactggtaaagcagctgcgcaccgagcggccgtcggggcccggcggcgagatgggcgtgtgcgagaagcaccgcgagcccctgaagctgtactgcgaggaggaccagatgcccatctgcgtggtgtgcgaccgctcccgcgagcaccgcggccacagcgtgctgccgctcgaggaggcggtggagggcttcaaggagcaaatccagaaccagctcgaccatttaaaaagagtgaaagatttaaagaagagacgtcgggcccagggggaacaggcacgagctgaactcttgagcctaacccagatggagagggagaagattgtttgggagtttgagcagctgtatcactccttaaaggagcatgagtatcgcctcctggcccgccttgaggagctagacttggccatctacaatagcatcaatggtgccatcacccagttctcttgcaacatctcccacctcagcagcctgatcgctcagctagaagagaagcagcagcagcccaccagggagctcctgcaggacattggggacacattgagcagggctgaaagaatcaggattcctgaaccttggatcacacctccagatttgcaagagaaaatccacatttttgcccaaaaatgtctattcttgacggagagtctaaagcagttcacagaaaaaatgcagtcagatatggagaaaatccaagaattaagagaggctcagttatactcagtggacgtgactctggacccagacacggcctaccccagcctgatcctctctgataatctgcggcaagtgcggtacagttacctccaacaggacctgcctgacaaccccgagaggtctccttctacaacgtgacagagaggtgtcacaccttcactttctctcatgctaccttttgtgggcctgtccggccctacttcagtctgagttactcgggagggaaaagtgcagctcctctgatcatctgccccatgagtgggatagatgggttttctggccatgttgggaatcatggtcattccatggagacctccccttgaggaggtgaattcaggccaaaagggctgttggctgtaatcctacgccaggcacaaggcatcttgttgccttgccacgtcctgtcacagctgggtatccttaccatgttccacgcccttgcagtgggagacaggatgtccatgttctctaccatccttttccttcccatgcagattgtgaaatgtaatgagatgtatcaagatatcctagaaataaaaaccagatgtccacctccagtgtttcatactttctggttttacacatcgctggagggataaagagtatggataatctttggatttggagagccgttcaagatacttccagcttcttggctcagcctggcttcctctggttcagccccacataatgattatggctatttgctgtcatttctgggctagggctcctttctaacaacctagactggaataaggccctgtcagcatggctccctttatcccagttttccgtctgggaacagtacctctgcccctgattcccaatgtgccatagttttattaactccattaaagaagcctgtatgtgttttggttagttacagttattttacaataatggtgggtaatggccccacctctgttatgagataatgttctaatcaatgtctctgcctttgtatcttttctgagggctttgtctgttctcttcattctaatgaaaggtgtattctagtgctgggtgcatatcatccaggataatattctgcccaactccatcctctgttactagatcccttaccagtcacatttgtggactggtggccagtcgtataccatccctggaaggattctgggacaatattccagggattcattgacttcttggctccttttctccatttcctttgggggaagggggaattgaccatgcttaagtgcatcctatcaaggggcagctccgtccccatggccattggatcatgagacactctgaagtcagaaggctggggcagatcacttcaagcaagcccccatgatggttctcagtcctgcttctctgtgggtacgtgcccctctgtttaaaaataaactgaatatggatgttta

SEQ ID NO: 32570 - DNA, 1813 bp, Homo sapiens; identical to SEQ ID NO: 32554

SEQ ID NO: 32571 - DNA, 1104 bp, Homo sapiens
gtttacgctgccgccggcatccgctcggacgcggccacgttgtcttgcgcgctttgcccgcctggccctgggactctgaccctcggctaccctttcctgccccactagcgtggccgcgagcctcggtgagccggccgtattcccgctctcgcttagggggcacaggcgcaggcatcggcccggccactccaagccttcggtgcgcgggcgcgtctgggatacgggcccgggaggcgccgccctccgtccgcccggtgcctctcaggaacagcgaaccggagagagcgccggagagttgggctcagtgcggagctcggcgccggggcccatgcccgtgcgcccccgcaggccggcgccatggcctccgggagtgtggccgagtgcctgcagcaggagaccacctgccccgtgtgcctgcagtacttcgcagagcccatgatgctcgactgcggccataacatctgttgcgcgtgcctcgcccgctgctggggcacggcagagactaacgtgtcgtgcccgcagtgccgggagaccttcccgcagaggcacatgcggcccaaccggcacctggccaacgtgacccaactggtaaagcagctgcgcaccgagcggccgtcggggcccggcggcgagatgggcgtgtgcgagaagcaccgcgagcccctgaagctgtactgcgaggaggaccagatgcccatctgcgtggtgtgcgaccgctcccgcgagcaccgcggccacagcgtgctgccgctcgaggaggcggtggagggcttcaaggagcaaatccagaaccagctcgaccatttaaaaagagtgaaagatttaaagaagagacgtcgggcccagggggaacaggcacgagctgaactcttgagcctaacccagatggagagggagaagattgtttgggagtttgagcagctgtatcactccttaaaggagcatgagtatcgcctcctggcccgccttgaggagctagacttggccatctacaatagcatcaatggtgccatcacccagttctcttgcaacatctcccacctcagcagcctgatcgctcagctagaagagaagcagcagcagcccaccagggagctcctgcag

SEQ ID NO: 32572 - DNA, 2844 bp, Homo sapiens
cccccggccggtccgcagccccgccccggcccctccctccggcctgtgcggctagtccggcggcggcgccggcgcggggacaggcggaggcgcgggcagggccgggcggacgggcgctggcagcagtagcagcgccgcgggcccttcagagtggccgcagtccgagctttgccctcgcatcctgttccaacgcgaggctggtgtgagtggcgggagccatctgtgggcgccatggcaaagagggaggacagccctggcccagaggtccagccaatggacaagcagttcctggtatgcagcatctgcctggatcggtaccagtgccccaaggttcttccttgcctgcacaccttctgtgagagatgtctccaaaactatatccctgcccagagcctgacgctatcctgtccagtatgccggcagacgtccatcctcccagagcagggcgtctcggcactgcagaacaacttcttcatcagcagcctcatggaggcaatgcagcaggcacctgatggggcccacgacccggaggacccccaccccctcagtgtagtggctggccgccctctctcctgccccaaccatgaaggcaagacgatggagttttactgtgaggcctgtgagacggccatgtgtggtgagtgccgcgccggggagcatcgtgagcagcacaaggcggccctgcagcgccagctcgaggctgtgcgtggccgattgccacagctgtccgcagcaattgccttagtcgggggcatcagccagcagctgcaggagcgcaaggcagaggccctggcccagatcagtgcagcgttcgaggacctggagcaagcactgcagcagcgcaagcaggctctggtcagcgacctggagaccatttgtggggccaaacagaaggtgttgcaaagccagctggacacactgcgccagggtcaggaacacatcggcagtagctgcagctttgcagagcaggcactgcgcctgggctcggccccggaggtgttgctggtgcgcaagcacatgcgagagcggctggctgcattggcggcacaggccttcccggagcggccacatgagaatgcacagctggaactggtccttgaggtggacggtctgcggcgatcggtgctcaatctgggcgcactgctcaccacgagcgccactgcacacgaaacggtggccacgggagagggcctgcgccaggcgctagtgggccagcctgcctcgctcactgtcactaccaaagacaaggacgggcggttggtgcgcacaggcagcgctgagctgcgtgcagagatcaccggcccggacggcacgcgccttccggtgccagtggtggaccacaagaatggcacatatgagctagtgtacacagcgcgcacggaaggcgagctgctcctctcggtgctgctctacggacagccagtgcgcggcagccccttccgcgtgcgtgccctgcgtccgggggacctgccaccttccccggacgatgtgaagcgccgtgtcaagtcccctggcggccccggcagccatgtgcgccagaaggcagtgcgtaggcccagctccatgtacagcacaggcggcaaacgaaaggacaacccaattgaggatgagctcgtcttccgtgttggcagtcgtggaagggagaaaggtgaattcaccaatttacaaggtgtgtccgcagccagcagcggccgcatcgtggtagcagacagcaacaaccagtgtattcaggttttctccaatgagggccagttcaagttccgttttggggtccgaggacgctcacctgggcagctgcagcgccccacaggtgtggcagtggacaccaatggagacataattgtggcagactatgacaaccgttgggtcagcatcttctcccctgagggcaagttcaagaccaagattggagctggccgcctcatgggccccaagggagtggccgtagaccggaatggacatatcattgtggtcgacaacaagtcttgctgcgtctttaccttccagcccaatggcaaactggttggccgttttgggggccgtggggccactgaccgccactttgcagggccccattttgtggctgtgaacaacaagaatgaaattgtagtaacggacttccataaccattcagtgaaggtgtacagtgccgatggagagttcctcttcaagtttggctcccatggcgagggcaatgggcagttcaatgcccccacaggagtagctgtggactccaatggaaacatcattgtggctgactggggcaacagccgcatccaggtattcgacagctctggctccttcctgtcctatatcaacacatctgcagaaccactgtatggtccacagggcctggcactgacctcggatggccatgtggtggtggctgatgctggcaaccactgctttaaagcctatcgctacctccagtagctgtacagaggccctgcctggcttgtggagggacagacattggggtgattggacaagagggtctggctgggaggtgggccagacctggcagcactgaatgtgggctgtgggcatgggtgcacccggtgccctccctctcctacccccacccccacggttgcactttatttattcggttcttgctttggtgactgggtgagcctggactgtggtcccaaggatgtgtgcagagcttcaccctacccttcttacacacctccccacccctgtcagtctgctccccatcccccagcctggggccagaacagcctaccccaggacaggagtccctctagttgtctccctaccaccctatacacactgacagagacagcaataccccaccccccatattaaataaatgtcttcacc

SEQ ID NO: 32573 - DNA, 2879 bp, Homo sapiens
cccccggccggtccgcagccccgccccggcccctccctccggcctgtgcggctagtccggcggcggcgccggcgcggggacaggcggaggcgcgggcagggccgggcggacgggcgctggcagcagtagcagcgccgcgggcccttcagagtggccgcagtccgagctttgccctcgcatcctgttccaacgcgaggctggtgtgagtggcgggagccatctgtgggcgccatggcaaagagggaggacagccctggcccagaggtccagccaatggacaagcagttcctggtatgcagcatctgcctggatcggtaccagtgccccaaggttcttccttgcctgcacaccttctgtgagagatgtctccaaaactatatccctgcccagagcctgacgctatcctgtccagtatgccggcagacgtccatcctcccagagcagggcgtctcggcactgcagaacaacttcttcatcagcagcctcatggaggcaatgcagcaggcacctgatggggcccacgacccggaggacccccaccccctcagtgtagtggctggccgccctctctcctgccccaaccatgaaggcaagacgatggagttttactgtgaggcctgtgagacggccatgtgtggtgagtgccgcgccggggagcatcgtgagcatggcacagtgctgctgagggatgtggtggagcagcacaaggcggccctgcagcgccagctcgaggctgtgcgtggccgattgccacagctgtccgcagcaattgccttagtcgggggcatcagccagcagctgcaggagcgcaaggcagaggccctggcccagatcagtgcagcgttcgaggacctggagcaagcactgcagcagcgcaagcaggctctggtcagcgacctggagaccatttgtggggccaaacagaaggtgttgcaaagccagctggacacactgcgccagggtcaggaacacatcggcagtagctgcagctttgcagagcaggcactgcgcctgggctcggccccggaggtgttgctggtgcgcaagcacatgcgagagcggctggctgcattggcggcacaggccttcccggagcggccacatgagaatgcacagctggaactggtccttgaggtggacggtctgcggcgatcggtgctcaatctgggcgcactgctcaccacgagcgccactgcacacgaaacggtggccacgggagagggcctgcgccaggcgctagtgggccagcctgcctcgctcactgtcactaccaaagacaaggacgggcggttggtgcgcacaggcagcgctgagctgcgtgcagagatcaccggcccggacggcacgcgccttccggtgccagtggtggaccacaagaatggcacatatgagctagtgtacacagcgcgcacggaaggcgagctgctcctctcggtgctgctctacggacagccagtgcgcggcagccccttccgcgtgcgtgccctgcgtccgggggacctgccaccttccccggacgatgtgaagcgccgtgtcaagtcccctggcggccccggcagccatgtgcgccagaaggcagtgcgtaggcccagctccatgtacagcacaggcggcaaacgaaaggacaacccaattgaggatgagctcgtcttccgtgttggcagtcgtggaagggagaaaggtgaattcaccaatttacaaggtgtgtccgcagccagcagcggccgcatcgtggtagcagacagcaacaaccagtgtattcaggttttctccaatgagggccagttcaagttccgttttggggtccgaggacgctcacctgggcagctgcagcgccccacaggtgtggcagtggacaccaatggagacataattgtggcagactatgacaaccgttgggtcagcatcttctcccctgagggcaagttcaagaccaagattggagctggccgcctcatgggccccaagggagtggccgtagaccggaatggacatatcattgtggtcgacaacaagtcttgctgcgtctttaccttccagcccaatggcaaactggttggccgttttgggggccgtggggccactgaccgccactttgcagggccccattttgtggctgtgaacaacaagaatgaaattgtagtaacggacttccataaccattcagtgaaggtgtacagtgccgatggagagttcctcttcaagtttggctcccatggcgagggcaatgggcagttcaatgcccccacaggagtagctgtggactccaatggaaacatcattgtggctgactggggcaacagccgcatccaggtattcgacagctctggctccttcctgtcctatatcaacacatctgcagaaccactgtatggtccacagggcctggcactgacctcggatggccatgtggtggtggctgatgctggcaaccactgctttaaagcctatcgctacctccagtagctgtacagaggccctgcctggcttgtggagggacagacattggggtgattggacaagagggtctggctgggaggtgggccagacctggcagcactgaatgtgggctgtgggcatgggtgcacccggtgccctccctctcctacccccacccccacggttgcactttatttattcggttcttgctttggtgactgggtgagcctggactgtggtcccaaggatgtgtgcagagcttcaccctacccttcttacacacctccccacccctgtcagtctgctccccatcccccagcctggggccagaacagcctaccccaggacaggagtccctctagttgtctccctaccaccctatacacactgacagagacagcaataccccaccccccatattaaataaatgtcttcaccaa

SEQ ID NO: 32574 - DNA, 3033 bp, Homo sapiens
ggtccgcagccccgccccggcccctccctccggcctgtgcggctagtccggcggcggcgccggcgcggggacaggcggaggcgcgggcagggccgggcggacgggcgctggcagcagtagcagcgccgcgggcccttcagagtggccgcagtccgagctttgccctcgcatcctgttccaacgcggaaaggacccctctggttctcctgtagcctgagccctgcctggaggaccccaggcccctccctggttctgacctcctcccttctgcaattggcttcagatcctgggctgcaaacctgcagggacagatggttgcaggttggaggggcaggctgcaccccagggagaggctggtgtgagtggcgggagccatctgtgggcgccatggcaaagagggaggacagccctggcccagaggtccagccaatggacaagcagttcctggtatgcagcatctgcctggatcggtaccagtgccccaaggttcttccttgcctgcacaccttctgtgagagatgtctccaaaactatatccctgcccagagcctgacgctatcctgtccagtatgccggcagacgtccatcctcccagagcagggcgtctcggcactgcagaacaacttcttcatcagcagcctcatggaggcaatgcagcaggcacctgatggggcccacgacccggaggacccccaccccctcagtgtagtggctggccgccctctctcctgccccaaccatgaaggcaagacgatggagttttactgtgaggcctgtgagacggccatgtgtggtgagtgccgcgccggggagcatcgtgagcatggcacagtgctgctgagggatgtggtggagcagcacaaggcggccctgcagcgccagctcgaggctgtgcgtggccgattgccacagctgtccgcagcaattgccttagtcgggggcatcagccagcagctgcaggagcgcaaggcagaggccctggcccagatcagtgcagcgttcgaggacctggagcaagcactgcagcagcgcaagcaggctctggtcagcgacctggagaccatttgtggggccaaacagaaggtgttgcaaagccagctggacacactgcgccagggtcaggaacacatcggcagtagctgcagctttgcagagcaggcactgcgcctgggctcggccccggaggtgttgctggtgcgcaagcacatgcgagagcggctggctgcattggcggcacaggccttcccggagcggccacatgagaatgcacagctggaactggtccttgaggtggacggtctgcggcgatcggtgctcaatctgggcgcactgctcaccacgagcgccactgcacacgaaacggtggccacgggagagggcctgcgccaggcgctagtgggccagcctgcctcgctcactgtcactaccaaagacaaggacgggcggttggtgcgcacaggcagcgctgagctgcgtgcagagatcaccggcccggacggcacgcgccttccggtgccagtggtggaccacaagaatggcacatatgagctagtgtacacagcgcgcacggaaggcgagctgctcctctcggtgctgctctacggacagccagtgcgcggcagccccttccgcgtgcgtgccctgcgtccgggggacctgccaccttccccggacgatgtgaagcgccgtgtcaagtcccctggcggccccggcagccatgtgcgccagaaggcagtgcgtaggcccagctccatgtacagcacaggcggcaaacgaaaggacaacccaattgaggatgagctcgtcttccgtgttggcagtcgtggaagggagaaaggtgaattcaccaatttacaaggtgtgtccgcagccagcagcggccgcatcgtggtagcagacagcaacaaccagtgtattcaggttttctccaatgagggccagttcaagttccgttttggggtccgaggacgctcacctgggcagctgcagcgccccacaggtgtggcagtggacaccaatggagacataattgtggcagactatgacaaccgttgggtcagcatcttctcccctgagggcaagttcaagaccaagattggagctggccgcctcatgggccccaagggagtggccgtagaccggaatggacatatcattgtggtcgacaacaagtcttgctgcgtctttaccttccagcccaatggcaaactggttggccgttttgggggccgtggggccactgaccgccactttgcagggccccattttgtggctgtgaacaacaagaatgaaattgtagtaacggacttccataaccattcagtgaaggtgtacagtgccgatggagagttcctcttcaagtttggctcccatggcgagggcaatgggcagttcaatgcccccacaggagtagctgtggactccaatggaaacatcattgtggctgactggggcaacagccgcatccaggtattcgacagctctggctccttcctgtcctatatcaacacatctgcagaaccactgtatggtccacagggcctggcactgacctcggatggccatgtggtggtggctgatgctggcaaccactgctttaaagcctatcgctacctccagtagctgtacagaggccctgcctggcttgtggagggacagacattggggtgattggacaagagggtctggctgggaggtgggccagacctggcagcactgaatgtgggctgtgggcatgggtgcacccggtgccctccctctcctacccccacccccacggttgcactttatttattcggttcttgctttggtgactgggtgagcctggactgtggtcccaaggatgtgtgcagagcttcaccctacccttcttacacacctccccacccctgtcagtctgctccccatcccccagcctggggccagaacagcctaccccaggacaggagtccctctagttgtctccctaccaccctatacacactgacagagacagcaataccccaccccccatattaaataaatgtcttcacc

SEQ ID NO: 32575 - DNA, 3044 bp, Homo sapiens
ccttctcccagagttctgggtactgcccttctgccgcccagagatcgtgctgaggtacagacggtttctacgtcttcctggtcagccgatagactagcatattccataggagcactccaaggaagccggaaagggcgcctccaggaggcaggcggcccagacaggctcccagagtccgaaatccctgctgccccagctgccttttcttgacggagtctcatctcaatccctgagaccgactacaccgcccttcccggagccggaggcagctggcggagatccgggatccgagatccgggatccggctcgccggcccgccggctccctagcagcaccaaggaggcagcgtccgcaggagaggctggtgtgagtggcgggagccatctgtgggcgccatggcaaagagggaggacagccctggcccagaggtccagccaatggacaagcagttcctggtatgcagcatctgcctggatcggtaccagtgccccaaggttcttccttgcctgcacaccttctgtgagagatgtctccaaaactatatccctgcccagagcctgacgctatcctgtccagtatgccggcagacgtccatcctcccagagcagggcgtctcggcactgcagaacaacttcttcatcagcagcctcatggaggcaatgcagcaggcacctgatggggcccacgacccggaggacccccaccccctcagtgtagtggctggccgccctctctcctgccccaaccatgaaggcaagacgatggagttttactgtgaggcctgtgagacggccatgtgtggtgagtgccgcgccggggagcatcgtgagcatggcacagtgctgctgagggatgtggtggagcagcacaaggcggccctgcagcgccagctcgaggctgtgcgtggccgattgccacagctgtccgcagcaattgccttagtcgggggcatcagccagcagctgcaggagcgcaaggcagaggccctggcccagatcagtgcagcgttcgaggacctggagcaagcactgcagcagcgcaagcaggctctggtcagcgacctggagaccatttgtggggccaaacagaaggtgttgcaaagccagctggacacactgcgccagggtcaggaacacatcggcagtagctgcagctttgcagagcaggcactgcgcctgggctcggccccggaggtgttgctggtgcgcaagcacatgcgagagcggctggctgcattggcggcacaggccttcccggagcggccacatgagaatgcacagctggaactggtccttgaggtggacggtctgcggcgatcggtgctcaatctgggcgcactgctcaccacgagcgccactgcacacgaaacggtggccacgggagagggcctgcgccaggcgctagtgggccagcctgcctcgctcactgtcactaccaaagacaaggacgggcggttggtgcgcacaggcagcgctgagctgcgtgcagagatcaccggcccggacggcacgcgccttccggtgccagtggtggaccacaagaatggcacatatgagctagtgtacacagcgcgcacggaaggcgagctgctcctctcggtgctgctctacggacagccagtgcgcggcagccccttccgcgtgcgtgccctgcgtccgggggacctgccaccttccccggacgatgtgaagcgccgtgtcaagtcccctggcggccccggcagccatgtgcgccagaaggcagtgcgtaggcccagctccatgtacagcacaggcggcaaacgaaaggacaacccaattgaggatgagctcgtcttccgtgttggcagtcgtggaagggagaaaggtgaattcaccaatttacaaggtgtgtccgcagccagcagcggccgcatcgtggtagcagacagcaacaaccagtgtattcaggttttctccaatgagggccagttcaagttccgttttggggtccgaggacgctcacctgggcagctgcagcgccccacaggtgtggcagtggacaccaatggagacataattgtggcagactatgacaaccgttgggtcagcatcttctcccctgagggcaagttcaagaccaagattggagctggccgcctcatgggccccaagggagtggccgtagaccggaatggacatatcattgtggtcgacaacaagtcttgctgcgtctttaccttccagcccaatggcaaactggttggccgttttgggggccgtggggccactgaccgccactttgcagggccccattttgtggctgtgaacaacaagaatgaaattgtagtaacggacttccataaccattcagtgaaggtgtacagtgccgatggagagttcctcttcaagtttggctcccatggcgagggcaatgggcagttcaatgcccccacaggagtagctgtggactccaatggaaacatcattgtggctgactggggcaacagccgcatccaggtattcgacagctctggctccttcctgtcctatatcaacacatctgcagaaccactgtatggtccacagggcctggcactgacctcggatggccatgtggtggtggctgatgctggcaaccactgctttaaagcctatcgctacctccagtagctgtacagaggccctgcctggcttgtggagggacagacattggggtgattggacaagagggtctggctgggaggtgggccagacctggcagcactgaatgtgggctgtgggcatgggtgcacccggtgccctccctctcctacccccacccccacggttgcactttatttattcggttcttgctttggtgactgggtgagcctggactgtggtcccaaggatgtgtgcagagcttcaccctacccttcttacacacctccccacccctgtcagtctgctccccatcccccagcctggggccagaacagcctaccccaggacaggagtccctctagttgtctccctaccaccctatacacactgacagagacagcaataccccaccccccatattaaataaatgtcttcaccaag

SEQ ID NO: 32576 - DNA, 2435 bp, Homo sapiens
gtattcctgtcagcccgggtctgggtcggagcgtctgtgggtgggggcacagatgattttcaaaagctgtgcctctctctgcccacgtgaggcgtgtccatgtccgtgagagcagcagggggattcttcgggctgtggctgctcacgtgagaggctggtgtgagtggcgggagccatctgtgggcgccatggcaaagagggaggacagccctggcccagaggtccagccaatggacaagcagttcctggtatgcagcatctgcctggatcggtaccagtgccccaaggttcttccttgcctgcacaccttctgtgagagatgtctccaaaactatatccctgcccagagcctgacgctatcctgtccagtatgccggcagacgtccatcctcccagagcagggcgtctcggcactgcagaacaacttcttcatcagcagcctcatggaggcaatgcagcaggcacctgatggggcccacgacccggaggacccccaccccctcagtgtagtggctggccgccctctctcctgccccaaccatgaaggcaagacgatggagttttactgtgaggcctgtgagacggccatgtgtggtgagtgccgcgccggggagcatcgtgagcatggcacagtgctgctgagggatgtggtggagcagcacaaggcggccctgcagcgccagctcgaggctgtgcgtggccgattgccacagctgtccgcagcaattgccttagtcgggggcatcagccagcagctgcaggagcgcaaggcagaggccctggcccagatcagtgcagcgttcgaggacctggagcaagcactgcagcagcgcaagcaggctctggtcagcgacctggagaccatttgtggggccaaacagaaggtgttgcaaagccagctggacacactgcgccagggtcaggaacacatcggcagtagctgcagctttgcagagcaggcactgcgcctgggctcggccccggaggtgttgctggtgcgcaagcacatgcgagagcggctggctgcattggcggcacaggccttcccggagcggccacatgagaatgcacagctggaactggtccttgaggtggacggtctgcggcgatcggtgctcaatctgggcgcactgctcaccacgagcgccactgcacacgaaacggtggccacgggagagggcctgcgccaggcgctagtgggccagcctgcctcgctcactgtcactaccaaagacaaggacgggcggttggtgcgcacaggcagcgctgagctgcgtgcagagatcaccggcccggacggcacgcgccttccggtgccagtggtggaccacaagaatggcacatatgagctagtgtacacagcgcgcacggaaggcgagctgctcctctcggtgctgctctacggacagccagtgcgcggcagccccttccgcgtgcgtgccctgcgtccgggggacctgccaccttccccggacgatgtgaagcgccgtgtcaagtcccctggcggccccggcagccatgtgcgccagaaggcagtgcgtaggcccagctccatgtacagcacaggcggcaaacgaaaggacaacccaattgaggatgagctcgtcttccgtgttggcagtcgtggaagggagaaaggtgaattcaccaatttacaaggtgtgtccgcagccagcagcggccgcatcgtggtagcagacagcaacaaccagtgtattcaggttttctccaatgagggccagttcaagttccgttttggggtccgaggacgctcacctgggcagctgcagcgccccacaggtgtggcagtggacaccaatggagacataattgtggcagactatgacaaccgttgggtcagcatcttctcccctgagggcaagttcaagaccaagattggagctggccgcctcatgggccccaagggagtggccgtagaccggaatggacatatcattgtggtcgacaacaagtcttgctgcgtctttaccttccagcccaatggcaaactggttggccgttttgggggccgtggggccactgaccgccactttgcagggccccattttgtggctgtgaacaacaagaatgaaattgtagtaacggacttccataaccattcagtgaaggtgtacagtgccgatggagagttcctcttcaagtttggctcccatggcgagggcaatgggcagttcaatgcccccacaggagtagctgtggactccaatggaaacatcattgatgtgtgcagagcttcaccctacccttcttacacacctccccacccctgtcagtctgctccccatcccccagcctggggccagaacagcctaccccaggacaggagtccctctagttgtctccctaccaccctatacacactgacagagacagcaataccccaccccccatattaaataaatgtcttcaccaag

SEQ ID NO: 32577 - DNA, 2580 bp, Homo sapiens
agtagcagcgccgcgggcccttcagagtggccgcagtccgagctttgccctcgcatcctgttccaacgcgatgtctccaaaactatatccctgcccagagcctgacgctatcctgtccagtatgccggcagacgtccatcctcccagagcagggcgtctcggcactgcagaacaacttcttcatcagcagcctcatggaggcaatgcagcaggcacctgatggggcccacgacccggaggacccccaccccctcagtgtagtggctggccgccctctctcctgccccaaccatgaagacgatggagttttactgtgaggcctgtgagacggccatgtgtggtgagtgccgcgccggggagcatcgtgagcatggcacagtgctgctgagggatgtggtggagcagcacaaggcggccctgcagcgccagctcgaggctgtgcgtggccgattgccacagctgtccgcagcaattgccttagtcgggggcatcagccagcagctgcaggagcgcaaggcagaggccctggcccagatcagtgcagcgttcgaggacctggagcaagcactgcagcagcgcaagcaggctctggtcagcgacctggagaccatttgtggggccaaacagaaggtgttgcaaagccagctggacacactgcgccagggtcaggaacacatcggcagtagctgcagctttgcagagcaggcactgcgcctgggctcggccccggaggtgttgctggtgcgcaagcacatgcgagagcggctggctgcattggcggcacaggccttcccggagcggccacatgagaatgcacagctggaactggtccttgaggtggacggtctgcggcgatcggtgctcaatctgggcgcactgctcaccacgagcgccactgcacacgaaacggtggccacgggagagggcctgcgccaggcgctagtgggccagcctgcctcgctcactgtcactaccaaagacaaggacgggcggttggtgcgcacaggcagcgctgagctgcgtgcagagatcaccggcccggacggcacgcgccttccggtgccagtggtggaccacaagaatggcacatatgagctagtgtacacagcgcgcacggaaggcgagctgctcctctcggtgctgctctacggacagccagtgcgcggcagccccttccgcgtgcgtgccctgcgtccgggggacctgccaccttccccggacgatgtgaagcgccgtgtcaagtcccctggcggccccggcagccatgtgcgccagaaggcagtgcgtaggcccagctccatgtacagcacaggcggcaaacgaaaggacaacccaattgaggatgagctcgtcttccgtgttggcagtcgtggaagggagaaaggtgaattcaccaatttacaaggtgtgtccgcagccagcagcggccgcatcgtggtagcagacagcaacaaccagtgtattcaggttttctccaatgagggccagttcaagttccgttttggggtccgaggacgctcacctgggcagctgcagcgccccacaggtgtggcagtggacaccaatggagacataattgtggcagactatgacaaccgttgggtcagcatcttctcccctgagggcaagttcaagaccaagattggagctggccgcctcatgggccccaagggagtggccgtagaccggaatggacatatcattgtggtcgacaacaagtcttgctgcgtctttaccttccagcccaatggcaaactggttggccgttttgggggccgtggggccactgaccgccactttgcagggccccattttgtggctgtgaacaacaagaatgaaattgtagtaacggacttccataaccattcagtgaaggtgtacagtgccgatggagagttcctcttcaagtttggctcccatggcgagggcaatgggcagttcaatgcccccacaggagtagctgtggactccaatggaaacatcattgtggctgactggggcaacagccgcatccaggtattcgacagctctggctccttcctgtcctatatcaacacatctgcagaaccactgtatggtccacagggcctggcactgacctcggatggccatgtggtggtggctgatgctggcaaccactgctttaaagcctatcgctacctccagtagctgtacagaggccctgcctggcttgtggagggacagacattggggtgattggacaagagggtctggctgggaggtgggccagacctggcagcactgaatgtgggctgtgggcatgggtgcacccggtgccctccctctcctacccccacccccacggttgcactttatttattcggttcttgctttggtgactgggtgagcctggactgtggtcccaaggatgtgtgcagagcttcaccctacccttcttacacacctccccacccctgtcagtctgctccccatcccccagcctggggccagaacagcctaccccaggacaggagtccctctagttgtctccctaccaccctatacacactgacagagacagcaataccccaccccccatattaaataaatgtcttcacc

SEQ ID NO: 32578 - DNA, 2643 bp, Homo sapiens
cccccggccggtccgcagccccgccccggcccctccctccggcctgtgcggctagtccggcggcggcgccggcgcggggacaggcggaggcgcgggcagggccgggcggacgggcgctggcagcagtagcagcgccgcgggcccttcagagtggccgcagtccgagctttgccctcgcatcctgttccaacgcgaggctggtgtgagtggcgggagccatctgtgggcgccatggcaaagagggaggacagccctggcccagaggtccagccaatggacaagcagttcctggtatgcagcatctgcctggatcggtaccagtgccccaaggttcttccttgcctgcacaccttctgtgagagatgtctccaaaactatatccctgcccagagcctgacgctatcctgtccagtatgccggcagacgtccatcctcccagagcagggcgtctcggcactgcagaacaacttcttcatcagcagcctcatggaggcaatgcagcaggcacctgatggggcccacgacccggaggacccccaccccctcagtgtagtggctggccgccctctctcctgccccaaccatgaaggcaagacgatggagttttactgtgaggcctgtgagacggccatgtgtggtgagtgccgcgccggggagcatcgtgagcatggcacagtgctgctgagggatgtggtggagcagcacaaggcggccctgcagcgccagctcgaggctgtgcgtggccgattgccacagctgtccgcagcaattgccttagtcgggggcatcagccagcagctgcaggagcgcaaggcagaggccctggcccagatcagtgcagcgttcgaggacctggagcaagcactgcagcagcgcaagcaggctctggtcagcgacctggtggacggtctgcggcgatcggtgctcaatctgggcgcactgctcaccacgagcgccactgcacacgaaacggtggccacgggagagggcctgcgccaggcgctagtgggccagcctgcctcgctcactgtcactaccaaagacaaggacgggcggttggtgcgcacaggcagcgctgagctgcgtgcagagatcaccggcccggacggcacgcgccttccggtgccagtggtggaccacaagaatggcacatatgagctagtgtacacagcgcgcacggaaggcgagctgctcctctcggtgctgctctacggacagccagtgcgcggcagccccttccgcgtgcgtgccctgcgtccgggggacctgccaccttccccggacgatgtgaagcgccgtgtcaagtcccctggcggccccggcagccatgtgcgccagaaggcagtgcgtaggcccagctccatgtacagcacaggcggcaaacgaaaggacaacccaattgaggatgagctcgtcttccgtgttggcagtcgtggaagggagaaaggtgaattcaccaatttacaaggtgtgtccgcagccagcagcggccgcatcgtggtagcagacagcaacaaccagtgtattcaggttttctccaatgagggccagttcaagttccgttttggggtccgaggacgctcacctgggcagctgcagcgccccacaggtgtggcagtggacaccaatggagacataattgtggcagactatgacaaccgttgggtcagcatcttctcccctgagggcaagttcaagaccaagattggagctggccgcctcatgggccccaagggagtggccgtagaccggaatggacatatcattgtggtcgacaacaagtcttgctgcgtctttaccttccagcccaatggcaaactggttggccgttttgggggccgtggggccactgaccgccactttgcagggccccattttgtggctgtgaacaacaagaatgaaattgtagtaacggacttccataaccattcagtgaaggtgtacagtgccgatggagagttcctcttcaagtttggctcccatggcgagggcaatgggcagttcaatgcccccacaggagtagctgtggactccaatggaaacatcattgtggctgactggggcaacagccgcatccaggtattcgacagctctggctccttcctgtcctatatcaacacatctgcagaaccactgtatggtccacagggcctggcactgacctcggatggccatgtggtggtggctgatgctggcaaccactgctttaaagcctatcgctacctccagtagctgtacagaggccctgcctggcttgtggagggacagacattggggtgattggacaagagggtctggctgggaggtgggccagacctggcagcactgaatgtgggctgtgggcatgggtgcacccggtgccctccctctcctacccccacccccacggttgcactttatttattcggttcttgctttggtgactgggtgagcctggactgtggtcccaaggatgtgtgcagagcttcaccctacccttcttacacacctccccacccctgtcagtctgctccccatcccccagcctggggccagaacagcctaccccaggacaggagtccctctagttgtctccctaccaccctatacacactgacagagacagcaataccccaccccccatattaaataaatgtcttcacc

SEQ ID NO: 32579 - DNA, 2432 bp, Homo sapiens
gtattcctgtcagcccgggtctgggtcggagcgtctgtgggtgggggcacagatgattttcaaaagctgtgcctctctctgcccacgtgaggcgtgtccatgtccgtgagagcagcagggggattcttcgggctgtggctgctcacgtgagaggctggtgtgagtggcgggagccatctgtgggcgccatggcaaagagggaggacagccctggcccagaggtccagccaatggacaagcagttcctggtatgcagcatctgcctggatcggtaccagtgccccaaggttcttccttgcctgcacaccttctgtgagagatgtctccaaaactatatccctgcccagagcctgacgctatcctgtccagtatgccggcagacgtccatcctcccagagcagggcgtctcggcactgcagaacaacttcttcatcagcagcctcatggaggcaatgcagcaggcacctgatggggcccacgacccggaggacccccaccccctcagtgtagtggctggccgccctctctcctgccccaaccatgaaggcaagacgatggagttttactgtgaggcctgtgagacggccatgtgtggtgagtgccgcgccggggagcatcgtgagcatggcacagtgctgctgagggatgtggtggagcagcacaaggcggccctgcagcgccagctcgaggctgtgcgtggccgattgccacagctgtccgcagcaattgccttagtcgggggcatcagccagcagctgcaggagcgcaaggcagaggccctggcccagatcagtgcagcgttcgaggacctggagcaagcactgcagcagcgcaagcaggctctggtcagcgacctggagaccatttgtggggccaaacagaaggtgttgcaaagccagctggacacactgcgccagggtcaggaacacatcggcagtagctgcagctttgcagagcaggcactgcgcctgggctcggccccggaggtgttgctggtgcgcaagcacatgcgagagcggctggctgcattggcggcacaggccttcccggagcggccacatgagaatgcacagctggaactggtccttgaggtggacggtctgcggcgatcggtgctcaatctgggcgcactgctcaccacgagcgccactgcacacgaaacggtggccacgggagagggcctgcgccaggcgctagtgggccagcctgcctcgctcactgtcactaccaaagacaaggacgggcggttggtgcgcacaggcagcgctgagctgcgtgcagagatcaccggcccggacggcacgcgccttccggtgccagtggtggaccacaagaatggcacatatgagctagtgtacacagcgcgcacggaaggcgagctgctcctctcggtgctgctctacggacagccagtgcgcggcagccccttccgcgtgcgtgccctgcgtccgggggacctgccaccttccccggacgatgtgaagcgccgtgtcaagtcccctggcggccccggcagccatgtgcgccagaaggcagtgcgtaggcccagctccatgtacagcacaggcggcaaacgaaaggacaacccaattgaggatgagctcgtcttccgtgttggcagtcgtggaagggagaaaggtgaattcaccaatttacaaggtgtgtccgcagccagcagcggccgcatcgtggtagcagacagcaacaaccagtgtattcaggttttctccaatgagggccagttcaagttccgttttggggtccgaggacgctcacctgggcagctgcagcgccccacaggtgtggcagtggacaccaatggagacataattgtggcagactatgacaaccgttgggtcagcatcttctcccctgagggcaagttcaagaccaagattggagctggccgcctcatgggccccaagggagtggccgtagaccggaatggacatatcattgtggtcgacaacaagtcttgctgcgtctttaccttccagcccaatggcaaactggttggccgttttgggggccgtggggccactgaccgccactttgcagggccccattttgtggctgtgaacaacaagaatgaaattgtagtaacggacttccataaccattcagtgaaggtgtacagtgccgatggagagttcctcttcaagtttggctcccatggcgagggcaatgggcagttcaatgcccccacaggagtagctgtggactccaatggaaacatcattgtgtgcagagcttcaccctacccttcttacacacctccccacccctgtcagtctgctccccatcccccagcctggggccagaacagcctaccccaggacaggagtccctctagttgtctccctaccaccctatacacactgacagagacagcaataccccaccccccatattaaataaatgtcttcaccaag

SEQ ID NO: 32580 - DNA, 2043 bp, Homo sapiens
attacacattcaaagtatccatttgttctcaagaggtagcaagaaacagtatccacagtggactccggggctcctacagacttggcacagcttcctacagtcttgaaacagccctgttgttctgtcatggccagtgggcagtttgtgaacaaactgcaagaggaagtgatctgccccatctgcctggacattctgcagaaacctgtcaccatcgactgtgggcacaatttctgcctcaaatgcatcactcagattggggaaacatcatgtggatttttcaaatgtcccctctgcaaaacttccgtaaggaagaacgcaatcaggttcaactcgctgttgcggaatctggtggagaaaatccaagctctacaagcctctgaggtgcagtccaaaaggaaagaggctacatgcccgaggcaccaggagatgttccactatttctgcgaggatgatgggaagttcctctgttttgtgtgttgtgaatccaaggaccacaaatcccataatgtcagcttgatcgaagaagctgcccagaattatcaggggcagattcaagagcagatccaagtcttgcagcaaaaggagaaggagacagtacaagtgaaggcacaaggtgtacacagggtcgatgtcttcacggaccaggtagaacatgagaagcaaaggatcctcacagaatttgaactcctgcatcaagtcctagaggaggagaagaatttcctgctatcacggatttactggctgggtcatgagggaacggaagcggggaaacactatgttgcctccactgagccacagttgaacgatctcaagaagctcgttgattccctgaagaccaagcagaacatgccacccaggcagctgctggaggatatcaaagtcgtcttgtgcagaagtgaagagtttcagtttctcaacccaacccctgttcctctggaactggagaaaaaactcagtgaagcaaaatcaagacacgactccatcacagggagcctgaaaaaattcaaagaccaactccaggctgataggaaaaaagatgaaaacagattcttcaaaagcatgaataaaaatgacatgaagagctggggcttgttacagaaaaataatcataaaatgaacaaaacctcagagcccgggtcatcttctgcaggcggcagaactacatcggggccaccaaatcaccactcttcagccccatcccactccctgtttcgggcctcgtctgctgggaaagtcacttttccagtatgtctcctggcctcttatgatgagatttctggtcaaggagcgagctctcaggatacgaagacatttgacgttgcgctgtccgaggagctccatgcggcactgagtgagtggctgacagcgatccgggcttggttttgtgaggttccttcaagctaagccagctcagagaacacggggagcggtggtgctacacggacttcggagcatagagtggcgctgagtgagtggctgagaccgaccacggttcttgacttagtggaattgggtcgaaggagtggagaatgggagggctcgggctactgagagtggagatgggggcgggggtggtggtgaagagagttggagaaggaatggacgagttcttgagcaaaaggaggggaagagacaatctccagccacccgccccacgcttgacttcttatcactttggctgtggtgccgcctagtggaaaaaggaagtccctgcagcagtccccgcactctttaagcagctgtttaccgaaggcaccagttcagccaggagtgaaatccggagaggagcaacgccagcctgggtcacagtccatcaaaccccatgagcccgaccactctcgctcttccttacattcccacgtcccccttctctcccaacccctcatatcagcaagggaaattaattaatgagatttgataaatcagtagatagaatgaggtccccattctgaaatatttagcagactggaaccaccacgcaagcctctgtagggggtggatggagacacttctaactttaataaactgcgactgaacgtggaa

SEQ ID NO: 32581 - DNA, 2025 bp, Homo sapiens
atccatttgttctcaagaggtagcaagaaacagtatccacagtggactccggggctcctacagacttggcacagcttcctacagtcttgaaacagccctgttgttctgtcatggccagtgggcagtttgtgaacaaactgcaagaggaagtgatctgccccatctgcctggacattctgcagaaacctgtcaccatcgactgtgggcacaatttctgcctcaaatgcatcactcagattggggaaacatcatgtggatttttcaaatgtcccctctgcaaaacttccgtaaggaagaacgcaatcaggttcaactcgctgttgcggaatctggtggagaaaatccaagctctacaagcctctgaggtgcagtccaaaaggaaagaggctacatgcccgaggcaccaggagatgttccactatttctgcgaggatgatgggaagttcctctgttttgtgtgtcgtgaatccaaggaccacaaatcccataatgtcagcttgatcgaagaagctgcccagaattatcaggggcagattcaagagcagatccaagtcttgcagcaaaaggagaaggagacagtacaagtgaaggcacaaggtgtacacagggtcgatgtcttcacggaccaggtagaacatgagaagcaaaggatcctcacagaatttgaactcctgcatcaagtcctagaggaggagaagaatttcctgctatcacggatttactggctgggtcatgagggaacggaagcggggaaacactatgttgcctccactgagccacagttgaacgatctcaagaagctcgttgattccctgaagaccaagcagaacatgccacccaggcagctgctggagccagctcaaccacatcttcctagaagtgaagagtttcagtttctcaacccaacccctgttcctctggaactggagaaaaaactcagtgaagcaaaatcaagacatgactccatcacagggagcctaaaaaaattcaaagaccaactccaggctgataggaaaaaagatgaaaacagattcttcaaaagcatgaataaaaatgacatgaagagctggggcttgttacagaaaaataatcataaaatgaacaaaacctcagagcccgggtcatcttctgcaggcggcagaactacatcggggccaccaaatcaccactcttcagccccatcccactccctgtttcgggcctcgtctgctgggaaagtcacttttccagtatgtctcctggcctcttatgatgagatttctggtcaaggagcgagctctcaggatacgaagacatttgacgttgcgctgtccgaggagctccatgcggcactgagtgagtggctgacagcgatccgggcttggttttgtgaggttccttcaagctaagccagctcagagaacacggggagcggtggtgctacacggacttcggagcatagagtggcgctgagtgagtggctgagaccgaccacggttcttgacttagtggaattgggtcgaaggagtggagaatgggagggctcgggctactgagagtggagatgggggcgggggtggtggtgaagagagttggagaaggaatggacgaattcttgagcaaaaggaggggaagagacaatctccagccacccgccccacgcttgacttcttatcactttggctgtggtgccgcctagtggaaaaaggaagtccctgcagcagtccccgcactctttaagcagctgtttaccgaaggcaccagttcagccaggagtgaaatccggagaggagcaacgccagcctgggtcacagtccatcaaaccccatgagcccgaccactctcgctcttccttacattcccacgtcccccttctctcccaacccctcatatcagcaagggaaattaattaatgagatttgataaatcagtagatagaatgaggtccccattctgaaatatttagcagactggaaccaccacgcaagcctctgtagggggtggatggagacacttctaactttaataaactgcgactgaacgtgg

SEQ ID NO: 32582 - DNA, 2043 bp, Homo sapiens
attacacattcaaagtatccatttgttctcaagaggtagcaagaaacagtatccacagtggactccggggctcctacagacttggcacagcttcctacagtcttgaaacagccctgttgttctgtcatggccagtgggcagtttgtgaacaaactgcaagaggaagtgatctgccccatctgcctggacattctgcagaaacctgtcaccatcgactgtgggcacaatttctgcctcaaatgcatcactcagattggggaaacatcatgtggatttttcaaatgtcccctctgcaaaacttccgtaaggaagaacgcaatcaggttcaactcgctgttgcggaatctggtggagaaaatccaagctctacaagcctctgaggtgcagtccaaaaggaaagaggctacatgcccgaggcaccaggagatgttccactatttctgcgaggatgatgggaagttcctctgttttgtgtgtcgtgaatccaaggaccacaaatcccataatgtcagcttgatcgaagaagctgcccagaattatcaggggcagattcaagagcagatccaagtcttgcagcaaaaggagaaggagacagtacaagtgaaggcacaaggtgtacacagggtcgatgtcttcacggaccaggtagaacatgagaagcaaaggatcctcacagaatttgaactcctgcatcaagtcctagaggaggagaagaatttcctgctatcacggatttactggctgggtcatgagggaacggaagcggggaaacactatgttgcctccactgagccacagttgaacgatctcaagaagctcgttgattccctgaagaccaagcagaacatgccacccaggcagctgctggaggatatcaaagtcgtcttgtgcagaagtgaagagtttcagtttctcaacccaacccctgttcctctggaactggagaaaaaactcagtgaagcaaaatcaagacatgactccatcacagggagcctaaaaaaattcaaagaccaactccaggctgataggaaaaaagatgaaaacagattcttcaaaagcatgaataaaaatgacatgaagagctggggcttgttacagaaaaataatcataaaatgaacaaaacctcagagcccgggtcatcttctgcaggcggcagaactacatcggggccaccaaatcaccactcttcagccccatcccactccctgtttcgggcctcgtctgctgggaaagtcacttttccagtatgtctcctggcctcttatgatgagatttctggtcaaggagcgagctctcaggatacgaagacatttgacgttgcgctgtccgaggagctccatgcggcactgagtgagtggctgacagcgatccgggcttggttttgtgaggttccttcaagctaagccagctcagagaacacggggagcggtggtgctacacggacttcggagcatagagtggcgctgagtgagtggctgagaccgaccacggttcttgacttagtggaattgggtcgaaggagtggagaatgggagggctcgggctactgagagtggagatgggggcgggggtggtggtgaagagagttggagaaggaatggacgaattcttgagcaaaaggaggggaagagacaatctccagccacccgccccacgcttgacttcttatcactttggctgtggtgccgcctagtggaaaaaggaagtccctgcagcagtccccgcactctttaagcagctgtttaccgaaggcaccagttcagccaggagtgaaatccggagaggagcaacgccagcctgggtcacagtccatcaaaccccatgagcccgaccactctcgctcttccttacattcccacgtcccccttctctcccaacccctcatatcagcaagggaaattaattaatgagatttgataaatcagtagatagaatgaggtccccattctgaaatatttagcagactggaaccaccacgcaagcctctgtagggggtggatggagacacttctaactttaataaactgcgactgaacgtggaa

SEQ ID NO: 32583 - DNA, 870 bp, Homo sapiens
attacacattcaaagtatccatttgttctcaagaggtagcaagaaacagtatccacagtggactccggggctcctacagacttggcacagcttcctacagtcttgaaacagccctgttgttctgtcatggccagtgggcagtttgtgaacaaactgcaagaggaagtgatctgccccatctgcctggacattctgcagaaacctgtcaccatcgactgtgggcacaatttctgcctcaaatgcatcactcagattggggaaacatcatgtggatttttcaaatgtcccctctgcaaaacttccgtaaggaagaacgcaatcaggttcaactcgctgttgcggaatctggtggagaaaatccaagctctacaagcctctgaggtgcagtccaaaaggaaagaggctacatgcccgaggcaccaggagatgttccactatttctgcgaggatgatgggaagttcctctgttttgtgtgtcgtgaatccaaggaccacaaatcccataatgtcagcttgatcgaagaagctgcccagaattatcaggggcagattcaagagcagatccaagtcttgcagcaaaaggagaaggagacagtacaagtgaaggcacaaggtgtacacagggtcgatgtcttcacggaccaggtagaacatgagaagcaaaggatcctcacagaatttgaactcctgcatcaagtcctagaggaggagaagaatttcctgctatcacggatttactggctgggtcatgagggaacggaagcggggaaacactatgttgcctccactgagccacagttgaacgatctcaagaagctcgttgattccctgaagaccaagcagaacatgccacccaggcagctgctggag

SEQ ID NO: 32584 - DNA, 2043 bp, Homo sapiens
attacacattcaaagtatccatttgttctcaagaggtagcaagaaacagtatccacagtggactccggggctcctacagacttggcacagcttcctacagtcttgaaacagccctgttgttctgtcatggccagtgggcagtttgtgaacaaactgcaagaggaagtgatctgccccatctgcctggacattctgcagaaacctgtcaccatcgactgtgggcacaatttctgcctcaaatgcatcactcagattggggaaacatcatgtggatttttcaaatgtcccctctgcaaaacttccgtaaggaagaacgcaatcaggttcaactcgctgttgcggaatctggtggagaaaatccaagctctacaagcctctgaggtgcagtccaaaaggaaagaggctacatgcccgaggcaccaggagatgttccactatttctgcgaggatgatgggaagttcctctgttttgtgtgtcgtgaatccaaggaccacaaatcccataatgtcagcttgatcgaagaagctgcccagaattatcaggggcagattcaagagcagatccaagtcttgcagcaaaaggagaaggagacagtacaagtgaaggcacaaggtgtacacagggtcgatgtcttcacggaccaggtagaacatgagaagcaaaggatcctcacagaatttgaactcctgcatcaagtcctagaggaggagaagaatttcctgctatcacggatttactggctgggtcatgagggaacggaagcggggaaacactatgttgcctccactgagccacagttgaacgatctcaagaagctcgttgattccctgaagaccaagcagaacatgccacccaggcagctgctggaggatatcaaagtcgtcttgtgcagaagtgaagagtttcagtttctcaacccaacccctgttcctctggaactggagaaaaaactcagtgaagcaaaatcaagacacgactccatcacagggagcctgaaaaaattcaaagaccaactccaggctgataggaaaaaagatgaaaacagattcttcaaaagcatgaataaaaatgacatgaagagctggggcttgttacagaaaaataatcataaaatgaacaaaacctcagagcccgggtcatcttctgcaggcggcagaactacatcggggccaccaaatcaccactcttcagccccatcccactccctgtttcgggcctcgtctgctgggaaagtcacttttccagtatgtctcctggcctcttatgatgagatttctggtcaaggagcgagctctcaggatacgaagacatttgacgttgcgctgtccgaggagctccatgcggcactgagtgagtggctgacagcgatccgggcttggttttgtaaggttccttcaagctaagccagctcagagaacacggggagcggtggtgctccacggacttcggagcatagagtggcgctgagtgagtggctgagaccgaccacggttcttgacttagtggaattgggtcgaaggagtggagaatgggagggctcgggctactgagagtggagatgggggcgggggtggtggtgaagagagttggagaaggaatggacgagttcttgagcaaaaggaggggaagagacaatctccagccacccgccccacgcttgacttcttatcactttggctgtggtgccgcctagtggaaaaaggaagtccctgcagcagtccccgcactctttaagcagctgtttaccgaaggcaccagttcagccaggagtgaaatccagagacgagcaacgccagcctgggtcacagtccatcaaaccccatgagcccgaccactctcgctcttccttacattcccacgtcccccttctctcccaacccctcatatcagcaagggaaattaattaatgagatttgataaatcagtagatagaatgaggtccccattctgaaatatttagcagactggaaccaccacgcaagcctctgtagggggtggatggagacacttctaactttaataaactgcgactgaacgtggaa

SEQ ID NO: 32585 - DNA, 2043 bp, Homo sapiens
attacacattcaaagtatccatttgttctcaagaggtagcaagaaacagtatccacagtggactccggggctcctacagacttggcacagcttcctacagtcttgaaacagccctgttgttctgtcatggccagtgggcagtttgtgaacaaactgcaagaggaagtgatctgccccatctgcctggacattctgcagaaacctgtcaccatcgactgtgggcacaatttctgcctcaaatgcatcactcagattggggaaacatcatgtggatttttcaaatgtcccctctgcaaaacttccgtaaggaagaacgcaatcaggttcaactcgctgttgcggaatctggtggagaaaatccaagctctacaagcctctgaggtgcagtccaaaaggaaagaggctacatgcccgaggcaccaggagatgttccactatttctgcgaggatgatgggaagttcctctgttttgtgtgtcgtgaatccaaggaccacaaatcccataatgtcagcttgatcgaagaagctgcccagaattatcaggggcagattcaagagcagatccaagtcttgcagcaaaaggagaaggagacagtacaagtgaaggcacaaggtgtacacagggtcgatgtcttcacggaccaggtagaacatgagaagcaaaggatcctcacagaatttgaactcctgcatcaagtcctagaggaggagaagaatttcctgctatcacggatttactggctgggtcatgagggaacggaagcggggaaacactatgttgcctccactgagccacagttgaacgatctcaagaagctcgttgattccctgaagaccaagcagaacatgccacccaggcagctgctggaggatatcaaagtcgtcttgtgcagaagtgaagagtttcagtttctcaacccaacccctgttcctctagaactggagaaaaaactcagtgaagcaaaatcaagacacgactccatcacagggagcctgaaaaaattcaaagaccaactccaggctgataggaaaaaagatgaaaacagattcttcaaaagcatgaataaaaatgacatgaagagctggggcttgttacagaaaaataatcataaaatgaacaaaacctcagagcccgggtcatcttctgcaggcggcagaactacatcggggccaccaaatcaccactcttcagccccatcccactccctgtttcgggcctcgtctgctgggaaagtcacttttccagtatgtctcctggcctcttatgatgagatttctggtcaaggagcgagctctcaggatacgaagacatttgacgttgcgctgtccgaggagctccatgcggcactgagtgagtggctgacagcgatccgggcttggttttgtgaggttccttcaagctaagccagctcagagaacacggggagcggtggtgctacacggacttcggagcatagagtggcgctgagtgagtggctgagaccgaccacggttcttgacttagtggaattgggtcgaaggagtggagaatgggagggctcgggctactgagagtggagatgggggcgggggtggtggtgaagagagttggagaaggaatggacgagttcttgagcaaaaggaggggaagagacaatctccagccacccgccccacgcttgacttcttatcactttggctgtggtgccgcctagtggaaaaaggaagtccctgcagcagtccccgcactctttaagcagctgtttaccgaaggcaccagttcagccaggagtgaaatccggagaggagcaacgccagcctgggtcacagtccatcaaaccccatgagcccgaccactctcgctcttccttacattcccacgtcccccttctctcccaacccctcatatcagcaagggaaattaattaatgagatttgataaatcagtagatagaatgaggtccccattctgaaatatttagcagactggaaccaccacgcaagcctctgtagggggtggatggagacacttctaactttaataaactgcgactgaacgtggaa

SEQ ID NO: 32586 - DNA, 2043 bp, Homo sapiens
attacacattcaaagtatccatttgttctcaagaggtagcaagaaacagtatccacagtggactccggggctcctacagacttggcacagcttcctacagtcttgaaacagccctgttgttctgtcatggccagtgggcagtttgtgaacaaactgcaagaggaagtgatctgccccatctgcctggacattctgcagaaacctgtcaccatcgactgtgggcacaatttctgcctcaaatgcatcactcagattggggaaacatcatgtggatttttcaaatgtcccctctgcaaaacttccgtaaggaagaacgcaatcaggttcaactcgctgttgcggaatctggtggagaaaatccaagctctacaagcctctgaggtgcagtccaaaaggaaagaggctacatgcccgaggcaccaggagatgttccactatttctgcgaggatgatgggaagttcctctgttttgtgtgtcgtgaatccaaggaccacaaatcccataatgtcagcttgatcgaagaagctgcccagaattatcaggggcagattcaagagcagatccaagtcttgcagcaaaaggagaaggagacagtacaagtgaaggcacaaggtgtacacagggtcgatgtcttcacggaccaggtagaacatgagaagcaaaggatcctcacagaatttgaactcctgcatcaagtcctagaggaggagaagaatttcctgctatcacggatttactggctgggtcatgagggaacggaagcggggaaacactatgttgcctccactgagccacagttgaacgatctcaagaagctcgttgattccctgaagaccaagcagaacatgccacccaggcagctgctggaggatatcaaagtcgtcttgtgcagaagtgaagagtttcagtttctcaacccaacccctgttcctctagaactggagaaaaaactcagtgaagcaaaatcaagacacgactccatcacagggagcctgaaaaaattcaaagaccaactccaggctgataggaaaaaagatgaaaacagattcttcaaaagcatgaataaaaatgacatgaagagctggggcttgttacagaaaaataatcataaaatgaacaaaacctcagagcccgggtcatcttctgcaggcggcagaactacatcggggccaccaaatcaccactcttcagccccatcccactccctgtttcgggcctcgtctgctgggaaagtcacttttccagtatgtctcctggcctcttatgatgagatttctggtcaaggagcgagctctcaggatacgaagacatttgacgttgcgctgtccgaggagctccatgcggcactgagtgagtggctgacagcgatccgggcttggttttgtgaggttccttcaagctaagccagctcagagaacacggggagcggtggtgctacacggacttcggagcatagagtggcgctgagtgagtggctgagaccgaccacggttcttgacttagtggaattgggtcgaaggagtggagaatgggagggctcgggctactgagagtggagatgggggcgggggtggtggtgaagagagttggagaaggaatggacgaattcttgagcaaaaggaggggaagagacaatctccagccacccgccccacgcttgacttcttatcactttggctgtggtgccgcctagtggaaaaaggaagtccctgcagcagtccccgcactctttaagcagctgtttaccgaaggcaccagttcagccaggagtgaaatccggagaggagcaacgccagcctgggtcacagtccatcaaaccccatgagcccgaccactctcgctcttccttacattcccacgtcccccttctctcccaacccctcatatcagcaagggaaattaattaatgagatttgataaatcagtagatagaatgaggtccccattctgaaatatttagcagactggaaccaccacgcaagcctctgtagggggtggatggagacacttctaactttaataaactgcgactgaacgtggaa

SEQ ID NO: 32587 - DNA, 2043 bp, Homo sapiens
attacacattcaaagtatccatttgttctcaagaggtagcaagaaacagtatccacagtggactccggggctcctacagacttggcacagcttcctacagtcttgaaacagccctgttgttctgtcatggccagtgggcagtttgtgaacaaactgcaagaggaagtgatctgccccatctgcctggacattctgcagaaacctgtcaccatcgactgtgggcacaatttctgcctcaaatgcatcactcagattggggaaacatcatgtggatttttcaaatgtcccctctgcaaaacttccgtaaggaagaacgcaatcaggttcaactcgctgttgcggaatctggtggagaaaatccaagctctacaagcctctgaggtgcagtccaaaaggaaagaggctacatgcccgaggcaccaggagatgttccactatttctgcgaggatgatgggaagttcctctgttttgtgtgtcgtgaatccaaggaccacaaatcccataatgtcagcttgatcgaagaagctgcccagaattatcaggggcagattcaagagcagatccaagtcttgcagcaaaaggagaaggagacagtacaagtgaaggcacaaggtgtacacagggtcgatgtcttcacggaccaggtagaacatgagaagcaaaggatcctcacagaatttgaactcctgcatcaagtcctagaggaggagaagaatttcctgctatcacggatttactggctgggtcatgagggaacggaagcggggaaacactatgttgcctccactgagccacagttgaacgatctcaagaagctcgttgattccctgaagaccaagcagaacatgccacccaggcagctgctggaggatatcaaagtcgtcttgtgcagaagtgaagagtttcagtttctcaacccaacccctgttcctctggaactggagaaaaaactcagtgaagcaaaatcaagacacgactccatcacagggagcctgaaaaaattcaaagaccaactccaggctgataggaaaaaagatgaaaacagattcttcaaaagcatgaataaaaatgacatgaagagctggggcttgttacagaaaaataatcataaaatgaacaaaacctcagagcccgggtcatcttctgcaggcggcagaactacatcggggccaccaaatcaccactcttcagccccatcccactccctgtttcgggcctcgtctgctgggaaagtcacttttccagtatgtctcctggcctcttatgatgagatttctggtcaaggagcgagctctcaggatacgaagacatttgacgttgcgctgtccgaggagctccatgcggcactgagtgagtggctgacagcgatccgggcttggttttgtgaggttccttcaagctaagccagctcagagaacacggggagcggtggtgctacacggacttcggagcatagagtggcgctgagtgagtggctgagaccgaccacggttcttgacttagtggaattgggtcgaaggagtggagaatgggagggctcgggctactgagagtggagatgggggcgggggtggtggtgaagagagttggagaaggaatggacgagttcttgagcaaaaggaggggaagagacaatctccagccacccgccccacgcttgacttcttatcactttggctgtggtgccgcctagtggaaaaaggaagtccctgcagcagtccccgcactctttaagcagctgtttaccgaaggcaccagttcagccaggagtgaaatccggagaggagcaacgccagcctgggtcacagtccatcaaaccccatgagcccgaccactctcgctcttccttacattcccacgtcccccttctctcccaacccctcatatcagcaagggaaattaattaatgagatttgataaatcagtagatagaatgaggtccccattctgaaatatttagcagactggaaccaccacgcaagcctctgtagggggtggatggagacacttctaactttaataaactgcgactgaacgtggaa

SEQ ID NO: 32588 - DNA, 2043 bp, Homo sapiens
attacacattcaaagtatccatttgttctcaagaggtagcaagaaacagtatccacagtggactccggggctcctacagacttggcacagcttcctacagtcttgaaacagccctgttgttctgtcatggccagtgggcagtttgtgaacaaactgcaagaggaagtgatctgccccatctgcctggacattctgcagaaacctgtcaccattgactgtgggcacaatttctgcctcaaatgcatcactcagattggggaaacatcatgtggatttttcaaatgtcccctctgcaaaacttccgtaaggaagaacgcaatcaggttcaactcgctgttgcggaatctggtggagaaaatccaagctctacaagcctctgaggtgcagtccaaaaggaaagaggctacatgcccgaggcaccaggagatgttccattatttctgcgaggatgatgggaagttcctctgttttgtgtgtcgtgaatccaaggaccacaaatcccataatgtcagcttgatcgaagaagctgcccagaattatcaggggcagattcaagagcagatccaagtcttgcagcaaaaggagaaggagacagtacaagtgaaggcacaaggtgtacacagggtcgatgtcttcacggaccaggtagaacatgagaagcaaaggatcctcacagaatttgaactcctgcatcaagtcctagaggaggagaagaatttcctgctatcacggatttactggctgggtcatgagggaacggaagcagggaaacactatgttgcctccactgagccacagttgaacgatctcaagaagctcattgattccctgaagaccaagcagaacatgccacccaggcagctgctggaggatatcaaagtcgtcttgtgcagaagtgaagagtttcagtttctcaacccaacccctgttcctctggaactggagaaaaaactcagtgaagcaaaatcaagacatgactccatcacagggagcctgaaaaaattcaaagaccaactccaggctgataggaaaaaagatgaaaacagattcttcaaaagcatgaataaaaatgacatgaagagctggggcttgttacagaaaaataatcataaaatgaacaaaacctcagagcccgggtcatcttctgcaggcggcagaactacatcggggccaccaaatcaccactcttcagccccatcccactccctgtttcgggcctcgtctgctgggaaagtcacttttccagtatgtctcctggcctcttatgatgagatttctggtcaaggagcgagctctcaggatacgaagacatttgacgttgcgctgtccgaggagctccatgcggcactgagtgagtggctgacagcgatccgggcttggttttgtaaggttccttcaagctaagccagctcagagaacacggggagcggtggtgctccacggacttcggagcatagagtggcgctgagtgagtggctgagaccgaccacggttcttgacttagtggaattgggtcgaaggagtggagaatgggagggctcgggctactgagagtggagatgggggcgggggtggtggtgaagagagttggagaaggaatggacgagttcttgagcaaaaggaggggaagagacaatctccagccacccgccccacgcttgacttcttatcactttggctgtggtgccgcctagtggaaaaaggaagtccctgcagcagtccccgcactctttaagcagctgtttaccgaaggcaccagttcagccaggagtgaaatccagagacgagcaacgccagcctgggtcacagtccatcaaaccccatgagcccgaccactctcgctcttccttacattcccacgtcccccttctctcccaacccctcatatcagcaagggaaattaattaatgagatttgataaatcagtagatagaatgaggtccccattctgaaatatttagcagactggaaccaccacgcaagcctctgtagggggtggatggagacacttctaactttaataaactgcgactgaacgtggaa

SEQ ID NO: 32589 - DNA, 1648 bp, Homo sapiens
atccatttgttctcaagaggtagcaagaaacagtatccacagtggactccggggctcctacagacttggcacagcttcctacagtcttgaaacagccctgttgttctgtcatggccagtgggcagtttgtgaacaaactgcaagaggaagtgatctgccccatctgcctggacattctgcagaaacctgtcaccatcgactgtgggcacaatttctgcctcaaatgcatcactcagattggggaaacatcatgtggatttttcaaatgtcccctctgcaaaacttccgtaaggaagaacgcaatcaggttcaactcgctgttgcggaatctggtggagaaaatccaagctctacaagcctctgaggtgcagtccaaaaggaaagaggctacatgcccgaggcaccaggagatgttccactatttctgcgaggatgatgggaagttcctctgttttgtgtgtcgtgaatccaaggaccacaaatcccataatgtcagcttgatcgaagaagctgcccagaattatcaggggcagattcaagagcagatccaagtcttgcagcaaaaggagaaggagacagtacaagtgaaggcacaaggtgtacacagggtcgatgtcttcacggaccaggtagaacatgagaagcaaaggatcctcacagaatttgaactcctgcatcaagtcctagaggaggagaagaatttcctgctatcacggatttactggctgggtcatgagggaacggaagcggggaaacactatgttgcctccactgagccacagttgaacgatctcaagaagctcgttgattccctgaagaccaagcagaacatgccacccaggcagctgctggaggatatcaaagtcgtcttgtgcagaagtgaagagtttcagtttctcaacccaacccctgttcctctggaactggagaaaaaactcagtgaagcaaaatcaagacatgactccatcacagggagcctaaaaaaattcaaagaccaactccaggctgataggaaaaaagatgaaaacagattcttcaaaagcatgaataaaaatgacatgaagagctggggcttgttacagaaaaataatcataaaatgaacaaaacctcagagcccgggtcatcttctgcaggcggcagaactacatcggggccaccaaatcaccactcttcagccccatcccactccctgtttcgggcctcgtctgctgggaaagtcacttttccagtatgtctcctggcctcttatgatgagatttctggtcaaggagcgagctctcaggatacgaagacatttgacgttgcgctgtccgaggagctccatgcggcactgagtgagtggctgacagcgatccgggcttggttttgtgaggttccttcaagctaagccagctcagagaacacggggagcggtggtgctacacggacttcggagcatagagtggcgctgatggaaaaaggaagtccctgcagcagtccccgcactctttaagcagctgtttaccgaaggcaccagttcagccaggagtgaaatccggagaggagcaacgccagcctgggtcacagtccatcaaaccccatgagcccgaccactctcgctcttccttacattcccacgtcccccttctctcccaacccctcatatca

SEQ ID NO: 32590 - DNA, 2025 bp, Homo sapiens
atccatttgttctcaagaggtagcaagaaacagtatccacagtggactccggggctcctacagacttggcacagcttcctacagtcttgaaacagccctgttgttctgtcatggccagtgggcagtttgtgaacaaactgcaagaggaagtgatctgccccatctgcctggacattctgcagaaacctgtcaccatcgactgtgggcacaatttctgcctcaaatgcatcactcagattggggaaacatcatgtggatttttcaaatgtcccctctgcaaaacttccgtaaggaagaacgcaatcaggttcaactcgctgttgcggaatctggtggagaaaatccaagctctacaagcctctgaggtgcagtccaaaaggaaagaggctacatgcccgaggcaccaggagatgttccactatttctgcgaggatgatgggaagttcctctgttttgtgtgtcgtgaatccaaggaccacaaatcccataatgtcagcttgatcgaagaagctgcccagaattatcaggggcagattcaagagcagatccaagtcttgcagcaaaaggagaaggagacagtacaagtgaaggcacaaggtgtacacagggtcgatgtcttcacggaccaggtagaacatgagaagcaaaggatcctcacagaatttgaactcctgcatcaagtcctagaggaggagaagaatttcctgctatcacggatttactggctgggtcatgagggaacggaagcggggaaacactatgttgcctccactgagccacagttgaacgatctcaagaagctcgttgattccctgaagaccaagcagaacatgccacccaggcagctgctggagccagctcaaccacatcttcctagaagtgaagagtttcagtttctcaacccaacccctgttcctctggaactggagaaaaaactcagtgaagcaaaatcaagacacgactccatcacagggagcctgaaaaaattcaaagaccaactccaggctgataggaaaaaagatgaaaacagattcttcaaaagcatgaataaaaatgacatgaagagctggggcttgttacagaaaaataatcataaaatgaacaaaacctcagagcccgggtcatcttctgcaggcggcagaactacatcggggccaccaaatcaccactcttcagccccatcccactccctgtttcgggcctcgtctgctgggaaagtcacttttccagtatgtctcctggcctcttatgatgagatttctggtcaaggagcgagctctcaggatacgaagacatttgacgttgcgctgtccgaggagctccatgcggcactgagtgagtggctgacagcgatccgggcttggttttgtgaggttccttcaagctaagccagctcagagaacacggggagcggtggtgctacacggacttcggagcatagagtggcgctgagtgagtggctgagaccgaccacggttcttgacttagtggaattgggtcgaaggagtggagaatgggagggctcgggctactgagagtggagatgggggcgggggtggtggtgaagagagttggagaaggaatggacgagttcttgagcaaaaggaggggaagagacaatctccagccacccgccccacgcttgacttcttatcactttggctgtggtgccgcctagtggaaaaaggaagtccctgcagcagtccccgcactctttaagcagctgtttaccgaaggcaccagttcagccaggagtgaaatccggagaggagcaacgccagcctgggtcacagtccatcaaaccccatgagcccgaccactctcgctcttccttacattcccacgtcccccttctctcccaacccctcatatcagcaagggaaattaattaatgagatttgataaatcagtagatagaatgaggtccccattctgaaatatttagcagactggaaccaccacgcaagcctctgtagggggtggatggagacacttctaactttaataaactgcgactgaacgtgg

SEQ ID NO: 32591 - DNA, 1648 bp, Homo sapiens
atccatttgttctcaagaggtagcaagaaacagtatccacagtggactccggggctcctacagacttggcacagcttcctacagtcttgaaacagccctgttgttctgtcatggccagtgggcagtttgtgaacaaactgcaagaggaagtgatctgccccatctgcctggacattctgcagaaacctgtcaccatcgactgtgggcacaatttctgcctcaaatgcatcactcagattggggaaacatcatgtggatttttcaaatgtcccctctgcaaaacttccgtaaggaagaacgcaatcaggttcaactcgctgttgcggaatctggtggagaaaatccaagctctacaagcctctgaggtgcagtccaaaaggaaagaggctacatgcccgaggcaccaggagatgttccactatttctgcgaggatgatgggaagttcctctgttttgtgtgtcgtgaatccaaggaccacaaatcccataatgtcagcttgatcgaagaagctgcccagaattatcaggggcagattcaagagcagatccaagtcttgcagcaaaaggagaaggagacagtacaagtgaaggcacaaggtgtacacagggtcgatgtcttcacggaccaggtagaacatgagaagcaaaggatcctcacagaatttgaactcctgcatcaagtcctagaggaggagaagaatttcctgctatcacggatttactggctgggtcatgagggaacggaagcggggaaacactatgttgcctccactgagccacagttgaacgatctcaagaagctcgttgattccctgaagaccaagcagaacatgccacccaggcagctgctggaggatatcaaagtcgtcttgtgcagaagtgaagagtttcagtttctcaacccaacccctgttcctctggaactggagaaaaaactcagtgaagcaaaatcaagacacgactccatcacagggagcctgaaaaaattcaaagaccaactccaggctgataggaaaaaagatgaaaacagattcttcaaaagcatgaataaaaatgacatgaagagctggggcttgttacagaaaaataatcataaaatgaacaaaacctcagagcccgggtcatcttctgcaggcggcagaactacatcggggccaccaaatcaccactcttcagccccatcccactccctgtttcgggcctcgtctgctgggaaagtcacttttccagtatgtctcctggcctcttatgatgagatttctggtcaaggagcgagctctcaggatacgaagacatttgacgttgcgctgtccgaggagctccatgcggcactgagtgagtggctgacagcgatccgggcttggttttgtaaggttccttcaagctaagccagctcagagaacacggggagcggtggtgctccacggacttcggagcatagagtggcgctgatggaaaaaggaagtccctgcagcagtccccgcactctttaagcagctgtttaccgaaggcaccagttcagccaggagtgaaatccagagacgagcaacgccagcctgggtcacagtccatcaaaccccatgagcccgaccactctcgctcttccttacattcccacgtcccccttctctcccaacccctcatatca

SEQ ID NO: 32592 - DNA, 2025 bp, Homo sapiens
atccatttgttctcaagaggtagcaagaaacagtatccacagtggactccggggctcctacagacttggcacagcttcctacagtcttgaaacagccctgttgttctgtcatggccagtgggcagtttgtgaacaaactgcaagaggaagtgatctgccccatctgcctggacattctgcagaaacctgtcaccatcgactgtgggcacaatttctgcctcaaatgcatcactcagattggggaaacatcatgtggatttttcaaatgtcccctctgcaaaacttccgtaaggaagaacgcaatcaggttcaactcgctgttgcggaatctggtggagaaaatccaagctctacaagcctctgaggtgcagtccaaaaggaaagaggctacatgcccgaggcaccaggagatgttccactatttctgcgaggatgatgggaagttcctctgttttgtgtgtcgtgaatccaaggaccacaaatcccataatgtcagcttgatcgaagaagctgcccagaattatcaggggcagattcaagagcagatccaagtcttgcagcaaaaggagaaggagacagtacaagtgaaggcacaaggtgtacacagggtcgatgtcttcacggaccaggtagaacatgagaagcaaaggatcctcacagaatttgaactcctgcatcaagtcctagaggaggagaagaatttcctgctatcacggatttactggctgggtcatgagggaacggaagcggggaaacactatgttgcctccactgagccacagttgaacgatctcaagaagctcgttgattccctgaagaccaagcagaacatgccacccaggcagctgctggagccagctcaaccacatcttcctagaagtgaagagtttcagtttctcaacccaacccctgttcctctagaactggagaaaaaactcagtgaagcaaaatcaagacacgactccatcacagggagcctgaaaaaattcaaagaccaactccaggctgataggaaaaaagatgaaaacagattcttcaaaagcatgaataaaaatgacatgaagagctggggcttgttacagaaaaataatcataaaatgaacaaaacctcagagcccgggtcatcttctgcaggcggcagaactacatcggggccaccaaatcaccactcttcagccccatcccactccctgtttcgggcctcgtctgctgggaaagtcacttttccagtatgtctcctggcctcttatgatgagatttctggtcaaggagcgagctctcaggatacgaagacatttgacgttgcgctgtccgaggagctccatgcggcactgagtgagtggctgacagcgatccgggcttggttttgtgaggttccttcaagctaagccagctcagagaacacggggagcggtggtgctacacggacttcggagcatagagtggcgctgagtgagtggctgagaccgaccacggttcttgacttagtggaattgggtcgaaggagtggagaatgggagggctcgggctactgagagtggagatgggggcgggggtggtggtgaagagagttggagaaggaatggacgaattcttgagcaaaaggaggggaagagacaatctccagccacccgccccacgcttgacttcttatcactttggctgtggtgccgcctagtggaaaaaggaagtccctgcagcagtccccgcactctttaagcagctgtttaccgaaggcaccagttcagccaggagtgaaatccggagaggagcaacgccagcctgggtcacagtccatcaaaccccatgagcccgaccactctcgctcttccttacattcccacgtcccccttctctcccaacccctcatatcagcaagggaaattaattaatgagatttgataaatcagtagatagaatgaggtccccattctgaaatatttagcagactggaaccaccacgcaagcctctgtagggggtggatggagacacttctaactttaataaactgcgactgaacgtgg

SEQ ID NO: 32593 - DNA, 2025 bp, Homo sapiens
atccatttgttctcaagaggtagcaagaaacagtatccacagtggactccggggctcctacagacttggcacagcttcctacagtcttgaaacagccctgttgttctgtcatggccagtgggcagtttgtgaacaaactgcaagaggaagtgatctgccccatctgcctggacattctgcagaaacctgtcaccattgactgtgggcacaatttctgcctcaaatgcatcactcagattggggaaacatcatgtggatttttcaaatgtcccctctgcaaaacttccgtaaggaagaacgcaatcaggttcaactcgctgttgcggaatctggtggagaaaatccaagctctacaagcctctgaggtgcagtccaaaaggaaagaggctacatgcccgaggcaccaggagatgttccattatttctgcgaggatgatgggaagttcctctgttttgtgtgtcgtgaatccaaggaccacaaatcccataatgtcagcttgatcgaagaagctgcccagaattatcaggggcagattcaagagcagatccaagtcttgcagcaaaaggagaaggagacagtacaagtgaaggcacaaggtgtacacagggtcgatgtcttcacggaccaggtagaacatgagaagcaaaggatcctcacagaatttgaactcctgcatcaagtcctagaggaggagaagaatttcctgctatcacggatttactggctgggtcatgagggaacggaagcagggaaacactatgttgcctccactgagccacagttgaacgatctcaagaagctcattgattccctgaagaccaagcagaacatgccacccaggcagctgctggagccagctcaaccacatcttcctagaagtgaagagtttcagtttctcaacccaacccctgttcctctggaactggagaaaaaactcagtgaagcaaaatcaagacatgactccatcacagggagcctgaaaaaattcaaagaccaactccaggctgataggaaaaaagatgaaaacagattcttcaaaagcatgaataaaaatgacatgaagagctggggcttgttacagaaaaataatcataaaatgaacaaaacctcagagcccgggtcatcttctgcaggcggcagaactacatcggggccaccaaatcaccactcttcagccccatcccactccctgtttcgggcctcgtctgctgggaaagtcacttttccagtatgtctcctggcctcttatgatgagatttctggtcaaggagcgagctctcaggatacgaagacatttgacgttgcgctgtccgaggagctccatgcggcactgagtgagtggctgacagcgatccgggcttggttttgtaaggttccttcaagctaagccagctcagagaacacggggagcggtggtgctccacggacttcggagcatagagtggcgctgagtgagtggctgagaccgaccacggttcttgacttagtggaattgggtcgaaggagtggagaatgggagggctcgggctactgagagtggagatgggggcgggggtggtggtgaagagagttggagaaggaatggacgagttcttgagcaaaaggaggggaagagacaatctccagccacccgccccacgcttgacttcttatcactttggctgtggtgccgcctagtggaaaaaggaagtccctgcagcagtccccgcactctttaagcagctgtttaccgaaggcaccagttcagccaggagtgaaatccagagacgagcaacgccagcctgggtcacagtccatcaaaccccatgagcccgaccactctcgctcttccttacattcccacgtcccccttctctcccaacccctcatatcagcaagggaaattaattaatgagatttgataaatcagtagatagaatgaggtccccattctgaaatatttagcagactggaaccaccacgcaagcctctgtagggggtggatggagacacttctaactttaataaactgcgactgaacgtgg

SEQ ID NO: 32594 - DNA, 2025 bp, Homo sapiens
atccatttgttctcaagaggtagcaagaaacagtatccacagtggactccggggctcctacagacttggcacagcttcctacagtcttgaaacagccctgttgttctgtcatggccagtgggcagtttgtgaacaaactgcaagaggaagtgatctgccccatctgcctggacattctgcagaaacctgtcaccatcgactgtgggcacaatttctgcctcaaatgcatcactcagattggggaaacatcatgtggatttttcaaatgtcccctctgcaaaacttccgtaaggaagaacgcaatcaggttcaactcgctgttgcggaatctggtggagaaaatccaagctctacaagcctctgaggtgcagtccaaaaggaaagaggctacatgcccgaggcaccaggagatgttccactatttctgcgaggatgatgggaagttcctctgttttgtgtgttgtgaatccaaggaccacaaatcccataatgtcagcttgatcgaagaagctgcccagaattatcaggggcagattcaagagcagatccaagtcttgcagcaaaaggagaaggagacagtacaagtgaaggcacaaggtgtacacagggtcgatgtcttcacggaccaggtagaacatgagaagcaaaggatcctcacagaatttgaactcctgcatcaagtcctagaggaggagaagaatttcctgctatcacggatttactggctgggtcatgagggaacggaagcggggaaacactatgttgcctccactgagccacagttgaacgatctcaagaagctcgttgattccctgaagaccaagcagaacatgccacccaggcagctgctggagccagctcaaccacatcttcctagaagtgaagagtttcagtttctcaacccaacccctgttcctctggaactggagaaaaaactcagtgaagcaaaatcaagacacgactccatcacagggagcctgaaaaaattcaaagaccaactccaggctgataggaaaaaagatgaaaacagattcttcaaaagcatgaataaaaatgacatgaagagctggggcttgttacagaaaaataatcataaaatgaacaaaacctcagagcccgggtcatcttctgcaggcggcagaactacatcggggccaccaaatcaccactcttcagccccatcccactccctgtttcgggcctcgtctgctgggaaagtcacttttccagtatgtctcctggcctcttatgatgagatttctggtcaaggagcgagctctcaggatacgaagacatttgacgttgcgctgtccgaggagctccatgcggcactgagtgagtggctgacagcgatccgggcttggttttgtgaggttccttcaagctaagccagctcagagaacacggggagcggtggtgctacacggacttcggagcatagagtggcgctgagtgagtggctgagaccgaccacggttcttgacttagtggaattgggtcgaaggagtggagaatgggagggctcgggctactgagagtggagatgggggcgggggtggtggtgaagagagttggagaaggaatggacgagttcttgagcaaaaggaggggaagagacaatctccagccacccgccccacgcttgacttcttatcactttggctgtggtgccgcctagtggaaaaaggaagtccctgcagcagtccccgcactctttaagcagctgtttaccgaaggcaccagttcagccaggagtgaaatccggagaggagcaacgccagcctgggtcacagtccatcaaaccccatgagcccgaccactctcgctcttccttacattcccacgtcccccttctctcccaacccctcatatcagcaagggaaattaattaatgagatttgataaatcagtagatagaatgaggtccccattctgaaatatttagcagactggaaccaccacgcaagcctctgtagggggtggatggagacacttctaactttaataaactgcgactgaacgtgg

SEQ ID NO: 32595 - DNA, 1648 bp, Homo sapiens
atccatttgttctcaagaggtagcaagaaacagtatccacagtggactccggggctcctacagacttggcacagcttcctacagtcttgaaacagccctgttgttctgtcatggccagtgggcagtttgtgaacaaactgcaagaggaagtgatctgccccatctgcctggacattctgcagaaacctgtcaccatcgactgtgggcacaatttctgcctcaaatgcatcactcagattggggaaacatcatgtggatttttcaaatgtcccctctgcaaaacttccgtaaggaagaacgcaatcaggttcaactcgctgttgcggaatctggtggagaaaatccaagctctacaagcctctgaggtgcagtccaaaaggaaagaggctacatgcccgaggcaccaggagatgttccactatttctgcgaggatgatgggaagttcctctgttttgtgtgtcgtgaatccaaggaccacaaatcccataatgtcagcttgatcgaagaagctgcccagaattatcaggggcagattcaagagcagatccaagtcttgcagcaaaaggagaaggagacagtacaagtgaaggcacaaggtgtacacagggtcgatgtcttcacggaccaggtagaacatgagaagcaaaggatcctcacagaatttgaactcctgcatcaagtcctagaggaggagaagaatttcctgctatcacggatttactggctgggtcatgagggaacggaagcggggaaacactatgttgcctccactgagccacagttgaacgatctcaagaagctcgttgattccctgaagaccaagcagaacatgccacccaggcagctgctggaggatatcaaagtcgtcttgtgcagaagtgaagagtttcagtttctcaacccaacccctgttcctctagaactggagaaaaaactcagtgaagcaaaatcaagacacgactccatcacagggagcctgaaaaaattcaaagaccaactccaggctgataggaaaaaagatgaaaacagattcttcaaaagcatgaataaaaatgacatgaagagctggggcttgttacagaaaaataatcataaaatgaacaaaacctcagagcccgggtcatcttctgcaggcggcagaactacatcggggccaccaaatcaccactcttcagccccatcccactccctgtttcgggcctcgtctgctgggaaagtcacttttccagtatgtctcctggcctcttatgatgagatttctggtcaaggagcgagctctcaggatacgaagacatttgacgttgcgctgtccgaggagctccatgcggcactgagtgagtggctgacagcgatccgggcttggttttgtgaggttccttcaagctaagccagctcagagaacacggggagcggtggtgctacacggacttcggagcatagagtggcgctgatggaaaaaggaagtccctgcagcagtccccgcactctttaagcagctgtttaccgaaggcaccagttcagccaggagtgaaatccggagaggagcaacgccagcctgggtcacagtccatcaaaccccatgagcccgaccactctcgctcttccttacattcccacgtcccccttctctcccaacccctcatatca

SEQ ID NO: 32596 - DNA, 2025 bp, Homo sapiens
atccatttgttctcaagaggtagcaagaaacagtatccacagtggactccggggctcctacagacttggcacagcttcctacagtcttgaaacagccctgttgttctgtcatggccagtgggcagtttgtgaacaaactgcaagaggaagtgatctgccccatctgcctggacattctgcagaaacctgtcaccatcgactgtgggcacaatttctgcctcaaatgcatcactcagattggggaaacatcatgtggatttttcaaatgtcccctctgcaaaacttccgtaaggaagaacgcaatcaggttcaactcgctgttgcggaatctggtggagaaaatccaagctctacaagcctctgaggtgcagtccaaaaggaaagaggctacatgcccgaggcaccaggagatgttccactatttctgcgaggatgatgggaagttcctctgttttgtgtgtcgtgaatccaaggaccacaaatcccataatgtcagcttgatcgaagaagctgcccagaattatcaggggcagattcaagagcagatccaagtcttgcagcaaaaggagaaggagacagtacaagtgaaggcacaaggtgtacacagggtcgatgtcttcacggaccaggtagaacatgagaagcaaaggatcctcacagaatttgaactcctgcatcaagtcctagaggaggagaagaatttcctgctatcacggatttactggctgggtcatgagggaacggaagcggggaaacactatgttgcctccactgagccacagttgaacgatctcaagaagctcgttgattccctgaagaccaagcagaacatgccacccaggcagctgctggagccagctcaaccacatcttcctagaagtgaagagtttcagtttctcaacccaacccctgttcctctagaactggagaaaaaactcagtgaagcaaaatcaagacacgactccatcacagggagcctgaaaaaattcaaagaccaactccaggctgataggaaaaaagatgaaaacagattcttcaaaagcatgaataaaaatgacatgaagagctggggcttgttacagaaaaataatcataaaatgaacaaaacctcagagcccgggtcatcttctgcaggcggcagaactacatcggggccaccaaatcaccactcttcagccccatcccactccctgtttcgggcctcgtctgctgggaaagtcacttttccagtatgtctcctggcctcttatgatgagatttctggtcaaggagcgagctctcaggatacgaagacatttgacgttgcgctgtccgaggagctccatgcggcactgagtgagtggctgacagcgatccgggcttggttttgtgaggttccttcaagctaagccagctcagagaacacggggagcggtggtgctacacggacttcggagcatagagtggcgctgagtgagtggctgagaccgaccacggttcttgacttagtggaattgggtcgaaggagtggagaatgggagggctcgggctactgagagtggagatgggggcgggggtggtggtgaagagagttggagaaggaatggacgagttcttgagcaaaaggaggggaagagacaatctccagccacccgccccacgcttgacttcttatcactttggctgtggtgccgcctagtggaaaaaggaagtccctgcagcagtccccgcactctttaagcagctgtttaccgaaggcaccagttcagccaggagtgaaatccggagaggagcaacgccagcctgggtcacagtccatcaaaccccatgagcccgaccactctcgctcttccttacattcccacgtcccccttctctcccaacccctcatatcagcaagggaaattaattaatgagatttgataaatcagtagatagaatgaggtccccattctgaaatatttagcagactggaaccaccacgcaagcctctgtagggggtggatggagacacttctaactttaataaactgcgactgaacgtgg

SEQ ID NO: 32597 - DNA, 1648 bp, Homo sapiens
atccatttgttctcaagaggtagcaagaaacagtatccacagtggactccggggctcctacagacttggcacagcttcctacagtcttgaaacagccctgttgttctgtcatggccagtgggcagtttgtgaacaaactgcaagaggaagtgatctgccccatctgcctggacattctgcagaaacctgtcaccatcgactgtgggcacaatttctgcctcaaatgcatcactcagattggggaaacatcatgtggatttttcaaatgtcccctctgcaaaacttccgtaaggaagaacgcaatcaggttcaactcgctgttgcggaatctggtggagaaaatccaagctctacaagcctctgaggtgcagtccaaaaggaaagaggctacatgcccgaggcaccaggagatgttccactatttctgcgaggatgatgggaagttcctctgttttgtgtgttgtgaatccaaggaccacaaatcccataatgtcagcttgatcgaagaagctgcccagaattatcaggggcagattcaagagcagatccaagtcttgcagcaaaaggagaaggagacagtacaagtgaaggcacaaggtgtacacagggtcgatgtcttcacggaccaggtagaacatgagaagcaaaggatcctcacagaatttgaactcctgcatcaagtcctagaggaggagaagaatttcctgctatcacggatttactggctgggtcatgagggaacggaagcggggaaacactatgttgcctccactgagccacagttgaacgatctcaagaagctcgttgattccctgaagaccaagcagaacatgccacccaggcagctgctggaggatatcaaagtcgtcttgtgcagaagtgaagagtttcagtttctcaacccaacccctgttcctctggaactggagaaaaaactcagtgaagcaaaatcaagacacgactccatcacagggagcctgaaaaaattcaaagaccaactccaggctgataggaaaaaagatgaaaacagattcttcaaaagcatgaataaaaatgacatgaagagctggggcttgttacagaaaaataatcataaaatgaacaaaacctcagagcccgggtcatcttctgcaggcggcagaactacatcggggccaccaaatcaccactcttcagccccatcccactccctgtttcgggcctcgtctgctgggaaagtcacttttccagtatgtctcctggcctcttatgatgagatttctggtcaaggagcgagctctcaggatacgaagacatttgacgttgcgctgtccgaggagctccatgcggcactgagtgagtggctgacagcgatccgggcttggttttgtgaggttccttcaagctaagccagctcagagaacacggggagcggtggtgctacacggacttcggagcatagagtggcgctgatggaaaaaggaagtccctgcagcagtccccgcactctttaagcagctgtttaccgaaggcaccagttcagccaggagtgaaatccggagaggagcaacgccagcctgggtcacagtccatcaaaccccatgagcccgaccactctcgctcttccttacattcccacgtcccccttctctcccaacccctcatatca

SEQ ID NO: 32598 - DNA, 1648 bp, Homo sapiens
atccatttgttctcaagaggtagcaagaaacagtatccacagtggactccggggctcctacagacttggcacagcttcctacagtcttgaaacagccctgttgttctgtcatggccagtgggcagtttgtgaacaaactgcaagaggaagtgatctgccccatctgcctggacattctgcagaaacctgtcaccattgactgtgggcacaatttctgcctcaaatgcatcactcagattggggaaacatcatgtggatttttcaaatgtcccctctgcaaaacttccgtaaggaagaacgcaatcaggttcaactcgctgttgcggaatctggtggagaaaatccaagctctacaagcctctgaggtgcagtccaaaaggaaagaggctacatgcccgaggcaccaggagatgttccattatttctgcgaggatgatgggaagttcctctgttttgtgtgtcgtgaatccaaggaccacaaatcccataatgtcagcttgatcgaagaagctgcccagaattatcaggggcagattcaagagcagatccaagtcttgcagcaaaaggagaaggagacagtacaagtgaaggcacaaggtgtacacagggtcgatgtcttcacggaccaggtagaacatgagaagcaaaggatcctcacagaatttgaactcctgcatcaagtcctagaggaggagaagaatttcctgctatcacggatttactggctgggtcatgagggaacggaagcagggaaacactatgttgcctccactgagccacagttgaacgatctcaagaagctcattgattccctgaagaccaagcagaacatgccacccaggcagctgctggaggatatcaaagtcgtcttgtgcagaagtgaagagtttcagtttctcaacccaacccctgttcctctggaactggagaaaaaactcagtgaagcaaaatcaagacatgactccatcacagggagcctgaaaaaattcaaagaccaactccaggctgataggaaaaaagatgaaaacagattcttcaaaagcatgaataaaaatgacatgaagagctggggcttgttacagaaaaataatcataaaatgaacaaaacctcagagcccgggtcatcttctgcaggcggcagaactacatcggggccaccaaatcaccactcttcagccccatcccactccctgtttcgggcctcgtctgctgggaaagtcacttttccagtatgtctcctggcctcttatgatgagatttctggtcaaggagcgagctctcaggatacgaagacatttgacgttgcgctgtccgaggagctccatgcggcactgagtgagtggctgacagcgatccgggcttggttttgtaaggttccttcaagctaagccagctcagagaacacggggagcggtggtgctccacggacttcggagcatagagtggcgctgatggaaaaaggaagtccctgcagcagtccccgcactctttaagcagctgtttaccgaaggcaccagttcagccaggagtgaaatccagagacgagcaacgccagcctgggtcacagtccatcaaaccccatgagcccgaccactctcgctcttccttacattcccacgtcccccttctctcccaacccctcatatca

SEQ ID NO: 32599 - DNA, 2025 bp, Homo sapiens
atccatttgttctcaagaggtagcaagaaacagtatccacagtggactccggggctcctacagacttggcacagcttcctacagtcttgaaacagccctgttgttctgtcatggccagtgggcagtttgtgaacaaactgcaagaggaagtgatctgccccatctgcctggacattctgcagaaacctgtcaccatcgactgtgggcacaatttctgcctcaaatgcatcactcagattggggaaacatcatgtggatttttcaaatgtcccctctgcaaaacttccgtaaggaagaacgcaatcaggttcaactcgctgttgcggaatctggtggagaaaatccaagctctacaagcctctgaggtgcagtccaaaaggaaagaggctacatgcccgaggcaccaggagatgttccactatttctgcgaggatgatgggaagttcctctgttttgtgtgtcgtgaatccaaggaccacaaatcccataatgtcagcttgatcgaagaagctgcccagaattatcaggggcagattcaagagcagatccaagtcttgcagcaaaaggagaaggagacagtacaagtgaaggcacaaggtgtacacagggtcgatgtcttcacggaccaggtagaacatgagaagcaaaggatcctcacagaatttgaactcctgcatcaagtcctagaggaggagaagaatttcctgctatcacggatttactggctgggtcatgagggaacggaagcggggaaacactatgttgcctccactgagccacagttgaacgatctcaagaagctcgttgattccctgaagaccaagcagaacatgccacccaggcagctgctggagccagctcaaccacatcttcctagaagtgaagagtttcagtttctcaacccaacccctgttcctctggaactggagaaaaaactcagtgaagcaaaatcaagacacgactccatcacagggagcctgaaaaaattcaaagaccaactccaggctgataggaaaaaagatgaaaacagattcttcaaaagcatgaataaaaatgacatgaagagctggggcttgttacagaaaaataatcataaaatgaacaaaacctcagagcccgggtcatcttctgcaggcggcagaactacatcggggccaccaaatcaccactcttcagccccatcccactccctgtttcgggcctcgtctgctgggaaagtcacttttccagtatgtctcctggcctcttatgatgagatttctggtcaaggagcgagctctcaggatacgaagacatttgacgttgcgctgtccgaggagctccatgcggcactgagtgagtggctgacagcgatccgggcttggttttgtaaggttccttcaagctaagccagctcagagaacacggggagcggtggtgctccacggacttcggagcatagagtggcgctgagtgagtggctgagaccgaccacggttcttgacttagtggaattgggtcgaaggagtggagaatgggagggctcgggctactgagagtggagatgggggcgggggtggtggtgaagagagttggagaaggaatggacgagttcttgagcaaaaggaggggaagagacaatctccagccacccgccccacgcttgacttcttatcactttggctgtggtgccgcctagtggaaaaaggaagtccctgcagcagtccccgcactctttaagcagctgtttaccgaaggcaccagttcagccaggagtgaaatccagagacgagcaacgccagcctgggtcacagtccatcaaaccccatgagcccgaccactctcgctcttccttacattcccacgtcccccttctctcccaacccctcatatcagcaagggaaattaattaatgagatttgataaatcagtagatagaatgaggtccccattctgaaatatttagcagactggaaccaccacgcaagcctctgtagggggtggatggagacacttctaactttaataaactgcgactgaacgtgg

SEQ ID NO: 32600 - DNA, 1648 bp, Homo sapiens
atccatttgttctcaagaggtagcaagaaacagtatccacagtggactccggggctcctacagacttggcacagcttcctacagtcttgaaacagccctgttgttctgtcatggccagtgggcagtttgtgaacaaactgcaagaggaagtgatctgccccatctgcctggacattctgcagaaacctgtcaccatcgactgtgggcacaatttctgcctcaaatgcatcactcagattggggaaacatcatgtggatttttcaaatgtcccctctgcaaaacttccgtaaggaagaacgcaatcaggttcaactcgctgttgcggaatctggtggagaaaatccaagctctacaagcctctgaggtgcagtccaaaaggaaagaggctacatgcccgaggcaccaggagatgttccactatttctgcgaggatgatgggaagttcctctgttttgtgtgtcgtgaatccaaggaccacaaatcccataatgtcagcttgatcgaagaagctgcccagaattatcaggggcagattcaagagcagatccaagtcttgcagcaaaaggagaaggagacagtacaagtgaaggcacaaggtgtacacagggtcgatgtcttcacggaccaggtagaacatgagaagcaaaggatcctcacagaatttgaactcctgcatcaagtcctagaggaggagaagaatttcctgctatcacggatttactggctgggtcatgagggaacggaagcggggaaacactatgttgcctccactgagccacagttgaacgatctcaagaagctcgttgattccctgaagaccaagcagaacatgccacccaggcagctgctggaggatatcaaagtcgtcttgtgcagaagtgaagagtttcagtttctcaacccaacccctgttcctctggaactggagaaaaaactcagtgaagcaaaatcaagacacgactccatcacagggagcctgaaaaaattcaaagaccaactccaggctgataggaaaaaagatgaaaacagattcttcaaaagcatgaataaaaatgacatgaagagctggggcttgttacagaaaaataatcataaaatgaacaaaacctcagagcccgggtcatcttctgcaggcggcagaactacatcggggccaccaaatcaccactcttcagccccatcccactccctgtttcgggcctcgtctgctgggaaagtcacttttccagtatgtctcctggcctcttatgatgagatttctggtcaaggagcgagctctcaggatacgaagacatttgacgttgcgctgtccgaggagctccatgcggcactgagtgagtggctgacagcgatccgggcttggttttgtgaggttccttcaagctaagccagctcagagaacacggggagcggtggtgctacacggacttcggagcatagagtggcgctgatggaaaaaggaagtccctgcagcagtccccgcactctttaagcagctgtttaccgaaggcaccagttcagccaggagtgaaatccggagaggagcaacgccagcctgggtcacagtccatcaaaccccatgagcccgaccactctcgctcttccttacattcccacgtcccccttctctcccaacccctcatatca

SEQ ID NO: 32601 - DNA, 1648 bp, Homo sapiens; identical to SEQ ID NO: 32595

SEQ ID NO: 32602 - DNA, 3697 bp, Homo sapiens
ggcaggcgggtgggctgccggcggtggactcgtcggagccgcgggcggtcagctttagcaggaatttgaccctctagggcatgaatactgtgctgttcagttctgagctgtgctagcaatacccttcaaaggaagagcaatggctgcagcagcagcttctcacctgaacctggatgccctccgggaagtgctagaatgccccatctgcatggagtccttcacagaagagcagctgcgtcccaagcttctgcactgtggccataccatctgccgccagtgcctggagaagctattggccagtagcatcaatggtgtccgctgtcccttttgcagcaagattacccgcataaccagcttgacccagctgacagacaatctgacagtgctaaagatcattgatacagctgggctcagcgaggctgtggggctgctcatgtgtcggtcctgtgggcggcgtctgccccggcaattctgccggagctgtggtttggtgttatgtgagccctgccgggaggcagaccatcagcctcctggccactgtacactccctgtcaaagaagcagctgaggagcggcgtcgggactttggagagaagttaactcgtctgcgggaacttatgggggagctgcagcggcggaaggcagccttggaaggtgtctccaaggaccttcaggcaaggtataaagcagttctccaggagtatgggcatgaggagcgcagggtccaggatgagctggctcgctctcggaagttcttcacaggctctttggctgaagttgagaagtccaatagtcaagtggtagaggagcagagttacctgcttaacattgcagaggtgcaggctgtgtctcgctgtgactacttcctggccaagatcaagcaggcagatgtagcactactggaggagacagctgatgaggaggagccagagctcactgccagcttgcctcgggagctcaccctgcaagatgtggagctccttaaggtaggtcatgttggccccctccaaattggacaagctgttaagaagccccggacagttaacgtggaagattcctgggccatggaggccacagcgtctgctgcctctacctctgttacttttagagagatggacatgagcccggaggaagtggttgccagccctagggcctcacctgctaaacagcggggtcctgaggcagcctccaatatccagcagtgcctctttctcaagaagatgggggccaaaggcagcactccaggaatgttcaatcttccagtcagtctctacgtgaccagtcaaggtgaagtactagtcgctgaccgtggtaactatcgtatacaagtctttacccgcaaaggctttttgaaggaaatccgccgcagccccagtggcattgatagctttgtgctaagcttccttggggcagatctacccaacctcactcctctctcagtggcaatgaactgccaggggctgattggtgtgactgacagctatgataactccctcaaggtatataccttggatggccactgcgtggcctgtcacaggagccagctgagcaaaccatggggtatcacagccttgccatctggccagtttgtagtaaccgatgtggaaggtggaaagctttggtgtttcacagttgatcgaggatcaggggtggtcaaatacagctgcctatgtagtgctgtgcggcccaaatttgtcacctgtgatgctgagggcaccgtctacttcacccagggcttaggcctcaatctggagaatcggcagaatgagcaccacctggagggtggcttttccattggctctgtaggccctgatgggcagctgggtcgccagattagccacttcttctcggagaatgaggatttccgctgcattgctggcatgtgtgtggatgctcgtggtgatctcatcgtggctgacagtagtcgcaaggaaattctccattttcctaagggtgggggctatagtgtccttattcgagagggacttacctgtccggtgggcatagccctaactcctaaggggcagctgctggtcttggactgttgggatcattgcatcaagatctacagctaccatctgagaagatattccaccccataggggatgagaaattatcagtttcttctgctcccaagccaacttcccttcccttagttcttggttgttagtggcacatgcagaatagactcagcctatgtcctgattccagctgggtagttctagaacttcagaagctccatcttttaatgtttttatttgttatgtccccctccccgcttcccacctaaatttagagctttaaaagatgcactgcccaaataggacacacgatggtgttagctgaagtttgattagcaattaggcacttccaaggctttagtagagagagccactttagccctttgtgccatgtttgaaatttgcccttgtattaaatccttgattttttcccatttggctttgatgcccttgatccattgtttccttcctactataatgtgcttcatctgtgacactttctcttgaactctgattggattcactgtgcatgcttcagtgggatctgctccacctttcagtgacatttaagacatcatattcccgtaacattatgtctcagtctgatcgtctttaccagtatgaaagtcattcatttagtgctaccaaaggggatacacaagccctttaggaagcagtacctctcgcctggaggatctgtgccatcttggattgagaattgcagatgtgacagaatggattgaccctagttggttggtattgatgacttcagcctggaaattgcttgccttttaaagaagcatatatgggttggaattatgccaaagcataggaagctgggaataagcaaacaaatgctgatatagtcagcaaatttggatagtctctagggctcatcatttttcatactacctctctcttctggcctgtgtctaaggaattgtacaacataggccagggccaacaaagtggagaggtggacacattttcatgttcattactaaaacaaacagcaaaactattggtttgttattctgtgttttcctcaagtcagtacatactatttggtttcaggatttctttccatttctctatcaagcattaaataattgagaactgtttcttcatctctggtgttcatgtcttttaattaaatacggaattttggagatgataagagggataacctgcgctatgccattttgcttccttatctcactgtgttctttcagagtgtagatatctacccaggtcaaaattcagccaaaagcactattatgtaaagataataatccaaatctttctcccaaatacatgtgtacagaatcatcccccaaggtttagagtcaccaataccctattctgagcttctgctgtatgttttatgtttataattacagttcacaaaaaggaagttagtcttgtttttaagatcagaagtgggtgagaggacctgtgatgaggttcctgagggtttggtgtttactaagtaatatatcttactctaggtgcagggctgatggcaagccaaagagcaactgccttactttgatgtaaacaaaatttgctaaactgagctgctcaaaattgtttttatggtagtagtgtttctttggattgtatcataatagctgccaaaggataggtaaagaggtcattaaaatgatgttgaactag

SEQ ID NO: 32603 - DNA, 699 bp, Homo sapiens
gctgccggcggtggactcgtcggagccgcgggcggtcagatgagtgatggggaaagagcttttggaagtttgagttaattccttatggtcatgcagctaacaggaatttgaccctctagggcatgaatactgtgctgttcagttctgagctgtgctagcaatacccttcaaaggaagagcaatggctgcagcagcagcttctcacctgaacctggatgccctccgggaagtgctagaatgccccatctgcatggagtccttcacagaagagcagctgcgtcccaagcttctgcactgtggccataccatctgccgccagtgcctggagaagctattggccagtagcatcaatggtgtccgctgtcccttttgcagcaagattacccgcataaccagcttgacccagctgacagacaatctgacagtgctaaagatcattgatacagctgggctcagcgaggctgtggggctgctcatgtgtcggtcctgtgggcggcgtctgccccggcaattctgccggagctgtggtttggtgttatgtgagccctgccgggaggcagaccatcagcctcctggccactgtacactccctgtcaaagaagcagctgaggagcggcgtcgggactttggagagaagttaactcgtctgcgggaacttatgggggagctgcagcggcggaaggcagccttggaaggtgt

SEQ ID NO: 32604 - DNA, 3717 bp, Homo sapiens
ggtgctcaacggcgcgtgcgcagagggaggcaggcgggtgggctgccggcggtggactcgtcggagccgcgggcggtcagcaggaatttgaccctctagggcatgaatactgtgctgttcagttctgagctgtgctagcaatacccttcaaaggaagagcaatggctgcagcagcagcttctcacctgaacctggatgccctccgggaagtgctagaatgccccatctgcatggagtccttcacagaagagcagctgcgtcccaagcttctgcactgtggccataccatctgccgccagtgcctggagaagctattggccagtagcatcaatggtgtccgctgtcccttttgcagcaagattacccgcataaccagcttgacccagctgacagacaatctgacagtgctaaagatcattgatacagctgggctcagcgaggctgtggggctgctcatgtgtcggtcctgtgggcggcgtctgccccggcaattctgccggagctgtggtttggtgttatgtgagccctgccgggaggcagaccatcagcctcctggccactgtacactccctgtcaaagaagcagctgaggagcggcgtcgggactttggagagaagttaactcgtctgcgggaacttatgggggagctgcagcggcggaaggcagccttggaaggtgtctccaaggaccttcaggcaaggtataaagcagttctccaggagtatgggcatgaggagcgcagggtccaggatgagctggctcgctctcggaagttcttcacaggctctttggctgaagttgagaagtccaatagtcaagtggtagaggagcagagttacctgcttaacattgcagaggtgcaggctgtgtctcgctgtgactacttcctggccaagatcaagcaggcagatgtagcactactggaggagacagctgatgaggaggagccagagctcactgccagcttgcctcgggagctcaccctgcaagatgtggagctccttaaggtaggtcatgttggccccctccaaattggacaagctgttaagaagccccggacagttaacgtggaagattcctgggccatggaggccacagcgtctgctgcctctacctctgttacttttagagagatggacatgagcccggaggaagtggttgccagccctagggcctcacctgctaaacagcggggtcctgaggcagcctccaatatccagcagtgcctctttctcaagaagatgggggccaaaggcagcactccaggaatgttcaatcttccagtcagtctctacgtgaccagtcaaggtgaagtactagtcgctgaccgtggtaactatcgtatacaagtctttacccgcaaaggctttttgaaggaaatccgccgcagccccagtggcattgatagctttgtgctaagcttccttggggcagatctacccaacctcactcctctctcagtggcaatgaactgccaggggctgattggtgtgactgacagctatgataactccctcaaggtatataccttggatggccactgcgtggcctgtcacaggagccagctgagcaaaccatggggtatcacagccttgccatctggccagtttgtagtaaccgatgtggaaggtggaaagctttggtgtttcacagttgatcgaggatcaggggtggtcaaatacagctgcctatgtagtgctgtgcggcccaaatttgtcacctgtgatgctgagggcaccgtctacttcacccagggcttaggcctcaatctggagaatcggcagaatgagcaccacctggagggtggcttttccattggctctgtaggccctgatgggcagctgggtcgccagattagccacttcttctcggagaatgaggatttccgctgcattgctggcatgtgtgtggatgctcgtggtgatctcatcgtggctgacagtagtcgcaaggaaattctccattttcctaagggtgggggctatagtgtccttattcgagagggacttacctgtccggtgggcatagccctaactcctaaggggcagctgctggtcttggactgttgggatcattgcatcaagatctacagctaccatctgagaagatattccaccccataggggatgagaaattatcagtttcttctgctcccaagccaacttcccttcccttagttcttggttgttagtggcacatgcagaatagactcagcctatgtcctgattccagctgggtagttctagaacttcagaagctccatcttttaatgtttttatttgttatgtccccctccccgcttcccacctaaatttagagctttaaaagatgcactgcccaaataggacacacgatggtgttagctgaagtttgattagcaattaggcacttccaaggctttagtagagagagccactttagccctttgtgccatgtttgaaatttgcccttgtattaaatccttgattttttcccatttggctttgatgcccttgatccattgtttccttcctactataatgtgcttcatctgtgacactttctcttgaactctgattggattcactgtgcatgcttcagtgggatctgctccacctttcagtgacatttaagacatcatattcccgtaacattatgtctcagtctgatcgtctttaccagtatgaaagtcattcatttagtgctaccaaaggggatacacaagccctttaggaagcagtacctctcgcctggaggatctgtgccatcttggattgagaattgcagatgtgacagaatggattgaccctagttggttggtattgatgacttcagcctggaaattgcttgccttttaaagaagcatatatgggttggaattatgccaaagcataggaagctgggaataagcaaacaaatgctgatatagtcagcaaatttggatagtctctagggctcatcatttttcatactacctctctcttctggcctgtgtctaaggaattgtacaacataggccagggccaacaaagtggagaggtggacacattttcatgttcattactaaaacaaacagcaaaactattggtttgttattctgtgttttcctcaagtcagtacatactatttggtttcaggatttctttccatttctctatcaagcattaaataattgagaactgtttcttcatctctggtgttcatgtcttttaattaaatacggaattttggagatgataagagggataacctgcgctatgccattttgcttccttatctcactgtgttctttcagagtgtagatatctacccaggtcaaaattcagccaaaagcactattatgtaaagataataatccaaatctttctcccaaatacatgtgtacagaatcatcccccaaggtttagagtcaccaataccctattctgagcttctgctgtatgttttatgtttataattacagttcacaaaaaggaagttagtcttgtttttaagatcagaagtgggtgagaggacctgtgatgaggttcctgagggtttggtgtttactaagtaatatatcttactctaggtgcagggctgatggcaagccaaagagcaactgccttactttgatgtaaacaaaatttgctaaactgagctgctcaaaattgtttttatggtagtagtgtttctttggattgtatcataatagctgccaaaggataggtaaagaggtcattaaaatgatgttgaact

SEQ ID NO: 32605 - DNA, 8339 bp, Homo sapiens
ctgcggctggggctgggggcggcggcggcggcgacgcgggcggcgggcggcgcggggcggtccggcgggttcaaagaggaaaacatggcggaaaacaaaggcggcggcgaggctgagagcggcggcgggggcagcggcagcgcgccggtaactgccggggccgccgggcccgccgcgcaggaggcggagccgcctctcaccgcggtgctggtggaggaggaggaggaggaaggcggcagggccggcgctgagggcggcgcggccgggcccgacgacgggggggtggccgcggcctcctcgggctcggcccaggctgcttcatctcctgcggcctcagtgggcactggagttgccgggggcgcagtatcgacgccggctccagctccagcctcggctcccgctccgggtccctcggcagggccgcctcctggaccgccagcctcgctcctggacacctgcgccgtgtgtcagcagagcttgcagagccggcgtgaggcggagcccaagctgctgccctgtcttcactccttctgcctgcgctgcctgcccgagccggagcgccagctcagcgtgcccatcccggggggcagcaacggcgacatccagcaagttggtgtaatacggtgcccagtatgccgccaagaatgcagacagatagaccttgtggataattattttgtgaaagacacatctgaagctcctagcagttctgatgaaaaatcagaacaggtatgtactagttgtgaagacaatgcaagtgcagttggcttttgtgtagaatgtggagagtggctatgtaagacatgtatcgaagcacatcaaagagtaaaatttactaaagatcacttgatcaggaagaaagaagatgtctcagagtctgttggagcatctggtcaacgccctgttttctgccctgtacacaaacaagaacagttgaaacttttctgtgaaacatgtgatagattgacatgtagagactgtcagctattggaacacaaagaacataggtatcagtttttggaagaagcttttcaaaatcagaagggtgcaattgagaatctactggcgaaacttcttgagaagaagaattatgttcattttgcagctactcaggtgcagaataggataaaagaagtaaatgagactaacaaacgagtagaacaggaaattaaagtggccattttcacccttatcaatgaaattaataagaaaggaaaatctctcttacaacagctagagaatgttacaaaggaaagacagatgaagttactacagcagcagaatgacatcacaggcctttcccggcaggtgaagcatgttatgaacttcacaaattgggcaattgcaagtggcagcagcacagcactactatacagcaagcgactgattactttccagttgcgtcatattttgaaagcacggtgtgatcctgtccctgctgctaatggagcaatacgtttccattgtgatcccaccttctgggcaaagaatgtagtcaatttaggtaatctagtaatagagagtaaaccagctcctggttatactcctaatgttgtagttgggcaagttcctccagggacaaaccacattagtaaaacccctggacagattaacttagcacagcttcgactccagcacatgcaacaacaagtatatgcacagaaacatcagcagttgcaacagatgaggatgcagcaaccaccagcacctgtaccaactacaacaacaacaacacaacagcatcctagacaagcagcccctcagatgttacaacaacagcctcctcgattgatcagtgtgcaaacaatgcaaagaggcaacatgaactgtggagcttttcaagcccatcagatgagactggctcagaatgctgccagaataccagggatacccaggcacagcggccctcaatattccatgatgcagccacacctccaaagacaacactcaaacccagggcatgctggaccctttcccgtagtatcggtacacaacaccacaatcaacccaacgagccctactacagcaactatggcaaatgcaaaccgaggtcccaccagcccatctgttacagcaatagagctaatcccctcagttaccaatccagaaaaccttccatcgctgccagatattccacccatacagttggaagatgctggctcaagtagtttagataatctactaagtagatacatctcaggcagtcacctacccccacagcctacaagcaccatgaatccttctccaggtccctctgccctttctccgggatcatcaggtttatccaattctcacacacctgtgagacccccaagtacttctagtactggcagtcgaggcagctgtgggtcatcaggaagaactgctgagaagacaagtcttagtttcaaatctgatcaggtgaaggtcaagcaagaacctgggactgaagatgaaatatgtagcttttcaggaggtgtaaaacaagaaaaaacagaggatggcaggaggagtgcttgcatgttgagcagtcctgagagtagcttgacaccacctctctcaaccaacctgcatctagaaagtgaattggatgcattggcaagcctggaaaaccatgtgaaaattgaacctgcagatatgaatgaaagctgcaaacagtcagggctcagcagccttgttaatggaaagtccccaattcgaagcctcatgcacaggtcggcaaggattggaggagatggcaacaataaagatgatgacccaaatgaagactggtgtgctgtctgccaaaacggaggagatctcttgtgctgcgaaaaatgtccaaaggtctttcatctaacttgtcatgttccaacactacttagctttccaagtggggactggatatgcacattttgtagagatattggaaagccagaagttgaatatgattgtgataatttgcaacatagtaagaaggggaaaactgcgcaggggttaagccccgtggaccaaaggaaatgtgaacgtcttctgctttacctctattgccatgaattaagtattgaattccaggagcctgttcctgcttcgataccaaactactataaaattataaagaaaccaatggatttatccaccgtgaaaaagaagcttcagaaaaaacattcccaacactaccaaatcccggatgactttgtggccgatgtccgtttgatcttcaagaactgtgaaaggtttaatgaaatgatgaaagttgttcaagtttatgcagacacacaagagattaatttgaaggctgattcagaagtagctcaggcagggaaagcagttgcattgtactttgaagataaactcacagagatctactcagacaggaccttcgcacctttgccagagtttgagcaggaagaggatgatggtgaggtaactgaggactctgatgaagactttatacagccccgcagaaaacgcctaaagtcagatgagagaccagtacatataaagtaaaatgacatggatttaaatcaattgtttaaaaaaaaaaaaacgaaaaaaaaaaaaaaaacacaaaaaacccagaaaacttttaagtgttgctggaatatcctgcctacagtgggcacctccttgaagaagctgatagcttttacacagtattagattgaaataatggacagaaacacattcttgtcaagaaagggggagagaagtctgtttgcaagtttcaaagcaaaaagcaaaagtgaaatgatttgaggatttctgttctaatggagatgattctctgattgttagaaatggcaaatattgatgattgtgtgctattgattggtgcaggatacttggtatacgagtaaatacttgagactcgtgtcacttgataaattttctttttggactaggtcgcacagttattaaaacaacttttaaccctcccccttcacacacatacatatcaggttgttttctagttaaaaacccaagtagctcagattctactttaatgtcagtgcagatttgcattgaatcatgccattatgttttttctcatttttatgctgttgggtcttagtttttaaattgatataaagaactcagcaatggttttattttctactcatacttagggtttaggaaacactaccactagttatcatttaatcaacttcaatggtctactgaaacaaaaatggtaacttttcattagtggattatttagagttatagtagttgtttccagaaaacacttcctcacaattgtacttcccaatcaaatcatgtgatcatacagttattcccatgaaaggcagaatgtttgtttcaaaattaatctagttttctgtacatttaaatttgagaaggtgacaactggctcttttccagtcttccttcatgtcagttttctgatagaccactattggcaaacagtatctgtcaactaccaaatgtgtaaaattttctgtatttcactttgtcttatttgtaaatagtgaactaaaacttttggcagatcagcaacatttgctgagcctgttttttaagctaatgtgtattcttactaatgttcctatcaagaatggatttgtaatatatgctgtctatttctaatgttcacattcatattttgaggttctatcttattttaatagagaacagacttctcaaaaaatcttcagaagcagcttattattgaaatatcgaaatattgaaataaacccggtggggttagattactcatctgtccaccaagtgggacatttgcatggactgggggcttaaaggacttagaagagacctgtaagtaaatcctgaaaatgagccaatccccacttgaatggttactggagtaaacccacctttaccaccccaattacagcacccgaggccgataaaccaacttggctctggttcatttttcttttcttcatttgtgatgctcagattcaaaatgtgtgttctacactgttacaggcttctcttttgtttgattaaagattttagtcctacttttgtatggacacattagaatattcagagaccaaaatagaagaatttgctgttagatatttttcagaagtcagcagatttgtggcaaatcatttatttgcctttttaaaaattcatttaagcagttcagagagtagactactcagaaaattatttcacgtaattgtctaagaggtcaatattttttaatgcatattgaatcaaataaagtgctctaaagaaattattatacaaattcctttgggttgtttttcttttcttaacaaggggtgggggtaaacaggaatatgattcaggctttctggttgtgtatttaaagagtattgattttattattactattgatttactttattcctggcttccttttcacttttctttcaatttttaaaaaataatttaagccgttgaaaatataccaaactgttgaaacattttactcaaattttaaattcctaaaaatgttttttaataagagggagaaaattatttaaaaatacttatgcctatgccaatttccctcttttttcacaaaatccatgatttcagtttgtaagtagacatatatctaagggcacatttttggaaagtgaggaatagcagcagtataacttcattttgtcaggcctttgagttctaatattttgtattgctcttcaaatggatccttttaaaaaaattgtagataatgagtcataaatagattctgccaactgaggggagaaacattttaagtaaatatttttcagtatttggggccttaaaaaataattgtgtttccttaaaattacatgttagatagagtttttaggtttttttggttttaagattggttaaagcaatttaaaagccacttttttgtcaacatttaatagcctccacttctgttaagataatgtatactgctgaggaattactattaatagctatcaacataccaccattaaattaaggtattcactttagattttttattaaagcttttttcttgcacactgatcgttgtgtttctaagctgattttttcagctctaatatacctatggttaaaaagtataaaaacttaaattgatatttagatatatgttttcctattagtttatgttttaaaaagacaaaattgtatctgtcagtccctgaaggcagtttgtttttatactctctcacatttgtatttgttttttaaatggcagtattttagaagatttggagaaaagtccacataataatgttttcttaaaagcttttaaagtttttgctgtacttcaatttacttcttccatcagaaaactaagaacaaagtgttgctcagtctgttccgctgacctaaatttgtgttttcagcacttggctcagccaattcactgagtgaaggaattgctttatgaggcaaagcatgtgaaagttctaaagtatggttagattgtaggtcgtgctctatatggaaacatcaaaccattactacagagaaatgataaggcattggatccactattgaaattattatttttggatcaacaagttggtactttctgacttctgtatcttaacataagggaattttaggtaatgctaagtcagttgtctcattttttgtgataagttttggaatttttagttaattgaaataaataatgcttttaaatagaagtaaaaggtttataagtgtgcaaattgtagatttatcaattacctcagcaggtatcctgccatgtaattattagtgattagtgttaataagataatagattcaggtcttccaactatgcccttggattgtggcctactgtatgttattaaatggtctcttactatccaaaatgggagtagatgctgtggccccgtctcccttggcttttacgtcccatatccacccccattcatgtacaacatgtgaaatataaaaatctcatttcttgtcaaaatcagcactgcttatttgcatactcagcatcggatcagtgagtagttttataaaaaatccacgcacccaactcccttagttaaaacagattcttaattcataccatgaattcttaatttctgtaccatctatgttaatgatctgctgaaggtgactcaagattttcaaggtgtaatacagtttgatcatgtaccggacctggatatttaattttttttccctcacagttaatctcctccttgataaagcaataacactgctttgagtctgttgcctaatagcatgtcagaatcctctcctggatggtgattttataggaaagtttgtatgcatatcacccagtctatcttttaaaaattaagaaatttaaatgtatgctggaagtaatgacactatattgtggcattttattttaaaaattggggaaagttgcatatttttttaaaagtaagtgtttgagtaaaaaaattgaaggtacttttttaaggaaaaaaatttatatgccacagtttacatagacatttcagattcaacacgtactcttgaatataatggtttcttttacttggtcaaaatgcatgtatagcatttctttcatcttagttccttgtgtttgcctatgtggtcctttatatattttttattgtatcgaagaaacaaaactatcttcaaaaataagttaatttggatatatttgtcatatcaaactacaaagtgtacaaagttaagtttagcccttttctagaaagtgatctttaaaattaaaaatgctcctcttttaaattcaccaaatttatgtgtgggaaggcaccaaaatgattttgtaagtgccactgcaatattccctttcaagtgtggcctaaatttcaatcttaaggatggaatgcatgtctgctccttgttctgaaaaatgtaggcatctactacattttaaaacacagtgaaacatatacataagcctataaaaaaagatttgtgcaatttgaaagcctgttaattttttatgtagacatacctacacacgaaagggttaaattcacagccttactagttccttgcttccagtatttcaattggtctcctcccctcattattattattactactagtactattatttttgcacatagttaactgcccttcaatatgattcttaaaaagtgctgtttctgtggtatcgtattctctaaataatcatatttaattttttaaaacaaggttgcagtttctaattgtttcgttcctgtgtttttgctggtgtgtaataaaagcaagttttttcttttcatggttatttaatacattagctgcctgtaaataattcttgttataatgctctggaatgtgttgtagaagttgtattagattagttttaaacccttgtttgaaagccacattgttttggttatttctattaaattagaaaattgaaaaagttttcaaatgaa

SEQ ID NO: 32606 - DNA, 3457 bp, Homo sapiens
ctgcggctggggctgggggcggcggcggcggcgacgcgggcggcgggcggcgcggggcggtccggcgggttcaaagaggaaaacatggcggaaaacaaaggcggcggcgaggctgagagcggcggcgggggcagcggcagcgcgccggtaactgccggggccgccgggcccgccgcgcaggaggcggagccgcctctcaccgcggtgctggtggaggaggaggaggaggaaggcggcagggccggcgctgagggcggcgcggccgggcccgacgacgggggggtggccgcggcctcctcgggctcggcccaggctgcttcatctcctgcggcctcagtgggcactggagttgccgggggcgcagtatcgacgccggctccagctccagcctcggctcccgctccgggtccctcggcagggccgcctcctggaccgccagcctcgctcctggacacctgcgccgtgtgtcagcagagcttgcagagccggcgtgaggcggagcccaagctgctgccctgtcttcactccttctgcctgcgctgcctgcccgagccggagcgccagctcagcgtgcccatcccggggggcagcaacggcgacatccagcaagttggtgtaatacggtgcccagtatgccgccaagaatgcagacagatagaccttgtggataattattttgtgaaagacacatctgaagctcctagcagttctgatgaaaaatcagaacaggtatgtactagttgtgaagacaatgcaagtgcagttggcttttgtgtagaatgtggagagtggctatgtaagacatgtatcgaagcacatcaaagagtaaaatttactaaagatcacttgatcaggaagaaagaagatgtctcagagtctgttggagcatctggtcaacgccctgttttctgccctgtacacaaacaagaacagttgaaacttttctgtgaaacatgtgatagattgacatgtagagactgtcagctattggaacacaaagaacataggtatcagtttttggaagaagcttttcaaaatcagaagggtgcaattgagaatctactggcgaaacttcttgagaagaagaattatgttcattttgcagctactcaggtgcagaataggataaaagaagtaaatgagactaacaaacgagtagaacaggaaattaaagtggccattttcacccttatcaatgaaattaataagaaaggaaaatctctcttacaacagctagagaatgttacaaaggaaagacagatgaagttactacagcagcagaatgacatcacaggcctttcccggcaggtgaagcatgttatgaacttcacaaattgggcaattgcaagtggcagcagcacagcactactatacagcaagcgactgattactttccagttgcgtcatattttgaaagcacggtgtgatcctgtccctgctgctaatggagcaatacgtttccattgtgatcccaccttctgggcaaagaatgtagtcaatttaggtaatctagtaatagagagtaaaccagctcctggttatactcctaatgttgtagttgggcaagttcctccagggacaaaccacattagtaaaacccctggacagattaacttagcacagcttcgactccagcacatgcaacaacaagtatatgcacagaaacatcagcagttgcaacagatgaggatgcagcaaccaccagcacctgtaccaactacaacaacaacaacacaacagcatcctagacaagcagcccctcagatgttacaacaacagcctcctcgattgatcagtgtgcaaacaatgcaaagaggcaacatgaactgtggagcttttcaagcccatcagatgagactggctcagaatgctgccagaataccagggatacccaggcacagcggccctcaatattccatgatgcagccacacctccaaagacaacactcaaacccagggcatgctggaccctttcccgtagtatcggtacacaacaccacaatcaacccaacgagccctactacagcaactatggcaaatgcaaaccgaggtcccaccagcccatctgttacagcaatagagctaatcccctcagttaccaatccagaaaaccttccatcgctgccagatattccacccatacagttggaagatgctggctcaagtagtttagataatctactaagtagatacatctcaggcagtcacctacccccacagcctacaagcaccatgaatccttctccaggtccctctgccctttctccgggatcatcaggtttatccaattctcacacacctgtgagacccccaagtacttctagtactggcagtcgaggcagctgtgggtcatcaggaagaactgctgagaagacaagtcttagtttcaaatctgatcaggtgaaggtcaagcaagaacctgggactgaagatgaaatatgtagcttttcaggaggtgtaaaacaagaaaaaacagaggatggcaggaggagtgcttgcatgttgagcagtcctgagagtagcttgacaccacctctctcaaccaacctgcatctagaaagtgaattggatgcattggcaagcctggaaaaccatgtgaaaattgaacctgcagatatgaatgaaagctgcaaacagtcagggctcagcagccttgttaatggaaagtccccaattcgaagcctcatgcacaggtcggcaaggattggaggagatggcaacaataaagatgatgacccaaatgaagactggtgtgctgtctgccaaaacggaggagatctcttgtgctgcgaaaaatgtccaaaggtctttcatctaacttgtcatgttccaacactacttagctttccaagtggggactggatatgcacattttgtagagatattggaaagccagaagttgaatatgattgtgataatttgcaacatagtaagaaggggaaaactgcgcaggggttaagccccgtggaccaaaggaaatgtgaacgtcttctgctttacctctattgccatgaattaagtattgaattccaggagcctgttcctgcttcgataccaaactactataaaattataaagaaaccaatggatttatccaccgtgaaaaagaagcttcagaaaaaacattcccaacactaccaaatcccggatgactttgtggccgatgtccgtttgatcttcaagaactgtgaaaggtttaatgaagctgattcagaagtagctcaggcagggaaagcagttgcattgtactttgaagataaactcacagagatctactcagacaggaccttcgcacctttgccagagtttgagcaggaagaggatgatggtgaggtaactgaggactctgatgaagactttatacagccccgcagaaaacgcctaaagtcagatgagagaccagtacatataaagtaaaatgacatggatttaaatcaattgtttaaaaaaaaaaaaa

SEQ ID NO: 32607 - DNA, 2706 bp, Homo sapiens
agtctgttggagcatctggtcaacgccctgttttctgccctgtacacaaacaagaacagttgaaacttttctgtgaaacatgtgatagattgacatgtagagactgtcagctattggaacacaaagaacataggtatcagtttttggaagaagcttttcaaaatcagaagggtgcaattgagaatctactggcgaaacttcttgagaagaagaattatgttcattttgcagctactcaggtgcagaataggataaaagaagtaaatgagactaacaaacgagtagaacaggaaattaaagtggccattttcacccttatcaatgaaattaataagaaaggaaaatctctcttacaacagctagagaatgttacaaaggaaagacagatgaagttactacagcagcagaatgacatcacaggcctttcccggcaggtgaagcatgttatgaacttcacaaattgggcaattgcaagtggcagcagcacagcactactatacagcaagcgactgattactttccagttgcgtcatattttgaaagcacggtgtgatcctgtccctgctgctaatggagcaatacgtttccattgtgatcccaccttctgggcaaagaatgtagtcaatttaggtaatctagtaatagagagtaaaccagctcctggttatactcctaatgttgtagttgggcaagttcctccagggacaaaccacattagtaaaacccctggacagattaacttagcacagcttcgactccagcacatgcaacaacaagtatatgcacagaaacatcagcagttgcaacagatgaggatgcagcaaccaccagcacctgtaccaactacaacaacaacaacacaacagcatcctagacaagcagcccctcagatgttacaacaacagcctcctcgattgatcagtgtgcaaacaatgcaaagaggcaacatgaactgtggagcttttcaagcccatcagatgagactggctcagaatgctgccagaataccagggatacccaggcacagcggccctcaatattccatgatgcagccacacctccaaagacaacactcaaacccagggcatgctggaccctttcccgtagtatcggtacacaacaccacaatcaacccaacgagccctactacagcaactatggcaaatgcaaaccgaggtcccaccagcccatctgttacagcaatagagctaatcccctcagttaccaatccagaaaaccttccatcgctgccagatattccacccatacaggcaaacgttgttccgatgatgcactcctggtatgagtttggagccagagagaagacccaggaccaaaatgtgttggaagatgctggctcaagtagtttagataatctactaagtagatacatctcaggcagtcacctacccccacagcctacaagcaccatgaatccttctccaggtccctctgccctttctccgggatcatcaggtttatccaattctcacacacctgtgagacccccaagtacttctagtactggcagtcgaggcagctgtgggtcatcaggaagaactgctgagaagacaagtcttagtttcaaatctgatcaggtgaaggtcaagcaagaacctgggactgaagatgaaatatgtagcttttcaggaggtgtaaaacaagaaaaaacagaggatggcaggaggagtgcttgcatgttgagcagtcctgagagtagcttgacaccacctctctcaaccaacctgcatctagaaagtgaattggatgcattggcaagcctggaaaaccatgtgaaaattgaacctgcagatatgaatgaaagctgcaaacagtcagggctcagcagccttgttaatggaaagtccccaattcgaagcctcatgcacaggtcggcaaggattggaggagatggcaacaataaagatgatgacccaaatgaagactggtgtgctgtctgccaaaacggaggagatctcttgtgctgcgaaaaatgtccaaaggtctttcatctaacttgtcatgttccaacactacttagctttccaagtggggactggatatgcacattttgtagagatattggaaagccagaagttgaatatgattgtgataatttgcaacatagtaagaaggggaaaactgcgcaggggttaagccccgtggaccaaaggaaatgtgaacgtcttctgctttacctctattgccatgaattaagtattgaattccaggagcctgttcctgcttcgataccaaactactataaaattataaagaaaccaatggatttatccaccgtgaaaaagaagcttcagaaaaaacattcccaacactaccaaatcccggatgactttgtggccgatgtccgtttgatcttcaagaactgtgaaaggtttaatgaaatgatgaaagttgttcaagtttatgcagacacacaagagattaatttgaaggctgattcagaagtagctcaggcagggaaagcagttgcattgtactttgaagataaactcacagagatctactcagacaggaccttcgcacctttgccagagtttgagcaggaagaggatgatggtgaggtaactgaggactctgatgaagactttatacagccccgcagaaaacgcctaaagtcagatgagagaccagtacatataaagtaaaatgacatggatttaaatcaattgtttaaaaaaaaaaaaa

SEQ ID NO: 32608 - DNA, 2708 bp, Homo sapiens
aagaagatgtctcagagtctgttggagcatctggtcaacgccctgttttctgccctgtacacaaacaagaacagttgaaacttttctgtgaaacatgtgatagattgacatgtagagactgtcagctattggaacacaaagaacataggtatcagtttttggaagaagcttttcaaaatcagaagggtgcaattgagaatctactggcgaaacttcttgagaagaagaattatgttcattttgcagctactcaggtgcagaataggataaaagaagtaaatgagactaacaaacgagtagaacaggaaattaaagtggccattttcacccttatcaatgaaattaataagaaaggaaaatctctcttacaacagctagagaatgttacaaaggaaagacagatgaagttactacagcagcagaatgacatcacaggcctttcccggcaggtgaagcatgttatgaacttcacaaattgggcaattgcaagtggcagcagcacagcactactatacagcaagcgactgattactttccagttgcgtcatattttgaaagcacggtgtgatcctgtccctgctgctaatggagcaatacgtttccattgtgatcccaccttctgggcaaagaatgtagtcaatttaggtaatctagtaatagagagtaaaccagctcctggttatactcctaatgttgtagttgggcaagttcctccagggacaaaccacattagtaaaacccctggacagattaacttagcacagcttcgactccagcacatgcaacaacaagtatatgcacagaaacatcagcagttgcaacagatgaggatgcagcaaccaccagcacctgtaccaactacaacaacaacaacacaacagcatcctagacaagcagcccctcagatgttacaacaacagcctcctcgattgatcagtgtgcaaacaatgcaaagaggcaacatgaactgtggagcttttcaagcccatcagatgagactggctcagaatgctgccagaataccagggatacccaggcacagcggccctcaatattccatgatgcagccacacctccaaagacaacactcaaacccagggcatgctggaccctttcccgtagtatcggtacacaacaccacaatcaacccaacgagccctactacagcaactatggcaaatgcaaaccgaggtcccaccagcccatctgttacagcaatagagctaatcccctcagttaccaatccagaaaaccttccatcgctgccagatattccacccatacaggcaaacgttgttccgatgatgcactcctggtatgagtttggagccagagagaagacccaggaccaaaatgtgttggaagatgctggctcaagtagtttagataatctactaagtagatacatctcaggcagtcacctacccccacagcctacaagcaccatgaatccttctccaggtccctctgccctttctccgggatcatcaggtttatccaattctcacacacctgtgagacccccaagtacttctagtactggcagtcgaggcagctgtgggtcatcaggaagaactgctgagaagacaagtcttagtttcaaatctgatcaggtgaaggtcaagcaagaacctgggactgaagatgaaatatgtagcttttcaggaggtgtaaaacaagaaaaaacagaggatggcaggaggagtgcttgcatgttgagcagtcctgagagtagcttgacaccacctctctcaaccaacctgcatctagaaagtgaattggatgcattggcaagcctggaaaaccatgtgaaaattgaacctgcagatatgaatgaaagctgcaaacagtcagggctcagcagccttgttaatggaaagtccccaattcgaagcctcatgcacaggtcggcaaggattggaggagatggcaacaataaagatgatgacccaaatgaagactggtgtgctgtctgccaaaacggaggagatctcttgtgctgcgaaaaatgtccaaaggtctttcatctaacttgtcatgttccaacactacttagctttccaagtggggactggatatgcacattttgtagagatattggaaagccagaagttgaatatgattgtgataatttgcaacatagtaagaaggggaaaactgcgcaggggttaagccccgtggaccaaaggaaatgtgaacgtcttctgctttacctctattgccatgaattaagtattgaattccaggagcctgttcctgcttcgataccaaactactataaaattataaagaaaccaatggatttatccaccgtgaaaaagaagcttcagaaaaaacattcccaacactaccaaatcccggatgactttgtggccgatgtccgtttgatcttcaagaactgtgaaaggtttaatgaaatgatgaaagttgttcaagtttatgcagacacacaagagattaatttgaaggctgattcagaagtagctcaggcagggaaagcagttgcattgtactttgaagataaactcacagagatctactcagacaggaccttcgcacctttgccagagtttgagcaggaagaggatgatggtgaggtaactgaggactctgatgaagactttatacagccccgcagaaaacgcctaaagtcagatgagagaccagtacatataaagtaaaatgacatggatttaaatcaattgttt

SEQ ID NO: 32609 - DNA, 3025 bp, Homo sapiens
agggatcccctgcctttctcggaacggaacggagcagagtcgtgcgtggttgagtttagataaaagccgagtgagcgcgctctgttccttaagattagtttaaggtgccttggattgctctgaagagctttgaccacctgatattgcttacatctggaacttcttggcttctcattccccagatgtgcgggtcagagaggattctacaggcaggaaacatcttagaaatcagggttgggcaggcaggagccaggagagtagctacaatgacttcaccagtactggtggacatacgagaagaggtgacctgccctatctgcctggagctcctaacagaacccctgagcatagactgtggccacagcttctgccaagcctgcatcacaccaaatggcagggaatcagtgattggtcaagaaggggaaagaagctgccctgtgtgccagaccagctaccagccagggaacctgcggcctaatcggcatctggccaacatagtgaggcggctcagagaggtagtgttgggccctgggaagcagctgaaagcagttctttgtgcagaccatggagaaaaactgcagctcttctgtcaggaggatgggaaggtcatttgctggctttgtgagcggtctcaggagcaccgtggtcaccacacgttcctcgtggaggaggttgcccaggagtaccaggagaagtttcaggagtctctaaagaagctgaagaacgaggagcaggaagctgagaagctaacagcttttatcagagagaagaaaacatcctggaagaatcagatggagcctgagagatgcaggatccagacagagtttaatcagctgcgaaatatcctagacagagtggagcaacgggagctgaaaaagctggaacaggaagagaagaaggggctacgaattatagaagaggctgagaatgatctggtccaccagacccagtcgctgcgagagctcatctcggatctggagcgtcgatgtcaggggtcaacaatggagctgctgcaggatgtgagtgatgtcacagaaaggagtgagttctggaccctgaggaagccagaagctctccctacaaagctgagaagtatgttccgagccccagatctgaaaaggatgctgcgagtgtgtagagagctgacagatgtccaaagctactgggccatccaggggtctttaaccagaagagagaggagagcctcaggagttaggaccagaagaagccagggaagcagtgcaatggcttcaaaaatcttgcttaacgtacaagaggaggtgacctgtcccatctgcctggagctgttgacagaacccttgagtctagactgtggccacagcctctgccgagcctgcatcactgtgagcaacaaggaggcagtgaccagcatgggaggaaaaagcagctgtcctgtgtgtggtatcagttactcatttgaacatctacaggctaatcagcatctggccaacatagtggagagactcaaggaggtcaagttgagcccagacaatgggaagaagagagatctctgtgatcatcatggagagaaactcctactcttctgtaaggaggataggaaagtcatttgctggctttgtgagcggtctcaggagcaccgtggtcaccacacagtcctcacggaggaagtattcaaggaatgtcaggagaaactccaggcagtcctcaagaggctgaagaaggaagaggaggaagctgagaagctggaagctgacatcagagaagagaaaacttcctggaagtatcaggtacaaactgagagacaaaggatacaaacagaatttgatcagcttagaagcatcctaaataatgaggagcagagagagctgcaaagattggaagaagaagaaaagaagacgctggataagtttgcagaggctgaggatgagctagttcagcagaagcagttggtgagagagctcatctcagatgtggagtgtcggagtcagtggtcaacaatggagctgctgcaggacatgagtggaatcatgaaatggagtgagatctggaggctgaaaaagccaaaaatggtttccaagaaactgaagactgtattccatgctccagatctgagtaggatgctgcaaatgtttagagaactgacagctgtccggtgctactgggtggatgtcacactgaattcagtcaacctaaatttgaatcttgtcctttcagaagatcagagacaagtgatatctgtgccaatttggccttttcagtgttataattatggtgtcttgggatcccaatatttctcctctgggaaacattactgggaagtggacgtgtccaagaaaactgcctggatcctgggggtatactgtagaacatattcccgccatatgaagtatgttgttagaagatgtgcaaatcgtcaaaatctttacaccaaatacagacctctatttggctactgggttatagggttacagaataaatgtaagtatggtgtctttgaagagtctttgtcctctgatcccgaggttttgactctctccatggctgtgcctccctgccgtgttggggttttcctcgactatgaagcaggcattgtctcatttttcaatgtcacaagccatggctccctcatttacaagttctctaaatgttgcttttctcagcctgtttatccatatttcaatccttggaactgtccagctcccatgactctatgcccaccaagctcttgaattttctcatttcttcacctacaaccctttgtcttgacttatctcctgcaactgactcatctgcaacattcacaccattgcttccttgtggtttcccttctttagaacttttactcatccttgagatgtatggtgtatttggcttgagttatgagagatgcttatttattcatttactctttttcatattttcagagaaagttacctaatccctcctaaagacacagcagtatgggtataacatccttgccttcccatttatccatgtttcactttatcactgatatgaagaggcccaaagcctgttagccacc

SEQ ID NO: 32610 - DNA, 2311 bp, Homo sapiens
tgaatgaatcctgaccacacccaccctggcttttcttcacctcttcaaccaggagccgagatttctgttgctctgaagccatccaggggtctttaaccagaagagagaggagagcctcaggagttaggaccagaagaagccagggaagcagtgcaatggcttcaaaaatcttgcttaacgtacaagaggaggtgacctgtcccatctgcctggagctgttgacagaacccttgagtctagactgtggccacagcctctgccgagcctgcatcactgtgagcaacaaggaggcagtgaccagcatgggaggaaaaagcagctgtcctgtgtgtggtatcagttactcatttgaacatctacaggctaatcagcatctggccaacatagtggagagactcaaggaggtcaagttgagcccagacaatgggaagaagagagatctctgtgatcatcatggagagaaactcctactcttctgtaaggaggataggaaagtcatttgctggctttgtgagcggtctcaggagcaccgtggtcaccacacagtcctcacggaggaagtattcaaggaatgtcaggagaaactccaggcagtcctcaagaggctgaagaaggaagaggaggaagctgagaagctggaagctgacatcagagaagagaaaacttcctggaagtatcaggtacaaactgagagacaaaggatacaaacagaatttgatcagcttagaagcatcctaaataatgaggagcagagagagctgcaaagattggaagaagaagaaaagaagacgctggataagtttgcagaggctgaggatgagctagttcagcagaagcagttggtgagagagctcatctcagatgtggagtgtcggagtcagtggtcaacaatggagctgctgcaggacatgagtggaatcatgaaatggagtgagatctggaggctgaaaaagccaaaaatggtttccaagaaactgaagactgtattccatgctccagatctgagtaggatgctgcaaatgtttagagaactgacagctgtccggtgctactgggtggatgtcacactgaattcagtcaacctaaatttgaatcttgtcctttcagaagatcagagacaagtgatatctgtgccaatttggccttttcagtgttataattatggtgtcttgggatcccaatatttctcctctgggaaacattactgggaagtggacgtgtccaagaaaactgcctggatcctgggggtatactgtagaacatattcccgccatatgaagtatgttgttagaagatgtgcaaatcgtcaaaatctttacaccaaatacagacctctatttggctactgggttatagggttacagaataaatgtaagtatggtgtctttgaagagtctttgtcctctgatcccgaggttttgactctctccatggctgtgcctccctgccgtgttggggttttcctcgactatgaagcaggcattgtctcatttttcaatgtcacaagccatggctccctcatttacaagttctctaaatgttgcttttctcagcctgtttatccatatttcaatccttggaactgtccagctcccatgactctatgcccaccaagctcttgaattttctcatttcttcacctacaaccctttgtcttgacttatctcctgcaactgactcatctgcaacattcacaccattgcttccttgtggtttcccttctttagaacttttactcatccttgagatgtatggtgtatttggcttgagttatgagagatgcttatttattcatttactctttttcatattttcagagaaagttacctaatccctcctaaagacacagcagtatgggtataacatccttgccttcccatttatccatgtttcactttatcactgatatgaagaggcccaaagcctgttagccaccatccatgctacctaggtagtccataggaaccacccccatgaccaccaccaacatcaactaaaggttcttggagggtatgtcagtgtgttgctcaggataccccaggtacatcaaggaatcaaggagaggaaaatatgagcaatatgtgtattcagagtgaagattttatgtccagagtatttgagctcaaaccttgcctgttgttttctaatcatgatgaatactttctcagtttctttttcctgaaatataaattgggatttaagactgtacctaactattaagatcactgtgtaaaactaagtgtctctaaatgtaatgcatcgatttagtgtctggaacataataaatatttgctctcatgattgctaaaaa

SEQ ID NO: 32611 - DNA, 2151 bp, Homo sapiens
atggcttcaaaaatcttgcttaacgtacaagaggaggtgacctgtcccatctgcctggagctgttgacagaacccttgagtctagactgtggccacagcctctgccgagcctgcatcactgtgagcaacaaggaggcagtgaccagcatgggaggaaaaagcagctgtcctgtgtgtggtatcagttactcatttgaacatctacaggctaatcagcatctggccaacatagtggagagactcaaggaggtcaagttgagcccagacaatgggaagaagagagatctctgtgatcatcatggagagaaactcctactcttctgtaaggaggataggaaagtcatttgctggctttgtgagcggtctcaggagcaccgtggtcaccacacagtcctcacggaggaagtattcaaggaatgtcaggagaaactccaggcagtcctcaagaggctgaagaaggaagaggaggaagctgagaagctggaagctgacatcagagaagagaaaacttcctggaagtatcaggtacaaactgagagacaaaggatacaaacagaatttgatcagcttagaagcatcctaaataatgaggagcagagagagctgcaaagattggaagaagaagaaaagaagacgctggataagtttgcagaggctgaggatgagctagttcagcagaagcagttggtgagagagctcatctcagatgtggagtgtcggagtcagtggtcaacaatggagctgctgcaggacatgagtggaatcatgaaatggagtgagatctggaggctgaaaaagccaaaaatggtttccaagaaactgaagactgtattccatgctccagatctgagtaggatgctgcaaatgtttagagaactgacagctgtccggtgctactgggtggatgtcacactgaattcagtcaacctaaatttgaatcttgtcctttcagaagatcagagacaagtgatatctgtgccaatttggccttttcagtgttataattatggtgtcttgggatcccaatatttctcctctgggaaacattactgggaagtggacgtgtccaagaaaactgcctggatcctgggggtatactgtagaacatattcccgccatatgaagtatgttgttagaagatgtgcaaatcgtcaaaatctttacaccaaatacagacctctatttggctactgggttatagggttacagaataaatgtaagtatggtgtctttgaagagtctttgtcctctgatcccgaggttttgactctctccatggctgtgcctccctgccgtgttggggttttcctcgactatgaagcaggcattgtctcatttttcaatgtcacaagccatggctccctcatttacaagttctctaaatgttgcttttctcagcctgtttatccatatttcaatccttggaactgtccagctcccatgactctatgcccaccaagctcttgaattttctcatttcttcacctacaaccctttgtcttgacttatctcctgcaactgactcatctgcaacattcacaccattgcttccttgtggtttcccttctttagaacttttactcatccttgagatgtatggtgtatttggcttgagttatgagagatgcttatttattcatttactctttttcatattttcagagaaagttacctaatccctcctaaagacacagcagtatgggtataacatccttgccttcccatttatccatgtttcactttatcactgatatgaagaggcccaaagcctgttagccaccatccatgctacctaggtagtccataggaaccacccccatgaccaccaccaacatcaactaaaggttcttggagggtatgtcagtgtgttgctcaggataccccaggtacatcaaggaatcaaggagaggaaaatatgagcaatatgtgtattcagagtgaagattttatgtccagagtatttgagctcaaaccttgcctgttgttttctaatcatgatgaatactttctcagtttctttttcctgaaatataaattgggatttaagactgtacctaactattaagatcactgtgtaaaactaagtgtctctaaatgtaatgcatcgatttagtgtctggaacataataaatatttgctctcatgattgct

SEQ ID NO: 32612 - DNA, 2493 bp, Homo sapiens
gtgatctcggctcactgcaacctctgtctcctgggttcaagcgatcctcctgtctcagcctcccgagtaactgggattacaggcgcccaccaccatgcccggctaatttttgtatttttgtagacagggtttcgacatgttggccaggctggtctcaaactcctgacctcaagtgatccacccgcctcagcctcccaaagtgctgggattacaggtgtgagccactgcgcccgtcctgactcatgcaacttctgcttcagccatccaggggtctttaaccagaagagagaggagagcctcaggagttaggaccagaagaagccagggaagcagtgcaatggcttcaaaaatcttgcttaacgtacaagaggaggtgacctgtcccatctgcctggagctgttgacagaacccttgagtctagactgtggccacagcctctgccgagcctgcatcactgtgagcaacaaggaggcagtgaccagcatgggaggaaaaagcagctgtcctgtgtgtggtatcagttactcatttgaacatctacaggctaatcagcatctggccaacatagtggagagactcaaggaggtcaagttgagcccagacaatgggaagaagagagatctctgtgatcatcatggagagaaactcctactcttctgtaaggaggataggaaagtcatttgctggctttgtgagcggtctcaggagcaccgtggtcaccacacagtcctcacggaggaagtattcaaggaatgtcaggagaaactccaggcagtcctcaagaggctgaagaaggaagaggaggaagctgagaagctggaagctgacatcagagaagagaaaacttcctggaagtatcaggtacaaactgagagacaaaggatacaaacagaatttgatcagcttagaagcatcctaaataatgaggagcagagagagctgcaaagattggaagaagaagaaaagaagacgctggataagtttgcagaggctgaggatgagctagttcagcagaagcagttggtgagagagctcatctcagatgtggagtgtcggagtcagtggtcaacaatggagctgctgcaggacatgagtggaatcatgaaatggagtgagatctggaggctgaaaaagccaaaaatggtttccaagaaactgaagactgtattccatgctccagatctgagtaggatgctgcaaatgtttagagaactgacagctgtccggtgctactgggtggatgtcacactgaattcagtcaacctaaatttgaatcttgtcctttcagaagatcagagacaagtgatatctgtgccaatttggccttttcagtgttataattatggtgtcttgggatcccaatatttctcctctgggaaacattactgggaagtggacgtgtccaagaaaactgcctggatcctgggggtatactgtagaacatattcccgccatatgaagtatgttgttagaagatgtgcaaatcgtcaaaatctttacaccaaatacagacctctatttggctactgggttatagggttacagaataaatgtaagtatggtgtctttgaagagtctttgtcctctgatcccgaggttttgactctctccatggctgtgcctccctgccgtgttggggttttcctcgactatgaagcaggcattgtctcatttttcaatgtcacaagccatggctccctcatttacaagttctctaaatgttgcttttctcagcctgtttatccatatttcaatccttggaactgtccagctcccatgactctatgcccaccaagctcttgaattttctcatttcttcacctacaaccctttgtcttgacttatctcctgcaactgactcatctgcaacattcacaccattgcttccttgtggtttcccttctttagaacttttactcatccttgagatgtatggtgtatttggcttgagttatgagagatgcttatttattcatttactctttttcatattttcagagaaagttacctaatccctcctaaagacacagcagtatgggtataacatccttgccttcccatttatccatgtttcactttatcactgatatgaagaggcccaaagcctgttagccaccatccatgctacctaggtagtccataggaaccacccccatgaccaccaccaacatcaactaaaggttcttggagggtatgtcagtgtgttgctcaggataccccaggtacatcaaggaatcaaggagaggaaaatatgagcaatatgtgtattcagagtgaagattttatgtccagagtatttgagctcaaaccttgcctgttgttttctaatcatgatgaatactttctcagtttctttttcctgaaatataaattgggatttaagactgtacctaactattaagatcactgtgtaaaactaagtgtctctaaatgtaatgcatcgatttagtgtctggaacataataaatatttgctctcatgattgctaaaaa

SEQ ID NO: 32613 - DNA, 4050 bp, Homo sapiens
tggttaacagcttatgggcggggagctcggcaaaactcagactaaaaacagaaaaagagaaaagaaaggacaaattcgatacacccgcgtcggtcctccagagtttgtgaaggggtgtaaacatgtcggagtctggggagatgagtgaatttggctacatcatggaattgatagctaaaggcaaggttaccattaagaatatcgaaagggagctcatttgcccagcatgcaaggagctgtttacccacccattgattctcccttgccaacatagtatctgtcataaatgtgtaaaagaactcctgctgactctcgatgattcattcaacgatgtgggatcagacaactccaatcaaagcagtcctcgacttcggctcccctcccctagtatggataaaattgaccgaattaacagaccaggctggaagcgcaattcattgaccccgaggacaactgttttcccttgccctggctgtgagcatgatgtggatcttggagaacgaggaatcaatggtctgtttcgaaacttcactttggaaactattgtggaaagatatcgtcaagcagctagggcagccacagccattatgtgtgacctttgtaaaccaccacctcaagaatccacaaaaagctgcatggactgtagtgcaagttactgcaatgaatgcttcaaaattcatcacccttggggtactataaaagctcaacatgagtatgttggtccaactactaacttcagacccaagattttaatgtgcccagaacatgaaacagagagaataaacatgtactgtgaattatgtaggaggccagtttgccatctgtgtaagttgggtggtaatcatgccaaccaccgtgtaaccactatgagcagtgcctacaaaaccttaaaggaaaagctttcaaaggatattgattaccttattggtaaggaaagccaggtgaagagtcaaatatctgaactaaacttgttaatgaaagaaacagagtgtaatggagagagggctaaagaagaagcaattacacattttgaaaagctctttgaagttctggaagagaggaaatcatctgttttgaaagcaattgactcctctaagaaactaagattagacaaatttcagactcaaatggaagagtaccagggacttctagagaacaatggacttgtgggatatgctcaagaagtgctaaaggagacagatcagtcttgctttgtgcagacagcaaagcagctccacctcagaatacagaaagccacagaatctttgaagagctttagacctgcagctcagacttcttttgaagactatgttgttaatacctctaaacaaacagaacttcttggagaattatcctttttctctagtggcatagacgtgccagagatcaatgaggaacagagcaaagtttataacaatgccttgataaattggcaccatccagaaaaggataaagctgatagctatgttcttgaatatcggaaaatcaatagagatgatgaaatgtcatggaatgagatagaagtgtgtggaacaagtaaaataattcaagacttggaaaacagtagtacctatgctttcagagtaagagcttacaagggttcaatctgtagtccttgcagcagagaattgattcttcatactcctccagctccagttttcagcttcctctttgatgaaaaatgtggctataataatgaacacctcctgctgaacttgaagagagaccgtgtagagagtagagctggatttaatcttctgcttgctgcagaacgcatccaagtgggttattacacaagcttagactacatcattggagatactggcattacaaaaggaaaacacttctgggccttccgtgtggaaccatattcatacctggtaaaagtgggagttgcttctagcgataaactacaagaatggctccgttctccccgggatgcagttagtccaagatatgagcaagacagtgggcatgacagtggaagtgaggatgcctgttttgattcttcacaaccatttaccttagttactataggcatgcagaaattttttatacccaagtcacctacttcttctaatgaacctgaaaatagagttctccctatgccaacaagtattgggattttccttgactgtgataaaggcaaagtagatttctatgatatggatcagatgaaatgcctttatgaacgccaagtggactgttcacatacactgtatccagcatttgcattaatgggcagtggaggaattcagcttgaagaacccatcacagcaaaatatctggaataccaagaggacatgtagttgaaacatctgatgtgactcaggataaaaactgtaaacaaagcaatgccttagcgttaaccttcgtaactaattacatatcgctgagtgttctgtcaccccacttgtgtttgagtatgattcttcttgaaatacagaaaatctaaacagccttgtgtcttcatgtcgttgttctgcctttcacaaatgatgaaagtgaagatgttctttccaagttaatactgaagtggttaactttgcaactggactgtcttttactttatgtacaggatatctaatttatttctgtcagctggtgttgctgacactttccttatggtgggggggatacaaaagtatttattatgattctcttctgtttgacttttcatttttatatcatgtttatgtcctaagagaagatattttttaaatgccttatggataggaattagtactaagcaatgtgtcttgcatttgttttcaataggaaaacaaagttctagataggttaaaagaaaaacaccataaaagtggtagtatatttaagtggaaaattatgtattttaaagtgtgtaactattaaaaatatattgcctggaaaaggaatactactgttttgttttgttaagaccacaaactgtattgctaaggacattttaagagtctgcttagccataacactcatttaacagcatgggtagtaagcatggtttcttgcagaaaacacaaagttctcagctaacacattaaacttctcactttatatactttttttcagagaaatttatctttagtttttcttattctgtgaaaatatttgttcttatgtcaaagaattatttttcagatatattggtaaagatggactgatattaaaagtcatatttattcttttacccccttactgtgttttgtgattttcatttttggcccaattattacatatcaggttttcctgatttatatttacatgtttgaaaagttcattatatattttagtagcgttacatatattataaatttttgtaacatttaaatgttcacttatgtggcattttctgtttctcattggtaataagcatttctaatataagcaagtaaaaatacaaatttaattacttagaaatgataactaagatcacaatgactgtgtaccctttaaaatatcttttaatttgaggaattacattctatctaaattgtgtgtctgtttttgaaaggtgttgctttcaagtaggtggtttttatttaaagtacttatttttttgaggttaaaatattcagaaactacttttatgcattgtagcagtaatcatttatggaatgcttttgacatgttttaacagggtaaccaaaacttttaggcctgttttttttggttgtccttgttgttatatttttaatggaaatctgttactcaggctggtagcattaaattagctttttaccctcaactcaagtagcaaatatcatggagaacttcagtgtttagcaggctgttaatttcccatctatgaatagcactttatgatgtaggctaaactaagcaaataatgcagcgttatgtggatcattatgcaataaagctgctaaagtcacatttgtggttgatactcaagccttgtacaagcacatatgatgtagacatttttaaatgtgaagctttaacaggaataggatagctgtttcaaaccttgtgcaattgtaaataaattgtttagctgtgtttctttcatttttaataaaaaattaaaaagaa

SEQ ID NO: 32614 - DNA, 1322 bp, Homo sapiens
gatggggcttttttccagatcttcgcgccgagagccggggacggccaacctgccggcatgcgataaaggccggggaatgtctagctggggccgcgctgagccgagtgcggacccgctttgtgtgcgcgtttgtttgtctccgctgcggtccgaaccgctgccgcgacccccgaggaggcggggcctccgcgcgcccggctccgcctggtgagggtttcacggcctctgctgccgccgccgccgccctcgtttgttccgttagatcgcgcagccccgaccgctgcacccggatcctagcaagccgggcgaggctgcccgggagccctcgatggccttcatttcacccaagcccgcttcttgctttccccggcgcttcccctcttttcctggttaacagcttatgggcggggagctcggcaaaactcagactaaaaacagaaaaagagaaaagaaaggacaaattcgatacacccgcgtcggtcctccagagtttgtgaaggggtgtaaacatgtcggagtctggggagatgagtgaatttggctacatcatggaattgatagctaaaggcaaggcttcagcaatgggcctgcagcaaacccatgagcattcccggttgacttctaaaggtggagaggcccgctgtccctttgaaatctctgaggttggaaagcagtctctcccaagaagaacttaggacaattcctctctctgttttgtgggggttggagggggagagttggtctggagtaggctcctaaccatttcaacgtaagcttatttcctaccactctcctcaggctcaaatcctgccccgccccgcagccccagcactagcccatttaagacccctgttttgtgtgtgattatacaggatttgaacactgaatattaaccatggaatagcagacctttgagactgacttgctttattttcctctgtggggttcggttccactttgtagttcgggtttgtaatgtaaagaataatgggaaactggtctaattatgagagttaagagagtagaggcctgtagttggcctgccctccgccccaccatccctcaaagttgagaccactgagttaaccatcctcttaatttctctcacttttcccccagatttgtttcatccttgtactggacttctcaagctctgtacataattaaaaatacatagctttacatttttacaaacttaatacctggaatatatgcttgttgtaaagtattcaaacttcacagaaaggttcacagagtaaaaagtctaagttcatgcccacctccaatctcattccttccccagtggcagcagtttgtgtgtc

SEQ ID NO: 32615 - DNA, 693 bp, Homo sapiens
gatggggcttttttccagatcttcgcgccgagagccggggacggccaacctgccggcatgcgataaaggccggggaatgtctagctggggccgcgctgagccgagtgcggacccgctttgtgtgcgcgtttgtttgtctccgctgcggtccgaaccgctgccgcgacccccgaggaggcggggcctccgcgcgcccggctccgcctggtgagggtttcacggcctctgctgccgccgccgccgccctcgtttgttccgttagatcgcgcagccccgaccgctgcacccggatcctagcaagccgggcgaggctgcccgggagccctcgatggccttcatttcacccaagcccgcttcttgctttccccggcgcttcccctcttttcctggttaacagcttatgggcggggagctcggcaaaactcagactaaaaacagaaaaagagaaaagaaaggacaaattcgatacacccgcgtcggtcctccagagtttgtgaaggggtgtaaacatgtcggagtctggggagatgagtgaatttggctacatcatggaattgatagctaaaggcaagatgccggattggagacgaggctaccgctgcagacagggctgtgggaagacgacggaacttgccacagcgacagacttctcccaaacaggaaataaaagtgggaagcattttaaaacctaaa

SEQ ID NO: 32616 - DNA, 4508 bp, Homo sapiens
acagcgtcctgcgcgcatgcgcttcgcagcttctctcgccgccgcgcccccagctgctctggttacggttggtgtttgcgaattctctgcggcaccttcttcgctgaactccaccgtcagttccataggcgcgcgcccgcgtcacgtgggccgaggttccggcgcggctgctggccggcggctgagccgggagaaaggagctgcggccaccgttcgccctacttctgcgcctcggggcgggcgcgccggtaaaaatggcgaaatgggggtaggcggcgctggacctgaagagatggggcgcgcaggtggggcggttgtcagagccccctgacgtgggcgccgggcttttatcggcgatttgatctggcgacctcgggccggcgcctaagaggtcagactgcggagcctgcgggtcgccagcggccccgccgagagccggaggcaatggatgaacagagcgtggagagcattgctgaggttttccgatgtttcatttgtatggagaaattgcgggatgcacgcctgtgtcctcattgctccaaactgtgttgtttcagctgtattaggcgctggctgacagagcagagagctcaatgtcctcattgccgtgctccactccagctacgagaactagtaaattgtcgttgggcagaagaagtaacacaacagcttgatactcttcaactctgcagtctcaccaaacatgaagaaaatgaaaaggacaaatgtgaaaatcaccatgaaaaacttagtgtattttgctggacttgtaagaagtgtatctgccatcagtgtgcactttggggaggaatgcatggcggacatacctttaaacctttggcagaaatttatgagcaacacgtcactaaagtgaatgaagaggtagccaaacttcgtcggcgtctcatggaactgatcagcttagttcaagaagtggaaaggaatgtagaagctgtaagaaatgcaaaagatgagcgtgttcgggaaattaggaatgcagtggagatgatgattgcacggttagacacacagctgaagaataagcttataacactgatgggtcagaagacatctctaacccaagaaacagagcttttggaatccttacttcaggaggtggagcaccagttgcggtcttgtagtaagagtgagttgatatctaagagctcagagatccttatgatgtttcagcaagttcatcggaagcccatggcatcttttgttaccactcctgttccaccagactttaccagtgaattagtgccatcttacgattcagctacttttgttttagagaatttcagcactttgcgtcagagagcagatcctgtttacagtccacctcttcaagtttcaggactttgctggaggttaaaagtttacccagatggaaatggagttgtgcgaggttactacttatctgtgtttctggagctctcagctggcttgcctgaaacttctaaatatgaatatcgtgtagagatggttcaccagtcctgtaatgatcctacaaaaaatatcattcgagaatttgcatctgactttgaagttggagaatgctggggctataatagatttttccgtttggacttactcgcaaatgaaggatacttgaatccacaaaatgatacagtgattttaaggtttcaggtacgttcaccaactttctttcaaaaatcccgggaccagcattggtacattactcagttggaagctgcacagactagttatatccaacaaataaacaaccttaaagagagacttactattgagctgtctcgaactcagaagtcaagagatttgtcaccaccagataaccatcttagcccccaaaatgatgatgctctggagacacgagctaagaagtctgcatgctctgacatgcttctcgaaggtggtcctactacagcttctgtaagagaggccaaagaggatgaagaagatgaggagaagattcagaatgaagattatcatcacgagctttcagatggagatctggatctggatcttgtttatgaggatgaagtaaatcagctcgatggcagcagttcctctgctagttccacagcaacaagtaatacagaagaaaatgatattgatgaagaaactatgtctggagaaaatgatgtggaatataacaacatggaattagaagagggagaactcatggaagatgcagctgctgcaggacccgcaggtagtagccatggttatgtgggttccagtagtagaatatcaagaagaacacatttatgctccgctgctaccagtagtttactagacattgatccattaattttaatacatttgttggaccttaaggaccggagcagtatagaaaatttgtggggcttacagcctcgcccacctgcttcacttctgcagcccacagcatcatattctcgaaaagataaagaccaaaggaagcaacaggcaatgtggcgagtgccctctgatttaaagatgctaaaaagactcaaaactcaaatggccgaagttcgatgtatgaaaactgatgtaaagaatacactttcagaaataaaaagcagcagtgctgcttctggagacatgcagacaagccttttttctgctgaccaggcagctctggctgcatgtggaactgaaaactctggcagattgcaggatttgggaatggaactcctggcaaagtcatcagttgccaattgttacatacgaaactccacaaataagaagagtaattcgcccaagccagctcgatccagtgtagcaggtagtctatcacttcgaagagcagtggaccctggagaaaatagtcgttcaaagggagactgtcagactctgtctgaaggctccccaggaagctctcagtctgggagcaggcacagttctccccgagccttgatacatggcagtatcggtgatattctgccaaaaactgaagaccggcagtgtaaagctttggattcagatgctgttgtggttgcagttttcagtggcttgcctgcggttgagaaaaggaggaaaatggtcaccttgggggctaatgctaaaggaggtcatctggaaggactgcagatgactgatttggaaaataattctgaaactggagagttacagcctgtactacctgaaggagcttcagctgcccctgaagaaggaatgagtagcgacagtgacattgaatgtgacactgagaatgaggagcaggaagagcataccagtgtgggcgggtttcacgactccttcatggtcatgacacagcccccggatgaagatacacattccagttttcctgatggtgaacaaataggccctgaagatctcagcttcaatacagatgaaaatagtggaaggtaattgccaaatcaagagaactgacttgcaagctaccttgaccctgaattttgctgtagttggtgctcaaatttgtcatcagtcagataatcagatttggtcttatttcttcattatctcgacctgaaatagtaatttggaaactgttggaaggtggcacagtttagtctaagacagcagtagtacatgggaaaaacagtatgggaagagttctttgtaatgtaaggaaataacaatgtagttctctattaatttagcaaatttgtacattcacaaaaggcagtttgtctactacagcagaaggctggttaactgccagaaaatgtacctccaggccctgcatgccgtcagtaacccgcccggcattggtgctctactgtctttggctagagcttagttgtgtttaaataatcatctttatatttggggttttaattacagttccattagtgcctgtagattagtgaacagaaaattgctttggaagagattctgccctgtagacactatgtgaataactgaagtaacactagactgaatctcctttttggagtatgtatcttctctcacttgttcaagtacaggcacactgttcaaccgcatggtatctttctgttgtgtgacttctacaaatgtaattttaaatgaaattaagttaacatggattcattacgttcctggccctgtagacacgtgtaagattatttaaaattctttcatttttttctgcctcttactatacgactgtagtgcaacaaatattttaaagcccccttttcttctttattttcattagttgtacattgatttcagtgtcaacacatttaaagattcattcatgttgcacagtggcttacatgaacgtgaaactgtgatataaggttttctttcatactcataattagcccaaaacagttgccaaactttgccattgtgctcctgcatttgtgtttgagctgctatatatttgtggaaattacactgaaagttgactaagagactattgaaaaagcatgaataattaaatatacatgtgagagacatctcatctgctgtattttacttagtgaatattgttcactcttccgtgtctgatgtcttgctgaatgctgtgactcatagtttacttttgttcaaaatagtttgcactttttgttaataaaatcaacttg

SEQ ID NO: 32617 - DNA, 4391 bp, Homo sapiens
acagcgtcctgcgcgcatgcgcttcgcagcttctctcgccgccgcgcccccagctgctctggttacggttggtgtttgcgaattctctgcggcaccttcttcgctgaactccaccgtcagttccataggcgcgcgcccgcgtcacgtgggccgaggttccggcgcggctgctggccggcggctgagccgggagaaaggagctgcggccaccgttcgccctacttctgcgcctcggggcgggcgcgccggtaaaaatggcgaaatgggggtaggcggcgctggacctgaagagatggggcgcgcaggtggggcggttgtcagagccccctgacgtgggcgccgggcttttatcggcgatttgatctggcgacctcgggccggcgcctaagaggtcagactgcggagcctgcgggtcgccagcggccccgccgagagccggaggcaatggatgaacagagcgtggagagcattgctgaggttttccgatgtttcatttgtatggagaaattgcgggatgcacgcctgtgtcctcattgctccaaactgtgttgtttcagctgtattaggcgctggctgacagagcagagagctcaatgtcctcattgccgtgctccactccagctacgagaactagtaaattgtcgttgggcagaagaagtaacacaacagcttgatactcttcaactctgcagtctcaccaaacatgaagaaaatgaaaaggacaaatgtgaaaatcaccatgaaaaacttagtgtattttgctggacttgtaagaagtgtatctgccatcagtgtgcactttggggaggaatgcatggcggacatacctttaaacctttggcagaaatttatgagcaacacgtcactaaagtgaatgaagaggtagccaaacttcgtcggcgtctcatggaactgatcagcttagttcaagaagtggaaaggaatgtagaagctgtaagaaatgcaaaagatgagcgtgttcgggaaattaggaatgcagtggagatgatgattgcacggttagacacacagctgaagaataagcttataacactgatgggtcagaagacatctctaacccaagaaacagagcttttggaatccttacttcaggaggtggagcaccagttgcggtcttgtagtaagagtgagttgatatctaagagctcagagatccttatgatgtttcagcaagttcatcggaagcccatggcatcttttgttaccactcctgttccaccagactttaccagtgaattagtgccatcttacgattcagctacttttgttttagagaatttcagcactttgcgtcagagagcagatcctgtttacagtccacctcttcaagtttcaggactttgctggaggttaaaagtttacccagatggaaatggagttgtgcgaggttactacttatctgtgtttctggagctctcagctggcttgcctgaaacttctaaatatgaatatcgtgtagagatggttcaccagtcctgtaatgatcctacaaaaaatatcattcgagaatttgcatctgactttgaagttggagaatgctggggctataatagatttttccgtttggacttactcgcaaatgaaggatacttgaatccacaaaatgatacagtgattttaaggtttcaggtacgttcaccaactttctttcaaaaatcccgggaccagcattggtacattactcagttggaagctgcacagactagttatatccaacaaataaacaaccttaaagagagacttactattgagctgtctcgaactcagaagtcaagagatttgtcaccaccagataaccatcttagcccccaaaatgatgatgctctggagacacgagctaagaagtctgcatgctctgacatgcttctcgaaggtggtcctactacagcttctgtaagagaggccaaagaggatgaagaagatgaggagaagattcagaatgaagattatcatcacgagctttcagatggagatctggatctggatcttgtttatgaggatgaagtaaatcagctcgatggcagcagttcctctgctagttccacagcaacaagtaatacagaagaaaatgatattgatgaagaaactatgtctggagaaaatgatgtggaatataacaacatggaattagaagagggagaactcatggaagatgcagctgctgcaggacccgcaggtagtagccatggttatgtgggttccagtagtagaatatcaagaagaacacatttatgctccgctgctaccagtagtttactagacattgatccattaattttaatacatttgttggaccttaaggaccggagcagtatagaaaatttgtggggcttacagcctcgcccacctgcttcacttctgcagcccacagcatcatattctcgaaaagataaagaccaaaggaagcaacaggcaatgtggcgagtgccctctgatttaaagatgctaaaaagactcaaaactcaaatggccgaagttcgatgtatgaaaactgatgtaaagaatacactttcagaaataaaaagcagcagtgctgcttctggagacatgcagacaagccttttttctgctgaccaggcagctctggctgcatgtggaactgaaaactctggcagattgcaggatttgggaatggaactcctggcaaagtcatcagttgccaattgttacatacgaaactccacaaataagaagagtaattcgcccaagccagctcgatccagtgtagcaggtagtctatcacttcgaagagcagtggaccctggagaaaatagtcgttcaaagggagactgtcagactctgtctgaaggctccccaggaagctctcagtctgggagcaggcacagttctccccgagccttgatacatggcagtatcggtgatattctgccaaaaactgaagaccggcagtgtaaagctttggattcagatgctgttgtggttgcagttttcagtggcttgcctgcggttgagaaaaggaggaaaatggtcaccttgggggctaatgctaaaggaggtcatctggaaggactgcagatgactgatttggaaaataattctgaaactggagagttacagcctgtactacctgaaggagcttcagctgcccctgaagaagatacacattccagttttcctgatggtgaacaaataggccctgaagatctcagcttcaatacagatgaaaatagtggaaggtaattgccaaatcaagagaactgacttgcaagctaccttgaccctgaattttgctgtagttggtgctcaaatttgtcatcagtcagataatcagatttggtcttatttcttcattatctcgacctgaaatagtaatttggaaactgttggaaggtggcacagtttagtctaagacagcagtagtacatgggaaaaacagtatgggaagagttctttgtaatgtaaggaaataacaatgtagttctctattaatttagcaaatttgtacattcacaaaaggcagtttgtctactacagcagaaggctggttaactgccagaaaatgtacctccaggccctgcatgccgtcagtaacccgcccggcattggtgctctactgtctttggctagagcttagttgtgtttaaataatcatctttatatttggggttttaattacagttccattagtgcctgtagattagtgaacagaaaattgctttggaagagattctgccctgtagacactatgtgaataactgaagtaacactagactgaatctcctttttggagtatgtatcttctctcacttgttcaagtacaggcacactgttcaaccgcatggtatctttctgttgtgtgacttctacaaatgtaattttaaatgaaattaagttaacatggattcattacgttcctggccctgtagacacgtgtaagattatttaaaattctttcatttttttctgcctcttactatacgactgtagtgcaacaaatattttaaagcccccttttcttctttattttcattagttgtacattgatttcagtgtcaacacatttaaagattcattcatgttgcacagtggcttacatgaacgtgaaactgtgatataaggttttctttcatactcataattagcccaaaacagttgccaaactttgccattgtgctcctgcatttgtgtttgagctgctatatatttgtggaaattacactgaaagttgactaagagactattgaaaaagcatgaataattaaatatacatgtgagagacatctcatctgctgtattttacttagtgaatattgttcactcttccgtgtctgatgtcttgctgaatgctgtgactcatagtttacttttgttcaaaatagtttgcactttttgttaataaaatcaacttg

SEQ ID NO: 32618 - DNA, 3548 bp, Homo sapiens
gaattctctgcggcaccttcttcgctgaactccaccgtcagttccataggcgcgcgcccgcgtcacgtgggccgaggttccggcgcggctgctggccggcggctgagccgggagaaaggagctgcggccaccgttcgccctacttctgcgcctcggggcgggcgcgccggtaaaaatggcgaaatgggggtaggcggcgctggacctgaagagatggggcgcgcaggtggggcggttgtcagagccccctgacgtgggcgccgggcttttatcggcgatttgatctggcgacctcgggccggcgcctaagaggtcagactgcggagcctgcgggtcgccagcggccccgccgagagccggaggcaatggatgaacagagcgtggagcgctggctgacagagcagagagctcaatgtcctcattgccgtgctccactccagctacgagaactagtaaattgtcgttgggcagaagaagtaacacaacagcttgatactcttcaactctgcagtctcaccaaacatgaagaaaatgaaaaggacaaatgtgaaaatcaccatgaaaaacttagtgtattttgctggacttgtaagaagtgtatctgccatcagtgtgcactttggggaggaatgcatggcggacatacctttaaacctttggcagaaatttatgagcaacacgtcactaaagtgaatgaagaggtagccaaacttcgtcggcgtctcatggaactgatcagcttagttcaagaagtggaaaggaatgtagaagctgtaagaaatgcaaaagatgagcgtgttcgggaaattaggaatgcagtggagatgatgattgcacggttagacacacagctgaagaataagcttataacactgatgggtcagaagacatctctaacccaagaaacagagcttttggaatccttacttcaggaggtggagcaccagttgcggtcttgtagtaagagtgagttgatatctaagagctcagagatccttatgatgtttcagcaagttcatcggaagcccatggcatcttttgttaccactcctgttccaccagactttaccagtgaattagtgccatcttacgattcagctacttttgttttagagaatttcagcactttgcgtcagagagcagatcctgtttacagtccacctcttcaagtttcaggactttgctggaggttaaaagtttacccagatggaaatggagttgtgcgaggttactacttatctgtgtttctggagctctcagctggcttgcctgaaacttctaaatatgaatatcgtgtagagatggttcaccagtcctgtaatgatcctacaaaaaatatcattcgagaatttgcatctgactttgaagttggagaatgctggggctataatagatttttccgtttggacttactcgcaaatgaaggatacttgaatccacaaaatgatacagtgattttaaggtttcaggtacgttcaccaactttctttcaaaaatcccgggaccagcattggtacattactcagttggaagctgcacagactagttatatccaacaaataaacaaccttaaagagagacttactattgagctgtctcgaactcagaagtcaagagatttgtcaccaccagataaccatcttagcccccaaaatgatgatgctctggagacacgagctaagaagtctgcatgctctgacatgcttctcgaaggtggtcctactacagcttctgtaagagaggccaaagaggatgaagaagatgaggagaagattcagaatgaagattatcatcacgagctttcagatggagatctggatctggatcttgtttatgaggatgaagtaaatcagctcgatggcagcagttcctctgctagttccacagcaacaagtaatacagaagaaaatgatattgatgaagaaactatgtctggagaaaatgatgtggaatataacaacatggaattagaagagggagaactcatggaagatgcagctgctgcaggacccgcaggtagtagccatggttatgtgggttccagtagtagaatatcaagaagaacacatttatgctccgctgctaccagtagtttactagacattgatccattaattttaatacatttgttggaccttaaggaccggagcagtatagaaaatttgtggggcttacagcctcgcccacctgcttcacttctgcagcccacagcatcatattctcgaaaagataaagaccaaaggaagcaacaggcaatgtggcgagtgccctctgatttaaagatgctaaaaagactcaaaactcaaatggccgaagttcgatgtatgaaaactgatgtaaagaatacactttcagaaataaaaagcagcagtgctgcttctggagacatgcagacaagccttttttctgctgaccaggcagctctggctgcatgtggaactgaaaactctggcagattgcaggatttgggaatggaactcctggcaaagtcatcagttgccaattgttacatacgaaactccacaaataagaagagtaattcgcccaagccagctcgatccagtgtagcaggtagtctatcacttcgaagagcagtggaccctggagaaaatagtcgttcaaagggagactgtcagactctgtctgaaggctccccaggaagctctcagtctgggagcaggcacagttctccccgagccttgatacatggcagtatcggtgatattctgccaaaaactgaagaccggcagtgtaaagctttggattcagatgctgttgtggttgcagttttcagtggcttgcctgcggttgagaaaaggaggaaaatggtcaccttgggggctaatgctaaaggaggtcatctggaaggactgcagatgactgatttggaaaataattctgaaactggagagttacagcctgtactacctgaaggagcttcagctgcccctgaagaaggaatgagtagcgacagtgacattgaatgtgacactgagaatgaggagcaggaagagcataccagtgtgggcgggtttcacgactccttcatggtcatgacacagcccccggatgaagatacacattccagttttcctgatggtgaacaaataggccctgaagatctcagcttcaatacagatgaaaatagtggaaggtaattgccaaatcaagagaactgacttgcaagctaccttgaccctgaattttgctgtagttggtgctcaaatttgtcatcagtcagataatcagatttggtcttatttcttcattatctcgacctgaaatagtaatttggaaactgttggaaggtggcacagtttagtctaagacagcagtagtacatgggaaaaacagtatgggaagagttctttgtaatgtaaggaaataacaatgtagttctctattaatttagcaaatttgtacattcacaaaaggcagtttgtctactacagcagaaggctggttaactgccagaaaatgtacctccaggccctgcatgccgtcagtaacccgcccggcattggtgctctactgtctttggctagagc

SEQ ID NO: 32619 - DNA, 3616 bp, Homo sapiens
acagcgtcctgcgcgcatgcgcttcgcagcttctctcgccgccgcgcccccagctgctctggttacggttggtgtttgcgaattctctgcggcaccttcttcgctgaactccaccgtcagttccataggcgcgcgcccgcgtcacgtgggccgaggttccggcgcggctgctggccggcggctgagccgggagaaaggagctgcggccaccgttcgccctacttctgcgcctcggggcgggcgcgccggtaaaaatggcgaaatgggggtaggcggcgctggacctgaagagatggggcgcgcaggtggggcggttgtcagagccccctgacgtgggcgccgggcttttatcggcgatttgatctggcgacctcgggccggcgcctaagaggtcagactgcggagcctgcgggtcgccagcggccccgccgagagccggaggcaatggatgaacagagcgtggagagcattgctgaggttttccgatgtttcatttgtatggagaaattgcgggatgcacgcctgtgtcctcattgctccaaactgtgttgtttcagctgtattaggcgctggctgacagagcagagagctcaatgtcctcattgccgtgctccactccagctacgagaactagtaaattgtcgttgggcagaagaagtaacacaacagcttgatactcttcaactctgcagtctcaccaaacatgaagaaaatgaaaaggacaaatgtgaaaatcaccatgaaaaacttagtgtattttgctggacttgtaagaagtgtatctgccatcagtgtgcactttggggaggaatgcatggcggacatacctttaaacctttggcagaaatttatgagcaacacgtcactaaagtgaatgaagaggtagccaaacttcgtcggcgtctcatggaactgatcagcttagttcaagaagtggaaaggaatgtagaagctgtaagaaatgcaaaagatgagcgtgttcgggaaattaggaatgcagtggagatgatgattgcacggttagacacacagctgaagaataagcttataacactgatgggtcagaagacatctctaacccaagaaacagagcttttggaatccttacttcaggaggtggagcaccagttgcggtcttgtagtaagagtgagttgatatctaagagctcagagatccttatgatgtttcagcaagttcatcggaagcccatggcatcttttgttaccactcctgttccaccagactttaccagtgaattagtgccatcttacgattcagctacttttgttttagagaatttcagcactttgcgtcagagagcagatcctgtttacagtccacctcttcaagtttcaggactttgctggaggttaaaagtttacccagatggaaatggagttgtgcgaggttactacttatctgtgtttctggagctctcagctggcttgcctgaaacttctaaatatgaatatcgtgtagagatggttcaccagtcctgtaatgatcctacaaaaaatatcattcgagaatttgcatctgactttgaagttggagaatgctggggctataatagatttttccgtttggacttactcgcaaatgaaggatacttgaatccacaaaatgatacagtgattttaaggtttcaggtacgttcaccaactttctttcaaaaatcccgggaccagcattggtacattactcagttggaagctgcacagactagttatatccaacaaataaacaaccttaaagagagacttactattgagctgtctcgaactcagaagtcaagagatttgtcaccaccagataaccatcttagcccccaaaatgatgatgctctggagacacgagctaagaagtctgcatgctctgacatgcttctcgaaggtggtcctactacagcttctgtaagagaggccaaagaggatgaagaagatgaggagaagattcagaatgaagattatcatcacgagctttcagatggagatctggatctggatcttgtttatgaggatgaagtaaatcagctcgatggcagcagttcctctgctagttccacagcaacaagtaatacagaagaaaatgatattgatgaagaaactatgtctggagaaaatgatgtggaatataacaacatggaattagaagagggagaactcatggaagatgcagctgctgcaggacccgcaggtagtagccatggttatgtgggttccagtagtagaatatcaagaagaacacatttatgctccgctgctaccagtagtttactagacattgatccattaattttaatacatttgttggaccttaaggaccggagcagtatagaaaatttgtggggcttacagcctcgcccacctgcttcacttctgcagcccacagcatcatattctcgaaaagataaagaccaaaggaagcaacaggcaatgtggcgagtgccctctgatttaaagatgctaaaaagactcaaaactcaaatggccgaagttcgatgtatgaaaactgatgtaaagaatacactttcagaaataaaaagcagcagtgctgcttctggagacatgcagacaagccttttttctgctgaccaggcagctctggctgcatgtggaactgaaaactctggcagattgcaggatttgggaatggaactcctggcaaagtcatcagttgccaattgttacatacgaaactccacaaataagaagagtaattcgcccaagccagctcgatccagtgtagcaggtagtctatcacttcgaagagcagtggaccctggagaaaatagtcgttcaaagggagactgtcagactctgtctgaaggctccccaggaagctctcagtctgggagcaggcacagttctccccgagccttgatacatggcagtatcggtgatattctgccaaaaactgaagaccggcagtgtaaagctttggattcagatgctgttgtggttgcagttttcagtggcttgcctgcggttgagaaaaggaggaaaatggtcaccttgggggctaatgctaaaggaggtcatctggaaggactgcagatgactgatttggaaaataattctgaaactggagagttacagcctgtactacctgaaggagcttcagctgcccctgaagaaggaatgagtagcgacagtgacattgaatgtgacactgagaatgaggagcaggaagagcataccagtgtgggcgggtttcacgactccttcatggtcatgacacagcccccggatgaagatacacattccagttttcctgatggtgaacaaataggccctgaagatctcagcttcaatacagatgaaaatagtggaagataatttgatttgaaactgacactgcacctgatgggttaacaagatctaggcttcagaaggtgacagatatgagtgaggaccatgtgtggggcaaagcctcagaatgatgaaaaggttccggcactatagttggggccatgttgactccttttcaaccatttgtcacagacgtgagaagaagaaatgacttcaaaatcaagagaaaacaaatactgaaagtctctacttacatccaaattttaaaaaataaaatctgtagattaacaatctgatcattgct

SEQ ID NO: 32620 - DNA, 3338 bp, Homo sapiens
cccagcttccactgacacgagcctcggcgcggcttccgcttccggcgagtattgtgtgtcgcgccgcggggcgggggcgaggggaggaggaaggagggaggcagcgctccggcggctccgcgccccgcactcccggacccgaagccgggaagattcctttcttgtctgttagaaacgtatgtcaaacgaggatacagtgtctggaactattggttctaagatataagtggaatgagcctggatcaggagaagtatgctgagctagagttgaaggaagcttctctttctaacaagagaaagcagagttaaattatggcagagacaagtctgttagaggctggggcctctgcagcctctacagctgcggctttggagaacttacaggtggaggcgagctgctctgtgtgcctggagtatctgaaggaacctgtcatcattgagtgtgggcacaacttctgcaaagcttgcatcacccgctggtgggaggacctagagagggacttcccttgtcctgtctgtcgaaagacatcccgctaccgcagtctccgacctaatcggcaactaggcagtatggtggaaattgccaagcagctccaggccgtcaagcggaagatccgggatgagagcctctgcccccaacaccatgaggccctcagccttttctgttatgaggaccaggaggctgtatgcttgatatgtgcaatttcccacacccaccgggcccacaccgttgtgccactggacgatgctacacaggagtacaaggaaaaactgcagaagtgtctggagcccctggaacagaagctgcaggagatcactcgctgcaagtcctctgaggagaagaagcctggtgagctcaagagactagtggaaagtcgccgacagcagatcttgagggagtttgaagagcttcataggcggctggatgaagagcagcaggtgttgctttcacgactggaagaagaggaacaggacattctgcagcgactccgagaaaatgctgctcaccttggggacaagcgccgggacctggcccacttggctgccgaggtggagggcaagtgcttacagtcaggcttcgagatgcttaaggatgtcaaaagtaccctggaaaagaatattcctagaaagttcggaggctcactctcaacgatctgtccacgggatcataaggctctccttggattagtaaaagaaatcaacagatgtgaaaaggtgaagaccatggaggtgacttcagtatccatagagctggaaaagaacttcagcaattttccccgacagtactttgccctaaggaaaatccttaaacagctaattgcggatgtgaccctggaccctgagacagctcatcctaacctagtcctgtcagaggatcgtaagagcgtcaagttcgtggagacaagactccgggatctccctgacacaccaaggcgtttcaccttctacccttgcgtcctggctactgagggtttcacctcaggtcgacactactgggaggtggaggtgggcgacaagacccactgggcagtgggtgtatgccgggactccgtgagccgaaagggcgagttgactccactccctgagactggctactggcgggtgcggctatggaatggggacaaatatgcagccaccaccacaccttttacccctttgcacatcaaggtgaaacccaagcgggtaggcatattcctagactatgaggccggcacactgtctttctacaatgtcacagaccgctctcatatctacaccttcactgatacttttactgagaaactttggcccctcttctacccaggcatccgggctggacggaagaatgctgcaccacttaccatcaggcccccaacagattgggagtgacaggttgggatgtgggaatgactggggtgaggcagggtcaagtgctacgggcctccttcccgtgtcctgctggaacgtcttcgtgtccacctgggtccagtcctgaatcatcttggagaaacaccttggtttctaggatggttttgtgtggagggggaggtaggactgggctggatgagagagcacagctgtgacttcctcctaactgtcagggtggggagctggttcccagaggattgtctaccctgaagtccatcaggttttctgttgcacaaggacgggtcaggaaggaaggagaggcttttccagaaacaaaaaatctgtgagggtctgacttgctcaaaccagaggaggaaacagaaacccctgcacatctttttagggggttctttgacccaggatagtcttgcttcttgaggtagatcacaggggtctgtgtacctctgaattcatgagagatgaatgacagatgctctcatgggtctagatattgaggagtttttctgagggcagagattggacatcaacaaggctagaagggtcagggaagtgggctaaaggaacagattcctagagattaatgaagaggagggaggtttctttggtcttctattccaagggtaaggttgcgattatgggtaagattggccagaggtaggaatgtggggagaaggagaggctgaaaagaaagcagaggagaacccaggtccctgcctcagccttcagcagagttggcttattgcctgcctctataccaataagtcagtcaccttgctcctctccagaggcaaagtggaagagatcctgcaagacacatctatcctttcacagtgttcccaagggaacttggaaaggagagtcaggtattagaggaaagagaagggtatttgtatacaaagccctggccttaaagaatgttacttagtagctactcccaaattgtcagccttcttacctggccaaggtgtccaagccagaaaggaaaaaaggttatggagtctttctcaccctaaggacagggtggaagagggtggtatatagggaagggccagataggcaacttcatttggcttgtgtgcatctggcctggaactggtgttaagccaggcttttgcttgtttgttgccatccctcaccctttgccatttcccttttcagagaatgtaaatgattttcatgttaggccaaaataaacaacttatagggtacatatgttgtcataaaaggtaaaagtgatgcatgccaaaccaaactaaaccaatttggattatctgctattcgggtaatcttcacagaaatgactgagagaagaatctgcagtttactgagggcatttcagttcctcctaccacctcaacaggactttgtccagactctcctcctcttacctttgtgccttgactgtggttctttgtggcaagatactttggttggttaaaataatatggaacaaaggatccactgaagtg

SEQ ID NO: 32621 - DNA, 3535 bp, Homo sapiens
cggcagcgtcatagcggcgggcatcccatctgcacgtcacacctctttctcacctggacacgcatcccttcctaccctgccagccacgacgtttcctctttcccctctccaatgccccagccccagatctggcggaagaagatggagaacgggggtgggacagagttgtggacaacctctcaggagagggtcgcaaggtgggaccctgaacagtggtagaaacaaaatgagattgtccctgaagtttgcccttcagctgagacacaaggagtagaggaagaggaaggactaacgcagaggcactcaaggtctcactatgactgtagttgagagtcctctcccttcttccctaaccctttccccatttctctcaccacttctttgccagtctagatccgtcctggtgccttactgtgcatacagttctactcgtctcagattcctttcttgtctgttagaaacgtatgtcaaacgaggatacagtgtctggaactattggttctaagatataagtggaatgagcctggatcaggagaagtatgctgagctagagttgaaggaagcttctctttctaacaagagaaagcagagttaaattatggcagagacaagtctgttagaggctggggcctctgcagcctctacagctgcggctttggagaacttacaggtggaggcgagctgctctgtgtgcctggagtatctgaaggaacctgtcatcattgagtgtgggcacaacttctgcaaagcttgcatcacccgctggtgggaggacctagagagggacttcccttgtcctgtctgtcgaaagacatcccgctaccgcagtctccgacctaatcggcaactaggcagtatggtggaaattgccaagcagctccaggccgtcaagcggaagatccgggatgagagcctctgcccccaacaccatgaggccctcagccttttctgttatgaggaccaggaggctgtatgcttgatatgtgcaatttcccacacccaccgggcccacaccgttgtgccactggacgatgctacacaggagtacaaggaaaaactgcagaagtgtctggagcccctggaacagaagctgcaggagatcactcgctgcaagtcctctgaggagaagaagcctggtgagctcaagagactagtggaaagtcgccgacagcagatcttgagggagtttgaagagcttcataggcggctggatgaagagcagcaggtgttgctttcacgactggaagaagaggaacaggacattctgcagcgactccgagaaaatgctgctcaccttggggacaagcgccgggacctggcccacttggctgccgaggtggagggcaagtgcttacagtcaggcttcgagatgcttaaggatgtcaaaagtaccctggaaaaatgtgaaaaggtgaagaccatggaggtgacttcagtatccatagagctggaaaagaacttcagcaattttccccgacagtactttgccctaaggaaaatccttaaacagctaattgcggatgtgaccctggaccctgagacagctcatcctaacctagtcctgtcagaggatcgtaagagcgtcaagttcgtggagacaagactccgggatctccctgacacaccaaggcgtttcaccttctacccttgcgtcctggctactgagggtttcacctcaggtcgacactactgggaggtggaggtgggcgacaagacccactgggcagtgggtgtatgccgggactccgtgagccgaaagggcgagttgactccactccctgagactggctactggcgggtgcggctatggaatggggacaaatatgcagccaccaccacaccttttacccctttgcacatcaaggtgaaacccaagcgggtaggcatattcctagactatgaggccggcacactgtctttctacaatgtcacagaccgctctcatatctacaccttcactgatacttttactgagaaactttggcccctcttctacccaggcatccgggctggacggaagaatgctgcaccacttaccatcaggcccccaacagattgggagtgacaggttgggatgtgggaatgactggggtgaggcagggtcaagtgctacgggcctccttcccgtgtcctgctggaacgtcttcgtgtccacctgggtccagtcctgaatcatcttggagaaacaccttggtttctaggatggttttgtgtggagggggaggtaggactgggctggatgagagagcacagctgtgacttcctcctaactgtcagggtggggagctggttcccagaggattgtctaccctgaagtccatcaggttttctgttgcacaaggacgggtcaggaaggaaggagaggcttttccagaaacaaaaaatctgtgagggtctgacttgctcaaaccagaggaggaaacagaaacccctgcacatctttttagggggttctttgacccaggatagtcttgcttcttgaggtagatcacaggggtctgtgtacctctgaattcatgagagatgaatgacagatgctctcatgggtctagatattgaggagtttttctgagggcagagattggacatcaacaaggctagaagggtcagggaagtgggctaaaggaacagattcctagagattaatgaagaggagggaggtttctttggtcttctattccaagggtaaggttgcgattatgggtaagattggccagaggtaggaatgtggggagaaggagaggctgaaaagaaagcagaggagaacccaggtccctgcctcagccttcagcagagttggcttattgcctgcctctataccaataagtcagtcaccttgctcctctccagaggcaaagtggaagagatcctgcaagacacatctatcctttcacagtgttcccaagggaacttggaaaggagagtcaggtattagaggaaagagaagggtatttgtatacaaagccctggccttaaagaatgttacttagtagctactcccaaattgtcagccttcttacctggccaaggtgtccaagccagaaaggaaaaaaggttatggagtctttctcaccctaaggacagggtggaagagggtggtatatagggaagggccagataggcaacttcatttggcttgtgtgcatctggcctggaactggtgttaagccaggcttttgcttgtttgttgccatccctcaccctttgccatttcccttttcagagaatgtaaatgattttcatgttaggccaaaataaacaacttatagggtacatatgttgtcataaaaggtaaaagtgatgcatgccaaaccaaactaaaccaatttggattatctgctattcgggtaatcttcacagaaatgactgagagaagaatctgcagtttactgagggcatttcagttcctcctaccacctcaacaggactttgtccagactctcctcctcttacctttgtgccttgactgtggttctttgtggcaagatactttggttggttaaaataatatggaacaaaggatccactgaagtga

SEQ ID NO: 32622 - DNA, 3198 bp, Homo sapiens
gcgaggggaggaggaaggagggaggcagcgctccggcggctccgcgccccgcactcccggacccgaagccgggaagatccgtcctggtgccttactgtgcatacagttctactcgtctcagaaacgtatgtcaaacgaggatacagtgtctggaactattggttctaagatataagtggaatgagcctggatcaggagaagtatgctgagctagagttgaaggaagcttctctttctaacaagagaaagcagagttaaattatggcagagacaagtctgttagaggctggggcctctgcagcctctacagctgcggctttggagaacttacaggtggaggcgagctgctctgtgtgcctggagtatctgaaggaacctgtcatcattgagtgtgggcacaacttctgcaaagcttgcatcacccgctggtgggaggacctagagagggacttcccttgtcctgtctgtcgaaagacatcccgctaccgcagtctccgacctaatcggcaactaggcagtatggtggaaattgccaagcagctccaggccgtcaagcggaagatccgggatgagagcctctgcccccaacaccatgaggccctcagccttttctgttatgaggaccaggaggctgtatgcttgatatgtgcaatttcccacacccaccgggctcacaccgttgtgccactggacgatgctacacaggagtacaaggaaaaactgcagaagtgtctggagcccctggaacagaagctgcaggagatcactcgctgcaagtcctctgaggagaagaagcctggtgagctcaagagactagtggaaagtcgccgacagcagatcttgagggagtttgaagagcttcataggcggctggatgaagagcagcaggtgttgctttcacgactggaagaagaggaacaggacattctgcagcgactccgagaaaatgctgctcaccttggggacaagcgccgggacctggcccacttggctgccgaggtggagggcaagtgcttacagtcaggcttcgagatgcttaaggatgtcaaaagtaccctggaaaaatgtgaaaaggtgaagaccatggaggtgacttcagtatccatagagctggaaaagaacttcagcaattttccccgacagtactttgccctaaggaaaatccttaaacagctaattgcggatgtgaccctggaccctgagacagctcatcctaacctagtcctgtcagaggatcgtaagagcgtcaagttcgtggagacaagactccgggatctccctgacacaccaaggcgtttcaccttctacccttgcgtcctggctactgagggtttcacctcaggtcgacactactgggaggtggaggtgggcgacaagacccactgggcagtgggtgtatgccgggactccgtgagccgaaagggcgagttgactccactccctgagactggctactggcgggtgcggctatggaatggggacaaatatgcagccaccaccacaccttttacccctttgcacatcaaggtgaaacccaagcgggtaggcatattcctagactatgaggccggcacactgtctttctacaatgtcacagaccgctctcatatctacaccttcactgatacttttactgagaaactttggcccctcttctacccaggcatccgggctggacggaagaatgctgcaccacttaccatcaggcccccaacagattgggagtgacaggttgggatgtgggaatgactggggtgaggcagggtcaagtgctacgggcctccttcccgtgtcctgctggaacgtcttcgtgtccacctgggtccagtcctgaatcatcttggagaaacaccttggtttctaggatggttttgtgtggagggggaggtaggactgggctggatgagagagcacagctgtgacttcctcctaactgtcagggtggggagctggttcccagaggattgtctaccctgaagtccatcaggttttctgttgcacaaggacgggtcaggaaggaaggagaggcttttccagaaacaaaaaatctgtgagggtctgacttgctcaaaccagaggaggaaacagaaacccctgcacatctttttagggggttctttgacccaggatagtcttgcttcttgaggtagatcacaggggtctgtgtacctctgaattcatgagagatgaatgacagatgctctcatgggtctagatattgaggagtttttctgagggcagagattggacatcaacaaggctagaagggtcagggaagtgggctaaaggaacagattcctagagattaatgaagaggagggaggtttctttggtcttctattccaagggtaaggttgcgattatgggtaagattggccagaggtaggaatgtggggagaaggagaggctgaaaagaaagcagaggagaacccaggtccctgcctcagccttcagcagagttggcttattgcctgcctctataccaataagtcagtcaccttgctcctctccagaggcaaagtggaagagatcctgcaagacacatctatcctttcacagtgttcccaagggaacttggaaaggagagtcaggtattagaggaaagagaagggtatttgtatacaaagccctggccttaaagaatgttacttagtagctactcccaaattgtcagccttcttacctggccaaggtgtccaagccagaaaggaaaaaaggttatggagtctttctcaccctaaggacagggtggaagagggtggtatatagggaagggccagataggcaacttcatttggcttgtgtgcatctggcctggaactggtgttaagccaggcttttgcttgtttgttgccatccctcaccctttgccatttcccttttcagagaatgtaaatgattttcatgttaggccaaaataaacaacttatagggtacatatgttgtcataaaaggtaaaagtgatgcatgccaaaccaaactaaaccaatttggattatctgctattcgggtaatcttcacagaaatgactgagagaagaatctgcagtttactgagggcatttcagttcctcctaccacctcaacaggactttgtccagactctcctcctcttacctttgtgccttgactgtggttctttgtggcaagatactttggttggttaaaataatatggaacaaaggatccactgaagtga

SEQ ID NO: 32623 - DNA, 3187 bp, Homo sapiens
attcctttcttgtctgttagaaacgtatgtcaaacgaggatacagtgtctggaactattggttctaagatataagtggaatgagcctggatcaggagaagtatgctgagctagagttgaaggaagcttctctttctaacaagagaaagcagagttaaattatggcagagacaagtctgttagaggctggggcctctgcagcctctacagctgcggctttggagaacttacaggtggaggcgagctgctctgtgtgcctggagtatctgaaggaacctgtcatcattgagtgtgggcacaacttctgcaaagcttgcatcacccgctggtgggaggacctagagagggacttcccttgtcctgtctgtcgaaagacatcccgctaccgcagtctccgacctaatcggcaactaggcagtatggtggaaattgccaagcagctccaggccgtcaagcggaagatccgggatgagagcctctgcccccaacaccatgaggccctcagccttttctgttatgaggaccaggaggctgtatgcttgatatgtgcaatttcccacacccaccgggctcacaccgttgtgccactggacgatgctacacaggagtacaaggaaaaactgcagaagtgtctggagcccctggaacagaagctgcaggagatcactcgctgcaagtcctctgaggagaagaagcctggtgagctcaagagactagtggaaagtcgccgacagcagatcttgagggagtttgaagagcttcataggcggctggatgaagagcagcaggtgttgctttcacgactggaagaagaggaacaggacattctgcagcgactccgagaaaatgctgctcaccttggggacaagcgccgggacctggcccacttggctgccgaggtggagggcaagtgcttacagtcaggcttcgagatgcttaaggatgtcaaaagtaccctggaaaagaatattcctagaaagttcggaggctcactctcaacgatctgtccacgggatcataaggctctccttggattagtaaaagaaatcaacagatgtgaaaaggtgaagaccatggaggtgacttcagtatccatagagctggaaaagaacttcagcaattttccccgacagtactttgccctaaggaaaatccttaaacagctaattgcggatgtgaccctggaccctgagacagctcatcctaacctagtcctgtcagaggatcgtaagagcgtcaagttcgtggagacaagactccgggatctccctgacacaccaaggcgtttcaccttctacccttgcgtcctggctactgagggtttcacctcaggtcgacactactgggaggtggaggtgggcgacaagacccactgggcagtgggtgtatgccgggactccgtgagccgaaagggcgagttgactccactccctgagactggctactggcgggtgcggctatggaatggggacaaatatgcagccaccaccacaccttttacccctttgcacatcaaggtgaaacccaagcgggtaggcatattcctagactatgaggccggcacactgtctttctacaatgtcacagaccgctctcatatctacaccttcactgatacttttactgagaaactttggcccctcttctacccaggcatccgggctggacggaagaatgctgcaccacttaccatcaggcccccaacagattgggagtgacaggttgggatgtgggaatgactggggtgaggcagggtcaagtgctacgggcctccttcccgtgtcctgctggaacgtcttcgtgtccacctgggtccagtcctgaatcatcttggagaaacaccttggtttctaggatggttttgtgtggagggggaggtaggactgggctggatgagagagcacagctgtgacttcctcctaactgtcagggtggggagctggttcccagaggattgtctaccctgaagtccatcaggttttctgttgcacaaggacgggtcaggaaggaaggagaggcttttccagaaacaaaaaatctgtgagggtctgacttgctcaaaccagaggaggaaacagaaacccctgcacatctttttagggggttctttgacccaggatagtcttgcttcttgaggtagatcacaggggtctgtgtacctctgaattcatgagagatgaatgacagatgctctcatgggtctagatattgaggagtttttctgagggcagagattggacatcaacaaggctagaagggtcagggaagtgggctaaaggaacagattcctagagattaatgaagaggagggaggtttctttggtcttctattccaagggtaaggttgcgattatgggtaagattggccagaggtaggaatgtggggagaaggagaggctgaaaagaaagcagaggagaacccaggtccctgcctcagccttcagcagagttggcttattgcctgcctctataccaataagtcagtcaccttgctcctctccagaggcaaagtggaagagatcctgcaagacacatctatcctttcacagtgttcccaagggaacttggaaaggagagtcaggtattagaggaaagagaagggtatttgtatacaaagccctggccttaaagaatgttacttagtagctactcccaaattgtcagccttcttacctggccaaggtgtccaagccagaaaggaaaaaaggttatggagtctttctcaccctaaggacagggtggaagagggtggtatatagggaagggccagataggcaacttcatttggcttgtgtgcatctggcctggaactggtgttaagccaggcttttgcttgtttgttgccatccctcaccctttgccatttcccttttcagagaatgtaaatgattttcatgttaggccaaaataaacaacttatagggtacatatgttgtcataaaaggtaaaagtgatgcatgccaaaccaaactaaaccaatttggattatctgctattcgggtaatcttcacagaaatgactgagagaagaatctgcagtttactgagggcatttcagttcctcctaccacctcaacaggactttgtccagactctcctcctcttacctttgtgccttgactgtggttctttgtggcaagatactttggttggttaaaataatatggaacaaaggatccactgaagtga

SEQ ID NO: 32624 - DNA, 3535 bp, Homo sapiens
cggcagcgtcatagcggcgggcatcccatctgcacgtcacacctctttctcacctggacacgcatcccttcctaccctgccagccacgacgtttcctctttcccctctccaatgccccagccccagatctggcggaagaagatggagaacgggggtgggacagagttgtggacaacctctcaggagagggtcgcaaggtgggaccctgaacagtggtagaaacaaaatgagattgtccctgaagtttgcccttcagctgagacacaaggagtagaggaagaggaaggactaacgcagaggcactcaaggtctcactatgactgtagttgagagtcctctcccttcttccctaaccctttccccatttctctcaccacttctttgccagtctagatccgtcctggtgccttactgtgcatacagttctactcgtctcagattcctttcttgtctgttagaaacgtatgtcaaacgaggatacagtgtctggaactattggttctaagatataagtggaatgagcctggatcaggagaagtatgctgagctagagttgaaggaagcttctctttctaacaagagaaagcagagttaaattatggcagagacaagtctgttagaggctggggcctctgcagcctctacagctgcggctttggagaacttacaggtggaggcgagctgctctgtgtgcctggagtatctgaaggaacctgtcatcattgagtgtgggcacaacttctgcaaagcttgcatcacccgctggtgggaggacctagagagggacttcccttgtcctgtctgtcgaaagacatcccgctaccgcagtctccgacctaatcggcaactaggcagtatggtggaaattgccaagcagctccaggccgtcaagcggaagatccgggatgagagcctctgcccccaacaccatgaggccctcagccttttctgttatgaggaccaggaggctgtatgcttgatatgtgcaatttcccacacccaccgggctcacaccgttgtgccactggacgatgctacacaggagtacaaggaaaaactgcagaagtgtctggagcccctggaacagaagctgcaggagatcactcgctgcaagtcctctgaggagaagaagcctggtgagctcaagagactagtggaaagtcgccgacagcagatcttgagggagtttgaagagcttcataggcggctggatgaagagcagcaggtgttgctttcacgactggaagaagaggaacaggacattctgcagcgactccgagaaaatgctgctcaccttggggacaagcgccgggacctggcccacttggctgccgaggtggagggcaagtgcttacagtcaggcttcgagatgcttaaggatgtcaaaagtaccctggaaaaatgtgaaaaggtgaagaccatggaggtgacttcagtatccatagagctggaaaagaacttcagcaattttccccgacagtactttgccctaaggaaaatccttaaacagctaattgcggatgtgaccctggaccctgagacagctcatcctaacctagtcctgtcagaggatcgtaagagcgtcaagttcgtggagacaagactccgggatctccctgacacaccaaggcgtttcaccttctacccttgcgtcctggctactgagggtttcacctcaggtcgacactactgggaggtggaggtgggcgacaagacccactgggcagtgggtgtatgccgggactccgtgagccgaaagggcgagttgactccactccctgagactggctactggcgggtgcggctatggaatggggacaaatatgcagccaccaccacaccttttacccctttgcacatcaaggtgaaacccaagcgggtaggcatattcctagactatgaggccggcacactgtctttctacaatgtcacagaccgctctcatatctacaccttcactgatacttttactgagaaactttggcccctcttctacccaggcatccgggctggacggaagaatgctgcaccacttaccatcaggcccccaacagattgggagtgacaggttgggatgtgggaatgactggggtgaggcagggtcaagtgctacgggcctccttcccgtgtcctgctggaacgtcttcgtgtccacctgggtccagtcctgaatcatcttggagaaacaccttggtttctaggatggttttgtgtggagggggaggtaggactgggctggatgagagagcacagctgtgacttcctcctaactgtcagggtggggagctggttcccagaggattgtctaccctgaagtccatcaggttttctgttgcacaaggacgggtcaggaaggaaggagaggcttttccagaaacaaaaaatctgtgagggtctgacttgctcaaaccagaggaggaaacagaaacccctgcacatctttttagggggttctttgacccaggatagtcttgcttcttgaggtagatcacaggggtctgtgtacctctgaattcatgagagatgaatgacagatgctctcatgggtctagatattgaggagtttttctgagggcagagattggacatcaacaaggctagaagggtcagggaagtgggctaaaggaacagattcctagagattaatgaagaggagggaggtttctttggtcttctattccaagggtaaggttgcgattatgggtaagattggccagaggtaggaatgtggggagaaggagaggctgaaaagaaagcagaggagaacccaggtccctgcctcagccttcagcagagttggcttattgcctgcctctataccaataagtcagtcaccttgctcctctccagaggcaaagtggaagagatcctgcaagacacatctatcctttcacagtgttcccaagggaacttggaaaggagagtcaggtattagaggaaagagaagggtatttgtatacaaagccctggccttaaagaatgttacttagtagctactcccaaattgtcagccttcttacctggccaaggtgtccaagccagaaaggaaaaaaggttatggagtctttctcaccctaaggacagggtggaagagggtggtatatagggaagggccagataggcaacttcatttggcttgtgtgcatctggcctggaactggtgttaagccaggcttttgcttgtttgttgccatccctcaccctttgccatttcccttttcagagaatgtaaatgattttcatgttaggccaaaataaacaacttatagggtacatatgttgtcataaaaggtaaaagtgatgcatgccaaaccaaactaaaccaatttggattatctgctattcgggtaatcttcacagaaatgactgagagaagaatctgcagtttactgagggcatttcagttcctcctaccacctcaacaggactttgtccagactctcctcctcttacctttgtgccttgactgtggttctttgtggcaagatactttggttggttaaaataatatggaacaaaggatccactgaagtga

SEQ ID NO: 32625 - DNA, 3187 bp, Homo sapiens
attcctttcttgtctgttagaaacgtatgtcaaacgaggatacagtgtctggaactattggttctaagatataagtggaatgagcctggatcaggagaagtatgctgagctagagttgaaggaagcttctctttctaacaagagaaagcagagttaaattatggcagagacaagtctgttagaggctggggcctctgcagcctctacagctgcggctttggagaacttacaggtggaggcgagctgctctgtgtgcctggagtatctgaaggaacctgtcatcattgagtgtgggcacaacttctgcaaagcttgcatcacccgctggtgggaggacctagagagggacttcccttgtcctgtctgtcgaaagacatcccgctaccgcagtctccgacctaatcggcaactaggcagtatggtggaaattgccaagcagctccaggccgtcaagcggaagatccgggatgagagcctctgcccccaacaccatgaggccctcagccttttctgttatgaggaccaggaggctgtatgcttgatatgtgcaatttcccacacccaccgggcccacaccgttgtgccactggacgatgctacacaggagtacaaggaaaaactgcagaagtgtctggagcccctggaacagaagctgcaggagatcactcgctgcaagtcctctgaggagaagaagcctggtgagctcaagagactagtggaaagtcgccgacagcagatcttgagggagtttgaagagcttcataggcggctggatgaagagcagcaggtgttgctttcacgactggaagaagaggaacaggacattctgcagcgactccgagaaaatgctgctcaccttggggacaagcgccgggacctggcccacttggctgccgaggtggagggcaagtgcttacagtcaggcttcgagatgcttaaggatgtcaaaagtaccctggaaaagaatattcctagaaagttcggaggctcactctcaacgatctgtccacgggatcataaggctctccttggattagtaaaagaaatcaacagatgtgaaaaggtgaagaccatggaggtgacttcagtatccatagagctggaaaagaacttcagcaattttccccgacagtactttgccctaaggaaaatccttaaacagctaattgcggatgtgaccctggaccctgagacagctcatcctaacctagtcctgtcagaggatcgtaagagcgtcaagttcgtggagacaagactccgggatctccctgacacaccaaggcgtttcaccttctacccttgcgtcctggctactgagggtttcacctcaggtcgacactactgggaggtggaggtgggcgacaagacccactgggcagtgggtgtatgccgggactccgtgagccgaaagggcgagttgactccactccctgagactggctactggcgggtgcggctatggaatggggacaaatatgcagccaccaccacaccttttacccctttgcacatcaaggtgaaacccaagcgggtaggcatattcctagactatgaggccggcacactgtctttctacaatgtcacagaccgctctcatatctacaccttcactgatacttttactgagaaactttggcccctcttctacccaggcatccgggctggacggaagaatgctgcaccacttaccatcaggcccccaacagattgggagtgacaggttgggatgtgggaatgactggggtgaggcagggtcaagtgctacgggcctccttcccgtgtcctgctggaacgtcttcgtgtccacctgggtccagtcctgaatcatcttggagaaacaccttggtttctaggatggttttgtgtggagggggaggtaggactgggctggatgagagagcacagctgtgacttcctcctaactgtcagggtggggagctggttcccagaggattgtctaccctgaagtccatcaggttttctgttgcacaaggacgggtcaggaaggaaggagaggcttttccagaaacaaaaaatctgtgagggtctgacttgctcaaaccagaggaggaaacagaaacccctgcacatctttttagggggttctttgacccaggatagtcttgcttcttgaggtagatcacaggggtctgtgtacctctgaattcatgagagatgaatgacagatgctctcatgggtctagatattgaggagtttttctgagggcagagattggacatcaacaaggctagaagggtcagggaagtgggctaaaggaacagattcctagagattaatgaagaggagggaggtttctttggtcttctattccaagggtaaggttgcgattatgggtaagattggccagaggtaggaatgtggggagaaggagaggctgaaaagaaagcagaggagaacccaggtccctgcctcagccttcagcagagttggcttattgcctgcctctataccaataagtcagtcaccttgctcctctccagaggcaaagtggaagagatcctgcaagacacatctatcctttcacagtgttcccaagggaacttggaaaggagagtcaggtattagaggaaagagaagggtatttgtatacaaagccctggccttaaagaatgttacttagtagctactcccaaattgtcagccttcttacctggccaaggtgtccaagccagaaaggaaaaaaggttatggagtctttctcaccctaaggacagggtggaagagggtggtatatagggaagggccagataggcaacttcatttggcttgtgtgcatctggcctggaactggtgttaagccaggcttttgcttgtttgttgccatccctcaccctttgccatttcccttttcagagaatgtaaatgattttcatgttaggccaaaataaacaacttatagggtacatatgttgtcataaaaggtaaaagtgatgcatgccaaaccaaactaaaccaatttggattatctgctattcgggtaatcttcacagaaatgactgagagaagaatctgcagtttactgagggcatttcagttcctcctaccacctcaacaggactttgtccagactctcctcctcttacctttgtgccttgactgtggttctttgtggcaagatactttggttggttaaaataatatggaacaaaggatccactgaagtga

SEQ ID NO: 32626 - DNA, 3198 bp, Homo sapiens
gcgaggggaggaggaaggagggaggcagcgctccggcggctccgcgccccgcactcccggacccgaagccgggaagatccgtcctggtgccttactgtgcatacagttctactcgtctcagaaacgtatgtcaaacgaggatacagtgtctggaactattggttctaagatataagtggaatgagcctggatcaggagaagtatgctgagctagagttgaaggaagcttctctttctaacaagagaaagcagagttaaattatggcagagacaagtctgttagaggctggggcctctgcagcctctacagctgcggctttggagaacttacaggtggaggcgagctgctctgtgtgcctggagtatctgaaggaacctgtcatcattgagtgtgggcacaacttctgcaaagcttgcatcacccgctggtgggaggacctagagagggacttcccttgtcctgtctgtcgaaagacatcccgctaccgcagtctccgacctaatcggcaactaggcagtatggtggaaattgccaagcagctccaggccgtcaagcggaagatccgggatgagagcctctgcccccaacaccatgaggccctcagccttttctgttatgaggaccaggaggctgtatgcttgatatgtgcaatttcccacacccaccgggcccacaccgttgtgccactggacgatgctacacaggagtacaaggaaaaactgcagaagtgtctggagcccctggaacagaagctgcaggagatcactcgctgcaagtcctctgaggagaagaagcctggtgagctcaagagactagtggaaagtcgccgacagcagatcttgagggagtttgaagagcttcataggcggctggatgaagagcagcaggtgttgctttcacgactggaagaagaggaacaggacattctgcagcgactccgagaaaatgctgctcaccttggggacaagcgccgggacctggcccacttggctgccgaggtggagggcaagtgcttacagtcaggcttcgagatgcttaaggatgtcaaaagtaccctggaaaaatgtgaaaaggtgaagaccatggaggtgacttcagtatccatagagctggaaaagaacttcagcaattttccccgacagtactttgccctaaggaaaatccttaaacagctaattgcggatgtgaccctggaccctgagacagctcatcctaacctagtcctgtcagaggatcgtaagagcgtcaagttcgtggagacaagactccgggatctccctgacacaccaaggcgtttcaccttctacccttgcgtcctggctactgagggtttcacctcaggtcgacactactgggaggtggaggtgggcgacaagacccactgggcagtgggtgtatgccgggactccgtgagccgaaagggcgagttgactccactccctgagactggctactggcgggtgcggctatggaatggggacaaatatgcagccaccaccacaccttttacccctttgcacatcaaggtgaaacccaagcgggtaggcatattcctagactatgaggccggcacactgtctttctacaatgtcacagaccgctctcatatctacaccttcactgatacttttactgagaaactttggcccctcttctacccaggcatccgggctggacggaagaatgctgcaccacttaccatcaggcccccaacagattgggagtgacaggttgggatgtgggaatgactggggtgaggcagggtcaagtgctacgggcctccttcccgtgtcctgctggaacgtcttcgtgtccacctgggtccagtcctgaatcatcttggagaaacaccttggtttctaggatggttttgtgtggagggggaggtaggactgggctggatgagagagcacagctgtgacttcctcctaactgtcagggtggggagctggttcccagaggattgtctaccctgaagtccatcaggttttctgttgcacaaggacgggtcaggaaggaaggagaggcttttccagaaacaaaaaatctgtgagggtctgacttgctcaaaccagaggaggaaacagaaacccctgcacatctttttagggggttctttgacccaggatagtcttgcttcttgaggtagatcacaggggtctgtgtacctctgaattcatgagagatgaatgacagatgctctcatgggtctagatattgaggagtttttctgagggcagagattggacatcaacaaggctagaagggtcagggaagtgggctaaaggaacagattcctagagattaatgaagaggagggaggtttctttggtcttctattccaagggtaaggttgcgattatgggtaagattggccagaggtaggaatgtggggagaaggagaggctgaaaagaaagcagaggagaacccaggtccctgcctcagccttcagcagagttggcttattgcctgcctctataccaataagtcagtcaccttgctcctctccagaggcaaagtggaagagatcctgcaagacacatctatcctttcacagtgttcccaagggaacttggaaaggagagtcaggtattagaggaaagagaagggtatttgtatacaaagccctggccttaaagaatgttacttagtagctactcccaaattgtcagccttcttacctggccaaggtgtccaagccagaaaggaaaaaaggttatggagtctttctcaccctaaggacagggtggaagagggtggtatatagggaagggccagataggcaacttcatttggcttgtgtgcatctggcctggaactggtgttaagccaggcttttgcttgtttgttgccatccctcaccctttgccatttcccttttcagagaatgtaaatgattttcatgttaggccaaaataaacaacttatagggtacatatgttgtcataaaaggtaaaagtgatgcatgccaaaccaaactaaaccaatttggattatctgctattcgggtaatcttcacagaaatgactgagagaagaatctgcagtttactgagggcatttcagttcctcctaccacctcaacaggactttgtccagactctcctcctcttacctttgtgccttgactgtggttctttgtggcaagatactttggttggttaaaataatatggaacaaaggatccactgaagtga

SEQ ID NO: 32627 - DNA, 3249 bp, Homo sapiens
cccagcttccactgacacgagcctcggcgcggcttccgcttccggcgagtattgtgtgtcgcgccgcggggcgggggcgaggggaggaggaaggagggaggcagcgctccggcggctccgcgccccgcactcccggacccgaagccgggaagattcctttcttgtctgttagaaacgtatgtcaaacgaggatacagtgtctggaactattggttctaagatataagtggaatgagcctggatcaggagaagtatgctgagctagagttgaaggaagcttctctttctaacaagagaaagcagagttaaattatggcagagacaagtctgttagaggctggggcctctgcagcctctacagctgcggctttggagaacttacaggtggaggcgagctgctctgtgtgcctggagtatctgaaggaacctgtcatcattgagtgtgggcacaacttctgcaaagcttgcatcacccgctggtgggaggacctagagagggacttcccttgtcctgtctgtcgaaagacatcccgctaccgcagtctccgacctaatcggcaactaggcagtatggtggaaattgccaagcagctccaggccgtcaagcggaagatccgggatgagagcctctgcccccaacaccatgaggccctcagccttttctgttatgaggaccaggaggctgtatgcttgatatgtgcaatttcccacacccaccgggcccacaccgttgtgccactggacgatgctacacaggagtacaaggaaaaactgcagaagtgtctggagcccctggaacagaagctgcaggagatcactcgctgcaagtcctctgaggagaagaagcctggtgagctcaagagactagtggaaagtcgccgacagcagatcttgagggagtttgaagagcttcataggcggctggatgaagagcagcaggtgttgctttcacgactggaagaagaggaacaggacattctgcagcgactccgagaaaatgctgctcaccttggggacaagcgccgggacctggcccacttggctgccgaggtggagggcaagtgcttacagtcaggcttcgagatgcttaaggatgtcaaaagtaccctggaaaaatgtgaaaaggtgaagaccatggaggtgacttcagtatccatagagctggaaaagaacttcagcaattttccccgacagtactttgccctaaggaaaatccttaaacagctaattgcggatgtgaccctggaccctgagacagctcatcctaacctagtcctgtcagaggatcgtaagagcgtcaagttcgtggagacaagactccgggatctccctgacacaccaaggcgtttcaccttctacccttgcgtcctggctactgagggtttcacctcaggtcgacactactgggaggtggaggtgggcgacaagacccactgggcagtgggtgtatgccgggactccgtgagccgaaagggcgagttgactccactccctgagactggctactggcgggtgcggctatggaatggggacaaatatgcagccaccaccacaccttttacccctttgcacatcaaggtgaaacccaagcgggtaggcatattcctagactatgaggccggcacactgtctttctacaatgtcacagaccgctctcatatctacaccttcactgatacttttactgagaaactttggcccctcttctacccaggcatccgggctggacggaagaatgctgcaccacttaccatcaggcccccaacagattgggagtgacaggttgggatgtgggaatgactggggtgaggcagggtcaagtgctacgggcctccttcccgtgtcctgctggaacgtcttcgtgtccacctgggtccagtcctgaatcatcttggagaaacaccttggtttctaggatggttttgtgtggagggggaggtaggactgggctggatgagagagcacagctgtgacttcctcctaactgtcagggtggggagctggttcccagaggattgtctaccctgaagtccatcaggttttctgttgcacaaggacgggtcaggaaggaaggagaggcttttccagaaacaaaaaatctgtgagggtctgacttgctcaaaccagaggaggaaacagaaacccctgcacatctttttagggggttctttgacccaggatagtcttgcttcttgaggtagatcacaggggtctgtgtacctctgaattcatgagagatgaatgacagatgctctcatgggtctagatattgaggagtttttctgagggcagagattggacatcaacaaggctagaagggtcagggaagtgggctaaaggaacagattcctagagattaatgaagaggagggaggtttctttggtcttctattccaagggtaaggttgcgattatgggtaagattggccagaggtaggaatgtggggagaaggagaggctgaaaagaaagcagaggagaacccaggtccctgcctcagccttcagcagagttggcttattgcctgcctctataccaataagtcagtcaccttgctcctctccagaggcaaagtggaagagatcctgcaagacacatctatcctttcacagtgttcccaagggaacttggaaaggagagtcaggtattagaggaaagagaagggtatttgtatacaaagccctggccttaaagaatgttacttagtagctactcccaaattgtcagccttcttacctggccaaggtgtccaagccagaaaggaaaaaaggttatggagtctttctcaccctaaggacagggtggaagagggtggtatatagggaagggccagataggcaacttcatttggcttgtgtgcatctggcctggaactggtgttaagccaggcttttgcttgtttgttgccatccctcaccctttgccatttcccttttcagagaatgtaaatgattttcatgttaggccaaaataaacaacttatagggtacatatgttgtcataaaaggtaaaagtgatgcatgccaaaccaaactaaaccaatttggattatctgctattcgggtaatcttcacagaaatgactgagagaagaatctgcagtttactgagggcatttcagttcctcctaccacctcaacaggactttgtccagactctcctcctcttacctttgtgccttgactgtggttctttgtggcaagatactttggttggttaaaataatatggaacaaaggatccactgaagtga

SEQ ID NO: 32628 - DNA, 3249 bp, Homo sapiens
cccagcttccactgacacgagcctcggcgcggcttccgcttccggcgagtattgtgtgtcgcgccgcggggcgggggcgaggggaggaggaaggagggaggcagcgctccggcggctccgcgccccgcactcccggacccgaagccgggaagattcctttcttgtctgttagaaacgtatgtcaaacgaggatacagtgtctggaactattggttctaagatataagtggaatgagcctggatcaggagaagtatgctgagctagagttgaaggaagcttctctttctaacaagagaaagcagagttaaattatggcagagacaagtctgttagaggctggggcctctgcagcctctacagctgcggctttggagaacttacaggtggaggcgagctgctctgtgtgcctggagtatctgaaggaacctgtcatcattgagtgtgggcacaacttctgcaaagcttgcatcacccgctggtgggaggacctagagagggacttcccttgtcctgtctgtcgaaagacatcccgctaccgcagtctccgacctaatcggcaactaggcagtatggtggaaattgccaagcagctccaggccgtcaagcggaagatccgggatgagagcctctgcccccaacaccatgaggccctcagccttttctgttatgaggaccaggaggctgtatgcttgatatgtgcaatttcccacacccaccgggctcacaccgttgtgccactggacgatgctacacaggagtacaaggaaaaactgcagaagtgtctggagcccctggaacagaagctgcaggagatcactcgctgcaagtcctctgaggagaagaagcctggtgagctcaagagactagtggaaagtcgccgacagcagatcttgagggagtttgaagagcttcataggcggctggatgaagagcagcaggtgttgctttcacgactggaagaagaggaacaggacattctgcagcgactccgagaaaatgctgctcaccttggggacaagcgccgggacctggcccacttggctgccgaggtggagggcaagtgcttacagtcaggcttcgagatgcttaaggatgtcaaaagtaccctggaaaaatgtgaaaaggtgaagaccatggaggtgacttcagtatccatagagctggaaaagaacttcagcaattttccccgacagtactttgccctaaggaaaatccttaaacagctaattgcggatgtgaccctggaccctgagacagctcatcctaacctagtcctgtcagaggatcgtaagagcgtcaagttcgtggagacaagactccgggatctccctgacacaccaaggcgtttcaccttctacccttgcgtcctggctactgagggtttcacctcaggtcgacactactgggaggtggaggtgggcgacaagacccactgggcagtgggtgtatgccgggactccgtgagccgaaagggcgagttgactccactccctgagactggctactggcgggtgcggctatggaatggggacaaatatgcagccaccaccacaccttttacccctttgcacatcaaggtgaaacccaagcgggtaggcatattcctagactatgaggccggcacactgtctttctacaatgtcacagaccgctctcatatctacaccttcactgatacttttactgagaaactttggcccctcttctacccaggcatccgggctggacggaagaatgctgcaccacttaccatcaggcccccaacagattgggagtgacaggttgggatgtgggaatgactggggtgaggcagggtcaagtgctacgggcctccttcccgtgtcctgctggaacgtcttcgtgtccacctgggtccagtcctgaatcatcttggagaaacaccttggtttctaggatggttttgtgtggagggggaggtaggactgggctggatgagagagcacagctgtgacttcctcctaactgtcagggtggggagctggttcccagaggattgtctaccctgaagtccatcaggttttctgttgcacaaggacgggtcaggaaggaaggagaggcttttccagaaacaaaaaatctgtgagggtctgacttgctcaaaccagaggaggaaacagaaacccctgcacatctttttagggggttctttgacccaggatagtcttgcttcttgaggtagatcacaggggtctgtgtacctctgaattcatgagagatgaatgacagatgctctcatgggtctagatattgaggagtttttctgagggcagagattggacatcaacaaggctagaagggtcagggaagtgggctaaaggaacagattcctagagattaatgaagaggagggaggtttctttggtcttctattccaagggtaaggttgcgattatgggtaagattggccagaggtaggaatgtggggagaaggagaggctgaaaagaaagcagaggagaacccaggtccctgcctcagccttcagcagagttggcttattgcctgcctctataccaataagtcagtcaccttgctcctctccagaggcaaagtggaagagatcctgcaagacacatctatcctttcacagtgttcccaagggaacttggaaaggagagtcaggtattagaggaaagagaagggtatttgtatacaaagccctggccttaaagaatgttacttagtagctactcccaaattgtcagccttcttacctggccaaggtgtccaagccagaaaggaaaaaaggttatggagtctttctcaccctaaggacagggtggaagagggtggtatatagggaagggccagataggcaacttcatttggcttgtgtgcatctggcctggaactggtgttaagccaggcttttgcttgtttgttgccatccctcaccctttgccatttcccttttcagagaatgtaaatgattttcatgttaggccaaaataaacaacttatagggtacatatgttgtcataaaaggtaaaagtgatgcatgccaaaccaaactaaaccaatttggattatctgctattcgggtaatcttcacagaaatgactgagagaagaatctgcagtttactgagggcatttcagttcctcctaccacctcaacaggactttgtccagactctcctcctcttacctttgtgccttgactgtggttctttgtggcaagatactttggttggttaaaataatatggaacaaaggatccactgaagtga

SEQ ID NO: 32629 - DNA, 1003 bp, Homo sapiens
gaagagaggaaaagtgtggaagtccacaagccgcccccgccccgccctcttcgtcgactttcagctgcaccgggaggcggcggcgcctggccagagccggggcctggagcctggactagacagcctcgccggccggggcgccagtccagcgccctgcgggcaatgggcttcagcgctcgagcacgcgcatgcgcgggcctgtatctccagaggattcctcgggtcacctggacgccagcatctcagccacctgcccctctgggtcccttcttgcccttgattccccctgctgcttctcatcgccagccctcctcctccttcttccgcaggcaccgctagacccggccgcggccgcccgccgacaccccagcttccactgacacgagcctcggcgcggcttccgcttccgattcctttcttgtctgttagaaacgtatgtcaaacgaggatacagtgtctggaactattggttctaagatataagtggaatgagcctggatcaggagaagtatgctgagctagagttgaaggaagcttctctttctaacaagagaaagcagagttaaattatggcagagacaagtctgttagaggctggggcctctgcagcctctacagctgcggctttggagaacttacaggtggaggcgagctgctctgtgtgcctggagtatctgaaggaacctgtcatcattgagtgtgggcacaacttctgcaaagcttgcatcacccgctggtgggaggacctagagagggacttcccttgtcctgtctgtcgaaagacatcccgctaccgcagtctccgacctaatcggcaactaggcagtatggtggaaattgccaagcagctccaggccgtcaagcggaagatccgggatgagagcctctgcccccaacaccatgaggccctcagccttttctgttatgaggaccaggaggctgtatgcttgatatgtgcaatttcccacacccaccgggcccacaccgttgtgccactggacga

SEQ ID NO: 32630 - DNA, 708 bp, Homo sapiens
agacatcccgctaccgcagtctccgacctaatcggcaactaggcagtatggtggaaattgccaagcagctccaggccgtcaagcggaagatccgggatgagagcctctgcccccaacaccatgaggccctcagccttttctgttatgaggaccaggaggctgtatgcttgatatgtgcaatttcccacacccaccgggcccacaccgttgtgccactggacgatgctacacaggagtacaaggaaaaactgcagaagtgtctggagcccctggaacagaagctgcaggagatcactcgctgcaagtcctctgaggagaagaagcctggtgagctcaagagactagtggaaagtcgccgacagcagatcttgagggagtttgaagagcttcataggcggctggatgaagagcagcaggtgttgctttcacgactggaagaagaggaacaggacattctgcagcgactccgagaaaatgctgctcaccttggggacaagcgccgggacctggcccacttggctgccgaggtggagggcaagtgcttacagtcaggcttcgagatgcttaaggatgtcaaaagtaccctggaaaaatgtgaaaaggtgaagaccatggaggtgacttcaactacaccttgtacttctctacatagtgagataaatgataatgtcagagggagatgaagagaggaccaggcgggaacctaga

SEQ ID NO: 32631 - DNA, 588 bp, Homo sapiens
cgccgacaccccagcttccactgacacgagcctcggcgcggcttccgcttccggcgagtattgtgtgtcgcgccgcggggcgggggcgaggggaggaggaaggagggaggcagcgctccggcggctccgcgccccgcactcccggacccgaagccgggaagatccgtcctggtgccttactgtgcatacagttctactcgtctcagattcctttcttgtctgttagaaacgtatgtcaaacgaggatacagtgtctggaactattggttctaagatataagtggaatgagcctggatcaggagaagtatgctgagctagagttgaaggaagcttctctttctaacaagagaaagcagagttaaattatggcagagacaagtctgttagaggctggggcctctgcagcctctacagctgcggctttggagaacttacaggtggaggcgagctgctctgtgtgcctggagtatctgaaggaacctgtcatcattgagtgtgggcacaacttctgcaaagcttgcatcacccgctggtgggaggacctagagagggacttcccttgtcctgtctgtcgaaagacatcccgc

SEQ ID NO: 32632 - DNA, 1824 bp, Homo sapiens
cccagcttccactgacacgagcctcggcgcggcttccgcttccggcgagtattgtgtgtcgcgccgcggggcgggggcgaggggaggaggaaggagggaggcagcgctccggcggctccgcgccccgcactcccggacccgaagccgggaagattcctttcttgtctgttagaaacgtatgtcaaacgaggatacagtgtctggaactattggttctaagatataagtggaatgagcctggatcaggagaagtatgctgagctagagttgaaggaagcttctctttctaacaagagaaagcagagttaaattatggcagagacaagtctgttagaggctggggcctctgcagcctctacagctgcggctttggagaacttacaggtggaggcgagctgctctgtgtgcctggagtatctgaaggaacctgtcatcattgagtgtgggcacaacttctgcaaagcttgcatcacccgctggtgggaggacctagagagggacttcccttgtcctgtctgtcgaaagacatcccgctaccgcagtctccgacctaatcggcaactaggcagtatggtggaaattgccaagcagctccaggccgtcaagcggaagatccgggatgagagcctctgcccccaacaccatgaggccctcagccttttctgttatgaggaccaggaggctgtatgcttgatatgtgcaatttcccacacccaccgggcccacaccgttgtgccactggacgatgctacacaggagtacaaggaaaaactgcagaagtgtctggagcccctggaacagaagctgcaggagatcactcgctgcaagtcctctgaggagaagaagcctggtgagctcaagagactagtggaaagtcgccgacagcagatcttgagggagtttgaagagcttcataggcggctggatgaagagcagcaggtgttgctttcacgactggaagaagaggaacaggacattctgcagcgactccgagaaaatgctgctcaccttggggacaagcgccgggacctggcccacttggctgccgaggtggagggcaagtgcttacagtcaggcttcgagatgcttaagccagttctttctgccagggaggaatgtgaaaaggtgaagaccatggaggtgacttcagtatccatagagctggaaaagaacttcagcaattttccccgacagtactttgccctaaggaaaatccttaaacagctaattgcggatgtgaccctggaccctgagacagctcatcctaacctagtcctgtcagaggatcgtaagagcgtcaagttcgtggagacaagactccgggatctccctgacacaccaaggcgtttcaccttctacccttgcgtcctggctactgagggtttcacctcaggtcgacactactgggaggtggaggccgcccattgtgtccttgcccaggaccccgagaaccaggcgctggcgaggttttactgctacactgagaggaccattgcgaagcggctcgtcttgcggcgggatccctcggtgaagaggactctctgtcgaggctgctcttccctcctcgtcccgggcctcacctgcacccagcgccagagacgctgcaggggacagcgctggaccgtacagacctgcctaacatgccagcgcagccaacgcttcctcaatgatcccgggcatttactctggggagacaggcctgaggcccagctcgggagccaagcagattccaaaccactacaacccttgccaaacacagcccactccatttcagaccgccttcctgaggagaaaatgcagactcagggttccagtaaccagtga

SEQ ID NO: 32633 - DNA, 3187 bp, Homo sapiens; identical to SEQ ID NO: 32625

SEQ ID NO: 32634 - DNA, 3535 bp, Homo sapiens; identical to SEQ ID NO: 32621

SEQ ID NO: 32635 - DNA, 1003 bp, Homo sapiens; identical to SEQ ID NO: 32629

SEQ ID NO: 32636 - DNA, 588 bp, Homo sapiens; identical to SEQ ID NO: 32631

SEQ ID NO: 32637 - DNA, 459 bp, Homo sapiens
caaggagtagaggaagaggaaggactaacgcagaggcactcaaggtctcactatgactgtagttgagagtcctctcccttcttccctaaccctttccccatttctctcaccacttctttgccagtctagatccgtcctggtgccttactgtgcatacagttctactcgtctcagaaacgtatgtcaaacgaggatacagtgtctggaactattggttctaagatataagtggaatgagcctggatcaggagaagtatgctgagctagagttgaaggaagcttctctttctaacaagagaaagcagagttaaattatggcagagacaagtctgttagaggctggggcctctgcagcctctacagctgcggctttggagaacttacaggtggaggcgagctgctctgtgtgcctggagtatctgaaggaacctgtcatcattgagtgtgggcacaacttct

SEQ ID NO: 32638 - DNA, 3535 bp, Homo sapiens; identical to SEQ ID NO: 32621

SEQ ID NO: 32639 - DNA, 708 bp, Homo sapiens; identical to SEQ ID NO: 32630

SEQ ID NO: 32640 - DNA, 459 bp, Homo sapiens; identical to SEQ ID NO: 32637

SEQ ID NO: 32641 - DNA, 459 bp, Homo sapiens; identical to SEQ ID NO: 32637

SEQ ID NO: 32642 - DNA, 427 bp, Homo sapiens
ggctccgcgccccgcactcccggacccgaagccgggaagtctagatccgtcctggtgccttactgtgcatacagttctactcgtctcagattcctttcttgtctgttagaaacgtatgtcaaacgaggatacagtgtctggaactattggttctaagatataagtggaatgagcctggatcaggagaagtatgctgagctagagttgaaggaagcttctctttctaacaagagaaagcagagttaaattatggcagagacaagtctgttagaggctggggcctctgcagcctctacagctgcggctttggagaacttacaggtggaggcgagctgctctgtgtgcctggagtatctgaaggaacctgtcatcattgagtgtgggcacaacttctgcaaagcttgcatcacccgctggtgggaggacc

SEQ ID NO: 32643 - DNA, 427 bp, Homo sapiens; identical to SEQ ID NO: 32642

SEQ ID NO: 32644 - DNA, 1003 bp, Homo sapiens
gaagagaggaaaagtgtggaagtccacaagccgcccccgccccgccctcttcgtcgactttcagctgcaccgggaggcggcggcgcctggccagagccggggcctggagcctggactagacagcctcgccggccggggcgccagtccagcgccctgcgggcaatgggcttcagcgctcgagcacgcgcatgcgcgggcctgtatctccagaggattcctcgggtcacctggacgccagcatctcagccacctgcccctctgggtcccttcttgcccttgattccccctgctgcttctcatcgccagccctcctcctccttcttccgcaggcaccactagacccggccgcggccgcccgccgacaccccagcttccactgacacgagcctcggcgcggcttccgcttccgattcctttcttgtctgttagaaacgtatgtcaaacgaggatacagtgtctggaactattggttctaagatataagtggaatgagcctggatcaggagaagtatgctgagctagagttgaaggaagcttctctttctaacaagagaaagcagagttaaattatggcagagacaagtctgttagaggctggggcctctgcagcctctacagctgcggctttggagaacttacaggtggaggcgagctgctctgtgtgcctggagtatctgaaggaacctgtcatcattgagtgtgggcacaacttctgcaaagcttgcatcacccgctggtgggaggacctagagagggacttcccttgtcctgtctgtcgaaagacatcccgctaccgcagtctccgacctaatcggcaactaggcagtatggtggaaattgccaagcagctccaggccgtcaagcggaagatccgggatgagagcctctgcccccaacaccatgaggccctcagccttttctgttatgaggaccaggaggctgtatgcttgatatgtgcaatttcccacacccaccgggctcacaccgttgtgccactggacga

SEQ ID NO: 32645 - DNA, 3187 bp, Homo sapiens; identical to SEQ ID NO: 32625

SEQ ID NO: 32646 - DNA, 708 bp, Homo sapiens
agacatcccgctaccgcagtctccgacctaatcggcaactaggcagtatggtggaaattgccaagcagctccaggccgtcaagcggaagatccgggatgagagcctctgcccccaacaccatgaggccctcagccttttctgttatgaggaccaggaggctgtatgcttgatatgtgcaatttcccacacccaccgggcccacaccgttgtgccactggacgacgctacacaggagtacaaggaaaaactgcagaagtgtctggagcccctggaacagaagctgcaggagatcactcgctgcaagtcctctgaggagaagaagcctggtgagctcaagagactagtggaaagtcgccgacagcagatcttgagggagtttgaagagcttcataggcggctggatgaagagcagcaggtgttgctttcacgactggaagaagaggaacaggacattctgcagcgactccgagaaaatgctgctcaccttggggacaagcgccgggacctggcccacttggctgccgaggtggagggcaagtgcttacagtcaggcttcgagatgcttaaggatgtcaaaagtaccctggaaaaatgtgaaaaggtgaagaccatggaggtgacttcaactacaccttgtacttctctacatagtgagataaatgataatgtcagagggagatgaagagaggaccaggcgggaacctaga

SEQ ID NO: 32647 - DNA, 708 bp, Homo sapiens; identical to SEQ ID NO: 32630

SEQ ID NO: 32648 - DNA, 459 bp, Homo sapiens; identical to SEQ ID NO: 32637

SEQ ID NO: 32649 - DNA, 3187 bp, Homo sapiens; identical to SEQ ID NO: 32625

SEQ ID NO: 32650 - DNA, 588 bp, Homo sapiens; identical to SEQ ID NO: 32631

SEQ ID NO: 32651 - DNA, 427 bp, Homo sapiens; identical to SEQ ID NO: 32642

SEQ ID NO: 32652 - DNA, 459 bp, Homo sapiens; identical to SEQ ID NO: 32637

SEQ ID NO: 32653 - DNA, 1013 bp, Homo sapiens
cgccgcggggcgggggcgaggggaggaggaaggagggaggcagcgctccggcggctccgcgccccgcactcccggacccgaagccgggaagaaacgtatgtcaaacgaggatacagtgtctggaactattggttctaagatataagtggaatgagcctggatcaggagaagtatgctgagctagagttgaaggaagcttctctttctaacaagagaaagcagagttaaattatggcagagacaagtctgttagaggctggggcctctgcagcctctacagctgcggctttggagaacttacaggtggaggcgagctgctctgtgtgcctggagtatctgaaggaacctgtcatcattgagtgtgggcacaacttctgcaaagcttgcatcacccgctggtgggaggacctagagagggacttcccttgtcctgtctgtcgaaagacatcccgctaccgcagtctccgacctaatcggcaactaggcagtatggtggaaattgccaagcagctccaggccgtcaagcggaagatccgggatgagagcctctgcccccaacaccatgaggccctcagccttttctgttatgaggaccaggaggctgtatgcttgatatgtgcaatttcccacacccaccgggcccacaccgttgtgccactggacgatgctacacaggagtacaaggaaaaactgcagaagtgtctggagcccctggaacagaagctgcaggagatcactcgctgcaagtcctctgaggagaagaagcctggtgagctcaagagactagtggaaagtcgccgacagcagatcttgagggagtttgaagagcttcataggcggctggatgaagagcagcaggtgttgctttcacgactggaagaagaggaacaggacattctgcagcgactccgagaaaatgctgctcaccttggggacaagcgccgggacctggcccacttggctgccgaggtggagggcaagtgcttacagtcaggcttcgagatgcttaaggt

SEQ ID NO: 32654 - DNA, 427 bp, Homo sapiens; identical to SEQ ID NO: 32642

SEQ ID NO: 32655 - DNA, 1003 bp, Homo sapiens; identical to SEQ ID NO: 32629

SEQ ID NO: 32656 - DNA, 3198 bp, Homo sapiens; identical to SEQ ID NO: 32626

SEQ ID NO: 32657 - DNA, 3535 bp, Homo sapiens; identical to SEQ ID NO: 32621

SEQ ID NO: 32658 - DNA, 1013 bp, Homo sapiens; identical to SEQ ID NO: 32653

SEQ ID NO: 32659 - DNA, 3535 bp, Homo sapiens; identical to SEQ ID NO: 32621

SEQ ID NO: 32660 - DNA, 427 bp, Homo sapiens; identical to SEQ ID NO: 32642

SEQ ID NO: 32661 - DNA, 427 bp, Homo sapiens; identical to SEQ ID NO: 32642

SEQ ID NO: 32662 - DNA, 708 bp, Homo sapiens; identical to SEQ ID NO: 32630

SEQ ID NO: 32663 - DNA, 3249 bp, Homo sapiens; identical to SEQ ID NO: 32627

SEQ ID NO: 32664 - DNA, 588 bp, Homo sapiens; identical to SEQ ID NO: 32631

SEQ ID NO: 32665 - DNA, 708 bp, Homo sapiens; identical to SEQ ID NO: 32630

SEQ ID NO: 32666 - DNA, 3249 bp, Homo sapiens
cccagcttccactgacacgagcctcggcgcggcttccgcttccggcgagtattgtgtgtcgcgccgcggggcgggggcgaggggaggaggaaggagggaggcagcgctccggcggctccgcgccccgcactcccggacccgaagccgggaagattcctttcttgtctgttagaaacgtatgtcaaacgaggatacagtgtctggaactattggttctaagatataagtggaatgagcctggatcaggagaagtatgctgagctagagttgaaggaagcttctctttctaacaagagaaagcagagttaaattatggcagagacaagtctgttagaggctggggcctctgcagcctctacagctgcggctttggagaacttacaggtggaggcgagctgctctgtgtgcctggagtatctgaaggaacctgtcatcattgagtgtgggcacaacttctgcaaagcttgcatcacccgctggtgggaggacctagagagggacttcccttgtcctgtctgtcgaaagacatcccgctaccgcagtctccgacctaatcggcaactaggcagtatggtggaaattgccaagcagctccaggccgtcaagcggaagatccgggatgagagcctctgcccccaacaccatgaggccctcagccttttctgttatgaggaccaggaggctgtatgcttgatatgtgcaatttcccacacccaccgggcccacaccgttgtgccactggacgacgctacacaggagtacaaggaaaaactgcagaagtgtctggagcccctggaacagaagctgcaggagatcactcgctgcaagtcctctgaggagaagaagcctggtgagctcaagagactagtggaaagtcgccgacagcagatcttgagggagtttgaagagcttcataggcggctggatgaagagcagcaggtgttgctttcacgactggaagaagaggaacaggacattctgcagcgactccgagaaaatgctgctcaccttggggacaagcgccgggacctggcccacttggctgccgaggtggagggcaagtgcttacagtcaggcttcgagatgcttaaggatgtcaaaagtaccctggaaaaatgtgaaaaggtgaagaccatggaggtgacttcagtatccatagagctggaaaagaacttcagcaattttccccgacagtactttgccctaaggaaaatccttaaacagctaattgcggatgtgaccctggaccccgagacagctcatcctaacctagtcctgtcagaggatcgtaagagcgtcaagttcgtggagacaagactccgggatctccctgacacaccaaggcgtttcaccttctacccttgcgtcctggctactgagggtttcacctcaggtcgacactactgggaggtggaggtgggcgacaagacccactgggcagtgggtgtatgccgggactccgtgagccgaaagggcgagttgactccactccctgagactggctactggcgggtgcggctatggaatggggacaaatatgcagccaccaccacaccttttacccctttgcacatcaaggtgaaacccaagcgggtaggcatattcctagactatgaggccggcacactgtctttctacaatgtcacagaccgctctcatatctacaccttcactgatacttttactgagaaactttggcccctcttctacccaggcatccgggctggacggaagaatgctgcaccacttaccatcaggcccccaacagattgggagtgacaggttgggatgtgggaatgactggggtgaggcagggtcaagtgctacgggcctccttcccgtgtcctgctggaacgtcttcgtgtccacctgggtccagtcctgaatcatcttggagaaacaccttggtttctaggatggttttgtgtggagggggaggtaggactgggctggatgagagagcacagctgtgacttcctcctaactgtcagggtggggagctggttcccagaggattgtctaccctgaagtccatcaggttttctgttgcacaaggacgggtcaggaaggaaggagaggcttttccagaaacaaaaaatctgtgagggtctgacttgctcaaaccagaggaggaaacagaaacccctgcacatctttttagggggttctttgacccaggatagtcttgcttcttgaggtagatcacaggggtctgtgtacctctgaattcatgagagatgaatgacagatgctctcatgggtctagatattgaggagtttttctgagggcagagattggacatcaacaaggctagaagggtcagggaagtgggctaaaggaacagattcctagagattaatgaagaggagggaggtttctttggtcttctattccaagggtaaggttgcgattatgggtaagattggccagaggtaggaatgtggggagaaggagaggctgaaaagaaagcagaggagaacccaggtccctgcctcagccttcagcagagttggcttattgcctgcctctataccaataagtcagtcaccttgctcctctccagaggcaaagtggaagagatcctgcaagacacatctatcctttcacagtgttcccaagggaacttggaaaggagagtcaggtattagaggaaagagaagggtatttgtatacaaagccctggccttaaagaatgttacttagtagctactcccaaattgtcagccttcttacctggccaaggtgtccaagccagaaaggaaaaaaggttatggagtctttctcaccctaaggacagggtggaagagggtggtatatagggaagggccagataggcaacttcatttggcttgtgtgcatctggcctggaactggtgttaagccaggcttttgcttgtttgttgccatccctcaccctttgccatttcccttttcagagaatgtaaatgattttcatgttaggccaaaataaacaacttatagggtacatatgttgtcataaaaggtaaaagtgatgcatgccaaaccaaactaaaccaatttggattatctgctattcgggtaatcttcacagaaatgactgagagaagaatctgcagtttactgagggcatttcagttcctcctaccacctcaacaggactttgtccagactctcctcctcttacctttgtgccttgactgtggttctttgtggcaagatactttggttggttaaaataatatggaacaaaggatccactgaagtga

SEQ ID NO: 32667 - DNA, 3249 bp, Homo sapiens; identical to SEQ ID NO: 32627

SEQ ID NO: 32668 - DNA, 1013 bp, Homo sapiens; identical to SEQ ID NO: 32653

SEQ ID NO: 32669 - DNA, 588 bp, Homo sapiens; identical to SEQ ID NO: 32631

SEQ ID NO: 32670 - DNA, 427 bp, Homo sapiens; identical to SEQ ID NO: 32642

SEQ ID NO: 32671 - DNA, 1013 bp, Homo sapiens
cgccgcggggcgggggcgaggggaggaggaaggagggaggcagcgctccggcggctccgcgccccgcactcccggacccgaagccgggaagaaacgtatgtcaaacgaggatacagtgtctggaactattggttctaagatataagtggaatgagcctggatcaggagaagtatgctgagctagagttgaaggaagcttctctttctaacaagagaaagcagagttaaattatggcagagacaagtctgttagaggctggggcctctgcagcctctacagctgcggctttggagaacttacaggtggaggcgagctgctctgtgtgcctggagtatctgaaggaacctgtcatcattgagtgtgggcacaacttctgcaaagcttgcatcacccgctggtgggaggacctagagagggacttcccttgtcctgtctgtcgaaagacatcccgctaccgcagtctccgacctaatcggcaactaggcagtatggtggaaattgccaagcagctccaggccgtcaagcggaagatccgggatgagagcctctgcccccaacaccatgaggccctcagccttttctgttatgaggaccaggaggctgtatgcttgatatgtgcaatttcccacacccaccgggcccacaccgttgtgccactggacgacgctacacaggagtacaaggaaaaactgcagaagtgtctggagcccctggaacagaagctgcaggagatcactcgctgcaagtcctctgaggagaagaagcctggtgagctcaagagactagtggaaagtcgccgacagcagatcttgagggagtttgaagagcttcataggcggctggatgaagagcagcaggtgttgctttcacgactggaagaagaggaacaggacattctgcagcgactccgagaaaatgctgctcaccttggggacaagcgccgggacctggcccacttggctgccgaggtggagggcaagtgcttacagtcaggcttcgagatgcttaaggt

SEQ ID NO: 32672 - DNA, 3198 bp, Homo sapiens; identical to SEQ ID NO: 32626

SEQ ID NO: 32673 - DNA, 3187 bp, Homo sapiens
attcctttcttgtctgttagaaacgtatgtcaaacgaggatacagtgtctggaactattggttctaagatataagtggaatgagcctggatcaggagaagtatgctgagctagagttgaaggaagcttctctttctaacaagagaaagcagagttaaattatggcagagacaagtctgttagaggctggggcctctgcagcctctacagctgcggctttggagaacttacaggtggaggcgagctgctctgtgtgcctggagtatctgaaggaacctgtcatcattgagtgtgggcacaacttctgcaaagcttgcatcacccgctggtgggaggacctagagagggacttcccttgtcctgtctgtcgaaagacatcccgctaccgcagtctccgacctaatcggcaactaggcagtatggtggaaattgccaagcagctccaggccgtcaagcggaagatccgggatgagagcctctgcccccaacaccatgaggccctcagccttttctgttatgaggaccaggaggctgtatgcttgatatgtgcaatttcccacacccaccgggcccacaccgttgtgccactggacgacgctacacaggagtacaaggaaaaactgcagaagtgtctggagcccctggaacagaagctgcaggagatcactcgctgcaagtcctctgaggagaagaagcctggtgagctcaagagactagtggaaagtcgccgacagcagatcttgagggagtttgaagagcttcataggcggctggatgaagagcagcaggtgttgctttcacgactggaagaagaggaacaggacattctgcagcgactccgagaaaatgctgctcaccttggggacaagcgccgggacctggcccacttggctgccgaggtggagggcaagtgcttacagtcaggcttcgagatgcttaaggatgtcaaaagtaccctggaaaagaatattcctagaaagttcggaggctcactctcaacgatctgtccacgggatcataaggctctccttggattagtaaaagaaatcaacagatgtgaaaaggtgaagaccatggaggtgacttcagtatccatagagctggaaaagaacttcagcaattttccccgacagtactttgccctaaggaaaatccttaaacagctaattgcggatgtgaccctggaccccgagacagctcatcctaacctagtcctgtcagaggatcgtaagagcgtcaagttcgtggagacaagactccgggatctccctgacacaccaaggcgtttcaccttctacccttgcgtcctggctactgagggtttcacctcaggtcgacactactgggaggtggaggtgggcgacaagacccactgggcagtgggtgtatgccgggactccgtgagccgaaagggcgagttgactccactccctgagactggctactggcgggtgcggctatggaatggggacaaatatgcagccaccaccacaccttttacccctttgcacatcaaggtgaaacccaagcgggtaggcatattcctagactatgaggccggcacactgtctttctacaatgtcacagaccgctctcatatctacaccttcactgatacttttactgagaaactttggcccctcttctacccaggcatccgggctggacggaagaatgctgcaccacttaccatcaggcccccaacagattgggagtgacaggttgggatgtgggaatgactggggtgaggcagggtcaagtgctacgggcctccttcccgtgtcctgctggaacgtcttcgtgtccacctgggtccagtcctgaatcatcttggagaaacaccttggtttctaggatggttttgtgtggagggggaggtaggactgggctggatgagagagcacagctgtgacttcctcctaactgtcagggtggggagctggttcccagaggattgtctaccctgaagtccatcaggttttctgttgcacaaggacgggtcaggaaggaaggagaggcttttccagaaacaaaaaatctgtgagggtctgacttgctcaaaccagaggaggaaacagaaacccctgcacatctttttagggggttctttgacccaggatagtcttgcttcttgaggtagatcacaggggtctgtgtacctctgaattcatgagagatgaatgacagatgctctcatgggtctagatattgaggagtttttctgagggcagagattggacatcaacaaggctagaagggtcagggaagtgggctaaaggaacagattcctagagattaatgaagaggagggaggtttctttggtcttctattccaagggtaaggttgcgattatgggtaagattggccagaggtaggaatgtggggagaaggagaggctgaaaagaaagcagaggagaacccaggtccctgcctcagccttcagcagagttggcttattgcctgcctctataccaataagtcagtcaccttgctcctctccagaggcaaagtggaagagatcctgcaagacacatctatcctttcacagtgttcccaagggaacttggaaaggagagtcaggtattagaggaaagagaagggtatttgtatacaaagccctggccttaaagaatgttacttagtagctactcccaaattgtcagccttcttacctggccaaggtgtccaagccagaaaggaaaaaaggttatggagtctttctcaccctaaggacagggtggaagagggtggtatatagggaagggccagataggcaacttcatttggcttgtgtgcatctggcctggaactggtgttaagccaggcttttgcttgtttgttgccatccctcaccctttgccatttcccttttcagagaatgtaaatgattttcatgttaggccaaaataaacaacttatagggtacatatgttgtcataaaaggtaaaagtgatgcatgccaaaccaaactaaaccaatttggattatctgctattcgggtaatcttcacagaaatgactgagagaagaatctgcagtttactgagggcatttcagttcctcctaccacctcaacaggactttgtccagactctcctcctcttacctttgtgccttgactgtggttctttgtggcaagatactttggttggttaaaataatatggaacaaaggatccactgaagtga

SEQ ID NO: 32674 - DNA, 3198 bp, Homo sapiens; identical to SEQ ID NO: 32626

SEQ ID NO: 32675 - DNA, 1013 bp, Homo sapiens
cgccgcggggcgggggcgaggggaggaggaaggagggaggcagcgctccggcggctccgcgccccgcactcccggacccgaagccgggaagaaacgtatgtcaaacgaggatacagtgtctggaactattggttctaagatataagtggaatgagcctggatcaggagaagtatgctgagctagagttgaaggaagcttctctttctaacaagagaaagcagagttaaattatggcagagacaagtctgttagaggctggggcctctgcagcctctacagctgcggctttggagaacttacaggtggaggcgagctgctctgtgtgcctggagtatctgaaggaacctgtcatcattgagtgtgggcacaacttctgcaaagcttgcatcacccgctggtgggaggacctagagagggacttcccttgtcctgtctgtcgaaagacatcccgctaccgcagtctccgacctaatcggcaactaggcagtatggtggaaattgccaagcagctccaggccgtcaagcggaagatccgggatgagagcctctgcccccaacaccatgaggccctcagccttttctgttatgaggaccaggaggctgtatgcttgatatgtgcaatttcccacacccaccgggctcacaccgttgtgccactggacgatgctacacaggagtacaaggaaaaactgcagaagtgtctggagcccctggaacagaagctgcaggagatcactcgctgcaagtcctctgaggagaagaagcctggtgagctcaagagactagtggaaagtcgccgacagcagatcttgagggagtttgaagagcttcataggcggctggatgaagagcagcaggtgttgctttcacgactggaagaagaggaacaggacattctgcagcgactccgagaaaatgctgctcaccttggggacaagcgccgggacctggcccacttggctgccgaggtggagggcaagtgcttacagtcaggcttcgagatgcttaaggt

SEQ ID NO: 32676 - DNA, 588 bp, Homo sapiens; identical to SEQ ID NO: 32631

SEQ ID NO: 32677 - DNA, 1548 bp, Homo sapiens
cccagcttccactgacacgagcctcggcgcggcttccgcttccggcgagtattgtgtgtcgcgccgcggggcgggggcgaggggaggaggaaggagggaggcagcgctccggcggctccgcgccccgcactcccggacccgaagccgggaagattcctttcttgtctgttagaaacgtatgtcaaacgaggatacagtgtctggaactattggttctaagatataagtggaatgagcctggatcaggagaagtatgctgagctagagttgaaggaagcttctctttctaacaagagaaagcagagttaaattatggcagagacaagtctgttagaggctggggcctctgcagcctctacagctgcggctttggagaacttacaggtggaggcgagctgctctgtgtgcctggagtatctgaaggaacctgtcatcattgagtgtgggcacaacttctgcaaagcttgcatcacccgctggtgggaggacctagagagggacttcccttgtcctgtctgtcgaaagacatcccgctaccgcagtctccgacctaatcggcaactaggcagtatggtggaaattgccaagcagctccaggccgtcaagcggaagatccgggatgagagcctctgcccccaacaccatgaggccctcagccttttctgttatgaggaccaggaggctgtatgcttgatatgtgcaatttcccacacccaccgggcccacaccgttgtgccactggacgatgctacacaggagtacaaggaaaaactgcagaagtgtctggagcccctggaacagaagctgcaggagatcactcgctgcaagtcctctgaggagaagaagcctggtgagctcaagagactagtggaaagtcgccgacagcagatcttgagggagtttgaagagcttcataggcggctggatgaagagcagcaggtgttgctttcacgactggaagaagaggaacaggacattctgcagcgactccgagaaaatgctgctcaccttggggacaagcgccgggacctggcccacttggctgccgaggtggagggcaagtgcttacagtcaggcttcgagatgcttaagccagttctttctgccagggaggaatgtgaaaaggtgaagaccatggaggtgacttcagtatccatagagctggaaaagaacttcagcaattttccccgacagtactttgccctaaggaaaatccttaaacagctaattgcggatgtgaccctggaccctgagacagctcatcctaacctagtcctgtcagaggatcgtaagagcgtcaagttcgtggagacaagactccgggatctccctgacacaccaaggcgtttcaccttctacccttgcgtcctggctactgagggtttcacctcaggtcgacactactgggaggtggaggtgggcgacaagacccactgggcagtgggtgtatgccgggactccgtgagccgaaagggcgggtgcggctatggaatggggacaaatatgcagccaccaccacaccttttacccctttgcacatcaaggtga

SEQ ID NO: 32678 - DNA, 3198 bp, Homo sapiens; identical to SEQ ID NO: 32626

SEQ ID NO: 32679 - DNA, 1013 bp, Homo sapiens; identical to SEQ ID NO: 32653

SEQ ID NO: 32680 - DNA, 459 bp, Homo sapiens; identical to SEQ ID NO: 32637

SEQ ID NO: 32681 - DNA, 1013 bp, Homo sapiens; identical to SEQ ID NO: 32653

SEQ ID NO: 32682 - DNA, 3535 bp, Homo sapiens
cggcagcgtcatagcggcgggcatcccatctgcacgtcacacctctttctcacctggacacgcatcccttcctaccctgccagccacgacgtttcctctttcccctctccaatgccccagccccagatctggcggaagaagatggagaacgggggtgggacagagttgtggacaacctctcaggagagggtcgcaaggtgggaccctgaacagtggtagaaacaaaatgagattgtccctgaagtttgcccttcagctgagacacaaggagtagaggaagaggaaggactaacgcagaggcactcaaggtctcactatgactgtagttgagagtcctctcccttcttccctaaccctttccccatttctctcaccacttctttgccagtctagatccgtcctggtgccttactgtgcatacagttctactcgtctcagattcctttcttgtctgttagaaacgtatgtcaaacgaggatacagtgtctggaactattggttctaagatataagtggaatgagcctggatcaggagaagtatgctgagctagagttgaaggaagcttctctttctaacaagagaaagcagagttaaattatggcagagacaagtctgttagaggctggggcctctgcagcctctacagctgcggctttggagaacttacaggtggaggcgagctgctctgtgtgcctggagtatctgaaggaacctgtcatcattgagtgtgggcacaacttctgcaaagcttgcatcacccgctggtgggaggacctagagagggacttcccttgtcctgtctgtcgaaagacatcccgctaccgcagtctccgacctaatcggcaactaggcagtatggtggaaattgccaagcagctccaggccgtcaagcggaagatccgggatgagagcctctgcccccaacaccatgaggccctcagccttttctgttatgaggaccaggaggctgtatgcttgatatgtgcaatttcccacacccaccgggcccacaccgttgtgccactggacgacgctacacaggagtacaaggaaaaactgcagaagtgtctggagcccctggaacagaagctgcaggagatcactcgctgcaagtcctctgaggagaagaagcctggtgagctcaagagactagtggaaagtcgccgacagcagatcttgagggagtttgaagagcttcataggcggctggatgaagagcagcaggtgttgctttcacgactggaagaagaggaacaggacattctgcagcgactccgagaaaatgctgctcaccttggggacaagcgccgggacctggcccacttggctgccgaggtggagggcaagtgcttacagtcaggcttcgagatgcttaaggatgtcaaaagtaccctggaaaaatgtgaaaaggtgaagaccatggaggtgacttcagtatccatagagctggaaaagaacttcagcaattttccccgacagtactttgccctaaggaaaatccttaaacagctaattgcggatgtgaccctggaccccgagacagctcatcctaacctagtcctgtcagaggatcgtaagagcgtcaagttcgtggagacaagactccgggatctccctgacacaccaaggcgtttcaccttctacccttgcgtcctggctactgagggtttcacctcaggtcgacactactgggaggtggaggtgggcgacaagacccactgggcagtgggtgtatgccgggactccgtgagccgaaagggcgagttgactccactccctgagactggctactggcgggtgcggctatggaatggggacaaatatgcagccaccaccacaccttttacccctttgcacatcaaggtgaaacccaagcgggtaggcatattcctagactatgaggccggcacactgtctttctacaatgtcacagaccgctctcatatctacaccttcactgatacttttactgagaaactttggcccctcttctacccaggcatccgggctggacggaagaatgctgcaccacttaccatcaggcccccaacagattgggagtgacaggttgggatgtgggaatgactggggtgaggcagggtcaagtgctacgggcctccttcccgtgtcctgctggaacgtcttcgtgtccacctgggtccagtcctgaatcatcttggagaaacaccttggtttctaggatggttttgtgtggagggggaggtaggactgggctggatgagagagcacagctgtgacttcctcctaactgtcagggtggggagctggttcccagaggattgtctaccctgaagtccatcaggttttctgttgcacaaggacgggtcaggaaggaaggagaggcttttccagaaacaaaaaatctgtgagggtctgacttgctcaaaccagaggaggaaacagaaacccctgcacatctttttagggggttctttgacccaggatagtcttgcttcttgaggtagatcacaggggtctgtgtacctctgaattcatgagagatgaatgacagatgctctcatgggtctagatattgaggagtttttctgagggcagagattggacatcaacaaggctagaagggtcagggaagtgggctaaaggaacagattcctagagattaatgaagaggagggaggtttctttggtcttctattccaagggtaaggttgcgattatgggtaagattggccagaggtaggaatgtggggagaaggagaggctgaaaagaaagcagaggagaacccaggtccctgcctcagccttcagcagagttggcttattgcctgcctctataccaataagtcagtcaccttgctcctctccagaggcaaagtggaagagatcctgcaagacacatctatcctttcacagtgttcccaagggaacttggaaaggagagtcaggtattagaggaaagagaagggtatttgtatacaaagccctggccttaaagaatgttacttagtagctactcccaaattgtcagccttcttacctggccaaggtgtccaagccagaaaggaaaaaaggttatggagtctttctcaccctaaggacagggtggaagagggtggtatatagggaagggccagataggcaacttcatttggcttgtgtgcatctggcctggaactggtgttaagccaggcttttgcttgtttgttgccatccctcaccctttgccatttcccttttcagagaatgtaaatgattttcatgttaggccaaaataaacaacttatagggtacatatgttgtcataaaaggtaaaagtgatgcatgccaaaccaaactaaaccaatttggattatctgctattcgggtaatcttcacagaaatgactgagagaagaatctgcagtttactgagggcatttcagttcctcctaccacctcaacaggactttgtccagactctcctcctcttacctttgtgccttgactgtggttctttgtggcaagatactttggttggttaaaataatatggaacaaaggatccactgaagtga

SEQ ID NO: 32683 - DNA, 588 bp, Homo sapiens; identical to SEQ ID NO: 32631

SEQ ID NO: 32684 - DNA, 3198 bp, Homo sapiens
gcgaggggaggaggaaggagggaggcagcgctccggcggctccgcgccccgcactcccggacccgaagccgggaagatccgtcctggtgccttactgtgcatacagttctactcgtctcagaaacgtatgtcaaacgaggatacagtgtctggaactattggttctaagatataagtggaatgagcctggatcaggagaagtatgctgagctagagttgaaggaagcttctctttctaacaagagaaagcagagttaaattatggcagagacaagtctgttagaggctggggcctctgcagcctctacagctgcggctttggagaacttacaggtggaggcgagctgctctgtgtgcctggagtatctgaaggaacctgtcatcattgagtgtgggcacaacttctgcaaagcttgcatcacccgctggtgggaggacctagagagggacttcccttgtcctgtctgtcgaaagacatcccgctaccgcagtctccgacctaatcggcaactaggcagtatggtggaaattgccaagcagctccaggccgtcaagcggaagatccgggatgagagcctctgcccccaacaccatgaggccctcagccttttctgttatgaggaccaggaggctgtatgcttgatatgtgcaatttcccacacccaccgggcccacaccgttgtgccactggacgacgctacacaggagtacaaggaaaaactgcagaagtgtctggagcccctggaacagaagctgcaggagatcactcgctgcaagtcctctgaggagaagaagcctggtgagctcaagagactagtggaaagtcgccgacagcagatcttgagggagtttgaagagcttcataggcggctggatgaagagcagcaggtgttgctttcacgactggaagaagaggaacaggacattctgcagcgactccgagaaaatgctgctcaccttggggacaagcgccgggacctggcccacttggctgccgaggtggagggcaagtgcttacagtcaggcttcgagatgcttaaggatgtcaaaagtaccctggaaaaatgtgaaaaggtgaagaccatggaggtgacttcagtatccatagagctggaaaagaacttcagcaattttccccgacagtactttgccctaaggaaaatccttaaacagctaattgcggatgtgaccctggaccccgagacagctcatcctaacctagtcctgtcagaggatcgtaagagcgtcaagttcgtggagacaagactccgggatctccctgacacaccaaggcgtttcaccttctacccttgcgtcctggctactgagggtttcacctcaggtcgacactactgggaggtggaggtgggcgacaagacccactgggcagtgggtgtatgccgggactccgtgagccgaaagggcgagttgactccactccctgagactggctactggcgggtgcggctatggaatggggacaaatatgcagccaccaccacaccttttacccctttgcacatcaaggtgaaacccaagcgggtaggcatattcctagactatgaggccggcacactgtctttctacaatgtcacagaccgctctcatatctacaccttcactgatacttttactgagaaactttggcccctcttctacccaggcatccgggctggacggaagaatgctgcaccacttaccatcaggcccccaacagattgggagtgacaggttgggatgtgggaatgactggggtgaggcagggtcaagtgctacgggcctccttcccgtgtcctgctggaacgtcttcgtgtccacctgggtccagtcctgaatcatcttggagaaacaccttggtttctaggatggttttgtgtggagggggaggtaggactgggctggatgagagagcacagctgtgacttcctcctaactgtcagggtggggagctggttcccagaggattgtctaccctgaagtccatcaggttttctgttgcacaaggacgggtcaggaaggaaggagaggcttttccagaaacaaaaaatctgtgagggtctgacttgctcaaaccagaggaggaaacagaaacccctgcacatctttttagggggttctttgacccaggatagtcttgcttcttgaggtagatcacaggggtctgtgtacctctgaattcatgagagatgaatgacagatgctctcatgggtctagatattgaggagtttttctgagggcagagattggacatcaacaaggctagaagggtcagggaagtgggctaaaggaacagattcctagagattaatgaagaggagggaggtttctttggtcttctattccaagggtaaggttgcgattatgggtaagattggccagaggtaggaatgtggggagaaggagaggctgaaaagaaagcagaggagaacccaggtccctgcctcagccttcagcagagttggcttattgcctgcctctataccaataagtcagtcaccttgctcctctccagaggcaaagtggaagagatcctgcaagacacatctatcctttcacagtgttcccaagggaacttggaaaggagagtcaggtattagaggaaagagaagggtatttgtatacaaagccctggccttaaagaatgttacttagtagctactcccaaattgtcagccttcttacctggccaaggtgtccaagccagaaaggaaaaaaggttatggagtctttctcaccctaaggacagggtggaagagggtggtatatagggaagggccagataggcaacttcatttggcttgtgtgcatctggcctggaactggtgttaagccaggcttttgcttgtttgttgccatccctcaccctttgccatttcccttttcagagaatgtaaatgattttcatgttaggccaaaataaacaacttatagggtacatatgttgtcataaaaggtaaaagtgatgcatgccaaaccaaactaaaccaatttggattatctgctattcgggtaatcttcacagaaatgactgagagaagaatctgcagtttactgagggcatttcagttcctcctaccacctcaacaggactttgtccagactctcctcctcttacctttgtgccttgactgtggttctttgtggcaagatactttggttggttaaaataatatggaacaaaggatccactgaagtga

SEQ ID NO: 32685 - DNA, 3187 bp, Homo sapiens; identical to SEQ ID NO: 32625

SEQ ID NO: 32686 - DNA, 3249 bp, Homo sapiens; identical to SEQ ID NO: 32627

SEQ ID NO: 32687 - DNA, 1003 bp, Homo sapiens; identical to SEQ ID NO: 32629

SEQ ID NO: 32688 - DNA, 1003 bp, Homo sapiens; identical to SEQ ID NO: 32629

SEQ ID NO: 32689 - DNA, 708 bp, Homo sapiens
agacatcccgctaccgcagtctccgacctaatcggcaactaggcagtatggtggaaattgccaagcagctccaggccgtcaagcggaagatccgggatgagagcctctgcccccaacaccatgaggccctcagccttttctgttatgaggaccaggaggctgtatgcttgatatgtgcaatttcccacacccaccgggctcacaccgttgtgccactggacgatgctacacaggagtacaaggaaaaactgcagaagtgtctggagcccctggaacagaagctgcaggagatcactcgctgcaagtcctctgaggagaagaagcctggtgagctcaagagactagtggaaagtcgccgacagcagatcttgagggagtttgaagagcttcataggcggctggatgaagagcagcaggtgttgctttcacgactggaagaagaggaacaggacattctgcagcgactccgagaaaatgctgctcaccttggggacaagcgccgggacctggcccacttggctgccgaggtggagggcaagtgcttacagtcaggcttcgagatgcttaaggatgtcaaaagtaccctggaaaaatgtgaaaaggtgaagaccatggaggtgacttcaactacaccttgtacttctctacatagtgagataaatgataatgtcagagggagatgaagagaggaccaggcgggaacctaga

SEQ ID NO: 32690 - DNA, 459 bp, Homo sapiens; identical to SEQ ID NO: 32637

SEQ ID NO: 32691 - DNA, 1003 bp, Homo sapiens; identical to SEQ ID NO: 32629

SEQ ID NO: 32692 - DNA, 3249 bp, Homo sapiens; identical to SEQ ID NO: 32627

SEQ ID NO: 32693 - DNA, 3248 bp, Homo sapiens
cccagcttccactgacacgagcctcggcgcggcttccgcttccggcgagtattgtgtgtcgcgccgcggggcgggggcgaggggaggaggaaggagggaggcagcgctccggcggctccgcgccccgcactcccggacccgaagccgggaagattcctttcttgtctgttagaaacgtatgtcaaacgaggatacagtgtctggaactattggttctaagatataagtggaatgagcctggatcaggagaagtatgctgagctagagttgaaggaagcttctctttctaacaagagaaagcagagttaaattatggcagagacaagtctgttagaggctggggcctctgcagcctctacagctgcggctttggagaacttacaggtggaggcgagctgctctgtgtgcctggagtatctgaaggaacctgtcatcattgagtgtgggcacaacttctgcaaagcttgcatcacccgctggtgggaggacctagagagggacttcccttgtcctgtctgtcgaaagacatcccgctaccgcagtctccgacctaatcggcaactaggcagtatggtggaaattgccaagcagctccaggccgtcaagcggaagatccgggatgagagcctctgcccccaacaccatgaggccctcagccttttctgttatgaggaccaggaggctgtatgcttgatatgtgcaatttcccacacccaccgggcccacaccgttgtgccactggacgatgctacacaggagtacaaggaaaaactgcagaagtgtctggagcccctggaacagaagctgcaggagatcactcgctgcaagtcctctgaggagaagaagcctggtgagctcaagagactagtggaaagtcgccgacagcagatcttgagggagtttgaagagcttcataggcggctggatgaagagcagcaggtgttgctttcacgactggaagaagaggaacaggacattctgcagcgactccgagaaaatgctgctcaccttggggacaagcgccgggacctggcccacttggctgccgaggtggagggcaagtgcttacagtcaggcttcgagatgcttaagccagttctttctgccagggaggaatgtgaaaaggtgaagaccatggaggtgacttcagtatccatagagctggaaaagaacttcagcaattttccccgacagtactttgccctaaggaaaatccttaaacagctaattgcggatgtgaccctggaccctgagacagctcatcctaacctagtcctgtcagaggatcgtaagagcgtcaagttcgtggagacaagactccgggatctccctgacacaccaaggcgtttcaccttctacccttgcgtcctggctactgagggtttcacctcaggtcgacactactgggaggtggaggtgggcgacaagacccactgggcagtgggtgtatgccgggactccgtgagccgaaagggcgagttgactccactccctgagactggctactggcgggtgcggctatggaatggggacaaatatgcagccaccaccacaccttttacccctttgcacatcaaggtgaaacccaagcgggtaggcatattcctagactatgaggccggcacactgtctttctacaatgtcacagaccgctctcatatctacaccttcactgatacttttactgagaaactttggcccctcttctacccaggcatccgggctggacggaagaatgctgcaccacttaccatcaggcccccaacagattgggagtgacaggttgggatgtgggaatgactggggtgaggcagggtcaagtgctacgggcctccttcccgtgtcctgctggaacgtcttcgtgtccacctgggtccagtcctgaatcatcttggagaaacaccttggtttctaggatggttttgtgtggagggggaggtaggactgggctggatgagagagcacagctgtgacttcctcctaactgtcagggtggggagctggttcccagaggattgtctaccctgaagtccatcaggttttctgttgcacaaggacgggtcaggaaggaaggagaggcttttccagaaacaaaaaatctgtgagggtctgacttgctcaaaccagaggaggaaacagaaacccctgcacatctttttagggggttctttgacccaggatagtcttgcttcttgaggtagatcacaggggtctgtgtacctctgaattcatgagagatgaatgacagatgctctcatgggtctagatattgaggagtttttctgagggcagagattggacatcaacaaggctagaagggtcagggaagtgggctaaaggaacagattcctagagattaatgaagaggagggaggtttctttggtcttctattccaagggtaaggttgcgattatgggtaagattggccagaggtaggaatgtggggagaaggagaggctgaaaagaaagcagaggagaacccaggtccctgcctcagccttcagcagagttggcttattgcctgcctctataccaataagtcagtcaccttgctcctctccagaggcaaagtggaagagatcctgcaagacacatctatcctttcacagtgttcccaagggaacttggaaaggagagtcaggtattagaggaaagagaagggtatttgtatacaaagccctggccttaaagaatgttacttagtagctactcccaaattgtcagccttcttacctggccaaggtgtccaagccagaaaggaaaaaaggttatggagtctttctcaccctaaggacagggtggaagagggtggtatatagggaagggccagataggcaacttcatttggcttgtgtgcatctggcctggaactggtgttaagccaggcttttgcttgtttgttgccatccctcaccctttgccatttcccttttcagagaatgtaaatgattttcatgttaggccaaaataaacaacttatagggtacatatgttgtcataaaaggtaaaagtgatgcatgccaaaccaaactaaaccaatttggattatctgctattcgggtaatcttcacagaaatgactgagagaagaatctgcagtttactgagggcatttcagttcctcctaccacctcaacaggactttgtccagactctcctcctcttacctttgtgccttgactgtggttctttgtggcaagatactttggttggttaaaataatatggaacaaaggatccactgaagtg

SEQ ID NO: 32694 - DNA, 3338 bp, Homo sapiens
cccagcttccactgacacgagcctcggcgcggcttccgcttccggcgagtattgtgtgtcgcgccgcggggcgggggcgaggggaggaggaaggagggaggcagcgctccggcggctccgcgccccgcactcccggacccgaagccgggaagattcctttcttgtctgttagaaacgtatgtcaaacgaggatacagtgtctggaactattggttctaagatataagtggaatgagcctggatcaggagaagtatgctgagctagagttgaaggaagcttctctttctaacaagagaaagcagagttaaattatggcagagacaagtctgttagaggctggggcctctgcagcctctacagctgcggctttggagaacttacaggtggaggcgagctgctctgtgtgcctggagtatctgaaggaacctgtcatcattgagtgtgggcacaacttctgcaaagcttgcatcacccgctggtgggaggacctagagagggacttcccttgtcctgtctgtcgaaagacatcccgctaccgcagtctccgacctaatcggcaactaggcagtatggtggaaattgccaagcagctccaggccgtcaagcggaagatccgggatgagagcctctgcccccaacaccatgaggccctcagccttttctgttatgaggaccaggaggctgtatgcttgatatgtgcaatttcccacacccaccgggcccacaccgttgtgccactggacgatgctacacaggagtacaaggaaaaactgcagaagtgtctggagcccctggaacagaagctgcaggagatcactcgctgcaagtcctctgaggagaagaagcctggtgagctcaagagactagtggaaagtcgccgacagcagatcttgagggagtttgaagagcttcataggcggctggatgaagagcagcaggtgttgctttcacgactggaagaagaggaacaggacattctgcagcgactccgagaaaatgctgctcaccttggggacaagcgccgggacctggcccacttggctgccgaggtggagggcaagtgcttacagtcaggcttcgagatgcttaagccagttctttctgccagggaaaagaatattcctagaaagttcggaggctcactctcaacgatctgtccacgggatcataaggctctccttggattagtaaaagaaatcaacagatgtgaaaaggtgaagaccatggaggtgacttcagtatccatagagctggaaaagaacttcagcaattttccccgacagtactttgccctaaggaaaatccttaaacagctaattgcggatgtgaccctggaccctgagacagctcatcctaacctagtcctgtcagaggatcgtaagagcgtcaagttcgtggagacaagactccgggatctccctgacacaccaaggcgtttcaccttctacccttgcgtcctggctactgagggtttcacctcaggtcgacactactgggaggtggaggtgggcgacaagacccactgggcagtgggtgtatgccgggactccgtgagccgaaagggcgagttgactccactccctgagactggctactggcgggtgcggctatggaatggggacaaatatgcagccaccaccacaccttttacccctttgcacatcaaggtgaaacccaagcgggtaggcatattcctagactatgaggccggcacactgtctttctacaatgtcacagaccgctctcatatctacaccttcactgatacttttactgagaaactttggcccctcttctacccaggcatccgggctggacggaagaatgctgcaccacttaccatcaggcccccaacagattgggagtgacaggttgggatgtgggaatgactggggtgaggcagggtcaagtgctacgggcctccttcccgtgtcctgctggaacgtcttcgtgtccacctgggtccagtcctgaatcatcttggagaaacaccttggtttctaggatggttttgtgtggagggggaggtaggactgggctggatgagagagcacagctgtgacttcctcctaactgtcagggtggggagctggttcccagaggattgtctaccctgaagtccatcaggttttctgttgcacaaggacgggtcaggaaggaaggagaggcttttccagaaacaaaaaatctgtgagggtctgacttgctcaaaccagaggaggaaacagaaacccctgcacatctttttagggggttctttgacccaggatagtcttgcttcttgaggtagatcacaggggtctgtgtacctctgaattcatgagagatgaatgacagatgctctcatgggtctagatattgaggagtttttctgagggcagagattggacatcaacaaggctagaagggtcagggaagtgggctaaaggaacagattcctagagattaatgaagaggagggaggtttctttggtcttctattccaagggtaaggttgcgattatgggtaagattggccagaggtaggaatgtggggagaaggagaggctgaaaagaaagcagaggagaacccaggtccctgcctcagccttcagcagagttggcttattgcctgcctctataccaataagtcagtcaccttgctcctctccagaggcaaagtggaagagatcctgcaagacacatctatcctttcacagtgttcccaagggaacttggaaaggagagtcaggtattagaggaaagagaagggtatttgtatacaaagccctggccttaaagaatgttacttagtagctactcccaaattgtcagccttcttacctggccaaggtgtccaagccagaaaggaaaaaaggttatggagtctttctcaccctaaggacagggtggaagagggtggtatatagggaagggccagataggcaacttcatttggcttgtgtgcatctggcctggaactggtgttaagccaggcttttgcttgtttgttgccatccctcaccctttgccatttcccttttcagagaatgtaaatgattttcatgttaggccaaaataaacaacttatagggtacatatgttgtcataaaaggtaaaagtgatgcatgccaaaccaaactaaaccaatttggattatctgctattcgggtaatcttcacagaaatgactgagagaagaatctgcagtttactgagggcatttcagttcctcctaccacctcaacaggactttgtccagactctcctcctcttacctttgtgccttgactgtggttctttgtggcaagatactttggttggttaaaataatatggaacaaaggatccactgaagtg

SEQ ID NO: 32695 - DNA, 1548 bp, Homo sapiens; identical to SEQ ID NO: 32677

SEQ ID NO: 32696 - DNA, 3338 bp, Homo sapiens; identical to SEQ ID NO: 32694

SEQ ID NO: 32697 - DNA, 3248 bp, Homo sapiens; identical to SEQ ID NO: 32693

SEQ ID NO: 32698 - DNA, 3338 bp, Homo sapiens; identical to SEQ ID NO: 32620

SEQ ID NO: 32699 - DNA, 3248 bp, Homo sapiens; identical to SEQ ID NO: 32693

SEQ ID NO: 32700 - DNA, 3248 bp, Homo sapiens
cccagcttccactgacacgagcctcggcgcggcttccgcttccggcgagtattgtgtgtcgcgccgcggggcgggggcgaggggaggaggaaggagggaggcagcgctccggcggctccgcgccccgcactcccggacccgaagccgggaagattcctttcttgtctgttagaaacgtatgtcaaacgaggatacagtgtctggaactattggttctaagatataagtggaatgagcctggatcaggagaagtatgctgagctagagttgaaggaagcttctctttctaacaagagaaagcagagttaaattatggcagagacaagtctgttagaggctggggcctctgcagcctctacagctgcggctttggagaacttacaggtggaggcgagctgctctgtgtgcctggagtatctgaaggaacctgtcatcattgagtgtgggcacaacttctgcaaagcttgcatcacccgctggtgggaggacctagagagggacttcccttgtcctgtctgtcgaaagacatcccgctaccgcagtctccgacctaatcggcaactaggcagtatggtggaaattgccaagcagctccaggccgtcaagcggaagatccgggatgagagcctctgcccccaacaccatgaggccctcagccttttctgttatgaggaccaggaggctgtatgcttgatatgtgcaatttcccacacccaccgggcccacaccgttgtgccactggacgacgctacacaggagtacaaggaaaaactgcagaagtgtctggagcccctggaacagaagctgcaggagatcactcgctgcaagtcctctgaggagaagaagcctggtgagctcaagagactagtggaaagtcgccgacagcagatcttgagggagtttgaagagcttcataggcggctggatgaagagcagcaggtgttgctttcacgactggaagaagaggaacaggacattctgcagcgactccgagaaaatgctgctcaccttggggacaagcgccgggacctggcccacttggctgccgaggtggagggcaagtgcttacagtcaggcttcgagatgcttaagccagttctttctgccagggaggaatgtgaaaaggtgaagaccatggaggtgacttcagtatccatagagctggaaaagaacttcagcaattttccccgacagtactttgccctaaggaaaatccttaaacagctaattgcggatgtgaccctggaccccgagacagctcatcctaacctagtcctgtcagaggatcgtaagagcgtcaagttcgtggagacaagactccgggatctccctgacacaccaaggcgtttcaccttctacccttgcgtcctggctactgagggtttcacctcaggtcgacactactgggaggtggaggtgggcgacaagacccactgggcagtgggtgtatgccgggactccgtgagccgaaagggcgagttgactccactccctgagactggctactggcgggtgcggctatggaatggggacaaatatgcagccaccaccacaccttttacccctttgcacatcaaggtgaaacccaagcgggtaggcatattcctagactatgaggccggcacactgtctttctacaatgtcacagaccgctctcatatctacaccttcactgatacttttactgagaaactttggcccctcttctacccaggcatccgggctggacggaagaatgctgcaccacttaccatcaggcccccaacagattgggagtgacaggttgggatgtgggaatgactggggtgaggcagggtcaagtgctacgggcctccttcccgtgtcctgctggaacgtcttcgtgtccacctgggtccagtcctgaatcatcttggagaaacaccttggtttctaggatggttttgtgtggagggggaggtaggactgggctggatgagagagcacagctgtgacttcctcctaactgtcagggtggggagctggttcccagaggattgtctaccctgaagtccatcaggttttctgttgcacaaggacgggtcaggaaggaaggagaggcttttccagaaacaaaaaatctgtgagggtctgacttgctcaaaccagaggaggaaacagaaacccctgcacatctttttagggggttctttgacccaggatagtcttgcttcttgaggtagatcacaggggtctgtgtacctctgaattcatgagagatgaatgacagatgctctcatgggtctagatattgaggagtttttctgagggcagagattggacatcaacaaggctagaagggtcagggaagtgggctaaaggaacagattcctagagattaatgaagaggagggaggtttctttggtcttctattccaagggtaaggttgcgattatgggtaagattggccagaggtaggaatgtggggagaaggagaggctgaaaagaaagcagaggagaacccaggtccctgcctcagccttcagcagagttggcttattgcctgcctctataccaataagtcagtcaccttgctcctctccagaggcaaagtggaagagatcctgcaagacacatctatcctttcacagtgttcccaagggaacttggaaaggagagtcaggtattagaggaaagagaagggtatttgtatacaaagccctggccttaaagaatgttacttagtagctactcccaaattgtcagccttcttacctggccaaggtgtccaagccagaaaggaaaaaaggttatggagtctttctcaccctaaggacagggtggaagagggtggtatatagggaagggccagataggcaacttcatttggcttgtgtgcatctggcctggaactggtgttaagccaggcttttgcttgtttgttgccatccctcaccctttgccatttcccttttcagagaatgtaaatgattttcatgttaggccaaaataaacaacttatagggtacatatgttgtcataaaaggtaaaagtgatgcatgccaaaccaaactaaaccaatttggattatctgctattcgggtaatcttcacagaaatgactgagagaagaatctgcagtttactgagggcatttcagttcctcctaccacctcaacaggactttgtccagactctcctcctcttacctttgtgccttgactgtggttctttgtggcaagatactttggttggttaaaataatatggaacaaaggatccactgaagtg

SEQ ID NO: 32701 - DNA, 3248 bp, Homo sapiens
cccagcttccactgacacgagcctcggcgcggcttccgcttccggcgagtattgtgtgtcgcgccgcggggcgggggcgaggggaggaggaaggagggaggcagcgctccggcggctccgcgccccgcactcccggacccgaagccgggaagattcctttcttgtctgttagaaacgtatgtcaaacgaggatacagtgtctggaactattggttctaagatataagtggaatgagcctggatcaggagaagtatgctgagctagagttgaaggaagcttctctttctaacaagagaaagcagagttaaattatggcagagacaagtctgttagaggctggggcctctgcagcctctacagctgcggctttggagaacttacaggtggaggcgagctgctctgtgtgcctggagtatctgaaggaacctgtcatcattgagtgtgggcacaacttctgcaaagcttgcatcacccgctggtgggaggacctagagagggacttcccttgtcctgtctgtcgaaagacatcccgctaccgcagtctccgacctaatcggcaactaggcagtatggtggaaattgccaagcagctccaggccgtcaagcggaagatccgggatgagagcctctgcccccaacaccatgaggccctcagccttttctgttatgaggaccaggaggctgtatgcttgatatgtgcaatttcccacacccaccgggctcacaccgttgtgccactggacgatgctacacaggagtacaaggaaaaactgcagaagtgtctggagcccctggaacagaagctgcaggagatcactcgctgcaagtcctctgaggagaagaagcctggtgagctcaagagactagtggaaagtcgccgacagcagatcttgagggagtttgaagagcttcataggcggctggatgaagagcagcaggtgttgctttcacgactggaagaagaggaacaggacattctgcagcgactccgagaaaatgctgctcaccttggggacaagcgccgggacctggcccacttggctgccgaggtggagggcaagtgcttacagtcaggcttcgagatgcttaagccagttctttctgccagggaggaatgtgaaaaggtgaagaccatggaggtgacttcagtatccatagagctggaaaagaacttcagcaattttccccgacagtactttgccctaaggaaaatccttaaacagctaattgcggatgtgaccctggaccctgagacagctcatcctaacctagtcctgtcagaggatcgtaagagcgtcaagttcgtggagacaagactccgggatctccctgacacaccaaggcgtttcaccttctacccttgcgtcctggctactgagggtttcacctcaggtcgacactactgggaggtggaggtgggcgacaagacccactgggcagtgggtgtatgccgggactccgtgagccgaaagggcgagttgactccactccctgagactggctactggcgggtgcggctatggaatggggacaaatatgcagccaccaccacaccttttacccctttgcacatcaaggtgaaacccaagcgggtaggcatattcctagactatgaggccggcacactgtctttctacaatgtcacagaccgctctcatatctacaccttcactgatacttttactgagaaactttggcccctcttctacccaggcatccgggctggacggaagaatgctgcaccacttaccatcaggcccccaacagattgggagtgacaggttgggatgtgggaatgactggggtgaggcagggtcaagtgctacgggcctccttcccgtgtcctgctggaacgtcttcgtgtccacctgggtccagtcctgaatcatcttggagaaacaccttggtttctaggatggttttgtgtggagggggaggtaggactgggctggatgagagagcacagctgtgacttcctcctaactgtcagggtggggagctggttcccagaggattgtctaccctgaagtccatcaggttttctgttgcacaaggacgggtcaggaaggaaggagaggcttttccagaaacaaaaaatctgtgagggtctgacttgctcaaaccagaggaggaaacagaaacccctgcacatctttttagggggttctttgacccaggatagtcttgcttcttgaggtagatcacaggggtctgtgtacctctgaattcatgagagatgaatgacagatgctctcatgggtctagatattgaggagtttttctgagggcagagattggacatcaacaaggctagaagggtcagggaagtgggctaaaggaacagattcctagagattaatgaagaggagggaggtttctttggtcttctattccaagggtaaggttgcgattatgggtaagattggccagaggtaggaatgtggggagaaggagaggctgaaaagaaagcagaggagaacccaggtccctgcctcagccttcagcagagttggcttattgcctgcctctataccaataagtcagtcaccttgctcctctccagaggcaaagtggaagagatcctgcaagacacatctatcctttcacagtgttcccaagggaacttggaaaggagagtcaggtattagaggaaagagaagggtatttgtatacaaagccctggccttaaagaatgttacttagtagctactcccaaattgtcagccttcttacctggccaaggtgtccaagccagaaaggaaaaaaggttatggagtctttctcaccctaaggacagggtggaagagggtggtatatagggaagggccagataggcaacttcatttggcttgtgtgcatctggcctggaactggtgttaagccaggcttttgcttgtttgttgccatccctcaccctttgccatttcccttttcagagaatgtaaatgattttcatgttaggccaaaataaacaacttatagggtacatatgttgtcataaaaggtaaaagtgatgcatgccaaaccaaactaaaccaatttggattatctgctattcgggtaatcttcacagaaatgactgagagaagaatctgcagtttactgagggcatttcagttcctcctaccacctcaacaggactttgtccagactctcctcctcttacctttgtgccttgactgtggttctttgtggcaagatactttggttggttaaaataatatggaacaaaggatccactgaagtg

SEQ ID NO: 32702 - DNA, 3338 bp, Homo sapiens; identical to SEQ ID NO: 32620

SEQ ID NO: 32703 - DNA, 1548 bp, Homo sapiens
cccagcttccactgacacgagcctcggcgcggcttccgcttccggcgagtattgtgtgtcgcgccgcggggcgggggcgaggggaggaggaaggagggaggcagcgctccggcggctccgcgccccgcactcccggacccgaagccgggaagattcctttcttgtctgttagaaacgtatgtcaaacgaggatacagtgtctggaactattggttctaagatataagtggaatgagcctggatcaggagaagtatgctgagctagagttgaaggaagcttctctttctaacaagagaaagcagagttaaattatggcagagacaagtctgttagaggctggggcctctgcagcctctacagctgcggctttggagaacttacaggtggaggcgagctgctctgtgtgcctggagtatctgaaggaacctgtcatcattgagtgtgggcacaacttctgcaaagcttgcatcacccgctggtgggaggacctagagagggacttcccttgtcctgtctgtcgaaagacatcccgctaccgcagtctccgacctaatcggcaactaggcagtatggtggaaattgccaagcagctccaggccgtcaagcggaagatccgggatgagagcctctgcccccaacaccatgaggccctcagccttttctgttatgaggaccaggaggctgtatgcttgatatgtgcaatttcccacacccaccgggcccacaccgttgtgccactggacgacgctacacaggagtacaaggaaaaactgcagaagtgtctggagcccctggaacagaagctgcaggagatcactcgctgcaagtcctctgaggagaagaagcctggtgagctcaagagactagtggaaagtcgccgacagcagatcttgagggagtttgaagagcttcataggcggctggatgaagagcagcaggtgttgctttcacgactggaagaagaggaacaggacattctgcagcgactccgagaaaatgctgctcaccttggggacaagcgccgggacctggcccacttggctgccgaggtggagggcaagtgcttacagtcaggcttcgagatgcttaagccagttctttctgccagggaggaatgtgaaaaggtgaagaccatggaggtgacttcagtatccatagagctggaaaagaacttcagcaattttccccgacagtactttgccctaaggaaaatccttaaacagctaattgcggatgtgaccctggaccccgagacagctcatcctaacctagtcctgtcagaggatcgtaagagcgtcaagttcgtggagacaagactccgggatctccctgacacaccaaggcgtttcaccttctacccttgcgtcctggctactgagggtttcacctcaggtcgacactactgggaggtggaggtgggcgacaagacccactgggcagtgggtgtatgccgggactccgtgagccgaaagggcgggtgcggctatggaatggggacaaatatgcagccaccaccacaccttttacccctttgcacatcaaggtga

SEQ ID NO: 32704 - DNA, 3338 bp, Homo sapiens; identical to SEQ ID NO: 32694

SEQ ID NO: 32705 - DNA, 1548 bp, Homo sapiens; identical to SEQ ID NO: 32677

SEQ ID NO: 32706 - DNA, 1548 bp, Homo sapiens; identical to SEQ ID NO: 32677

SEQ ID NO: 32707 - DNA, 3338 bp, Homo sapiens; identical to SEQ ID NO: 32620

SEQ ID NO: 32708 - DNA, 3338 bp, Homo sapiens
cccagcttccactgacacgagcctcggcgcggcttccgcttccggcgagtattgtgtgtcgcgccgcggggcgggggcgaggggaggaggaaggagggaggcagcgctccggcggctccgcgccccgcactcccggacccgaagccgggaagattcctttcttgtctgttagaaacgtatgtcaaacgaggatacagtgtctggaactattggttctaagatataagtggaatgagcctggatcaggagaagtatgctgagctagagttgaaggaagcttctctttctaacaagagaaagcagagttaaattatggcagagacaagtctgttagaggctggggcctctgcagcctctacagctgcggctttggagaacttacaggtggaggcgagctgctctgtgtgcctggagtatctgaaggaacctgtcatcattgagtgtgggcacaacttctgcaaagcttgcatcacccgctggtgggaggacctagagagggacttcccttgtcctgtctgtcgaaagacatcccgctaccgcagtctccgacctaatcggcaactaggcagtatggtggaaattgccaagcagctccaggccgtcaagcggaagatccgggatgagagcctctgcccccaacaccatgaggccctcagccttttctgttatgaggaccaggaggctgtatgcttgatatgtgcaatttcccacacccaccgggctcacaccgttgtgccactggacgatgctacacaggagtacaaggaaaaactgcagaagtgtctggagcccctggaacagaagctgcaggagatcactcgctgcaagtcctctgaggagaagaagcctggtgagctcaagagactagtggaaagtcgccgacagcagatcttgagggagtttgaagagcttcataggcggctggatgaagagcagcaggtgttgctttcacgactggaagaagaggaacaggacattctgcagcgactccgagaaaatgctgctcaccttggggacaagcgccgggacctggcccacttggctgccgaggtggagggcaagtgcttacagtcaggcttcgagatgcttaagccagttctttctgccagggaaaagaatattcctagaaagttcggaggctcactctcaacgatctgtccacgggatcataaggctctccttggattagtaaaagaaatcaacagatgtgaaaaggtgaagaccatggaggtgacttcagtatccatagagctggaaaagaacttcagcaattttccccgacagtactttgccctaaggaaaatccttaaacagctaattgcggatgtgaccctggaccctgagacagctcatcctaacctagtcctgtcagaggatcgtaagagcgtcaagttcgtggagacaagactccgggatctccctgacacaccaaggcgtttcaccttctacccttgcgtcctggctactgagggtttcacctcaggtcgacactactgggaggtggaggtgggcgacaagacccactgggcagtgggtgtatgccgggactccgtgagccgaaagggcgagttgactccactccctgagactggctactggcgggtgcggctatggaatggggacaaatatgcagccaccaccacaccttttacccctttgcacatcaaggtgaaacccaagcgggtaggcatattcctagactatgaggccggcacactgtctttctacaatgtcacagaccgctctcatatctacaccttcactgatacttttactgagaaactttggcccctcttctacccaggcatccgggctggacggaagaatgctgcaccacttaccatcaggcccccaacagattgggagtgacaggttgggatgtgggaatgactggggtgaggcagggtcaagtgctacgggcctccttcccgtgtcctgctggaacgtcttcgtgtccacctgggtccagtcctgaatcatcttggagaaacaccttggtttctaggatggttttgtgtggagggggaggtaggactgggctggatgagagagcacagctgtgacttcctcctaactgtcagggtggggagctggttcccagaggattgtctaccctgaagtccatcaggttttctgttgcacaaggacgggtcaggaaggaaggagaggcttttccagaaacaaaaaatctgtgagggtctgacttgctcaaaccagaggaggaaacagaaacccctgcacatctttttagggggttctttgacccaggatagtcttgcttcttgaggtagatcacaggggtctgtgtacctctgaattcatgagagatgaatgacagatgctctcatgggtctagatattgaggagtttttctgagggcagagattggacatcaacaaggctagaagggtcagggaagtgggctaaaggaacagattcctagagattaatgaagaggagggaggtttctttggtcttctattccaagggtaaggttgcgattatgggtaagattggccagaggtaggaatgtggggagaaggagaggctgaaaagaaagcagaggagaacccaggtccctgcctcagccttcagcagagttggcttattgcctgcctctataccaataagtcagtcaccttgctcctctccagaggcaaagtggaagagatcctgcaagacacatctatcctttcacagtgttcccaagggaacttggaaaggagagtcaggtattagaggaaagagaagggtatttgtatacaaagccctggccttaaagaatgttacttagtagctactcccaaattgtcagccttcttacctggccaaggtgtccaagccagaaaggaaaaaaggttatggagtctttctcaccctaaggacagggtggaagagggtggtatatagggaagggccagataggcaacttcatttggcttgtgtgcatctggcctggaactggtgttaagccaggcttttgcttgtttgttgccatccctcaccctttgccatttcccttttcagagaatgtaaatgattttcatgttaggccaaaataaacaacttatagggtacatatgttgtcataaaaggtaaaagtgatgcatgccaaaccaaactaaaccaatttggattatctgctattcgggtaatcttcacagaaatgactgagagaagaatctgcagtttactgagggcatttcagttcctcctaccacctcaacaggactttgtccagactctcctcctcttacctttgtgccttgactgtggttctttgtggcaagatactttggttggttaaaataatatggaacaaaggatccactgaagtg

SEQ ID NO: 32709 - DNA, 3338 bp, Homo sapiens; identical to SEQ ID NO: 32694

SEQ ID NO: 32710 - DNA, 3338 bp, Homo sapiens
cccagcttccactgacacgagcctcggcgcggcttccgcttccggcgagtattgtgtgtcgcgccgcggggcgggggcgaggggaggaggaaggagggaggcagcgctccggcggctccgcgccccgcactcccggacccgaagccgggaagattcctttcttgtctgttagaaacgtatgtcaaacgaggatacagtgtctggaactattggttctaagatataagtggaatgagcctggatcaggagaagtatgctgagctagagttgaaggaagcttctctttctaacaagagaaagcagagttaaattatggcagagacaagtctgttagaggctggggcctctgcagcctctacagctgcggctttggagaacttacaggtggaggcgagctgctctgtgtgcctggagtatctgaaggaacctgtcatcattgagtgtgggcacaacttctgcaaagcttgcatcacccgctggtgggaggacctagagagggacttcccttgtcctgtctgtcgaaagacatcccgctaccgcagtctccgacctaatcggcaactaggcagtatggtggaaattgccaagcagctccaggccgtcaagcggaagatccgggatgagagcctctgcccccaacaccatgaggccctcagccttttctgttatgaggaccaggaggctgtatgcttgatatgtgcaatttcccacacccaccgggctcacaccgttgtgccactggacgatgctacacaggagtacaaggaaaaactgcagaagtgtctggagcccctggaacagaagctgcaggagatcactcgctgcaagtcctctgaggagaagaagcctggtgagctcaagagactagtggaaagtcgccgacagcagatcttgagggagtttgaagagcttcataggcggctggatgaagagcagcaggtgttgctttcacgactggaagaagaggaacaggacattctgcagcgactccgagaaaatgctgctcaccttggggacaagcgccgggacctggcccacttggctgccgaggtggagggcaagtgcttacagtcaggcttcgagatgcttaaggatgtcaaaagtaccctggaaaagaatattcctagaaagttcggaggctcactctcaacgatctgtccacgggatcataaggctctccttggattagtaaaagaaatcaacagatgtgaaaaggtgaagaccatggaggtgacttcagtatccatagagctggaaaagaacttcagcaattttccccgacagtactttgccctaaggaaaatccttaaacagctaattgcggatgtgaccctggaccctgagacagctcatcctaacctagtcctgtcagaggatcgtaagagcgtcaagttcgtggagacaagactccgggatctccctgacacaccaaggcgtttcaccttctacccttgcgtcctggctactgagggtttcacctcaggtcgacactactgggaggtggaggtgggcgacaagacccactgggcagtgggtgtatgccgggactccgtgagccgaaagggcgagttgactccactccctgagactggctactggcgggtgcggctatggaatggggacaaatatgcagccaccaccacaccttttacccctttgcacatcaaggtgaaacccaagcgggtaggcatattcctagactatgaggccggcacactgtctttctacaatgtcacagaccgctctcatatctacaccttcactgatacttttactgagaaactttggcccctcttctacccaggcatccgggctggacggaagaatgctgcaccacttaccatcaggcccccaacagattgggagtgacaggttgggatgtgggaatgactggggtgaggcagggtcaagtgctacgggcctccttcccgtgtcctgctggaacgtcttcgtgtccacctgggtccagtcctgaatcatcttggagaaacaccttggtttctaggatggttttgtgtggagggggaggtaggactgggctggatgagagagcacagctgtgacttcctcctaactgtcagggtggggagctggttcccagaggattgtctaccctgaagtccatcaggttttctgttgcacaaggacgggtcaggaaggaaggagaggcttttccagaaacaaaaaatctgtgagggtctgacttgctcaaaccagaggaggaaacagaaacccctgcacatctttttagggggttctttgacccaggatagtcttgcttcttgaggtagatcacaggggtctgtgtacctctgaattcatgagagatgaatgacagatgctctcatgggtctagatattgaggagtttttctgagggcagagattggacatcaacaaggctagaagggtcagggaagtgggctaaaggaacagattcctagagattaatgaagaggagggaggtttctttggtcttctattccaagggtaaggttgcgattatgggtaagattggccagaggtaggaatgtggggagaaggagaggctgaaaagaaagcagaggagaacccaggtccctgcctcagccttcagcagagttggcttattgcctgcctctataccaataagtcagtcaccttgctcctctccagaggcaaagtggaagagatcctgcaagacacatctatcctttcacagtgttcccaagggaacttggaaaggagagtcaggtattagaggaaagagaagggtatttgtatacaaagccctggccttaaagaatgttacttagtagctactcccaaattgtcagccttcttacctggccaaggtgtccaagccagaaaggaaaaaaggttatggagtctttctcaccctaaggacagggtggaagagggtggtatatagggaagggccagataggcaacttcatttggcttgtgtgcatctggcctggaactggtgttaagccaggcttttgcttgtttgttgccatccctcaccctttgccatttcccttttcagagaatgtaaatgattttcatgttaggccaaaataaacaacttatagggtacatatgttgtcataaaaggtaaaagtgatgcatgccaaaccaaactaaaccaatttggattatctgctattcgggtaatcttcacagaaatgactgagagaagaatctgcagtttactgagggcatttcagttcctcctaccacctcaacaggactttgtccagactctcctcctcttacctttgtgccttgactgtggttctttgtggcaagatactttggttggttaaaataatatggaacaaaggatccactgaagtg

SEQ ID NO: 32711 - DNA, 3338 bp, Homo sapiens; identical to SEQ ID NO: 32694

SEQ ID NO: 32712 - DNA, 1824 bp, Homo sapiens
cccagcttccactgacacgagcctcggcgcggcttccgcttccggcgagtattgtgtgtcgcgccgcggggcgggggcgaggggaggaggaaggagggaggcagcgctccggcggctccgcgccccgcactcccggacccgaagccgggaagattcctttcttgtctgttagaaacgtatgtcaaacgaggatacagtgtctggaactattggttctaagatataagtggaatgagcctggatcaggagaagtatgctgagctagagttgaaggaagcttctctttctaacaagagaaagcagagttaaattatggcagagacaagtctgttagaggctggggcctctgcagcctctacagctgcggctttggagaacttacaggtggaggcgagctgctctgtgtgcctggagtatctgaaggaacctgtcatcattgagtgtgggcacaacttctgcaaagcttgcatcacccgctggtgggaggacctagagagggacttcccttgtcctgtctgtcgaaagacatcccgctaccgcagtctccgacctaatcggcaactaggcagtatggtggaaattgccaagcagctccaggccgtcaagcggaagatccgggatgagagcctctgcccccaacaccatgaggccctcagccttttctgttatgaggaccaggaggctgtatgcttgatatgtgcaatttcccacacccaccgggcccacaccgttgtgccactggacgatgctacacaggagtacaaggaaaaactgcagaagtgtctggagcccctggaacagaagctgcaggagatcactcgctgcaagtcctctgaggagaagaagcctggtgagctcaagagactagtggaaagtcgccgacagcagatcttgagggagtttgaagagcttcataggcggctggatgaagagcagcaggtgttgctttcacgactggaagaagaggaacaggacattctgcagcgactccgagaaaatgctgctcaccttggggacaagcgccgggacctggcccacttggctgccgaggtggagggcaagtgcttacagtcaggcttcgagatgcttaagccagttctttctgccagggaggaatgtgaaaaggtgaagaccatggaggtgacttcagtatccatagagctggaaaagaacttcagcaattttccccgacagtactttgccctaaggaaaatccttaaacagctaattgcggatgtgaccctggaccctgagacagctcatcctaacctagtcctgtcagaggatcgtaagagcgtcaagttcgtggagacaagactccgggatctccctgacacaccaaggcgtttcaccttctacccttgcgtcctggctactgagggtttcacctcaggtcgacactactgggaggtggaggccgcccattgtgtccttgcccaggaccccgagaaccaggcgctggcgaggttttactgctacactgagaggaccattgcgaagcggctcgtcttgcggcgggatccctcggtgaagaggactctctgtcgaggctgctcttccctcctcgtcccgggcctcacctgcacccaccgccagagacgctgcaggggacagcgctggaccgtacagacctgcctaacatgccagcgcagccaacgcttcctcaatgatcccgggcatttactctggggagacaggcctgaggcccagctcgggagccaagcagattccaaaccactacaacccttgccaaacacagcccactccatttcagaccgccttcctgaggagaaaatgcagactcagggttccagtaaccagtga

SEQ ID NO: 32713 - DNA, 1824 bp, Homo sapiens
cccagcttccactgacacgagcctcggcgcggcttccgcttccggcgagtattgtgtgtcgcgccgcggggcgggggcgaggggaggaggaaggagggaggcagcgctccggcggctccgcgccccgcactcccggacccgaagccgggaagattcctttcttgtctgttagaaacgtatgtcaaacgaggatacagtgtctggaactattggttctaagatataagtggaatgagcctggatcaggagaagtatgctgagctagagttgaaggaagcttctctttctaacaagagaaagcagagttaaattatggcagagacaagtctgttagaggctggggcctctgcagcctctacagctgcggctttggagaacttacaggtggaggcgagctgctctgtgtgcctggagtatctgaaggaacctgtcatcattgagtgtgggcacaacttctgcaaagcttgcatcacccgctggtgggaggacctagagagggacttcccttgtcctgtctgtcgaaagacatcccgctaccgcagtctccgacctaatcggcaactaggcagtatggtggaaattgccaagcagctccaggccgtcaagcggaagatccgggatgagagcctctgcccccaacaccatgaggccctcagccttttctgttatgaggaccaggaggctgtatgcttgatatgtgcaatttcccacacccaccgggctcacaccgttgtgccactggacgatgctacacaggagtacaaggaaaaactgcagaagtgtctggagcccctggaacagaagctgcaggagatcactcgctgcaagtcctctgaggagaagaagcctggtgagctcaagagactagtggaaagtcgccgacagcagatcttgagggagtttgaagagcttcataggcggctggatgaagagcagcaggtgttgctttcacgactggaagaagaggaacaggacattctgcagcgactccgagaaaatgctgctcaccttggggacaagcgccgggacctggcccacttggctgccgaggtggagggcaagtgcttacagtcaggcttcgagatgcttaagccagttctttctgccagggaggaatgtgaaaaggtgaagaccatggaggtgacttcagtatccatagagctggaaaagaacttcagcaattttccccgacagtactttgccctaaggaaaatccttaaacagctaattgcggatgtgaccctggaccctgagacagctcatcctaacctagtcctgtcagaggatcgtaagagcgtcaagttcgtggagacaagactccgggatctccctgacacaccaaggcgtttcaccttctacccttgcgtcctggctactgagggtttcacctcaggtcgacactactgggaggtggaggccgcccattgtgtccttgcccaggaccccgagaaccaggcgctggcgaggttttactgctacactgagaggaccattgcgaagcggctcgtcttgcggcgggatccctcggtgaagaggactctctgtcgaggctgctcttccctcctcgtcccgggcctcacctgcacccaccgccagagacgctgcaggggacagcgctggaccgtacagacctgcctaacatgccagcgcagccaacgcttcctcaatgatcccgggcatttactctggggagacaggcctgaggcccagctcgggagccaagcagattccaaaccactacaacccttgccaaacacagcccactccatttcagaccgccttcctgaggagaaaatgcagactcagggttccagtaaccagtga

SEQ ID NO: 32714 - DNA, 1548 bp, Homo sapiens
cccagcttccactgacacgagcctcggcgcggcttccgcttccggcgagtattgtgtgtcgcgccgcggggcgggggcgaggggaggaggaaggagggaggcagcgctccggcggctccgcgccccgcactcccggacccgaagccgggaagattcctttcttgtctgttagaaacgtatgtcaaacgaggatacagtgtctggaactattggttctaagatataagtggaatgagcctggatcaggagaagtatgctgagctagagttgaaggaagcttctctttctaacaagagaaagcagagttaaattatggcagagacaagtctgttagaggctggggcctctgcagcctctacagctgcggctttggagaacttacaggtggaggcgagctgctctgtgtgcctggagtatctgaaggaacctgtcatcattgagtgtgggcacaacttctgcaaagcttgcatcacccgctggtgggaggacctagagagggacttcccttgtcctgtctgtcgaaagacatcccgctaccgcagtctccgacctaatcggcaactaggcagtatggtggaaattgccaagcagctccaggccgtcaagcggaagatccgggatgagagcctctgcccccaacaccatgaggccctcagccttttctgttatgaggaccaggaggctgtatgcttgatatgtgcaatttcccacacccaccgggctcacaccgttgtgccactggacgatgctacacaggagtacaaggaaaaactgcagaagtgtctggagcccctggaacagaagctgcaggagatcactcgctgcaagtcctctgaggagaagaagcctggtgagctcaagagactagtggaaagtcgccgacagcagatcttgagggagtttgaagagcttcataggcggctggatgaagagcagcaggtgttgctttcacgactggaagaagaggaacaggacattctgcagcgactccgagaaaatgctgctcaccttggggacaagcgccgggacctggcccacttggctgccgaggtggagggcaagtgcttacagtcaggcttcgagatgcttaagccagttctttctgccagggaggaatgtgaaaaggtgaagaccatggaggtgacttcagtatccatagagctggaaaagaacttcagcaattttccccgacagtactttgccctaaggaaaatccttaaacagctaattgcggatgtgaccctggaccctgagacagctcatcctaacctagtcctgtcagaggatcgtaagagcgtcaagttcgtggagacaagactccgggatctccctgacacaccaaggcgtttcaccttctacccttgcgtcctggctactgagggtttcacctcaggtcgacactactgggaggtggaggtgggcgacaagacccactgggcagtgggtgtatgccgggactccgtgagccgaaagggcgggtgcggctatggaatggggacaaatatgcagccaccaccacaccttttacccctttgcacatcaaggtga

SEQ ID NO: 32715 - DNA, 1824 bp, Homo sapiens; identical to SEQ ID NO: 32712

SEQ ID NO: 32716 - DNA, 3338 bp, Homo sapiens
cccagcttccactgacacgagcctcggcgcggcttccgcttccggcgagtattgtgtgtcgcgccgcggggcgggggcgaggggaggaggaaggagggaggcagcgctccggcggctccgcgccccgcactcccggacccgaagccgggaagattcctttcttgtctgttagaaacgtatgtcaaacgaggatacagtgtctggaactattggttctaagatataagtggaatgagcctggatcaggagaagtatgctgagctagagttgaaggaagcttctctttctaacaagagaaagcagagttaaattatggcagagacaagtctgttagaggctggggcctctgcagcctctacagctgcggctttggagaacttacaggtggaggcgagctgctctgtgtgcctggagtatctgaaggaacctgtcatcattgagtgtgggcacaacttctgcaaagcttgcatcacccgctggtgggaggacctagagagggacttcccttgtcctgtctgtcgaaagacatcccgctaccgcagtctccgacctaatcggcaactaggcagtatggtggaaattgccaagcagctccaggccgtcaagcggaagatccgggatgagagcctctgcccccaacaccatgaggccctcagccttttctgttatgaggaccaggaggctgtatgcttgatatgtgcaatttcccacacccaccgggcccacaccgttgtgccactggacgacgctacacaggagtacaaggaaaaactgcagaagtgtctggagcccctggaacagaagctgcaggagatcactcgctgcaagtcctctgaggagaagaagcctggtgagctcaagagactagtggaaagtcgccgacagcagatcttgagggagtttgaagagcttcataggcggctggatgaagagcagcaggtgttgctttcacgactggaagaagaggaacaggacattctgcagcgactccgagaaaatgctgctcaccttggggacaagcgccgggacctggcccacttggctgccgaggtggagggcaagtgcttacagtcaggcttcgagatgcttaagccagttctttctgccagggaaaagaatattcctagaaagttcggaggctcactctcaacgatctgtccacgggatcataaggctctccttggattagtaaaagaaatcaacagatgtgaaaaggtgaagaccatggaggtgacttcagtatccatagagctggaaaagaacttcagcaattttccccgacagtactttgccctaaggaaaatccttaaacagctaattgcggatgtgaccctggaccccgagacagctcatcctaacctagtcctgtcagaggatcgtaagagcgtcaagttcgtggagacaagactccgggatctccctgacacaccaaggcgtttcaccttctacccttgcgtcctggctactgagggtttcacctcaggtcgacactactgggaggtggaggtgggcgacaagacccactgggcagtgggtgtatgccgggactccgtgagccgaaagggcgagttgactccactccctgagactggctactggcgggtgcggctatggaatggggacaaatatgcagccaccaccacaccttttacccctttgcacatcaaggtgaaacccaagcgggtaggcatattcctagactatgaggccggcacactgtctttctacaatgtcacagaccgctctcatatctacaccttcactgatacttttactgagaaactttggcccctcttctacccaggcatccgggctggacggaagaatgctgcaccacttaccatcaggcccccaacagattgggagtgacaggttgggatgtgggaatgactggggtgaggcagggtcaagtgctacgggcctccttcccgtgtcctgctggaacgtcttcgtgtccacctgggtccagtcctgaatcatcttggagaaacaccttggtttctaggatggttttgtgtggagggggaggtaggactgggctggatgagagagcacagctgtgacttcctcctaactgtcagggtggggagctggttcccagaggattgtctaccctgaagtccatcaggttttctgttgcacaaggacgggtcaggaaggaaggagaggcttttccagaaacaaaaaatctgtgagggtctgacttgctcaaaccagaggaggaaacagaaacccctgcacatctttttagggggttctttgacccaggatagtcttgcttcttgaggtagatcacaggggtctgtgtacctctgaattcatgagagatgaatgacagatgctctcatgggtctagatattgaggagtttttctgagggcagagattggacatcaacaaggctagaagggtcagggaagtgggctaaaggaacagattcctagagattaatgaagaggagggaggtttctttggtcttctattccaagggtaaggttgcgattatgggtaagattggccagaggtaggaatgtggggagaaggagaggctgaaaagaaagcagaggagaacccaggtccctgcctcagccttcagcagagttggcttattgcctgcctctataccaataagtcagtcaccttgctcctctccagaggcaaagtggaagagatcctgcaagacacatctatcctttcacagtgttcccaagggaacttggaaaggagagtcaggtattagaggaaagagaagggtatttgtatacaaagccctggccttaaagaatgttacttagtagctactcccaaattgtcagccttcttacctggccaaggtgtccaagccagaaaggaaaaaaggttatggagtctttctcaccctaaggacagggtggaagagggtggtatatagggaagggccagataggcaacttcatttggcttgtgtgcatctggcctggaactggtgttaagccaggcttttgcttgtttgttgccatccctcaccctttgccatttcccttttcagagaatgtaaatgattttcatgttaggccaaaataaacaacttatagggtacatatgttgtcataaaaggtaaaagtgatgcatgccaaaccaaactaaaccaatttggattatctgctattcgggtaatcttcacagaaatgactgagagaagaatctgcagtttactgagggcatttcagttcctcctaccacctcaacaggactttgtccagactctcctcctcttacctttgtgccttgactgtggttctttgtggcaagatactttggttggttaaaataatatggaacaaaggatccactgaagtg

SEQ ID NO: 32717 - DNA, 1824 bp, Homo sapiens
cccagcttccactgacacgagcctcggcgcggcttccgcttccggcgagtattgtgtgtcgcgccgcggggcgggggcgaggggaggaggaaggagggaggcagcgctccggcggctccgcgccccgcactcccggacccgaagccgggaagattcctttcttgtctgttagaaacgtatgtcaaacgaggatacagtgtctggaactattggttctaagatataagtggaatgagcctggatcaggagaagtatgctgagctagagttgaaggaagcttctctttctaacaagagaaagcagagttaaattatggcagagacaagtctgttagaggctggggcctctgcagcctctacagctgcggctttggagaacttacaggtggaggcgagctgctctgtgtgcctggagtatctgaaggaacctgtcatcattgagtgtgggcacaacttctgcaaagcttgcatcacccgctggtgggaggacctagagagggacttcccttgtcctgtctgtcgaaagacatcccgctaccgcagtctccgacctaatcggcaactaggcagtatggtggaaattgccaagcagctccaggccgtcaagcggaagatccgggatgagagcctctgcccccaacaccatgaggccctcagccttttctgttatgaggaccaggaggctgtatgcttgatatgtgcaatttcccacacccaccgggcccacaccgttgtgccactggacgacgctacacaggagtacaaggaaaaactgcagaagtgtctggagcccctggaacagaagctgcaggagatcactcgctgcaagtcctctgaggagaagaagcctggtgagctcaagagactagtggaaagtcgccgacagcagatcttgagggagtttgaagagcttcataggcggctggatgaagagcagcaggtgttgctttcacgactggaagaagaggaacaggacattctgcagcgactccgagaaaatgctgctcaccttggggacaagcgccgggacctggcccacttggctgccgaggtggagggcaagtgcttacagtcaggcttcgagatgcttaagccagttctttctgccagggaggaatgtgaaaaggtgaagaccatggaggtgacttcagtatccatagagctggaaaagaacttcagcaattttccccgacagtactttgccctaaggaaaatccttaaacagctaattgcggatgtgaccctggaccccgagacagctcatcctaacctagtcctgtcagaggatcgtaagagcgtcaagttcgtggagacaagactccgggatctccctgacacaccaaggcgtttcaccttctacccttgcgtcctggctactgagggtttcacctcaggtcgacactactgggaggtggaggccgcccattgtgtccttgcccaggaccccgagaaccaggcgctggcgaggttttactgctacactgagaggaccattgcgaagcggctcgtcttgcggcgggatccctcggtgaagaggactctctgtcgaggctgctcttccctcctcgtcccgggcctcacctgcacccagcgccagagacgctgcaggggacagcgctggaccgtacagacctgcctaacatgccagcgcagccaacgcttcctcaatgatcccgggcatttactctggggagacaggcctgaggcccagctcgggagccaagcagattccaaaccactacaacccttgccaaacacagcccactccatttcagaccgccttcctgaggagaaaatgcagacgaagggttccagtaaccagtga

SEQ ID NO: 32718 - DNA, 1548 bp, Homo sapiens; identical to SEQ ID NO: 32677

SEQ ID NO: 32719 - DNA, 1824 bp, Homo sapiens
cccagcttccactgacacgagcctcggcgcggcttccgcttccggcgagtattgtgtgtcgcgccgcggggcgggggcgaggggaggaggaaggagggaggcagcgctccggcggctccgcgccccgcactcccggacccgaagccgggaagattcctttcttgtctgttagaaacgtatgtcaaacgaggatacagtgtctggaactattggttctaagatataagtggaatgagcctggatcaggagaagtatgctgagctagagttgaaggaagcttctctttctaacaagagaaagcagagttaaattatggcagagacaagtctgttagaggctggggcctctgcagcctctacagctgcggctttggagaacttacaggtggaggcgagctgctctgtgtgcctggagtatctgaaggaacctgtcatcattgagtgtgggcacaacttctgcaaagcttgcatcacccgctggtgggaggacctagagagggacttcccttgtcctgtctgtcgaaagacatcccgctaccgcagtctccgacctaatcggcaactaggcagtatggtggaaattgccaagcagctccaggccgtcaagcggaagatccgggatgagagcctctgcccccaacaccatgaggccctcagccttttctgttatgaggaccaggaggctgtatgcttgatatgtgcaatttcccacacccaccgggcccacaccgttgtgccactggacgatgctacacaggagtacaaggaaaaactgcagaagtgtctggagcccctggaacagaagctgcaggagatcactcgctgcaagtcctctgaggagaagaagcctggtgagctcaagagactagtggaaagtcgccgacagcagatcttgagggagtttgaagagcttcataggcggctggatgaagagcagcaggtgttgctttcacgactggaagaagaggaacaggacattctgcagcgactccgagaaaatgctgctcaccttggggacaagcgccgggacctggcccacttggctgccgaggtggagggcaagtgcttacagtcaggcttcgagatgcttaagccagttctttctgccagggaggaatgtgaaaaggtgaagaccatggaggtgacttcagtatccatagagctggaaaagaacttcagcaattttccccgacagtactttgccctaaggaaaatccttaaacagctaattgcggatgtgaccctggaccctgagacagctcatcctaacctagtcctgtcagaggatcgtaagagcgtcaagttcgtggagacaagactccgggatctccctgacacaccaaggcgtttcaccttctacccttgcgtcctggctactgagggtttcacctcaggtcgacactactgggaggtggaggccgcccattgtgtccttgcccaggaccccgagaaccaggcgctggcgaggttttactgctacactgagaggaccattgcgaagcggctcgtcttgcggcgagatccctcggtgaagaggactctctgtcgaggctgctcttccctcctcgtcccgggcctcacctgcacccagcgccagagacgctgcaggggacagcgctggaccgtacagacctgcctaacatgccagcgcagccaacgcttcctcaatgatcccgggcatttactctggggagacaggcctgaggcccagctcgggagccaagcagattccaaaccactacaacccttgccaaacacagcccactccatttcagaccgccttcctgaggagaaaatgcagactcagggttccagtaaccagtga

SEQ ID NO: 32720 - DNA, 3338 bp, Homo sapiens
cccagcttccactgacacgagcctcggcgcggcttccgcttccggcgagtattgtgtgtcgcgccgcggggcgggggcgaggggaggaggaaggagggaggcagcgctccggcggctccgcgccccgcactcccggacccgaagccgggaagattcctttcttgtctgttagaaacgtatgtcaaacgaggatacagtgtctggaactattggttctaagatataagtggaatgagcctggatcaggagaagtatgctgagctagagttgaaggaagcttctctttctaacaagagaaagcagagttaaattatggcagagacaagtctgttagaggctggggcctctgcagcctctacagctgcggctttggagaacttacaggtggaggcgagctgctctgtgtgcctggagtatctgaaggaacctgtcatcattgagtgtgggcacaacttctgcaaagcttgcatcacccgctggtgggaggacctagagagggacttcccttgtcctgtctgtcgaaagacatcccgctaccgcagtctccgacctaatcggcaactaggcagtatggtggaaattgccaagcagctccaggccgtcaagcggaagatccgggatgagagcctctgcccccaacaccatgaggccctcagccttttctgttatgaggaccaggaggctgtatgcttgatatgtgcaatttcccacacccaccgggcccacaccgttgtgccactggacgacgctacacaggagtacaaggaaaaactgcagaagtgtctggagcccctggaacagaagctgcaggagatcactcgctgcaagtcctctgaggagaagaagcctggtgagctcaagagactagtggaaagtcgccgacagcagatcttgagggagtttgaagagcttcataggcggctggatgaagagcagcaggtgttgctttcacgactggaagaagaggaacaggacattctgcagcgactccgagaaaatgctgctcaccttggggacaagcgccgggacctggcccacttggctgccgaggtggagggcaagtgcttacagtcaggcttcgagatgcttaaggatgtcaaaagtaccctggaaaagaatattcctagaaagttcggaggctcactctcaacgatctgtccacgggatcataaggctctccttggattagtaaaagaaatcaacagatgtgaaaaggtgaagaccatggaggtgacttcagtatccatagagctggaaaagaacttcagcaattttccccgacagtactttgccctaaggaaaatccttaaacagctaattgcggatgtgaccctggaccccgagacagctcatcctaacctagtcctgtcagaggatcgtaagagcgtcaagttcgtggagacaagactccgggatctccctgacacaccaaggcgtttcaccttctacccttgcgtcctggctactgagggtttcacctcaggtcgacactactgggaggtggaggtgggcgacaagacccactgggcagtgggtgtatgccgggactccgtgagccgaaagggcgagttgactccactccctgagactggctactggcgggtgcggctatggaatggggacaaatatgcagccaccaccacaccttttacccctttgcacatcaaggtgaaacccaagcgggtaggcatattcctagactatgaggccggcacactgtctttctacaatgtcacagaccgctctcatatctacaccttcactgatacttttactgagaaactttggcccctcttctacccaggcatccgggctggacggaagaatgctgcaccacttaccatcaggcccccaacagattgggagtgacaggttgggatgtgggaatgactggggtgaggcagggtcaagtgctacgggcctccttcccgtgtcctgctggaacgtcttcgtgtccacctgggtccagtcctgaatcatcttggagaaacaccttggtttctaggatggttttgtgtggagggggaggtaggactgggctggatgagagagcacagctgtgacttcctcctaactgtcagggtggggagctggttcccagaggattgtctaccctgaagtccatcaggttttctgttgcacaaggacgggtcaggaaggaaggagaggcttttccagaaacaaaaaatctgtgagggtctgacttgctcaaaccagaggaggaaacagaaacccctgcacatctttttagggggttctttgacccaggatagtcttgcttcttgaggtagatcacaggggtctgtgtacctctgaattcatgagagatgaatgacagatgctctcatgggtctagatattgaggagtttttctgagggcagagattggacatcaacaaggctagaagggtcagggaagtgggctaaaggaacagattcctagagattaatgaagaggagggaggtttctttggtcttctattccaagggtaaggttgcgattatgggtaagattggccagaggtaggaatgtggggagaaggagaggctgaaaagaaagcagaggagaacccaggtccctgcctcagccttcagcagagttggcttattgcctgcctctataccaataagtcagtcaccttgctcctctccagaggcaaagtggaagagatcctgcaagacacatctatcctttcacagtgttcccaagggaacttggaaaggagagtcaggtattagaggaaagagaagggtatttgtatacaaagccctggccttaaagaatgttacttagtagctactcccaaattgtcagccttcttacctggccaaggtgtccaagccagaaaggaaaaaaggttatggagtctttctcaccctaaggacagggtggaagagggtggtatatagggaagggccagataggcaacttcatttggcttgtgtgcatctggcctggaactggtgttaagccaggcttttgcttgtttgttgccatccctcaccctttgccatttcccttttcagagaatgtaaatgattttcatgttaggccaaaataaacaacttatagggtacatatgttgtcataaaaggtaaaagtgatgcatgccaaaccaaactaaaccaatttggattatctgctattcgggtaatcttcacagaaatgactgagagaagaatctgcagtttactgagggcatttcagttcctcctaccacctcaacaggactttgtccagactctcctcctcttacctttgtgccttgactgtggttctttgtggcaagatactttggttggttaaaataatatggaacaaaggatccactgaagtg

SEQ ID NO: 32721 - DNA, 3338 bp, Homo sapiens; identical to SEQ ID NO: 32620

SEQ ID NO: 32722 - DNA, 3248 bp, Homo sapiens; identical to SEQ ID NO: 32693

SEQ ID NO: 32723 - DNA, 3248 bp, Homo sapiens; identical to SEQ ID NO: 32693

SEQ ID NO: 32724 - DNA, 1824 bp, Homo sapiens; identical to SEQ ID NO: 32632

SEQ ID NO: 32725 - DNA, 3637 bp, Homo sapiens
atcggctgtggggagtaccggctgcagtcggctgtgccgggagggtaggatggcgtctggccgatgcggtgatagcaccgaaagcagacggccgccaggcgctccccctaccccccgaagtttctccccagcggcgggggatgggggtaggcggttcctctgttctttctgcgttccccgcggcctcttaccacagagacgcgggcctccaccgtcctagccctcccgccctgttctctagtgcggactagagcgtctcctcgccatttcctgtcgccctggggccccgcggggaaaaagggggagtagcaggacagcggagggaagtcgcgagcttaggtggtgtgtagacgccggaagtgttgggaaggaggccggaagctaggggcggggccaggaagtgaggaggggcgggggtttatgaggagtccaagggagcattggggcagacttgtactcagagccacctgagggacttggcggtggcgcccagcactgtcccctcccctcgtagagacacggttgtcgtttgggagtagggaacactgtgttggggtgggttgtcggcaggacatctctctggctgctcttggggcgaggtgtggaggggcagggctgggggtggagccgggtcgccagggcgtcggtagggaagacccccgcccctcgcccccccaccgaacctctacactggctggctggacactaagatggctgccgttgccatgacacccaaccctgtgcagacccttcaggaggaggcggtgtgcgccatctgcctcgattacttcacggaccccgtgtccatcggctgcgggcacaacttctgccgagtttgtgtaacccagttgtggggtggggaggatgaggaggacagagatgagttagatcgggaggaggaggaggaggacggagaggaggaggaagtggaggctgtgggggctggcgcggggtgggacacccccatgcgggatgaagactacgagggtgacatggaggaggaggtcgaggaggaagaagagggtgtgttctggaccagtggcatgagcaggtccagctgggacaacatggactatgtgtgggaggaggaggacgaggaggaagacctggactactacttgggggacatggaggaggaggacctgaggggggaggatgaggaggacgaggaggaagtgctggaggaggttgaggaagaggatctagaccccgtcaccccactgcccccgcctccagcccctcggaggtgcttcacatgccctcagtgccgaaagagctttcctcggcggagcttccgccccaacctgcagctggccaatatggtccaggtgattcggcagatgcacccaacccctggtcgagggagccgcgtgaccgatcagggcatctgtcccaaacaccaagaagccctgaagctcttctgcgaggtagacgaagaggccatctgtgtggtgtgccgagaatccaggagccacaaacagcacagcgtggtgccattggaggaggtggtgcaggagtacaaggccaaactgcaggggcacgtggaaccactgaggaagcacctggaggcagtgcagaagatgaaagccaaggaggagaggcgagtgacagaactgaagagccagatgaagtcagagctggcagcggtggcctcggagtttgggcgactgacacggtttctggctgaagagcaggcagggctggaacggcgtctcagagagatgcatgaagcccagctggggcgtgcgggagccgcggctagtcgccttgcagaacaggccgcccagctcagccgcctgctggcagaggcccaggagcggagccagcaggggggtctccggctgctccaggacatcaaggagactttcaataggtgtgaagaggtacagctgcagcccccagaggtctggtcccctgacccgtgccaaccccatagccatgacttcctgacagatgccatcgtgaggaaaatgagccggatgttctgtcaggctgcgagagtggacctgacgctggaccctgacacggctcacccggccctgatgctgtcccctgaccgccggggggtccgcctggcagagcggcggcaggaggttgctgaccatcccaagcgcttctcggccgactgctgcgtactgggggcccagggcttccgctccggccggcactactgggaggtagaggtgggcgggcggcggggctgggcggtgggtgctgcccgtgaatcaacccatcataaggaaaaggtgggccctgggggttcctccgtgggcagcggggatgccagctcctcgcgccatcaccatcgccgccgccggctccacctgccccagcagcccctgctccagcgggaagtgtggtgcgtgggcaccaacggcaaacgctatcaggcccagagctccacagaacagacgctgctgagccccagtgagaaaccaaggcgctttggtgtgtacctggactatgaagctgggcgcctgggcttctacaacgcagagactctagcccacgtgcacaccttctcggctgccttcctgggcgagcgtgtctttcctttcttccgggtgctctccaagggcacccgcatcaagctctgcccttgattatcctgccacccgcaggggcccctctgtcagcacttggggggtgggtggtggagggtggcccgtaagtttgagggctcaaaggctcttcccactgcttgttactgtgttgcttcccactcccccttgaccccaggcccctgcttctccctctaggagcctaaagaaccctcctggcctccagctcagccttctctcacctactatgtctgtccaacaggtctgcatgggtccctgataatgagaacagctgcctggtcttctctcccagtctgcctagcccagccctgggactggaatttgagtaggggatgaggggaaattgtaatttcattccttaacttccttttccccacccctgctcttcaacctctttatcagttctgaggctggagggtttgggcaaggcaacatccccattccaattccattttctgatgcagattttagctgagggatttggaagccatttggggaggcaggctgggccaaagggtagagctgggtaataaatgtctattctcctggggaggagggattctaaactttccttccgtcctcaatttctacctccatagaccggccagaatttagcttcacttgagagagatctggaatggtcgccatgattgaaaccacgcaccattacatcatcattacattaattacatcaacataaattatttcttcccccttcccttttccagcactcaaccaaggagcaaagctcatcccaccccacacccctcccaggtctgctcactgccaggctcctctcccctttgttcagtggagctggcttttctcccagcccctttccatgcctttcactccatttggcaagctctgagggggagcctggggacgggtttgggtccccaggaggagagccttgggtataatctatttttctaggagcctcttgccttgtcacttgcagctttcgccctctgctttgatggctgaggtgaactcatgttctttgggaaaagggaaggcgtgctgtggaaataaaatgtttatttgcttctctt

SEQ ID NO: 32726 - DNA, 2696 bp, Homo sapiens
atcggctgtggggagtaccggctgcagtcggctgtgccgggagggtaggatggcgtctggccgatgcggtgatagcaccgaaagcagacggccgccaggcgctccccctaccccccgaagtttctccccagcggcgggggatgggggtaggcggttcctctgttctttctgcgttccccgcggcctcttaccacagagacgcgggcctccaccgtcctagccctcccgccctgttctctagtgcggactagagcgtctcctcgccatttcctgtcgccctggggccccgcggggaaaaagggggagtagcaggacagcggagggaagtcgcgagcttaggtggtgtgtagacgccggaagtgttgggaaggaggccggaagctaggggcggggccaggaagtgaggaggggcgggggtttatgaggagtccaagggagcattggggcagacttgtactcagagccacctgagggacttggcggtggcgcccagcactgtcccctcccctcgtagagacacggttgtcgtttgggagtagggaacactgtgttggggtgggttgtcggcaggacatctctctggctgctcttggggcgaggtgtggaggggcagggctgggggtggagccgggtcgccagggcgtcggtagggaagacccccgcccctcgcccccccaccgaacctctacactggctggctggacactaagatggctgccgttgccatgacacccaaccctgtgcagacccttcaggaggaggcggtgtgcgccatctgcctcgattacttcacggaccccgtgtccatcggctgcgggcacaacttctgccgagtttgtgtaacccagttgtggggtggggaggatgaggaggacagagatgagttagatcgggaggaggaggaggaggacggagaggaggaggaagtggaggctgtgggggctggcgcggggtgggacacccccatgcgggatgaagactacgagggtgacatggaggaggaggtcgaggaggaagaagagggtgtgttctggaccagtggcatgagcaggtccagctgggacaacatggactatgtgtgggaggaggaggacgaggaggaagacctggactactacttgggggacatggaggaggaggacctgaggggggaggatgaggaggacgaggaggaagtgctggaggaggttgaggaagaggatctagaccccgtcaccccactgcccccgcctccagcccctcggaggtgcttcacatgccctcagtgccgaaagagctttcctcggcggagcttccgccccaacctgcagctggccaatatggtccaggtgattcggcagatgcacccaacccctggtcgagggagccgcgtgaccgatcagggcatctgtcccaaacaccaagaagccctgaagctcttctgcgaggtagacgaagaggccatctgtgtggtgtgccgagaatccaggagccacaaacagcacagcgtggtgccattggaggaggtggtgcaggagtacaaggccaaactgcaggggcacgtggaaccactgaggaagcacctggaggcagtgcagaagatgaaagccaaggaggagaggcgagtgacagaactgaagagccagatgaagtcagagctggcagcggtggcctcggagtttgggcgactgacacggtttctggctgaagagcaggcagggctggaacggcgtctcagagagatgcatgaagcccagctggggcgtgcgggagccgcggctagtcgccttgcagaacaggccgcccagctcagccgcctgctggcagaggcccaggagcggagccagcaggggggtctccggctgctccaggacatcaaggagactttcaataggtgtgaagaggtacagctgcagcccccagaggtctggtcccctgacccgtgccaaccccatagccatgacttcctgacagatgccatcgtgaggaaaatgagccggatgttctgtcaggctgcgagagtggacctgacgctggaccctgacacggctcacccggccctgatgctgtcccctgaccgccggggggtccgcctggcagagcggcggcaggaggttgctgaccatcccaagcgcttctcggccgactgctgcgtactgggggcccagggcttccgctccggccggcactactgggaggagcctaaagaaccctcctggcctccagctcagccttctctcacctactatgtctgtccaacagaccggccagaatttagcttcacttgagagagatctggaatggtcgccatgattgaaaccacgcaccattacatcatcattacattaattacatcaacataaattatttcttcccccttcccttttccagcactcaaccaaggagcaaagctcatcccaccccacacccctcccaggtctgctcactgccaggctcctctcccctttgttcagtggagctggcttttctcccagcccctttccatgcctttcactccatttggcaagctctgagggggagcctggggacgggtttgggtccccaggaggagagccttgggtataatctatttttctaggagcctcttgccttgtcacttgcagctttcgccctctgctttgatggctgaggtgaactcatgttctttgggaaaagggaaggcgtgctgtggaaataaaatgtttatttgcttctct

SEQ ID NO: 32727 - DNA, 450 bp, Homo sapiens
cttcaggaggaggcggtgtgcgccatctgcctcgattacttcacggaccccgtgtccatcggctgcgggcacaacttctgccgagtttgtgtaacccagttgtggggacggagaggaggaggaagtggaggctaccccgtcaccccactgcccccgcctccagcccctcggaggtgcttcacatgccctcagtgccgaaagagctttcctcggcggagcttccgccccaacctgcagctggccaatatggtccaggtgattcggcagatgcacccaacccctggtcgagggagccgcgtgaccgatcagggcatctgtcccaaacaccaagaagccctgaagctcttctgcgaggtagacgaagaggccatctgtgtggtgtgccgagaatccaggagccacaaacagcacagcgtggtgccattggaggaggtggtgcaggagtacaag

SEQ ID NO: 32728 - DNA, 2512 bp, Homo sapiens
accggctgcagtcggctgtgccgggagggtaggatggcgtctggccgatgcggtgatagcaccgaaagcagacggccgccaggcgctccccctaccccccgaagtttctccccagcggcgggggatgggggtaggcggttcctctgttctttctgcgttccccgcggcctcttaccacagagacgcgggcctccaccgtcctagccctcccgccctgttctctagtgcggactagagcgtctcctcgccatttcctgtcgccctggggccccgcggggaaaaagggggagtagcaggacagcggagggaagtcgcgagcttaggtggtgtgtagacgccggaagtgttgggaaggaggccggaagctaggggcggggccaggaagtgaggaggggcgggggtttatgaggagtccaagggagcattggggcagacttgtactcagagccacctgagggacttggcggtggcgcccagcactgtcccctcccctcgtagagacacggttgtcgtttgggagtagggaacactgtgttggggtgggttgtcggcaggacatctctctggctgctcttggggcgaggtgtggaggggcagggctgggggtggagccgggtcgccagggcgtcggtagggaagacccccgcccctcgcccccccaccgaacctctacactggctggctggacactaagatggctgccgttgccatgacacccaaccctgtgcagacccttcaggaggaggcggtgtgcgccatctgcctcgattacttcacggaccccgtgtccatcggctgcgggcacaacttctgccgagtttgtgtaacccagttgtggggtggggaggatgaggaggacagagatgagttagatcgggaggaggaggaggaggacggagaggaggaggaagtggaggctgtgggggctggcgcggggtgggacacccccatgcgggatgaagactacgagggtgacatggaggaggaggtcgaggaggaagaagagggtgtgttctggaccagtggcatgagcaggtccagctgggacaacatggactatgtgtgggaggaggaggacgaggaggaagacctggactactacttgggggacatggaggaggaggacctgaggggggaggatgaggaggacgaggaggaagtgctggaggaggttgaggaagaggatctagaccccgtcaccccactgcccccgcctccagcccctcggaggtgcttcacatgccctcagtgccgaaagagctttcctcggcggagcttccgccccaacctgcagctggccaatatggtccaggtgattcggcagatgcacccaacccctggtcgagggagccgcgtgaccgatcagggcatctgtcccaaacaccaagaagccctgaagctcttctgcgaggtagacgaagaggccatctgtgtggtgtgccgagaatccaggagccacaaacagcacagcgtggtgccattggaggaggtggtgcaggagtacaaggccaaactgcaggggcacgtggaaccactgaggaagcacctggaggcagtgcagaagatgaaagccaaggaggagaggcgagtgacagaactgaagagccagatgaagtcagagctggcagcggtggcctcggagtttgggcgactgacacggtttctggctgaagagcaggcagggctggaacggcgtctcagagagatgcatgaagcccagctggggcgtgcgggagccgcggctagtcgccttgcagaacaggccgcccagctcagccgcctgctggcagaggcccaggagcggagccagcaggggggtctccggctgctccagcaagacatcaaggagactttcaataggtatgccatcgtgaggaaaatgagccggatgttctgtcaggctgcgagagtggacctgacgctggaccctgacacggctcacccggccctgatgctgtcccctgaccgccggggggtccgcctggcagagcggcggcaggaggttgctgaccatcccaagcgcttctcggccgactgctgcgtactgggggcccagggcttccgctccggccggcactactgggaggtagaggtgggcgggcggcggggctgggcggtgggtgctgcccgtgaatcaacccatcataaggaaaaggtgggccctgggggttcctccgtgggcagcggggatgccagctcctcgcgccatcaccatcgccgccgccggctccacctgccccagcagcccctgctccagcgggaagtgtggtgcgtgggcaccaacggcaaacgctatcaggcccagagctccacagaacagacgctgctgagccccagtgagaaaccaaggcgctttggtgtgtacctggactatgaagctgggcgcctgggcttctacaacgcagagactctagcccacgtgcacaccttctcggctgccttcctgggcgagcgtgtctttcctttcttccgggtgctctccaagggcacccgcatcaagctctgcccttga

SEQ ID NO: 32729 - DNA, 3182 bp, Homo sapiens
ggaggctgagcgggcggcgcgacgcgggggccgacgggggcgccgggtggccgcgccggaagtgccttgcgcggcagaggaagcgcagggacagagcggagcaggccgagccggcggaaagggtctttgctgctgcgcccgggcaggggctgccgcggccccaggtcccgcttcgagacgcggcgcggtccaggcgggaggcgactccctaggaagggacccggggcgggaggaggaagtgaggccgcgcggaaggaaggcggcgagccccggggccccgaggccttggccgcgtcacagcacccacatggcctctggagtgggcgcggccttcgaggaactgcctcacgacggcacgtgtgacgagtgcgagcccgacgaggctccgggggccgaggaagtgtgccgagaatgcggcttctgctactgccgccgccatgccgaggcgcacaggcagaagttcctcagtcaccatctggccgaatacgtccacggctcccaggcctggaccccgccagctgacggagagggggcggggaaggaagaagcggaggtcaaggtggagcaggagagggagatagaaagcgaggcaggggaagagagtgagtcggaggaagagagcgagtcagaggaagagagcgagacagaggaagagagtgaggatgagagcgatgaggagagtgaagaagacagcgaggaagaaatggaggatgagcaagaaagcgaggccgaagaagacaaccaagaagaaggggaatccgaggcggagggagaaactgaggcagaaagtgaatttgacccagaaatagaaatggaagcagagagagtggccaagaggaagtgtccggaccatgggcttgatttgagtacctattgccaggaagataggcagctcatctgtgtcctgtgtccagtcattggggctcaccagggccaccaactctccaccctagacgaagcctttgaagaattaagaagcaaagactcaggtggactgaaggccgctatgatcgaattggtggaaaggttgaagttcaagagctcagaccctaaagtaactcgggaccaaatgaagatgtttatacagcaggaatttaagaaagttcagaaagtgattgctgatgaggagcagaaggcccttcatctagtggacatccaagaggcaatggccacagctcatgtgactgagatactggcagacatccaatcccacatggataggttgatgactcagatggcccaagccaaggaacaacttgatacctctaatgaatcagctgagccaaaggcagagggcgatgaggaaggacccagtggtgccagtgaagaagaggacacatgaaggcttgctacccccagtggaaaatcatcccctccccttgtgtgtatgtgacagcgtgtatgtaacggcttctgatttctgtgaaagctgctcagcaacaaacgtacttccaccagatgtgtccccagatccacagcaggcacatatctctccaagggatgaccagttttatgcttactgtgtgcttctcatcccctggttgtggtaggtcaaggaaaagagcccctttgatccaccaggagcaattaagaaaggtccttcaggtaatccctcaatggctgctttgaacttactcaggaaagccagcccccataatattgtattaccaaacagtatcgctttgttaggaaggatctggaataatcttgaagggaagtcagagttttctccctgcctattaacaaaaacccaattttgttcatattgaagcatgaaataaatgagagcaaggtagggccaaattaactcttgtggacagtccctaaaagtccagttctacatttgtgaaaattgtggtgccatgaattaagatggatgactggaaaaaggtgttggagaaagagttaaagatgaggaagagatatttttagtatatgaagttatccaggacttgatattcataattcagtgctgtggaaatgaaaaaaatgattgaagaggtggaacggaaatgaccttagggggaaaaaaaaggaccaaagaagtctgattaaaagttgaaatcagtatttctgaattcaaattgcttgaatttccaaaatagtcagtaaaggatctaatagaaccagaattatttgggtgaattctgcaggttttatgggcttgtcacaacgtgaagggctggaatgtatattaccaaatgggaatttccattgtaggtttttgctagtcccacccccattttagcctaatttggcttaaacgcagtatggggagaattgttcccattccatgtgttctgaattcagctcatctcccagcatatagatatatcctcctttaactccgaccagaacccttcttcctgtggcactccccacccatagaccttcagatcatctcccacaccctggatctcactctcctcttagtaacagagacactcctgaggttggacttccttgcttttctctacttccaaatcacaatttcttacaaccaagctttgtgctcccgagtaagcagggatgtactaggggaatgtaaaactgcaaacttaaaaacctgcatcttcttgaagcatcagttttacttaccaaatggtttagagtcataagatgacctatttttatataaaagttatattatagaataaaatgttcatacgcatagactgttaagataaaaaaataggaatcttgcaaggtaattcttatttgcaagtgggttatgtgttcactctcctctacctttatggtattttggtgttcacttacgaagcatacaactagaaccatatccaagcagactctgggttgctgttaacccagggcctagacttctagtgcctctgaggcagaaccaaaggagcctgcactgggggaaatcccttttcctgcctgcctgtctgcctgtgacctgtgtacgtattacaggctttaggaccagctgattgttatgcttgcaggatggttttgaaacagaaacaatacttgtttactgtaggaatcctatttatattatttttcagtcctgtgaatgctgtgaaaagatttattcctttgaggccaggaagctcccaggcatatatgcttctaggttaggattgtcctgactcactaaagatgccaggatattggggctgaggggagtttgaggtgttaaaaaaaaaaaaaaaaaa

SEQ ID NO: 32730 - DNA, 3515 bp, Homo sapiens
gggccgaggcgcgggagaggcggtggacaccgagaagcccgccggcggcttgcaattccctcacccggcgcgcgcctttcgcagagggaaggagcaagagggcccctacctcatcgtgcgcgggtggggtcggcgcttgtcgcgtgtggcgcgcagtggggcgggcggcgggaggggggtggcagtggagggagcgagaggtgcaggggtgactttgttggcagcaggactagctggagagctagacctggaagcgcatccggggaggacttgcggggcagaggagggcgtgggcgtgtctggtgtgggatgcagtggaaaggagggggccctcctgagtagatctgtgggtgattccttcgaggacgcctcgtcttcccgtctgcccttttatttgtcagcgagggagtccccatggtctctgttcaagttctggagactttctctttgggtgggcttaatcacctgctactaaatcgtagaactgcccagggccctttctaatattggtcacaaacgtgaggagtatgtcagaaaacagaaaaccgctgctgggctttgtaagcaaactcactagtgggactgcacttgggaactcaggcaagactcactgccccctgtgcttggggcttttcaaagcccccaggctcttgccttgtttgcatacagtttgcaccacgtgtctggagcagctggagcccttctcagtagtggacatccgagggggagactctgacacaagctctgaggggtcaatattccaggaactcaagccacgaagtctgcagtcgcagatcggcatcctttgtcctgtatgtgatgctcaggtggacctgcccatgggtggagtgaaggctttaaccatagaccacctggccgtgaatgatgtgatgctggagagcctacgtggggaaggccagggcctggtgtgtgacctgtgcaacgacagggaagtagagaagaggtgtcagacctgcaaagccaacctctgccacttctgctgccaggctcataggcggcagaagaaaacgacttaccacaccatggtggacctaaaagacttgaaaggctacagccggattgggaagcccatcctgtgtcctgttcaccctgcagaggaactgaggctgttctgtgagttctgtgaccggcccgtgtgccaggattgtgtggtgggggagcatcgggaacacccctgtgacttcaccagcaatgtcatccacaagcatggggactctgtgtgggagctcctcaaaggtactcagccccacgtggaggccctggaggaagccctggctcagatccacataataaacagtgccctccagaagcgagtggaggcagtggcagctgatgtccggacattctcggagggctacattaaggccattgaggagcatcgggacaagctgctgaagcagctggaagacatacgggcccagaaggaaaattccctgcagctgcagaaggcccagctggaacagttactggcagacatgcggactggagtggagttcaccgagcacttgctgaccagcggctcagacttggagatcctcatcaccaagagggtggtggtagaacggctcaggaagctgaacaaagttcaatatagcacccgtcctggagtaaatgataagatacgcttctgtcctcaggagaaagcaggccagtgccgtggctatgaaatttatggtacgattaataccaaagaggttgatccagccaaatgtgtcctacaaggagaagacctccacagagcccgggagaaacagacggcctctttcaccctgctttgtaaggatgccgcaggagaaatcatgggcaggggaggagacaacgttcaagttgccgttgtccctaaagataagaaagacagcccagtcagaacaatggtccaggataacaaggatgggacatactacatttcctacacccccaaggaacctggcgtctatactgtgtgggtctgcatcaaagaacagcatgtgcagggctcgccattcactgtgatggtgaggagaaagcaccgcccacactcaggcgtgtttcactgctgcaccttctgctccagcgggggccagaaaaccgctcgctgcgcctgtggaggcaccatgccaggtgggtacctaggctgtggccatggacacaaaggccacccaggtcatccccactggtcatgctgtggaaaatttaatgagaaatctgaatgcacatggacaggtgggcagagcgcaccgaggagtctacttaggactgtggctctctgatgggtttgtgctcagccttttaaagctgcaggcagcaccacttgagatttccagaggacccagaccttcgttcattctaaagagactgatagaattaaaaacaaagtgccttatcttgcactggagttcaagtgctcttttgttagttattcactgattgtacttgtggatggttgagcacaaaaaaccacctctacatttctcttaaaggtaggttggcaacgttctttttctaccacaggatactccttttcattttgtacagtatggaggtatctattccattggcactgaagggtctaggtagtttagttcctttctgatataaccctttttttttcttttttttttttttttaaagacagagtctcactctgtcacccaggctggagtgcagtggcatgatctcggctcactgcaacctctgcctcccggttcaaatgattctcgtgccttggtgtcccgagtagctgggattacaggttcccccccaccttcccccacacccagctaatttttgtgtttttagtagagacggggtttcaccatgttggccaggctggtctcaaactcctgacctcgtgatccacctgcctcggcctcccaaagtgctggggttacaagcatgagccaccacacctggcctattatgacctttttcatttttctctgagctacacattatttagatatttcccctagagattagaaacctcctttcatcctgtccactttttgttagcatactttcattggatttactggtacatgttttgtgatcatgataatgtgatcttgttttggtggtgtccccctactccgtctctatgccatgacagccttctgccccaaagcctggaagattactctttggtcaagggcatacaaatagaaagttaataaaggggaatggtgttgaaatagaacctcatacatttattacagttctacttatacagaaaatctagacaccttcatccttctcacagctctgttttttagtagagtagtctttagagtagtcttcactgttatctatatacctagaaagttaactgggagctttgactcttactgtgccttcactcatagtgtgccttcttagctgctggagaatttggggagaggatgtacacagcactggtgcctcagccctgccaaggtcttcactgtatatattttgtgtgttcttctgaaactcttgatttcttatatggcaataaactcagcatgtattaaatataa

SEQ ID NO: 32731 - DNA, 2415 bp, Homo sapiens
gttacacaggactgtggaatcccgggtgacattcaactccttaggtcatctgcactccccccggaccggaaaacaaagccttcccgagcccgacaaggagggtggcgctccctggcccggccgaagtaagccctccattcgacacctcggctccacggtctcccgaaccggtccccgtaacgcgagcctgagatgccctcacccccgaaaaatacccaaagtcggggagccgcgggagtgcttgtacccagcacgctaggcctgagggacctgtgagctacagtaagcgcctgaggacagaggggagcctcgcagcctcaaacccgcgtggaggagaaacgtctggcgcccccgagcggccgagacctcgggagcccgaaaaacgtctcccactcccagcgcagagccaactgacagtgccatccaccaatgggagaacccagtctgcgttcgtgggacgagtccgagggcagaaagaaggccgtcccggcgccaaatcagcgtggctttttaagaggtcctgaggcctctctggtcaccacagagagagggacagtccctgtgaaacggtgacgctgactacactatgccgctcgctccgagccttggccttttcctcccgccgcactctaagcccttcggccgccccgcccacggccttgtcaggtcccgccccccgcgtgagtggactggcgaagatgtggaatttccaaaacttattggatgcttagtggcgtcactctggagggcggcggggcccggagcggcgagggccgccgctctcggacggaactcaagccacgaagtctgcagtcgcagatcggcatcctttgtcctgtatgtgatgctcaggtggacctgcccatgggtggagtgaaggctttaaccatagaccacctggccgtgaatgatgtgatgctggagagcctacgtggggaaggccagggcctggtgtgtgacctgtgcaacgacagggaagtagagaagaggtgtcagacctgcaaagccaacctctgccacttctgctgccaggctcataggcggcagaagaaaacgacttaccacaccatggtggacctaaaagacttgaaaggctacagccggattgggaagcccatcctgtgtcctgttcaccctgcagaggaactgaggctgttctgtgagttctgtgaccggcccgtgtgccaggattgtgtggtgggggagcatcgggaacacccctgtgacttcaccagcaatgtcatccacaagcatggggactctgtgtgggagctcctcaaaggtactcagccccacgtggaggccctggaggaagccctggctcagatccacataataaacagtgccctccagaagcgagtggaggcagtggcagctgatgtccggacattctcggagggctacattaaggccattgaggagcatcgggacaagctgctgaagcagctggaagacatacgggcccagaaggaaaattccctgcagctgcagaaggcccagctggaacagttactggcagacatgcggactggagtggagttcaccgagcacttgctgaccagcggctcagacttggagatcctcatcaccaagagggtggtggtagaacggctcaggaagctgaacaaagttcaatatagcacccgtcctggagtaaatgataagatacgcttctgtcctcaggagaaagcaggccagtgccgtggctatgaaatttatggtacgattaataccaaagaggttgatccagccaaatgtgtcctacaaggagaagacctccacagagcccgggagaaacagacggcctctttcaccctgctttgtaaggatgccgcaggagaaatcatgggcaggggaggagacaacgttcaagttgccgttgtccctaaagataagaaagacagcccagtcagaacaatggtccaggataacaaggatgggacatactacatttcctacacccccaaggaacctggcgtctatactgtgtgggtctgcatcaaagaacagcatgtgcagggctcgccattcactgtgatggtgaggagaaagcaccgcccacactcaggcgtgtttcactgctgcaccttctgctccagcgggggccagaaaaccgctcgctgcgcctgtggaggcaccatgccaggtgggtacctaggctgtggccatggacacaaaggccacccaggtcatccccactggtcatgctgtggaaaatttaatgagaaatctgaatgcacatggacaggtgggcagagcgcaccgaggagtctacttaggactgtggctctctgatgggtttgtgctcagccttttaaagctgcaggcagcaccacttgagatttccagaggacccagaccttcgttcattctaaagagactgatagaattaaaaacaaagtgccttatcttgca

SEQ ID NO: 32732 - DNA, 3495 bp, Homo sapiens
ggtgtgaggaggggccagagcccgcgggcgtcccgggccgaggcgcgggagaggcggtggacaccgagaagcccgccggcggcttgcaattccctcacccggcgcgcgcctttcgcagagggaaggagcaagagggcccctacctcatcgtgcgcgggtggggtcggcgcttgtcgcgtgtggcgcgcagtggggcgggcggcgggaggggggtggcagtggagggagcgagaggtgcaggggtgactttgttggcagcaggactagctggagagctagacctggaagcgcatccggggaggacttgcggggcagaggagggcgtgggcgtgtctggtgtgggatgcagtggaaaggagggggccctcctgagtagatctgtgggtgattccttcgaggacgcctcgtcttcccgtctgcccttttatttgtcagcgagggagtccccatggtctctgttcaagttctggagactttctctttgggtgggcttaatcacctgctactaaatcgtagaactgcccagggccctttctaatattggtcacaaacgtgaggagtatgtcagaaaacagaaaaccgctgctgggctttgtaagcaaactcactagtgggactgcacttgggaactcaggcaagactcactgccccctgtgcttggggcttttcaaagcccccaggctcttgccttgtttgcatacagtttgcaccacgtgtctggagcagctggagcccttctcagtagtggacatccgagggggagactctgacacaagctctgaggggtcaatattccaggaactcaagccacgaagtctgcagtcgcagatcggcatcctttgtcctgtatgtgatgctcaggtggacctgcccatgggtggagtgaaggctttaaccatagaccacctggccgtgaatgatgtgatgctggagagcctacgtggggaaggccagggcctggtgtgtgacctgtgcaacgacagggaagtagagaagaggtgtcagacctgcaaagccaacctctgccacttctgctgccaggctcataggcggcagaagaaaacgacttaccacaccatggtggacctaaaagacttgaaaggctacagccggattgggaagcccatcctgtgtcctgttcaccctgcagaggaactgaggctgttctgtgagttctgtgaccggcccgtgtgccaggattgtgtggtgggggagcatcgggaacacccctgtgacttcaccagcaatgtcatccacaagcatggggactctgtgtgggagctcctcaaaggtactcagccccacgtggaggccctggaggaagccctggctcagatccacataataaacagtgccctccagaagcgagtggaggcagtggcagctgatgtccggacattctcggagggctacattaaggccattgaggagcatcgggacaagctgctgaagcagctggaagacatacgggcccagaaggaaaattccctgcagctgcagaaggcccagctggaacagttactggcagacatgcggactggagtggagttcaccgagcacttgctgaccagcggctcagacttggagatcctcatcaccaagagggtggtggtagaacggctcaggaagctgaacaaagttcaatatagcacccgtcctggagtaaatgataagatacgcttctgtcctcaggagaaagcaggccagtgccgtggctatgaaatttatgacctccacagagcccgggagaaacagacggcctctttcaccctgctttgtaaggatgccgcaggagaaatcatgggcaggggaggagacaacgttcaagttgccgttgtccctaaagataagaaagacagcccagtcagaacaatggtccaggataacaaggatgggacatactacatttcctacacccccaaggaacctggcgtctatactgtgtgggtctgcatcaaagaacagcatgtgcagggctcgccattcactgtgatggtgaggagaaagcaccgcccacactcaggcgtgtttcactgctgcaccttctgctccagcgggggccagaaaaccgctcgctgcgcctgtggaggcaccatgccaggtgggtacctaggctgtggccatggacacaaaggccacccaggtcatccccactggtcatgctgtggaaaatttaatgagaaatctgaatgcacatggacaggtgggcagagcgcaccgaggagtctacttaggactgtggctctctgatgggtttgtgctcagccttttaaagctgcaggcagcaccacttgagatttccagaggacccagaccttcgttcattctaaagagactgatagaattaaaaacaaagtgccttatcttgcactggagttcaagtgctcttttgttagttattcactgattgtacttgtggatggttgagcacaaaaaaccacctctacatttctcttaaaggtaggttggcaacgttctttttctaccacaggatactccttttcattttgtacagtatggaggtatctattccattggcactgaagggtctaggtagtttagttcctttctgatataaccctttttttttcttttttttttttttttaaagacagagtctcactctgtcacccaggctggagtgcagtggcatgatctcggctcactgcaacctctgcctcccggttcaaatgattctcgtgccttggtgtcccgagtagctgggattacaggttcccccccaccttcccccacacccagctaatttttgtgtttttagtagagacggggtttcaccatgttggccaggctggtctcaaactcctgacctcgtgatccacctgcctcggcctcccaaagtgctggggttacaagcatgagccaccacacctggcctattatgacctttttcatttttctctgagctacacattatttagatatttcccctagagattagaaacctcctttcatcctgtccactttttgttagcatactttcattggatttactggtacatgttttgtgatcatgataatgtgatcttgttttggtggtgtccccctactccgtctctatgccatgacagccttctgccccaaagcctggaagattactctttggtcaagggcatacaaatagaaagttaataaaggggaatggtgttgaaatagaacctcatacatttattacagttctacttatacagaaaatctagacaccttcatccttctcacagctctgttttttagtagagtagtctttagagtagtcttcactgttatctatatacctagaaagttaactgggagctttgactcttactgtgccttcactcatagtgtgccttcttagctgctggagaatttggggagaggatgtacacagcactggtgcctcagccctgccaaggtcttcactgtatatattttgtgtgttcttctgaaactcttgatttcttatatggcaataaactcagcatgtattaaatataa

SEQ ID NO: 32733 - DNA, 2261 bp, Homo sapiens
ggcggcgccctgggcggccgcggagtcatggacggcagtggacccttcagctgccccatctgcctagagccactccgggagccggtgacgctgccctgcggccacaacttctgtctcgcctgcctgggcgcgctctggccgcatcgtggcgcgagtggagccggcggacccggaggcgcggcccgctgcccgctgtgccaggagcccttccccgacggccttcagctccgcaagaaccacacgctgtccgagctgctgcagctccgccagggctcgggccccgggtccggccccggcccggcccctgccctggccccggagccctcggcacccagcgcgctgcccagtgtcccggagccgtcggccccctgcgctcccgagccgtggcccgcgggcgaagagccagtgcgctgcgacgcgtgccccgagggcgcggccctgcccgccgcgctgtcctgcctctcctgcctcgcctccttttgccccgcgcacctgggcccgcacgagcgcagccccgccctccgcggacaccgcctggtgccgccgctgcgccggctagaggagagcctgtgcccgcgccacctacggccgctcgagcgctactgccgcgcggagcgcgtgtgtctgtgcgaggcctgcgccgcacaggagcaccgcggccacgagctggtgccgctggagcaggagcgcgcgcttcaggaggctgagcagtccaaagtcctgagcgccgtggaggaccgcatggacgagctgggtgctggcattgcacagtccaggcgcacagtggccctcatcaagagtgcagccgtagcagagcgggagagggtgagccggctgtttgcagatgctgcggccgccctgcagggcttccagacccaggtgctgggcttcatcgaggagggggaagctgccatgctaggccgctcccagggtgacctgcggcgacaggaggaacagcgcagccgcctgagccgagcccgccagaatctcagccaggtccctgaagctgactcagtcagcttcctgcaggagctgctggcactaaggctggccctggaggatgggtgtggccctgggcctggacccccgagggagctcagcttcaccaaatcatcccaagctgtccgtgcagtgagagacatgctggccgtggcctgcgtcaaccagtgggagcagctgagggggccgggtggcaacgaggatgggccacagaagctggactcggaagctgatgctgagccccaagacctcgagagtacgaacctcttggagagtgaagctcccagggactatttcctcaagtttgcctatattgtggatttggacagcgacacagcagacaagttcctgcagctgtttggaaccaaaggtgtcaagagggtgctgtgtcctatcaactaccccttgtcgcccacccgcttcacccattgtgagcaggtgctgggcgagggtgccctggaccgaggcacctactactgggaggtggagattatcgagggctgggtcagcatgggggtcatggccgaagacttctccccacaagagccctacgaccgcggccggctgggccgcaacgcccactcctgctgcctgcagtggaatggacgcagcttctccgtctggtttcatgggctggaggctcccctgccccaccccttctcgcccacggttggggtctgcctggaatacgctgaccgtgccttggccttctatgctgtacgggacggcaagatgagcctcctgcggaggctgaaggcctcccggccccgccggggtggcatcccggcctcccccattgaccccttccagagccgcctggacagtcactttgcggggctcttcacccacagactcaagcctgccttcttcctggagagtgtggacgcccacttgcagatcgggcccctcaagaagtcctgcatatccgtgctgaagaggaggtgatgccgggcacgggcgctcctgctgccgtctctgctccaggaagctgcctcctctgggccctctccttcgtctgggaaggcaccagcatgagtcccacacacccagccttctcatttctagaggcttccacctttttatacactcagccttccctctcccaggcaggaggacccccagaccctgttcccctgcagacctcacttctgggagacagagctacagctgggacagctccaagctaccctaacccctcctttcccaggtttctagaatagtgtctggcatgtagtagatgctcaataaacacttgttgaatg

SEQ ID NO: 32734 - DNA, 3399 bp, Homo sapiens
agtttatctttcactttcctgccctgagtgtgagcaagaatttcctgcggttcctctaggaaaattcctttgtgcagatcaggcccgtggattggtgagtgaatcctaaccacgtcttccctggcctgtcttcactcttctccccagaatcaccacttctgcactggtgtctgaaggtgtattgagtgattttgtggagggcagaagtaggaagtctttgggacaaaactgtatttaccttgggatctgtgaacaagaggaacctcagcagccaggacaggcaggagcagtggaatagctactatggcttctggaatcctggttaatgtaaaggaggaggtgacctgccccatctgcctggaactcctgacacaacccctgagcctggactgcggccacagcttctgccaagcatgcctcactgcaaaccacaagaagtccatgctagacaaaggagagagtagctgccctgtgtgccggatcagttaccagcctgagaacatacggcctaatcggcatgtagccaacatagtggagaagctcagggaggtcaagttgagcccagaggggcagaaagttgatcattgtgcacgccatggagagaaacttctactcttctgtcaggaggacgggaaggtcatttgctggctttgtgagcggtctcaggagcaccgtggtcaccacacgttcctcacagaggaggttgcccgggagtaccaagtgaagctccaggcagctctggagatgctgaggcagaagcagcaggaagctgaagagttagaagctgacatcagagaagagaaagcttcctggaagactcaaatacagtatgacaaaaccaacgtcttggcagattttgagcaactgagagacatcctggactgggaggagagcaatgagctgcaaaacctggagaaggaggaggaagacattctgaaaagccttacgaactctgaaactgagatggtgcagcagacccagtccctgagagagctcatctcagatctggagcatcggctgcaggggtcagtgatggagctgcttcagaaagtaagtgggaagattcttaggacggagaacgtgaccttgaagaagccagaaacttttccaaaaaatcaaaggagagtgtttcgagctcctgatctgaaaggaatgctagaagtgtttagagagctgacagatgtccgacgctactgggttgatgtgacagtggctccaaacaacatttcatgtgctgtcatttctgaagataagagacaagtgagctctccgaaaccacagataatatatggggcacgagggacaagataccagacatttgtgaatttcaattattgtactggcatcctgggctctcaaagtatcacatcagggaaacattactgggaggtagacgtgtccaagaaaactgcttggatcctgggggtatgtgctggcttccaacctgatgcaatgtgtaatattgaaaaaaatgaaaattatcaacctaaatacggctactgggttatagggttagaggaaggagttaaatgtagtgctttccaggatagttccttccatactccttctgttcctttcattgtgcccctctctgtgattatttgtcctgatcgtgttggagttttcctagactatgaggcttgcactgtctcattcttcaatatcacaaaccatggatttctcatctataagttttctcactgttctttttctcagcctgtatttccatatttaaatcctagaaaatgtggagtccccatgactctgtgctcaccaagctcttgaaccttcttacacactcagccccttctgtacagcacctcttgtccaggtgcatctcatacacctgaactcatttgcatcattttaaccatcttttccttgctgtctcccttctttctatttgaacgtccttcactcatcagtaaaatgtaataattgccttgtgccatattgtccccaatattttattgacatttgatagcaatttttttcatcattttccgtactcctaaggaaaactgacctatacctcataaaatgagaccgctatttaggtattacttctgccagatatttatcacccaattgcctctgacactgactaagaagatgaagaaaagcttttcaacagcctttctatatcatcgtgtgataattgttcaccaatgaatgagtccttagccctgtgtcagtttaccctcgatgcccttatttgtgagttaaagagaaaatatcataaatggtatactcttaagtatagaggttttgtatctagaggatctcagttcaactcctgtctctccatataccagcagtgtaactgtgaataacatacttaaatggctgtgcttatttccttttcttttcttttttctttttttttttttttgagatgaagttttgctcttgttccccaggctggagtgcaatggcacgatctcggttcactgcaacctccacctctcagattcaagcaattctcctgcctcagcctcccaagtagctgggattacaggtgcccaccaccacccctggctaaatttgtattttcagtagagacggggtttccccatgttggttaggctcgtctagaacctctgacctcaggtgatccacccgcctcggcctcccaaagtgctgggattacaggcgtgagccacggcgcccagcctgtgcttattttcttaaaataatttttgtattaaaaacttcacattaaataagtgctaatgttttattgcatagtagggtgactagagttaacaataacctattgcatatattttgaaatagctagaagagaggattttgaaagttctcaacacaaagaaatgacacatatttgaggtgatggatatgctaattaccctggttcggttattacgcaatgtatacatgtatcaaaacatcacactgtaccacataaatatgtatatttattatttgtcaattaaaagcaaaataaaacaaaaaaccttcatctaatactttggatcattgtgaaaaaataaattcctgaagtataaagcatctatctaagtgtcttgatctaataagtacttgttctacaaattattgaaaaacataaactctgttaatgtctcatggaacaggttgtgccttcagggaaactaggattggatttactaaattctcattttttagatctcagatactactgtcaaaatgacttcaattctgccttctatatataatacacacatatatttaggattttattgtaattctagtgttgctacatattagtctttatcaaacaaactgaattatgtgggaatcagtttattaattgtaaaaaataattataataaaattagctgatgtagttttttaaaagttaaacgagttttttgaatagcttcactcatttctagc

SEQ ID NO: 32735 - DNA, 2290 bp, Homo sapiens
atttccttctagaagccaggagcaaaggacagacctctctctggtataaggaggaagagattgagaagaggaattctccagagtctattaactatactacatcaacgcctccaagatactatggtacccatcccaggggaagtggggctacaagaacagtataaatatctcctattggcataataaatggtgtaccccaagaatatgccaagggatgttttgtagagattttgagactaaggagatttggaaattgtgtggctattagcagtttcattcataatgaaatttataatcccttaaaaaacttggaggaagataattgcaggaagaacaccttgaataagcagaactcagctgtgagatcaggagcaagaggagcacattggaagaatttcgaaaaagggcaccttttctaatttttaatacttggctgggttaatctgaaactatgtcagaagaagtggcatgataacaagatcctgagactcaagagaaaagggagattgagtgggaatgcctctagttcccacggctcctcctgtgaacagcacagctacacggcccggctgattcattcagagggcgggactcaccaggccctacgtggagaaatgccattggcccatagtttatctttcactttcctgccctgagtgtgagcaagaatttcctgcggttcctctaggaaaattcctttgtgcagatcaggcccgtggattgggatctgtgaacaagaggaacctcagcagccaggacaggcaggagcagtggaatagctactatggcttctggaatcctggttaatgtaaaggaggaggtgacctgccccatctgcctggaactcctgacacaacccctgagcctggactgcggccacagcttctgccaagcatgcctcactgcaaaccacaagaagtccatgctagacaaaggagagagtagctgccctgtgtgccggatcagttaccagcctgagaacatacggcctaatcggcatgtagccaacatagtggagaagctcagggaggtcaagttgagcccagaggggcagaaagttgatcattgtgcacgccatggagagaaacttctactcttctgtcaggaggacgggaaggtcatttgctggctttgtgagcggtctcaggagcaccgtggtcaccacacgttcctcacagaggaggttgcccgggagtaccaagtgaagctccaggcagctctggagatgctgaggcagaagcagcaggaagctgaagagttagaagctgacatcagagaagagaaagcttcctggaagactcaaatacagtatgacaaaaccaacgtcttggcagattttgagcaactgagagacatcctggactgggaggagagcaatgagctgcaaaacctggagaaggaggaggaagacattctgaaaagccttacgaactctgaaactgagatggtgcagcagacccagtccctgagagagctcatctcagatctggagcatcggctgcaggggtcagtgatggagctgcttcagggtgtggatggcgtcataaaaaggacggagaacgtgaccttgaagaagccagaaacttttccaaaaaatcaaaggagagtgtttcgagctcctgatctgaaaggaatgctagaagtgtttagagagctgacagatgtccgacgctactggggctggagtgcaatggcacgatctcggttcactgcaacctccacctctcagattcaagcaattctcctgcctcagcctcccaagtagctgggattacaggtgcccaccaccacccctggctaaatttgtattttcagtagagacggggtttccccatgttggttaggctcgtctagaacctctgacctcaggtgatccacccgcctcggcctcccaaagtgctgggattacaggcgtgagccacggcgcccagcctgtgcttattttcttaaaataatttttgtattaaaaacttcacattaaataagtgctaatgttttattgcatagtagggtgactagagttaacaataacctattgcatatattttgaaatagctagaagagaggattttgaaagttctcaacacaaagaaatgacacatatttgaggtgatggatatgctaattaccctggttcggttattacgcaatgtatacatgtatcaaaacatcacactgtaccacataaatatgtatatttattatttgtcaattaaaagcaaaataaaacaaaaaaccttcatctaatactttggatcattgtgaaaaaataaattcctgaagtataaag

SEQ ID NO: 32736 - DNA, 2991 bp, Homo sapiens
gcggttcctctaggaaaattcctttgtgcagatcaggcccgtggattggtgagtgaatcctaaccacgtcttccctggcctgtcttcactcttctccccagaatcaccacttctgcactggtgtctgaaggtgtattgagtgattttgtggagggcagaagtaggaagtctttgggacaaaactgtatttaccttgggatctgtgaacaagaggaacctcagcagccaggacaggcaggagcagtggaatagctactatggcttctggaatcctggttaatgtaaaggaggaggtgacctgccccatctgcctggaactcctgacacaacccctgagcctggactgcggccacagcttctgccaagcatgcctcactgcaaaccacaagaagtccatgctagacaaaggagagagtagctgccctgtgtgccggatcagttaccagcctgagaacatacggcctaatcggcatgtagccaacatagtggagaagctcagggaggtcaagttgagcccagaggggcagaaagttgatcattgtgcacgccatggagagaaacttctactcttctgtcaggaggacgggaaggtcatttgctggctttgtgagcggtctcaggagcaccgtggtcaccacacgttcctcacagaggaggttgcccgggagtaccaagtgaagctccaggcagctctggagatgctgaggcagaagcagcaggaagctgaagagttagaagctgacatcagagaagagaaagcttcctggaagactcaaatacagtatgacaaaaccaacgtcttggcagattttgagcaactgagagacatcctggactgggaggagagcaatgagctgcaaaacctggagaaggaggaggaagacattctgaaaagccttacgaactctgaaactgagatggtgcagcagacccagtccctgagagagctcatctcagatctggagcatcggctgcaggggtcagtgatggagctgcttcagggtgtggatggcgtcataaaaaggacggagaacgtgaccttgaagaagccagaaacttttccaaaaaatcaaaggagagtgtttcgagctcctgatctgaaaggaatgctagaagtgtttagagagctgacagatgtccgacgctactgggttgatgtgacagtggctccaaacaacatttcatgtgctgtcatttctgaagataagagacaagtgagctctccgaaaccacagataatatatggggcacgagggacaagataccagacatttgtgaatttcaattattgtactggcatcctgggctctcaaagtatcacatcagggaaacattactgggaggtagacgtgtccaagaaaactgcttggatcctgggggtatgtgctggcttccaacctgatgcaatgtgtaatattgaaaaaaatgaaaattatcaacctaaatacggctactgggttatagggttagaggaaggagttaaatgtagtgctttccaggatagttccttccatactccttctgttcctttcattgtgcccctctctgtgattatttgtcctgatcgtgttggagttttcctagactatgaggcttgcactgtctcattcttcaatatcacaaaccatggatttctcatctataagttttctcactgttctttttctcagcctgtatttccatatttaaatcctagaaaatgtggagtccccatgactctgtgctcaccaagctcttgaaccttcttacacactcagccccttctgtacagcacctcttgtccaggtgcatctcatacacctgaactcatttgcatcattttaaccatcttttccttgctgtctcccttctttctatttgaacgtccttcactcatcagtaaaatgtaataattgccttgtgccatattgtccccaatattttattgacatttgatagcaatttttttcatcattttccgtactcctaaggaaaactgacctatacctcataaaatgagaccgctatttaggtattacttctgccagatatttatcacccaattgcctctgacactgactaagaagatgaagaaaagcttttcaacagcctttctatatcatcgtgtgataattgttcaccaatgaatgagtccttagccctgtgtcagtttaccctcgatgcccttatttgtgagttaaagagaaaatatcataaatggtatactcttaagtatagaggttttgtatctagaggatctcagttcaactcctgtctctccatataccagcagtgtaactgtgaataacatacttaaatggctgtgcttatttccttttcttttcttttttctttttttttttttttgagatgaagttttgctcttgttccccaggctggagtgcaatggcacgatctcggttcactgcaacctccacctctcagattcaagcaattctcctgcctcagcctcccaagtagctgggattacaggtgcccaccaccacccctggctaaatttgtattttcagtagagacggggtttccccatgttggttaggctcgtctagaacctctgacctcaggtgatccacccgcctcggcctcccaaagtgctgggattacaggcgtgagccacggcgcccagcctgtgcttattttcttaaaataatttttgtattaaaaacttcacattaaataagtgctaatgttttattgcatagtagggtgactagagttaacaataacctattgcatatattttgaaatagctagaagagaggattttgaaagttctcaacacaaagaaatgacacatatttgaggtgatggatatgctaattaccctggttcggttattacgcaatgtatacatgtatcaaaacatcacactgtaccacataaatatgtatatttattatttgtcaattaaaagcaaaataaaacaaaaaaccttcatctaatactttggatcattgtgaaaaaataaattcctgaagtataaagcatcta

SEQ ID NO: 32737 - DNA, 3170 bp, Homo sapiens
ctttgtgcagatcaggcccgtggattggtgagtgaatcctaaccacgtcttccctggcctgtcttcactcttctccccagaatcaccacttctgcactggtgtctgaaggtgtattgagtgattttgtggagggcagaagtaggaagtctttgggacaaaactgtatttaccttgggatctgtgaacaagaggaacctcagcagccaggacaggcaggagcagtggaatagctactatggcttctggaatcctggttaatgtaaaggaggaggtgacctgccccatctgcctggaactcctgacacaacccctgagcctggactgcggccacagcttctgccaagcatgcctcactgcaaaccacaagaagtccatgctagacaaaggagagagtagctgccctgtgtgccggatcagttaccagcctgagaacatacggcctaatcggcatgtagccaacatagtggagaagctcagggaggtcaagttgagcccagaggggcagaaagttgatcattgtgcacgccatggagagaaacttctactcttctgtcaggaggacgggaaggtcatttgctggctttgtgagcggtctcaggagcaccgtggtcaccacacgttcctcacagaggaggttgcccgggagtaccaagtgaagctccaggcagctctggagatgctgaggcagaagcagcaggaagctgaagagttagaagctgacatcagagaagagaaagcttcctggaagactcaaatacagtatgacaaaaccaacgtcttggcagattttgagcaactgagagacatcctggactgggaggagagcaatgagctgcaaaacctggagaaggaggaggaagacattctgaaaagccttacgaactctgaaactgagatggtgcagcagacccagtccctgagagagctcatctcagatctggagcatcggctgcaggggtcagtgatggagctgcttcagggtgtggatggcgtcataaaaaggacggagaacgtgaccttgaagaagccagaaacttttccaaaaaatcaaaggagagtgtttcgagctcctgatctgaaaggaatgctagaagtgtttagagagctgacagatgtccgacgctactggggtaaggagaagtcacattatcataagccaccctgcggcttatcattattattatctttatcttttagaattttatgttctctattaggctcatgttttaagatttatgattctccttccaagacacacataacttacccctccttataacttctaaacaaggttcctcccagttttctctcaagtctttatcaagatttctctcatatcacaaataaagttacattatatcccttagctgacctgttaatttttctacagttgatgtgacagtggctccaaacaacatttcatgtgctgtcatttctgaagataagagacaagtgagctctccgaaaccacagataatatatggggcacgagggacaagataccagacatttgtgaatttcaattattgtactggcatcctgggctctcaaagtatcacatcagggaaacattactgggaggtagacgtgtccaagaaaactgcttggatcctgggggtatgtgctggcttccaacctgatgcaatgtgtaatattgaaaaaaatgaaaattatcaacctaaatacggctactgggttatagggttagaggaaggagttaaatgtagtgctttccaggatagttccttccatactccttctgttcctttcattgtgcccctctctgtgattatttgtcctgatcgtgttggagttttcctagactatgaggcttgcactgtctcattcttcaatatcacaaaccatggatttctcatctataagttttctcactgttctttttctcagcctgtatttccatatttaaatcctagaaaatgtggagtccccatgactctgtgctcaccaagctcttgaaccttcttacacactcagccccttctgtacagcacctcttgtccaggtgcatctcatacacctgaactcatttgcatcattttaaccatcttttccttgctgtctcccttctttctatttgaacgtccttcactcatcagtaaaatgtaataattgccttgtgccatattgtccccaatattttattgacatttgatagcaatttttttcatcattttccgtactcctaaggaaaactgacctatacctcataaaatgagaccgctatttaggtattacttctgccagatatttatcacccaattgcctctgacactgactaagaagatgaagaaaagcttttcaacagcctttctatatcatcgtgtgataattgttcaccaatgaatgagtccttagccctgtgtcagtttaccctcgatgcccttatttgtgagttaaagagaaaatatcataaatggtatactcttaagtatagaggttttgtatctagaggatctcagttcaactcctgtctctccatataccagcagtgtaactgtgaataacatacttaaatggctgtgcttatttccttttcttttcttttttctttttttttttttttgagatgaagttttgctcttgttccccaggctggagtgcaatggcacgatctcggttcactgcaacctccacctctcagattcaagcaattctcctgcctcagcctcccaagtagctgggattacaggtgcccaccaccacccctggctaaatttgtattttcagtagagacggggtttccccatgttggttaggctcgtctagaacctctgacctcaggtgatccacccgcctcggcctcccaaagtgctgggattacaggcgtgagccacggcgcccagcctgtgcttattttcttaaaataatttttgtattaaaaacttcacattaaataagtgctaatgttttattgcatagtagggtgactagagttaacaataacctattgcatatattttgaaatagctagaagagaggattttgaaagttctcaacacaaagaaatgacacatatttgaggtgatggatatgctaattaccctggttcggttattacgcaatgtatacatgtatcaaaacatcacactgtaccacataaatatgtatatttattatttgtcaattaaaagcaaaataaaacaaaaaa

SEQ ID NO: 32738 - DNA, 1287 bp, Homo sapiens
agtttatctttcactttcctgccctgagtgtgagcaagaatttcctgcggttcctctaggaaaattcctttgtgcagatcaggcccgtggattggtgagtgaatcctaaccacgtcttccctggcctgtcttcactcttctccccagaatcaccacttctgcactggtgtctgaaggtgtattgagtgattttgtggagggcagaagtaggaagtctttgggacaaaactgtatttaccttgggatctgtgaacaagaggaacctcagcagccaggacaggcaggagcagtggaatagctactatggcttctggaatcctggttaatgtaaaggaggaggtgacctgccccatctgcctggaactcctgacacaacccctgagcctggactgcggccacagcttctgccaagcatgcctcactgcaaaccacaagaagtccatgctagacaaaggagagagtagctgccctgtgtgccggatcagttaccagcctgagaacatacggcctaatcggcatgtagccaacatagtggagaagctcagggaggtcaagttgagcccagaggggcagaaagttgatcattgtgcacgccatggagagaaacttctactcttctgtcaggaggacgggaaggtcatttgctggctttgtgagcggtctcaggagcaccgtggtcaccacacgttcctcacagaggaggttgcccgggagtaccaagtgaagctccaggcagctctggagatgctgaggcagaagcagcaggaagctgaagagttagaagctgacatcagagaagagaaagcttcctggaagactcaaatacagtatgacaaaaccaacgtcttggcagattttgagcaactgagagacatcctggactgggaggagagcaatgagctgcaaaacctggagaaggaggaggaagacattctgaaaagccttacgaactctgaaactgagatggtgcagcagacccagtccctgagagagctcatctcagatctggagcatcggctgcaggggtcagtgatggagctgcttcaggctggagtgcagtgtttaattcttaggacggagaacgtgaccttgaagaagccagaaacttttccaaaaaatcaaaggagagtgtttcgagctcctgatctgaaaggaatgctagaagtgtttagagagctgacagatgtccgacgctactggggctggagtgcaatggcacgatctcggttcactgcaacctccacctctcagattcaagcaattctcctgcctcagcctcccaagtag

SEQ ID NO: 32739 - DNA, 2029 bp, Homo sapiens
agtttatctttcactttcctgccctgagtgtgagcaagaatttcctgcggttcctctaggaaaattcctttgtgcagatcaggcccgtggattgggatctgtgaacaagaggaacctcagcagccaggacaggcaggagcagtggaatagctactatggcttctggaatcctggttaatgtaaaggaggaggtgacctgccccatctgcctggaactcctgacacaacccctgagcctggactgcggccacagcttctgccaagcatgcctcactgcaaaccacaagaagtccatgctagacaaaggagagagtagctgccctgtgtgccggatcagttaccagcctgagaacatacggcctaatcggcatgtagccaacatagtggagaagctcagggaggtcaagttgagcccagaggggcagaaagttgatcattgtgcacgccatggagagaaacttctactcttctgtcaggaggacgggaaggtcatttgctggctttgtgagcggtctcaggagcaccgtggtcaccacacgttcctcacagaggaggttgcccgggagtaccaagtgaagctccaggcagctctggagatgctgaggcagaagcagcaggaagctgaagagttagaagctgacatcagagaagagaaagcttcctggaagactcaaatacagtatgacaaaaccaacgtcttggcagattttgagcaactgagagacatcctggactgggaggagagcaatgagctgcaaaacctggagaaggaggaggaagacattctgaaaagccttacgaactctgaaactgagatggtgcagcagacccagtccctgagagagctcatctcagatctggagcatcggctgcaggggtcagtgatggagctgcttcagggtgtggatggcgtcataaaaaggacggagaacgtgaccttgaagaagccagaaacttttccaaaaaatcaaaggagagtgtttcgagctcctgatctgaaaggaatgctagaagtgtttagagagctgacagatgtccgacgctactggggctggagtgcaatggcacgatctcggttcactgcaacctccacctctcagattcaagcaattctcctgcctcagcctcccaagtagctgggattacaggtgcccaccaccacccctggctaaatttgtattttcagtagagacggggtttccccatgttggttaggctcgtctagaacctctgacctcaggtgatccacccgcctcggcctcccaaagtgctgggattacaggcgtgagccacggcgcccagcctgtgcttattttcttaaaataatttttgtattaaaaacttcacattaaataagtgctaatgttttattgcatagtagggtgactagagttaacaataacctattgcatatattttgaaatagctagaagagaggattttgaaagttctcaacacaaagaaatgacacatatttgaggtgatggatatgctaattaccctggttcggttattacgcaatgtatacatgtatcaaaacatcacactgtaccacataaatatgtatatttattatttgtcaattaaaagcaaaataaaacaaaaaaccttcatctaatactttggatcattgtgaaaaaataaattcctgaagtataaagcatctatctaagtgtcttgatctaataagtacttgttctacaaattattgaaaaacataaactctgttaatgtctcatggaacaggttgtgccttcagggaaactaggattggatttactaaattctcattttttagatctcagatactactgtcaaaatgacttcaattctgccttctatatataatacacacatatatttaggattttattgtaattctagtgttgctacatattagtctttatcaaacaaactgaattatgtgggaatcagtttattaattgtaaaaaataattataataaaattagctgatgtagttttttaaaagttaaacgagttttttgaatagcttcactcatttctagc

SEQ ID NO: 32740 - DNA, 1054 bp, Homo sapiens
tccgttctgctggaacacaaacgcgcttctcagtttctctggaggaacttggttggcgaagagcttggcgcttcttgtaaaccttgtcccgctggacaaagacttgtgaaggaacacggagtgccaccaggactccgtggccctccccgcctctctctcctttttcccttcatggcggtgaagctgtggacgcttctcttcaggaggtgagctccagatgagacgccacatcccagcggagtcccggaagggtcaccccgcaggtctaaggcccgcctgttctgtgccgtgacctgtgctaccgaagtcatctgttgctgtagggaggccagggactcagccgatgcctcaatggccaactgcagggatctgtgaacaagaggaacctcagcagccaggacaggcaggagcagtggaatagctactatggcttctggaatcctggttaatgtaaaggaggaggtgacctgccccatctgcctggaactcctgacacaacccctgagcctggactgcggccacagcttctgccaagcatgcctcactgcaaaccacaagaagtccatgctagacaaaggagagagtagctgccctgtgtgccggatcagttaccagcctgagaacatacggcctaatcggcatgtagccaacatagtggagaagctcagggaggtcaagttgagcccagaggggcagaaagttgatcattgtgcacgccatggagagaaacttctactcttctgtcaggaggacgggaaggtcatttgctggctttgtgagcggtctcaggagcaccgtggtcaccacacgttcctcacagaggaggttgcccgggagtaccaagtgaagctccaggcagctctggagatgctgaggcagaagcagcaggaagctgaagagttagaagctgacatcagagaagagaaagcttcctggaagactcaaatacagtatgacaaaaccaacgtcttggcagattttgagcaactgagagacatcctggactgggaggagagcaatgagctgcaaaacctggagaaggaggaggaagaca

SEQ ID NO: 32741 - DNA, 607 bp, Homo sapiens
cctttgtgcagatcaggcccgtggattggtgagtgaatcctaaccacgtcttccctggcctgtcttcactcttctccccagaatcaccacttctgcactggtgtctgaaggtgtattgagtgattttgtggagggcagaagtaggaagtctttgggacaaaactgtatttaccttgaatgaagccgcggacgcttgcagtgagtgttacagttcttaaaggcggcatgtccggagtttcttccttctgatgttcggatgtgttcagagtttcttctttctggtgggttcgtggtctcgctggctcaggagggaagctgcagaccttcgcgggatctgtgaacaagaggaacctcagcagccaggacaggcaggagcagtggaatagctactatggcttctggaatcctggttaatgtaaaggaggaggtgacctgccccatctgcctggaactcctgacacaacccctgagcctggactgcggccacagcttctgccaagcatgcctcactgcaaaccacaagaagtccatgctagacaaaggagagagtagctgccctgtgtgccggatcagttaccagcctgagaacatacggcctaatcggcat

SEQ ID NO: 32742 - DNA, 2759 bp, Homo sapiens
gtgaacaagaggaacctcagcagccaggacaggcaggagcagtggaatagctactatggcttctggaatcctggttaatgtaaaggaggaggtgacctgccccatctgcctggaactcctgacacaacccctgagcctggactgcggccacagcttctgccaagcatgcctcactgcaaaccacaagaagtccatgctagacaaaggagagagtagctgccctgtgtgccggatcagttaccagcctgagaacatacggcctaatcggcatgtagccaacatagtggagaagctcagggaggtcaagttgagcccagaggggcagaaagttgatcattgtgcacgccatggagagaaacttctactcttctgtcaggaggacgggaaggtcatttgctggctttgtgagcggtctcaggagcaccgtggtcaccacacgttcctcacagaggaggttgcccgggagtaccaagtgaagctccaggcagctctggagatgctgaggcagaagcagcaggaagctgaagagttagaagctgacatcagagaagagaaagcttcctggaagactcaaatacagtatgacaaaaccaacgtcttggcagattttgagcaactgagagacatcctggactgggaggagagcaatgagctgcaaaacctggagaaggaggaggaagacattctgaaaagccttacgaactctgaaactgagatggtgcagcagacccagtccctgagagagctcatctcagatctggagcatcggctgcaggggtcagtgatggagctgcttcaggacggagaacgtgaccttgaagaagccagaaacttttccaaaaaatcaaaggagagtgtttcgagctcctgatctgaaaggaatgctagaagtgtttagagagctgacagatgtccgacgctactgggttgatgtgacagtggctccaaacaacatttcatgtgctgtcatttctgaagataagagacaagtgagctctccgaaaccacagataatatatggggcacgagggacaagataccagacatttgtgaatttcaattattgtactggcatcctgggctctcaaagtatcacatcagggaaacattactgggaggtagacgtgtccaagaaaactgcttggatcctgggggtatgtgctggcttccaacctgatgcaatgtgtaatattgaaaaaaatgaaaattatcaacctaaatacggctactgggttatagggttagaggaaggagttaaatgtagtgctttccaggatagttccttccatactccttctgttcctttcattgtgcccctctctgtgattatttgtcctgatcgtgttggagttttcctagactatgaggcttgcactgtctcattcttcaatatcacaaaccatggatttctcatctataagttttctcactgttctttttctcagcctgtatttccatatttaaatcctagaaaatgtggagtccccatgactctgtgctcaccaagctcttgaaccttcttacacactcagccccttctgtacagcacctcttgtccaggtgcatctcatacacctgaactcatttgcatcattttaaccatcttttccttgctgtctcccttctttctatttgaacgtccttcactcatcagtaaaatgtaataattgccttgtgccatattgtccccaatattttattgacatttgatagcaatttttttcatcattttccgtactcctaaggaaaactgacctatacctcataaaatgagaccgctatttaggtattacttctgccagatatttatcacccaattgcctctgacactgactaagaagatgaagaaaagcttttcaacagcctttctatatcatcgtgtgataattgttcaccaatgaatgagtccttagccctgtgtcagtttaccctcgatgcccttatttgtgagttaaagagaaaatatcataaatggtatactcttaagtatagaggttttgtatctagaggatctcagttcaactcctgtctctccatataccagcagtgtaactgtgaataacatacttaaatggctgtgcttatttccttttcttttcttttttctttttttttttttttgagatgaagttttgctcttgttccccaggctggagtgcaatggcacgatctcggttcactgcaacctccacctctcagattcaagcaattctcctgcctcagcctcccaagtagctgggattacaggtgcccaccaccacccctggctaaatttgtattttcagtagagacggggtttccccatgttggttaggctcgtctagaacctctgacctcaggtgatccacccgcctcggcctcccaaagtgctgggattacaggcgtgagccacggcgcccagcctgtgcttattttcttaaaataatttttgtattaaaaacttcacattaaataagtgctaatgttttattgcatagtagggtgactagagttaacaataacctattgcatatattttgaaatagctagaagagaggattttgaaagttctcaacacaaagaaatgacacatatttgaggtgatggatatgctaattaccctggttcggttattacgcaatgtatacatgtatcaaaacatcacactgtaccacataaatatgtatatttattatttgtcaattaaaagcaaaataaaacaaaaaaccttcatctaatactttggatcattgtgaaaaaataaattcctgaagtataaa

SEQ ID NO: 32743 - DNA, 2047 bp, Homo sapiens
agagcatgatggggcacgcgcggtagcgcgaggcggggcatgtaaccatagcgtgcgggtcatgatgaggcacggacgtggggggttaggtggggcacgtaattggagctcgcggggcaggatggggcatctaactggagcgacagagagcacgatggggcacttacaggggccggaggctggcccgggcagtgagtgtggatggcttggcaggtgagcctgctggagctggaggactggcttcagtgtcccatctgcctggaggtcttcaaggagcccctgatgctgcagtgtggccactcttactgcaagggctgcctggtttccctgtcctgccacctggatgccgagctgcgctgccccgtgtgccggcaggcggtggacggcagcagctccctgcccaacgtctccctggccagggtgatcgaagccctgaggctccctggggacccggagcccaaggtctgcgtgcaccaccggaacccgctcagccttttctgcgagaaggaccaggagctcatctgtggcctctgcggtctgctgggctcccaccaacaccacccggtcacgcccgtctccaccgtctacagccgcatgaaggaggagctcgcagccctcatctctgagctgaagcaggagcagaaaaaggtggatgagctcatcgccaaactggtgaacaaccggacccgaatcgtcaatgagtcggatgtcttcagctgggtgatccgccgcgagttccaggagctgcaccacctggtggatgaggagaaggcccgctgcctggaggggatagggggtcacacccgtggcctggtggcctccctggacatgcagctggagcaggcccagggaacccgggagcggctggcccaagccgagtgtgtgctggaacagttcggcaatgaggaccaccacaagttcatccggaagttccactccatggcctccagagcagagatgccgcaggcccggcccttagaaggcgcattcagccccatctccttcaagccaggcctccaccaggctgacatcaagctgaccgtgtggaaaaggctcttccggaaagttttgccagccccggagcctctcaagttggaccctgccactgcccacccactcctggagctctccaagggcaacacggtggtgcagtgcgggcttctggcccagcggcgagccagccagcctgagcgcttcgactacagcacctgcgtcctggccagccgcggcttctcctgcggccgccactactgggaggtggtggtgggcagcaagagcgactggcgcctgggggtcatcaagggcacagccagccgtaagggcaagctgaacaggtcccccgagcacggcgtgtggctgatcggcctgaaggagggccgggtgtacgaagcctttgcctgcccccgggtacccctgcccgtggccggccacccccaccgcatcgggctctacctgcactatgagcagggcgaactcaccttcttcgatgccgaccgccccgatgacctgcggccgctctacaccttccaggccgacttccagggcaagctctaccccatcctggacacctgctggcacgagaggggcagcaactcgctgcccatggtgctgcccccgcccagcgggcctggccccctcagccccgagcagcccaccaagctgtagggccgcccggagtcctgccggcccacaggcccatcccggcggggcaccggggactcgcgggcttctgctgggtcccgcctgaggtgatatcgtcactgtttaggaaggtcttcaggcctgtgtgtccctggaacatgtaatgatagggaacaggaccccagtccctttcccctcagccaagggtgtatttgtaaacttcggcccccaggccttggcagccagggacacactgaaatccccatggttcctgccacttgctaaccatgctatctgcgcagacgcttccgagggcagaaatagtcccatgtataccttttccatattactgtgaactttcaactactatcaaggataataaatttgacattatttctttctcttt

SEQ ID NO: 32744 - DNA, 1599 bp, Homo sapiens
tttcccacttctgactctgtgcctgctgttccctgctgggaagaaggaaagccagtgatgctggcttgaggctgtagtgggaggcccagcggattgtgagaagccagcccgggcagtgagtgtggatggcttggcaggtgagcctgctggagctggaggactggcttcagtgtcccatctgcctggaggtcttcaaggagcccctgatgctgcagtgtggccactcttactgcaagggctgcctggtttccctgtcctgccacctggatgccgagctgcgctgccccgtgtgccggcaggcggtggacggcagcagctccctgcccaacgtctccctggccagggtgatcgaagccctgaggctccctggggacccggagcccaaggtctgcgtgcaccaccggaacccgctcagccttttctgcgagaaggaccaggagctcatctgtggcctctgcggtctgctgggctcccaccaacaccacccggtcacgcccgtctccaccgtctacagccgcatgaaggaggagctcgcagccctcatctctgagctgaagcaggagcagaaaaaggtggatgagctcatcgccaaactggtgaacaaccggacccgaatcgtcaatgagtcggatgtcttcagctgggtgatccgccgcgagttccaggagctgcaccacctggtggatgaggagaaggcccgctgcctggaggggatagggggtcacacccgtggcctggtggcctccctggacatgcagctggagcaggcccagggaacccgggagcggctggcccaagccgagtgtgtgctggaacagttcggcaatgaggaccaccacaagttcatccggaagttccactccatggcctccagagcagagatgccgcaggcccggcccttagaaggcgcattcagccccatctccttcaagccaggcctccaccaggctgacatcaagctgaccgtgtggaaaaggctcttccggaaagttttgccagccccggagcctctcaagttggaccctgccactgcccacccactcctggagctctccaagggcaacacggtggtgcagtgcgggcttctggcccagcggcgagccagccagcctgagcgcttcgactacagcacctgcgtcctggccagccgcggcttctcctgcggccgccactactgggaggtggtggtgggcagcaagagcgactggcgcctgggggtcatcaagggcacagccagccgtaagggcaagctgaacaggtcccccgagcacggcgtgtggctgatcggcctgaaggagggccgggtgtacgaagcctttgcctgcccccgggtacccctgcccgtggccggccacccccaccgcatcgggctctacctgcactatgagcagggcgaactcaccttcttcgatgccgaccgccccgatgacctgcggccgctctacaccttccaggccgacttccagggcaagctctaccccatcctggacacctgctggcacgagaggggcagcaactcgctgcccatggtgctgcccccgcccagcgggcctggccccctcagccccgagcagcccaccaagctgtagggccgcccgg

SEQ ID NO: 32745 - DNA, 3217 bp, Homo sapiens
ctgagtctttcggcctgggtggaggacgcggctgcttcaagtccttggctctgatccaggccacagattccaggattctacaggcaggaaacatcttagaaatcagggttgggcaggcaggagccaggagagtagctacaatgacttcaccagtactggtggacatacgagaagaggtgacctgccctatctgcctggagctcctaacagaacccctgagcatagactgtggccacagcttctgccaagcctgcatcacaccaaatggcagggaatcagtgattggtcaagaaggggaaagaagctgccctgtgtgccagaccagctaccagccagggaacctgcggcctaatcggcatctggccaacatagtgaggcggctcagagaggtagtgttgggccctgggaagcagctgaaagcagttctttgtgcagaccatggagaaaaactgcagctcttctgtcaggaggatgggaaggtcatttgctggctttgtgagcggtctcaggagcaccgtggtcaccacacgttcctcgtggaggaggttgcccaggagtaccaggagaagtttcaggagtctctaaagaagctgaagaacgaggagcaggaagctgagaagctaacagcttttatcagagagaagaaaacatcctggaagaatcagatggagcctgagagatgcaggatccagacagagtttaatcagctgcgaaatatcctagacagagtggagcaacgggagctgaaaaagctggaacaggaagagaagaaggggctacgaattatagaagaggctgagaatgatctggtccaccagacccagtcgctgcgagagctcatctcggatctggagcgtcgatgtcaggggtcaacaatggagctgctgcaggatgtgagtgatgtcacagaaaggagtgagttctggaccctgaggaagccagaagctctccctacaaagctgagaagtatgttccgagccccagatctgaaaaggatgctgcgagtgtgtagagagctgacagatgtccaaagctactgggttgacgtgaccctgaatccacacacagctaatttaaatcttgtcctggctaaaaaccggagacaagtgaggtttgtgggagctaaagtatctggaccttcctgtctggaaaagcattatgactgtagtgtcctgggctcccagcacttctcctctggtaagcattactgggaggtagatgtggccaagaagactgcctggatcctgggggtatgcagcaattcactgggacctacattctctttcaaccattttgctcaaaatcacagtgcttactccaggtatcagcctcagagtggatactgggtgattgggttacagcataaccatgaatatagggcctatgaggattcttccccttccctgcttctctccatgacagtgccccctcgccgtgttggggttttcttagattatgaggctggtactgtctccttttataatgtcacaaaccatggcttccccatctacactttctctaaatattactttcccactactctttgtccatattttaatccttgcaactgtgtaattcctatgaccctgcgtcgtccaagctcttgaatattcttctgttcccacccacttctgataagtaccctgaggcttatcagcatgtgattctcccttctgatcttctgtttttctgtgttctcaattcttttgttgttttttggtttttgaatcttttttgagatggaatctcgctctgtcgcccaggctggagtgcactggcgcaatctcggctcactgcaacctctgcctcctgggttcaagcgaacctcctgcctcagcatcccaagtagctgggattacaggcacccaccaccatgcccaactaatttttgtatttttatagagatagggtttcaccgtgttggccaggctgatctcgaactcctgaccgcaagtgatccacccgcctcggtctcccaaagtgctgggattacagatgtgagccgccgcgcccagacagttctttcgttttaaacagttactcagtactaggatgcacccagtggtgagagtaagcatctttgactgatgacaggtcttgaggtggatagggggcgctttcagtattttgccattaagcatagtatttgatgcaggttttttttgattgatgcaggggatcaaatttaggaagttctgatctgttaatttactacaagtttttgtataaaatgaaaactcgtattctacctatgtcttttctgtaaattattgagacaattgtgtatcatttttgttctgttaatgtggcttagtacattgatttacttcaatttgttaccacaacttgctgaaatacaccattattatttgttgtatgcaatactggatttattttgataacgtattgtttagattttgttctcatctatgttaatgaaagaaattggcctgtatttttacattcttgtaatatctttgccaggttctataaaatgcaataataagcaaataaattactttgtttttgtataagtatgtataggattgagctctaaaaccaaaccattataatgataatttgggtagcttcaaactcaaattgaagagagtcttcactacaatcttcactacaacctttggccttcctctctacatttaagagtagcaatagaacaataaaaaaaaatacgtctttcaaattaattgcagtaaaaacaaaagagtagtggggagagaaaaacaatccaatacatatttttctctcagaatagaaagaaaacacaaagagaaaatatgaacaatataaagcacttaaaggaagaggatgatttcttccagcttttccacactctctttatgcgcaggaacaaacagctgttgagtgagctgctatgactttggtagagaggtgcaatatgttttttgaaccagctataaaagaaattaagaggtacatgtgagggtagaaacaaatatcaaggatgagaatggcactggctgtcccatatggtatccaggagccaccaatgtctgttgagtacttcatacatgcctagtctgaattgagatgtgctcaatgtataaaatatataccagatttcaaatacctacttcaaaaaataatgtaaaatatctcactaataacttttcctttgtgtattgcaatgataatatgttggctctattggattaaataaagtatgttattcatttta

SEQ ID NO: 32746 - DNA, 3403 bp, Homo sapiens
gccttccgcaaactcctgacctgtgggtccgtccgttcaacggccaaaggctggcggaggagggatcccctgcctttctcggaacggaacggagcagagtcgtgcgtggttgagtttagataaaagccgagtgagcgcgctctgttccttaagattagtttaaggtgccttggattgctctgaagagctttgaccacctgatattgcttacatctggaacttcttggcttctcattccccagatgtgcgggtcagagaggattctacaggcaggaaacatcttagaaatcagggttgggcaggcaggagccaggagagtagctacaatgacttcaccagtactggtggacatacgagaagaggtgacctgccctatctgcctggagctcctaacagaacccctgagcatagactgtggccacagcttctgccaagcctgcatcacaccaaatggcagggaatcagtgattggtcaagaaggggaaagaagctgccctgtgtgccagaccagctaccagccagggaacctgcggcctaatcggcatctggccaacatagtgaggcggctcagagaggtagtgttgggccctgggaagcagctgaaagcagttctttgtgcagaccatggagaaaaactgcagctcttctgtcaggaggatgggaaggtcatttgctggctttgtgagcggtctcaggagcaccgtggtcaccacacgttcctcgtggaggaggttgcccaggagtaccaggagaagtttcaggagtctctaaagaagctgaagaacgaggagcaggaagctgagaagctaacagcttttatcagagagaagaaaacatcctggaagaatcagatggagcctgagagatgcaggatccagacagagtttaatcagctgcgaaatatcctagacagagtggagcaacgggagctgaaaaagctggaacaggaagagaagaaggggctacgaattatagaagaggctgagaatgatctggtccaccagacccagtcgctgcgagagctcatctcggatctggagcgtcgatgtcaggggtcaacaatggagctgctgcaggatgtgagtgatgtcacagaaaggagtgagttctggaccctgaggaagccagaagctctccctacaaagctgagaagtatgttccgagccccagatctgaaaaggatgctgcgagtgtgtagagagctgacagatgtccaaagctactgggttgacgtgaccctgaatccacacacagctaatttaaatcttgtcctggctaaaaaccggagacaagtgaggtttgtgggagctaaagtatctggaccttcctgtctggaaaagcattatgactgtagtgtcctgggctcccagcacttctcctctggtaagcattactgggaggtagatgtggccaagaagactgcctggatcctgggggtatgcagcaattcactgggacctacattctctttcaaccattttgctcaaaatcacagtgcttactccaggtatcagcctcagagtggatactgggtgattgggttacagcataaccatgaatatagggcctatgaggattcttccccttccctgcttctctccatgacagtgccccctcgccgtgttggggttttcttagattatgaggctggtactgtctccttttataatgtcacaaaccatggcttccccatctacactttctctaaatattactttcccactactctttgtccatattttaatccttgcaactgtgtaattcctatgaccctgcgtcgtccaagctcttgaatattcttctgttcccacccacttctgataagtaccctgaggcttatcagcatgtgattctcccttctgatcttctgtttttctgtgttctcaattcttttgttgttttttggtttttgaatcttttttgagatggaatctcgctctgtcgcccaggctggagtgcactggcgcaatctcggctcactgcaacctctgcctcctgggttcaagcgaacctcctgcctcagcatcccaagtagctgggattacaggcacccaccaccatgcccaactaatttttgtatttttatagagatagggtttcaccgtgttggccaggctgatctcgaactcctgaccgcaagtgatccacccgcctcggtctcccaaagtgctgggattacagatgtgagccgccgcgcccagacagttctttcgttttaaacagttactcagtactaggatgcacccagtggtgagagtaagcatctttgactgatgacaggtcttgaggtggatagggggcgctttcagtattttgccattaagcatagtatttgatgcaggttttttttgattgatgcaggggatcaaatttaggaagttctgatctgttaatttactacaagtttttgtataaaatgaaaactcgtattctacctatgtcttttctgtaaattattgagacaattgtgtatcatttttgttctgttaatgtggcttagtacattgatttacttcaatttgttaccacaacttgctgaaatacaccattattatttgttgtatgcaatactggatttattttgataacgtattgtttagattttgttctcatctatgttaatgaaagaaattggcctgtatttttacattcttgtaatatctttgccaggttctataaaatgcaataataagcaaataaattactttgtttttgtataagtatgtataggattgagctctaaaaccaaaccattataatgataatttgggtagcttcaaactcaaattgaagagagtcttcactacaatcttcactacaacctttggccttcctctctacatttaagagtagcaatagaacaataaaaaaaaatacgtctttcaaattaattgcagtaaaaacaaaagagtagtggggagagaaaaacaatccaatacatatttttctctcagaatagaaagaaaacacaaagagaaaatatgaacaatataaagcacttaaaggaagaggatgatttcttccagcttttccacactctctttatgcgcaggaacaaacagctgttgagtgagctgctatgactttggtagagaggtgcaatatgttttttgaaccagctataaaagaaattaagaggtacatgtgagggtagaaacaaatatcaaggatgagaatggcactggctgtcccatatggtatccaggagccaccaatgtctgttgagtacttcatacatgcctagtctgaattgagatgtgctcaatgtataaaatatataccagatttcaaatacctacttcaaaaaataatgtaaaatatctcactaataacttttcctttgtgtattgcaatgataatatgttggctctattggattaaataaagtatgttattcatttta

SEQ ID NO: 32747 - DNA, 2590 bp, Homo sapiens
ggaggacgcggctgcttcaagtccttggctctgatccaggccacagattccaggattctacaggcaggaaacatcttagaaatcagggttgggcaggcaggagccaggagagtagctacaatgacttcaccagtactggtggacatacgagaagaggtgacctgccctatctgcctggagctcctaacagaacccctgagcatagactgtggccacagcttctgccaagcctgcatcacaccaaatggcagggaatcagtgattggtcaagaaggggaaagaagctgccctgtgtgccagaccagctaccagccagggaacctgcggcctaatcggcatctggccaacatagtgaggcggctcagagaggaggatgggaaggtcatttgctggctttgtgagcggtctcaggagcaccgtggtcaccacacgttcctcgtggaggaggttgcccaggagtaccaggagaagtttcaggagtctctaaagaagctgaagaacgaggagcaggaagctgagaagctaacagcttttatcagagagaagaaaacatcctggaagaatcagatggagcctgagagatgcaggatccagacagagtttaatcagctgcgaaatatcctagacagagtggagcaacgggagctgaaaaagctggaacaggaagagaagaaggggctacgaattatagaagaggctgagaatgatctggtccaccagacccagtcgctgcgagagctcatctcggatctggagcgtcgatgtcaggggtcaacaatggagctgctgcaggatgtgagtgatgtcacagaaaggagtgagttctggaccctgaggaagccagaagctctccctacaaagctgagaagtatgttccgagccccagatctgaaaaggatgctgcgagtgtgtagagagctgacagatgtccaaagctactgggttgacgtgaccctgaatccacacacagctaatttaaatcttgtcctggctaaaaaccggagacaagtgaggtttgtgggagctaaagtatctggaccttcctgtctggaaaagcattatgactgtagtgtcctgggctcccagcacttctcctctggtaagcattactgggaggtagatgtggccaagaagactgcctggatcctgggggtatgcagcaattcactgggacctacattctctttcaaccattttgctcaaaatcacagtgcttactccaggtatcagcctcagagtggatactgggtgattgggttacagcataaccatgaatatagggcctatgaggattcttccccttccctgcttctctccatgacagtgccccctcgccgtgttggggttttcttagattatgaggctggtactgtctccttttataatgtcacaaaccatggcttccccatctacactttctctaaatattactttcccactactctttgtccatattttaatccttgcaactgtgtaattcctatgaccctgcgtcgtccaagctcttgaatattcttctgttcccacccacttctgataagtaccctgaggcttatcagcatgtgattctcccttctgatcttctgtttttctgtgttctcaattcttttgttgttttttggtttttgaatcttttttgagatggaatctcgctctgtcgcccaggctggagtgcactggcgcaatctcggctcactgcaacctctgcctcctgggttcaagcgaacctcctgcctcagcatcccaagtagctgggattacaggcacccaccaccatgcccaactaatttttgtatttttatagagatagggtttcaccgtgttggccaggctgatctcgaactcctgaccgcaagtgatccacccgcctcggtctcccaaagtgctgggattacagatgtgagccgccgcgcccagacagttctttcgttttaaacagttactcagtactaggatgcacccagtggtgagagtaagcatctttgactgatgacaggtcttgaggtggatagggggcgctttcagtattttgccattaagcatagtatttgatgcaggttttttttgattgatgcaggggatcaaatttaggaagttctgatctgttaatttactacaagtttttgtataaaatgaaaactcgtattctacctatgtcttttctgtaaattattgagacaattgtgtatcatttttgttctgttaatgtggcttagtacattgatttacttcaatttgttaccacaacttgctgaaatacaccattattatttgttgtatgcaatactggatttattttgataacgtattgtttagattttgttctcatctatgttaatgaaagaaattggcctgtatttttacattcttgtaatatctttgccaggttctataaaatgcaataataagcaaataaattactttgtttttgtataagtatgtataggattgagctctaaaaccaaaccattataatgataatttgggtagcttcaaactcaaattgaagagagtcttcactacaatcttcactacaacctttggccttcctctctacatttaagagtagcaatagaacaataaaaaaaaa

SEQ ID NO: 32748 - DNA, 2949 bp, Homo sapiens
ggagcagagtcgtgcgtggttgagtttagataaaagccgagtgagcgcgctctgttccttaagattagtttaaggtgccttggattgctctgaagagctttgaccacctgatattgcttacatctggaacttcttggcttctcattccccagatgtgcgggtcagagagaccatggagaaaaactgcagctcttctgtcaggaggatgggaaggtcatttgctggcttgtgagcggtctcaggagcaccgtggtcaccacacgttcctcgtggaggaggttgcccaggagtaccaggagaagtttcaggagtctctaaagaagctgaagaacgaggagcaggaagctgagaagctaacagcttttatcagagagaagaaaacatcctggaagaatcagatggagcctgagagatgcaggatccagacagagtttaatcagctgcgaaatatcctagacagagtggagcaacgggagctgaaaaagctggaacaggaagagaagaaggggctacgaattatagaagaggctgagaatgatctggtccaccagacccagtcgctgcgagagctcatctcggatctggagcgtcgatgtcaggggtcaacaatggagctgctgcaggatgtgagtgatgtcacagaaaggagtgagttctggaccctgaggaagccagaagctctccctacaaagctgagaagtatgttccgagccccagatctgaaaaggatgctgcgagtgtgtagagagctgacagatgtccaaagctactgggttgacgtgaccctgaatccacacacagctaatttaaatcttgtcctggctaaaaaccggagacaagtgaggtttgtgggagctaaagtatctggaccttcctgtctggaaaagcattatgactgtagtgtcctgggctcccagcacttctcctctggtaagcattactgggaggtagatgtggccaagaagactgcctggatcctgggggtatgcagcaattcactgggacctacattctctttcaaccattttgctcaaaatcacagtgcttactccaggtatcagcctcagagtggatactgggtgattgggttacagcataaccatgaatatagggcctatgaggattcttccccttccctgcttctctccatgacagtgccccctcgccgtgttggggttttcttagattatgaggctggtactgtctccttttataatgtcacaaaccatggcttccccatctacactttctctaaatattactttcccactactctttgtccatattttaatccttgcaactgtgtaattcctatgaccctgcgtcgtccaagctcttgaatattcttctgttcccacccacttctgataagtaccctgaggcttatcagcatgtgattctcccttctgatcttctgtttttctgtgttctcaattcttttgttgttttttggtttttgaatcttttttgagatggaatctcgctctgtcgcccaggctggagtgcactggcgcaatctcggctcactgcaacctctgcctcctgggttcaagcgaacctcctgcctcagcatcccaagtagctgggattacaggcacccaccaccatgcccaactaatttttgtatttttatagagatagggtttcaccgtgttggccaggctgatctcgaactcctgaccgcaagtgatccacccgcctcggtctcccaaagtgctgggattacagatgtgagccgccgcgcccagacagttctttcgttttaaacagttactcagtactaggatgcacccagtggtgagagtaagcatctttgactgatgacaggtcttgaggtggatagggggcgctttcagtattttgccattaagcatagtatttgatgcaggttttttttgattgatgcaggggatcaaatttaggaagttctgatctgttaatttactacaagtttttgtataaaatgaaaactcgtattctacctatgtcttttctgtaaattattgagacaattgtgtatcatttttgttctgttaatgtggcttagtacattgatttacttcaatttgttaccacaacttgctgaaatacaccattattatttgttgtatgcaatactggatttattttgataacgtattgtttagattttgttctcatctatgttaatgaaagaaattggcctgtatttttacattcttgtaatatctttgccaggttctataaaatgcaataataagcaaataaattactttgtttttgtataagtatgtataggattgagctctaaaaccaaaccattataatgataatttgggtagcttcaaactcaaattgaagagagtcttcactacaatcttcactacaacctttggccttcctctctacatttaagagtagcaatagaacaataaaaaaaaatacgtctttcaaattaattgcagtaaaaacaaaagagtagtggggagagaaaaacaatccaatacatatttttctctcagaatagaaagaaaacacaaagagaaaatatgaacaatataaagcacttaaaggaagaggatgatttcttccagcttttccacactctctttatgcgcaggaacaaacagctgttgagtgagctgctatgactttggtagagaggtgcaatatgttttttgaaccagctataaaagaaattaagaggtacatgtgagggtagaaacaaatatcaaggatgagaatggcactggctgtcccatatggtatccaggagccaccaatgtctgttgagtacttcatacatgcctagtctgaattgagatgtgctcaatgtataaaatatataccagatttcaaatacctacttcaaaaaataatgtaaaatatctcactaataacttttcctttgtgtattgcaatgataatatgttggctctattggattaaataaagtatgttattcatttt

SEQ ID NO: 32749 - DNA, 2951 bp, Homo sapiens
ggagcagagtcgtgcgtggttgagtttagataaaagccgagtgagcgcgctctgttccttaagattagtttaaggtgccttggattgctctgaagagctttgaccacctgatattgcttacatctggaacttcttggcttctcattccccagatgtgcgggtcagagagaccatggagaaaaactgcagctcttctgtcaggaggatgggaaggtcatttgctggctttgtgagcggtctcaggagcaccgtggtcaccacacgttcctcgtggaggaggttgcccaggagtaccaggagaagtttcaggagtctctaaagaagctgaagaacgaggagcaggaagctgagaagctaacagcttttatcagagagaagaaaacatcctggaagaatcagatggagcctgagagatgcaggatccagacagagtttaatcagctgcgaaatatcctagacagagtggagcaacgggagctgaaaaagctggaacaggaagagaagaaggggctacgaattatagaagaggctgagaatgatctggtccaccagacccagtcgctgcgagagctcatctcggatctggagcgtcgatgtcaggggtcaacaatggagctgctgcaggatgtgagtgatgtcacagaaaggagtgagttctggaccctgaggaagccagaagctctccctacaaagctgagaagtatgttccgagccccagatctgaaaaggatgctgcgagtgtgtagagagctgacagatgtccaaagctactgggttgacgtgaccctgaatccacacacagctaatttaaatcttgtcctggctaaaaaccggagacaagtgaggtttgtgggagctaaagtatctggaccttcctgtctggaaaagcattatgactgtagtgtcctgggctcccagcacttctcctctggtaagcattactgggaggtagatgtggccaagaagactgcctggatcctgggggtatgcagcaattcactgggacctacattctctttcaaccattttgctcaaaatcacagtgcttactccaggtatcagcctcagagtggatactgggtgattgggttacagcataaccatgaatatagggcctatgaggattcttccccttccctgcttctctccatgacagtgccccctcgccgtgttggggttttcttagattatgaggctggtactgtctccttttataatgtcacaaaccatggcttccccatctacactttctctaaatattactttcccactactctttgtccatattttaatccttgcaactgtgtaattcctatgaccctgcgtcgtccaagctcttgaatattcttctgttcccacccacttctgataagtaccctgaggcttatcagcatgtgattctcccttctgatcttctgtttttctgtgttctcaattcttttgttgttttttggtttttgaatcttttttgagatggaatctcgctctgtcgcccaggctggagtgcactggcgcaatctcggctcactgcaacctctgcctcctgggttcaagcgaacctcctgcctcagcatcccaagtagctgggattacaggcacccaccaccatgcccaactaatttttgtatttttatagagatagggtttcaccgtgttggccaggctgatctcgaactcctgaccgcaagtgatccacccgcctcggtctcccaaagtgctgggattacagatgtgagccgccgcgcccagacagttctttcgttttaaacagttactcagtactaggatgcacccagtggtgagagtaagcatctttgactgatgacaggtcttgaggtggatagggggcgctttcagtattttgccattaagcatagtatttgatgcaggttttttttgattgatgcaggggatcaaatttaggaagttctgatctgttaatttactacaagtttttgtataaaatgaaaactcgtattctacctatgtcttttctgtaaattattgagacaattgtgtatcatttttgttctgttaatgtggcttagtacattgatttacttcaatttgttaccacaacttgctgaaatacaccattattatttgttgtatgcaatactggatttattttgataacgtattgtttagattttgttctcatctatgttaatgaaagaaattggcctgtatttttacattcttgtaatatctttgccaggttctataaaatgcaataataagcaaataaattactttgtttttgtataagtatgtataggattgagctctaaaaccaaaccattataatgataatttgggtagcttcaaactcaaattgaagagagtcttcactacaatcttcactacaacctttggccttcctctctacatttaagagtagcaatagaacaataaaaaaaaatacgtctttcaaattaattgcagtaaaaacaaaagagtagtggggagagaaaaacaatccaatacatatttttctctcagaatagaaagaaaacacaaagagaaaatatgaacaatataaagcacttaaaggaagaggatgatttcttccagcttttccacactctctttatgcgcaggaacaaacagctgttgagtgagctgctatgactttggtagagaggtgcaatatgttttttgaaccagctataaaagaaattaagaggtacatgtgagggtagaaacaaatatcaaggatgagaatggcactggctgtcccatatggtatccaggagccaccaatgtctgttgagtacttcatacatgcctagtctgaattgagatgtgctcaatgtataaaatatataccagatttcaaatacctacttcaaaaaataatgtaaaatatctcactaataacttttcctttgtgtattgcaatgataatatgttggctctattggattaaataaagtatgttattcatttta

SEQ ID NO: 32750 - DNA, 1398 bp, Homo sapiens
aagattagtttaaggtgccttggattgctctgaagagctttgaccacctgatattgcttacatctggaacttcttggcttctcattccccagatgtgcgggtcagagaggagaagtttcaggagtctctaaagaagctgaagaacgaggagcaggaagctgagaagctaacagcttttatcagagagaagaaaacatcctggaagaatcagatggagcctgagagatgcaggatccagacagagtttaatcagctgcgaaatatcctagacagagtggagcaacgggagctgaaaaagctggaacaggaagagaagaaggggctacgaattatagaagaggctgagaatgatctggtccaccagacccagtcgctgcgagagctcatctcggatctggagcgtcgatgtcaggggtcaacaatggagctgctgcaggatgtgagtgatgtcacagaaaggagtgagttctggaccctgaggaagccagaagctctccctacaaagctgagaagtatgttccgagccccagatctgaaaaggatgctgcgagtgtgtagagagctgacagatgtccaaagctactgggttgacgtgaccctgaatccacacacagctaatttaaatcttgtcctggctaaaaaccggagacaagtgaggtttgtgggagctaaagtatctggaccttcctgtctggaaaagcattatgactgtagtgtcctgggctcccagcacttctcctctggtaagcattactgggaggtagatgtggccaagaagactgcctggatcctgggggtatgcagcaattcactgggacctacattctctttcaaccattttgctcaaaatcacagtgcttactccaggtatcagcctcagagtggatactgggtgattgggttacagcataaccatgaatatagggcctatgaggattcttccccttccctgcttctctccatgacagtgccccctcgccgtgttggggttttcttagattatgaggctggtactgtctccttttataatgtcacaaaccatggcttccccatctacactttctctaaatattactttcccactactctttgtccatattttaatccttgcaactgtgtaattcctatgaccctgcgtcgtccaagctcttgaatattcttctgttcccacccacttctgataagtaccctgaggcttatcagcatgtgattctcccttctgatcttctgtttttctgtgttctcaattcttttgttgttttttggtttttgaatcttttttgagatggaatctcgctctgtcgcccaggctggagtgcactggcgcaatctcggctcactgcaacctctgcctcctgggttcaagcgaacctcctgcctcagcatcccaagtagctg

SEQ ID NO: 32751 - DNA, 1767 bp, Homo sapiens
gtctttcggcctgggtggaggacgcggctgcttcaagtccttggctctgatccaggccacagattccagaccatggagaaaaactgcagctcttctgtcaggaggatgggaaggtcatttgctggctttgtgagcggtctcaggagcaccgtggtcaccacacgttcctcgtggaggaggttgcccaggagtaccaggagaagtttcaggagtctctaaagaagctgaagaacgaggagcaggaagctgagaagctaacagcttttatcagagagaagaaaacatcctggaaggcaagggagactttttctgaagatgtcctggggcaggaatcatggcaggtcataggagctgagggcaaaggagtccttgtcctgtctgtcctctgatgccatgactagaagagcttccctttgcctggtcctccactatattccttccaaacagggggaggagaggagaatcagatggagcctgagagatgcaggatccagacagagtttaatcagctgcgaaatatcctagacagagtggagcaacgggagctgaaaaagctggaacaggaagagaagaaggggctacgaattatagaagaggctgagaatgatctggtccaccagacccagtcgctgcgagagctcatctcggatctggagcgtcgatgtcaggggtcaacaatggagctgctgcaggatgtgagtgatgtcacagaaaggagtgagttctggaccctgaggaagccagaagctctccctacaaagctgagaagtatgttccgagccccagatctgaaaaggatgctgcgagtgtgtagagagctgacagatgtccaaagctactgggttgacgtgaccctgaatccacacacagctaatttaaatcttgtcctggctaaaaaccggagacaagtgaggtttgtgggagctaaagtatctggaccttcctgtctggaaaagcattatgactgtagtgtcctgggctcccagcacttctcctctggtaagcattactgggaggtagatgtggccaagaagactgcctggatcctgggggtatgcagcaattcactgggacctacattctctttcaaccattttgctcaaaatcacagtgcttactccaggtatcagcctcagagtggatactgggtgattgggttacagcataaccatgaatatagggcctatgaggattcttccccttccctgcttctctccatgacagtgccccctcgccgtgttggggttttcttagattatgaggctggtactgtctccttttataatgtcacaaaccatggcttccccatctacactttctctaaatattactttcccactactctttgtccatattttaatccttgcaactgtgtaattcctatgaccctgcgtcgtccaagctcttgaatattcttctgttcccacccacttctgataagtaccctgaggcttatcagcatgtgattctcccttctgatcttctgtttttctgtgttctcaattcttttgttgttttttggtttttgaatcttttttgagatggaatctcgctctgtcgcccaggctggagtgcactggcgcaatctcggctcactgcaacctctgcctcctgggttcaagcgaacctcctgcctcagcatcccaagtagctgggattacaggcacccaccaccatgcccaactaatttttgtatttttatagagatagggtttcaccgtgttggccaggctgatctcgaactcctgaccgcaagtgatccacccg

SEQ ID NO: 32752 - DNA, 1060 bp, Homo sapiens
aagattagtttaaggtgccttggattgctctgaagagctttgaccacctgatattgcttacatctggaacttcttggcttctcattccccagatgtgcgggtcagagagaatcagatggagcctgagagatgcaggatccagacagagtttaatcagctgcgaaatatcctagacagagtggagcaacgggagctgaaaaagctggaacaggaagagaagaaggggctacgaattatagaagaggctgagaatgatctggtccaccagacccagtcgctgcgagagctcatctcggatctggagcgtcgatgtcaggggtcaacaatggagctgctgcaggatgtgagtgatgtcacagaaaggagtgagttctggaccctgaggaagccagaagctctccctacaaagctgagaagtatgttccgagccccagatctgaaaaggatgctgcgagtgtgtagagagctgacagatgtccaaagctactgggttgacgtgaccctgaatccacacacagctaatttaaatcttgtcctggctaaaaaccggagacaagtgaggtttgtgggagctaaagtatctggaccttcctgtctggaaaagcattatgactgtagtgtcctgggctcccagcacttctcctctggtaagcattactgggaggtagatgtggccaagaagactgcctggatcctgggggtatgcagcaattcactgggacctacattctctttcaaccattttgctcaaaatcacagtgcttactccaggtatcagcctcagagtggatactgggtgattgggttacagcataaccatgaatatagggcctatgaggattcttccccttccctgcttctctccatgacagtgccccctcgccgtgttggggttttcttagattatgaggctggtactgtctccttttataatgtcacaaaccatggcttccccatctacactttctctaaatattactttcccactactctttgtccatattttaatccttgcaactgtgtaattcctatgaccctgcgtcgtccaagctcttgaata

SEQ ID NO: 32753 - DNA, 9753 bp, Homo sapiens
gacagatttcaatgtctgttgaaggcccccccacaccctccttcagtgccgggggcatggagggatatcttgggctcctgctgttttttaaaatgatgcgagctcatctcctgtcctgggtgtgaacgagtatatcttaccagggatgtaactgaacatttttttctgcattgtgttcctactgagcaacccaagatggccaggaactgctctgagtgcaaggagaagagggcagcacatatcctctgcacctactgcaatcgctggctgtgcagctcttgcacagaggaacaccgacacagccctgtccccgggggcccattctttcctcgggcccagaagggatctccaggagtgaatggtggtcccggagacttcaccttgtattgtcctctacacacacaggaagtactcaagctattctgtgagacatgtgatatgctcacttgccatagctgcctagtggtggaacacaaagaacacaggtgcagacatgttgaagaagttttgcaaaaccagaggatgcttctggaaggtgtgactacacaggtggcacataagaaatccagtctacagacatctgcaaagcaaattgaggacaggatttttgaagtgaagcatcagcataggaaggtggaaaaccagatcaaaatggccaagatggttctgatgaatgagctgaacaaacaggccaatgggctaatagaggaattagaggggattactaatgagagaaagcggaagctggaacagcagttacagagcatcatggttctcaaccgtcagtttgagcatgtgcagaatttcatcaactgggctgtctgcagcaaaaccagtgtcccttttcttttcagcaaagagctgattgtgtttcagatgcagcgattgctggagacaagttgtaacacagatcctggctccccttggagtatcagattcacctgggagcctaacttctggaccaagcagctagcttctcttggctgcataactactgaaggtggacaaatgtccagggcagatgctcctgcttatggaggcttacaggggtcatcacccttttatcaaagccaccagtctccagtggctcagcaagaggctcttagccacccctcacacaagttccagtctccagcagtgtgctcctcatctgtgtgctgctcccactgctccccagtctcgccttccctcaaaggccaggtccccccacccagcatacacccagcccacagcttcaggcagccccctgagatggtgccccagcagctggggtctctgcagtgctctgccctgctgcccagggagaaagagctggcctgcagccctcatccaccaaagctgctgcagccctggctggaaacccagccccccgtggagcaggagagcacatcccagcggctggggcagcagctgacttcccagcccgtgtgcattgtccccccacaggatgttcagcaaggagcccatgcccagcccaccttacagacaccctctatccaagtccagtttggccaccaccagaagctgaagctcagtcactttcagcagcagccacagcagcagctaccacctccaccaccacccctcccccatcccccacctccccttccccctcccccacagcagccacacccacctcttcctccatcccagcatctggcttctagtcagcacgagagccctcctggccctgcctgttctcagaacatggacataatgcatcacaagtttgagctggaggaaatgcagaaggacttggagcttcttctccaggctcaacagcccagcctgcaactgagtcagaccaaatctcctcagcatcttcagcaaaccattgtggggcagatcaactacatcgtgaggcagccagcacctgtccagtcccagagccaggaggagaccctgcaggctacagatgagcccccagcatctcagggctcaaagccggctctccctcttgacaagaatactgctgctgccttgccccaggcgtctggggaagaaacccctctcagtgtccccccagtggacagcaccatccagcactcctctccaaatgtggtgagaaagcactccacctcgctgagcatcatgggcttttccaacactctggagatggagttgtcatctaccaggttggagaggcccctagagccacagatccagagtgtgagcaacctgacagctggtgccccccaggcagtaccaagcctgctgagtgctccccccaaaatggtgtccagcctgacaagtgttcaaaaccaggccatgcccagcctgacaaccagtcacctacagactgtgcccagccttgtgcatagcacattccagtccatgcccaacctgataagtgactcccctcaggctatggcaagcctggcaagtgatcaccctcaggctgggcccagcctaatgtctggtcacacccaggctgtgccgagtctggcaacttgtcctctgcagagcatccctccagtttctgacatgcagccagaaactgggtccagctccagttctggccgaacttcagggagcctgtgtcccagagatggggctgatccctccctggagaatgctctgtgtaaggtaaaactggaggagccaattaacctctctgtgaagaaacctccactggcgccagtggtcagcacgtctacagctctgcagcagtaccagaacccaaaagagtgtgagaattttgaacaaggagccctagagctggatgcaaaagagaaccagagcatcagagccttcaatagtgagcataagattccctatgtgcgactggagcgactcaagatctgtgctgcctcctcaggagagatgcctgtgttcaaactgaagccacagaagaatgatcaggatgggagcttcctgctgatcatcgagtgtggcactgagtcctccagcatgtccattaaggtcagccaggacagactgtctgaggccacccaggccccaggtctggagggaagaaaggtcactgtcacttctttggctgggcagcggccaccagaagtggagggcacatctcctgaagaacacagactcattcctcgaaccccaggagccaagaagggccccccagccccaatagagaatgaggacttctgtgctgtttgcctcaatggcggagagttactgtgctgtgaccgctgccccaaagtgttccacctctcctgccatgtgccagccttgctcagcttcccagggggagagtgggtgtgtaccttgtgccgcagcctgacccagcccgagatggagtacgactgtgagaatgcctgctataaccagcctggaatgcgggcatctcctggcctaagcatgtatgaccagaagaagtgtgagaagctggtattgtccttgtgctgcaataacctcagcctgcccttccatgaacctgtcagccccctggcccggcattattaccagattatcaagaggcccatggacctgtcaatcatccggaggaagctgcaaaagaaggacccagctcactataccaccccagaggaggtggtatcagatgtgcgcctcatgttctggaactgtgctaagttcaattatcctgactccgaggttgcagaggctggccgctgcctggaagtgttctttgagggctggttgaaggagatctacccggagaaacggtttgcccagccaaggcaggaggactcagactccgaggaggtgtctagtgagagtggatgttccactccccagggcttcccgtggcctccctacatgcaggagggcatccaacccaagaggcggcgacgacatatggagaatgaaagagcaaaaagaatgtcatttcgcctggccaacagcatctctcaggtgtgagagccaaaaggagactgggcactctggcagctgttgtcccatactgtcgaccattcctccccatcttgcagcttatcctcttcagagtgtggatggtagatgagtcttgttgaactgtgtagtgctcttctttgccatttgcatctacagcatttatttgggagccgtagtacatccactacagagaagatttcagtaataaacaggaaagaggaaggtatttattattaccagagtaatcagatgtataggctccacttgacaagaccacacctggttaggctcgggaaaacctactttccttggtgaatttttttctgcctgggaaagcagacccgtctaaccttttagtgtccagggctcaggagccatgtatacatctgaactcctcctgggctcagaagtgggtaaaagaagggagagaggtttagacatatggcaggactgtgatccctggcccagcacagccaaagactgtcactgtttgcctttgcttgtcctgtctggatagaggcacctgccatgtgcagactagtggaggcttctagaggccataggtctcaatttgtgcctatttgggttctaacggttttcagggtatttgttttgcatagtcactttcctgatgttgacataggtggctgctgtgaaaatgctgtggatggtgtgacattcttgactgagctgggtggctgtggagagaccacttaaatcttctggttcagatttcacttacagacttagtaagatgtccacttcagagcccgccctctgtgctacttactctgggctaatcacacttctttagggtgagaacctgccttcctagaagtgactgttggtgcttgtcagtggccatacccttcatcatcctcattcagaggtatggatcgtgagttctgcttgtgaatactgtgagacagctgctgtctgcttcaggtccagagttccatgggtggagagagtaacccacaaccagctcactcctctgggcctctcctcctgcttaaagattctagttctcaacctctccaagttcatgagccaaagatcagaagtgagtcttctgaccagcccgcctccaggctgtctacagccccaaaaaagccaacacttttctggcagccctttttgttggaggttagagaaggcctcagggaccaacaggggccagatctagacattcctgggggaagtttgtctaaggtggacagggggaaaaatcaagaggcaaaaagccagtgtcctttggtgaccatgaagcaacctcagagccttagttctcctagaatgcagagagaagcattctggaagccatgggaacaggagctcgaggctgcatcctgaatgcatctgcatggccctcgcagggtgtttgtgaggatactggaggtcaggctacctcccaagcaagggcttggttgagaaggaacccattgctcatattgttgggggagctatgaacctgacatgtcagtggccaggactgagacagctctccctggtcctgtcattgcatggctaatttcaggggagtctgaggtcatggctttatttttgctaacagatgaagttcaaggatgttcttgtttgtagggcctttgctaatgagcagttttttaattagaaaacatttcttctctctttgtgagttgatggtattgctcatttccttctctacccaacctgagagatcatcttcactttaaagcaaaccatgccccttggcttgccattctttcagcagcacatgccacgttctaagcagatgggcttccgtgatcccgttttctagtttggggtaactgagtcttgaatgctttactagtccggcaatctttggacttaggcttctgccctttgagactcacatgactttctggtttggggtctggtcatttccctttcaatttttgaatctccttctctgttcagttggcttggcaaagtaccctctgttctcatgtcactaattcctgctctaggtcatctttcctttgtgcagcccacattcccaccatcctgtgaactttgttgtacttggtgttgggcaactggtgagtgttgtgacaggctcagacctgatccttcctcaggagcaattggagaccacaaatttaaagcagaaatacctgttaaaagcttggctttccttatatgagtgaggctcccagcttgggtgtggcctcctgggctcacggatcagcttgctgggccagagggggtcttagtaatgtgctagagagacacatgctcccttctcatcgtagagagcctgcatgctgagaggctccctttacacacctgcctctcgctggcttttcctttagacctagccaccagtgttttgaatcatggttttgttttgtttttgcatgcaaaaaccagaacatgacttagaaattaaaaaaaaaaaaatcctactagccaagtgactgcctgcagaggctcttcattaacatttgggctgatcctgcttttgacttattcccataatggcccagttttgaagtcagccaagtccttttgtccttgacaacatcatgcagtggaaatacggtgagttctagattcttatgggacagcatgcagccctagaggaaaaattgacttcttgggtatgctgagaaataagacagtaaaatggcttcagttgatgcaaggggattttagttaaaaattggttcaggatttttaaattttattttattttttggctgggcgcggtggctcacgcctgtaatcccagcactttgggaggctgaggtgggtggatcacctaaggacagcagttcgagaccagcctggccaacatagtgaaaccctgtctctactaaaaatacaaatatcagccaggtgtgatggcacatgcctgtaatcccagctacttgggaggctgaggcaggagaattgcttgaatccgggaggtggaggttgcagtgagctgagatcatgccattgcattccagcctgggcaacagaacgagactccgtctcaaaaaaaaaaaaattggttcaggatgaacttgcagagcactcttccacagaacatggttaggttagccctgcctgacttctagcaattgctaactatacaccttgcctgcctctaggacccctacctgagtggcaaccataccttccatatgctctgttccatggcagtccctgccatcccccaccagcggactctggctccctccctgtacccatttctagcaacagctccttgcctggctgctaagacggaggcgcctccttgtttgttcctgggctctgttctgctccctctctcactccatggagtcacttatagtcttcctttctgaacgccagaattgagcctttgctccttctggatcaccccttcctgggcttcttctccatccctcagtactgctaaaattgccctgctcctttagtccatttccatgacctcagccctctctctcctctccttgtcttttaactttctcctggacttcttcctctccccagcatgaacccagagcctatcacacactgatgtttttgtcagcatcctgaactttctcatgcccttcaactttatttatttatttatttatttattttttattttttgagagagagagtctcactctgtcatgcaggctggagtgcagtggtatgatgtcggctcattgcaacctctgccttctgggctcaggtgatcctcccatctcagcctcctgagtagctgggactacaggtgcatgccaccatgcctggctaatttttctactttaggtagagatggagtttcgccatgttgctcaagctggtatcaacactcctgggctcaagcagtctgcttcccttggcctcccaaagtgctgggattacaggcgtgagccactgcgccaggcgtatccccttcaattttgctgaaactatcagccattctccattttcggcatcatcatatttgctgcttccacctcctgggctgctatgcatgacagattcacagttggcagcctcagttgagctctcagtgttgactggaaattctttaacttgttgtgatccctttttttttccccacccatgcctccatctttgtcctccacaaatgactgagctcactgtctacttcacagaagacagcccctaaagcaagagcttccttgcctgctgttcctctctcccctctcattcatctgtgtctgtaactctccccaacccctccattcttgctcctatttaattctctatatcttgaatcctgttgtatgtcctccaagactgctccctcgcttactccactgctcccactccctggagtctccagcctctgtctccactggttacctccacacagcctgcaaacaagttctccacaagattaaaacagcatttctcagagtctgttaccccttacacattttccttgttaaccaagttacttttaaaaagatcctttttaaactgattcttcctcagctgttcttcagccctctatactttttcataaaagtcaccagtgactgcccagttgccaaatagaatgaatacctttcagtgctcagctgtcttgacctctccgcagcatttcacaccacccaccaaccctcagtgaaacaacctcctcccttagcttttatgacaccacaagtctctggattctcagagaatccagaaaaacaagtctctggattctctcctcttacctctcagcccacacaggctgagctgtccttgaaacctagatgggggaaatgtctgtggctgtctgtggtctcttcttttcaggagttgggtagggaggaagaatcacagctgctcctgcttcctctgtctgtctctctatttcctgagtcccttccttttcctgaactcagttctcctcatgccaaccatgtttatgagctcctgctgggaggacagcatctgtgagtccttccctctgtctctcccagacaacacagaggttttagcctgtttgctaagagaccccatctaagtcagcccaagggtgtggattaggttttacagcatccaggccgcagtctggctaaactggattaccaggctggtgggcagctcctcaccatgatcctgcaccagttagagcctgctgtagttgggaaggagcctgggattgtggtaagatgtgtttccgtgcatgtcagtgctgctaaccaggaggagaacctggcagggtgggtgcctgctgctgataacattcggatggagggagactagggagcgcggtggctgctcccttgctggggctcagctggagtcagcatgactccttatatcagggcctttcccacctgtgctgatcaccaccacctgcttgctccagttgtttctggagttggaggcagctattggttgctttcttggaggtaaggaggtatatactagaaagatatctgatttgagagtctgaacaccaaaatttttggctctttccattatgagctgtgtaaccttggatacagtttcctcatctataaagttgtggtgggagaatggctgagaacagtgatctctcagctctccagctgtaaagatgttaattatgattttaactctcaagatcaggccacataaggaacaggggaattccaggggtgggacacagctgggggagtccagaccagggcagggaaaggagactcacaagccaaacagagctgctttggggaaagttcttatcagctggtgctgcttcctgagccatatgcccattcctcaagctgtacccctttcttggctatgtaggatgagttcctcctaggcccttgttaggagtggctattggattctaagcggttggggcatgagggaggatattttaaagggaagtatagctgattttaaaagaacctatacattcaagaacaaataaaaaacagcacttttctttaccaagaa

SEQ ID NO: 32754 - DNA, 3352 bp, Homo sapiens
attggctgccgtcccgcgagcggggcctagagccgggtgtagtattctgggagctgcgggctactgggcctgcgctgccgggctttgggttctgggcctctgccgctctctggccctaagtgctgagctgccgggaacggcagcttctgacgctgggccattggacgctgcggaaccaggcttcttcactttgagtttccgccgcgaagcgccagtccgggccgaggagggagcctttactacttctccctggtttcattcatgttctgaggagggtgtgagaaggaaccatggatcccacagccttggtggaagccattgtggaagaagtggcctgtcccatctgtatgaccttcctgagggagcccatgagcattgactgtggccacagcttctgccacagctgtctctctggactctgggagatcccaggagaatcccagaactggggttacacctgtcccctctgtcgagctcctgtccagccaaggaacctgcggcctaattggcagctggccaatgttgtagaaaaagtccgtctgctaaggctacatccaggaatggggctgaagggtgacctgtgtgagcgccatggggaaaagctgaagatgttctgcaaagaggatgtcttgataatgtgtgaggcctgcagccagtccccagagcatgaggcccacagtgttgtgccaatggaggatgttgcctgggagtacaagtgggaacttcatgaggccctcgaacatctgaagaaagagcaagaagaggcctggaagcttgaagttggtgaaaggaaacgaactgccacctggaagatacaggtggaaacccgaaaacagagtattgtatgggagtttgaaaaataccagcgattactagagaaaaagcagccaccacatcggcagctgggggcagaggtagcagcagctctggccagcctacagcgggaggcagcggagaccatgcagaaactggagttgaaccatagcgagctcatccagcagagccaggtcctgtggaggatgattgcagagttgaaagagaggtcgcagaggcctgtccgctggatgttgcaggatattcaggaagtgttaaacaggagcaaatcttggagcttgcagcagccagaaccaatctccctggagttgaagacagattgccgtgtgctggggctaagagagatcctgaagacttatgcagctgatgtgcgcttggatccagatactgcttactcccgtctcatcgtgtctgaggacagaaaacgtgtgcactatggagacaccaaccagaaactgccagacaatcctgagagattttaccgctataatatcgtcctgggaagccagtgcatctcctcaggccggcactactgggaggtggaggtgggagacaggtctgagtggggcctgggagtatgtaagcaaaatgtagaccggaaggaggtggtctacttatccccccactatggattctgggtgataaggctgaggaagggaaatgagtaccgagcaggcaccgatgagtacccaatcctgtccttgccggtccctcctcgccgggtgggaatcttcgtggattatgaggcccatgacatttctttctacaatgtgactgactgtggctcccacatcttcactttcccccgctatcccttccctgggcgcctcctgccctattttagtccttgctacagcattggaaccaacaacactgctcctctggccatctgctccctggatggggaggactaagaaagctaccaccctaaccagagaggcttggaattgggcctggcccccatggggcttggaggaccgagccactgacaggtatcccctgaaactgagctgagcccagtatccaaggattcctctgtctgatcctttggtctttgctaccaggctgaagtctgtcatgaaaccacttattttaaaaagcagaggcccagtcaaatgagcattgcatcccatgagggaagcacgacagggctgatggtgaggatcagagcagttctaaggtgactcgttggggtaaggatcaggactttgtccatgtagtagccaaccaccctcttccctgattcccgtccggtgtcacagttcagtcagtgaggatgatgaagtagatacagtcttcaggacaccattagatgggctttcccaataggccaaaaaaatgctgcgcatacccagagctggttgttgtgctgaggccagtcagaggatgcttcccctgaggtttgctataactaagcaacctttatgtgactctcaccttctgacctcctggcaagagaaattcagtgcagcagggggacacagacctgcccaagccaccccactgccgttccctctctgagcacaagctgggcaaatcactgtcccttggactccaggagaccagtgtcctagtcttgccttttttctctaagtggcaggatcagaaaacctgcgagctttagtttgtattttcactttatgaatgaggaaactgaaatggccttaagggagcaagttatttctttttttttgacacggagtctcactctgttgcccaggctggagtgcagtggcacgatctcggctcactgcaggctctgcctcctgggttcacgccattctcctgcctcagcttcccgagtagctgggactacaggcgcccaccacgacgcctggctcatttttttgtatttttagtagagacggagtttcaccatgttagctaggatggtctcgatctcctgacctcatgatccgccctcctcagcctcccacagtgctgggattagaggcatgagccactgcgcccggcccctggagcaagttatttcttacaaagctgctgaaggtaagattatcaaaattataaagcatttttcacactcaagtgaaacaaggttgacaaactcacttcgcaggtcacatgcctatacatcacttattatatttgggtctgaaacttctcacatgtttgggaggttttatgtgtcctcattgggaaaatgggtgtaattcagcataaaacctcatatgattgtcctgcctcatggagctgttgtatagatcccagatccatcccatgatttgttcctgtctgaggcatagaggcaggcaagccgtggattttgcacatggtgactttcccactgtgccatgatacagtctgcatcttatagcagtgcctttgtctcagggcctctgctggcagtctagaccttttgggcagaaaggagcttcaaatggctgtgataaggaatattaaaaattgtgtttctactttaattgtattggctgttcatgtatgtaggagttaaaataggccaaactggagaaataaacgcattctgtccaccatg

SEQ ID NO: 32755 - DNA, 1269 bp, Homo sapiens
aagtgctgagctgccgggaacggcagcttctgacgctgggccattggacgctgcggaaccaggcttcttcactttgagtttccgccgcgaagcgccagtccgggccgaggagggagtgggaacttcatgaggccctcgaacatctgaagaaagagcaagaagaggcctggaagcttgaagttggtgaaaggaaacgaactgccacctggaagatacaggtggaaacccgaaaacagagtattgtatgggagtttgaaaaataccagcgattactagagaaaaagcagccaccacatcggcagctgggggcagaggtagcagcagctctggccagcctacagcgggaggcagcggagaccatgcagaaactggagttgaagacagattgccgtgtgctggggctaagagagatcctgaagacttatgcagctgatgtgcgcttggatccagatactgcttactcccgtctcatcgtgtctgaggacagaaaacgtgtgcactatggagacaccaaccagaaactgccagacaatcctgagagattttaccgctataatatcgtcctgggaagccagtgcatctcctcaggccggcactactgggaggtggaggtgggagacaggtctgagtggggcctgggagtatgtaagcaaaatgtagaccggaaggaggtggtctacttatccccccactatggattctgggtgataaggctgaggaagggaaatgagtaccgagcaggcaccgatgagtacccaatcctgtccttgccggtccctcctcgccgggtgggaatcttcgtggattatgaggcccatgacatttctttctacaatgtgactgactgtggctcccacatcttcactttcccccgctatcccttccctgggcgcctcctgccctattttagtccttgctacagcattggaaccaacaacactgctcctctggccatctgctccctggatggggaggactaagaaagctaccaccctaaccagagaggcttggaattgggcctggcccccatggggcttggaggaccgagccactgacaggtatcccctgaaactgagctgagcccagtatccaaggattcctctgtctgatcctttggtctttgctaccaggctgaagtctgtcatgaaaccacttattttaaaaagcagaggcccagtcaaatgagcattgcatcccatgagggaagcacgacagggctgatggtgaggatcagagcagttctaaggtgactcgttggggtaaggatca

SEQ ID NO: 32756 - DNA, 2840 bp, Homo sapiens
gcgtcctgtgaggtccagtggccgcccaggcgcgaccagatctgggtgcgcggagagcgcgcatggcggctgtgggaccgcggaccggccccggaaccggcgccgaggctctagcgctggcggcagagctgcagggcgaggcgacgtgctccatctgcctagagctctttcgtgagccggtgtccgtcgagtgcggccacagcttctgccgcgcctgcatagggcgctgctgggagcgcccgggcgcggggtctgttggggccgccacccgcgcgccccccttcccactgccctgtccgcagtgccgcgagcccgcgcgccccagtcagctgcggcccaaccggcagctggcggcagtggccacgctcctgcggcgcttcagcctgcccgcggctgccccgggagagcacgggtctcaggcggccgcggcccgggcagcggctgcccgctgcgggcagcatggcgaacccttcaagctctactgccaggacgacggacgcgccatctgcgtggtgtgcgaccgcgcccgcgagcaccgcgagcacgccgtgctgccgctggacgaggcggtgcaggaggccaaggagctcttggagtccaggctgagggtcttgaagaaggaactggaggactgtgaggtgttccggtccacggaaaagaaggagagcaaggagctgctgaaacagatggcagcggagcaggagaaggtgggggcagagttccaggcactgagggctttcctggtggagcaggagggtcggctgctaggccgcctggaggaactgtcccgggaggtggcacagaagcagaatgagaacctggcccagctcggggttgagatcacccagctgtccaagctcagcagccagatccaggagacagctcaaaagcctgaccttgactttctccaggaattcaaaagcacgctgagcaggtgtagcaatgtgcctggccccaagccaaccacagtctcttctgagatgaagaataaagtctggaatgtttctctcaagacctttgtcttaaaagggatgctgaagaagttcaaagaggaccttcggggagagctggagaaagaggagaaagtggagctcaccttggatcccgacacggccaacccgcgcctcatcctctctctggatcttaagggcgtgcgcctcggcgagcgggcccaggacctgcccaaccacccctgccgcttcgacaccaacacccgcgtcctggcgtcctgcggcttctcctcgggccggcatcactgggaggtggaggtgggctctaaggacggctgggcctttggcgtggcccgcgagagcgtgcgccgaaagggcctgacgcccttcactcccgaggagggcgtctgggccctgcagctcaacggcggccagtactgggccgtgaccagccccgagcggtcgcccctcagctgcgggcacctgtcgcgcgtgcgggtggccctggacctggaggtgggagccgtgtccttctacgctgtggaggacatgcgccacctctacaccttccgcgtcaacttccaggagcgcgtgttcccgcttttctctgtttgctccacgggcacctacttgcgaatctggccttgaggggcactgctggggagctcctgtctctgggctgccggtgggaggggatgtcgcctccccagagatgcctggtccgtcttgggtctgccctccgtgctcctgacccctgctgcccaagagagcctgctacagacacaaccccgaggcaggagagtgactgtggccaaccgagcaggggaacaggggctttggactcctgagggtgttcccttcctgaggtcacatgtggatttggccagagccttcaggaggtggaggccggtgaggtcaggagcccagctctccagggggcttctgccctgactgggaagggtgcctggctccctaaaacaatgtcaaagccagtcctgctgttctctgttgccagggggcaggtctgggcctgggccaaccacgtttgttatcatggctgctgccttctggacagctgccagctctgccttgagaggttgtgggacctctggatccagctgacctgacaggtcatctactcagggaggagccctgtgctcccagctcagaggacagtctgggccagaactggaaggagacatctgtcccgtctttgagtgacaagcccgggacaacagccagtgggcatcacggctctccagcactccttagccggaggatacagagtgatgggtgcatcctgaccaatgcgacaaccaacacgtgctctcacaaacccctgactcccgcactttccagtgccaaagtacaaacgctgcttggataaggagagcaaagcttctggaactttatttactctttctttttaattttcttttaagagactgggtcttgctatgttgcccaggctggtcttgaactcctggcctcaagtgatcctccagtttccatctccctaagagctgggattacaggtgtgagccgctgtacccgaactttttttgtttttgcttctggaactttgaaacacaaaacacaagttggcacttacaattttaaagatgcagccagctctaaacaacacacagagcacaaatatgctcctgacggactcaggaaaatgccaacagcagagcaccctggtgccaaggccttctcagcccatgccctggagggcattcccctggccagcctcagccccttgtctacttgttctccagcttctgggtagctgggcttctggaagggtggcagtgggctactccctgctcagcgctcccctgggaagggggtgaggagatgaaaatgaaactatgagctgtctttgga

SEQ ID NO: 32757 - DNA, 1228 bp, Homo sapiens
ccgtagtcaacgtgcgcctcccctcccggctcccagccgggcgcgccccgggctcgagtctctgcctgcccagtggcagccccgcccttcctctcccagtgggccctcggcgcccagctccgcgtcctgtgaggtccagtggccgcccaggcgcgaccagatctgggtgcgcggagagcgcgcatggcggctgtgggaccgcggaccggccccggaaccggcgccgaggctctagcgctggcggcagagctgcagggcgaggcgacgtgctccatctgcctagagctctttcgtgagccggtgtccgtcgagtgcggccacagcttctgccgcgcctgcatagggcgctgctgggagcgcccgggcgcggggtctgttggggccgccacccgcgcgccccccttcccactgccctgtccgcagtgccgcgagcccgcgcgccccagtcagctgcggcccaaccggcagctggcggcagtggccacgctcctgcggcgcttcagcctgcccgcggctgccccgggagagcacgggtctcaggcggccgcggcccgggcagcggctgcccgctgcgggcagcatggcgaacccttcaagctctactgccaggacgacggacgcgccatctgcgtggtgtgcgaccgcgcccgcgagcaccgcgagcacgccgtgctgccgctggacgaggcggtgcaggaggccaaggagctcttggagtccaggctgagggtcttgaagaaggaactggaggactgtgaggtgttccggtccacggaaaagaaggagagcaaggagctgctggtgagccaggcacccgcaggccccccgtgggacattacagaggcctgagaactcagcaccagggctcggtgtgtgtggtgttggagtgtgtgctatggaaccgcagaatcgatttcagaaagataatagagtccatattatatagggtgtccacataattgttgtacaaaccagagctttttaaagtgaaaagcagtgctaaaataattattgcaaaacaactggcttaaactggagctgtcccagcgaatcaggacgctcagtcactctgatattacgtaacataccagttagggcctgcggaagcatcttgtaatggaacacattactatttctgcagagaaacatggatattcaataagtgggaatattaatacaataaagagcctcatggcatgttttgtcaacaaaacagtagtgaaaaaaa

SEQ ID NO: 32758 - DNA, 2574 bp, Homo sapiens
tgcgcgacgtcccccacggacttggcgatgttcttcctgtctgttcggagcctctagcctggtctgcgtctccgcagctctctgcccgcgggaagtctccggcacagccacgcagccgctgcccccactcttatctctttccccgaagcgggctctgctcaaagtccccacctcgtggaactgagtgagaggacctcgccaagatgtccagggagggggctcccgggttaagccgcgcacctagagccgtctgactgtgccaacgctgtcgattctgggggccctttctttgctattttctcgctgagcctcagcgagggagctcttggagtccaggctgagggtcttgaagaaggaactggaggactgtgaggtgttccggtccacggaaaagaaggagagcaaggagctgctgaaacagatggcagcggagcaggagaaggtgggggcagagttccaggcactgagggctttcctggtggagcaggagggtcggctgctaggccgcctggaggaactgtcccgggaggtggcacagaagcagaatgagaacctggcccagctcggggttgagatcacccagctgtccaagctcagcagccagatccaggagacagctcaaaagcctgaccttgactttctccaggaattcaaaagcacgctgagcaggtgtagcaatgtgcctggccccaagccaaccacagtctcttctgagatgaagaataaagtctggaatgtttctctcaagacctttgtcttaaaagggatgctgaagaagttcaaagaggaccttcggggagagctggagaaagaggagaaagtggagctcaccttggatcccgacacggccaacccgcgcctcatcctctctctggatcttaagggcgtgcgcctcggcgagcgggcccaggacctgcccaaccacccctgccgcttcgacaccaacacccgcgtcctggcgtcctgcggcttctcctcgggccggcatcactgggaggtggaggtgggctctaaggacggctgggcctttggcgtggcccgcgagagcgtgcgccgaaagggcctgacgcccttcactcccgaggagggcgtctgggccctgcagctcaacggcggccagtactgggccgtgaccagccccgagcggtcgcccctcagctgcgggcacctgtcgcgcgtgcgggtggccctggacctggaggtgggagccgtgtccttctacgctgtggaggacatgcgccacctctacaccttccgcgtcaacttccaggagcgcgtgttcccgcttttctctgtttgctccacgggcacctacttgcgaatctggccttgaggggcactgctggggagctcctgtctctgggctgccggtgggaggggatgtcgcctccccagagatgcctggtccgtcttgggtctgccctccgtgctcctgacccctgctgcccaagagagcctgctacagacacaaccccgaggcaggagagtgactgtggccaaccgagcaggggaacaggggctttggactcctgagggtgttcccttcctgaggtcacatgtggatttggccagagccttcaggaggtggaggccggtgaggtcaggagcccagctctccagggggcttctgccctgactgggaagggtgcctggctccctaaaacaatgtcaaagccagtcctgctgttctctgttgccagggggcaggtctgggcctgggccaaccacgtttgttatcatggctgctgccttctggacagctgccagctctgccttgagaggttgtgggacctctggatccagctgacctgacaggtcatctactcagggaggagccctgtgctcccagctcagaggacagtctgggccagaactggaaggagacatctgtcccgtctttgagtgacaagcccgggacaacagccagtgggcatcacggctctccagcactccttagccggaggatacagagtgatgggtgcatcctgaccaatgcgacaaccaacacgtgctctcacaaacccctgactcccgcactttccagtgccaaagtacaaacgctgcttggataaggagagcaaagcttctggaactttatttactctttctttttaattttcttttaagagactgggtcttgctatgttgcccaggctggtcttgaactcctggcctcaagtgatcctccagtttccatctccctaagagctgggattacaggtgtgagccgctgtacccgaactttttttgtttttgcttctggaactttgaaacacaaaacacaagttggcacttacaattttaaagatgcagccagctctaaacaacacacagagcacaaatatgctcctgacggactcaggaaaatgccaacagcagagcaccctggtgccaaggccttctcagcccatgccctggagggcattcccctggccagcctcagccccttgtctacttgttctccagcttctgggtagctgggcttctggaagggtggcagtgggctactccctgctcagcgctcccctgggaagggggtgaggagatgaaaatgaaactatgagctgtctttgg

SEQ ID NO: 32759 - DNA, 2851 bp, Homo sapiens
tgcgcgacgtcccccacggacttggcgatgttcttcctgtctgttcggagcctctagcctggtctgcgtctccgcagctctctgcccgcgggaagtctccggcacagccacgcagccgctgcccccactcttatctctttccccgaagcgggctctgctcaaagtccccacctcgtggaactgagtgagaggacctcgccaagatgtccagggagggggctcccgggttaagccgcgcacctagagccgtctgactgtgccaacgctgtcgattctgggggccctttctttgctattttctcgctgagcctcagcgagggtgtgtgcaggggtgagggcggggcggggaggctcgggcggcagtccccagtctctccttgctggcccatcctgctccaactctcccagccacggggcttcctggtgggggggcggagagtagaggagacgactaggggtagggctgccggagcttgtgtttcagtctggctggtccagcagatgcttttggggaagcaagatcccgagaccttcagagtcacctcgcagtgtaacctgtagcctgtagagatgacttctacccggcctccccctcagagctcttggagtccaggctgagggtcttgaagaaggaactggaggactgtgaggtgttccggtccacggaaaagaaggagagcaaggagctgctgaaacagatggcagcggagcaggagaaggtgggggcagagttccaggcactgagggctttcctggtggagcaggagggtcggctgctaggccgcctggaggaactgtcccgggaggtggcacagaagcagaatgagaacctggcccagctcggggttgagatcacccagctgtccaagctcagcagccagatccaggagacagctcaaaagcctgaccttgactttctccaggaattcaaaagcacgctgagcaggtgtagcaatgtgcctggccccaagccaaccacagtctcttctgagatgaagaataaagtctggaatgtttctctcaagacctttgtcttaaaagggatgctgaagaagttcaaagaggaccttcggggagagctggagaaagaggagaaagtggagctcaccttggatcccgacacggccaacccgcgcctcatcctctctctggatcttaagggcgtgcgcctcggcgagcgggcccaggacctgcccaaccacccctgccgcttcgacaccaacacccgcgtcctggcgtcctgcggcttctcctcgggccggcatcactgggaggtggaggtgggctctaaggacggctgggcctttggcgtggcccgcgagagcgtgcgccgaaagggcctgacgcccttcactcccgaggagggcgtctgggccctgcagctcaacggcggccagtactgggccgtgaccagccccgagcggtcgcccctcagctgcgggcacctgtcgcgcgtgcgggtggccctggacctggaggtgggagccgtgtccttctacgctgtggaggacatgcgccacctctacaccttccgcgtcaacttccaggagcgcgtgttcccgcttttctctgtttgctccacgggcacctacttgcgaatctggccttgaggggcactgctggggagctcctgtctctgggctgccggtgggaggggatgtcgcctccccagagatgcctggtccgtcttgggtctgccctccgtgctcctgacccctgctgcccaagagagcctgctacagacacaaccccgaggcaggagagtgactgtggccaaccgagcaggggaacaggggctttggactcctgagggtgttcccttcctgaggtcacatgtggatttggccagagccttcaggaggtggaggccggtgaggtcaggagcccagctctccagggggcttctgccctgactgggaagggtgcctggctccctaaaacaatgtcaaagccagtcctgctgttctctgttgccagggggcaggtctgggcctgggccaaccacgtttgttatcatggctgctgccttctggacagctgccagctctgccttgagaggttgtgggacctctggatccagctgacctgacaggtcatctactcagggaggagccctgtgctcccagctcagaggacagtctgggccagaactggaaggagacatctgtcccgtctttgagtgacaagcccgggacaacagccagtgggcatcacggctctccagcactccttagccggaggatacagagtgatgggtgcatcctgaccaatgcgacaaccaacacgtgctctcacaaacccctgactcccgcactttccagtgccaaagtacaaacgctgcttggataaggagagcaaagcttctggaactttatttactctttctttttaattttcttttaagagactgggtcttgctatgttgcccaggctggtcttgaactcctggcctcaagtgatcctccagtttccatctccctaagagctgggattacaggtgtgagccgctgtacccgaactttttttgtttttgcttctggaactttgaaacacaaaacacaagttggcacttacaattttaaagatgcagccagctctaaacaacacacagagcacaaatatgctcctgacggactcaggaaaatgccaacagcagagcaccctggtgccaaggccttctcagcccatgccctggagggcattcccctggccagcctcagccccttgtctacttgttctccagcttctgggtagctgggcttctggaagggtggcagtgggctactccctgctcagcgctcccctgggaagggggtgaggagatgaaaatgaaactatgagctgtctttgg

SEQ ID NO: 32760 - DNA, 2320 bp, Homo sapiens
ctgcagcctgcctggaagctgaaggaaaggtgggggcattgtaggacaccttgaacccaggtctcccaacttcacaggactcccttcctccgcccaggagttttaaggaagaggaacttcctggtgggacatattgagtgccaaacgtgtgttcacataaaaaatcaagagatcagggcatgagtctgcatctgaaaactcgagtaaaaaatccggtgtatgctgttaatggaaagaacagaatatgacacttgcatgccgcatattctcacttcgttccttgggggtgtgctgctacctctggtcactggcatcggacttttcttccttctttctactttcctacatctcccaagttttgtattttgagcatgtgttagcattataactgctaaacaggaaagatggcctttaaaaagaaagtgaagtgtaaaagtttgagggtgatgaaataaatgtgcttgaggaagaaaaagcaatctcagtttaatcctatggttgccccaggaggcactaatttatcccttctgcttttcaagtgaggaagctgcagcttggcgtagttctggggggagtatgaagctgccttggtttaggtgatggagcacaggtccacagacatgtgtgggtgcatctgtggcaggggagaaaagagcatgtgtccagactacagcttgttcagagctgggacactgacaatagagcacgcactgcgtgcgtaggtgggtgtgtctccgatcctccagcagtgacagggacgaagccttgccctgtgggatgactcaggccactggccaaatgttatgtctccatgttcaagtccctctccaacttctcctcctgggacagaaacagatggcagcggagcaggagaaggtgggggcagagttccaggcactgagggctttcctggtggagcaggagggtcggctgctaggccgcctggaggaactgtcccgggaggtggcacagaagcagaatgagaacctggcccagctcggggttgagatcacccagctgtccaagctcagcagccagatccaggagacagctcaaaagcctgaccttgactttctccaggaattcaaaagcacgctgagcaggtgtagcaatgtgcctggccccaagccaaccacagtctcttctgagatgaagaataaagtctggaatgtttctctcaagacctttgtcttaaaagggatgctgaagaagttcaaagaggaccttcggggagagctggagaaagaggagaaagtggagctcaccttggatcccgacacggccaacccgcgcctcatcctctctctggatcttaagggcgtgcgcctcggcgagcgggcccaggacctgcccaaccacccctgccgcttcgacaccaacacccgcgtcctggcgtcctgcggcttctcctcgggccggcatcactgggaggtggaggtgggctctaaggacggctgggcctttggcgtggcccgcgagagcgtgcgccgaaagggcctgacgcccttcactcccgaggagggcgtctgggccctgcagctcaacggcggccagtactgggccgtgaccagccccgagcggtcgcccctcagctgcgggcacctgtcgcgcgtgcgggtggccctggacctggaggtgggagccgtgtccttctacgctgtggaggacatgcgccacctctacaccttccgcgtcaacttccaggagcgcgtgttcccgcttttctctgtttgctccacgggcacctacttgcgaatctggccttgaggggcactgctggggagctcctgtctctgggctgccggtgggaggggatgtcgcctccccagagatgcctggtccgtcttgggtctgccctccgtgctcctgacccctgctgcccaagagagcctgctacagacacaaccccgaggcaggagagtgactgtggccaaccgagcaggggaacaggggctttggactcctgagggtgttcccttcctgaggtcacatgtggatttggccagagccttcaggaggtggaggccggtgaggtcaggagcccagctctccagggggcttctgccctgactgggaagggtgcctggctccctaaaacaatgtcaaagccagtcctgctgttctctgttgccagggggcaggtctgggcctgggccaaccacgtttgttatcatggctgctgccttctggacagctgccagctctgccttgagaggttgtgggacctctggatccagctgacctgacaggtcatctactcagggaggagccctgtgctcccagctcagaggacagtctgggccagaactggaaggagaca

SEQ ID NO: 32761 - DNA, 1954 bp, Homo sapiens
tgcgcgacgtcccccacggacttggcgatgttcttcctgtctgttcggagcctctagcctggtctgcgtctccgcagctctctgcccgcgggaagtctccggcacagccacgcagccgctgcccccactcttatctctttccccgaagcgggctctgctcaaagtccccacctcgtggaactgagtgagaggacctcgccaagatgtccagggagggggctcccgggttaagccgcgcacctagagccgtctgactgtgccaacgctgtcgattctgggggccctttctttgctattttctcgctgagcctcagcgagggagctcttggagtccaggctgagggtcttgaagaaggaactggaggactgtgaggtgttccggtccacggaaaagaaggagagcaaggagctgctggtgagccaggcacccgcaggccccccgtgggacattacagaggcctgagaactcagcaccagggctcgaaacagatggcagcggagcaggagaaggtgggggcagagttccaggcactgagggctttcctggtggagcaggagggtcggctgctaggccgcctggaggaactgtcccgggaggtggcacagaagcagaatgagaacctggcccagctcggggttgagatcacccagctgtccaagctcagcagccagatccaggagacagctcaaaagcctgaccttgactttctccaggaattcaaaagcacgctgagcaggtgtagcaatgtgcctggccccaagccaaccacagtctcttctgagatgaagaataaagtctggaatgtttctctcaagacctttgtcttaaaagggatgctgaagaagttcaaagaggaccttcggggagagctggagaaagaggagaaagtggagctcaccttggatcccgacacggccaacccgcgcctcatcctctctctggatcttaagggcgtgcgcctcggcgagcgggcccaggacctgcccaaccacccctgccgcttcgacaccaacacccgcgtcctggcgtcctgcggcttctcctcgggccggcatcactgggaggtggaggtgggctctaaggacggctgggcctttggcgtggcccgcgagagcgtgcgccgaaagggcctgacgcccttcactcccgaggagggcgtctgggccctgcagctcaacggcggccagtactgggccgtgaccagccccgagcggtcgcccctcagctgcgggcacctgtcgcgcgtgcgggtggccctggacctggaggtgggagccgtgtccttctacgctgtggaggacatgcgccacctctacaccttccgcgtcaacttccaggagcgcgtgttcccgcttttctctgtttgctccacgggcacctacttgcgaatctggccttgaggggcactgctggggagctcctgtctctgggctgccggtgggaggggatgtcgcctccccagagatgcctggtccgtcttgggtctgccctccgtgctcctgacccctgctgcccaagagagcctgctacagacacaaccccgaggcaggagagtgactgtggccaaccgagcaggggaacaggggctttggactcctgagggtgttcccttcctgaggtcacatgtggatttggccagagccttcaggaggtggaggccggtgaggtcaggagcccagctctccagggggcttctgccctgactgggaagggtgcctggctccctaaaacaatgtcaaagccagtcctgctgttctctgttgccagggggcaggtctgggcctgggccaaccacgtttgttatcatggctgctgccttctggacagctgccagctctgccttgagaggttgtgggacctctggatccagctgacctgacaggtcatctactcagggaggagccctgtgctcccagctcagaggacagtctgggccagaactggaaggagaca

SEQ ID NO: 32762 - DNA, 2152 bp, Homo sapiens
ttttagaacggtttccggaagtgatgggagggattgggcagggcagctaaatatagtcctggggccatggctcagtctgggagggtcttccgctgagcactgtgtgcccatcacgcgtggtgtccactgccagctgcccctgtgagtccctgtccttgcttggagcctgctgcttgtctcagatccttggacccagccctgaccccagtccagctaagctcaaccctgaccggtcctccttcgagactctttcagcctaagatctccaaccagacctgcccgccatgtcggctgcgcccggcctcctgcaccaggagctgtcctgcccgctgtgcctgcagctgttcgacgcgcccgtgacagccgagtgcggccacagtttctgccgcgcctgcctaggccgcgtggccggggagccggcggcggatggcaccgttctctgcccctgctgccaggcccccacgcggccgcaggcactcagcaccaacctgcagctggcgcgcctggtggaggggctggcccaggtgccgcagggccactgcgaggagcacctggacccgctgagcatctactgcgagcaggaccgcgcgctggtgtgcggagtgtgcgcctcactcggctcgcaccgcggtcatcgcctcctgcctgccgccgaggcccacgcacgcctcaagacacagctgccacagcagaaactgcagctgcaggaggcatgcatgcgcaaggagaagagtgtggctgtgctggagcatcagctggtggaggtggaggagacagtgcgtcagttccggggggccgtgggggagcagctgggcaagatgcgggtgttcctggctgcactggagggctccttggaccgcgaggcagagcgtgtacggggtgaggcaggggtcgccttgcgccgggagctggggagcctgaactcttacctggagcagctgcggcagatggagaaggtcctggaggaggtggcggacaagccgcagactgagttcctcatgaaatactgcctggtgaccagcaggctgcagaagatcctggcagagtctcccccacccgcccgtctggacatccagctgccaattatctcagatgacttcaaattccaggtgtggaggaagatgttccgggctctgatgccagcgctggaggagctgacctttgacccgagctctgcgcacccgagcctggtggtgtcttcctctggccgccgcgtggagtgctcggagcagaaggcgccgccggccggggaggacccgcgccagttcgacaaggcggtggcggtggtggcgcaccagcagctctccgagggcgagcactactgggaggtggatgttggcgacaagccgcgctgggcgctgggcgtgatcgcggccgaggccccccgccgcgggcgcctgcacgcggtgccctcgcagggcctgtggctgctggggctgcgcgagggcaagatcctggaggcacacgtggaggccaaggagccgcgcgctctgcgcagccccgagaggcggcccacgcgcattggcctttacctgagcttcggcgacggcgtcctctccttctacgatgccagcgacgccgacgcgctcgtgccgctttttgccttccacgagcgcctgcccaggcccgtgtaccccttcttcgacgtgtgctggcacgacaagggcaagaatgcccagccgctgctgctcgtgggtcccgaaggcgccgaggcctgagccgccggacgggtagtggaggggcgcgggggcctgggttgaagcttaggtctccttggtcgggtctgacgggagaagggtggggagcgggttgccagggcccagggggctgggaactgggggatctcccagaatactgacaagcgtggggtaggactggcttggtggctcatgcctgtaatcccagcactttgggagacggaggcgggtggatcacctgaggtcaggagttcaagaccagcctggccaacatggtgaaactcctctctactgaaaatacaaaaatgagctgggcgcggtggcatacgcctgtaatcccagctagttgggaggctgaggcaggataattgcttgaacccaggaggtggaggttgcagtgagcagacattgcggcactgcactctagcctgggtgacaagagtgagactctgtct

SEQ ID NO: 32763 - DNA, 1350 bp, Homo sapiens
gagcatgatggggcatgtgcgggagcgccaggcggggcatgtaaccagagcgtgcggggcatgatggggcacggacatggggggttaggtggggcacgtaattggagctcgcggggcaggatggggcatctaactggagcgacagagagcacgatggggcacttacaggggccggaggctggcccgggcagtgagtgtggatggcttggcaggtgagcctgctggagctggaggaccggcttcagtgtcccatctgcctggaggtcttcaaggagtccctaatgctacagtgcggccactcctactgcaagggctgcctggtttccctgtcctaccacctggacaccaaggtgcgctgccccatgtgctggcaggtggtggacggcagcagctccttgcccaacgtctccctggcctgggtgatcgaagccctgaggctccctggggacccagagcccaaggtctgcgtgcaccaccggaacccgctcagccttttctgcgagaaggaccaggagctcatctgtggcctctgcggtctgctgggctcccaccaacaccacccggtcacgcccgtctccaccgtctgcagccgcatgaaggaggagctcgcagccctcttctctgagctgaagcaggagcagaagaaggtggatgagctcatcgccaaactggtgaaaaaccggacccgaatcgtcaatgagtcggatgtcttcagctgggtgatccgccgcgagttccaggagctgcgccacccggtggacgaggagaaggcccgctgcctggaggggatagggggtcacacccgtggcctggtggcctccctggacatgcagctggagcaggcccagggaacccgggagcggctggcccaagccgagtgtgtgctggaacagttcggcaatgaggaccaccatgagttcatctggaagttccactccatggcctccaggtaataaccttggagagagctcagccagggtctggtggctgcgggcacgggcatctcagctccactggttcctccattcagcttaaccagcgcctcccaagcagctgcctatagctggctctataactgagcctggggaagatagaggaaagtcacatccctgccttcaagggtctcgcagacaggtggggaggcagatggtgaactgtgggtacctagaacagcagaagttcactcaagctacagaaatactagaggagggtagctcatgcctgcaatcccagtactttgggaggccaaggcaggagtattgctggaggccgggagttcgagaccagcctggccaatgtagtaacacccccgtctctacaaaaaatacaaaaataaaaaaattagttggg

SEQ ID NO: 32764 - DNA, 1321 bp, Homo sapiens
atctaactggagcgacagagagcacgatggggcacttacaggggccggaggctggcccgggcagtgagtgtggatggcttggcaggtgagcctgctggagctggaggaccggcttcagtgtcccatctgcctggaggtcttcaaggagtccctaatgctacagtgcggccactcctactgcaagggctgcctggtttccctgtcctaccacctggacaccaaggtgcgctgccccatgtgctggcaggtggtggacggcagcagctccttgcccaacgtctccctggcctgggtgatcgaagccctgaggctccctggggacccagagcccaaggtctgcgtgcaccaccggaacccgctcagccttttctgcgagaaggaccaggagctcatctgtggcctctgcggtctgctgggctcccaccaacaccacccggtcacgcccgtctccaccgtctgcagccgcatgaaggaggagctcgcagccctcttctctgagctgaagcaggagcagaagaaggtggatgagctcatcgccaaactggtgaaaaaccggacccgaatcgtcaatgagtcggatgtcttcagctgggtgatccgccgcgagttccaggagctgcgccacccggtggacgaggagaaggcccgctgcctggaggggatagggggtcacacccgtggcctggtggcctccctggacatgcagctggagcaggcccagggaacccgggagcggctggcccaagccgagtgtgtgctggaacagttcggcaatgaggaccaccatgagttcatctggaagttccactccatggcctccagattgacaaagactgaagaactggagaagaagtggcgaaacgggctcgcagcgtcgcattccctaccccagcaggtgcgcccgcagcgtcgcactccctagcccggcagaacgtgaagcagctgtacgcgctggtgtgcgaaacgcagcgctactccgccgtgctggatgccgtgatctccagcgccggcctcctcagtgcgaagaagctgcagccgcacctggccaagggtaggggcggggcggggaagtgaaccccgacggtcagcgctttgtcatctggtttcagccccgctgccgtgcacggcgggactggagcaagtcgctcacctgaaatgagtatgagcagaccttccctgggttacgaattgagatgggatgaaaatgctttaacttcgagtgttttgaaggattaaataaccgaagtacaaagtagtagtagcggagacagtaaggaagtcgggcgtggcggcgcgcacctgtggtcccagctactcggaa

SEQ ID NO: 32765 - DNA, 1169 bp, Homo sapiens
gcccgggcagtgagtgtggatggcttggcaggtgagcctgctggagctggaggaccggcttcagtgtcccatctgcctggaggtcttcaaggagtccctaatgctacagtgcggccactcctactgcaagggctgcctggtttccctgtcctaccacctggacaccaaggtgcgctgccccatgtgctggcaggtggtggacggcagcagctccttgcccaacgtctccctggcctgggtgatcgaagccctgaggctccctggggacccagagcccaaggtctgcgtgcaccaccggaacccgctcagccttttctgcgagaaggaccaggagctcatctgtggcctctgcggtctgctgggctcccaccaacaccacccggtcacgcccgtctccaccgtctgcagccgcatgaaggaggagctcgcagccctcttctctgagctgaagcaggagcagaagaaggtggatgagctcatcgccaaactggtgaaaaaccggacccgaatcgtcaatgagtcggatgtcttcagctgggtgatccgccgcgagttccaggagctgcgccacccggtggacgaggagaaggcccgctgcctggaggggatagggggtcacacccgtggcctggtggcctccctggacatgcagctggagcaggcccagggaacccgggagcggctggcccaagccgagtgtgtgctggaacagttcggcaatgaggaccaccatgagttcatctggaagttccactccatggcctccaggtaataaccttggagagagctcagccagggtctggtggctgcgggcacgggcatctcagctccactggttcctccattcagcttaaccagcgcctcccaagcagctgcctatagctggctctataactgagcctggggaagatagaggaaagtcacatccctgccttcaagggtctcgcagacaggtggggaggcagatggtgaactgtgggtacctagaacagcagaagttcactcaagctacagaaatactagaggagggtagctcatgcctgcaatcccagtactttgggaggccaaggcaggagtattgctggaggccgggagttcgagaccagcctggccaatgtagtaacacccccgtctctacaaaaaatacaaaaataaaaaaattagttggg

SEQ ID NO: 32766 - DNA, 1286 bp, Homo sapiens
ggcgtccagctgcacttcccacttctgactctgtgcctgctgttccctgctgggaagaagaaaagccagtgatgctggcttgaggctgtagtgggaggcccagcggattgtgagaagccagcccgggcagtgagtgtggatggcttggcaggtgagcctgctggagctggaggaccggcttcagtgtcccatctgcctggaggtcttcaaggagtccctaatgctacagtgcggccactcctactgcaagggctgcctggtttccctgtcctaccacctggacaccaaggtgcgctgccccatgtgctggcaggtggtggacggcagcagctccttgcccaacgtctccctggcctgggtgatcgaagccctgaggctccctggggacccagagcccaaggtctgcgtgcaccaccggaacccgctcagccttttctgcgagaaggaccaggagctcatctgtggcctctgcggtctgctgggctcccaccaacaccacccggtcacgcccgtctccaccgtctgcagccgcatgaaggaggagctcgcagccctcttctctgagctgaagcaggagcagaagaaggtggatgagctcatcgccaaactggtgaaaaaccggacccgaatcgtcaatgagtcggatgtcttcagctgggtgatccgccgcgagttccaggagctgcgccacccggtggacgaggagaaggcccgctgcctggaggggatagggggtcacacccgtggcctggtggcctccctggacatgcagctggagcaggcccagggaacccgggagcggctggcccaagccgagtgtgtgctggaacagttcggcaatgaggaccaccatgagttcatctggttccactccatggcctccaggtaataaccttggagagagctcagccagggtctggtggctgcgggcacgggcatctcagctccactggttcctccattcagcttaaccagcgcctcccaagcagctgcctatagctggctctataactgagcctggggaagatagaggaaagtcacatccctgccttcaagggtctcgcagacaggtggggaggcagatggtgaactgtgggtacctagaacagcagaagttcactcaagctacagaaatactagaggagggtagctcatgcctgcaatcccagtactttgggaggccaaggcaggagtattgctggaggccgggagttcgagaccagcctggccaatgtagtaacacccccgtctctacaaaaaatacaaaaataaaaaaattagttggg

SEQ ID NO: 32767 - DNA, 1350 bp, Homo sapiens
gagcatgatggggcatgtgcgggagcgccaggcggggcatgtaaccagagcgtgcggggcatgatggggcacggacatggggggttaggtggggcacgtaattggagctcgcggggcaggatggggcatctaactggagcgacagagagcacgatggggcacttacaggggccggaggctggcccgggcagtgagtgtggatggcttggcaggtgagcctgctggagctggaggactggcttcagtgtcccatctgcctggaggtcttcaaggagtccctaatgctacagtgcggccactcctactgcaagggctgcctggtttccctgtcctaccacctggacaccaaggtgcgctgccccatgtgctggcaggtggtggacggcagcagctccttgcccaacgtctccctggcctgggtgatcgaagccctgaggctccctggggacccggagcccaaggtctgcgtgcaccaccggaacccgctcagccttttctgcgagaaggaccaggagctcatctgtggcctctgcggtctgctgggctcccaccaacaccacccggtcacgcccgtctccaccgtctgcagccgcatgaaggaggagctcgcagccctcttctctgagctgaagcaggagcagaagaaggtggatgagctcatcgccaaactggtgaaaaaccggacccgaatcgtcaatgagtcggatgtcttcagctgggtgatccgccgcgagttccaggagctgcgccacccggtggacgaggagaaggcccgctgcctggaggggatagggggtcacacccgtggcctggtggcctccctggacatgcagctggagcaggcccagggaacccgggagcggctggcccaagccgagtgtgtgctggaacagttcggaaatgaggaccaccatgagttcatctggaagttccactccatggcctccaggtaataaccttggagagagctcagccagggtctggtggctgcgggcacgggcatctcagctccactggttcctccattcagcttaaccagcgcctcccaagcagctgcctatagctggctctataactgagcctggggaagatagaggaaagtcacgtccctgccttcaagggtctcgcagacaggtggggaggcagatggtgaactgtgggtacctagaacagcagaagttcactcaagctacagaaatactagaggagggtagctcatgcctgcaatcccagtactttgggaggccaaggcaggagtattgctggaggccgggagttcgagaccagcctggccaatgtagtaacacccccgtctctacaaaaaatacaaaaataaaaaaattagttggg

SEQ ID NO: 32768 - DNA, 1286 bp, Homo sapiens
ggcgtccagctgcacttcccacttctgactctgtgcctgctgttccctgctgggaagaagaaaagccagtgatgctggcttgaggccatagtgggaggcccagtggatcctgagaagctagcccgggcagtgagtgtggatggcttggcaggtgagcctgctggagctggaggactggcttcagtgtcccatctgcctggaggtcttcaaggagtccctaatgctacagtgcggccactcctactgcaagggctgcctggtttccctgtcctaccacctggacaccaaggtgcgctgccccatgtgctggcaggtggtggacggcagcagctccttgcccaacgtctccctggcctgggtgatcgaagccctgaggctccctggggacccggagcccaaggtctgcgtgcaccaccggaacccgctcagccttttctgcgagaaggaccaggagctcatctgtggcctctgcggtctgctgggctcccaccaacaccacccggtcacgcccgtctccaccgtctgcagccgcatgaaggaggagctcgcagccctcttctctgagctgaagcaggagcagaagaaggtggatgagctcatcgccaaactggtgaaaaaccggacccgaatcgtcaatgagtcggatgtcttcagctgggtgatccgccgcgagttccaggagctgcgccacccggtggacgaggagaaggcccgctgcctggaggggatagggggtcacacccgtggcctggtggcctccctggacatgcagctggagcaggcccagggaacccgggagcggctggcccaagccgagtgtgtgctggaacagttcggaaatgaggaccaccatgagttcatctggttccactccatggcctccaggtaataaccttggagagagctcagccagggtctggtggctgcgggcacgggcatctcagctccactggttcctccattcagcttaaccagcgcctcccaagcagctgcctatagctggctctataactgagcctggggaagatagaggaaagtcacgtccctgccttcaagggtctcgcagacaggtggggaggcagatggtgaactgtgggtacctagaacagcagaagttcactcaagctacagaaatactagaggagggtagctcatgcctgcaatcccagtactttgggaggccaaggcaggagtattgctggaggccgggagttcgagaccagcctggccaatgtagtaacacccccgtctctacaaaaaatacaaaaataaaaaaattagttggg

SEQ ID NO: 32769 - DNA, 2742 bp, Homo sapiens
gagcgaccgtcggggccggctggggccggagctcggggctcggtgggcctacagcggctccggacggacccccggggctggggagtcggggaggcctgccccggccccctgcccgcggccgccatggcggagaattggaagaactgcttcgaggaggagctcatctgccctatctgcctgcacgttttcgtggagccagtgcagctgccgtgcaaacacaacttctgccggggctgcatcggcgaggcgtgggccaaggacagcggcctcgtacgctgcccagagtgcaaccaggcctacaaccagaagccgggcctggagaagaacctgaagctcaccaacatcgtggagaagttcaatgccctgcacgtggagaagccgccggcggcgctgcactgcgtgttctgccgccgcggccccccgctgcccgcgcagaaggtctgcctgcgctgcgaggcgccctgctgccagtcccacgtgcagacgcacctgcagcagccctccaccgcccgcgggcacctcctggtggaggcggacgacgtgcgggcctggagctgcccgcagcacaacgcctaccgcctctaccactgcgaggccgagcaggtggccgtgtgccagtactgctgctactacagcggcgcgcatcagggacactcggtgtgcgacgtggagatccgaaggaatgaaatccggaagatgctcatgaagcagcaggaccggctggaggagcgagagcaggacattgaggaccagctgtacaaactcgagtcagacaagcgcctggtggaggagaaagtgaaccaactgaaggaggaagttcggctgcagtacgagaagctgcaccagctgctggacgaggacctgcggcagacagtggaggtcctagacaaggcccaggccaagttctgcagcgagaacgcagcgcaggcgctgcacctcggggagcgcatgcaggaggccaagaagctgctgggctccctgcagctgctctttgataagacggaggatgtcagcttcatgaagaacaccaagtctgtgaaaatcctgatggacaggacccagacctgcacgagcagcagcctttcccccactaagatcggccacctgaactccaagctcttcctgaacgaagtggccaagaaggagaagcagctgcggaaaatgctagaaggccccttcagcacgccggtgcccttcctgcagagtgtccccctgtacccttgcggcgtgagcagctctggggcggaaaagcgcaagcactcaacggccttcccagaggccagtttcctagagacgtcgtcgggccctgtgggcggccagtacggggcggcgggcacagccagcggtgagggccagtctgggcagcccctggggccctgcagctccacgcagcacttggtggccctgccgggcggcgcccaaccagtgcactcaagccccgtgttccccccatcgcagtatcccaatggctccgccgcccagcagcccatgctcccccagtatggcggccgcaagattctcgtctgttctgtggacaactgttactgttcttccgtggccaaccatggcggccaccagccctacccccgctccggccactttccctggacagtgccctcgcaggagtactcacacccgctcccgcccacaccctccgtcccccagtcccttcccagcctggcggtcagagactggcttgacgcctcccagcagcccggccaccaggatttctacagggtgtatgggcagccgtccaccaaacactacgtgacgagctaacgccacgcaggcggcggggcgctggggaatcttcctccccagcccccgggctcgggagttatgcatccagagacctgcccttctaccttcctcgcctcccctcttcctcattccattgccccaggtcttttccttttggattttgttttggttttggctttgtttttgatttttttttattatgaatctcctggacgcagaggtgacagtgggagctggcctgggccaggacggcaggtggccctggagatgggaaagtgtctgtgtcgaggcgctgagctctctctctgtttctccttttttcctctactccttccccttcacacccccgtggctggaaggaacctcggcttccctgaaagcttgggggtcccacccttcttaccccacccgggaggaacgcccagggccccgggcttgtttctcctcttgttttccttttgggcagtttgatcactgatcgagtaaggaatgacctttagattgtgcgacttttgtttttgtttttttaaatttttttaaaccaagaatgatttctcctgcttccttctcctcaccatcttcccagacggagttcaaaggccacttctcaagcagcttttggcaccttcagcctcagagtggaatcttttaaagacaggacccctatgtccaggaaaggggaaaaggaactttgccaatgatagtgaccacagcaaaagcaaataataataatattaataataataaagagaaataaaataataaaataaaaaacaatagcacagcccttgttgaggtcagcagggaggaggggctgcccggagttgggtccttgcctggattttgacacagcaacttcctgtagtgagcactttgtatgaatcgtggacttcctgttctcaaggcgcaggtatttattctgtatctgtctagagcacacaccaaaatccaaccttctaataaacatgatggcgcagtccc

SEQ ID NO: 32770 - DNA, 2828 bp, Homo sapiens
agcgaccgtcggggccggctggggccggagctcggggctcggtgggcctacagcggctccggacggacccccggggctggggagtcggggaggcctgccccggccccctgcccgcggccgccatggcggagaattggaagaactgcttcgaggaggagctcatctgccctatctgcctgcacgttttcgtggagccagtgcagctgccgtgcaaacacaacttctgccggggctgcatcggcgaggcgtgggccaaggacagcggcctcgtacgctgcccagagtgcaaccaggcctacaaccagaagccgggcctggagaagaacctgaagctcaccaacatcgtggagaagttcaatgccctgcacgtggagaagccgccggcggcgctgcactgcgtgttctgccgccgcggccccccgctgcccgcgcagaaggtctgcctgcgctgcgaggcgccctgctgccagtcccacgtgcagacgcacctgcagcagccctccaccgcccgcgggcacctcctggtggaggcggacgacgtgcgggcctggagctgcccgcagcacaacgcctaccgcctctaccactgcgaggccgagcaggtggccgtgtgccagtactgctgctactacagcggcgcgcatcagggacactcggtgtgcgacgtggagatccgaaggaatgaaatccggatgctcatgaagcagcaggaccggctggaggagcgagagcaggacattgaggaccagctgtacaaactcgagtcagacaagcgcctggtggaggagaaagtgaaccaactgaaggaggaagttcggctgcagtacgagaagctgcaccagctgctggacgaggacctgcggcagacagtggaggtcctagacaaggcccaggccaagttctgcagcgagaacgcagcgcaggcgctgcacctcggggagcgcatgcaggaggccaagaagctgctgggctccctgcagctgctctttgataagacggaggatgtcagcttcatgaagaacaccaagtctgtgaaaatcctgatggacaggacccagacctgcacgagcagcagcctttcccccactaagatcggccacctgaactccaagctcttcctgaacgaagtggccaagaaggagaagcagctgcggaaaatgctagaaggccccttcagcacgccggtgcccttcctgcagagtgtccccctgtacccttgcggcgtgagcagctctggggcggaaaagcgcaagcactcaacggccttcccagaggccagtttcctagagacgtcgtcgggccctgtgggcggccagtacggggcggcgggcacagccagcggtgagggccagtctgggcagcccctggggccctgcagctccacgcagcacttggtggccctgccgggcggcgcccaaccagtgcactcaagccccgtgttccccccatcgcagtatcccaatggctccgccgcccagcagcccatgctcccccagtatggcggccgcaagattctcgtctgttctgtggacaactgttactgttcttccgtggccaaccatggcggccaccagccctacccccgctccggccactttccctggacagtgccctcgcaggagtactcacacccgctcccgcccacaccctccgtcccccagtcccttcccagcctggcggtcagagactggcttgacgcctcccagcagcccggccaccaggatttctacagggtgtatgggcagccgtccaccaaacactacgtgacgagctaacgccacgcaggcggcggggcgctggggaatcttcctccccagcccccgggctcgggagttatgcatccagagacctgcccttctaccttcctcgcctcccctcttcctcattccattgccccaggtcttttccttttggattttgttttggttttggctttgtttttgatttttttttattatgaatctcctggacgcagaggtgacagtgggagctggcctgggccaggacggcaggtggccctggagatgggaaagtgtctgtgtcgaggcgctgagctctctctctgtttctccttttttcctctactccttccccttcacacccccgtggctggaaggaacctcggcttccctgaaagcttgggggtcccacccttcttaccccacccgggaggaacgcccagggccccgggcttgtttctcctcttgttttccttttgggcagtttgatcactgatcgagtaaggaatgacctttagattgtgcgacttttgtttttgtttttttaaatttttttaaaccaagaatgatttctcctgcttccttctcctcaccatcttcccagacggagttcaaaggccacttctcaagcagcttttggcaccttcagcctcagagtggaatcttttaaagacaggacccctatgtccaggaaaggggaaaaggaactttgccaatgatagtgaccacagcaaaagcaaataataataatattaataataataaagagaaataaaataataaaataaaaaacaatagcacagcccttgttgaggtcagcagggaggaggggctgcccggagttgggtccttgcctggattttgacacagcaacttcctgtagtgagcactttgtatgaatcgtggacttcctgttctcaaggcgcaggtatttattctgtatctgtctagagcacacaccaaaatccaaccttctaataaacatgatggcgcagtcccactccctgcctcgcctgttcccctatcccccccaggcctgggatcttcaggcgtcggtgtggggaggggcccctgccctccttgccttga

SEQ ID NO: 32771 - DNA, 5284 bp, Homo sapiens
aaactacgggcactcagaaatagacaaactgttcttgcctcaaccgaaccaaaggcccagcgggcctcgaaaaagctcagccaggtgctttgggaggccgcgaggaggaagaaggatccgtggaaggaagcacgttcacaccacggcactgaggcctctgggccgagctataatttaaagcatgaaacgaaggggtcatagattctgactaatgctgaccatttccatcggttacccagttgaatctcatgtcgacactaggaaatcgactttatacatgctctttaggaaacgagggacgcaggatgaaagaagccaagagtgtcgccagggcttgcgccagcgccgtcagactcccgggatgggggagctccagggcacggcgtcagcggattcacggagaaggagaaaagccccactgccgtgcagaagcctaggcccgggtgagacgcctgcgaaggctgccagcagcggaagagaaggggcgtcctccgtgctgcgcagcactcgcccgcggtaggtgggcgcggagctcagagctgggagccaaacgcaaacgctggcgagaagccccagccccctccggcagcccactcgctgcggggaggggtttctcacgcccccagctcctgggagactgcaccggaggtcggaagtaagccgggcgaggatgaatcatcccgcctaactcctccttcccggtcccctagcctccgcacgccggcccccttcagagatcttgcagccgcgagcgaagactgccctatcctcagactctaccgaaccccctgtggcctgcggagacgaggagacggacgggtctggtggccaatgagagcttcgatctcttgccccccgcccaatgggccgctgctcatgggccggggcgggactaggagggcaggtaggggcggtccgggctggcgcgcggcgcggcggctacgcggctgcggctcacagagctagcgcctctctgggtgtccgtgccagtgctgcgcgggaaggcaccaccaccacagccgccgccgctggccagggtgctggacaagacgggcccgtcggccacctcgccagctcaggcacccgctgcagccgtcgctgtctcctcccagaccggtccccatggaggagatggaagaggagttgaaatgccccgtgtgcggctccttctatcgggagcccatcatcctgccctgctctcacaatttgtgtcaggcgtgcgcccgcaacatcctggtgcagaccccagagtctgaatccccccagagccatcgggccgcgggctccggggtctccgactatgactatctggacctggacaagatgagcctatacagcgaggcggacagcggctatggctcctacggggggttcgccagcgcccccactaccccgtgccagaagtcccccaacggcgtccgcgtgtttcccccggctatgccgccaccggccacccacttgtcaccggccctggccccggtgccccgcaactcctgtatcacctgcccccagtgtcaccgcagcctcatcctggatgaccgggggctccgcggcttccccaagaatcgcgtactggaaggggtaattgaccgctaccagcagagcaaagccgcggccctcaagtgccagctctgcgagaaggcgcccaaggaagccaccgtcatgtgcgaacagtgcgatgtcttctactgcgatccgtgccgcctgcgctgccacccgccccgggggcccctagccaagcaccgcctggtgcccccggcccagggtcgtgtgagccggaggctgagcccacgcaaggtctccacctgcacagaccacgagctggagaaccacagcatgtactgcgtgcaatgcaagatgcccgtgtgctaccagtgcttggaggagggcaaacactccagccacgaagtcaaggctctgggggccatgtggaaactacataagagccagctctcccaggcgctgaacggactgtcagacagggccaaagaagccaaggagtttctggtacagctgcgcaacatggtccagcagatccaggagaacagtgtggagtttgaagcctgtctggtggcccaatgtgatgccctcatcgatgccctcaacagaagaaaagcccagctgctggcccgcgtcaacaaggagcatgagcacaagctgaaggtggttcgagatcagatctctcactgcacagtgaaattgcgccagaccacaggtctcatggagtactgcttggaggtgattaaggaaaatgatcctagtggttttttgcagatttctgacgccctcataagaagagtgcacctgactgaggatcagtggggtaaaggcacactcactccaaggatgaccacggactttgacttgagtctggacaacagccctctgctgcaatccatccaccagctggatttcgtgcaagtgaaagcttcctctccagtcccagcaacccctatcctacagctggaggaatgttgtacccacaacaacagcgctacgttgtcctggaaacagccacctctgtccacggtgcccgccgatggatacattctggagctggatgatggcaacggtggtcaattccgggaggtgtatgtggggaaggagacaatgtgcactgtggatggtcttcacttcaacagcacatacaacgctcgggtcaaggccttcaacaaaacaggagtcagcccgtacagcaagaccctggtcctccaaacgtctgaggtggcctggtttgctttcgaccctggctcggcgcactcggacatcatcctctccaatgacaacctgacagtgacctgtagtagctatgatgaccgggtggtgctagggaagactggcttctccaagggcatccactactgggagctcacggtagatcgctatgacaaccaccctgatcctgcctttggtgtggctcgcatggacgtgatgaaggatgtgatgttaggaaaagacgacaaagcttgggcaatgtatgtggacaataaccggagctggttcatgcacaacaactcgcacaccaacagaactgagggagggatcacaaaaggggccacaattggggtcctcctcgacttaaatagaaaaaacttgacattttttatcaacgatgaacaacaaggtcccatagcatttgataacgtggagggcctcttcttccctgcggtcagcctgaacaggaacgtgcaggtcacgctgcacaccgggctcccagtccccgacttctactccagcagagcatcaatagcctaaggatgtgccgtggaggcgccagctgcctgttcttacctccgcctgcgagagccacagcaaggagctcagccagccgtggtggggtgcagagttggcaggagtgggagaaggaggagagaaaagctggtcctctgcagtctttacacccacagctctgcccttttccctttcaacctctcctccgctgtcatgcctgcttccgcttccatgtccaacaattctaaccaacaaaggacctagacagcccaccaagtcacttggttcccactcccagattttgcttttatttaacttaattttttatgtaggtgagttatattttctttcttttctgatcaggttattggtgacttactggactggcaccgccaggagaaaattctcctgctaactttttttcttaagctttctgtcaaacaatgaggttgtagggggaggtagggaagaatgagctgaatttgtagcatacagcttacctgctagaatgttcttaccctcttacctctcctgtagcgttagctctgcagagctaagctttgggagaatgaatctatcactgagaagttttactactcattgaagcacaaaaatatccgctacacaggttcacatcagggtaggatcgttaggatggctctataattaggataggccagaaccctggccactgtataaaattggaaagtctctaagacacaggcaaaccaggggacttaatgatttggttcgtttatttaataaaagcttttaattgagaacctactattgaccaggcactgttcaagacactagaacattatgttctagacactgtggggacacagtggtgaacagacaggcatggtctctgcccttcggagcttatattccagtaggagaaaaagcaaaaataaaataattataaatggtcatatgtactagaaaggaaatgggcaagggtcaaagagactcatgggcaagatctttcaggcttcctagaatgatgctaaaaatccacacattctggccatagcaccagaaatgtaccaactcaatgccttttcagctgcactatttaattatggtacctgctgccactcatcacagagcccttcttggtagaaatgatgtcagcattcttatttgctgatgctgctatgataccacgccttaaaaattgacagttgaaaaaaaaaagagtgaccagagggcaaaggacccattctcagtaatgggagatcttgagttgcagtccacagcattcacattctcaggataaacatgcttgtctccatatatactatctgtgcctgttatgaatgaaaaatccatccactctgctgccattcacagcctaattttctggagtagtccaaacaatgtttggaaaaacatgggactgtatgtcattactatgactgatagcagaataataatgcatcttacttctatatagagatagacttacataggttacccttgaaattcattagtttgtcataaagttttaggaaaggtaggacccggaaagaagttctaattagttgtctaaatatttttcagtgagccaagaaattcaccatgaaaaaacaagaataacaaatagaagggaagagataggatgggaaagctaacaaattaaagttttggcaaaaaggaatatatgtaaatagctaattatttacttttgtgcttactttatttagattatttctatcagttacaatctttttctagttaagtgtacctaatttatggaatgggtgctatcctgtttatgtgtgtcttggtttttcttggctacagaaaaactgttgcagggcaacactagtttgatatttgatttactctccaatgagactcaatggctgggccgtggtagactcatagttcctcttgttctttattaaattcatcctgctaattagatttctagtgacttgtaacatgtagtttacactgaattgcaattacagatgcatacaactactatactagaaaaaattgtcatttctgatgtgccaataaatgatttttatgagagaataaa

SEQ ID NO: 32772 - DNA, 3312 bp, Homo sapiens
agagatcttgcagccgcgagcgaagactgccctatcctcagactctaccgaaccccctgtggcctgcggagacgaggagacggacgggtctggtggccaatgagagcttcgatctcttgccccccgcccaatgggccgctgctcatgggccggggcgggactaggagggcaggtaggggcggtccgggctggcgcgcggcgcggcggctacgcggctgcggctcacagagctagcgcctctctgggtgtccgtgccagtgctgcgcgggaaggcaccaccaccacagccgccgccgctggccagggtgctggacaagacgggcccgtcggccacctcgccagctcaggcacccgctgcagccgtcgctgtctcctcccagaccggtccccatggaggagatggaagaggagttgaaatgccccgtgtgcggctccttctatcgggagcccatcatcctgccctgctctcacaatttgtgtcaggcgtgcgcccgcaacatcctggtgcagaccccagagtctgaatccccccagagccatcgggccgcgggctccggggtctccgactatgactatctggacctggacaagatgagcctatacagcgaggcggacagcggctatggctcctacggggggttcgccagcgcccccactaccccgtgccagaagtcccccaacggcgtccgcgtgtttcccccggctatgccgccaccggccacccacttgtcaccggccctggccccggtgccccgcaactcctgtatcacctgcccccagtgtcaccgcagcctcatcctggatgaccgggggctccgcggcttccccaagaatcgcgtactggaaggggtaattgaccgctaccagcagagcaaagccgcggccctcaagtgccagctctgcgagaaggcgcccaaggaagccaccgtcatgtgcgaacagtgcgatgtcttctactgcgatccgtgccgcctgcgctgccacccgccccgggggcccctagccaagcaccgcctggtgcccccggcccagggtcgtgtgagccggaggctgagcccacgcaaggtctccacctgcacagaccacgagctggagaaccacagcatgtactgcgtgcaatgcaagatgcccgtgtgctaccagtgcttggaggagggcaaacactccagccacgaagtcaaggctctgggggccatgtggaaactacataagagccagctctcccaggcgctgaacggactgtcagacagggccaaagaagccaaggagtttctggtacagctgcgcaacatggtccagcagatccaggagaacagtgtggagtttgaagcctgtctggtggcccaatgtgatgccctcatcgatgccctcaacagaagaaaagcccagctgctggcccgcgtcaacaaggagcatgagcacaagctgaaggtggttcgagatcagatctctcactgcacagtgaaattgcgccagaccacaggtctcatggagtactgcttggaggtgattaaggaaaatgatcctagtggttttttgcagatttctgacgccctcataagaagagtgcacctgactgaggatcagtggggtaaaggcacactcactccaaggatgaccacggactttgacttgagtctggacaacagccctctgctgcaatccatccaccagctggatttcgtgcaagtgaaagtcccagcaacccctatcctacagctggaggaatgttgtacccacaacaacagcgctacgttgtcctggaaacagccacctctgtccacggtgcccgccgatggatacattctggagctggatgatggcaacggtggtcaattccgggaggtgtatgtggggaaggagacaatgtgcactgtggatggtcttcacttcaacagcacatacaacgctcgggtcaaggccttcaacaaaacaggagtcagcccgtacagcaagaccctggtcctccaaacgtctgaggacacagattcagaagaacagaccctcccttttccagtgccttcggaaagattgccgctccgtagaatgagtcctttctcctccacccttaatctacaacccagcttccccgggagatcctactttgatttccgatcctcaccccaccagctgagcttgcattcctctttacagtctctcaatgcaccgggatgcaattttgagacacaatctgcaccttactctcaattagttgacattaaaaagctgttggcagtggcctggtttgctttcgaccctggctcggcgcactcggacatcatcctctccaatgacaacctgacagtgacctgtagtagctatgatgaccgggtggtgctagggaagactggcttctccaagggcatccactactgggagctcacggtagatcgctatgacaaccaccctgatcctgcctttggtgtggctcgcatggacgtgatgaaggatgtgatgttaggaaaagacgacaaagcttgggcaatgtatgtggacaataaccggagctggttcatgcacaacaactcgcacaccaacagaactgagggagggatcacaaaaggggccacaattggggtcctcctcgacttaaatagaaaaaacttgacattttttatcaacgatgaacaacaaggtcccatagcatttgataacgtggagggcctcttcttccctgcggtcagcctgaacaggaacgtgcaggtaagcaccctgcccctgaggttaaacagctgttgctggctaccggttcaaaggctgcccagggccgttcaatccaaccgaagagagggaagctgacagcgtaaggcccagaccaagatatgaaggagaggaggagagaaagggatcagcactggcaacttattttattccacgccaagcataagcaccttctttatacttggacgcagactagttaatagcacataggaaactagaattctcttcatggttggctaatgatcatctctgtagctctagtttcacctctaaatagaaacgaaagcctttaaccaactggcatgaaaacaaatagaatgacttaacaaagctcaggagtgcctgagaagaggtgagggtgtaagactgaagcattagtatcattatcagaaaatctgagcatcttctctgcactcttgtttggctctgttaggtcctaaggggtagaaaacatagtccctacctacaacttagtcaattattatttattatagaataaaacaacagcttctcatttattcattcagcaaatatctatagaatgcctttaatgtgccaggcacagttataagtgtctgggatacatcagtg

SEQ ID NO: 32773 - DNA, 3726 bp, Homo sapiens
gccagtgctgcgcgggaaggcaccaccaccacagccgccgccgctggccagggtgctggacaagacgggcccgtcggccacctcgccagctcaggcacccgctgcagccgtcgctgtctcctcccagaccggtccccatggaggagatggaagaggagttgaaatgccccgtgtgcggctccttctatcgggagcccatcatcctgccctgctctcacaatttgtgtcaggcgtgcgcccgcaacatcctggtgcagaccccagagtctgaatccccccagagccatcgggccgcgggctccggggtctccgactatgactatctggacctggacaagatgagcctatacagcgaggcggacagcggctatggctcctacggggggttcgccagcgcccccactaccccgtgccagaagtcccccaacggcgtccgcgtgtttcccccggctatgccgccaccggccacccacttgtcaccggccctggccccggtgccccgcaactcctgtatcacctgcccccagtgtcaccgcagcctcatcctggatgaccgggggctccgcggcttccccaagaatcgcgtactggaaggggtaattgaccgctaccagcagagcaaagccgcggccctcaagtgccagctctgcgagaaggcgcccaaggaagccaccgtcatgtgcgaacagtgcgatgtcttctactgcgatccgtgccgcctgcgctgccacccgccccgggggcccctagccaagcaccgcctggtgcccccggcccagggtcgtgtgagccggaggctgagcccacgcaaggtctccacctgcacagaccacgagctggagaaccacagcatgtactgcgtgcaatgcaagatgcccgtgtgctaccagtgcttggaggagggcaaacactccagccacgaagtcaaggctctgggggccatgtggaaactacataagagccagctctcccaggcgctgaacggactgtcagacagggccaaagaagccaaggagtttctggtacagctgcgcaacatggtccagcagatccaggagaacagtgtggagtttgaagcctgtctggtggcccaatgtgatgccctcatcgatgccctcaacagaagaaaagcccagctgctggcccgcgtcaacaaggagcatgagcacaagctgaaggtggttcgagatcagatctctcactgcacagtgaaattgcgccagaccacaggtctcatggagtactgcttggaggtgattaaggaaaatgatcctagtggttttttgcagatttctgacgccctcataagaagagtgcacctgactgaggatcagtggggtaaaggcacactcactccaaggatgaccacggactttgacttgagtctggacaacagccctctgctgcaatccatccaccagctggatttcgtgcaagtgaaagcttcctctccagtcccagcaacccctatcctacagctggaggaatgttgtacccacaacaacagcgctacgttgtcctggaaacagccacctctgtccacggtgcccgccgatggatacattctggagctggatgatggcaacggtggtcaattccgggaggtgtatgtggggaaggagacaatgtgcactgtggatggtcttcacttcaacagcacatacaacgctcgggtcaaggccttcaacaaaacaggagtcagcccgtacagcaagaccctggtcctccaaacgtctgagggtaaggcccttcagcagtatccctcagagcgagaactgcgtggcatctaaagtggctggcaagcccggaggtaaccccaccactgcccacattcctgaagtgtttccatgacttgctctgcattctgcacagagccgctgttcctctcctgcctttagagagcctatggtatgtggatgtgatcaaaccaaagattccacatcggcagttccaatggcttgggccggcggcttcctttgataacaatctaaataagctgcagttgaagaagctgaaaaatgaaggcctgaatgtgcccctggtgtgtaagacaaatgtatctaggctctagagcaggctcccattctccaccgatacacatcatgtgccagttttgcccagatgattctaaattactctgtagtacttgcttgttctgagggtgggacctaggttctttccagtcgtggatttgtatgactgaatgtgtttcaaatgggtggtggggtgctagagctgtttagagagggcctgttggctgctcctggcttacccacttagactgcctccgtttcatacccaaagcggaggccgtcagcaccaggattgagacttcctgtgggcaccaaacaggaagagaccagcaacttcgcattacccgccattttcatctttgccagtcccttcagtcttggctaggctaccgagagccaccatacaaggttcatctctagagaatttttgcttcttagctatactttaaatattttggtcatcaaagacaagtaatgtgtctcagatgagaggcttgaatttgatggccagatataacctctgaggcttttaacattttcattttaagagtaagcaagacacatgaaattaaacctacaaggaggtatttgtggctggtgccaaagcattctgacactttggggtgtcattttaatcaaagaaatcacccccccacctcaccgggattctccataacttccctctgcagaactaattatgttgattttgttcaagttcaagatgttagctaaaagaactatggtggtgttttttttcccacttcccacaaacctcaacatgtgccagtcaccctaaaatgcttcacatggttaaaaacaagcacaattttgaatcctacagcaaggatgaaaggcccctagccgtgaaaacagtgctttggggagcagttgtcagtctaagtgatgctattccaagagaaggatatgctgagggaaaatgcccacatgacctgttcccatttggagtacagtgatgtggtagctacagcttcccccagaattatcattttagcaccttctctcagggatgacctatcagtttgagagcagttgcctcttttctcaaaataccatactaactgctaaagccctccaagagtctttcctagatgcaacgcagaaggcccttgctggtgatggcctcatttcccatgtgtgtacaaggtggtttgattgaagagtgaagtgcatgcctgcagagcagagagaaatttgtagcaatgttgctaatatgtgttatcagatctgcgggaaaactatttctattcataatacatcatgggaatcatactattctggtaaaaatcagttattagcataacagcctgagcacttatgtctctcgtttcatcctgcaggaggatgtagcgcctcagtttattttaatgttcataagattatggtgtctaatttaataaattacaggattggaactgcgatccttggtaccacagtcacagaactgggggtcattttctagatgaaacaaacggaacaagttctcttccaacaaagaaactgtactgtagaaattaatttcctccatgaattttatatattgtgtacaaatataaggtatgtatctgaatacaaagaaaagcctatcatcatatagatatcagtattctctgttactgcacagaagtaattttctcatgatgaaataaagttcacacacatactttctccataa

SEQ ID NO: 32774 - DNA, 3931 bp, Homo sapiens
gcagtttgccgcttcctcgtcctccatcctgcgtccatggccaccgctgcgactgaggagcccttcccttttcacggtctcctgccgaagaaggagaccggagccgcctccttcctctgccgctacccggagtatgatgggcggggggtgctcatcgcagtcctggacacgggggtcgacccgggggctccgggcatgcaggttacaactgatggaaaaccaaaaatcgttgatatcattgatacaacaggaagtggcgatgtgaatactgctacagaagtagagccaaaggatggtgagattgttggcctttcaggaagagtgcttaagattcctgcaagctggacaaatccctcaggcaaatatcatattggcataaaaaatggctatgacttctatcctaaggcactcaaggaaaggatacagaaagaacggaaggaaaaaatctgggaccctgttcacagagtggcccttgcagaagcctgtagaaaacaggaagaatttgatgttgccaacaacggctcttctcaagcaaataaactaatcaaggaggaacttcaaagtcaagtggaattgctaaattcttttgagaagaaatacagcgatcctggccctgtatatgactgcttggtatggcatgatggcgaagtctggagagcctgcattgattctaatgaagatggggacttgagtaaatctaccgtgttgagaaactacaaagaagcccaagaatatggctcttttggcacagctgagatgttgaattactccgttaatatatacgatgatggaaacctgctctccattgtgaccagtggaggagctcatgggacacatgtagctagtatagctgctggacactttccagaagaacctgaacggaatggggtagctcctggtgctcaaattctttccatcaagattggtgatacaagactaagcacaatggaaacaggcacaggcctcataagagctatgatagaagttataaatcataagtgtgatcttgtcaactacagttacggagaagcaactcactggccaaattctgggagaatttgtgaagtaattaatgaagcagtatggaagcataatataatttatgtttcaagtgctggaaataatggtccatgcctgtctacagttggttgtccaggtggaactacatcaagtgtgataggtgttggtgcttatgtttctcctgatatgatggttgctgagtattcactgagagagaaattacctgcaaatcaatatacttggtcttctagaggacctagtgctgacggggcccttggtgtgagtatcagtgcgccaggaggagccattgcttctgttcctaactggacactgagagggacgcagctgatgaatggaacatctatgtcttcccccaatgcatgtggaggcattgccctgatcctttcaggtctgaaagctaataacattgactacacagttcattcagtcagaagagctctagaaaacactgcagtgaaggctgacaatatagaagtatttgctcaaggacatggtattattcaggttgataaagcctatgactacctcgttcagaatacatcatttgctaataaattaggttttactgttactgttggaaataaccgtggcatctacctccgagatcctgttcaggtggctgcaccttcagatcatggcgttggcattgaacctgtatttccggagaacacagaaaactctgaaaaaatatcccttcagcttcatttagctctgacttcaaattcatcttgggttcagtgtcccagccatttggaactcatgaatcaatgtagacacataaacatacgtgtggatcccaggggcttaagagaaggattgcattatacagaggtatgtggctatgatatagcatcccctaacgcaggtccgctcttcagagttccgatcactgcagttatagcagcaaaagtaaatgaatcatcacattatgatctagcctttacagatgtacactttaaacctggtcaaattcgaaggcattttattgaggttcctgagggtgcaacatgggctgaagtgacagtgtgttcgtgttcttctgaggtgtcagcaaagtttgttctacatgcagtccagcttgtgaagcaaagagcatatcgaagccatgaattctataagttttgttctcttccagagaaaggaacactgactgaagcttttcctgtcctaggtggaaaagcaattgaattttgcattgctcgttggtgggcaagtctcagtgatgtcaacattgattataccatttctttccatgggatagtgtgtactgctcctcagttaaacattcatgcatcggaaggaatcaaccgctttgatgttcagtcctccttgaaatacgaagatctggctccctgcataactttgaagaactgggtccaaacactgcgcccagtgagtgcaaaaacaaaacctttaggatcaagagatgttttgccaaataaccgtcaactttatgagatggtcctgacatataactttcatcaacccaagagtggggaagtaactccaagctgcccactactttgtgaactattatatgaatctgaatttgacagccaactgtggattatttttgaccagaacaaaagacagatgggttcaggcgatgcctatccacatcagtattctttgaaactggagaaaggagattatacaattcgactacagattcgccatgagcaaatcagtgatttggaacgccttaaagaccttccatttattgtttctcatagattgtctaataccttgagcttagatattcatgaaaatcatagttttgcacttctagggaagaagaaatcaagcaatttgacattaccacccaaatataaccagccattctttgttacttccttacctgatgataaaatacctaaaggggcaggacctggatgctatcttgcaggatccttaacattgtcaaagactgaactaggaaagaaagctgatgtaatccctgttcattactacttaatacctccaccaacaaagactaagaatggcagcaaagataaggaaaaagattcagaaaaagagaaagatttaaaagaagagtttactgaagcattacgagatcttaaaattcagtggatgacaaagctggattctagtgacatttataacgaattgaaagaaacatatcctaattatcttcctctgtacgttgcacgacttcatcaattggatgctgaaaaggaacgaatgaaaagacttaatgaaattgttgatgcggcaaatgctgttatttctcatatagatcaaacagccctagcagtttatattgcaatgaagactgatcccaggcctgatgcagctactataaaaaatgacatggacaaacaaaaatccaccctcgtagatgccctttgtaggaaaggttgtgccctggcagaccatcttcttcacacccaggctcaagacggagccatttccactgatgcagaaggaaaggaggaggaaggagaaagtcctttggattctctggcagaaacattttgggaaactactaaatggactgatctctttgacaataaggttttgacatttgcatataaacatgcattagtaaataaaatgtatgggagaggccttaaatttgcaactaaacttgtggaagaaaaaccaacaaaagaaaactggaaaaattgtattcaactgatgaagttacttggatggacccattgtgcatcttttactgaaaactggctccccatcatgtatcctcccgattattgcgtattctaaaataggaaacaagactttaaattttaaaaaaggaagttttatagtgaatgggtataaaaacaaatttgtggcatttttagtctaatgcatgttttcatccactatccagtactgattattaaaatgacatgtatttatcagagaa

SEQ ID NO: 32775 - DNA, 4065 bp, Homo sapiens
tgttcgtgtcttctaataagagcaagccgatcattaaccttctcaacgcagcgtcttttggtttcttccatttccaaccagcagaatatcttcttggaactttcttttttaacctctgccttcctcacgcacctattttttggagggttccttttccctgctctctacctcctgtttaaattgaaacctgtacactttaagctttttgctcatcgcttggttttgctcttttatgccttaaattatctttgcggcatttttgactcatctgctggggaagaccattccctcaagaaaacttccaacagcaactcaaagcaaactaagatgaaaaaatggggggaaagaatctgtccactgggaacgctttacgtcaccgtgttgctctggaagacagagactgctctgggcacctggcgaggcggctctgcagtgcaggctggggccggtccctgcggcctgctgggctctggcctcgtttggcccatcactcatgctgccgtctcaagcacaagggttgctgtggtgggttttccctctgtttcctgcttcctcactgtcctacccacctgtttcctacagggcagatggcctggcccgtaacactttcctgaaggcatgcagtgaaagcagcagcagtagcaacatctccaccatgttggtgacacacgattacacggcagtgaaggaggatgagatcaacgtctaccaaggagaggtcgttcaaattctggccagcaaccagcagaacatgtttctggtgttccgagccgccactgaccagtgccccgcagctgagggctggattccaggctttgtcctgggccacaccagtgcagtcatcgtggagaacccggacgggactctcaagaagtcaacatcttggcacacagcactccgtttaaggaaaaaatctgagaaaaaagataaagacggcaaaagggaaggcaagttagagaacggttatcggaagtcacgggaaggactcagcaacaaggtatctgtgaagcttctcaatcccaactacatttatgacgttcccccagaattcgtcattccattgagtgaggtcacgtgtgagacaggggagaccgttgttcttagatgtcgagtctgtggccgccccaaagcctcaattacctggaagggccctgaacacaacaccttgaacaacgatggtcactacagcatctcctacagtgacctgggagaggccacgctgaagattgtgggcgtgaccacggaagatgacggcatctacacgtgcatcgctgtcaatgacatgggttcagcctcatcgtcggccagcctgagggtcctaggtccagggatggatgggatcatggtgacctggaaagacaactttgactccttctacagtgaagtggctgagcttggcaggggcagattctctgtcgttaagaaatgtgatcagaaaggaaccaagcgagcagtggccactaagtttgtgaacaagaagttgatgaagcgcgaccaggtcacccatgagcttggcatcctgcagagcctccagcaccccctgcttgtcggcctcctcgacacctttgagacccccaccagctacatcctggtcttagaaatggctgaccagggtcgcctcctggactgcgtggtgcgatggggaagcctcactgaagggaagatcagggcgcacctgggggaggttctggaagctgtccggtacctgcacaactgcaggatagcacacctggacctaaagcctgagaatatcctggtggatgagagtttagccaagccaaccatcaaactggctgactttggagatgctgttcagctcaacacgacctactacatccaccagttactggggaaccctgaattcgcagcccctgaaatcatcctcgggaaccctgtctccctgacctcggatacgtggagtgttggagtgctcacatacgtacttcttagtggcgtgtcccccttcctggatgacagtgtggaagagacctgcctgaacatttgccgcttagactttagcttcccagatgactactttaaaggagtgagccagaaggccaaggagttcgtgtgcttcctcctgcaggaggaccccgccaagcgtccctcggctgcgctggccctccaggagcagtggctgcaggccggcaacggcagaagcacgggcgtcctcgacacgtccagactgacttccttcattgagcggcgcaaacaccagaatgatgttcgacctatccgtagcattaaaaactttctgcagagcaggcttctgcctagagtttgacctatccagaagttctttctcattctctttcacctgccaatcagctgttaatctgaattttcaagagaaaacaagcaaacataactgatcagctgccggtatgttcatcgtgtgaaattgcattccaagtgagctgtgctcagcagtgcttggacacagagctgcaagctgcgctggggtggaggaccgtcacttacactctgcccaaggcagaggtcgcattgctgtatcacagtattttattcaggtttctgcaaaaaaataaaaagataacttttttaaacaaacatgaatagaattttgcaaatttaacgttttcaagatttattcaaggaaacaaaatgcctatgttcaaccactggtgttaatgaacaaagatactgtgcgtctctggggaagacgcacctaggtggcggccactcccatggccttgtctaggactcagagaccactcggctctgagcttccaggcgcctcgtctgtgtgcatctcacgcccgacgtggcttctgaaacgtgcattcaacctcaaacttttgcataaaatagaatgaatcgttttgctctgatgaaatgtaggccttacttgtatataagactgttcctgccttcggtctgtcattttcccacctgcctcccctacccaccccccacccaccacctggggcttcctctgggggtccgagggtcttcccatcacatgaagacatcaggttgggtcctgccccactgcccctccccctgttcctgccccaagccgtcaatcagattgtggagcagtacacagtcagatgaaaatactgtaaatgcactcattgggggttttttggttttacttcatatcatgtgcaatgttgtggctttaacattttatgcaactatttatgaagacctctgttgtacctgtaataaatatatagaaaaagcacatacttcgtatggtgagctttatggttttgtgtgtgtgttggggttggcgggtgggtgggtagggtcgtagccctgtgccatcggttcaaagagacttttcgtgaaatttgttggttttgaggactgtaaaagtgatttcatactctgaatataaaactggataatagggtaatgttttaaaatttattatgctattattcagaatgccaaagtattattttttttcccaaaatcagtctggacatttactactttttagactttttgacgttgaactttctgtataaaaattggctgggttttgagcttttggtaagaaataaaagccgattaagcactggccgccccgcggctggtacccaatgcccgagtcactgtggcagcattcgcactggtgtggggagtcctttcaactcaaggaggctgggtttctgggcaccctcgaagttttctggatgtctttttatctttctcgtgtgaactgcactacaaaagagaccagcccgcttcccaagccagccagacacctgggtcttgagccataaactggcgtagttaagctttgcagcttccagtgtattttatttattcttttgttgggtttttgtttgtttcttcttgtaaaattgtacagaaactttttaaaagaaattggattcgaaactggatgtgtattcgtaacctcataatttttatttgtgtattgtttcttttattatttcagttaaatttttacattattttgcatgtatatttctttgtacagagaccttacatgtttacacagtatgatgtgatgtaaatattttattttgccatcagttattttaaaaaattaaacatatttgcctg

SEQ ID NO: 32776 - DNA, 11100 bp, Homo sapiens
gcggccgcgggcgccgccgcagccatgagcggcagcagcggcggagccgccgcccccgccgcgtcctccggccccgccgcggcggccagcgcggctggctcgggctgcgggggcggtgccggcgagggggcagaggaggcggccaaggacctggccgacatcgcggccttcttccgatccgggtttcgaaaaaacgatgaaatgaaagctatggatgttttaccaattttgaaggaaaaagttgcatacctttcaggtgggagagataaacgtggaggtcccattttaacgtttccggcccgcagcaatcatgacagaatacgacaggaggatctcaggagactcatttcctatctagcctgtattcccagcgaggaggtctgcaagcgtggcttcacggtgatcgtggacatgcgtgggtccaagtgggactccatcaagccccttctgaagatcctgcaggagtccttcccctgctgcatccatgtggccctgatcatcaagccagacaacttctggcagaaacagaggactaattttggcagttctaaatttgaatttgagacaaatatggtctctttagaaggccttaccaaagtagttgatccttctcagctaactcctgagtttgatggctgcctggaatacaaccacgaagaatggattgaaatcagagttgcttttgaagactacattagcaatgccacccacatgctgtctcggctggaggaacttcaggacatcctagctaagaaggagctgcctcaggatttagagggggctcggaatatgatcgaggaacattctcagctgaagaagaaggtgattaaggcccccatcgaggacctggatttggagggacagaagctgcttcagaggatacagagcagtgaaagctttcccaaaaagaactcaggctcaggcaatgcggacctgcagaacctcttgcccaaggtgtccaccatgctggaccggctgcactcgacacggcagcatctgcaccagatgtggcatgtgaggaagctgaagctggaccagtgcttccagctgaggctgtttgaacaggatgctgagaagatgtttgactggatcacacacaacaaaggcctgtttctaaacagctacacagagattgggaccagccaccctcatgccatggagcttcagacgcagcacaatcactttgccatgaactgtatgaacgtgtatgtaaatataaaccgcatcatgtcggtggccaatcgtctggtggagtctggccactatgcctcgcagcagatcaggcagatcgcgagtcagctggagcaggagtggaaggcgtttgcggcagccctggatgagcggagcaccttgctggacatgtcctccattttccaccagaaggccgaaaagtatatgagcaacgtggattcatggtgtaaagcttgcggtgaggtagaccttccctcagagctgcaggacctagaagatgccattcatcaccaccagggaatatatgaacatatcactcttgcttattctgaggtcagccaagatgggaagtcgctccttgacaagctccagcggcccttgactcccggcagctccgattccctgacagcctctgccaactactccaaggccgtgcaccatgtcctggatgtcatccacgaggtgctgcaccaccagcggcagctggagaacatctggcaacaccgcaaggtccggctgcatcagaggctgcagctgtgtgttttccagcaggacgttcagcaggtgctagactggatcgagaaccacggagaagcatttctgagcaaacatacaggtgtggggaaatctcttcatcgggccagagcattgcagaaacgtcatgaagattttgaagaagtggcacagaacacatacaccaatgcggataaattactggaagcagcagaacagctggctcagactggggaatgtgaccccgaagagatttatcaggctgcccatcagctggaagaccggattcaagatttcgttcggcgtgttgagcagcgaaagatcctactggacatgtcagtgtcctttcacacccatgtgaaagagctgtggacgtggctggaggagctgcagaaggagctgctggacgacgtgtatgccgagtcggtggaggccgtgcaggacctcatcaagcgctttggccagcagcagcagaccaccctgcaggtgactgtcaacgtgatcaaggaaggggaggacctcatccagcagctcagggactctgccatctccagtaacaagaccccccacaacagctccatcaaccacattgagacggtgctgcagcagctggacgaggcgcagtcgcagatggaggagctcttccaggagcgcaagatcaagctggagctcttcctgcagctgcgcatcttcgagagggacgccatcgacattatctcagacctcgagtcttggaatgatgagctttctcagcaaatgaatgacttcgacacagaagatctcacgattgcagagcagcgcctccagcaccatgcagacaaagccttgaccatgaacaacttgacttttgacgtcatccaccaagggcaagatcttctgcagtatgtcaatgaggtccaggcctctggtgtggagctgctgtgtgatagagatgtagacatggcaactcgggtccaggacctgctggagtttcttcatgaaaaacagcaggaattggatttagccgcagagcagcatcggaaacacctggagcagtgcgtgcagctgcgccacctgcaggcagaagtgaaacaggtgctgggttggatccgcaacggagagtccatgttaaatgccggacttatcacagccagctcgttacaagaggcagagcagctccagcgagagcacgagcagttccagcatgccattgagaaaacacatcagagcgcgctgcaggtgcagcagaaggcagaagccatgctacaggccaaccactacgacatggacatgatccgggactgcgccgagaaggtggcgtctcactggcaacagctcatgctcaagatggaagatcgcctcaagctcgtcaacgcctctgtcgctttctacaaaacctcagagcaggtctgcagcgtcctcgagagcctggaacaggagtacaagagagaagaagactggtgtggcggggcggataagctgggcccaaactctgagacggaccacgtgacgcccatgatcagcaagcacctggagcagaaggaggcattcctgaaggcttgcacccttgctcggaggaatgcagacgtcttcctgaaatacctgcacaggaacagcgtgaacatgccaggaatggtgacgcacatcaaagctcctgaacagcaagtgaaaaatatcttgaatgaactcttccaacgggagaacagggtattgcattactggaccatgaggaagagacggctggaccagtgtcagcagtacgtggtctttgagaggagtgccaagcaggctttggaatggatccatgacaatggcgagttctacctttccacacacacctccacgggctccagtatacagcacacccaggagctcctgaaagagcacgaggagttccagataactgcaaagcaaaccaaagagagagtgaagctattgatacagctggctgatggcttttgtgaaaaagggcatgcccatgcggcagagataaaaaaatgtgttactgctgtggataagaggtacagagatttctctctgcggatggagaagtacaggacctctttggaaaaagccctggggatttcttcagattccaacaaatcgagtaaaagtctccagctagatatcattccagccagtatccctggctcagaggtgaaacttcgagatgctgctcatgaacttaatgaagagaagcggaaatctgcccgcaggaaagagttcataatggctgagctcattcaaactgaaaaggcttatgtaagagacctccgggaatgtatggatacgtacctgtgggaaatgaccagtggcgtggaagagattccacctggcattgtaaacaaagaactcatcatcttcggaaacatgcaagaaatctacgaatttcataataacatattcctaaaggagctggaaaaatatgaacagttgccagaggatgttggacattgttttgttacttgggcagacaagtttcagatgtatgtcacatattgcaaaaataagcctgattctactcagctgatattggaacatgcagggtcctattttgacgagatacagcagcgacatggattagccaattccatttcttcctaccttattaaaccagttcagcgaataacgaagtatcagctccttttaaaagagctgctgacgtgctgtgaggaaggaaagggagagattaaagatggcctggaggtgatgctcagcgtgccgaagcgagccaatgatgccatgcacctcagcatgctggaagggtttgatgaaaacattgagtctcagggagaactcatcctacaggaatccttccaagtgtgggacccaaaaaccttaattcgaaagggtcgagaacggcatctcttcctttttgaaatgtccttagtatttagtaaagaagtgaaagattccagtgggagaagcaagtacctttataaaagcaaattgtttacctcagagttgggtgtcacagaacatgttgaaggagacccttgcaaatttgcactgtgggtggggagaacaccaacttcagataataaaattgtccttaaggcttccagcatagagaacaagcaggactggataaagcatatccgcgaagtcatccaggagcggacgatccacctgaagggagccctgaaggagcccattcacatccctaagaccgctcccgccacaagacagaagggaaggagggatggagaggatctggacagccaaggagacggcagcagccagcctgatacgatttccatcgcctcacggacgtctcagaacacgctggacagcgataagctctctggtggctgtgagctgacagtggtgatccatgacttcaccgcttgcaacagcaacgagctgaccatccgacggggccagaccgtggaagttctggagcggccgcatgacaagcctgactggtgtctggtgcggacaactgaccgctccccagcggcagaaggcctggtcccctgtggttcactgtgcatcgcccactccagaagtagcatggaaatggagggcatcttcaaccacaaagactcgctctccgtctccagcaatgacgccagtccacccgcatccgtggcttccctccagccccacatgatcggggcccagagctcgccgggccccaagcggccgggcaacaccctgcgcaagtggctcaccagccccgtgcggcggctcagcagcggcaaggccgacgggcacgtgaagaagctggcgcacaagcacaagaagagccgcgaggtccgcaagagcgccgacgccggctcgcagaaggactccgacgacagtgcggccaccccgcaggacgagacggtcgaggagagaggccggaacgagggcctgagcagcggtactctctccaaatcctcctcctcggggatgcagagctgtggagaagaggaaggcgaggagggggccgacgccgtgcccctgccgccacccatggccatccagcagcacagcctcctccagccagactcacaggatgacaaggcctcttctcggttattagtccgccccaccagctccgaaacaccgagtgcagccgagctcgtcagtgcaattgaggaactcgtgaaaagcaagatggcactggaggatcgccccagctcactccttgttgaccagggagatagtagcagcccttccttcaacccttcggataattcccttctctcttcctcctcgcccattgatgagatggaagaaaggaaatccagctctttaaagagaagacactacgttttgcaagaactagtggagacagagcgtgactatgtgcgggaccttggctatgtggttgagggctacatggcacttatgaaagaagatggtgttcctgatgacatgaaaggaaaagacaaaattgtgttcggcaacatccatcagatttacgactggcacagagacttttttttaggagagttagagaagtgccttgaagatccagaaaaactaggatccctttttgttaaacacgagagaaggttgcacatgtacatagcttattgtcaaaataaaccaaagtctgagcacattgtctcagaatacattgataccttttttgaggacttaaagcagcgtcttggccacaggttacagctcacagatctgttgatcaaaccagtgcagagaatcatgaagtatcagctgttactgaaggacttcctcaagtattccaaaaaggccagcctggatacatcagaattagagagagctgtggaagtcatgtgcatagtacccaggcggtgcaacgacatgatgaacgtggggcggctgcaaggattcgacgggaaaatcgttgcccagggtaaactgctcttgcaggacacattcttggtcacagaccaagatgcaggacttctgcctcgctgcagagagaggcgcatcttcctctttgagcagatcgtcatattcagcgaaccacttgataaaaagaagggcttctccatgccgggattcctgtttaagaacagtatcaaggtgagttgcctttgcctggaggaaaatgtggaaaatgatccctgtaaatttgctctgacatcgaggacgggtgacgtggtagagaccttcattttgcattcatctagtccaagtgtccggcaaacttggatccatgaaatcaaccaaattttagaaaaccagcgcaattttttaaatgccttgacatcgccaatcgagtaccagaggaaccacagcgggggcggcggcggcggcggcagcgggggcagcggcgggggtgggggcagcggcggcggcggggcccccagtggcggcagcggccacagtggcggccccagcagctgcggcggcgcccccagcacgagcaggagccggccctcccggatcccccagcctgtccgacaccacccccccgtgctggtctcctctgcagcctcgagccaggcagaggcagacaagatgtcaggtacgtccacccccgggccctccctgcctccccctggcgcggcccccgaggccggccccagcgcgcccagcaggcggccccccggcgcggacgccgaggggtccgagcgagaagcggagccgatccccaagatgaaggtgctggagagccccaggaaaggcgccgcgaacgcctcggggtcgagcccagacgcccccgccaaggacgcgcgcgctagcctgggcaccctgccgcttgggaagccccgggccggggccgcttcgccgctgaactcgccgctctccagcgcggtcccttctctcggcaaggagcccttcccccccagcagccccctgcagaaggggggctccttctggagctccatccccgcctcccccgccagccgacccggctccttcaccttcccgggggacagcgactccctccagcggcagacaccccgccacgcggcccctggcaaggatactgaccgcatgagcacgtgctcctcggccagcgagcagtccgtgcagtccacccagagcaacgggagtgaaagcagcagcagtagcaacatctccaccatgttggtgacacacgattacacggcagtgaaggaggatgagatcaacgtctaccaaggagaggtcgttcaaattctggccagcaaccagcagaacatgtttctggtgttccgagccgccactgaccagtgccccgcagctgagggctggattccaggctttgtcctgggccacaccagtgcagtcatcgtggagaacccggacgggactctcaagaagtcaacatcttggcacacagcactccgtttaaggaaaaaatctgagaaaaaagataaagacggcaaaagggaaggcaagttagagaacggttatcggaagtcacgggaaggactcagcaacaaggtatctgtgaagcttctcaatcccaactacatttatgacgttcccccagaattcgtcattccattgagtgaggtcacgtgtgagacaggggagaccgttgttcttagatgtcgagtctgtggccgccccaaagcctcaattacctggaagggccctgaacacaacaccttgaacaacgatggtcactacagcatctcctacagtgacctgggagaggccacgctgaagattgtgggcgtgaccacggaagatgacggcatctacacgtgcatcgctgtcaatgacatgggttcagcctcatcgtcggccagcctgagggtcctaggtccagggatggatgggatcatggtgacctggaaagacaactttgactccttctacagtgaagtggctgagcttggcaggggcagattctctgtcgttaagaaatgtgatcagaaaggaaccaagcgagcagtggccactaagtttgtgaacaagaagttgatgaagcgcgaccaggtcacccatgagcttggcatcctgcagagcctccagcaccccctgcttgtcggcctcctcgacacctttgagacccccaccagctacatcctggtcttagaaatggctgaccagggtcgcctcctggactgcgtggtgcgatggggaagcctcactgaagggaagatcagggcgcacctgggggaggttctggaagctgtccggtacctgcacaactgcaggatagcacacctggacctaaagcctgagaatatcctggtggatgagagtttagccaagccaaccatcaaactggctgactttggagatgctgttcagctcaacacgacctactacatccaccagttactggggaaccctgaattcgcagcccctgaaatcatcctcgggaaccctgtctccctgacctcggatacgtggagtgttggagtgctcacatacgtacttcttagtggcgtgtcccccttcctggatgacagtgtggaagagacctgcctgaacatttgccgcttagactttagcttcccagatgactactttaaaggagtgagccagaaggccaaggagttcgtgtgcttcctcctgcaggaggaccccgccaagcgtccctcggctgcgctggccctccaggagcagtggctgcaggccggcaacggcagaagcacgggcgtcctcgacacgtccagactgacttccttcattgagcggcgcaaacaccagaatgatgttcgacctatccgtagcattaaaaactttctgcagagcaggcttctgcctagagtttgacctatccagaagttctttctcattctctttcacctgccaatcagctgttaatctgaattttcaagagaaaacaagcaaacataactgatcagctgccggtatgttcatcgtgtgaaattgcattccaagtgagctgtgctcagcagtgcttggacacagagctgcaagctgcgctggggtggaggaccgtcacttacactctgcccaaggcagaggtcgcattgctgtatcacagtattttattcaggtttctgcaaaaaaataaaaagataacttttttaaacaaacatgaatagaattttgcaaatttaacgttttcaagatttattcaaggaaacaaaatgcctatgttcaaccactggtgttaatgaacaaagatactgtgcgtctctggggaagacgcacctaggtggcggccactcccatggccttgtctaggactcagagaccactcggctctgagcttccaggcgcctcgtctgtgtgcatctcacgcccgacgtggcttctgaaacgtgcattcaacctcaaacttttgcataaaatagaatgaatcgttttgctctgatgaaatgtaggccttacttgtatataagactgttcctgccttcggtctgtcattttcccacctgcctcccctacccaccccccacccaccacctggggcttcctctgggggtccgagggtcttcccatcacatgaagacatcaggttgggtcctgccccactgcccctccccctgttcctgccccaagccgtcaatcagattgtggagcagtacacagtcagatgaaaatactgtaaatgcactcattgggggttttttggttttacttcatatcatgtgcaatgttgtggctttaacattttatgcaactatttatgaagacctctgttgtacctgtaataaatatatagaaaaagcacatacttcgtatggtgagctttatggttttgtgtgtgtgttggggttggcgggtgggtgggtagggtcgtagccctgtgccatcggttcaaagagacttttcgtgaaatttgttggttttgaggactgtaaaagtgatttcatactctgaatataaaactggataatagggtaatgttttaaaatttattatgctattattcagaatgccaaagtattattttttttcccaaaatcagtctggacatttactactttttagactttttgacgttgaactttctgtataaaaattggctgggttttgagcttttggtaagaaataaaagccgattaagcactggccgccccgcggctggtacccaatgcccgagtcactgtggcagcattcgcactggtgtggggagtcctttcaactcaaggaggctgggtttctgggcaccctcgaagttttctggatgtctttttatctttctcgtgtgaactgcactacaaaagagaccagcccgcttcccaagccagccagacacctgggtcttgagccataaactggcgtagttaagctttgcagcttccagtgtattttatttattcttttgttgggtttttgtttgtttcttcttgtaaaattgtacagaaactttttaaaagaaattggattcgaaactggatgtgtattcgtaacctcataatttttatttgtgtattgtttcttttattatttcagttaaatttttacattattttgcatgtatatttctttgtacagagaccttacatgtttacacagtatgatgtgatgtaaatattttattttgccatcagttattttaaaaaattaaacatatttgcctga

SEQ ID NO: 32777 - DNA, 7993 bp, Homo sapiens
attaaggcccccatcgaggacctggatttggagggacagaagctgcttcagaggatacagagcagtgaaagctttcccaaaaagaactcaggctcaggcaatgcggacctgcagaacctcttgcccaaggtgtccaccatgctggaccggctgcactcgacacggcagcatctgcaccagatgtggcatgtgaggaagctgaagctggaccagtgcttccagctgaggctgtttgaacaggatgctgagaagatgtttgactggatcacacacaacaaaggcctgtttctaaacagctacacagagattgggaccagccaccctcatgccatggagcttcagacgcagcacaatcactttgccatgaactgtatgaacgtgtatgtaaatataaaccgcatcatgtcggtggccaatcgtctggtggagtctggccactatgcctcgcagcagatcaggcagatcgcgagtcagctggagcaggagtggaaggcgtttgcggcagccctggatgagcggagcaccttgctggacatgtcctccattttccaccagaaggccgaaaagtatatgagcaacgtggattcatggtgtaaagcttgcggtgaggtagaccttccctcagagctgcaggacctagaagatgccattcatcaccaccagggaatatatgaacatatcactcttgcttattctgaggtcagccaagatgggaagtcgctccttgacaagctccagcggcccttgactcccggcagctccgattccctgacagcctctgccaactactccaaggccgtgcaccatgtcctggatgtcatccacgaggtgctgcaccaccagcggcagctggagaacatctggcaacaccgcaaggtccggctgcatcagaggctgcagctgtgtgttttccagcaggacgttcagcaggtgctagactggatcgagaaccacggagaagcatttctgagcaaacatacaggtgtggggaaatctcttcatcgggccagagcattgcagaaacgtcatgaagattttgaagaagtggcacagaacacatacaccaatgcggataaattactggaagcagcagaacagctggctcagactggggaatgtgaccccgaagagatttatcaggctgcccatcagctggaagaccggattcaagatttcgttcggcgtgttgagcagcgaaagatcctactggacatgtcagtgtcctttcacacccatgtgaaagagctgtggacgtggctggaggagctgcagaaggagctgctggacgacgtgtatgccgagtcggtggaggccgtgcaggacctcatcaagcgctttggccagcagcagcagaccaccctgcaggtgactgtcaacgtgatcaaggaaggggaggacctcatccagcagctcagggactctgccatctccagtaacaagaccccccacaacagctccatcaaccacattgagacggtgctgcagcagctggacgaggcgcagtcgcagatggaggagctcttccaggagcgcaagatcaagctggagctcttcctgcagctgcgcatcttcgagagggacgccatcgacattatctcagacctcgagtcttggaatgatgagctttctcagcaaatgaatgacttcgacacagaagatctcacgattgcagagcagcgcctccagcaccatgcagacaaagccttgaccatgaacaacttgacttttgacgtcatccaccaagggcaagatcttctgcagtatgtcaatgaggtccaggcctctggtgtggagctgctgtgtgatagagatgtagacatggcaactcgggtccaggacctgctggagtttcttcatgaaaaacagcaggaattggatttagccgcagagcagcatcggaaacacctggagcagtgcgtgcagctgcgccacctgcaggcagaagtgaaacaggtgctgggttggatccgcaacggagagtccatgttaaatgccggacttatcacagccagctcgttacaagaggcagagcagctccagcgagagcacgagcagttccagcatgccattgagaaaacacatcagagcgcgctgcaggtgcagcagaaggcagaagccatgctacaggccaaccactacgacatggacatgatccgggactgcgccgagaaggtggcgtctcactggcaacagctcatgctcaagatggaagatcgcctcaagctcgtcaacgcctctgtcgctttctacaaaacctcagagcaggtctgcagcgtcctcgagagcctggaacaggagtacaagagagaagaagactggtgtggcggggcggataagctgggcccaaactctgagacggaccacgtgacgcccatgatcagcaagcacctggagcagaaggaggcattcctgaaggcttgcacccttgctcggaggaatgcagacgtcttcctgaaatacctgcacaggaacagcgtgaacatgccaggaatggtgacgcacatcaaagctcctgaacagcaagtgaaaaatatcttgaatgaactcttccaacgggagaacagggtattgcattactggaccatgaggaagagacggctggaccagtgtcagcagtacgtggtctttgagaggagtgccaagcaggctttggaatggatccatgacaatggcgagttctacctttccacacacacctccacgggctccagtatacagcacacccaggagctcctgaaagagcacgaggagttccagataactgcaaagcaaaccaaagagagagtgaagctattgatacagctggctgatggcttttgtgaaaaagggcatgcccatgcggcagagataaaaaaatgtgttactgctgtggataagaggtacagagatttctctctgcggatggagaagtacaggacctctttggaaaaagccctggggatttcttcagattccaacaaatcgagtaaaagtctccagctagatatcattccagccagtatccctggctcagaggtgaaacttcgagatgctgctcatgaacttaatgaagagaagcggaaatctgcccgcaggaaagagttcataatggctgagctcattcaaactgaaaaggcttatgtaagagacctccgggaatgtatggatacgtacctgtgggaaatgaccagtggcgtggaagagattccacctggcattgtaaacaaagaactcatcatcttcggaaacatgcaagaaatctacgaatttcataataacatattcctaaaggagctggaaaaatatgaacagttgccagaggatgttggacattgttttgttacttgggcagacaagtttcagatgtatgtcacatattgcaaaaataagcctgattctactcagctgatattggaacatgcagggtcctattttgacgagatacagcagcgacatggattagccaattccatttcttcctaccttattaaaccagttcagcgaataacgaagtatcagctccttttaaaagagctgctgacgtgctgtgaggaaggaaagggagagattaaagatggcctggaggtgatgctcagcgtgccgaagcgagccaatgatgccatgcacctcagcatgctggaagggtttgatgaaaacattgagtctcagggagaactcatcctacaggaatccttccaagtgtgggacccaaaaaccttaattcgaaagggtcgagaacggcatctcttcctttttgaaatgtccttagtatttagtaaagaagtgaaagattccagtgggagaagcaagtacctttataaaagcaaattgtttacctcagagttgggtgtcacagaacatgttgaaggagacccttgcaaatttgcactgtgggtggggagaacaccaacttcagataataaaattgtccttaaggcttccagcatagagaacaagcaggactggataaagcatatccgcgaagtcatccaggagcggacgatccacctgaagggagccctgaaggagcccattcacatccctaagaccgctcccgccacaagacagaagggaaggagggatggagaggatctggacagccaaggagacggcagcagccagcctgatacgatttccatcgcctcacggacgtctcagaacacgctggacagcgataagctctctggtggctgtgagctgacagtggtgatccatgacttcaccgcttgcaacagcaacgagctgaccatccgacggggccagaccgtggaagttctggagcggccgcatgacaagcctgactggtgtctggtgcggacaactgaccgctccccagcggcagaaggcctggtcccctgtggttcactgtgcatcgcccactccagaagtagcatggaaatggagggcatcttcaaccacaaagactcgctctccgtctccagcaatgacgccagtccacccgcatccgtggcttccctccagccccacatgatcggggcccagagctcgccgggccccaagcggccgggcaacaccctgcgcaagtggctcaccagccccgtgcggcggctcagcagcggcaaggccgacgggcacgtgaagaagctggcgcacaagcacaagaagagccgcgaggtccgcaagagcgccgacgccggctcgcagaaggactccgacgacagtgcggccaccccgcaggacgagacggtcgaggagagaggccggaacgagggcctgagcagcggtactctctccaaatcctcctcctcggggatgcagagctgtggagaagaggaaggcgaggagggggccgacgccgtgcccctgccgccacccatggccatccagcagcacagcctcctccagccagactcacaggatgacaaggcctcttctcggttattagtccgccccaccagctccgaaacaccgagtgcagccgagctcgtcagtgcaattgaggaactcgtgaaaagcaagatggcactggaggatcgccccagctcactccttgttgaccagggagatagtagcagcccttccttcaacccttcggataattcccttctctcttcctcctcgcccattgatgagatggaagaaaggaaatccagctctttaaagagaagacactacgttttgcaagaactagtggagacagagcgtgactatgtgcgggaccttggctatgtggttgagggctacatggcacttatgaaagaagatggtgttcctgatgacatgaaaggaaaagacaaaattgtgttcggcaacatccatcagatttacgactggcacagagacttttttttaggagagttagagaagtgccttgaagatccagaaaaactaggatccctttttgttaaacacgagagaaggttgcacatgtacatagcttattgtcaaaataaaccaaagtctgagcacattgtctcagaatacattgataccttttttgaggacttaaagcagcgtcttggccacaggttacagctcacagatctgttgatcaaaccagtgcagagaatcatgaagtatcagctgttactgaaggacttcctcaagtattccaaaaaggccagcctggatacatcagaattagagagagctgtggaagtcatgtgcatagtacccaggcggtgcaacgacatgatgaacgtggggcggctgcaaggattcgacgggaaaatcgttgcccagggtaaactgctcttgcaggacacattcttggtcacagaccaagatgcaggacttctgcctcgctgcagagagaggcgcatcttcctctttgagcagatcgtcatattcagcgaaccacttgataaaaagaagggcttctccatgccgggattcctgtttaagaacagtatcaaggtgagttgcctttgcctggaggaaaatgtggaaaatgatccctgtaaatttgctctgacatcgaggacgggtgacgtggtagagaccttcattttgcattcatctagtccaagtgtccggcaaacttggatccatgaaatcaaccaaattttagaaaaccagcgcaattttttaaatgccttgacatcgccaatcgagtaccagaggaaccacagcgggggcggcggcggcggcggcagcgggggcagcggcgggggtgggggcagcggcggcggcggggcccccagtggcggcagcggccacagtggcggccccagcagctgcggcggcgcccccagcacgagcaggagccggccctcccggatcccccagcctgtccgacaccacccccccgtgctggtctcctctgcagcctcgagccaggcagaggcagacaagatgtcaggtacgtccacccccgggccctccctgcctccccctggcgcggcccccgaggccggccccagcgcgcccagcaggcggccccccggcgcggacgccgaggggtccgagcgagaagcggagccgatccccaagatgaaggtgctggagagccccaggaaaggcgccgcgaacgcctcggggtcgagcccagacgcccccgccaaggacgcgcgcgctagcctgggcaccctgccgcttgggaagccccgggccggggccgcttcgccgctgaactcgccgctctccagcgcggtcccttctctcggcaaggagcccttcccccccagcagccccctgcagaaggggggctccttctggagctccatccccgcctcccccgccagccgacccggctccttcaccttcccgggggacagcgactccctccagcggcagacaccccgccacgcggcccctggcaaggatactgaccgcatgagcacgtgctcctcggccagcgagcagtccgtgcagtccacccagagcaacgggagtgaaagcagcagcagtagcaacatctccaccatgttggtgacacacgattacacggcagtgaaggaggatgagatcaacgtctaccaaggagaggtcgttcaaattctggccagcaaccagcagaacatgtttctggtgttccgagccgccactgaccagtgccccgcagctgagggctggattccaggctttgtcctgggccacaccagtgcagtcatcgtggagaacccggacgggactctcaagaagtcaacatcttggcacacagcactccgtttaaggaaaaaatctgagaaaaaagataaagacggcaaaagggaaggcaagttagagaacggttatcggaagtcacgggaaggactcagcaacaaggtatctgtgaagcttctcaatcccaactacatttatgacgttcccccagaattcgtcattccattgagtgaggtcacgtgtgagacaggggagaccgttgttcttagatgtcgagtctgtggccgccccaaagcctcaattacctggaagggccctgaacacaacaccttgaacaacgatggtcactacagcatctcctacagtgacctgggagaggccacgctgaagattgtgggcgtgaccacggaagatgacggcatctacacgtgcatcgctgtcaatgacatgggttcagcctcatcgtcggccagcctgagggtcctaggtccagggatggatgggatcatggtgacctggaaagacaactttgactccttctacagtgaagtggctgagcttggcagggcaaactggaacaactggtcaccctactaacctgtaaactgggaataactggcatttgtgcagaatggctcccaggttcctgatgcccagcggcactctacagacattgccaggtctgtctgcaaatccacggtgcttggccggatgctgtttgaagtgtgcactttagagaagaaaaggggcggggtgtcatttcccacacacaagccgctagtccttatggaaactcttccaacgaaggtggatggaaacttttccaacgaaggtgatgtttttgaaacccagcttttatttggacaaagccttcttgaaaaatccttgaaaatgctttctgtttttaataaaggagatctctggaacatttccatgagctttcatagca

SEQ ID NO: 32778 - DNA, 9689 bp, Homo sapiens
gcagccatgagcggcagcagcggcggagccgccgcccccgccgcgtcctccggccccgccgcggcggccagcgcggctggctcgggctgcgggggcggtgccggcgagggggcagaggaggcggccaaggacctggccgacatcgcggccttcttccgatccgggtttcgaaaaaacgatgaaatgaaagctatggatgttttaccaattttgaaggaaaaagttgcatacctttcaggtgggagagataaacgtggaggtcccattttaacgtttccggcccgcagcaatcatgacagaatacgacaggaggatctcaggagactcatttcctatctagcctgtattcccagcgaggaggtctgcaagcgtggcttcacggtgatcgtggacatgcgtgggtccaagtgggactccatcaagccccttctgaagatcctgcaggagtccttcccctgctgcatccatgtggccctgatcatcaagccagacaacttctggcagaaacagaggactaattttggcagttctaaatttgaatttgagacaaatatggtctctttagaaggccttaccaaagtagttgatccttctcagctaactcctgagtttgatggctgcctggaatacaaccacgaagaatggattgaaatcagagttgcttttgaagactacattagcaatgccacccacatgctgtctcggctggaggaacttcaggacatcctagctaagaaggagctgcctcaggatttagagggggctcggaatatgatcgaggaacattctcagctgaagaagaaggtgattaaggcccccatcgaggacctggatttggagggacagaagctgcttcagaggatacagagcagtgaaagctttcccaaaaagaactcaggctcaggcaatgcggacctgcagaacctcttgcccaaggtgtccaccatgctggaccggctgcactcgacacggcagcatctgcaccagatgtggcatgtgaggaagctgaagctggaccagtgcttccagctgaggctgtttgaacaggatgctgagaagatgtttgactggatcacacacaacaaaggcctgtttctaaacagctacacagagattgggaccagccaccctcatgccatggagcttcagacgcagcacaatcactttgccatgaactgtatgaacgtgtatgtaaatataaaccgcatcatgtcggtggccaatcgtctggtggagtctggccactatgcctcgcagcagatcaggcagatcgcgagtcagctggagcaggagtggaaggcgtttgcggcagccctggatgagcggagcaccttgctggacatgtcctccattttccaccagaaggccgaaaagtatatgagcaacgtggattcatggtgtaaagcttgcggtgaggtagaccttccctcagagctgcaggacctagaagatgccattcatcaccaccagggaatatatgaacatatcactcttgcttattctgaggtcagccaagatgggaagtcgctccttgacaagctccagcggcccttgactcccggcagctccgattccctgacagcctctgccaactactccaaggccgtgcaccatgtcctggatgtcatccacgaggtgctgcaccaccagcggcagctggagaacatctggcaacaccgcaaggtccggctgcatcagaggctgcagctgtgtgttttccagcaggacgttcagcaggtgctagactggatcgagaaccacggagaagcatttctgagcaaacatacaggtgtggggaaatctcttcatcgggccagagcattgcagaaacgtcatgaagattttgaagaagtggcacagaacacatacaccaatgcggataaattactggaagcagcagaacagctggctcagactggggaatgtgaccccgaagagatttatcaggctgcccatcagctggaagaccggattcaagatttcgttcggcgtgttgagcagcgaaagatcctactggacatgtcagtgtcctttcacacccatgtgaaagagctgtggacgtggctggaggagctgcagaaggagctgctggacgacgtgtatgccgagtcggtggaggccgtgcaggacctcatcaagcgctttggccagcagcagcagaccaccctgcaggtgactgtcaacgtgatcaaggaaggggaggacctcatccagcagctcagggactctgccatctccagtaacaagaccccccacaacagctccatcaaccacattgagacggtgctgcagcagctggacgaggcgcagtcgcagatggaggagctcttccaggagcgcaagatcaagctggagctcttcctgcagctgcgcatcttcgagagggacgccatcgacattatctcagacctcgagtcttggaatgatgagctttctcagcaaatgaatgacttcgacacagaagatctcacgattgcagagcagcgcctccagcaccatgcagacaaagccttgaccatgaacaacttgacttttgacgtcatccaccaagggcaagatcttctgcagtatgtcaatgaggtccaggcctctggtgtggagctgctgtgtgatagagatgtagacatggcaactcgggtccaggacctgctggagtttcttcatgaaaaacagcaggaattggatttagccgcagagcagcatcggaaacacctggagcagtgcgtgcagctgcgccacctgcaggcagaagtgaaacaggtgctgggttggatccgcaacggagagtccatgttaaatgccggacttatcacagccagctcgttacaagaggcagagcagctccagcgagagcacgagcagttccagcatgccattgagaaaacacatcagagcgcgctgcaggtgcagcagaaggcagaagccatgctacaggccaaccactacgacatggacatgatccgggactgcgccgagaaggtggcgtctcactggcaacagctcatgctcaagatggaagatcgcctcaagctcgtcaacgcctctgtcgctttctacaaaacctcagagcaggtctgcagcgtcctcgagagcctggaacaggagtacaagagagaagaagactggtgtggcggggcggataagctgggcccaaactctgagacggaccacgtgacgcccatgatcagcaagcacctggagcagaaggaggcattcctgaaggcttgcacccttgctcggaggaatgcagacgtcttcctgaaatacctgcacaggaacagcgtgaacatgccaggaatggtgacgcacatcaaagctcctgaacagcaagtgaaaaatatcttgaatgaactcttccaacgggagaacagggtattgcattactggaccatgaggaagagacggctggaccagtgtcagcagtacgtggtctttgagaggagtgccaagcaggctttggaatggatccatgacaatggcgagttctacctttccacacacacctccacgggctccagtatacagcacacccaggagctcctgaaagagcacgaggagttccagataactgcaaagcaaaccaaagagagagtgaagctattgatacagctggctgatggcttttgtgaaaaagggcatgcccatgcggcagagataaaaaaatgtgttactgctgtggataagaggtacagagatttctctctgcggatggagaagtacaggacctctttggaaaaagccctggggatttcttcagattccaacaaatcgagtaaaagtctccagctagatatcattccagccagtatccctggctcagaggtgaaacttcgagatgctgctcatgaacttaatgaagagaagcggaaatctgcccgcaggaaagagttcataatggctgagctcattcaaactgaaaaggcttatgtaagagacctccgggaatgtatggatacgtacctgtgggaaatgaccagtggcgtggaagagattccacctggcattgtaaacaaagaactcatcatcttcggaaacatgcaagaaatctacgaatttcataataacatattcctaaaggagctggaaaaatatgaacagttgccagaggatgttggacattgttttgttacttgggcagacaagtttcagatgtatgtcacatattgcaaaaataagcctgattctactcagctgatattggaacatgcagggtcctattttgacgagatacagcagcgacatggattagccaattccatttcttcctaccttattaaaccagttcagcgaataacgaagtatcagctccttttaaaagagctgctgacgtgctgtgaggaaggaaagggagagattaaagatggcctggaggtgatgctcagcgtgccgaagcgagccaatgatgccatgcacctcagcatgctggaagggtttgatgaaaacattgagtctcagggagaactcatcctacaggaatccttccaagtgtgggacccaaaaaccttaattcgaaagggtcgagaacggcatctcttcctttttgaaatgtccttagtatttagtaaagaagtgaaagattccagtgggagaagcaagtacctttataaaagcaaattgtttacctcagagttgggtgtcacagaacatgttgaaggagacccttgcaaatttgcactgtgggtggggagaacaccaacttcagataataaaattgtccttaaggcttccagcatagagaacaagcaggactggataaagcatatccgcgaagtcatccaggagcggacgatccacctgaagggagccctgaaggagcccattcacatccctaagaccgctcccgccacaagacagaagggaaggagggatggagaggatctggacagccaaggagacggcagcagccagcctgatacgatttccatcgcctcacggacgtctcagaacacgctggacagcgataagctctctggtggctgtgagctgacagtggtgatccatgacttcaccgcttgcaacagcaacgagctgaccatccgacggggccagaccgtggaagttctggagcggccgcatgacaagcctgactggtgtctggtgcggacaactgaccgctccccagcggcagaaggcctggtcccctgtggttcactgtgcatcgcccactccagaagtagcatggaaatggagggcatcttcaaccacaaagactcgctctccgtctccagcaatgacgccagtccacccgcatccgtggcttccctccagccccacatgatcggggcccagagctcgccgggccccaagcggccgggcaacaccctgcgcaagtggctcaccagccccgtgcggcggctcagcagcggcaaggccgacgggcacgtgaagaagctggcgcacaagcacaagaagagccgcgaggtccgcaagagcgccgacgccggctcgcagaaggactccgacgacagtgcggccaccccgcaggacgagacggtcgaggagagaggccggaacgagggcctgagcagcggtactctctccaaatcctcctcctcggggatgcagagctgtggagaagaggaaggcgaggagggggccgacgccgtgcccctgccgccacccatggccatccagcagcacagcctcctccagccagactcacaggatgacaaggcctcttctcggttattagtccgccccaccagctccgaaacaccgagtgcagccgagctcgtcagtgcaattgaggaactcgtgaaaagcaagatggcactggaggatcgccccagctcactccttgttgaccagggagatagtagcagcccttccttcaacccttcggataattcccttctctcttcctcctcgcccattgatgagatggaagaaaggaaatccagctctttaaagagaagacactacgttttgcaagaactagtggagacagagcgtgactatgtgcgggaccttggctatgtggttgagggctacatggcacttatgaaagaagatggtgttcctgatgacatgaaaggaaaagacaaaattgtgttcggcaacatccatcagatttacgactggcacagagacttttttttaggagagttagagaagtgccttgaagatccagaaaaactaggatccctttttgttaaacacgagagaaggttgcacatgtacatagcttattgtcaaaataaaccaaagtctgagcacattgtctcagaatacattgataccttttttgaggacttaaagcagcgtcttggccacaggttacagctcacagatctgttgatcaaaccagtgcagagaatcatgaagtatcagctgttactgaaggacttcctcaagtattccaaaaaggccagcctggatacatcagaattagagagagctgtggaagtcatgtgcatagtacccaggcggtgcaacgacatgatgaacgtggggcggctgcaaggattcgacgggaaaatcgttgcccagggtaaactgctcttgcaggacacattcttggtcacagaccaagatgcaggacttctgcctcgctgcagagagaggcgcatcttcctctttgagcagatcgtcatattcagcgaaccacttgataaaaagaagggcttctccatgccgggattcctgtttaagaacagtatcaaggtgagttgcctttgcctggaggaaaatgtggaaaatgatccctgtaaatttgctctgacatcgaggacgggtgacgtggtagagaccttcattttgcattcatctagtccaagtgtccggcaaacttggatccatgaaatcaaccaaattttagaaaaccagcgcaattttttaaatgccttgacatcgccaatcgagtaccagaggaaccacagcgggggcggcggcggcggcggcagcgggggcagcggcgggggtgggggcagcggcggcggcggggcccccagtggcggcagcggccacagtggcggccccagcagctgcggcggcgcccccagcacgagcaggagccggccctcccggatcccccagcctgtccgacaccacccccccgtgctggtctcctctgcagcctcgagccaggcagaggcagacaagatgtcagaaagtgaaagcagcagcagtagcaacatctccaccatgttggtgacacacgattacacggcagtgaaggaggatgagatcaacgtctaccaaggagaggtcgttcaaattctggccagcaaccagcagaacatgtttctggtgttccgagccgccactgaccagtgccccgcagctgagggctggattccaggctttgtcctgggccacaccagtgcagtcatcgtggagaacccggacgggactctcaagaagtcaacatcttggcacacagcactccgtttaaggaaaaaatctgagaaaaaagataaagacggcaaaagggaaggcaagttagagaacggttatcggaagtcacgggaaggactcagcaacaaggtatctgtgaagcttctcaatcccaactacatttatgacgttcccccagaattcgtcattccattgagtgaggtcacgtgtgagacaggggagaccgttgttcttagatgtcgagtctgtggccgccccaaagcctcaattacctggaagggccctgaacacaacaccttgaacaacgatggtcactacagcatctcctacagtgacctgggagaggccacgctgaagattgtgggcgtgaccacggaagatgacggcatctacacgtgcatcgctgtcaatgacatgggttcagcctcatcgtcggccagcctgagggtcctaggtccagggatggatgggatcatggtgacctggaaagacaactttgactccttctacagtgaagtggctgagcttggcaggggcagattctctgtcgttaagaaatgtgatcagaaaggaaccaagcgagcagtggccactaagtttgtgaacaagaagttgatgaagcgcgaccaggtcacccatgagcttggcatcctgcagagcctccagcaccccctgcttgtcggcctcctcgacacctttgagacccccaccagctacatcctggtcttagaaatggctgaccagggtcgcctcctggactgcgtggtgcgatggggaagcctcactgaagggaagatcagggcgcacctgggggaggttctggaagctgtccggtacctgcacaactgcaggatagcacacctggacctaaagcctgagaatatcctggtggatgagagtttagccaagccaaccatcaaactggctgactttggagatgctgttcagctcaacacgacctactacatccaccagttactggggaaccctgaattcgcagcccctgaaatcatcctcgggaaccctgtctccctgacctcggatacgtggagtgttggagtgctcacatacgtacttcttagtggcgtgtcccccttcctggatgacagtgtggaagagacctgcctgaacatttgccgcttagactttagcttcccagatgactactttaaaggagtgagccagaaggccaaggagttcgtgtgcttcctcctgcaggaggaccccgccaagcgtccctcggctgcgctggccctccaggagcagtggctgcaggccggcaacggcagaagcacgggcgtcctcgacacgtccagactgacttccttcattgagcggcgcaaacaccagaatgatgttcgacctatccgtagcattaaaaactttctgcagagcaggcttctgcctagagtttgacctatccagaagttctttctcattctctttcacctgccaatcagctgttaatctgaattttcaagagaaaacaagcaaacataactgatcagctgccggtatgttcatcgtgtgaaattgcattccaagtgagctgtgctcagcagtgcttggacacagagctgcaagctgcgctggggtggaggaccgtcacttacactctgcccaaggcagaggtcgcattgctgtatcacagtattttattcaggtttctgcaaaaaaataaaaagataacttttttaaacaaacatgaatagaattttgcaaatttaacgttttcaagatttattcaaggaaacaaaatgcctatgttcaaccactggtgttaatgaacaaagatactgtgcgtctctggggaagacgcacctaggtggcggccactcccatggccttgtctaggactcagagaccactcggctctgagcttccaggcgcctcgtctgtgtgcatctcacgcccgacgtggcttctgaaacgtgcattcaacctcaaacttttgcataaaatagaatgaatcgttttgctctgatgaaatgtaggccttacttgtatataagactgttcctgccttcggtctgtcattttcccacctgcctcccctacccaccccccacccaccacctggggcttcctctgggggtccgagggtcttcccatcacatgaagacatcaggttgggtcctgccccactgcccctccccctgttcctgccccaagccgtcaatcagattgtggagcagtacacagtcagatgaaaatactgtaaatgcactcattgggggttttttggttttacttcatatcatgtgcaatgttgtggctttaacattttatgcaactatttatgaagacctctgttgtacctgtaataaatatat

SEQ ID NO: 32779 - DNA, 1547 bp, Homo sapiens
gagtgcagccgagctcgtcagtgcaattgaggaactcgtgaaaagcaagatggcactggaggatcgccccagctcactccttgttgaccagggagatagtagcagcccttccttcaacccttcggataattcccttctctcttcctcctcgcccattgatgagatggaagaaaggaaatccagctctttaaagagaagacactacgttttgcaagaactagtggagacagagcgtgactatgtgcgggaccttggctatgtggttgagggctacatggcacttatgaaagaagatggtgttcctgatgacatgaaaggaaaagacaaaattgtgttcggcaacatccatcagatttacgactggcacagagacttttttttaggagagttagagaagtgccttgaagatccagaaaaactaggatccctttttgttaaacacgagagaaggttgcacatgtacatagcttattgtcaaaataaaccaaagtctgagcacattgtctcagaatacattgataccttttttgaggacttaaagcagcgtcttggccacaggttacagctcacagatctgttgatcaaaccagtgcagagaatcatgaagtatcagctgttactgaaggacttcctcaagtattccaaaaaggccagcctggatacatcagaattagagagagctgtggaagtcatgtgcatagtacccaggcggtgcaacgacatgatgaacgtggggcggctgcaaggattcgacggtagggtcgtagccctgtgccatcggttcaaagagacttttcgtgaaatttgttggttttgaggactgtaaaagtgatttcatactctgaatataaaactggataatagggtaatgttttaaaatttattatgctattattcagaatgccaaagtattattttttttcccaaaatcagtctggacatttactactttttagactttttgacgttgaactttctgtataaaaattggctgggttttgagcttttggtaagaaataaaagccgattaagcactggccgccccgcggctggtacccaatgcccgagtcactgtggcagcattcgcactggtgtggggagtcctttcaactcaaggaggctgggtttctgggcaccctcgaagttttctggatgtctttttatctttctcgtgtgaactgcactacaaaagagaccagcccgcttcccaagccagccagacacctgggtcttgagccataaactggcgtagttaagctttgcagcttccagtgtattttatttattcttttgttgggtttttgtttgtttcttcttgtaaaattgtacagaaactttttaaaagaaattggattcgaaactggatgtgtattcgtaacctcataatttttatttgtgtattgtttcttttattatttcagttaaatttttacattattttgcatgtatatttctttgtacagagaccttacatgtttacacagtatgatgtgatgtaaatattttattttgccatcagttattttaaaaaattaaacatatttgcc

SEQ ID NO: 32780 - DNA, 1978 bp, Homo sapiens
gtcctgggtatgtccacgcgcaataaggaggggcgaaaggacatttttttttttcttgctcccgcctctgttcttcccccacctgccacgtacagagcccaagttctcgctaggcttgttgggtcagcgcgattggccggggcccgcgcgagcctgcgagcgaggtgcggcggtcgcgaagggcaaccgagggggccgtgaccaccgcctccccgcgacgccccagtccagtggcctcgcgtccgcccattcagcggagacctgcggagaggcggcggccgcggcctccgcaagccgtctttctctagagttgtatatatagaacatcctggagtccaccatgaacggacagttggatctaagtgggaagctaatcatcaaagctcaacttggggaggatattcggcgaattcctattcataatgaagatattacttatgatgaattagtgctaatgatgcaacgagttttcagaggaaaacttctgagtaatgatgaagtaacaataaagtataaagatgaagatggagatcttataacaatttttgatagttctgacctttcctttgcaattcagtgcagtaggatactgaaactgacattatttgttaatggccagccaagaccccttgaatcaagtcaggtgaaatatctccgtcgagaactgatagaacttcgaaataaagtgaatcgtttattggatagcttggaaccacctggagaaccaggaccttccaccaatattcctgaaaatgatactgtggatggtagggaagaaaagtctgcttctgattcttctggaaaacagtctactcaggttatggcagcaagtatgtctgcttttgatcctttaaaaaaccaagatgaaatcaataaaaatgttatgtcagcgtttggcttaacagatgatcaggtttcagggccacccagtgctcctgcagaagatcgttcaggaacacccgacagcattgcttcctcctcctcagcagctcacccaccaggcgttcagccacagcagccaccatatacaggagctcagactcaagcaggtcagattgaaggtcagatgtaccaacagtaccagcaacaggccggctatggtgcacagcagccgcaggctccacctcagcagcctcaacagtatggtattcagtattcagcaagctatagtcagcagactggacctcaacaacctcagcagttccagggatatggccagcaaccaacttcccaggcaccagctcctgccttttctggtcagcctcaacaactgcctgctcagccgccacagcagtaccaggcgagcaattatcctgcacaaacttacactgcccaaacttctcagcctactaattatactgtggctcctgcctctcaacctggaatggctccaagccaacctggggcctatcaaccaagaccaggttttacttcacttcctggaagtaccatgacccctcctccaagtgggcctaatccttatgcgcgtaaccgtcctccctttggtcagggctatacccaacctggacctggttatcgataaggaggctcctctacaccaattaatgtagctgctagctattggcctcccaaaagactccagtactattttaatttgtattgaagaagttcagaaatttaaaagcagagcattttttatgatatcattgttggtgttaattgaaagtataatttgctggaacacaaagaccaaaatgaaagttttttcctccctgcttaaaaatgtagcagcttcttagttactttggaacactactcttacatgtataaagtgattgacttgactttctagcttcccttgtccggaggatattaaaatgctagggtgaggtttagccatcttacttggctttttactattaacatgatgtactaaagtagagccctttgagaatacaagatattatgtataaaatgtaacactgatgataggttaataaagatgattgaatccatt

SEQ ID NO: 32781 - DNA, 1781 bp, Homo sapiens
ggcaaccgagggggccgtgaccaccgcctccccgcgacgccccagtccagtggcctcgcgtccgcccattcagcggagacctgcggagaggcggcggccgcggcctccgcaagccgtctttctctagagttgtatatatagaacatcctggagtccaccatgaacggacagttggatctaagtgggaagctaatcatcaaagctcaacttggggaggatattcggcgaattcctattcataatgaagatattacttatgatgaattagtgctaatgatgcaacgagttttcagaggaaaacttctgagtaatgatgaagtaacaataaagtataaagatgaagatggagatcttataacaatttttgatagttctgacctttcctttgcaattcagtgcagtaggatactgaaactgacattatttgttaatggccagccaagaccccttgaatcaagtcaggtgaaatatctccgtcgagaactgatagaacttcgaaataaagtgaatcgtttattggatagcttggaaccacctggagaaccaggaccttccaccaatattcctgaaaatgatactgtggatggtagggaagaaaagtctgcttctgattcttctggaaaacagtctactcaggttatggcagcaagtatgtctgcttttgatcctttaaaaaaccaagatgaaatcaataaaaatgttatgtcagcgtttggcttaacagatgatcaggtttcagggccacccagtgctcctgcagaagatcgttcaggaacacccgacagcattgcttcctcctcctcagcagctcacccaccaggcgttcagccacagcagccaccatatacaggagctcagactcaagcaggtcagatgtaccaacagtacagcaacaggccggctatggtgcacagcagccgcaggctccacctcagcagcctcaacagtatggtattcagtattcagcaagctatagtcagcagactggacctcaacaacctcagcagttccagggatatggccagcaaccaacttcccaggcaccagctcctgccttttctggtcagcctcaacaactgcctgctcagccgccacagcagtaccaggcgagcaattatcctgcacaaacttacactgcccaaacttctcagcctactaattatactgtggctcctgcctctcaacctggaatggctccaagccaacctggggcctatcaaccaagaccaggttttacttcacttcctggaagtaccatgacccctcctccaagtgggcctaatccttatgcgcgtaaccgtcctccctttggtcagggctatacccaacctggacctggttatcgataaggaggctcctctacaccaattaatgtagctgctagctattggcctcccaaaagactccagtactattttaatttgtattgaagaagttcagaaatttaaaagcagagcattttttatgatatcattgttggtgttaattgaaagtataatttgctggaacacaaagaccaaaatgaaagttttttcctccctgcttaaaaatgtagcagcttcttagttactttggaacactactcttacatgtataaagtgattgacttgactttctagcttcccttgtccggaggatattaaaatgctagggtgaggtttagccatcttacttggctttttactattaacatgatgtactaaagtagagccctttgagaatacaagatattatgtataaaatgtaacactgatgataggttaataaagatgattgaatcc

SEQ ID NO: 32782 - DNA, 723 bp, Homo sapiens
gagggggccgtgaccaccgcctccccgcgacgccccagtccagtggcctcgcgtccgcccattcagcggagacctgcggagaggcggcggccgcggcctccgcaagccggtatggccactggagacgggggttgcgggcgctctgtccgaggaggccgggagactaggaggcgctgggagggcctcgttcgaaccgcgcggcagctgggtctttctctagagttgtatatatagaacatcctggagtccaccatgaacggacagttggatctaagtgggaagctaatcatcaaagctcaacttggggaggatattcggcgaattcctattcataatgaagatattacttatgatgaattagtgctaatgatgcaacgagttttcagaggaaaacttctgagtaatgatgaagtaacaataaagtataaagatgaagatggagatcttataacaatttttgatagttctgacctttcctttgcaattcagtgcagtaggatactgaaactgacattatttgttaatggccagccaagaccccttgaatcaagtcaggtgaaatatctccgtcgagaactgatagaacttcgaaataaagtgaatcgtttattggatagcttggaaccacctggagaaccaggaccttccaccaatattcctgaaaatgatactgtggatggtagggaagaaaagtctgcttctgattcttctggaaaacagtct

SEQ ID NO: 32783 - DNA, 776 bp, Homo sapiens
tttttttcttgctcccgcctctgttcttcccccacctgccacgtacagagcccaagttctcgctaggcttgttgggtcagcgcgattggccggggcccgcgcgagcctgcgagcgaggtgcggcggtcgcgaagggcaaccgagggggccgtgaccaccgcctccccgcgacgccccagtccagtggcctcgcgtccgcccattcagcggagacctgcggagaggcggcggccgcggcctccgcaagccgatgactgcaagagcaaacgacagctttaggaaagaagcactggttcctggccacaagatgtttacagtcaataggaaacacaaaaagtgaatttgcagtctttctctagagttgtatatatagaacatcctggagtccaccatgaacggacagttggatctaagtgggaagctaatcatcaaagctcaacttggggaggatattcggcgaattcctattcataatgaagatattacttatgatgaattagtgctaatgatgcaacgagttttcagaggaaaacttctgagtaatgatgaagtaacaataaagtataaagatgaagatggagatcttataacaatttttgatagttctgacctttcctttgcaattcagtgcagtaggatactgaaactgacattatttgttaatggccagccaagaccccttgaatcaagtcaggtgaaatatctccgtcgagaactgatagaacttcgaaataaagtgaatcgtttattggatagcttggaaccacctggagaac

SEQ ID NO: 32784 - DNA, 913 bp, Homo sapiens
aacccctggctgcggtggccaggaggcgcgcctggggggctccgggaggggagtgcgccagctaatgccttggtgcagcctgcctccaagcgtttggattgagaggagaggggctttgggaggtttggggcggccggcgcccaatacccgaaggagctcggaagggtgtggagtggcgcctacgggaataagttgattggggtcatagaatcggagcctagttccttggctaagtcagcgcttaatcaagcgccggctggaggcccagcctggtttatagtgatgattctagctaactttaagagtttgctttgctggacactacatctttctctagagttgtatatatagaacatcctggagtccaccatgaacggacagttggatctaagtgggaagctaatcatcaaagctcaacttggggaggatattcggcgaattcctattcataatgaagatattacttatgatgaattagtgctaatgatgcaacgagttttcagaggaaaacttctgagtaatgatgaagtaacaataaagtataaagatgaagatggagatcttataacaatttttgatagttctgacctttcctttgcaattcagtgcagtaggatactgaaactgacattatttgttaatggccagccaagaccccttgaatcaagtcaggtgaaatatctccgtcgagaactgatagaacttcgaaataaagtgaatcgtttattggatagcttggaaccacctggagaaccaggaccttccaccaatattcctgaaaatgatactgtggatggtagggaagaaaagtctgcttctgattcttctggaaaacagtctactcaggttatggcagcaagtatgtctgcttttgatcctttaaaaaaccaagatgaaatcaataaaaatgtta

SEQ ID NO: 32785 - DNA, 1696 bp, Homo sapiens
ggcagccgggacccagccagccctgcgcctcgcgccgtcgcgcatgcgtcctggtctttctctagagttgtatatatagaacatcctggagtccaccatgaacggacagttggatctaagtgggaagctaatcatcaaagctcaacttggggaggatattcggcgaattcctattcataatgaagatattacttatgatgaattagtgctaatgatgcaacgagttttcagaggaaaacttctgagtaatgatgaagtaacaataaagtataaagatgaagatggagatcttataacaatttttgatagttctgacctttcctttgcaattcagtgcagtaggatactgaaactgacattatttgttaatggccagccaagaccccttgaatcaagtcaggtgaaatatctccgtcgagaactgatagaacttcgaaataaagtgaatcgtttattggatagcttggaaccacctggagaaccaggaccttccaccaatattcctgaaaatgatactgtggatggtagggaagaaaagtctgcttctgattcttctggaaaacagtctactcaggttatggcagcaagtatgtctgcttttgatcctttaaaaaaccaagatgaaatcaataaaaatgttatgtcagcgtttggcttaacagatgatcaggtttcagggccacccagtgctcctgcagaagatcgttcaggaacacccgacagcattgcttcctcctcctcagcagctcacccaccaggcgttcagccacagcagccaccatatacaggagctcagactcaagcaggtcagattgaaggtcagatgtaccaacagtaccagcaacaggccggctatggtgcacagcagccgcaggctccacctcagcagcctcaacagtatggtattcagtattcagcaagctatagtcagcagactggacctcaacaacctcagcagttccagggatatggccagcaaccaacttcccaggcaccagctcctgccttttctggtcagcctcaacaactgcctgctcagccgccacagcagtaccaggcgagcaattatcctgcacaaacttacactgcccaaacttctcagcctactaattatactgtggctcctgcctctcaacctggaatggctccaagccaacctggggcctatcaaccaagaccaggttttacttcacttcctggaagtaccatgacccctcctccaagtgggcctaatccttatgcgcgtaaccgtcctccctttggtcagggctatacccaacctggacctggttatcgataaggaggctcctctacaccaattaatgtagctgctagctattggcctcccaaaagactccagtactattttaatttgtattgaagaagttcagaaatttaaaagcagagcattttttatgatatcattgttggtgttaattgaaagtataatttgctggaacacaaagaccaaaatgaaagttttttcctccctgcttaaaaatgtagcagcttcttagttactttggaacactactcttacatgtataaagtgattgacttgactttctagcttcccttgtccggaggatattaaaatgctagggtgaggtttagccatcttacttggctttttactattaacatgatgtactaaagtagagccctttgagaatacaagatattatgtataaaatgt

SEQ ID NO: 32786 - DNA, 1716 bp, Homo sapiens
agggactcttcggcctaggcagccgggacccagccagccctgcgcctcgcgccgtcgcgcatgcgtcctggtctttctctagagttgtatatatagaacatcctggagtccaccatgaacggacagttggatctaagtgggaagctaatcatcaaagctcaacttggggaggatattcggcgaattcctattcataatgaagatattacttatgatgaattagtgctaatgatgcaacgagttttcagaggaaaacttctgagtaatgatgaagtaacaataaagtataaagatgaagatggagatcttataacaatttttgatagttctgacctttcctttgcaattcagtgcagtaggatactgaaactgacattatttgttaatggccagccaagaccccttgaatcaagtcaggtgaaatatctccgtcgagaactgatagaacttcgaaataaagtgaatcgtttattggatagcttggaaccacctggagaaccaggaccttccaccaatattcctgaaaatgatactgtggatggtagggaagaaaagtctgcttctgattcttctggaaaacagtctactcaggttatggcagcaagtatgtctgcttttgatcctttaaaaaaccaagatgaaatcaataaaaatgttatgtcagcgtttggcttaacagatgatcaggtttcagggccacccagtgctcctgcagaagatcgttcaggaacacccgacagcattgcttcctcctcctcagcagctcacccaccaggcgttcagccacagcagccaccatatacaggagctcagactcaagcaggtcagatgtaccaacagtaccagcaacaggccggctatggtgcacagcagccgcaggctccacctcagcagcctcaacagtatggtattcagtattcagcaagctatagtcagcagactggacctcaacaacctcagcagttccagggatatggccagcaaccaacttcccaggcaccagctcctgccttttctggtcagcctcaacaactgcctgctcagccgccacagcagtaccaggcgagcaattatcctgcacaaacttacactgcccaaacttctcagcctactaattatactgtggctcctgcctctcaacctggaatggctccaagccaacctggggcctatcaaccaagaccaggttttacttcacttcctggaagtaccatgacccctcctccaagtgggcctaatccttatgcgcgtaaccgtcctccctttggtcagggctatacccaacctggacctggttatcgataaggaggctcctctacaccaattaatgtagctgctagctattggcctcccaaaagactccagtactattttaatttgtattgaagaagttcagaaatttaaaagcagagcattttttatgatatcattgttggtgttaattgaaagtataatttgctggaacacaaagaccaaaatgaaagttttttcctccctgcttaaaaatgtagcagcttcttagttactttggaacactactcttacatgtataaagtgattgacttgactttctagcttcccttgtccggaggatattaaaatgctagggtgaggtttagccatcttacttggctttttactattaacatgatgtactaaagtagagccctttgagaatacaagatattatgtataaaatgtaacactgatgatagg

SEQ ID NO: 32787 - DNA, 2176 bp, Homo sapiens
aggacgggctaggcagcgcggggagggattcggactcggggcgggcctgcacgagggcatcggctccacagggaccagtcatccccaaaacgaggggatatcagcttaccgaggccgcaggttttcctagtccctacctcatagatatgtaggacatccccgggcccggaatgcggctctctgaccctctctgtgccctcccccgccccccgaaccaggcttggcgggcggaggcgccagcggatgtctcatgcaaggatcgtctctgtggctaagcctcactttccgctccgcccgggtgctctctagagcccggtttttcgagtggcagtctccagggctgccgaatacagcagcgatggagaacggcaccgggccctacggagaagaacgtccacgtgaagtccaggagacgacagtcaccgagggggctgccaaaatcgcctttcccagtgccaacgaggtcttttataacccggtgcaggaattcaatcgggacctgacatgtgctgtgatcaccgagtttgctcgcattcagcttggggccaaaggaatccagatcaaggttccaggagagaaggacacgcaaaaagtggtcgtggacttgtcagagcaagaggaggaaaaggttgaactgaaagagagtgaaaacctggcctcaggagaccaacctcgcacagcggccgtgggggagatctgtgaggaaggcctgcatgtgctggaaggcctggcagcttcaggcctacgttccattcgatttgccctagaggtgcctgggctcagatctgtggttgcaaacgatgcctccacccgggctgtggatctcatacgccggaatgtccagctcaatgacgtggcccacctggtacagccgagccaagcagatgcccggatgctgatgtaccagcaccagagggtgtcggagaggtttgacgtcatcgatctggacccctatggcagcccagccaccttcctggatgcagctgtgcaggctgtgagtgaaggagggttgctgtgtgtgacctgcacagacatggcggtgttggcggggaacagcggggagacgtgctacagcaagtacggggccatggccctcaagagccgggcctgccacgagatggccctgagaatcgtcctgcacagcctggacctccgcgccaactgctaccagcgcttcgtggtgccgctgctcagcatcagcgctgacttctacgtgcgtgtttttgtccgtgtcttcaccggccaggccaaggtcaaggcctcagccagggccaagttctctgcagcctgtggtccccctgtgacccccgagtgtgaacactgtgggcaacgacaccagcttggtggccccatgtgggcagagcccatccatgacctggattttgtgggccgtgtcctggaggctgtgagcgctaaccccggccgcttccacacctcggagcggatccgaggggtcctgagcgtcatcactgaggagctcccggacgtgcctctgtactacaccctggaccagctgagcagcaccatccactgcaacacaccaagcctcctgcagttgcggtcggccctcctccacgctgacttccgggtctcactctcccacgcctgtaagaacgctgtgaagacggatgcccctgcctctgccctctgggacatcatgcgttgctgggagaaggaatgtccggtgaaacgggagcgactatcagagactagcccagcgttccgcattctcagtgtggagcccaggctgcaggccaacttcaccatccgggaagatgccaaccccagctcccgacagcgaggactcaagcgcttccaggctaacccggaggccaactggggtccccggcctcgtgcccggccagggggcaaggcggccgacgaagctatggaggagagacgcaggctgcttcagaacaagcggaaggagccgccggaagatgtggcccagcgggctgcccggctcaagacatttccttgcaagaggtttaaggagggcacctgtcaacgcggggaccagtgctgctactcccacagccccccgacacccagggtttctgctgatgctgcccctgactgtccagagacctccaaccagaccccccctggacctggggctgccgctgggccaggcatagactgaaccaataaagagatgtcacgtcaccttctcccg

SEQ ID NO: 32788 - DNA, 2142 bp, Homo sapiens
gattcgcccacccactgtgccaacatggcggcgcccaggtcctaattcgggaaacgtgcaccttgactaattcggttttctgtggctacgagagcaggcttggcgggcggaggcgccagcggatgtctcatgcaaggatcgtctctgtggctaagcctcactttccgctccgcccgggtgctctctagagcccggtttttcgagtggcagtctccagggctgccgaatacagcagcgatggagaacggcaccgggccctacggagaagaacgtccacgtgaagtccaggagacgacagtcaccgagggggctgccaaaatcgcctttcccagtgccaacgaggtcttttataacccggtgcaggaattcaatcgggacctgacatgtgctgtgatcaccgagtttgctcgcattcagcttggggccaaaggaatccagatcaaggttccaggagagaaggacacgcaaaaagtggtcgtggacttgtcagagcaagaggaggaaaaggttgaactgaaagagagtgaaaacctggcctcaggagaccaacctcgcacagcggccgtgggggagatctgtgaggaaggcctgcatgtgctggaaggcctggcagcttcaggcctacgttccattcgatttgccctagaggtgcctgggctcagatctgtggttgcaaacgatgcctccacccgggctgtggatctcatacgccggaatgtccagctcaatgacgtggcccacctggtacagccgagccaagcagatgcccggatgctgatgtaccagcaccagagggtgtcggagaggtttgacgtcatcgatctggacccctatggcagcccagccaccttcctggatgcagctgtgcaggctgtgagtgaaggagggttgctgtgtgtgacctgcacagacatggcggtgttggcggggaacagcggggagacgtgctacagcaagtacggggccatggccctcaagagccgggcctgccacgagatggccctgagaatcgtcctgcacagcctggacctccgcgccaactgctaccagcgcttcgtggtgccgctgctcagcatcagcgctgacttctacgtgcgtgtttttgtccgtgtcttcaccggccaggccaaggtcaaggcctcagccagcaagcaggcgctggtgttccagtgtgtgggctgcggggccttccaccttcagcgtctcggcaaagcgtcaggagtccccagcggccgggccaagttctctgcagcctgtggtccccctgtgacccccgagtgtgaacactgtgggcaacgacaccagcttggtggccccatgtgggcagagcccatccatgacctggattttgtgggccgtgtcctggaggctgtgagcgctaaccccggccgcttccacacctcggagcggatccgaggggtcctgagcgtcatcactgaggagctcccggacgtgcctctgtactacaccctggaccagctgagcagcaccatccactgcaacacaccaagcctcctgcagttgcggtcggccctcctccacgctgacttccgggtctcactctcccacgcctgtaagaacgctgtgaagacggatgcccctgcctctgccctctgggacatcatgcgttgctgggagaaggaatgtccggtgaaacgggagcgactatcagagactagcccagcgttccgcattctcagtgtggagcccaggctgcaggccaacttcaccatccgggaagatgccaaccccagctcccgacagcgaggactcaagcgcttccaggctaacccggaggccaactggggtccccggcctcgtgcccggccagggggcaaggcggccgacgaagctatggaggagagacgcaggctgcttcagaacaagcggaaggagccgccggaagatgtggcccagcgggctgcccggctcaagacatttccttgcaagaggtttaaggagggcacctgtcaacgcggggaccagtgctgctactcccacagccccccgacacccagggtttctgctgatgctgcccctgactgtccagagacctccaaccagaccccccctggacctggggctgccgctgggccaggcatagactgaaccaataaagagatgtcacgtcaccttctcccg

SEQ ID NO: 32789 - DNA, 2263 bp, Homo sapiens
aggacgggctaggcagcgcggggagggattcggactcggggcgggcctgcacgagggcatcggctccacagggaccagtcatccccaaaacgaggggatatcagcttaccgaggccgcaggttttcctagtccctacctcatagatatgtaggacatccccgggcccggaatgcggctctctgaccctctctgtgccctcccccgccccccgaaccaggcttggcgggcggaggcgccagcggatgtctcatgcaaggatcgtctctgtggctaagcctcactttccgctccgcccgggtgctctctagagcccggtttttcgagtggcagtctccagggctgccgaatacagcagcgatggagaacggcaccgggccctacggagaagaacgtccacgtgaagtccaggagacgacagtcaccgagggggctgccaaaatcgcctttcccagtgccaacgaggtcttttataacccggtgcaggaattcaatcgggacctgacatgtgctgtgatcaccgagtttgctcgcattcagcttggggccaaaggaatccagatcaaggttccaggagagaaggacacgcaaaaagtggtcgtggacttgtcagagcaagaggaggaaaaggttgaactgaaagagagtgaaaacctggcctcaggagaccaacctcgcacagcggccgtgggggagatctgtgaggaaggcctgcatgtgctggaaggcctggcagcttcaggcctacgttccattcgatttgccctagaggtgcctgggctcagatctgtggttgcaaacgatgcctccacccgggctgtggatctcatacgccggaatgtccagctcaatgacgtggcccacctggtacagccgagccaagcagatgcccggatgctgatgtaccagcaccagagggtgtcggagaggtttgacgtcatcgatctggacccctatggcagcccagccaccttcctggatgcagctgtgcaggctgtgagtgaaggagggttgctgtgtgtgacctgcacagacatggcggtgttggcggggaacagcggggagacgtgctacagcaagtacggggccatggccctcaagagccgggcctgccacgagatggccctgagaatcgtcctgcacagcctggacctccgcgccaactgctaccagcgcttcgtggtgccgctgctcagcatcagcgctgacttctacgtgcgtgtttttgtccgtgtcttcaccggccaggccaaggtcaaggcctcagccagcaagcaggcgctggtgttccagtgtgtgggctgcggggccttccaccttcagcgtctcggcaaagcgtcaggagtccccagcggccgggccaagttctctgcagcctgtggtccccctgtgacccccgagtgtgaacactgtgggcaacgacaccagcttggtggccccatgtgggcagagcccatccatgacctggattttgtgggccgtgtcctggaggctgtgagcgctaaccccggccgcttccacacctcggagcggatccgaggggtcctgagcgtcatcactgaggagctcccggacgtgcctctgtactacaccctggaccagctgagcagcaccatccactgcaacacaccaagcctcctgcagttgcggtcggccctcctccacgctgacttccgggtctcactctcccacgcctgtaagaacgctgtgaagacggatgcccctgcctctgccctctgggacatcatgcgttgctgggagaaggaatgtccggtgaaacgggagcgactatcagagactagcccagcgttccgcattctcagtgtggagcccaggctgcaggccaacttcaccatccgggaagatgccaaccccagctcccgacagcgaggactcaagcgcttccaggctaacccggaggccaactggggtccccggcctcgtgcccggccagggggcaaggcggccgacgaagctatggaggagagacgcaggctgcttcagaacaagcggaaggagccgccggaagatgtggcccagcgggctgcccggctcaagacatttccttgcaagaggtttaaggagggcacctgtcaacgcggggaccagtgctgctactcccacagccccccgacacccagggtttctgctgatgctgcccctgactgtccagagacctccaaccagaccccccctggacctggggctgccgctgggccaggcatagactgaaccaataaagagatgtcacgtcaccttctcccg

SEQ ID NO: 32790 - DNA, 2964 bp, Homo sapiens
ctagagctggctaaagtggttgggggttggatccggcgcgtgacgatgacgttgccagaagccaggatcatagagacgctcggcctccgccgcacgcgctggcggactaagagtggctggcgaagcgagcggccggcgcgggcccctggcgggcgggcggtacagccccaagcctgagacccggacctgagcatcgcaggttcgagtcccgccccgcctggggcgaagccgggggtggcggcgacctcgcggcgttgcaccggctctgtgagcacctcccctctgagcacttcccttgtgacaggccacttcccttgtgacaggcccaggacgaggtggccaggcggcccccatggcgtccctggtctaggcggagaaccgcctgggcgatgagtgagaacctcgacaacgagggcccgaagcccatggagagctgtggccaggagagcagcagtgccctgagctgccctaccgtctcggtgccccctgcagccccggcagccctggaggaggtggagaaagagggcgctggggcggctacagggccggggcctcagcccgggctctacagctacatcagggatgacttgtttacctctgagatctttaaactggagctgcagaacgtgcctcgccacgccagcttcagcgacgtccggcgcttcctgggccgctttggtctgcagccccacaaaaccaaactctttgggcaaccaccctgcgcctttgtgacattccgcagcgctgcagagagggacaaggccctgcgcgttttgcatggtgccctctggaaaggccgcccactcagtgtgcgcctggcccggcccaaggccgaccccatggccaggaggaggcgacaggagggtgagagtgagccaccagtaacacgagtggccgacgtggtgacccctctatggacagtgccctatgctgagcagcttgagcggaagcagctggagtgcgagcaggtgctgcagaaacttgccaaggaaatcgggagcaccaaccgtgccttgctgccctggctgctcgagcagaggcacaagcacaacaaggcctgctgcccgctggagggggtcaggccatcaccccagcagactgagtatcgtaataagtgtgagtttctggttggcgtcggggtggatggggaggataacaccgtgggctgtcggctcggcaagtacaagggcgggacgtgtgctgtggcagccccgtttgacaccgtgcacatccccgaagccaccaagcaggtggtgaaggccttccaggagttcatccggtccactccatactcggcatacgacccagagacgtacacaggccactggaagcagctgactgtgcgcaccagccgccgccaccaggccatggccattgcctacttccacccccagaagctgagccctgaggagctggcagagctgaagacctccctagcgcagcacttcacagcagggccaggcagggccagtggagtgacctgcctctacttcgtggaggagggacagcgaaagactcctagccaggagggcctgcccctggagcatgtggctggggaccggtgcatccacgaggacctgctagggctgaccttccggatctctccacacgccttcttccaggtgaacacacccgcagccgaggtgctctacacagtcatccaggactgggcccaattggatgcggggagcatggtgctggacgtgtgctgtggcaccggcaccattggcctggccctggcccggaaggtaaagagggtcattggggtcgagctatgcccagaggctgtggaggacgcccgggtgaacgcccaggacaatgagttgagtaatgtggagttccactgcgggagggccgaggacctggtgcccaccctggtgagcagactggcctcccagcacctcgtggccatcctggacccaccccgtgctggcttgcattccaaggtgatcctggccatccggagagctaagaacctcaggcggctgctgtacgtctcatgcaacccccgggcagccatgggcaactttgtggacctctgcagagccccatctaaccgggtgaagggcattcccttccggccggtcaaggctgtggcagtggacctgttcccgcagaccccgcactgtgagatgctcatcctgtttgagagggtggagcaccccaatggcacaggggtcttggggccccacagccctccagctcaacccacaccaggacccccagataacaccctacaagaaactgggaccttcccctcatcctaggcccaggacccattatggggacaggagctgaagggctcccagggccccaggggcggggaaggcatggcttgctggccaggatattcagaggtaggcagccaaagggcacagaaccctgtgccccaccaggattggcctgctgctaggggccaggggccctgaccaggaagacaggtgggttcctgtagcctgttgcccatccccagggcctttgtggactagccaaggctgtgagggccagaataaacaactgctcaacaaagggtgtttctgtgatgagagccaggggtctgaacacagggcctgggtgccagggaaagggccaaactaggcctaggcagctctgcaagcctctctgcatggctgggggagtcagggcagagcttactttaaaaaagaatgttcgatttgatacttaaacttgaggagaggcagagagaggtctgggaactgcaccagctgggggcatggggtggagaacactgggcagagttggcccctctgtggccagcctggccctcagcccagcagagagggcatcaaccaaggaaggggccatgctggggtgctgctcagctgttacaaaggcagggtccagcctgcagggaggccccaggaggggatctggccagtcaagggtccacagggtgccagcctctcaccctcagaataaagacatcagccattcccttctgga

SEQ ID NO: 32791 - DNA, 2928 bp, Homo sapiens
aaaacgcccgcggcgcatgcccggcccgcccgtcagccagaggagcgcgcactcccggcgacacccgcgcgcacttccgtcccggccacgcgcgcctctagagctggctaaagtggttgggggttggatccggcgcgtgacgatgacgttgccagaagccaggatcatagagacgctcggcctccgccgcacgcgctggcggactaagagtggctggcgaagcgagcggccggcgcgggcccctggcgggcgggcggtacagccccaagcctgagacccggacctgagcatcgcaggcccaggacgaggtggccaggcggcccccatggcgtccctggtctaggcggagaaccgcctgggcgatgagtgagaacctcgacaacgagggcccgaagcccatggagagctgtggccaggagagcagcagtgccctgagctgccctaccgtctcggtgccccctgcagccccggcagccctggaggaggtggagaaagagggcgctggggcggctacagggccggggcctcagcccgggctctacagctacatcagggatgacttgtttacctctgagatctttaaactggagctgcagaacgtgcctcgccacgccagcttcagcgacgtccggcgcttcctgggccgctttggtctgcagccccacaaaaccaaactctttgggcaaccaccctgcgcctttgtgacattccgcagcgctgcagagagggacaaggccctgcgcgttttgcatggtgccctctggaaaggccgcccactcagtgtgcgcctggcccggcccaaggccgaccccatggccaggaggaggcgacaggagggtgagagtgagccaccagtaacacgagtggccgacgtggtgacccctctatggacagtgccctatgctgagcagcttgagcggaagcagctggagtgcgagcaggtgctgcagaaacttgccaaggaaatcgggagcaccaaccgtgccttgctgccctggctgctcgagcagaggcacaagcacaacaaggcctgctgcccgctggagggggtcaggccatcaccccagcagactgagtatcgtaataagtgtgagtttctggttggcgtcggggtggatggggaggataacaccgtgggctgtcggctcggcaagtacaagggcgggacgtgtgctgtggcagccccgtttgacaccgtgcacatccccgaagccaccaagcaggtggtgaaggccttccaggagttcatccggtccactccatactcggcatacgacccagagacgtacacaggccactggaagcagctgactgtgcgcaccagccgccgccaccaggccatggccattgcctacttccacccccagaagctgagccctgaggagctggcagagctgaagacctccctagcgcagcacttcacagcagggccaggcagggccagtggagtgacctgcctctacttcgtggaggagggacagcgaaagactcctagccaggagggcctgcccctggagcatgtggctggggaccggtgcatccacgaggacctgctagggctgaccttccggatctctccacacgccttcttccaggtgaacacacccgcagccgaggtgctctacacagtcatccaggactgggcccaattggatgcggggagcatggtgctggacgtgtgctgtggcaccggcaccattggcctggccctggcccggaaggtaaagagggtcattggggtcgagctatgcccagaggctgtggaggacgcccgggtgaacgcccaggacaatgagttgagtaatgtggagttccactgcgggagggccgaggacctggtgcccaccctggtgagcagactggcctcccagcacctcgtggccatcctggacccaccccgtgctggcttgcattccaaggtgatcctggccatccggagagctaagaacctcaggcggctgctgtacgtctcatgcaacccccgggcagccatgggcaactttgtggacctctgcagagccccatctaaccgggtgaagggcattcccttccggccggtcaaggctgtggcagtggacctgttcccgcagaccccgcactgtgagatgctcatcctgtttgagagggtggagcaccccaatggcacaggggtcttggggccccacagccctccagctcaacccacaccaggacccccagataacaccctacaagaaactgggaccttcccctcatcctaggcccaggacccattatggggacaggagctgaagggctcccagggccccaggggcggggaaggcatggcttgctggccaggatattcagaggtaggcagccaaagggcacagaaccctgtgccccaccaggattggcctgctgctaggggccaggggccctgaccaggaagacaggtgggttcctgtagcctgttgcccatccccagggcctttgtggactagccaaggctgtgagggccagaataaacaactgctcaacaaagggtgtttctgtgatgagagccaggggtctgaacacagggcctgggtgccagggaaagggccaaactaggcctaggcagctctgcaagcctctctgcatggctgggggagtcagggcagagcttactttaaaaaagaatgttcgatttgatacttaaacttgaggagaggcagagagaggtctgggaactgcaccagctgggggcatggggtggagaacactgggcagagttggcccctctgtggccagcctggccctcagcccagcagagagggcatcaaccaaggaaggggccatgctggggtgctgctcagctgttacaaaggcagggtccagcctgcagggaggccccaggaggggatctggccagtcaagggtccacagggtgccagcctctcaccctcagaataaagacatcagccattc

SEQ ID NO: 32792 - DNA, 2498 bp, Homo sapiens
gttgccagaagccaggatcatagagacgctcggcctccgccgcacgcgctggcggactaagagtggctggcgaagcgagcggccggcgcgggcccctggcgggcgggcggtacagccccaagcctgagacccggacctgagcatcgcaggttcgagtcccgccccgcctggggcgaagccgggggtggcggcgacctcgcggcgttgcaccggctctgtgagcacctcccctctgagcacttcccttgtgacaggccacttcccttgtgacaggcccaggacgaggtggccaggcggcccccatggcgtccctggtctaggcggagaaccgcctgggcgatgagtgagaacctcgacaacgagggcccgaagcccatggagagctgtggccaggagagcagcagtgccctgagctgccctaccgtctcggtgccccctgcagccccggcagccctggaggaggtggagaaagagggcgctggggcggctacagggccggggcctcagcccgggctctacagctacatcagggatgacttgtttacctctgagatctttaaactggagctgcagaacgtgcctcgccacgccagcttcagcgacgtccggcgcttcctgggccgctttggtctgcagccccacaaaaccaaactctttgggcaaccaccctgcgcctttgtgacattccgcagcgctgcagagagggacaaggccctgcgcgttttgcatggtgccctctggaaaggccgcccactcagtgtgcgcctggcccggcccaaggccgaccccatggccaggaggaggcgacaggagggtgagagtgagccaccagtaacacgagtggccgacgtggtgacccctctatggacagtgccctatgctgagcagcttgagcggaagcagctggagtgcgagcaggtgctgcagaaacttgccaaggaaatcgggagcaccaaccgtgccttgctgccctggctgctcgagcagaggcacaagcacaacaaggcctgctgcccgctggagggggtcaggccatcaccccagcagactgagtatcgtaataagtgtgagtttctggttggcgtcggggtggatggggaggataacaccgtgggctgtcggctcggcaagtacaagggcgggacgtgtgctgtggcagccccgtttgacaccgtgcacatccccgaagccaccaagcaggtggtgaaggccttccaggagttcatccggtccactccatactcggcatacgacccagagacgtacacaggccactggaagcagctgactgtgcgcaccagccgccgccaccaggccatggccattgcctacttccacccccagaagctgagccctgaggagctggcagagctgaagacctccctagcgcagcacttcacagcagggccaggcagggccagtggagtgacctgcctctacttcgtggaggagggacagcgaaagactcctagccaggagggcctgcccctggagcatgtggctggggaccggtgcatccacgaggacctgctagggctgaccttccggatctctccacacgccttcttccaggtgaacacacccgcagccgaggtgctctacacagtcatccaggactgggcccaattggatgcggggagcatggtgctggacgtgtgctgtggcaccggcaccattggcctggccctggcccggaaggtaaagagggtcattggggtcgagctatgcccagaggctgtggaggacgcccgggtgaacgcccaggacaatgagttgagtaatgtggagttccactgcgggagggccgaggacctggtgcccaccctggtgagcagactggcctcccagcacctcgtggccatcctggacccaccccgtgctggcttgcattccaaggtgatcctggccatccggagagctaagaacctcaggcggctgctgtacgtctcatgcaacccccgggcagccatgggcaactttgtggacgccccccttttccccccacagcctctgcagagccccatctaaccgggtgaagggcattcccttccggccggtcaaggctgtggcagtggacctgttcccgcagaccccgcactgtgagatgctcatcctgtttgagagggtggagcaccccaatggcacaggggtcttggggccccacagccctccagctcaacccacaccaggacccccagataacaccctacaagaaactgggaccttcccctcatcctaggcccaggacccattatggggacaggagctgaagggctcccagggccccaggggcggggaaggcatggcttgctggccaggatattcagaggtaggcagccaaagggcacagaaccctgtgccccaccaggattggcctgctgctaggggccaggggccctgaccaggaagacaggtgggttcctgtagcctgttgcccatccccagggcctttgtggactagccaaggctgtgagggccagaataaacaactgctcaac

SEQ ID NO: 32793 - DNA, 5573 bp, Homo sapiens
ttcggcctccgcttcttcaggctgctggacagagacataccagccccgctcagcgttgaagctcccccaggacgcctccatgctgctctccagctgactaccagttccatctacgagcctctacccctgccctgcgctccagtcgtcggtcgcgccagaggcggagctttgagcccggcccttccggcattccgtacttcaccagggcctggaaggagaggagcgagtcgacttgatctgatgacgcgcgccctcttcgcggcgaacagtgatgatgtcatagaagacccgcccatccacccgcgacccacatccgatcggtaccggagcgggaggtgaggggtcggctcgcggatccagctgcagagcgacgtggggaattggaatggtgctttggatcttatggaggccatttggattctcaggaagatttctgaaactggaaagccatagcataactgaatcaaaatcgttgattccagtagcttggacatccctgacacagatgcttttggaagcacctggtattttcttattgggtcaaagaaaaagattctcaaccatgccagaaacagaaacacatgagagagagactgaattgttttcaccaccttctgatgtccgaggcatgacaaaacttgatagaacagcttttaaaaagacagtcaacattccagtgcttaaagtgaggaaagaaatagtcagtaaattgatgcgatccctaaaaagggcagcattgcagcgcccaggcataagacgtgtgattgaagatccggaagataaagaaagtagactaatcatgttggatccctataaaatatttactcatgattcctttgagaaagcagaactcagtgttttagagcagcttaatgtcagtccacagatctctaaatacaatttggaactaacatatgaacactttaagtcagaagaaatcttgagagctgtgcttcctgaaggtcaagatgtaacttcagggtttagcaggattggacatattgcacacctaaaccttcgagatcatcagctgtctttcaaacatttaattggccaggttatgattgacaaaaatccaggaatcacctcagcagtaaataaaataaataatattgacaatatgtaccgaaatttccaaatggaagtgctatctggagagcagaacatgatgacaaaggttcgagaaaacaactacacctatgaatttgatttttcaaaagtctattggaatcctcgtctgtctacagaacacagccgtatcacagaacttctcaaacctggggatgtcctatttgatgtttttgctggggttgggccctttgccattccagtagcaaagaaaaactgcactgtatttgccaatgatctcaatcctgaatctcataaatggctgttgtacaactgtaaattaaataaagtggaccaaaaggtgaaagtcttcaacttggatgggaaagacttcctccaaggaccagtcaaagaagagttaatgcagctgctgggtctgtcaaaagaaagaaaaccctctgtgcacgttgtcatgaacttgccagcaaaagctatagagtttcttagtgctttcaagtggcttttagatgggcagccatgcagcagtgagttccttcccatagtgcattgttatagcttttccaaagatgctaaccctgctgaggatgttcggcaaagggctggagctgtgttaggcatttctctggaggcatgcagttcagttcacctggtaagaaatgtggccccaaacaaggaaatgctgtgcatcacgtttcagattcctgcctctgtcctctacaagaaccagaccagaaatccagagaatcatgaagatccacctcttaaaaggcagaggacggctgaagccttttcagacgaaaaaacacaaattgtttcaaacacttaattggaaatgttttctccatctccctaccagacttacatgtagtgaaatagaatttgtattatttaataaaattttagggtttggtttttactattgaacccttgtactttgccttattttacaaattgaggattaccaattaaactttaactgaactaaggctaccaaatacattccctgttatctaaattataacatacaattattttataacaaaatatatctaatttttattggataaatatgaataaatattttctctcagggaaaataatttttgaaagtagggtgattgagtactaactaggaaggtattaacaccactttgtagttgtcctttacgtaactactcctttactgccaattaactatcaccataaaagtaataaaaaatgaaattatttagaacggggcaggcaaactacatcctgcaggccaaatctgtcccaccacctgttttcatatggcctgtggcctaataatgttcttacgttttccattggttgaaaaataatcaaaagaacattttgtgacgtgaaaattttatgacatctattatgtatcagttttaaaaattagaattgtatgaaattaagagtttcagagttcataaagtttgattggaacataccatgctcatttgtttacatatcatctgcagctgttttttgtttttaatatggaacgcttcacgaatttgcatgtcatccttgcgcagggaccattctgatcttctctgtaccattccagttttttagtatatgtgctgctgaagtgaggactgcagctgctttcttgaacaatagcagagttgagtggttgcaacacacactgaatgtgactgtcatcacttcacactgctgtttgacacatcacaaatcactgatgtggttgtaacgacagcattttgagtgccatgtatatcacatgaacccacattttattttttattaccagagcatatctattatagcaaaacaagaaaagtggactttgttgttatttttaaagtacagtagggtgtgaattattttgatgttgaattagacgacaaagcatctatatagctaagctaaaagaataaccattgacattaccagacaaaccactcatcacagtattcccaactcacaggcaagcaactgttagaaaaattagaaaatttaaaatggaaataacaaagcagaatttcttcacaaaatgaaaatgaggctgcaacaacagtaagtctctaagtcaatcatttgttagccaagcaaagccatttattgatggtgtgaattaattatgtttggatgcagcagctgaatatatccagagaaaataaacttaagattactggcctttggcaagaacagttgcttaaagagttaaggacattgaaagcgacataaatagtcactttaaaaaggaaatgattctggatggttctttgactctatttttatttttacttagagacagggtcttgctctgttgcccaggctggagtgtagagacacagttacacctcaatgtaaccttgaactcctaggcttgagatcttcccatctcggcttcccaatgtgtgaaggttacaggtgtgagcccttatatgtggccctcgtgaatggtttagcactatccccttggtggtgtccttaagataatgagttatgagatcttgttgtttcaaagtatgtggcactcgccccccacactctcttgctcctgccttcgccatgtgaagtgccttctcctattttgccttctaccatgagtaaaagcttcctgaggcttccccagaagcagatgccagtgctatgcttcctatagcctggagaactgtgagccaattatacctcttttcttataaattacccagtatcaagtatttctttatagcaatgcaagaatggcctaaaacacaaggcaaaacaactttgatatggtacagtcattttgacaatcgatatttgaatcacaatatttgatgacaatatccttacacatttgtcatactatcaaagagaaagaaacaagatttccattcccacaaattttagtgagtatattttctgagttcagcatttttagggacctaggtgcaagtgcaaaggaaatttccctgtttcaaaatctatttaactgcaattgaggtgattcaacctaattttcagtaagaagtgattaaaataatgacatgctaaaaggcaaatttcaagggaagaaatgtaaaagaattttacaaatgctttccaagtgatgaatatgctcagttaatttcatatgctcctggattgatagcagtatttggcaatacctatctgtatgagaagacatttttaaagatgaaatgtgtaaaatcttattaccattagtattaatggttaatgatggttaatgataaccattaataggcaatcatttacaactgattttgatcacagggaacacttacttagaaccctgattagaggcaatgttattctcaccaaaaaaggcattacaaaaaattgggctatattttgaattttgtcaattaaaaaagcgtgggagcagtgtgaaggagaagaggcaagaacgacccctggaccgaccaaagcccgcgcgctgctgcgtcccacacccggtgcccacatcccgccgccgccgccgccgccatgcccaagagaaagactgaaggggatgctaaaggagataaagccaaggtgaaggatgaatcacagagaagatctgcgaggttgtctgctaaacctgctcctccaaagccagagcccaagcctaaaaaggcccctgcaaagaagggagagaaggtacccaaagggaaaaagagaaaagctgatgctggcaaggagcgggaaggtgctggagatcccaagtgaagtgtgtgcattttttataactgtacttctggtgactgtacagtttgaaatattctttatcaagttttataaaaatgcagaattttgttttactttttttaagctatgttgttagcacacagaacacttcattgttgtttttgggggaaggggtatgtgtcactaatagaatatctctgaagctggattgatacggggaaaacatctttcccttctagttttgagagacttcctcttggctcccaggaggagggatttcctgactttgacacacatggccaccttggcacaaaagccttgtggtatggaaaaacaaattcgtttttatgtcttcttttccctttccatctttcagcatagacttaatccccttaagcccagacatctgttgggacctgacccccggtcattggttaccagtgtgtctggcaatctggactttccagtgatgccactgagatggcacctgtcaaaagagcagtggttccatttctagattatggatcttcggataaattctgccattttcatttcacttcctgaaagtcagggttggcttgtgaaaagttgttaaacaacatgctaaatgtgaaatgttaaccctctaaactttccctgttcagagcatcagatgaggacttcattgggttttatagcggctgatttttggtagtccattgaagaagagagtttgaaagttgtatactgttaatgactgtctgcccatgtcctgcctgaaataccatgattgtttatggaaagtatctttaataaagctggatacagtttgaaag

SEQ ID NO: 32794 - DNA, 1940 bp, Homo sapiens
ggctggggggcttagaattttatttttggtttacagcgcagaagaagagcagtgaggccggggcgcgggtggggagggcaaggcggcggctcaaaaaaaaagccagcccctcgcggcccgacagagtctcggcgccccgcgggtcggtggagcctcaggggtgagcgcaggccggagacaggggaacccgccgcgggacaggggaaggccggacggaacgcgggtaagctgccgcagcttccggccgggccactagcgcggaccctacggccggggcgggacttccggcaaggcgcggaagcggcggtagctgcagctggcgaagttgggcgactggcggatgcaggccttgcggcacgtcgtgtgcgccctgtccggcggcgtggacagcgccgtggccgcgctgctgctgaggcggagaggttaccaggtgacaggggtgtttatgaagaactgggactcactggatgaacatggggtctgtactgccgacaaagactgtgaagatgcttacagagtttgccagatcttagacatccctttccatcaagtgtcctacgtaaaggagtattggaatgatgtgttcagtgactttttgaatgagtatgaaaaaggaaggactcccaatcctgacatagtttgcaacaagcacatcaaatttagttgcttttttcattatgctgtggataatcttggggcagatgccattgccacaggtcactatgcaagaacttccctggaagatgaagaagtctttgagcagaagcacgttaagaagcccgaagggcttttcagaaatcggtttgaagttagaaatgcggtaaaactcctccaggcagctgacagctttaaagaccagaccttctttctcagccaggtttcccaggatgccctgaggagaaccatcttccctctggggggattaacgaaagagtttgtaaagaaaatcgctgctgagaatagacttcatcatgtgcttcagaagaaagagagcatgggcatgtgtttcatcgggaagaggaattttgaacatttccttcttcagtatctgcagcctcgacctggtcactttatttccatagaagacaataaggttctgggaacacataaaggttggttcctgtataccttgggccagagagcaaacataggtggcctgagagagccctggtacgtggtggagaaggacagcgtcaagggtgacgtgtttgtggccccccggacagaccacccagccctgtacagggacctgctgaggaccagccgcgtgcactggattgcggaggagcctcccgcagcactggtccgggacaagatgatggagtgccacttccgattccgccaccagatggcactagtgccctgtgtgctgaccctcaatcaagatggcaccgtgtgggtgacagctgtgcaggctgtgcgtgcccttgccacaggacagtttgctgtgttctacaagggggacgagtgcctgggcagcgggaagatcctgcggctggggccgtctgcctacacgctccagaagggccagcgcagagctgggatggccactgagagccccagtgacagcccagaagatggtccaggcctgagtcccttgctctgacagagatggatctgctagaaggaacctggagagcaggacccatggctgggcggctggtgagcagtccaggtgcccaagggccagcttgctgctgcccaaagcagaggaagccgggctggctgagggtccgaaaagcctgcaggggcccggcgagccccaggaagagcctcagctccaggctggggctctggctgctggagcatctgctggctggtggggtggcccgagttccccttcaccgcccccagggagggtttcccacctcagagtacaccgaggggacctgcagagggggctgtcgggacagcgtggaataaacattatttcaaggaca

SEQ ID NO: 32795 - DNA, 1830 bp, Homo sapiens
ggctggggggcttagaattttatttttggtttacagcgcagaagaagagcagtgaggccggggcgcgggtggggagggcaaggcggcggctcaaaaaaaaagccagcccctcgcggcccgacagagtctcggcgccccgcgggtcggtggagcctcaggggtgagcgcaggccggagacaggggaacccgccgcgggacaggggaaggccggacggaacgcgggtaagctgccgcagcttccggccgggccactagcgcggaccctacggccggggcgggacttccggcaaggcgcggaagcggcggtagctgcagctggcgaagttgggcgactggcggatgcaggccttgcggcacgtcgtgtgcgccctgtccggcggcgtggacagcgccgtggccgcgctgctgctgaggcggagaggttaccaggtgacaggggtgtttatgaagaactgggactcactggatgaacatggggtctgtactgccgacaaagactgtgaagatgcttacagagtttgccagatcttagacatccctttccatcaagtgtcctacgtaaaggagtattggaatgatgtgttcaggggcagatgccattgccacaggtcactatgcaagaacttccctggaagatgaagaagtctttgagcagaagcacgttaagaagcccgaagggcttttcagaaatcggtttgaagttagaaatgcggtaaaactcctccaggcagctgacagctttaaagaccagaccttctttctcagccaggtttcccaggatgccctgaggagaaccatcttccctctggggggattaacgaaagagtttgtaaagaaaatcgctgctgagaatagacttcatcatgtgcttcagaagaaagagagcatgggcatgtgtttcatcgggaagaggaattttgaacatttccttcttcagtatctgcagcctcgacctggtcactttatttccatagaagacaataaggttctgggaacacataaaggttggttcctgtataccttgggccagagagcaaacataggtggcctgagagagccctggtacgtggtggagaaggacagcgtcaagggtgacgtgtttgtggccccccggacagaccacccagccctgtacagggacctgctgaggaccagccgcgtgcactggattgcggaggagcctcccgcagcactggtccgggacaagatgatggagtgccacttccgattccgccaccagatggcactagtgccctgtgtgctgaccctcaatcaagatggcaccgtgtgggtgacagctgtgcaggctgtgcgtgcccttgccacaggacagtttgctgtgttctacaagggggacgagtgcctgggcagcgggaagatcctgcggctggggccgtctgcctacacgctccagaagggccagcgcagagctgggatggccactgagagccccagtgacagcccagaagatggtccaggcctgagtcccttgctctgacagagatggatctgctagaaggaacctggagagcaggacccatggctgggcggctggtgagcagtccaggtgcccaagggccagcttgctgctgcccaaagcagaggaagccgggctggctgagggtccgaaaagcctgcaggggcccggcgagccccaggaagagcctcagctccaggctggggctctggctgctggagcatctgctggctggtggggtggcccgagttccccttcaccgcccccagggagggtttcccacctcagagtacaccgaggggacctgcagagggggctgtcgggacagcgtggaataaacattatttcaagg

SEQ ID NO: 32796 - DNA, 1401 bp, Homo sapiens
gtgcacgtctcctccctccctgggccgctggttgcgcgcgggtcggcaggaggataccccgtcctctgactttggttcggaggctcctcgccctccacctgtgtagtcggaggtgtgcgcgactgcagctccgactacctgggagcagttccgcgcccctctccacccacgcgcgcccacccacagttaccaggtgacaggggtgtttatgaagaactgggactcactggatgaacatggggtctgtactgccgacaaagactgtgaagatgcttacagagtttgccagatcttagacatccctttccatcaagtgtcctacgtaaaggagtattggaatgatgtgttcagtgactttttgaatgagtatgaaaaaggaaggactcccaatcctgacatagtttgcaacaagcacatcaaatttagttgcttttttcattatgctgtggataatcttggggcagatgccattgccacaggtcactatgcaagaacttccctggaagatgaagaagtctttgagcagaagcacgttaagaagcccgaagggcttttcagaaatcggtttgaagttagaaatgccaggtttcccaggatgccctgaggagaaccatcttccctctggggggattaacgaaagagtttgtaaagaaaatcgctgctgagaatagacttcatcatgtgcttcagaagaaagagagcatgggcatgtgtttcatcgggaagaggaattttgaacatttccttcttcagtatctgcagcctcgacctggtcactttatttccatagaagacaataaggttctgggaacacataaaggtgaggtgcagactctgccacttgtcatctgaaatgcctagagctgtggcgtttcagctctgggagactagaccagagttcctgtcgtcccttccacttggctggagaattgtagaaggctctgtggggcggccgggggcgggcacggcctagggtggaacagttgccttgatggtggctgggtgcacttccagatgtggcctcagctgagatgctggagttcatgaaaagcgcgcctctgacttggaaggactatactctgtgagttacgtatcaagtccctgtaaaaagaatgatttccttcctgtgtaaggaaaatgttaaactacacaaaactccactctgattcagggagtaaggtggacgtcccggcatggtgtgaatgattaaggaccacatgcagcgatgggatcaggcgtccgcgctggccagagtgctgctcgctcatgtgcagacccttactgcggtgaggcctgcgtgagcctgtgctgtgcctggtgtcaggggacaggctccgagtcagtcacagtgtgcagtcctgctgtggggacagagtgcagccattgttgggttagtacagt

SEQ ID NO: 32797 - DNA, 1793 bp, Homo sapiens
gccgagaggaggcctccaatggctggctggggggcttagaattttatttttggtttacagcgcagaagaagagcagtgaggccggggcgcgggtggggagggcaaggcggcggctcaaaaaaaaagccagcccctcgcggcccgacagagtctcggcgccccgcgggtcggtggagcctcaggggtgagcgcaggccggagacaggggaacccgccgcgggacaggggaaggccggacggaacgcgggtaagctgccgcagcttccggccgggccactagcgcggaccctacggccggggcgggacttccggcaaggcgcggaagcggcggtagctgcagctggcgaagttgggcgactggcggatgcaggccttgcggcacgtcgtgtgcgccctgtccggcggcgtggacagcgccgtggccgcgctgctgctgaggcggagaggttaccaggtgacaggggtgtttatgaagaactgggactcactggatgaacatggggtctgtactgccgacaaagactgtgaagatgcttacagagtttgccagatcttagacatccctttccatcaagtgtcctacgtaaaggagtattggaatgatgtgttcaggggcagatgccattgccacaggtcactatgcaagaacttccctggaagatgaagaagtctttgagcagaagcacgttaagaagcccgaagggcttttcagaaatcggtttgaagttagaaatggtttcccaggatgccctgaggagaaccatcttccctctggggggattaacgaaagagtttgtaaagaaaatcgctgctgagaatagacttcatcatgtgcttcagaagaaagagagcatgggcatgtgtttcatcgggaagaggaattttgaacatttccttcttcagtatctgcagcctcgacctggtcactttatttccatagaagacaataaggttctgggaacacataaaggttggttcctgtataccttgggccagagagcaaacataggtggcctgagagagccctggtacgtggtggagaaggacagcgtcaagggtgacgtgtttgtggccccccggacagaccacccagccctgtacagggacctgctgaggaccagccgcgtgcactggattgcggaggagcctcccgcagcactggtccgggacaagatgatggagtgccacttccgattccgccaccagatggcactagtgccctgtgtgctgaccctcaatcaagatggcaccgtgtgggtgacagctgtgcaggctgtgcgtgcccttgccacaggacagtttgctgtgttctacaagggggacgagtgcctgggcagcgggaagatcctgcggctggggccgtctgcctacacgctccagaagggccagcgcagagctgggatggccactgagagccccagtgacagcccagaagatggtccaggcctgagtcccttgctctgacagagatggatctgctagaaggaacctggagagcaggacccatggctgggcggctggtgagcagtccaggtgcccaagggccagcttgctgctgcccaaagcagaggaagccgggctggctgagggtccgaaaagcctgcaggggcccggcgagccccaggaagagcctcagctccaggctggggctctggctgctggagcatctgctggctggtggggtggcccgagttccccttcaccgcccccagggagggtttcccacctcagagtacaccgaggggacctgcagagggggctgtcgggacagcgtggaataaacattatttcaa

SEQ ID NO: 32798 - DNA, 1775 bp, Homo sapiens
ggctggggggcttagaattttatttttggtttacagcgcagaagaagagcagtgaggccggggcgcgggtggggagggcaaggcggcggctcaaaaaaaaagccagcccctcgcggcccgacagagtctcggcgccccgcgggtcggtggagcctcaggggtgagcgcaggccggagacaggggaacccgccgcgggacaggggaaggccggacggaacgcgggtaagctgccgcagcttccggccgggccactagcgcggaccctacggccggggcgggacttccggcaaggcgcggaagcggcggtagctgcagctggcgaagttgggcgactggcggatgcaggccttgcggcacgtcgtgtgcgccctgtccggcggcgtggacagcgccgtggccgcgctgctgctgaggcggagaggttaccaggtgacaggggtgtttatgaagaactgggactcactggatgaacatggggtctgtactgccgacaaagactgtgaagatgcttacagagtttgccagatcttagacatccctttccatcaagtgtcctacgtaaaggagtattggaatgatgtgttcaggggcagatgccattgccacaggtcactatgcaagaacttccctggaagatgaagaagtctttgagcagaagcacgttaagaagcccgaagggcttttcagaaatcggtttgaagttagaaatgccaggtttcccaggatgccctgaggagaaccatcttccctctggggggattaacgaaagagtttgtaaagaaaatcgctgctgagaatagacttcatcatgtgcttcagaagaaagagagcatgggcatgtgtttcatcgggaagaggaattttgaacatttccttcttcagtatctgcagcctcgacctggtcactttatttccatagaagacaataaggttctgggaacacataaaggttggttcctgtataccttgggccagagagcaaacataggtggcctgagagagccctggtacgtggtggagaaggacagcgtcaagggtgacgtgtttgtggccccccggacagaccacccagccctgtacagggacctgctgaggaccagccgcgtgcactggattgcggaggagcctcccgcagcactggtccgggacaagatgatggagtgccacttccgattccgccaccagatggcactagtgccctgtgtgctgaccctcaatcaagatggcaccgtgtgggtgacagctgtgcaggctgtgcgtgcccttgccacaggacagtttgctgtgttctacaagggggacgagtgcctgggcagcgggaagatcctgcggctggggccgtctgcctacacgctccagaagggccagcgcagagctgggatggccactgagagccccagtgacagcccagaagatggtccaggcctgagtcccttgctctgacagagatggatctgctagaaggaacctggagagcaggacccatggctgggcggctggtgagcagtccaggtgcccaagggccagcttgctgctgcccaaagcagaggaagccgggctggctgagggtccgaaaagcctgcaggggcccggcgagccccaggaagagcctcagctccaggctggggctctggctgctggagcatctgctggctggtggggtggcccgagttccccttcaccgcccccagggagggtttcccacctcagagtacaccgaggggacctgcagagggggctgtcgggacagcgtggaataaacattatttcaagg

SEQ ID NO: 32799 - DNA, 1688 bp, Homo sapiens
ggctggggggcttagaattttatttttggtttacagcgcagaagaagagcagtgaggccggggcgcgggtggggagggcaaggcggcggctcaaaaaaaaagccagcccctcgcggcccgacagagtctcggcgccccgcgggtcggtggagcctcaggggtgagcgcaggccggagacaggggaacccgccgcgggacaggggaaggccggacggaacgcgggtaagctgccgcagcttccggccgggccactagcgcggaccctacggccggggcgggacttccggcaaggcgcggaagcggcggtagctgcagctggcgaagttgggcgactggcggatgcaggccttgcggcacgtcgtgtgcgccctgtccggcggcgtggacagcgccgtggccgcgctgctgctgaggcggagaggttaccaggtgacaggggtgtttatgaagaactgggactcactggatgaacatggggtctgtactgccgacaaagactgtgaagatgcttacagagtttgccagatcttagacatccctttccatcaagtgtcctacgtaaaggagtattggaatgatgtgttcaggggcagatgccattgccacaggtcactatgcaagaacttccctggaagatgaagaagtctttgagcagaagcacgttaagaagcccgaagggcttttcagaaatcggtttgaagttagaaatggtttcccaggatgccctgaggagaaccatcttccctctggggggattaacgaaagagtttgtaaagaaaatcgctgctgagaatagacttcatcatgtgcttcagaagaaagagagcatgggcatgtgtttcatcgggaagaggaattttgaacatttccttcttcagtatctgcagcctcgacctggtcactttatttccatagaagacaataaggttctgggaacacataaaggttggttcctgtataccttgggccagagagcaaacataggtggcctgagagagccctggtacgtggtggagaaggacagcgtcaagggtgacgtgtttgtggccccccggacagaccacccagccctgtacagggacctgctgaggaccagccgcgtgcactggattgcggaggagcctcccgcagcactggtccgggacaagatgatggagtgccacttccgattccgccaccagatggcactagtttgctgtgttctacaagggggacgagtgcctgggcagcgggaagatcctgcggctggggccgtctgcctacacgctccagaagggccagcgcagagctgggatggccactgagagccccagtgacagcccagaagatggtccaggcctgagtcccttgctctgacagagatggatctgctagaaggaacctggagagcaggacccatggctgggcggctggtgagcagtccaggtgcccaagggccagcttgctgctgcccaaagcagaggaagccgggctggctgagggtccgaaaagcctgcaggggcccggcgagccccaggaagagcctcagctccaggctggggctctggctgctggagcatctgctggctggtggggtggcccgagttccccttcaccgcccccagggagggtttcccacctcagagtacaccgaggggacctgcagagggggctgtcgggacagcgtggaataaacattatttcaagg

SEQ ID NO: 32800 - DNA, 1882 bp, Homo sapiens
ggctggggggcttagaattttatttttggtttacagcgcagaagaagagcagtgaggccggggcgcgggtggggagggcaaggcggcggctcaaaaaaaaagccagcccctcgcggcccgacagagtctcggcgccccgcgggtcggtggagcctcaggggtgagcgcaggccggagacaggggaacccgccgcgggacaggggaaggccggacggaacgcgggtaagctgccgcagcttccggccgggccactagcgcggaccctacggccggggcgggacttccggcaaggcgcggaagcggcggtagctgcagctggcgaagttgggcgactggcggatgcaggccttgcggcacgtcgtgtgcgccctgtccggcggcgtggacagcgccgtggccgcgctgctgctgaggcggagaggttaccaggtgacaggggtgtttatgaagaactgggactcactggatgaacatggggtctgtactgccgacaaagactgtgaagatgcttacagagtttgccagatcttagacatccctttccatcaagtgtcctacgtaaaggagtattggaatgatgtgttcagtgactttttgaatgagtatgaaaaaggaaggactcccaatcctgacatagtttgcaacaagcacatcaaatttagttgcttttttcattatgctgtggataatcttggggcagatgccattgccacaggtcactatgcaagaacttccctggaagatgaagaagtctttgagcagaagcacgttaagaagcccgaagggcttttcagaaatcggtttgaagttagaaatgccaggtttcccaggatgccctgaggagaaccatcttccctctggggggattaacgaaagagtttgtaaagaaaatcgctgctgagaatagacttcatcatgtgcttcagaagaaagagagcatgggcatgtgtttcatcgggaagaggaattttgaacatttccttcttcagtatctgcagcctcgacctggtcactttatttccatagaagacaataaggttctgggaacacataaaggttggttcctgtataccttgggccagagagcaaacataggtggcctgagagagccctggtacgtggtggagaaggacagcgtcaagggtgacgtgtttgtggccccccggacagaccacccagccctgtacagggacctgctgaggaccagccgcgtgcactggattgcggaggagcctcccgcagcactggtccgggacaagatgatggagtgccacttccgattccgccaccagatggcactagtgccctgtgtgctgaccctcaatcaagatggcaccgtgtgggtgacagctgtgcaggctgtgcgtgcccttgccacaggacagtttgctgtgttctacaagggggacgagtgcctgggcagcgggaagatcctgcggctggggccgtctgcctacacgctccagaagggccagcgcagagctgggatggccactgagagccccagtgacagcccagaagatggtccaggcctgagtcccttgctctgacagagatggatctgctagaaggaacctggagagcaggacccatggctgggcggctggtgagcagtccaggtgcccaagggccagcttgctgctgcccaaagcagaggaagccgggctggctgagggtccgaaaagcctgcaggggcccggcgagccccaggaagagcctcagctccaggctggggctctggctgctggagcatctgctggctggtggggtggcccgagttccccttcaccgcccccagggagggtttcccacctcagagtacaccgaggggacctgcagagggggctgtcgggacagcgtggaataaacattatttcaagg

SEQ ID NO: 32801 - DNA, 1208 bp, Homo sapiens
cgcggggatggagcccctgcgggtgctggagctatacagcggcgtgggcggcatgcaccacgcgctgagagaaagctgtatacctgcacaagtggtggctgccattgatgtcaacactgtcgctaatgaagtatacaagtataattttcctcacacacagttacttgccaagacgattgaaggcattacactcgaagagtttgacagattatcttttgatatgattttaatgagccctccctgccagccattcacaagagacctcttgatacaaacaatagaaaattgtggctttcagtaccaagagtttctattatctccaacctctcttggcattccaaattcaaggctacgatattttcttattgcaaagcttcagtcagagccattaccctttcaagcccctggtcaggtactgatggagttccccaaaattgaatctgtacatccacaaaaatatgcaatggatgtagaaaataaaattcaagaaaagaacgttgaaccaaatattagctttgatggcagcatacagtgttctggaaaagatgccattctttttaagcttgaaactgcagaagaaattcacaggaaaaatcaacaagatagtgatctctctgtgaaaatgctaaaagattttcttgaagatgacactgacgtgaaccagtatcttttaccaccaaagtcattgctgcgatatgctcttctgttagacattgttcagcccacttgtagaaggtccgtgtgctttaccaaaggatatggaagctacatagaagggacagggtctgtgttacagactgcagaggatgtgcaggttgagaatatctacaaatcccttaccaatttgtcacaagaagaacagataacaaagctgttaatacttaaactgcgatatttcactcctaaagaaatagcaaatctccttggatttcctccagagttcggatttcctgagaagataacagtgaaacagcgttatcgcctacttggaaatagtctcaacgtgcatgtagtagctaaactaatcaaaatcttatatgaataattttgaaataactctgaaagatggtcatatgatattccttcattttcagagagtaattctgaaattctgttttgaactaattctggtgaaatttaactaaattattttaatctgtccttattaagaaatttggattttattaaaaaaatccatgtgtttcatc

SEQ ID NO: 32802 - DNA, 1197 bp, Homo sapiens
cgcggggatggagcccctgcgggtgctggagctatacagcggcgtgggcggcatgcaccacgcgctgagagaaagctgtatacctgcacaagtggtggctgccattgatgtcaacactgtcgctaatgaagtatacaagtataattttcctcacacacagttacttgccaagacgattgaaattacaaaaattaccaaagtatattcttttggaaaatgttaaaggttttgaagtatcttctacaagagacctcttgatacaaacaatagaaaattgtggctttcagtaccaagagtttctattatctccaacctctcttggcattccaaattcaaggctacgatattttcttattgcaaagcttcagtcagagccattaccctttcaagcccctggtcaggtactgatggagttccccaaaattgaatctgtacatccacaaaaatatgcaatggatgtagaaaataaaattcaagaaaagaacgttgaaccaaatattagctttgatggcagcatacagtgttctggaaaagatgccattctttttaagcttgaaactgcagaagaaattcacaggaaaaatcaacaagatagtgatctctctgtgaaaatgctaaaagattttcttgaagatgacactgacgtgaaccagtatcttttaccaccaaagtcattgctgcgatatgctcttctgttagacattgttcagcccacttgtagaaggtccgtgtgctttaccaaaggatatggaagctacatagaagggacagggtctgtgttacagactgcagaggatgtgcaggttgagaatatctacaaatcccttaccaatttgtcacaagaagaacagataacaaagctgttaatacttaaactgcgatatttcactcctaaagaaatagcaaatctccttggatttcctccagagttcggatttcctgagaagataacagtgaaacagcgttatcgcctacttggaaatagtctcaacgtgcatgtagtagctaaactaatcaaaatcttatatgaataattttgaaataactctgaaagatggtcatatgatattccttcattttcagagagtaattctgaaattctgttttgaactaattctggtgaaatttaactaaattattttaatctgtccttattaagaaatttggattttattaaaaaaatccatgtgtttcatc

SEQ ID NO: 32803 - DNA, 1131 bp, Homo sapiens
cgcggggatggagcccctgcgggtgctggagctatacagcggcgtgggcggcatgcaccacgcgctgagagaaagctgtatacctgcacaagtggtggctgccattgatgtcaacactgtcgctaatgaagtatacaagtataattttcctcacacacagttacttgccaagacgattgaaagacctcttgatacaaacaatagaaaattgtggctttcagtaccaagagtttctattatctccaacctctcttggcattccaaattcaaggctacgatattttcttattgcaaagcttcagtcagagccattaccctttcaagcccctggtcaggtactgatggagttccccaaaattgaatctgtacatccacaaaaatatgcaatggatgtagaaaataaaattcaagaaaagaacgttgaaccaaatattagctttgatggcagcatacagtgttctggaaaagatgccattctttttaagcttgaaactgcagaagaaattcacaggaaaaatcaacaagatagtgatctctctgtgaaaatgctaaaagattttcttgaagatgacactgacgtgaaccagtatcttttaccaccaaagtcattgctgcgatatgctcttctgttagacattgttcagcccacttgtagaaggtccgtgtgctttaccaaaggatatggaagctacatagaagggacagggtctgtgttacagactgcagaggatgtgcaggttgagaatatctacaaatcccttaccaatttgtcacaagaagaacagataacaaagctgttaatacttaaactgcgatatttcactcctaaagaaatagcaaatctccttggatttcctccagagttcggatttcctgagaagataacagtgaaacagcgttatcgcctacttggaaatagtctcaacgtgcatgtagtagctaaactaatcaaaatcttatatgaataattttgaaataactctgaaagatggtcatatgatattccttcattttcagagagtaattctgaaattctgttttgaactaattctggtgaaatttaactaaattattttaatctgtccttattaagaaatttggattttattaaaaaaatccatgtgtttcatc

SEQ ID NO: 32804 - DNA, 3527 bp, Homo sapiens
acggaccggcaggcctagctccggggctgcggcggctgaggcgcggggatggagcccctgcgggtgctggagctatacagcggcgtgggcggcatgcaccacgcgctgagagaaagctgtatacctgcacaagtggtggctgccattgatgtcaacactgtcgctaatgaagtatacaagtataattttcctcacacacagttacttgccaagacgattgaaggcattacactcgaagagtttgacagattatcttttgatatgattttaatgagccctccctgccagccattcacaaggattggccggcagggtgatatgactgattcaaggacgaatagcttcttacatattctagatattctcccaagattacaaaaattaccaaagtatattcttttggaaaatgttaaaggttttgaagtatcttctacaagagacctcttgatacaaacaatagaaaattgtggctttcagtaccaagagtttctattatctccaacctctcttggcattccaaattcaaggctacgatattttcttattgcaaagcttcagtcagagccattaccctttcaagcccctggtcaggtactgatggagttccccaaaattgaatctgtacatccacaaaaatatgcaatggatgtagaaaataaaattcaagaaaagaacgttgaaccaaatattagctttgatggcagcatacagtgttctggaaaagatgccattctttttaagcttgaaactgcagaagaaattcacaggaaaaatcaacaagatagtgatctctctgtgaaaatgctaaaagattttcttgaagatgacactgacgtgaaccagtatcttttaccaccaaagtcattgctgcgatatgctcttctgttagacattgttcagcccacttgtagaaggtccgtgtgctttaccaaaggatatggaagctacatagaagggacagggtctgtgttacagactgcagaggatgtgcaggttgagaatatctacaaatcccttaccaatttgtcacaagaagaacagataacaaagctgttaatacttaaactgcgatatttcactcctaaagaaatagcaaatctccttggatttcctccagagttcggatttcctgagaagataacagtgaaacagcgttatcgcctacttggaaatagtctcaacgtgcatgtagtagctaaactaatcaaaatcttatatgaataattttgaaataactctgaaagatggtcatatgatattccttcattttcagagagtaattctgaaattctgttttgaactaattctggtgaaatttaactaaattattttaatctgtccttattaagaaatttggattttattaaaaaaatccatgtgtttcatcaaatttatattactgtattttataaaatacgaactattgttatgctttatggagagtatattttcatatgaaactgataaatatatatgtggaatattctttttaaaaacaattttataaacaaatcaaggagcactagagctttagtgtctacatgagtatcttgtgaagtgtcataacaggcataacatatttttatgttaattaaagaagttttttatttctaattttaaaataatgattctaattctagcccattgaatgttttacttaatttccaatcctgtaaatatttctttatttcatctaaacaaatgcatatgatatgtaaaccaaattatcatcattcagtttatacagcagactgaagaatatgtcaggaaaaataatcctaaatgtttgattacctctccatgaagcggccacagaaactgttggtgcacattatctacattttcctcagcctctatctgaaggacaaaactcatttttccttcttcattttgtatgtactttcctttagttgactattatcaaagcttgtttttgtcttctcagcttctgagttgaatttgcctttgcacgctgaggaatgtagcatgacgttaagatttcagggaggaagctgccctctgatcccatgtcatatgacagtactcccctccccccagttgttctttattgtagcaacatacactctcaatgaacttttatgacttttaactttctctgtctctcttcctcagcagacctcttggaattagggtttctaatcaaactaagtcttgcatcataaattctatggtttgtgataaaagcaagtgacaaagagaagagagatgaaaagaaacaagtccagaaatcatattacaagattttaattcaaatttttcttcttaaaaatcagctatttagaggtggataaattggaagtttgtgcattgcttgtgggaacgtaaaatggttcagctgctgttggaaaacgctatggaggttcgtcacaaaattcaacatagaattaccctatgattcagcgattccacctctggctatagatccaaaagaattgaaagcagggacttgaacagatatttgtacaccagcgtttataacaccattatttacagtagccaaaaggtagaagcagcccaagtgtcatcccattcacccatgaatggatgcaggaattgtgttccgtgcatgcagtggaatagtaccagccttccgcaggaaggaaattctgacatatgcggtgacatggatgaaccttgagtacattatgcgaagtgaaataagccaccctgtggggatggagaatgggtagttagtgcataatggatacaaagtttctgattggggtgatgagaaagttctggaggtggatggggaggatggttgcacaacagtgtgagtgtacttaatgccactgcaactgtatatttaaaaatagttaaaatgataaattttacattatgtatattttactgcaattgaaaaaatcatactctattaccaatttttcagaactcatagataaatatgaatgtagggaagctgtaagccagcccatatacagaaactatcactatctacatttttcatatgtgttcagacagagcctattacaagtctcataaatttcagtaaacaatcacaaattattttggcacactttcatgtaggttctgttcactgctgaaatattctaaataaaatggtttagagttttactgtaactatgaataattatgctataattatagtatcccacattcggttgagcaacattatacaaaataagtgtcgagttactgtgcaccaactataaatacttgaaaggtctgtagagacatttgcttacaaactggtagacagaatgtagcttagtggaattcttaaattatgggaatgtattcacaggaagacggtgattcttgcccttaattcataattgaaaatatgcagtaacaagcataaaactcacatcttaatgaagatgtatctaccagtgtcattcaattagcagatgtatatgtatgcataattaatttggaaaatgttattttatggaatgtctgctatatgcttttggtaataatgctgtatataaaatttgcactggaaattctgtttcctgata

SEQ ID NO: 32805 - DNA, 1274 bp, Homo sapiens
cgcggggatggagcccctgcgggtgctggagctatacagcggcgtgggcggcatgcaccacgcgctgagagaaagctgtatacctgcacaagtggtggctgccattgatgtcaacactgtcgctaatgaagtatacaagtataattttcctcacacacagttacttgccaagacgattgaaggcattacactcgaagagtttgacagattatcttttgatatgattttaatgagccctccctgccagccattcacaagattacaaaaattaccaaagtatattcttttggaaaatgttaaaggttttgaagtatcttctacaagagacctcttgatacaaacaatagaaaattgtggctttcagtaccaagagtttctattatctccaacctctcttggcattccaaattcaaggctacgatattttcttattgcaaagcttcagtcagagccattaccctttcaagcccctggtcaggtactgatggagttccccaaaattgaatctgtacatccacaaaaatatgcaatggatgtagaaaataaaattcaagaaaagaacgttgaaccaaatattagctttgatggcagcatacagtgttctggaaaagatgccattctttttaagcttgaaactgcagaagaaattcacaggaaaaatcaacaagatagtgatctctctgtgaaaatgctaaaagattttcttgaagatgacactgacgtgaaccagtatcttttaccaccaaagtcattgctgcgatatgctcttctgttagacattgttcagcccacttgtagaaggtccgtgtgctttaccaaaggatatggaagctacatagaagggacagggtctgtgttacagactgcagaggatgtgcaggttgagaatatctacaaatcccttaccaatttgtcacaagaagaacagataacaaagctgttaatacttaaactgcgatatttcactcctaaagaaatagcaaatctccttggatttcctccagagttcggatttcctgagaagataacagtgaaacagcgttatcgcctacttggaaatagtctcaacgtgcatgtagtagctaaactaatcaaaatcttatatgaataattttgaaataactctgaaagatggtcatatgatattccttcattttcagagagtaattctgaaattctgttttgaactaattctggtgaaatttaactaaattattttaatctgtccttattaagaaatttggattttattaaaaaaatccatgtgtttcatc

SEQ ID NO: 32806 - DNA, 1374 bp, Homo sapiens
attcgggaagccttattgttttccgtcctttgttcccctctagacccttgccaatccccaggccgcgaggccctctgaagccctgagcctggagcggtaggagacgggggaactgaaacgccgcggaaccagaggctgagggagcggcgcgatggagggaggaggagcgacggaccggcaggcctagctccggggctgcggcggctgaggcgcggggatggagcccctgcgggtgctggagctatacagcggcgtgggcggcatgcaccacgcgctgagagaaagctgtatacctgcacaagtggtggctgccattgatgtcaacactgtcgctaatgaagtatacaagtataattttcctcacacacagttacttgccaagacgattgaagattggccggcagggtgatatgactgattcaaggacgaatagcttcttacatattctagatattctcccaagagacctcttgatacaaacaatagaaaattgtggctttcagtaccaagagtttctattatctccaacctctcttggcattccaaattcaaggctacgatattttcttattgcaaagcttcagtcagagccattaccctttcaagcccctggtcaggtactgatggagttccccaaaattgaatctgtacatccacaaaaatatgcaatggatgtagaaaataaaattcaagaaaagaacgttgaaccaaatattagctttgatggcagcatacagtgttctggaaaagatgccattctttttaagcttgaaactgcagaagaaattcacaggaaaaatcaacaagatagtgatctctctgtgaaaatgctaaaagattttcttgaagatgacactgacgtgaaccagtatcttttaccaccaaagtcattgctgcgatatgctcttctgttagacattgttcagcccacttgtagaaggtccgtgtgctttaccaaaggatatggaagctacatagaagggacagggtctgtgttacagactgcagaggatgtgcaggttgagaatatctacaaatcccttaccaatttgtcacaagaagaacagataacaaagctgttaatacttaaactgcgatatttcactcctaaagaaatagcaaatctccttggatttcctccagagttcggatttcctgagaagataacagtgaaacagcgttatcgcctacttggaaatagtctcaacgtgcatgtagtagctaaactaatcaaaatcttatatgaataattttgaaataactctgaaagatggtcatatgatattccttcattttcagagagtaattctgaaattctgttttgaactaattctggtgaaatttaactaaattattttaatctgtccttattaa

SEQ ID NO: 32807 - DNA, 2276 bp, Homo sapiens
gttggtgacgtcaccgcgttcaccagcccggaagtgcgcgtggcggcggtggcggctgcggcaacagcggggccgatgtgtagttggtgactgcctctccagatgctgaggtgcctgtatcattggcacaggccagtgctgaaccgtaggtggagtaggctgtgccttccgaagcagtatctattcacaatgaagttgcagtctcccgaattccagtcacttttcacagaaggactgaagagtctgacagaattatttgtcaaagagaatcacgaattaagaatagcaggaggagcagtgagggatttattaaatggagtaaagcctcaggatatagattttgccaccactgctacccctactcaaatgaaggagatgtttcagtcggctgggattcggatgataaacaacagaggagaaaagcacggaacaattactgccaggcttcatgaagaaaattttgagattactacactacggattgatgtcaccactgatggaagacatgctgaggtagaatttacaactgactggcagaaagatgcggaacgcagagatctcactataaattctatgtttttaggttttgatggcactttatttgactactttaatggttatgaagatttaaaaaataagaaagttagatttgttggacatgctaaacagagaatacaagaggattatcttagaattttaagatacttcaggttttatgggagaattgtagacaaacctggtgaccatgatcctgagactttggaagcaattgcagaaaatgcaaaaggcttggctggaatatcaggagaaaggatttgggtggaactgaaaaaaattcttgttggtaaccatgtaaatcatttgattcaccttatctatgatcttgatgtggctccttatataggtttacctgctaatgcaagtttagaagaatttgacaaagtcagtaaaaatgttgatggtttttcaccaaagccagtgactcttttggcctcattattcaaagtacaagatgatgtcacaaaattggatttgaggttgaagatcgcaaaagaggagaaaaaccttggcttatttatagttaaaaataggaaagatttaattaaagcaacagatagttcagacccattgaaaccctatcaagacttcattatagattctagggaacctgatgcaactactcgtgtatgtgaactactgaagtaccaaggagagcactgtctcctaaaggaaatgcagcagtggtccattcctccatttcctgtaagtggccatgacatcagaaaagtgggcatttcttcaggaaaagaaattggggctctattacaacagttgcgagaacagtggaaaaaaagtggttaccaaatggaaaaagatgaacttctgagttacataaagaagacctaaaactgatggctactaaaaagcagagcatttctggtaagactaaattttctcccctccctcttaatgaggttttagagactacaccagaataaaagacagtttaggggacctctgtagaacaacaagggtcttattttgtgaattatatatttcaagaactaaacagagatccacctttctggatctgatttatatcactgaaatgtacagttcttttggaatagtttcacctgagaaaacatagttggctattatctatcttaacctgttcaggcttttaaaaaaaactgtttttgcatagggtagtactaagatcttaaaaagtggtaactgtcttgaagaaaaaacgtttattgtttgtttgcaattgaaataacagggttaccttaacaatgactgtctatgatgtgtcagttcttatctgaattccaaaataaacctgtgcttaaaaaagaaataattgaccaagtaagtttgcataaaatgtgaatactaaatgtgtccccagttgctggcattcatatgtacaggatttgttctagcaagctatgcttcagtatgtggttgatatttttctgtcacaatgatttctttatgcatgcagagcctggggaagtcatgggattaacttgagggtcactattgagcctattaattaattattgttttaataaaacaaacattggtattggaagataaatatgtttatgtggtatctgacaatgtgtattaggtgtcatatacaatggtaatatgcctgtctttaaagtgttattttattaattaaaaggatatggctattattatatattctctaaagatttgagtcctaaatgctttcatcaggtaaataaaatgtataatacaaa

SEQ ID NO: 32808 - DNA, 2180 bp, Homo sapiens
cgcgtggcggcggtggcggctgcggcaacagcggggccgatgtgtagttggtgactgcctctccagatgctgaggtgcctgtatcattggcacaggccagtgctgaaccgtaggtggagtaggctgtgccttccgaagcagtatctattcacaatgaagttgcagtctcccgaattccagtcacttttcacagaaggactgaagagtctgacagaattatttgtcaaagagaatcacgaattaagaatagcaggaggagcagtgagggatttattaaatggagtaaagcctcaggatatagattttgccaccactgctacccctactcaaatgaaggagatgtttcagtcggctgggattcggatgataaacaacagaggagaaaagcacggaacaattactgccaggcttcatgaagaaaattttgagattactacactacggattgatgtcaccactgatggaagacatgctgaggtagaatttacaactgactggcagaaagatgcggaacgcagagatctcactataaattctatgtttttaggttttgatggcactttatttgactactttaatggttatgaagatttaaaaaataagaaagttagatttgttggacatgctaaacagagaatacaagaggattatcttagaattttaagatacttcaggttttatgggagaattgtagacaaacctggtgaccatgatcctgagactttggaagcaattgcagaaaatgcaaaaggcttggctggaatatcaggagaaaggatttgggtggaactgaaaaaaattcttgttggtttacctgctaatgcaagtttagaagaatttgacaaagtcagtaaaaatgttgatggtttttcaccaaagccagtgactcttttggcctcattattcaaagtacaagatgatgtcacaaaattggatttgaggttgaagatcgcaaaagaggagaaaaaccttggcttatttatagttaaaaataggaaagatttaattaaagcaacagatagttcagacccattgaaaccctatcaagacttcattatagattctagggaacctgatgcaactactcgtgtatgtgaactactgaagtaccaaggagagcactgtctcctaaaggaaatgcagcagtggtccattcctccatttcctgtaagtggccatgacatcagaaaagtgggcatttcttcaggaaaagaaattggggctctattacaacagttgcgagaacagtggaaaaaaagtggttaccaaatggaaaaagatgaacttctgagttacataaagaagacctaaaactgatggctactaaaaagcagagcatttctggtaagactaaattttctcccctccctcttaatgaggttttagagactacaccagaataaaagacagtttaggggacctctgtagaacaacaagggtcttattttgtgaattatatatttcaagaactaaacagagatccacctttctggatctgatttatatcactgaaatgtacagttcttttggaatagtttcacctgagaaaacatagttggctattatctatcttaacctgttcaggcttttaaaaaaaactgtttttgcatagggtagtactaagatcttaaaaagtggtaactgtcttgaagaaaaaacgtttattgtttgtttgcaattgaaataacagggttaccttaacaatgactgtctatgatgtgtcagttcttatctgaattccaaaataaacctgtgcttaaaaaagaaataattgaccaagtaagtttgcataaaatgtgaatactaaatgtgtccccagttgctggcattcatatgtacaggatttgttctagcaagctatgcttcagtatgtggttgatatttttctgtcacaatgatttctttatgcatgcagagcctggggaagtcatgggattaacttgagggtcactattgagcctattaattaattattgttttaataaaacaaacattggtattggaagataaatatgtttatgtggtatctgacaatgtgtattaggtgtcatatacaatggtaatatgcctgtctttaaagtgttattttattaattaaaaggatatggctattattatatattctctaaagatttgagtcctaaatgctttcatcaggtaaataaaatgtataatacaaa

SEQ ID NO: 32809 - DNA, 976 bp, Homo sapiens
gcgcgtggcggcggtggcggctgcggcaacagcggggccgatgtgtagttggtgactgcctctccagatgctgaggtgcctgtatcattggcacaggccagtgctgaaccgtaggtggagtaggctgtgccttccgaagcagtatctattcacaatgaagttgcagtctcccgaattccagtcacttttcacagaaggactgaagagtctgacaggtataaatgctttccatgagaactgaaggaagaaggaaataggagttgcctccattgtgcacgttgcaaaacctgtctggaaggagcataggaaatggctttagctaagtgccagtagcttcttgctgttgccacagtttcattagtgttgattctcaatgttgtctgctgatgttgctaaagcagccacacagtagcattacaaagcctgtgggaattttaatagcaccttcataaatatatttagtagtatatgtagaaatatgacctatacagcactggctatctattagattcacctggggagcttttaaagcacacatgctcgggttctacctgcagcctactgaattagaatctctgggtgggatgaccatctatatttttaataaaagctccacaagttaattctgatgcacagaagatagacgaaccattactttaacatgactcaccttgtattagcttattctcaaagctactttcccattcttgaaattggatgatggctttttaggtacgtgccagagataaatggcccagaatatgttgattcttttagattgttttaggcagactttaagtagagggcttaaatgcatgtttggttttgccgatgcttcactatcttttttaattggagagagtgaaaattgctaaaaattgctgtccaatagaaatttatgagcccatatgtaatataaacttttttactaaccacattaaaaagatagaaatggtgaaataaattttaataatta

SEQ ID NO: 32810 - DNA, 1935 bp, Homo sapiens
agagttggtggcgtgagttgctgccccttccttcctgctgtgggccagaggcgccaccgcgcccggtcctcgaggaagacgggagcgggacgtggcgagaggcctcctcagcagtgggcaaaatagccccgacgcggaggtcgtgtccccgccacgtttccggcgaccgcaggcgcggattccttggcttccctcagcactttcccctccgcgcggacggccccgagacgctttttcactgggccttgtcgccagcacccggcgtggggggtgagacgcgccttttcagggctggggttccccagagcgttttcctaagtcgaggcggaggtgcgaggaaactgagtgggtctttccgccccacgtggcctgccgggaagcgcggctcctccacccgcttccgtggaatggaatggtttttctctgcaggtttacaccggggtcactcgagagctgctgcggcctccttatgggcaggacccccgtatggggagaacgaggatgtgatatgtagaagggaaggccgcggtgtgccagaaatcagaggagattgcaagatggcaggaaaagaatcaggaaaatgggggcagcaaaactaaattcatgggaaaatacaatgtctaggagctatcccagggtcgtgaatcctcgagtgcaggtggggaagtagggtgatacccacctgtgaccatgacaagttttggagaccagaaactcggttagagtttctagaaccccgcatccctctcatactgcctgaagccctgctctggggagagtgtcatcacagtaccatgtggcatgcgagtgtcgtggtaatgctccccgaccaaaccaccaaaccgagggttgggctgcttattctcgctgcccaataatgagatgcagataaactaggaaagaaaggagtttatttctgtaaccaggtacggggcgaaggcgtggaaaatatcccagaccgactcagaattacagagctttccagagcttatataccttatgtgtagttggtgactgcctctccagatgctgaggtgcctgtatcattggcacaggccagtgctgaaccgtaggtggagtaggctgtgccttccgaagcagtatctattcacaatgaagttgcagtctcccgaattccagtcacttttcacagaaggactgaagagtctgacaggtataaatgctttccatgagaactgaaggaagaaggaaataggagttgcctccattgtgcacgttgcaaaacctgtctggaaggagcataggaaatggctttagctaagtgccagtagcttcttgctgttgccacagtttcattagtgttgattctcaatgttgtctgctgatgttgctaaagcagccacacagtagcattacaaagcctgtgggaattttaatagcaccttcataaatatatttagtagtatatgtagaaatatgacctatacagcactggctatctattagattcacctggggagcttttaaagcacacatgctcgggttctacctgcagcctactgaattagaatctctgggtgggatgaccatctatatttttaataaaagctccacaagttaattctgatgcacagaagatagacgaaccattactttaacatgactcaccttgtattagcttattctcaaagctactttcccattcttgaaattggatgatggctttttaggtacgtgccagagataaatggcccagaatatgttgattcttttagattgttttaggcagactttaagtagagggcttaaatgcatgtttggttttgccgatgcttcactatcttttttaattggagagagtgaaaattgctaaaaattgctgtccaatagaaatttatgagcccatatgtaatataaacttttttactaaccacattaaaaagatagaaatggtgaaataaattttaataatta

SEQ ID NO: 32811 - DNA, 483 bp, Homo sapiens
agagttggtggcgtgagttgctgccccttccttcctgctgtgggccagaggcgccaccgcgcccggtcctcgaggaagacgggagcgggacgtggcgagaggcctcctcagcagtgggcaaaatagccccgacgcggaggtcgtgtccccgccacgtttccggcgaccgcaggcgcggattccttggcttccctcagcactttcccctccgcgcggacggccccgagacgctttttcactgggccttgtcgccagcacccggcgtgggggatgtgtagttggtgactgcctctccagatgctgaggtgcctgtatcattggcacaggccagtgctgaaccgtaggtggagtaggctgtgccttccgaagcagtatctattcacaatgaagttgcagtctcccgaattccagtcacttttcacagaaggactgaagagtctgacagaattatttgtcaaagagaatcacgaattaagaatagca

SEQ ID NO: 32812 - DNA, 854 bp, Homo sapiens
cagcggggccggtaagcgggcgcgcgccgctcagaggggcagagttggtggcgtgagttgctgccccttccttcctgctgtgggccagaggcgccaccgcgcccggtcctcgaggaagacgggagcgggacgtggcgagaggcctcctcagcagtgggcaaaatagccccgacgcggaggtcgtgtccccgccacgtttccggcgaccgcaggcgcggattccttggcttccctcagcactttcccctccgcgcggacggccccgagacgctttttcactgggccttgtcgccagcacccggcgtggggggtacggggcgaaggcgtggaaaatatcccagaccgactcagaattacagagctttccagagcttatataccttatgtgtagttggtgactgcctctccagatgctgaggtgcctgtatcattggcacaggccagtgctgaaccgtaggtggagtaggctgtgccttccgaagcagtatctattcacaatgaagttgcagtctcccgaattccagtcacttttcacagaaggactgaagagtctgacaggtataaatgctttccatgagaactgaaggaagaaggaaataggagttgcctccattgtgcacgttgcaaaacctgtctggaaggagcataggaaatggctttagctaagtgccagtagcttcttgctgttgccacagtttcattagtgttgattctcaatgttgtctgctgatgttgctaaagcagccacacagtagcattacaaagcctgtgggaattttaatagcaccttcataaatatatttagtagtatatgtagaaatatgacctatacagcactggctatctattagatt

SEQ ID NO: 32813 - DNA, 1871 bp, Homo sapiens
tggcggctgcggcaacagcggggccgatgtgtagttggtgactgcctctccagatgctgaggtgcctgtatcattggcacaggccagtgctgaaccgtaggtggagtaggctgtgccttccgaagcagtatctattcacaatgaagttgcagtctcccgaattccagtcacttttcacagaaggactgaagagtctgacagaattatttgtcaaagagaatcacgaattaagaatagcaggaggagcagtgagggatttattaaatggagtaaagcctcaggatatagattttgccaccactgctacccctactcaaatgaaggagatgtttcagtcggctgggattcggatgataaacaacagaggagaaaagcacggaacaattactgccaggcttcatgaagaaaattttgagattactacactacggattgatgtcaccactgatggaagacatgctgaggtagaatttacaactgactggcagaaagatgcggaacgcagagatctcactataaattctatgtttttaggttttgatggcactttatttgactactttaatggttatgaagatttaaaaaataagaaagttagatttgttggacatgctaaacagagaatacaagaggattatcttagaattttaagatacttcaggttttatgggagaattgtagacaaacctggtgaccatgatcctgagactttggaagcaattgcagaaaatgcaaaaggcttggctggaatatcaggagaaaggatttgggtggaactgaaaaaaattcttgttggtaaccatgtaaatcatttgattcaccttatctatgatcttgatgtggctccttatataggtttacctgctaatgcaagtttagaagaatttgacaaagtcagtaaaaatgttgatggtttttcaccaaagccagtgactcttttggcctcattattcaaagtacaagatgatgtcacaaaattggatttgaggttgaagatcgcaaaagaggagaaaaaccttggcttatttatagttaaaaataggaaagatttaattaaagcaacagatagttcagacccattgaaaccctatcaagacttcattatagattctagggaacctgatgcaactactcgtgtatgtgaactactgaagtaccaaggagagcactgtctcctaaaggaaatgcagcagtggtccattcctccatttcctgtaagtggccatgacatcagaaaagtgggcatttcttcaggaaaagaaattggggctctattacaacagttgcgagaacagtggaaaaaaagtggttaccaaatggaaaaagatgaacttctgagttacataaagaagacctaaaactgatggctactaaaaagcagagcatttctgccagtcataacatctttgtactctatgagcaaatagtaattttggaccttgataaaacaattttgtagagtgtaatatttctaagaggaaatgtcacaggggctatgatgcaagaaagcctcagaaatgactgcatacaggaaataatctcatcatttccaaagatgtcttcatgtcccatcaatgacatgctaccagacatatcagattccacaggataatggcaccaagctacccaagtagatgtttctggtattctagactgccgttcatgcttgtttcctaaagtatacttaaaagtttcaaatacagtttcacttagaaactgcaaccctccaagtaatgttatgtttacttaggtattaatgttatgtttacttaggtatgtatcagaggcaataatttccaaagcagatcttagaatataaccaatttgttagataactttatctctatcacatctgtttacaagcaaagtat

SEQ ID NO: 32814 - DNA, 962 bp, Homo sapiens
gcggtcgaggatcctggaggtttgtccccgccgccccgacgcttccgcccggtccgtcggcacgtcggccctgcctcccggaccaccctgcggggcgcaccagcgatctggggtgcggggctcggcctccctgcgctcctggctgaccgtgtgaccttgggtcttaaccatgaacttctctggaggagggaggcaggaagcagcagggtccaggggtagaagggctcccagaccccgagaacaggaccgagacgtgcagctgtccaaggctctgtcctatgccctgcgccatggggccttgaagctggggcttcccatgggagctgatggcttcgtgcccctgggcaccctcctgcagttgccccagttccgcggcttctctgctgaagatgtgcagcgcgtggtggacaccaataggaagcagcggttcgccctgcagctgggggatcccagcactggccttctcatccgggccaaccagggccattccctgcaggtacctaagttggagctgatgcccctggagacaccgcaggccctgcccccgatgctagtccatggtacattctggaagcactggccatccatcctactcaaaggcctgtcctgccagggaaggacgcacattcacctggccccaggactgcctggagaccccggtatcatcagtggcatgcggtcccattgtgaaatagctgtgttcatcgatggacccctggctctggcagatggaatacccttcttccgctctgccaatggggtgattctgactccagggaatactgatggcttcctccttcccaagtacttcaaggaggccctgcagctacgccctacccgaaagcccctttccttggctggtgatgaagagacagagtgtcagagtagccccaagcacagctccagagaaaggaggaggatccaacaataaaatattaatttataaaaaagaaattttaaaa

SEQ ID NO: 32815 - DNA, 1058 bp, Homo sapiens
agtgcccgccccctttccacgcggcttttcattggcgggtccgccgcggtcgaggatcctggaggtttgtccccgccgccccgacgcttccgcccggtccgtcggcacgtcggccctgcctcccggaccaccctgcggggcgcaccagcgatctggggtgcggggctcggcctccctgcgctcctggctgaccgtgtgaccttgggtcttaaccatgaacttctctggaggagggaggcaggaagcagcagggtccaggggtagaagggctcccagaccccgagaacaggaccgagacgtgcagctgtccaaggctctgtcctatgccctgcgccatggggccttgaagctggggcttcccatgggagctgatggcttcgtgcccctgggcaccctcctgcagttgccccagttccgcggcttctctgctgaagatgtgcagcgcgtggtggacaccaataggaagcagcggttcgccctgcagctgggggatcccagcactggccttctcatccgggccaaccagggccattccctgcaggtcggggtacctaagttggagctgatgcccctggagacaccgcaggccctgcccccgatgctagtccatggtacattctggaagcactggccatccatcctactcaaaggcctgtcctgccagggaaggacgcacattcacctggccccaggactgcctggagaccccggtatcatcagtggcatgcggtcccattgtgaaatagctgtgttcatcgatggacccctggctctggcagatggaatacccttcttccgctctgccaatggggtgattctgactccagggaatactgatggcttcctccttcccaagtacttcaaggaggccctgcagctacgccctacccgaaagcccctttccttggctggtgatgaagagacagagtgtcagagtagccccaagcacagctccagagaaaggaggaggatccaacaataaaatattaatttataaaaaagaaattttaaaaagtaacaagaaagaactcgtttgaaaccatgtttcatcatcctgt

SEQ ID NO: 32816 - DNA, 865 bp, Homo sapiens
gcacgtcggccctgcctcccggaccaccctgcggggcgcaccagcgatctggggtgcggggctcggcctccctgcgctcctggctgaccgtgtgaccttgggaccgagacgtgcagctgtccaaggctctgtcctatgccctgcgccatggggccttgaagctggggcttcccatgggagctgatggcttcgtgcccctgggcaccctcctgcagttgccccagttccgcggcttctctgctgaagatgtgcagcgcgtggtggacaccaataggaagcagcggttcgccctgcagctgggggatcccagcactggccttctcatccgggccaaccagggccattccctgcaggtacctaagttggagctgatgcccctggagacaccgcaggccctgcccccgatgctagtccatggtacattctggaagcactggccatccatcctactcaaaggcctgtcctgccagggaaggacgcacattcacctggccccaggactgcctggagaccccggtatcatcagtggcatgcggtcccattgtgaaatagctgtgttcatcgatggacccctggctctggcagatggaatacccttcttccgctctgccaatggggtgattctgactccagggaatactgatggcttcctccttcccaagtacttcaaggaggccctgcagctacgccctacccgaaagcccctttccttggctggtgatgaagagacagagtgtcagagtagccccaagcacagctccagagaaaggaggaggatccaacaataaaatattaatttataaaaaagaaattttaaaaagtaacaagaaagaactcgtttgaaaccatgtttcatcatcctgta

SEQ ID NO: 32817 - DNA, 941 bp, Homo sapiens
agtgcccgccccctttccacgcggcttttcattggcgggtccgccgcggtcgaggatcctggaggtttgtccccgccgccccgacgcttccgcccggtccgtcggcacgtcggccctgcctcccggaccaccctgcggggcgcaccagcgatctggggtgcggggctcggcctccctgcgctcctggctgaccgtgtgaccttgggtcttaaccatgaacttctctggaggagggaggcaggaagcagcagggtccaggggtagaagggctcccagaccccgagaacaggaccgagacgtgcagctgtccaaggctctgtcctatgccctgcgccatggggccttgaagctggggcttcccatgggagctgatggcttcgtgcccctgggcaccctcctgcagttgccccagttccgcggcttctctgctgaagatgtgcagcgcgtggtggacaccaataggaagcagcggttcgccctgcagctgggggatcccagcactggccttctcatccgggccaaccagggccattccctgcaggtacctaagttggagctgatgcccctggagacaccgcaggccctgcccccgatgctagtccatggtacattctggaagcactggccatccatcctactcaaaggcctgtcctgccagggaaggacgcacattcacctggccccaggactgcctggagaccccggtatcatcagtggcatgcggtcccattgtgaaatagctgtgttcatcgatggacccctggctctggcaggaaagcccctttccttggctggtgatgaagagacagagtgtcagagtagccccaagcacagctccagagaaaggaggaggatccaacaataaaatattaatttataaaaaagaaattttaaaaagtaacaagaaagaactcgtttgaaaccatgtttcatcatcctgt

SEQ ID NO: 32818 - DNA, 684 bp, Homo sapiens
ggtcttaaccatgaacttctctggaggagggaggcaggaagcagcagggtccaggggtagaagggctcccagaccccgagaacaggaccgagacgtgcagctgtccaaggctctgtcctatgccctgcgccatggggccttgaagctggggcttcccatgggagctgatggcttcgtgcccctgggcaccctcctgcagttgccccagttccgcggcttctctgctgaagatgtgcagcgcgtggtggacaccaataggaagcagcggttcgccctgcagctgggggatcccagcactggccttctcatccgggccaaccagggccattccctgcaggtacctaagttggagctgatgcccctggagacaccgcaggccctgcccccgatgctagtccatggtacattctggaagcactggccatccatcctactcaaaggcctgtcctgccagggaaggacgcacattcacctggccccaggactgcctggagaccccggtatcatcagtggcatgcggtcccattgtgaaatagctgtgttcatcgatggacccctggctctggcaggaaagcccctttccttggctggtgatgaagagacagagtgtcagagtagccccaagcacagctccagagaaaggaggaggatccaacaataaaatattaatttataaaaaagaaa

SEQ ID NO: 32819 - DNA, 1960 bp, Homo sapiens
ggaacccacaggcgcgcgcgccgctgcttctggccgggcgcgggtcgtggtgcaccacgggagcgccgcaccggccggcatggaggagcgcggcgattccgagccgacccccggctgcagcggcctgggtccgggcggtgttcgcggctttggcgacggcggtggagctccttcgtgggcccctgaggacgcctggatgggcactcaccctaagtatctagaaatgatggaattagatataggagatgccacccaagtttatgtagcgttcttggtttacctggacctcatggaaagcaaaagctggcatgaagtaaactgtgtaggattaccagaactccagctcatctgccttgttggtactgagatagaaggggaggggttacagactgtggtgcctacccccatcactgcttccctcagccataacaggataagggagatcttgaaggcatctcgaaagttgcaaggtgatccagatttgccgatgtcttttactttggccatagtggagtctgattctacaatagtctattataaacttactgatggatttatgctgccagaccctcagaatatttctcttagaagatgacatccatgtttcctgatgcttgttttattcatacaagattggatttgagacccatcagactgcttcatcttttatctcagaaatagggttgacgtacatagtgagggttgacttccccattccataaggttttcattctgaagagtaaaacttccccaggtagaagactttctccttcttaaaaaatatagggtgatttctttaaaactttgttatctagagacagtttaattacagttatatacaggtttatgcctaggatgtattcagatgggtgggacctgtgtgctgcttttgtcatcccacactcaaagttgtctctttgtttcttgctgccactgccagctcattgttgagactgccatttctttctcttactcagctctccccagtgccttttggccactgcagctaccgtagaatggcattttatatgtaccttgtcacccacttctgtttactttttcctctccagtaaaaagtaaaagatttctttcaattggtcttcccattgcagttactgttatttctcttttttggttaactttaaatcaaaactcaaaatatgttcatccagagtgtgtcttaagtaacttacgtgtcttaagtaacagggaccagagacatgttacctacaagagttctgggctatccttttcattcttatcacatatcatagcttgaatattacaacagtgtgggagagaatcaaccgtaaaaatgtcttcattaattagacccagttattccacttttgttaatgtctctcaaattgtacaaagtataaaaaattatatgcacaaagatgttccaagtgacattacttttagtagcccaaattataaaccactttaaagtttggggtaaagattggcaaactttttctataaagggccagaaagtaactattttaggtttttaaacctactgtctctgtcataacttgtcaacactgctgtatgaagcacaaaagcagccatagacaatacataaacaatacgggcgtggctttgttccagtaaaactttgtttacaaatgtggtgccatagtttgtcatccctgggtctaggaaatagtcaataaacagatatatacaaatgatacataatgtacttattaaaaattagtaatgaatattattaaaaacatgaaaatattaccttaagtaaaaattgcaagacggaaaagtgtataagtgggtgtaatcatggctgaaataacagaccaagcatatgataaaaagataacaaagtaaatcaaattactaactggttatagtgggataggaggcagaaaatggatgactttgtcttttctcaatgtttttatttgtattttataataaaaatgttttaaaattaaaa

SEQ ID NO: 32820 - DNA, 1743 bp, Homo sapiens
accggccggcatggaggagcgcggcgattccgagccgacccccggctgcagcggcctgggtccgggcggtgttcgcggctttggcgacggcggtggagctccttcgtgggcccctgaggacgcctggatgggcactcaccctaagtatctagaaatgatggaattagatataggagatgccacccaagtttatgtagcgttcttggtttacctggacctcatggaaagcaaaagctggcatgaagtaaactgtgtaggattaccagaactccagctcatctgccttgttggtactgagatagaaggggaggggttacagactgtggtgcctacccccatcactgcttccctcagccataacagaatatttctcttagaagatgacatccatgtttcctgatgcttgttttattcatacaagattggatttgagacccatcagactgcttcatcttttatctcagaaatagggttgacgtacatagtgagggttgacttccccattccataaggttttcattctgaagagtaaaacttccccaggtagaagactttctccttcttaaaaaatatagggtgatttctttaaaactttgttatctagagacagtttaattacagttatatacaggtttatgcctaggatgtattcagatgggtgggacctgtgtgctgcttttgtcatcccacactcaaagttgtctctttgtttcttgctgccactgccagctcattgttgagactgccatttctttctcttactcagctctccccagtgccttttggccactgcagctaccgtagaatggcattttatatgtaccttgtcacccacttctgtttactttttcctctccagtaaaaagtaaaagatttctttcaattggtcttcccattgcagttactgttatttctcttttttggttaactttaaatcaaaactcaaaatatgttcatccagagtgtgtcttaagtaacttacgtgtcttaagtaacagggaccagagacatgttacctacaagagttctgggctatccttttcattcttatcacatatcatagcttgaatattacaacagtgtgggagagaatcaaccgtaaaaatgtcttcattaattagacccagttattccacttttgttaatgtctctcaaattgtacaaagtataaaaaattatatgcacaaagatgttccaagtgacattacttttagtagcccaaattataaaccactttaaagtttggggtaaagattggcaaactttttctataaagggccagaaagtaactattttaggtttttaaacctactgtctctgtcataacttgtcaacactgctgtatgaagcacaaaagcagccatagacaatacataaacaatacgggcgtggctttgttccagtaaaactttgtttacaaatgtggtgccatagtttgtcatccctgggtctaggaaatagtcaataaacagatatatacaaatgatacataatgtacttattaaaaattagtaatgaatattattaaaaacatgaaaatattaccttaagtaaaaattgcaagacggaaaagtgtataagtgggtgtaatcatggctgaaataacagaccaagcatatgataaaaagataacaaagtaaatcaaattactaactggttatagtgggataggaggcagaaaatggatgactttgtcttttctcaatgtttttatttgtattttataataaaaatgttttaaaa

SEQ ID NO: 32821 - DNA, 2381 bp, Homo sapiens
aagaaaggtaagggccctgggcgaggaaagcgcggccctttccgagtttggtgttttgcagcgaaaggaaatctcgctcttccgaaagtcctccagggcgagagaggaaagggcctaggtactgtgctggggtcgcacagccggccgagacagtgccgggacggggagccaggcttccgagtgcgcccggtcactgactcctccgcgctttcctcgtgcgcctgcagcccttggttcttggaaacgccggcgccttgttcagggctggtggggctggggcgcaaggtgcagctgacaatgcccgagaggagccgcagcctctggtggagttcggtcgggtgtgggggtagtcaaggaaagaagcaaagggaatacctcctctgaaaaatggcagaagcagttttccatgccccaaagaggaaaagaagagtgtatgagacttacgagtctccattgccaatcccttttggtcaggaccatggtcctctgaaagaattcaagatattccgtgctgaaatgattaacaacaatgtgattgtgaggaatgcggaggacattgagcagctctatgggaaaggttattttggaaaaggtattctttcaagaagccgtccaagcttcacaatttcagatcctaaactggttgctaaatggaaagatatgaagacaaacatgcctatcatcacatcaaagaggtatcagcatagtgttgagtgggcagcagagctgatgcgtagacaggggcaggatgagagtacagtgcgcagaatcctcaaggattacacgaaaccgcttgagcatcctcctgtgaaaaggaatgaagaggctcaagtgcatgacaagcttaactctggaatggtttccaacatggaaggcacagcagggggagagagaccttctgtggtaaacggggactctggaaagtcaggtggtgtgggtgatccccgtgagccattaggctgcctgcaggagggctctggctgccacccaacaacagagagctttgagaaaagcgtgcgagaggatgcctcacctctgccccatgtctgttgctgcaaacaagatgctctcatcctccagcgtggccttcatcatgaagacggcagccagcacatcggcctcctgcatcctggggacagagggcctgaccatgagtacgtgctggtcgaggaagcggagtgtgccatgagcgagagggaggctgccccaaatgaggaattggtgcaaagaaacaggttaatatgcagaagaaatccatataggatctttgagtatttgcaactcagcctagaagaggcctttttcttggtctatgctctgggatgtttaagtatttactatgagaaggagcctttaacgatagtgaagctctggaaagctttcactgtagttcagcccacgttcagaaccacctacatggcctaccattactttcgaagcaagggctgggtgcccaaagtgggactcaagtacgggacagatttactgctatatcggaaaggccctccattttaccatgcaagttattctgtcattatcgagctagttgatgaccattttgaaggctctctccgcaggcctctcagttggaagtccctggctgccttgagcagagtttccgttaatgtctctaaggaacttatgctgtgctatttgattaaaccctctactatgactgacaaggaaatggagtcaccagaatgtatgaaaaggattaaagttcaggaggtgattctgagtcgatgggtttcttcacgagagaggagtgaccaagacgatctttaacaattcaacctcaaatttctaatttcaccaacaactatttattgagggctaggtaaaaagttctttttgttgtaatcgtccattaattcataagttttaaagggcatggtgctcccagcaccagaaaactatcagtgtttttaaagataaattacacaagggaggagaaagatccctgtgctaggactgcagattctatacttgcgttggcctctaactctccaatccagagcctcctgcctctggcgtcagtcttttccctcatccactcactggggagattggactagaggagtcctgagaggacacttccaacaagagacatttattctctgattttacctgaaaatggtagtagtttacatttatacagtacagtttatgaagcactttcatacgcaggcatctcttgttacctacatctaagctgttcccgaaagagtgttacagaacacaacagtattgtacaatattcgataagcatatcttcactgcacttgttataaaaatgagtggtgaaataatgtttggagacataatgaaagcgattaacatttggcaaaatataataaagcctttttgtaattggtgagaaa

SEQ ID NO: 32822 - DNA, 2023 bp, Homo sapiens
tttgcggccgcactgcttgacggcagcggtgtccgccccacggccggcgttgccggggtaacggcgagcgcgtggggccaagaaagaatacctcctctgaaaaatggcagaagcagttttccatgccccaaagaggaaaagaagagtgtatgagacttacgagtctccattgccaatcccttttggtcaggaccatggtcctctgaaagaattcaagatattccgtgctgaaatgattaacaacaatgtgattgtgaggaatgcggaggacattgagcagctctatgggaaaggttattttggaaaaggtattctttcaagaagccgtccaagcttcacaatttcagatcctaaactggttgctaaatggaaagatatgaagacaaacatgcctatcatcacatcaaagaggtatcagcatagtgttgagtgggcagcagagctgatgcgtagacaggggcaggatgagagtacagtgcgcagaatcctcaaggattacacgaaaccgcttgagcatcctcctgtgaaaaggaatgaagaggctcaagtgcatgacaagcttaactctggaatggtttccaacatggaaggcacagcagggggagagagaccttctgtggtaaacggggactctggaaagtcaggtggtgtgggtgatccccgtgagccattaggctgcctgcaggagggctctggctgccacccaacaacagagagctttgagaaaagcgtgcgagaggatgcctcacctctgccccatgtctgttgctgcaaacaagatgctctcatcctccagcgtggccttcatcatgaagacggcagccagcacatcggcctcctgcatcctggggacagagggcctgaccatgagtacgtgctggtcgaggaagcggagtgtgccatgagcgagagggaggctgccccaaatgaggaagcctttttcttggtctatgctctgggatgtttaagtatttactatgagaaggagcctttaacgatagtgaagctctggaaagctttcactgtagttcagcccacgttcagaaccacctacatggcctaccattactttcgaagcaagggctgggtgcccaaagtgggactcaagtacgggacagatttactgctatatcggaaaggccctccattttaccatgcaagttattctgtcattatcgagctagttgatgaccattttgaaggctctctccgcaggcctctcagttggaagtccctggctgccttgagcagagtttccgttaatgtctctaaggaacttatgctgtgctatttgattaaaccctctactatgactgacaaggaaatggagtcaccagaatgtatgaaaaggattaaagttcaggaggtgattctgagtcgatgggtttcttcacgagagaggagtgaccaagacgatctttaacaattcaacctcaaatttctaatttcaccaacaactatttattgagggctaggtaaaaagttctttttgttgtaatcgtccattaattcataagttttaaagggcatggtgctcccagcaccagaaaactatcagtgtttttaaagataaattacacaagggaggagaaagatccctgtgctaggactgcagattctatacttgcgttggcctctaactctccaatccagagcctcctgcctctggcgtcagtcttttccctcatccactcactggggagattggactagaggagtcctgagaggacacttccaacaagagacatttattctctgattttacctgaaaatggtagtagtttacatttatacagtacagtttatgaagcactttcatacgcaggcatctcttgttacctacatctaagctgttcccgaaagagtgttacagaacacaacagtattgtacaatattcgataagcatatcttcactgcacttgttataaaaatgagtggtgaaataatgtttggagacataatgaaagcgattaacatttggcaaaatataataaagcctttttgtaattggtgagaaagtca

SEQ ID NO: 32823 - DNA, 2028 bp, Homo sapiens
actgcttgacggcagcggtgtccgccccacggccggcgttgccggggtaacggcgagcgcgtggggccaagaaagaatacctcctctgaaaaatggcagaagcagttttccatgccccaaagaggaaaagaagagtgtatgagacttacgagtctccattgccaatcccttttggtcaggaccatggtcctctgaaagaattcaagatattccgtgctgaaatgattaacaacaatgtgattgtgaggaatgcggaggacattgagcagctctatgggaaaggttattttggaaaaggtattctttcaagaagccgtccaagcttcacaatttcagatcctaaactggttgctaaatggaaagatatgaagacaaacatgcctatcatcacatcaaagaggtatcagcatagtgttgagtgggcagcagagctgatgcgtagacaggggcaggatgagagtacagtgcgcagaatcctcaaggattacacgaaaccgcttgagcatcctcctgtgaaaaggaatgaagaggctcaagtgcatgacaagcttaactctggaatggtttccaacatggaaggcacagcagggggagagagaccttctgtggtaaacggggactctggaaagtcaggtggtgtgggtgatccccgtgagccattaggctgcctgcaggagggctctggctgccacccaacaacagagagctttgagaaaagcgtgcgagaggatgcctcacctctgccccatgtctgttgctgcaaacaagatgctctcatcctccagcgtggccttcatcatgaagacggcagccagcacatcggcctcctgcatcctggggacagagggcctgaccatgagtacgtgctggtcgaggaagcggagtgtgccatgagcgagagggaggctgccccaaatgaggaattggtgcaaagaaacaggttaatatgcagaagaaatccatataggatctttgagtatttgcaactcagcctagaagaggagcctttaacgatagtgaagctctggaaagctttcactgtagttcagcccacgttcagaaccacctacatggcctaccattactttcgaagcaagggctgggtgcccaaagtgggactcaagtacgggacagatttactgctatatcggaaaggccctccattttaccatgcaagttattctgtcattatcgagctagttgatgaccattttgaaggctctctccgcaggcctctcagttggaagtccctggctgccttgagcagagtttccgttaatgtctctaaggaacttatgctgtgctatttgattaaaccctctactatgactgacaaggaaatggagtcaccagaatgtatgaaaaggattaaagttcaggaggtgattctgagtcgatgggtttcttcacgagagaggagtgaccaagacgatctttaacaattcaacctcaaatttctaatttcaccaacaactatttattgagggctaggtaaaaagttctttttgttgtaatcgtccattaattcataagttttaaagggcatggtgctcccagcaccagaaaactatcagtgtttttaaagataaattacacaagggaggagaaagatccctgtgctaggactgcagattctatacttgcgttggcctctaactctccaatccagagcctcctgcctctggcgtcagtcttttccctcatccactcactggggagattggactagaggagtcctgagaggacacttccaacaagagacatttattctctgattttacctgaaaatggtagtagtttacatttatacagtacagtttatgaagcactttcatacgcaggcatctcttgttacctacatctaagctgttcccgaaagagtgttacagaacacaacagtattgtacaatattcgataagcatatcttcactgcacttgttataaaaatgagtggtgaaataatgtttggagacataatgaaagcgattaacatttggcaaaatataataaagcctttttgtaattgg

SEQ ID NO: 32824 - DNA, 2149 bp, Homo sapiens
aacggcgagcgcgtggggccaagaaaggtaagggccctgggcgaggaaagcgcggccctttccgagtttggtgttttgcagcgaaaggaaatctcgctcttccgaaagtcctccagggcgagagaggaaagggcctagaatacctcctctgaaaaatggcagaagcagttttccatgccccaaagaggaaaagaagagtgtatgagacttacgagtctccattgccaatcccttttggtcaggaccatggtcctctgaaagaattcaagatattccgtgctgaaatgattaacaacaatgtgattgtgaggaatgcggaggacattgagcagctctatgggaaaggttattttggaaaaggtattctttcaagaagccgtccaagcttcacaatttcagatcctaaactggttgctaaatggaaagatatgaagacaaacatgcctatcatcacatcaaagaggtatcagcatagtgttgagtgggcagcagagctgatgcgtagacaggggcaggatgagagtacagtgcgcagaatcctcaaggattacacgaaaccgcttgagcatcctcctgtgaaaaggaatgaagaggctcaagtgcatgacaagcttaactctggaatggtttccaacatggaaggcacagcagggggagagagaccttctgtggtaaacggggactctggaaagtcaggtggtgtgggtgatccccgtgagccattaggctgcctgcaggagggctctggctgccacccaacaacagagagctttgagaaaagcgtgcgagaggatgcctcacctctgccccatgtctgttgctgcaaacaagatgctctcatcctccagcgtggccttcatcatgaagacggcagccagcacatcggcctcctgcatcctggggacagagggcctgaccatgagtacgtgctggtcgaggaagcggagtgtgccatgagcgagagggaggctgccccaaatgaggaattggtgcaaagaaacaggttaatatgcagaagaaatccatataggatctttgagtatttgcaactcagcctagaagaggcctttttcttggtctatgctctgggatgtttaagtatttactatgagaaggagcctttaacgatagtgaagctctggaaagctttcactgtagttcagcccacgttcagaaccacctacatggcctaccattactttcgaagcaagggctgggtgcccaaagtgggactcaagtacgggacagatttactgctatatcggaaaggccctccattttaccatgcaagttattctgtcattatcgagctagttgatgaccattttgaaggctctctccgcaggcctctcagttggaagtccctggctgccttgagcagagtttccgttaatgtctctaaggaacttatgctgtgctatttgattaaaccctctactatgactgacaaggaaatggagtcaccagaatgtatgaaaaggattaaagttcaggaggtgattctgagtcgatgggtttcttcacgagagaggagtgaccaagacgatctttaacaattcaacctcaaatttctaatttcaccaacaactatttattgagggctaggtaaaaagttctttttgttgtaatcgtccattaattcataagttttaaagggcatggtgctcccagcaccagaaaactatcagtgtttttaaagataaattacacaagggaggagaaagatccctgtgctaggactgcagattctatacttgcgttggcctctaactctccaatccagagcctcctgcctctggcgtcagtcttttccctcatccactcactggggagattggactagaggagtcctgagaggacacttccaacaagagacatttattctctgattttacctgaaaatggtagtagtttacatttatacagtacagtttatgaagcactttcatacgcaggcatctcttgttacctacatctaagctgttcccgaaagagtgttacagaacacaacagtattgtacaatattcgataagcatatcttcactgcacttgttataaaaatgagtggtgaaataatgtttggagacataatgaaagcgattaacatttggcaaaatataataaagcctttttgtaattggtgagaaa

SEQ ID NO: 32825 - DNA, 2279 bp, Homo sapiens
aaagaatacctcctctgaaaaatggcagaagcagttttccatgccccaaagaggaaaagaagagtgtatgagacttacgagtctccattgccaatcccttttggtcaggaccatggtcctctgaaagaattcaagatattccgtgctgaaatgattaacaacaatgtgattgtgaggaatgcggaggacattgagcagctctatgggaaaggttattttggaaaaggtattctttcaagaagccgtccaagcttcacaatttcagatcctaaactggttgctaaatggaaagatatgaagacaaacatgcctatcatcacatcaaagaggtatcagcatagtgttgagtgggcagcagagctgatgcgtagacaggggcaggatgagagtacagtgcgcagaatcctcaaggattacacgaaaccgcttgagcatcctcctgtgaaaaggaatgaagaggctcaagtgcatgacaagcttaactctggaatggtttccaacatggaaggcacagcagggggagagagaccttctgtggtaaacggggactctggaaagtcaggtggtgtgggtgatccccgtgagccattaggctgcctgcaggagggctctggctgccacccaacaacagagagctttgagaaaagcgtgcgagaggatgcctcacctctgccccatgtctgttgctgcaaacaagatgctctcatcctccagcgtggccttcatcatgaagacggcagccagcacatcggcctcctgcatcctggggacagagggcctgaccatgagtacgtgctggtcgaggaagcggagtgtgccatgagcgagagggaggctgccccaaatgaggaagcctttttcttggtctatgctctgggatgtttaagtatttactatgagaaggagcctttaacgatagtgaagctctggaaagctttcactgtagttcagcccacgttcagaaccacctacatggcctaccattactttcgaagcaagggctgggtgcccaaagtgggactcaagtacgggacagatttactgctatatcggaaaggccctccattttaccatgcaagttattctgtcattatcgagctagttgatgaccattttgaaggctctctccgcaggcctctcagttggaagtccctggctgccttgagcagagtttccgttaatgtctctaaggaacttatgctgtgctatttgattaaaccctctactatgactgacaaggaaatggagtcaccagaatgtatgaaaaggattaaagttcaggaggtgattctgagtcgatgggtttcttcacgagagaggagtgaccaagacgatctttaacaattcaacctcaaatttctaatttcaccaacaactatttattgagggctaggtaaaaagttctttttgttgtaatcgtccattaattcataagttttaaagggcatggtgctcccagcaccagaaaactatcagtgtttttaaagataaattacacaagggaggagaaagatccctgtgctaggactgcagattctatacttgcgttggcctctaactctccaatccagagcctcctgcctctggcgtcagtcttttccctcatccactcactggggagattggactagaggagtcctgagaggacacttccaacaagagacatttattctctgattttacctgaaaatggtagtagtttacatttatacagtacagtttatgaagcactttcatacgcaggcatctcttgttacctacatctaagctgttcccgaaagagtgttacagaacacaacagtattgtacaatattcgataagcatatcttcactgcacttgttataaaaatgagtggtgaaataatgtttggagacataatgaaagcgattaacatttggcaaaatataataaagcctttttgtaattggtgagaaagtcatgaagacttaagttgcctcagggcatctggtggcaagaggagggagatgggtggctgggcatggtggcccatacctataatcccagcacttgggaggccttgggaggccaaggcgcatggatcgcttgagcccaggagttggagaccagcttgggcaacatggtgaaacctcctctctactaacaaaaattatccaagcattgtagcacatgcctgtaattccagctgctcaggagactaaggtaggaggatcgcttgagcccaggaggaagaggttgcagtgagcggagattgtgccactgcaatccagcctgagcaatagagcaaggtcctgtctc

SEQ ID NO: 32826 - DNA, 2697 bp, Homo sapiens
aagaaaggtaagggccctgggcgaggaaagcgcggccctttccgagtttggtgttttgcagcgaaaggaaatctcgctcttccgaaagtcctccagggcgagagaggaaagggcctaggtactgtgctggggtcgcacagccggccgagacagtgccgggacggggagccaggcttccgagtgcgcccggtcactgactcctccgcgctttcctcgtgcgcctgcagcccttggttcttggaaacgccggcgccttgttcagggctggtggggctggggcgcaaggtgcagctgacaatgcccgagaggagccgcagcctctggtggagttcggtcgggtgtgggggtagtcaaggaaagaagcaaagggaatacctcctctgaaaaatggcagaagcagttttccatgccccaaagaggaaaagaagagtgtatgagacttacgagtctccattgccaatcccttttggtcaggaccatggtcctctgaaagaattcaagatattccgtgctgaaatgattaacaacaatgtgattgtgaggaatgcggaggacattgagcagctctatgggaaaggttattttggaaaaggtattctttcaagaagccgtccaagcttcacaatttcagatcctaaactggttgctaaatggaaagatatgaagacaaacatgcctatcatcacatcaaagaggtatcagcatagtgttgagtgggcagcagagctgatgcgtagacaggggcaggatgagagtacagtgcgcagaatcctcaaggattacacgaaaccgcttgagcatcctcctgtgaaaaggaatgaagaggctcaagtgcatgacaagcttaactctggaatggtttccaacatggaaggcacagcagggggagagagaccttctgtggtaaacggggactctggaaagtcaggtggtgtgggtgatccccgtgagccattaggctgcctgcaggagggctctggctgccacccaacaacagagagctttgagaaaagcgtgcgagaggatgcctcacctctgccccatgtctgttgctgcaaacaagatgctctcatcctccagcgtggccttcatcatgaagacggcagccagcacatcggcctcctgcatcctggggacagagggcctgaccatgagtacgtgctggtcgaggaagcggagtgtgccatgagcgagagggaggctgccccaaatgaggaagcctttttcttggtctatgctctgggatgtttaagtatttactatgagaaggagcctttaacgatagtgaagctctggaaagctttcactgtagttcagcccacgttcagaaccacctacatggcctaccattactttcgaagcaagggctgggtgcccaaagtgggactcaagtacgggacagatttactgctatatcggaaaggccctccattttaccatgcaagttattctgtcattatcgagctagttgatgaccattttgaaggctctctccgcaggcctctcagttggaagtccctggctgccttgagcagagtttccgttaatgtctctaaggtaacacaacatcagctttgccattggagtgtcacttaaatggttcagtttttttttttttcttaaatgtagtagaatcaaaaaagttagttgtagaaacttcataacattcctgccagtgacatgctggaagatttggggtcattcgtacccttcccttattgcgctagaagttgtcctcccctcatgttacattttattgtcccctccctcccaactgctgctgagctccaatgacggagctttggagtgtcccatggtgatctgatctgggtaggcattgcttctcttcccaggggtatcgttgctatgtgacttgttttatactgcaatttaacattcactcatacacatattcacaaaggagtcaaaacattgaaagtttgcagatctcttagagaggaagggacttgatatttgttgctaagcactttcccaccctgttgttatcctcatcctgaggatgagaaaccaaggttggagccgttgagtggctaatccaagatcacacagctcatgtgcatactcgggatccaaacccacagctctctggctccctggcttttgtttcactatatccttcgtgttgccatcagagataggagggactcagcttacacaaggactatcaagaaagaaagctgtgtgtgttctcattactcagtgatttgctggctgaaaacaaattgtagataccctctaatttcatcctcatgctgctggaggtgaggtggggctgaggccagagggtcttgcagggctagagatgactgccctttagagcaggttaggttgcctaggctttagcttggtcctatagaaaattagggagcctatactgtttctagaatttttatgcccattttaggggacttgtagcatatacttaatatgtcctcacttaacattgttgatatgttcttggaaactgcaactttaatgtcgtataacaaaaccgttttttcttctcatcatttcaagaaaacaatgttgaagtttatttgaagacctgctgtacatctgtattagtccattctcatgctgctataaagaaatacttgagactgggtaatttataatgaaaagaggtttaattgactcacagttccatgtggctggggaggcctcaggaaacttaca

SEQ ID NO: 32827 - DNA, 1239 bp, Homo sapiens
tttgcggccgcactgcttgacggcagcggtgtccgccccacggccggcgttgccggggtaacggcgagcgcgtggggccaagaaagaatacctcctctgaaaaatggcagaagcagttttccatgccccaaagaggaaaagaagagtgtatgagacttacgagtctccattgccaatcccttttggtcaggaccatggtcctctgaaagaattcaagatattccgtgctgaaatgattaacaacaatgtgattgtgaggaatgcggaggacattgagcagctctatgggaaaggttattttggaaaaggtattctttcaagaagccgtccaagcttcacaatttcagatcctaaactggttgctaaatggaaagatatgaagacaaacatgcctatcatcacatcaaagaggtatcagcatagtgttgagtgggcagcagagctgatgcgtagacaggggcaggatgagagtacagtgcgcagaatcctcaaggattacacgaaaccgcttgagcatcctcctgtgaaaaggaatgaagaggctcaagtgcatgacaagcttaactctggaatggtttccaacatggaaggcacagcagggggagagagaccttctgtggtaaacggggactctggaaagtcaggtggtgtgggtgatccccgtgagccattaggctgcctgcaggagggctctggctgccacccaacaacagagagctttgagaaaagcgtgcgagaggatgcctcacctctgccccatgtctgttgctgcaaacaagatgctctcatcctccagcgtggccttcatcatgaagacggcagccagcacatcggcctcctgcatcctggggacagagggcctgaccatgagtacgtgctggtcgaggaagcggagtgtgccatgagcgagagggaggctgccccaaatgaggaattggtgcaaagaaacaggttaatatgcagaagaaatccatataggatctttgagtatttgcaactcagcctagaagaggcctttttcttggtctatgctctgggatgtttaagtatttactatgagaaggagcctttaacgatagtgaagctctggaaagctttcactgtagttcagcccacgttcagaaccacctacatggcctaccattactttcgaagcaagggctgggtgcccaaagtgggactcaagtacgggacagatttactgctatatcggaaaggccctccattttaccatgcaag

SEQ ID NO: 32828 - DNA, 1712 bp, Homo sapiens
agtttggtgttttgcagcgaaaggaaatctcgctcttccgaaagtcctccagggcgagagaggaaagggcctaggtactgtgctggggtcgcacagccggccgagacagtgccgggacggggagccaggcttccgagtgcgcccggtcactgactcctccgcgctttcctcgtgcgcctgcagcccttggttcttggaaacgccggcgccttgttcagggctggtggggctggggcgcaaggtgcagctgacaatgcccgagaggagccgcagcctctggtggagttcggtcgggtgtgggggtagtcaaggaaagaagcaaagggaatacctcctctgaaaaatggcagaagcagttttccatgccccaaagaggaaaagaagagtgtatgagacttacgagtctccattgccaatcccttttggtcaggaccatggtcctctgaaagaattcaagatattccgtgctgaaatgattaacaacaatgtgattgtgaggaatgcggaggacattgagcagctctatgggaaagatatgaagacaaacatgcctatcatcacatcaaagaggtatcagcatagtgttgagtgggcagcagagctgatgcgtagacaggggcaggatgagagtacagtgcgcagaatcctcaaggattacacgaaaccgcttgagcatcctcctgtgaaaaggaatgaagaggctcaagtgcatgacaagcttaactctggaatggtttccaacatggaaggcacagcagggggagagagaccttctgtggtaaacggggactctggaaagtcaggtggtgtgggtgatccccgtgagccattaggctgcctgcaggagggctctggctgccacccaacaacagagagctttgagaaaagcgtgcgagaggatgcctcacctctgccccatgtctgttgctgcaaacaagatgctctcatcctccagcgtggccttcatcatgaagacggcagccagcacatcggcctcctgcatcctggggacagagggcctgaccatgagtacgtgctggtcgaggaagcggagtgtgccatgagcgagagggaggctgccccaaatgaggaattggtgcaaagaaacaggttaatatgcagaagaaatccatataggatctttgagtatttgcaactcagcctagaagaggcctttttcttggtctatgctctgggatgtttaagtatttactatgagaaggagcctttaacgatagtgaagctctggaaagctttcactgtagttcagcccacgttcagaaccacctacatggcctaccattactttcgaagcaagggctgggtgcccaaagtgggactcaagtacgggacagatttactgctatatcggaaaggccctccattttaccatgcaagttattctgtcattatcgagctagttgatgaccattttgaaggctctctccgcaggcctctcagttggaagtccctggctgccttgagcagagtttccgttaatgtctctaaggaacttatgctgtgctatttgattaaaccctctactatgactgacaaggaaatggagtcaccagaatgtatgaaaaggattaaagttcaggaggtgattctgagtcgatgggtttcttcacgagagaggagtgaccaagacgatctttaacaattcaacctcaaatttctaatttcaccaacaactatttattgagggctag

SEQ ID NO: 32829 - DNA, 1909 bp, Homo sapiens
actgcttgacggcagcggtgtccgccccacggccggcgttgccggggtaacggcgagcgcgtggggccaagaaagaatacctcctctgaaaaatggcagaagcagttttccatgccccaaagaggaaaagaagagtgtatgagacttacgagtctccattgccaatcccttttggtcaggaccatggtcctctgaaagaattcaagatattccgtgctgaaatgattaacaacaatgtgattgtgaggaatgcggaggacattgagcagctctatgggaaaggttattttggaaaaggtattctttcaagaagccgtccaagcttcacaatttcagatcctaaactggttgctaaatggaaagatatgaagacaaacatgcctatcatcacatcaaagaggtatcagcatagtgttgagtgggcagcagagctgatgcgtagacaggggcaggatgagagtacagtgcgcagaatcctcaaggattacacgaaaccgcttgagcatcctcctgtgaaaaggaatgaagaggctcaagtgcatgacaagcttaactctggaatggtttccaacatggaaggcacagcagggggagagagaccttctgtgcgtggccttcatcatgaagacggcagccagcacatcggcctcctgcatcctggggacagagggcctgaccatgagtacgtgctggtcgaggaagcggagtgtgccatgagcgagagggaggctgccccaaatgaggaattggtgcaaagaaacaggttaatatgcagaagaaatccatataggatctttgagtatttgcaactcagcctagaagaggcctttttcttggtctatgctctgggatgtttaagtatttactatgagaaggagcctttaacgatagtgaagctctggaaagctttcactgtagttcagcccacgttcagaaccacctacatggcctaccattactttcgaagcaagggctgggtgcccaaagtgggactcaagtacgggacagatttactgctatatcggaaaggccctccattttaccatgcaagttattctgtcattatcgagctagttgatgaccattttgaaggctctctccgcaggcctctcagttggaagtccctggctgccttgagcagagtttccgttaatgtctctaaggaacttatgctgtgctatttgattaaaccctctactatgactgacaaggaaatggagtcaccagaatgtatgaaaaggattaaagttcaggaggtgattctgagtcgatgggtttcttcacgagagaggagtgaccaagacgatctttaacaattcaacctcaaatttctaatttcaccaacaactatttattgagggctaggtaaaaagttctttttgttgtaatcgtccattaattcataagttttaaagggcatggtgctcccagcaccagaaaactatcagtgtttttaaagataaattacacaagggaggagaaagatccctgtgctaggactgcagattctatacttgcgttggcctctaactctccaatccagagcctcctgcctctggcgtcagtcttttccctcatccactcactggggagattggactagaggagtcctgagaggacacttccaacaagagacatttattctctgattttacctgaaaatggtagtagtttacatttatacagtacagtttatgaagcactttcatacgcaggcatctcttgttacctacatctaagctgttcccgaaagagtgttacagaacacaacagtattgtacaatattcgataagcatatcttcactgcacttgttataaaaatgagtggtgaaataatgtttggagacataatgaaagcgattaacatttggcaaaatataataaagcctttttgtaattggtgagaaa

SEQ ID NO: 32830 - DNA, 1424 bp, Homo sapiens
tgacgaagttgacgagggtgtcggcatgagggggtggagcaaggagcgcgtggcgcggtgcgcagtgggtggctccacctcgactgcgaattactgtttatgaggtgactcgctggttctatcggtggacagtgggacattctgaagggaggcaaggaggcggactgagcgctcccaattggggaggatgctggtggtggaggtggcgaacggccgctccctggtgtggggagccgaggcggtgcaggccctccgggagcgcctgggtgtggggggccgcacggtaggcgccctgccccgcgggccccgccagaactcgcgcctgggcctcccgctgctgctgatgcccgaagaggcgcggctcttggccgagatcggcgccgtgactctggtcagcgccccgcgtccagactctcggcaccacagcctggccctgacatccttcaagcgccagcaagaggagagcttccaggagcagagcgccttggcagctgaggcccgggagacccgtcgtcaggagctcctggagaagattacggagggccaggctgctaagaagcagaaactagaacaggcttcaggggccagctcaagccaggaggccggctcgagccaggctgccaaagaggatgagaccagtgatggccaggcttcgggagagcaggaggaagctggcccctcgtcttcccaagcaggaccctcaaatggggtagcccccttgcccagatctgctctccttgtccagctggccactgccaggcctcgaccggtcaaggccaggcccctggactggcgtgtccagtctaaagactggccccacgccggccgccctgcccacgagctgcgctacagtatctacagagacctgtgggagcgaggcttcttcctcagtgcggctggcaagttcggaggtgacttcctggtctatcctggtgaccccctccgcttccacgcccattatatcgctcagtgctgggcccccgaggacaccatcccactccaagacctggttgctgctgggcgccttggaaccagcgtcagaaagaccctgctcctctgttctccgcagcctgatggtaaggtggtctacacctccctgcaatgggccagcctgcagtgaactccagagacctaggggatgtggctgtgtcggcagcaagagcctttctggatgttccccagctcttctctgggagtctagaacatcctcctacctttctccgcggttagtttttgattccaggttttcgaacactacatcttttttatgttcttccttgtttcaaagcacttattggctgtgtttttgtagttacctattttcacactgtgagcttcccgagaatggggcctgggtttgattcatctgttttctacagggtttaagtctcaggaggtctcaataaacttggtatataaatgtt

SEQ ID NO: 32831 - DNA, 1548 bp, Homo sapiens
cgaggacgcccgaacgccgaacttcctgtgctcgggagggggcagggttttgtactgtgggagtctgagagcgaggaggtccgaaagccgaatcacagtcgttcggaaagaggaggagcgaaggctcgagcgtccggaagagggtgtggcctcggcggtgccttagcctccagagcttctgaccgctgacgggaacacccgaagggggacgcccactttgcaagagggtggtgccaaaatggacctttgtaagggggcgtgtcgccgcgcttgcggaggtttgtttttcacgctccaaggcgcaatggaggatgctggtggtggaggtggcgaacggccgctccctggtgtggggagccgaggcggtgcaggccctccgggagcgcctgggtgtggggggccgcacggtaggcgccctgccccgcgggccccgccagaactcgcgcctgggcctcccgctgctgctgatgcccgaagaggcgcggctcttggccgagatcggcgccgtgactctggtcagcgccccgcgtccagactctcggcaccacagcctggccctgacatccttcaagcgccagcaagaggagagcttccaggagcagagcgccttggcagctgaggcccgggagacccgtcgtcaggagctcctggagaagattacggagggccaggctgctaagaagcagaaactagaacaggcttcaggggccagctcaagccaggaggccggctcgagccaggctgccaaagaggatgagaccagtgatggccaggcttcgggagagcaggaggaagctggcccctcgtcttcccaagcaggaccctcaaatggggtagcccccttgcccagatctgctctccttgtccagctggccactgccaggcctcgaccggtcaaggccaggcccctggactggcgtgtccagtctaaagactggccccacgccggccgccctgcccacgagctgcgctacagtatctacagagacctgtgggagcgaggcttcttcctcagtgcggctggcaagttcggaggtgacttcctggtctatcctggtgaccccctccgcttccacgcccattatatcgctcagtgctgggcccccgaggacaccatcccactccaagacctggttgctgctgggcgccttggaaccagcgtcagaaagaccctgctcctctgttctccgcagcctgatggtaaggtggtctacacctccctgcaatgggccagcctgcagtgaactccagagacctaggggatgtggctgtgtcggcagcaagagcctttctggatgttccccagctcttctctgggagtctagaacatcctcctacctttctccgcggttagtttttgattccaggttttcgaacactacatcttttttatgttcttccttgtttcaaagcacttattggctgtgtttttgtagttacctattttcacactgtgagcttcccgagaatggggcctgggtttgattcatctgttttctacagggtttaagtctcaggaggtctcaataaacttggtatataaatgtt

SEQ ID NO: 32832 - DNA, 1349 bp, Homo sapiens
gaggcctaggggcggggcttcgccgagaccccggaggctttgggtgcgctgcagcggtctgcggcgcgcagctgtttcggtaactgctttgcctcccggctcccgcaggaggatgctggtggtggaggtggcgaacggccgctccctggtgtggggagccgaggcggtgcaggccctccgggagcgcctgggtgtggggggccgcacggtaggcgccctgccccgcgggccccgccagaactcgcgcctgggcctcccgctgctgctgatgcccgaagaggcgcggctcttggccgagatcggcgccgtgactctggtcagcgccccgcgtccagactctcggcaccacagcctggccctgacatccttcaagcgccagcaagaggagagcttccaggagcagagcgccttggcagctgaggcccgggagacccgtcgtcaggagctcctggagaagattacggagggccaggctgctaagaagcagaaactagaacaggcttcaggggccagctcaagccaggaggccggctcgagccaggctgccaaagaggatgagaccagtgatggccaggcttcgggagagcaggaggaagctggcccctcgtcttcccaagcaggaccctcaaatggggtagcccccttgcccagatctgctctccttgtccagctggccactgccaggcctcgaccggtcaaggccaggcccctggactggcgtgtccagtctaaagactggccccacgccggccgccctgcccacgagctgcgctacagtatctacagagacctgtgggagcgaggcttcttcctcagtgcggctggcaagttcggaggtgacttcctggtctatcctggtgaccccctccgcttccacgcccattatatcgctcagtgctgggcccccgaggacaccatcccactccaagacctggttgctgctgggcgccttggaaccagcgtcagaaagaccctgctcctctgttctccgcagcctgatggtaaggtggtctacacctccctgcaatgggccagcctgcagtgaactccagagacctaggggatgtggctgtgtcggcagcaagagcctttctggatgttccccagctcttctctgggagtctagaacatcctcctacctttctccgcggttagtttttgattccaggttttcgaacactacatcttttttatgttcttccttgtttcaaagcacttattggctgtgtttttgtagttacctattttcacactgtgagcttcccgagaatggggcctgggtttgattcatctgttttctacagggtttaagtctcaggaggtctcaataaacttggtatataaatgtt

SEQ ID NO: 32833 - DNA, 1087 bp, Homo sapiens
gtcggcatgagggggtggagcaaggagcgcgtggcgcggtgcgcagtgggtggctccacctcgactgcgaattactgtttatgaggaggatgctggtggtggaggtggcgaacggccgctccctggtgtggggagccgaggcggtgcaggccctccgggagcgcctgggtgtggggggccgcacggtaggcgccctgccccgcgggccccgccagaactcgcgcctgggcctcccgctgctgctgatgcccgaagaggcgcggctcttggccgagatcggcgccgtgactctggtcagcgccccgcgtccagactctcggcaccacagcctggccctgacatccttcaagcgccagcaagaggagagcttccaggagcagagcgccttggcagctgaggcccgggagacccgtcgtcaggagctcctggagaagattacggagggccaggctgctaagaagcagaaactagaacaggcttcaggggccagctcaagccaggaggccggctcgagccaggctgccaaagaggatgagaccagtgatggccaggcttcgggagagcaggaggaagctggcccctcgtcttcccaagcaggaccctcaaatggggtagcccccttgcccagatctgctctccttgtccagctggccactgccaggcctcgaccggtcaaggccaggcccctggactggcgtgtccagtctaaagactggccccacgccggccgccctgcccacgagctgcgctacagtatctacagagacctgtgggagcgaggcttcttcctcagtgcggctggcaagttcggaggtgacttcctggtctatcctggtgaccccctccgcttccacgcccattatatcgctcagtgctgggcccccgaggacaccatcccactccaagacctggttgctgctgggcgccttggaaccagcgtcagaaagaccctgctcctctgttctccgcagcctgatgggtttaagtctcaggaggtctcaataaacttggtatataaatgttcatgatttgaatgtttgcgacagtcctggaacccgtggatggtctcatctgcatgtacaggtga

SEQ ID NO: 32834 - DNA, 956 bp, Homo sapiens
cacaagcttcggtttacttcgtagatagttgggtacaagtgacgctaggatgataggcggagtcaacaggttcgccagatacccatgagtatttacaagggggcggggcgaaagcgacttgccctcaaaggggcggaaccccgagggccggcgtgcgcctacgggaccgggccagggtgacgatcctcaagttcccaagtagaggagaggaagcggcagagggaggaggatgctggtggtggaggtggcgaacggccgctccctggtgtggggagccgaggcggtgcaggccctccgggagcgcctgggtgtggggggccgcacggtaggcgccctgccccgcgggccccgccagaactcgcgcctgggcctcccgctgctgctgatgcccgaagaggcgcggctcttggccgagatcggcgccgtgactctggtcagcgccccgcgtccagactctcggcaccacagcctggccctgacatccttcaagcgccagcaagaggagagcttccaggagcagagcgccttggcagctgaggcccgggagacccgtcgtcaggagctcctggagaagattacggagggccaggctgctaagaagcagaaactagaacaggcttcaggggccagctcaagccaggaggccggctcgagccaggctgccaaagaggatgagaccagtgatggccaggcttcgggagagcaggaggaagctggcccctcgtcttcccaagcaggaccctcaaatggggtagcccccttgcccagatctgctctccttgtccagctggccactgccaggcctcgaccggtcaaggccaggcccctggactggcgtgtccagtctaaagactggccccacgccggccgccctgcccacgagctgcgctacagtatctacagagacctgtgggagcgaggcttcttcctcagtgcggctggcaagttcggaggtg

SEQ ID NO: 32835 - DNA, 1941 bp, Homo sapiens
gtggcggcgcgcgcagcggcaggcggcggcgggatggagcccgagcccgagcccgcggccgtggaggttcccgcggggcgcgtgctcagcgcccgggagctcttcgccgcccgctcgcggtcgcagaagctgccccagcgctcgcatggccccaaggactttctgcccgacggctcggcagctcaggccgagcggctgcgccggtgccgggaagagctctggcagctgctggcagagcagcgcgtggagcgcctgggcagcttggtggctgccgagtggaggccagaagagggcttcgtggagttgaagtctcccgcgggcaaattctggcagaccatgggcttctcagagcagggccggcagcgccttcacccggaagaggccttgtatcttctggagtgtggctccatccacctcttccaccaagacctgccactgtctatccaggaagcttaccagctgctgctgaccgaccacactgtgaccttcctgcagtaccaggtcttcagccacctgaagaggttgggttatgtggttcgacgattccaaccaagctctgtcctgtccccgtatgagaggcagcttaacctggatgccagcgtgcagcacttggaggatggagatggcaagagaaagaggagcagctccagccctcggtccattaataagaaggccaaggccctggacaactccctgcaacccaagagtctggcagcctccagcccacctccctgcagccagcccagccaatgcccagaggagaaaccccaggagtcaagccccatgaagggcccagggggcccctttcagcttctggggtccctgggccccagccctggcccggccagggagggggtggggtgcagctgggagagtggcagagccgagaacggagtcacgggagccggtaagcggcgctggaacttcgagcagatctccttccccaacatggcttcagacagccgccacacccttctgcgcgccccagccccagagctgctcccggccaacgtggctgggcgggagacagacgctgagtcctggtgccagaagctgaaccagcgcaaggagaagctctccaggcgggaacgggagcaccacgcggaggccgcgcagttccaggaagatgtcaacgccgatcccgaggtgcagcggtgctccagctggcgggagtacaaggagctgctgcagcggcggcaggtgcagaggagccagcgccgggcccctcacctgtggggccagcccgtcaccccgctgctgagtcctggccaggccagctccccagccgtggtccttcagcatatctctgtgctgcagacaacacaccttcctgatggaggtgcccggctgttggagaagtctgggggcttggaaatcatctttgatgtttaccaggccgacgctgtggccacattccgaaagaataaccctggcaaaccctatgcccggatgtgcattagtggatttgatgagcctgtcccagacctctgcagcctcaagcggttgtcttaccagagtggggatgtccctctgatctttgccctggtggatcatggtgacatctccttctacagcttcagggacttcacgttgccccaggatgtggggcactgacctcacagctctgcagaggatggagcttgctccgggggaccgggactgtctgttctcagggaccatctcggctgcctcctgtacccagactctaacctgtagcttcagaggccagtctgggccttggccctgggtgtctgatactcacagagtgaaactgtgaccctctcccttccctgctgccttgcagtgacccctctggaactcaggactcgattttaaggacccaggaggtggggcagaagagaggactgtgtgcctttaacgagagggtgcctgcttcgtgctataaagccaaagccattaaaaatagatttcttttctgct

SEQ ID NO: 32836 - DNA, 1682 bp, Homo sapiens
gaaacggaggggcggggggcgcgggggcagaggtgacctggggctctggacttagacccaagggctagacaccccgggtctgactggtgggagagaagacgtaatgtgaagggggttggcaaccaagacgcgggaccccacttgcagtaccccccgtctgcggccggcgtcgcccacccgcagccgccggccgggcaatggcaccacctagcggacggcaccagtgcggggaccccagcctcgaggaggcgctcgtgccgggcggaggtggcgcttcagcaccgtcgtgggccggacagcgcctcccgcccccggccctcgaaacctggcttcggagcccagccgtagggaccggacggaagacaccgaaggaatggcgaacctccccggaccgctcctgacagttcccgggtggccttcggcctgcaaagtcggaatttgcacaccctccgctcgtccttccctgagcccttctgccctccttgcccagcccgggcggtggggactaagcagcgcgaggctgcagaggggcggtcacaagtgtgaccattcgcactgcactccagacgccggctcctcaggctttactggagagaagccccgaggagggctaggggcaaaagaggggccttctgcatctccagcaacctgcgggctgagctcccagacccggcgtcgggcgcccgggagctcttcgccgcccgctcgcggtcgcagaagctgccccagcgctcgcatggccccaaggactttctgcccgacggctcggcagctcaggccgagcggctgcgccggtgccgggaagagctctggcagctgctggcagagcagcgcgtggagcgcctgggcagcttggtggctgccgagtggaggccagaagagggcttcgtggagttgaagtctcccgcgggcaaattctggcagaccatgggcttctcagagcagggccggcagcgccttcacccggaagaggccttgtatcttctggagtgtggctccatccacctcttccaccaagacctgccactgtctatccaggaagcttaccagctgctgctgaccgaccacactgtgaccttcctgcagtaccaggtcttcagccacctgaagaggttgggttatgtggttcgacgattccaaccaagctctgtcctgtccccgtatgagaggcagcttaacctggatgccagcgtgcagcacttggaggatggagatggcaagagaaagaggagcagctccagccctcggtccattaataagaaggccaaggccctggacaactccctgcaacccaagagtctggcagcctccagcccaccttcagggacttcacgttgccccaggatgtggggcactgacctcacagctctgcagaggatggagcttgctccgggggaccgggactgtctgttctcagggaccatctcggctgcctcctgtacccagactctaacctgtagcttcagaggccagtctgggccttggccctgggtgtctgatactcacagagtgaaactgtgaccctctcccttccctgctgccttgcagtgacccctctggaactcaggactcgattttaaggacccaggaggtggggcagaagagaggactgtgtgcctttaacgagagggtgcctgcttcgtgctataaagccaaagccattaaaaatagatttcttttct

SEQ ID NO: 32837 - DNA, 1856 bp, Homo sapiens
cggcgggatggagcccgagcccgagcccgcggccgtggaggttcccgcggggcgcgtgctcagcgcccgggagctcttcgccgcccgctcgcggtcgcagaagctgccccagcgctcgcatggccccaaggactttctgcccgacggctcggcagctcaggccgagcggctgcgccggtgccgggaagagctctggcagctgctggcagagcagcgcgtggagcgcctgggcagcttggtggctgccgagtggaggccagaagagggcttcgtggagttgaagtctcccgcgggcaaattctggcagaccatgggcttctcagagcagggccggcagcgccttcacccggaagaggccttgtatcttctggagtgtggctccatccacctcttccaccaagacctgccactgtctatccaggaagcttaccagctgctgctgaccgaccacactgtgaccttcctgcagtaccagccacctgaagaggttgggttatgtggttcgacgattccaaccaagctctgtcctgtccccgtatgagaggcagcttaacctggatgccagcgtgcagcacttggaggatggagatggcaagagaaagaggagcagctccagccctcggtccattaataagaaggccaaggccctggacaactccctgcaacccaagagtctggcagcctccagcccacctccctgcagccagcccagccaatgcccagaggagaaaccccaggagtcaagcccccagccctggcccggccagggagggggtggggtgcagctgggagagtggcagagccgagaacggagtcacgggagccggtaagcggcgctggaacttcgagcagatctccttccccaacatggcttcagacagccgccacacccttctgcgcgccccagccccagagctgctcccggccaacgtggctgggcgggagacagacgctgagtcctggtgccagaagctgaaccagcgcaaggagaagctctccaggcgggaacgggagcaccacgcggaggccgcgcagttccaggaagatgtcaacgccgatcccgaggtgcagcggtgctccagctggcgggagtacaaggagctgctgcagcggcggcaggtgcagaggagccagcgccgggcccctcacctgtggggccagcccgtcaccccgctgctgagtcctggccaggccagctccccagccgtggtccttcagcatatctctgtgctgcagacaacacaccttcctgatggaggtgcccggctgttggagaagtctgggggcttggaaatcatctttgatgtttaccaggccgacgctgtggccacattccgaaagaataaccctggcaaaccctatgcccggatgtgcattagtggatttgatgagcctgtcccagacctctgcagcctcaagcggttgtcttaccagagtggggatgtccctctgatctttgccctggtggatcatggtgacatctccttctacagcttcagggacttcacgttgccccaggatgtggggcactgacctcacagctctgcagaggatggagcttgctccgggggaccgggactgtctgttctcagggaccatctcggctgcctcctgtacccagactctaacctgtagcttcagaggccagtctgggccttggccctgggtgtctgatactcacagagtgaaactgtgaccctctcccttccctgctgccttgcagtgacccctctggaactcaggactcgattttaaggacccaggaggtggggcagaagagaggactgtgtgcctttaacgagagggtgcctgcttcgtgctataaagccaaagccattaaaaatagatttcttttc

SEQ ID NO: 32838 - DNA, 4647 bp, Homo sapiens
gggggataggctcagacacaaggagaggcttggagagagcagacgccttctggattcaagaagacgaggcccattcccctcaggctcacctgttactcggcctcccagaaagatggataggagaaatgactacggatatagggtgcctctatttcagggccctctgcctcccccggggagcctggggcttcccttccctccagatatacagactgagaccacagaagaggacagtgtcctgctgatgcataccctgttggcggcaaccaaggactccctggccatggacccaccagttgtcaaccggcctaagaaaagcaagaccaagaaggcccctataaagactattactaaggctgcacctgctgcccctccagtcccagctgccaatgagattgccaccaacaagcccaaaataacttggcaggctttaaacctgccagtcattacccagatcagccaggctttacctaccactgaggtaaccaatactcaggcttcttcagtcactgctcagcctaagaaagccaacaagatgaagagagttactgccaaggcagcccaaggctcccaatccccaactggccatgagggtggcactatacagctgaagtcacccttgcaggtcctaaagctaccagtcatctcacagaatattcacgctccaattgccaatgagtcagccagttcccaagccttgataacctctatcaagcctaagaaagcttccaaggctaagaaggctgcaaataaggccatagctagtgccaccgaggtctcgctggctgcaactgccacccatacagctaccacccaaggccaaattaccaatgagacagccagtatccacaccacagcagcctccatccgaaccaagaaagcctccaaagccaggaagacaattgctaaggtcataaatactgacactgagcatatagaggctctaaatgtcactgacgcagctaccaggcagattgaggcctcagtagtggctatcaggcccaaaaaatccaagggcaagaaggctgccagcaggggcccaaattctgtctctgagatctctgaggccccacttgccactcagatagtcacaaaccaagccctggcagccaccctgcgggtcaagagagggtctagggctcggaaggctgccactaaggctcgggcaactgaaagccagactccaaatgctgaccaaggggcccaggccaagatagcctctgctcagaccaacgtaagtgcccttgagactcaggttgctgctgctgtccaggccctggcagatgactatctggctcagttgagcctggagcccacaaccaggacccggggcaaaagaaaccgaaagtccaagcatctgaatggggatgagagaagtggcagtaattacaggcggatcccatggggccggaggcctgcaccaccgcgagatgtggccattttacaagaaagggctaataagttggtgaaatacctgttggttaaggaccagacaaagatccccatcaaacgctcagacatgctgagggatgtcatccaagaatatgatgaatatttcccagaaatcattgaacgagcaagctacactctggagaagatgtttcgagtcaatctgaaagaaattgataagcaaagtagcttgtatattctcatcagcactcaggaatcctctgcaggcatactgggaacgaccaaggacacacccaagctgggtctcctcatggtgattctgagtgtcatttttatgaatggcaacaaggccagtgaggctgtcatctgggaggtgctgcgcaagttggggctgcgccctggggtgaggcattcactctttggggaagtgaggaagctcatcacagacgagtttgtgaagcagaagtacctggagtacaagagggtccctaacagcagaccacctgaatatgagttcttctggggcttgcgctcctaccacgagactagcaagatgaaagtcctcaagtttgcatgcagggtgcagaagaaagaccccaaggactgggctgtgcagtaccgcgaggcagtggagatggaagtccaagctgcagctgtggctgtggctgaggctgaagccagggctgaggcaagagcccaaatggggattggagaggaagctgtggctgggccctggaattgggatgacatggatatcgactgcctaacaagggaagagttaggcgatgatgctcaggcctggagcagattttcatttgaaattgaggccagagcccaagaaaatgcagatgccagcaccaacgtcaacttcagcagaggagctagtaccagggctggcttcagcgatggtgctagtattagcttcaatggtgcacccagctccagtggtggcttcagtggtggacctggcattacctttggtgttgcacccagcaccagtgccagcttcagcaatacagccagcattagctttggtggtacactgagcactagctccagcttcagcagcgcagccagcattagctttggttgtgcacacagcaccagcactagtttcagcagtgaagccagcattagctttggtggcatgccttgtaccagtgccagctttagtggtggagtcagctctagttttagtggcccactcagcaccagtgccactttcagtggtggagccagctctggctttggaggcacactcagcaccacggctggctttagtggtgtactcagcactagcaccagctttggcagtgcacccacaacgagcacagtcttcagtagtgcgcttagcaccagcactggctttggaggcatactcagcaccagtgtctgttttggtggctctcccagctccagtggtagctttggtggtacactcagtaccagtatctgcttcggtggctctccctgcaccagcactggctttggaggcacacttagcaccagtgtctcctttggtggctcttccagcaccagtgccaattttggtggtacactaagtaccagcatctgctttgatggctctcccagcactggtgctggctttggtggtgctctcaacaccagtgccagctttggcagtgtgctcaacaccagtactggttttggtggtgctatgagcaccagtgctgactttggcggtacactaagcaccagtgtctgctttggtggctctcctggcaccagtgtcagctttggcagtgcactcaacaccaatgctggttatggtggtgctgtcagcaccaacactgactttggtggtacactaagcaccagcgtctgttttggtggctctcccagcaccagtgctggctttggtggtgcactcaacaccaatgccagctttggctgtgccgtcagcaccagtgccagcttcagtggtgctgtcagcaccagtgcttgcttcagtggtgcaccaatcaccaaccctggctttggcggtgcatttagcaccagtgctggcttcggtggggcacttagtaccgctgctgacttcggtggtactcccagcaacagcattggctttggtgctgctcccagcaccagtgtcagctttggtggtgctcatggcaccagcctctgttttggtggagctcccagcaccagcctctgctttggcagtgcatctaatactaacctatgctttggtggccctcctagcaccagtgcctgctttagtggtgctaccagccctagtttttgtgatggacccagcaccagtaccggtttcagctttggcaatgggttaagcaccaatgctggatttggtggtggactgaacaccagtgctggctttggtggtggcctaggcaccagtgctggcttcagtggtggcctaagcacaagttctggctttgatggtgggctaggtaccagcgctggcttcggtggaggaccaggcaccagcactggttttggtggtggactgggcaccagtgctggcttcagtggcggactgggcaccagtgctggctttggtggtggactggtcactagtgatggctttggtggtggactgggcaccaatgctagtttcggcagcacacttggcaccagtgctggctttagtggtggcctcagcaccagcgatggctttggcagtaggcctaatgccagcttcgacagaggactgagtaccatcattggctttggcagtggttccaacaccagcactggctttactggcgaacccagcaccagcacgggcttcagtagtggacccagttctattgttggcttcagcggtggaccaagcactggtgttggcttctgcagtggaccaagcaccagtggcttcagcggtggaccgagcacaggagctggcttcggcggtggaccaaacactggtgctggctttggtggtggaccgagcaccagtgctggctttggcagtggagccgccagtcttggtgcctgtggcttctcgtatggctagtgaggtttcagatttattccccatgtttacagataccgctaataaattgcagtagtccttcccatggagccaaagtacatccttggaatctttgtccacacagcagtcaaggcagttatggccaatcagctgagggtgtcatgtgatggaaaaatctgtttgctgttcctgctttattgtttgctttctgtgtgctgtcatattttggtatcagagttacattaaatttgcaaaatgaa

SEQ ID NO: 32839 - DNA, 2326 bp, Homo sapiens
gggggataggctcagacacaaggagaggcttggagagagcagacgccttctggattcaagaagacgaggcccattcccctcaggctcacctgttactcggcctcccagaaagatggataggagaaatgactacggatatagggtgcctctatttcagggccctctgcctcccccggggagcctggggcttcccttccctccagatatacagactgagaccacagaagaggacagtgtcctgctgatgcataccctgttggcggcaaccaaggactccctggccatggacccaccagttgtcaaccggcctaagaaaagcaagaccaagaaggcccctataaagactattactaaggctgcacctgctgcccctccagtcccagctgccaatgagattgccaccaacaagcccaaaataacttggcaggctttaaacctgccagtcattacccagatcagccaggctttacctaccactgaggtaaccaatactcaggcttcttcagtcactgctcagcctaagaaagccaacaagatgaagagagttactgccaaggcagcccaaggctcccaatccccaactggccatgagggtggcactatacagctgaagtcacccttgcaggtcctaaagctaccagtcatctcacagaatattcacgctccaattgccaatgagtcagccagttcccaagccttgataacctctatcaagcctaagaaagcttccaaggctaagaaggctgcaaataaggccatagctagtgccaccgaggtctcgctggctgcaactgccacccatacagctaccacccaaggccaaattaccaatgagacagccagtatccacaccacagcagcctccatccgaaccaagaaagcctccaaagccaggaagacaattgctaaggtcataaatactgacactgagcatatagaggctctaaatgtcactgacgcagctaccaggcagattgaggcctcagtagtggctatcaggcccaaaaaatccaagggcaagaaggctgccagcaggggcccaaattctgtctctgagatctctgaggccccacttgccactcagatagtcacaaaccaagccctggcagccaccctgcgggtcaagagagggtctagggctcggaaggctgccactaaggctcgggcaactgaaagccagactccaaatgctgaccaaggggcccaggccaagatagcctctgctcagaccaacgtaagtgcccttgagactcaggttgctgctgctgtccaggccctggcagatgactatctggctcagttgagcctggagcccacaaccaggacccggggcaaaagaaaccgaaagtccaagcatctgaatggggatgagagaagtggcagtaattacaggcggatcccatggggccggaggcctgcaccaccgcgagatgtggccattttacaagaaagggctaataagttggtgaaatacctgttggttaaggaccagacaaagatccccatcaaacgctcagacatgctgagggatgtcatccaagaatatgatgaatatttcccagaaatcattgaacgagcaagctacactctggagaagatgtttcgagtcaatctgaaagaaattgataagcaaagtagcttgtatattctcatcagcactcaggaatcctctgcaggcatactgggaacgaccaaggacacacccaagctgggtctcctcatggtgattctgagtgtcatttttatgaatggcaacaaggccagtgaggctgtcatctgggaggtgctgcgcaagttggggctgcgccctggggtgaggcattcactctttggggaagtgaggaagctcatcacagacgagtttgtgaagcagaagtacctggagtacaagagggtccctaacagcagaccacctgaatatgagttcttctggggcttgcgctcctaccacgagactagcaagatgaaagtcctcaagtttgcatgcagggtgcagaagaaagaccccaaggactgggctgtgcagtaccgcgaggcagtggagatggaagtccaagctgcagctgtggctgtggctgaggctgaagccagggctgagatttattccccatgtttacagataccgctaataaattgcagtagtccttcccatggagccaaagtacatccttggaatctttgtccacacagcagtcaaggcagttatggccaatcagctgagggtgtcatgtgatggaaaaatctgtttgctgttcctgctttattgtttgctttctgtgtgctgtcatattttggtatcagagttacattaaatttgcaaaatgaa

SEQ ID NO: 32840 - DNA, 1403 bp, Homo sapiens
ataggctcagacacaaggagaggcttggagagagcagacgccttctggattcaagaagacgaggctcacctgttactcggcctcccagaaagatggataggagaaatgactacggatatagggtgcctctatttcagtccaagcatctgaatggggatgagagaagtggcagtaattacaggcggatcccatggggccggaggcctgcaccaccgcgagatgtggccattttacaagaaagggctaataagttggtgaaatacctgttggttaaggaccagacaaagatccccatcaaacgctcagacatgctgagggatgtcatccaagaatatgatgaatatttcccagaaatcattgaacgagcaagctacactctggagaagatgtttcgagtcaatctgaaagaaattgataagcaaagtagcttgtatattctcatcagcactcaggaatcctctgcaggcatactgggaacgaccaaggacacacccaagctgggtctcctcatggtgattctgagtgtcatttttatgaatggcaacaaggccagtgaggctgtcatctgggaggtgctgcgcaagttggggctgcgccctggggtgaggcattcactctttggggaagtgaggaagctcatcacagacgagtttgtgaagcagaagtacctggagtacaagagggtccctaacagcagaccacctgaatatgagttcttctggggcttgcgctcctaccacgagactagcaagatgaaagtcctcaagtttgcatgcagggtgcagaagaaagaccccaaggactgggctgtgcagtaccgcgaggcagtggagatggaagtccaactgcagctgtggctgtggctgaggctgaagccagggctgagtggttccaacaccagcactggctttactggcgaacccagcaccagcacgggcttcagtagtggacccagttctattgttggcttcagcggtggaccaagcactggtgttggcttctgcagtggaccaagcaccagtggcttcagcggtggaccgagcacaggagctggcttcggcggtggaccaaacactggtgctggctttggtggtggaccgagcaccagtgctggctttggcagtggagccgccagtcttggtgcctgtggcttctcgtatggctagtgaggtttcagatttattccccatgtttacagataccgctaataaattgcagtagtccttcccatggagccaaagtacatccttggaatctttgtccacacagcagtcaaggcagttatggccaatcagctgagggtgtcatgtgatggaaaaatctgtttgctgttcctgctttattgtttgctttctgtgtgctgtcatattttggtatcagagttacattaaatttgcaaaatg

SEQ ID NO: 32841 - DNA, 2306 bp, Homo sapiens
ataggctcagacacaaggagaggcttggagagagcagacgccttctggattcaagaagacgaggctcacctgttactcggcctcccagaaagatggataggagaaatgactacggatatagggtgcctctatttcagggccctctgcctcccccggggagcctggggcttcccttccctccagatatacagactgagaccacagaagaggacagtgtcctgctgatgcataccctgttggcggcaaccaaggactccctggccatggacccaccagttgtcaaccggcctaagaaaagcaagaccaagaaggcccctataaagactattactaaggctgcacctgctgcccctccagtcccagctgccaatgagattgccaccaacaagcccaaaataacttggcaggctttaaacctgccagtcattacccagatcagccaggctttacctaccactgaggtaaccaatactcaggcttcttcagtcactgctcagcctaagaaagccaacaagatgaagagagttactgccaaggcagcccaaggctcccaatccccaactggccatgagggtggcactatacagctgaagtcacccttgcaggtcctaaagctaccagtcatctcacagaatattcacgctccaattgccaatgagtcagccagttcccaagccttgataacctctatcaagcctaagaaagcttccaaggctaagaaggctgcaaataaggccatagctagtgccaccgaggtctcgctggctgcaactgccacccatacagctaccacccaaggccaaattaccaatgagacagccagtatccacaccacagcagcctccatccgaaccaagaaagcctccaaagccaggaagacaattgctaaggtcataaatactgacactgagcatatagaggctctaaatgtcactgacgcagctaccaggcagattgaggcctcagtagtggctatcaggcccaaaaaatccaagggcaagaaggctgccagcaggggcccaaattctgtctctgagatctctgaggccccacttgccactcagatagtcacaaaccaagccctggcagccaccctgcgggtcaagagagggtctagggctcggaaggctgccactaaggctcgggcaactgaaagccagactccaaatgctgaccaaggggcccaggccaagatagcctctgctcagaccaacgtaagtgcccttgagactcaggttgctgctgctgtccaggccctggcagatgactatctggctcagttgagcctggagcccacaaccaggacccggggcaaaagaaaccgaaagtccaagcatctgaatggggatgagagaagtggcagtaattacaggcggatcccatggggccggaggcctgcaccaccgcgagatgtggccattttacaagaaagggctaataagttggtgaaatacctgttggttaaggaccagacaaagatccccatcaaacgctcagacatgctgagggatgtcatccaagaatatgatgaatatttcccagaaatcattgaacgagcaagctacactctggagaagatgtttcgagtcaatctgaaagaaattgataagcaaagtagcttgtatattctcatcagcactcaggaatcctctgcaggcatactgggaacgaccaaggacacacccaagctgggtctcctcatggtgattctgagtgtcatttttatgaatggcaacaaggccagtgaggctgtcatctgggaggtgctgcgcaagttggggctgcgccctggggtgaggcattcactctttggggaagtgaggaagctcatcacagacgagtttgtgaagcagaagtacctggagtacaagagggtccctaacagcagaccacctgaatatgagttcttctggggcttgcgctcctaccacgagactagcaagatgaaagtcctcaagtttgcatgcagggtgcagaagaaagaccccaaggactgggctgtgcagtaccgcgaggcagtggagatggaagtccaagctgcagctgtggctgtggctgaggctgaagccagggctgagatttattccccatgtttacagataccgctaataaattgcagtagtccttcccatggagccaaagtacatccttggaatctttgtccacacagcagtcaaggcagttatggccaatcagctgagggtgtcatgtgatggaaaaatctgtttgctgttcctgctttattgtttgctttctgtgtgctgtcatattttggtatcagagttacattaaatttgcaaaatgaa

SEQ ID NO: 32842 - DNA, 3488 bp, Homo sapiens
agacgccttctggattcaagaagacgaggtgagctgaggtacctggctttagtgaagaccctgtgggggcttcctggctgcggcttcgacgtgcctgactccacacgcccctaaggctcacctgttactcggcctcccagaaagatggataggagaaatgactacggatatagggtgcctctatttcagtccaagcatctgaatggggatgagagaagtggcagtaattacaggcggatcccatggggccggaggcctgcaccaccgcgagatgtggccattttacaagaaagggctaataagttggtgaaatacctgttggttaaggaccagacaaagatccccatcaaacgctcagacatgctgagggatgtcatccaagaatatgatgaatatttcccagaaatcattgaacgagcaagctacactctggagaagatgtttcgagtcaatctgaaagaaattgataagcaaagtagcttgtatattctcatcagcactcaggaatcctctgcaggcatactgggaacgaccaaggacacacccaagctgggtctcctcatggtgattctgagtgtcatttttatgaatggcaacaaggccagtgaggctgtcatctgggaggtgctgcgcaagttggggctgcgccctggggtgaggcattcactctttggggaagtgaggaagctcatcacagacgagtttgtgaagcagaagtacctggagtacaagagggtccctaacagcagaccacctgaatatgagttcttctggggcttgcgctcctaccacgagactagcaagatgaaagtcctcaagtttgcatgcagggtgcagaagaaagaccccaaggactgggctgtgcagtaccgcgaggcagtggagatggaagtccaagctgcagctgtggctgtggctgaggctgaagccagggctgaggcaagagcccaaatggggattggagaggaagctgtggctgggccctggaattgggatgacatggatatcgactgcctaacaagggaagagttaggcgatgatgctcaggcctggagcagattttcatttgaaattgaggccagagcccaagaaaatgcagatgccagcaccaacgtcaacttcagcagaggagctagtaccagggctggcttcagcgatggtgctagtattagcttcaatggtgcacccagctccagtggtggcttcagtggtggacctggcattacctttggtgttgcacccagcaccagtgccagcttcagcaatacagccagcattagctttggtggtacactgagcactagctccagcttcagcagcgcagccagcattagctttggttgtgcacacagcaccagcactagtttcagcagtgaagccagcattagctttggtggcatgccttgtaccagtgccagctttagtggtggagtcagctctagttttagtggcccactcagcaccagtgccactttcagtggtggagccagctctggctttggaggcacactcagcaccacggctggctttagtggtgtactcagcactagcaccagctttggcagtgcacccacaacgagcacagtcttcagtagtgcgcttagcaccagcactggctttggaggcatactcagcaccagtgtctgttttggtggctctcccagctccagtggtagctttggtggtacactcagtaccagtatctgcttcggtggctctccctgcaccagcactggctttggaggcacacttagcaccagtgtctcctttggtggctcttccagcaccagtgccaattttggtggtacactaagtaccagcatctgctttgatggctctcccagcactggtgctggctttggtggtgctctcaacaccagtgccagctttggcagtgtgctcaacaccagtactggttttggtggtgctatgagcaccagtgctgactttggcggtacactaagcaccagtgtctgctttggtggctctcctggcaccagtgtcagctttggcagtgcactcaacaccaatgctggttatggtggtgctgtcagcaccaacactgactttggtggtacactaagcaccagcgtctgttttggtggctctcccagcaccagtgctggctttggtggtgcactcaacaccaatgccagctttggctgtgccgtcagcaccagtgccagcttcagtggtgctgtcagcaccagtgcttgcttcagtggtgcaccaatcaccaaccctggctttggcggtgcatttagcaccagtgctggcttcggtggggcacttagtaccgctgctgacttcggtggtactcccagcaacagcattggctttggtgctgctcccagcaccagtgtcagctttggtggtgctcatggcaccagcctctgttttggtggagctcccagcaccagcctctgctttggcagtgcatctaatactaacctatgctttggtggccctcctagcaccagtgcctgctttagtggtgctaccagccctagtttttgtgatggacccagcaccagtaccggtttcagctttggcaatgggttaagcaccaatgctggatttggtggtggactgaacaccagtgctggctttggtggtggcctaggcaccagtgctggcttcagtggtggcctaagcacaagttctggctttgatggtgggctaggtaccagcgctggcttcggtggaggaccaggcaccagcactggttttggtggtggactgggcaccagtgctggcttcagtggcggactgggcaccagtgctggctttggtggtggactggtcactagtgatggctttggtggtggactgggcaccaatgctagtttcggcagcacacttggcaccagtgctggctttagtggtggcctcagcaccagcgatggctttggcagtaggcctaatgccagcttcgacagaggactgagtaccatcattggctttggcagtggttccaacaccagcactggctttactggcgaacccagcaccagcacgggcttcagtagtggacccagttctattgttggcttcagcggtggaccaagcactggtgttggcttctgcagtggaccaagcaccagtggcttcagcggtggaccgagcacaggagctggcttcggcggtggaccaaacactggtgctggctttggtggtggaccgagcaccagtgctggctttggcagtggagccgccagtcttggtgcctgtggcttctcgtatggctagtgaggtttcagatttattccccatgtttacagataccgctaataaattgcagtagtccttcccatggagccaaagtacatccttggaatctttgtccacacagcagtcaaggcagttatggccaatcagctgagggtgtcatgtgatggaaaaatctgtttgctgttcctgctttattgtttgctttctgtgtgctgtcatattttggtatcagagttacattaaatttgcaaaatgaa

SEQ ID NO: 32843 - DNA, 1196 bp, Homo sapiens
agagcagctctagggaagagagacatagacacaaggtataacaacactatgtaaatagtgttgggatagagggtctgtaggaagggttggtgtgggagttcagagaactacattcctcctaggggaaacaggagaatcaaataggaacggagatacagagtggggaatagagaagtcaaatggagaataagagggagtgataactgaataggggtagtaagaagaaaaagggagctacattgaggagaatggaaagttgaaagtaggtatggaggggaggagactgacaggcaggaacggagacccccctctggaggcggaaagaggcaggaccacttccggccagggagggggataggctcagacacaaggagaggcttggagagagcagacgccttctggattcaagaagacgagggccctctgcctcccccggggagcctggggcttcccttccctccagatatacagactgagaccacagaagaggacagtgtcctgctgatgcataccctgttggcggcaaccaaggactccctggccatggacccaccagttgtcaaccggcctaagaaaagcaagaccaagaaggcccctataaagactattactaaggctgcacctgctgcccctccagtcccagctgccaatgagattgccaccaacaagcccaaaataacttggcaggctttaaacctgccagtcattacccagatcagccaggctttacctaccactgaggtaaccaatactcaggcttcttcagtcactgctcagcctaagaaagccaacaagatgaagagagttactgccaaggcagcccaaggctcccaatccccaactggccatgagggtggcactatacagctgaagtcacccttgcaggtcctaaagctaccagtcatctcacagaatattcacgctccaattgccaatgagtcagccagttcccaagccttgataacctctatcaagcctaagaaagcttccaaggctaagaaggctgcaaataaggccatagctagtgccaccgaggtctcgctggctgcaactgccacccatacagctaccacccaaggccaaattaccaatgagacagccagtatccacaccacagcagcctccatccgaaccaagaaagcctccaaagccaggaagacaattgctaaggtcataaatactgacactgagcatat

SEQ ID NO: 32844 - DNA, 594 bp, Homo sapiens
ccggtttgaaagggaagagacaggacctggtagggtttgagaacaggaatacacagaaggctcacctgttactcggcctcccagaaagatggataggagaaatgactacggatatagggtgcctctatttcagggccctctgcctcccccggggagcctggggcttcccttccctccagatatacagactgagaccacagaagaggacagtgtcctgctgatgcataccctgttggcggcaaccaaggactccctggccatggacccaccagttgtcaaccggcctaagaaaagcaagaccaagaaggcccctataaagactattactaaggctgcacctgctgcccctccagtcccagctgccaatgagattgccaccaacaagcccaaaataacttggcaggctttaaacctgccagtcattacccagatcagccaggctttacctaccactgaggtaaccaatactcaggcttcttcagtcactgctcagcctaagaaagccaacaagatgaagagagttactgccaaggcagcccaaggctcccaatccccaactggccatgagggtggcactatacagctgaagtcacc

SEQ ID NO: 32845 - DNA, 3352 bp, Homo sapiens
agacacaaggagaggcttggagagagcagacgccttctggattcaagaagacgagtccaagcatctgaatggggatgagagaagtggcagtaattacaggcggatcccatggggccggaggcctgcaccaccgcgagatgtggccattttacaagaaagggctaataagttggtgaaatacctgttggttaaggaccagacaaagatccccatcaaacgctcagacatgctgagggatgtcatccaagaatatgatgaatatttcccagaaatcattgaacgagcaagctacactctggagaagatgtttcgagtcaatctgaaagaaattgataagcaaagtagcttgtatattctcatcagcactcaggaatcctctgcaggcatactgggaacgaccaaggacacacccaagctgggtctcctcatggtgattctgagtgtcatttttatgaatggcaacaaggccagtgaggctgtcatctgggaggtgctgcgcaagttggggctgcgccctggggtgaggcattcactctttggggaagtgaggaagctcatcacagacgagtttgtgaagcagaagtacctggagtacaagagggtccctaacagcagaccacctgaatatgagttcttctggggcttgcgctcctaccacgagactagcaagatgaaagtcctcaagtttgcatgcagggtgcagaagaaagaccccaaggactgggctgtgcagtaccgcgaggcagtggagatggaagtccaagctgcagctgtggctgtggctgaggctgaagccagggctgaggcaagagcccaaatggggattggagaggaagctgtggctgggccctggaattgggatgacatggatatcgactgcctaacaagggaagagttaggcgatgatgctcaggcctggagcagattttcatttgaaattgaggccagagcccaagaaaatgcagatgccagcaccaacgtcaacttcagcagaggagctagtaccagggctggcttcagcgatggtgctagtattagcttcaatggtgcacccagctccagtggtggcttcagtggtggacctggcattacctttggtgttgcacccagcaccagtgccagcttcagcaatacagccagcattagctttggtggtacactgagcactagctccagcttcagcagcgcagccagcattagctttggttgtgcacacagcaccagcactagtttcagcagtgaagccagcattagctttggtggcatgccttgtaccagtgccagctttagtggtggagtcagctctagttttagtggcccactcagcaccagtgccactttcagtggtggagccagctctggctttggaggcacactcagcaccacggctggctttagtggtgtactcagcactagcaccagctttggcagtgcacccacaacgagcacagtcttcagtagtgcgcttagcaccagcactggctttggaggcatactcagcaccagtgtctgttttggtggctctcccagctccagtggtagctttggtggtacactcagtaccagtatctgcttcggtggctctccctgcaccagcactggctttggaggcacacttagcaccagtgtctcctttggtggctcttccagcaccagtgccaattttggtggtacactaagtaccagcatctgctttgatggctctcccagcactggtgctggctttggtggtgctctcaacaccagtgccagctttggcagtgtgctcaacaccagtactggttttggtggtgctatgagcaccagtgctgactttggcggtacactaagcaccagtgtctgctttggtggctctcctggcaccagtgtcagctttggcagtgcactcaacaccaatgctggttatggtggtgctgtcagcaccaacactgactttggtggtacactaagcaccagcgtctgttttggtggctctcccagcaccagtgctggctttggtggtgcactcaacaccaatgccagctttggctgtgccgtcagcaccagtgccagcttcagtggtgctgtcagcaccagtgcttgcttcagtggtgcaccaatcaccaaccctggctttggcggtgcatttagcaccagtgctggcttcggtggggcacttagtaccgctgctgacttcggtggtactcccagcaacagcattggctttggtgctgctcccagcaccagtgtcagctttggtggtgctcatggcaccagcctctgttttggtggagctcccagcaccagcctctgctttggcagtgcatctaatactaacctatgctttggtggccctcctagcaccagtgcctgctttagtggtgctaccagccctagtttttgtgatggacccagcaccagtaccggtttcagctttggcaatgggttaagcaccaatgctggatttggtggtggactgaacaccagtgctggctttggtggtggcctaggcaccagtgctggcttcagtggtggcctaagcacaagttctggctttgatggtgggctaggtaccagcgctggcttcggtggaggaccaggcaccagcactggttttggtggtggactgggcaccagtgctggcttcagtggcggactgggcaccagtgctggctttggtggtggactggtcactagtgatggctttggtggtggactgggcaccaatgctagtttcggcagcacacttggcaccagtgctggctttagtggtggcctcagcaccagcgatggctttggcagtaggcctaatgccagcttcgacagaggactgagtaccatcattggctttggcagtggttccaacaccagcactggctttactggcgaacccagcaccagcacgggcttcagtagtggacccagttctattgttggcttcagcggtggaccaagcactggtgttggcttctgcagtggaccaagcaccagtggcttcagcggtggaccgagcacaggagctggcttcggcggtggaccaaacactggtgctggctttggtggtggaccgagcaccagtgctggctttggcagtggagccgccagtcttggtgcctgtggcttctcgtatggctagtgaggtttcagatttattccccatgtttacagataccgctaataaattgcagtagtccttcccatggagccaaagtacatccttggaatctttgtccacacagcagtcaaggcagttatggccaatcagctgagggtgtcatgtgatggaaaaatctgtttgctgttcctgctttattgtttgctttctgtgtgctgtcatattttggtatcagagttacattaaatttgcaaaatg

SEQ ID NO: 32846 - DNA, 562 bp, Homo sapiens
gcgcactatcgagttgcggagggggcgtgtaaaggggtggggtcgtagaactgactctctcggaggcaaaaggagctgggccttggaaaccagatggcctgggttttttagggccctctgcctcccccggggagcctggggcttcccttccctccagatatacagactgagaccacagaagaggacagtgtcctgctgatgcataccctgttggcggcaaccaaggactccctggccatggacccaccagttgtcaaccggcctaagaaaagcaagaccaagaaggcccctataaagactattactaaggctgcacctgctgcccctccagtcccagctgccaatgagattgccaccaacaagcccaaaataacttggcaggctttaaacctgccagtcattacccagatcagccaggctttacctaccactgaggtaaccaatactcaggcttcttcagtcactgctcagcctaagaaagccaacaagatgaagagagttactgccaaggcagcccaaggctcccaatccccaactggccatgagggtggcactatacagc

SEQ ID NO: 32847 - DNA, 868 bp, Homo sapiens
acttccggccagggagggggataggctcagacacaaggagaggcttggagagagcagacgccttctggattcaagaagacgaggtttgaagaaaacctgctggaggtttgggacctaaccgcatcaaagtcgcctttagcggtgcctggacccagttcgcacgggaggaagtaggaggctcacctgttactcggcctcccagaaagatggataggagaaatgactacggatatagggtgcctctatttcagatatacagactgagaccacagaagaggacagtgtcctgctgatgcataccctgttggcggcaaccaaggactccctggccatggacccaccagttgtcaaccggcctaagaaaagcaagaccaagaaggcccctataaagactattactaaggctgcacctgctgcccctccagtcccagctgccaatgagattgccaccaacaagcccaaaataacttggcaggctttaaacctgccagtcattacccagatcagccaggctttacctaccactgaggtaaccaatactcaggcttcttcagtcactgctcagcctaagaaagccaacaagatgaagagagttactgccaaggcagcccaaggctcccaatccccaactggccatgagggtggcactatacagctgaagtcacccttgcaggtcctaaagctaccagtcatctcacagaatattcacgctccaattgccaatgagtcagccagttcccaagccttgataacctctatcaagcctaagaaagcttccaaggctaagaaggctgcaaataaggccatagctagtgccaccgaggtctcgctggctgcaactgccacccatacagctaccacccaaggc

SEQ ID NO: 32848 - DNA, 672 bp, Homo sapiens
agacgccttctggattcaagaagacgaggtgagctgaggtacctggctttagtgaagaccctgtgggggcttcctggctgcggcttcgacgtgcctgactccacacgcccctaaggctcacctgttactcggcctcccagaaagatggataggagaaatgactacggatatagggtgcctctatttcagggccctctgcctcccccggggagcctggggcttcccttccctccagatatacagactgagaccacagaagaggacagtgtcctgctgatgcataccctgttggcggcaaccaaggactccctggccatggacccaccagttgtcaaccggcctaagaaaagcaagaccaagaaggcccctataaagactattactaaggctgcacctgctgcccctccagtcccagctgccaatgagattgccaccaacaagcccaaaataacttggcaggctttaaacctgccagtcattacccagatcagccaggctttacctaccactgaggtaaccaatactcaggcttcttcagtcactgctcagcctaagaaagccaacaagatgaagagagttactgccaaggcagcccaaggctcccaatccccaactggccatgagggtggcactatacagctgaagtcacccttgcaggtcctaaagctacca

SEQ ID NO: 32849 - DNA, 626 bp, Homo sapiens
acttccggccagggagggggataggctcagacacaaggagaggcttggagagagcagacgccttctggattcaagaagacgaggtgagctgaggctcacctgttactcggcctcccagaaagatggataggagaaatgactacggatatagggtgcctctatttcagggccctctgcctcccccggggagcctggggcttcccttccctccagatatacagactgagaccacagaagaggacagtgtcctgctgatgcataccctgttggcggcaaccaaggactccctggccatggacccaccagttgtcaaccggcctaagaaaagcaagaccaagaaggcccctataaagactattactaaggctgcacctgctgcccctccagtcccagctgccaatgagattgccaccaacaagcccaaaataacttggcaggctttaaacctgccagtcattacccagatcagccaggctttacctaccactgaggtaaccaatactcaggcttcttcagtcactgctcagcctaagaaagccaacaagatgaagagagttactgccaaggcagcccaaggctcccaatccccaactggccatgagggtggcactatacagctgaagtca

SEQ ID NO: 32850 - DNA, 2597 bp, Homo sapiens
ataggctcagacacaaggagaggcttggagagagcagacgccttctggattcaagaagacgaggctcacctgttactcggcctcccagaaagatggataggagaaatgactacggatatagggtgcctctatttcagggccctctgcctcccccggggagcctggggcttcccttccctccagatatacagactgagaccacagaagaggacagtgtcctgctgatgcataccctgttggcggcaaccaaggactccctggccatggacccaccagttgtcaaccggcctaagaaaagcaagaccaagaaggcccctataaagactattactaaggctgcacctgctgcccctccagtcccagctgccaatgagattgccaccaacaagcccaaaataacttggcaggctttaaacctgccagtcattacccagatcagccaggctttacctaccactgaggtaaccaatactcaggcttcttcagtcactgctcagcctaagaaagccaacaagatgaagagagttactgccaaggcagcccaaggctcccaatccccaactggccatgagggtggcactatacagctgaagtcacccttgcaggtcctaaagctaccagtcatctcacagaatattcacgctccaattgccaatgagtcagccagttcccaagccttgataacctctatcaagcctaagaaagcttccaaggctaagaaggctgcaaataaggccatagctagtgccaccgaggtctcgctggctgcaactgccacccatacagctaccacccaaggccaaattaccaatgagacagccagtatccacaccacagcagcctccatccgaaccaagaaagcctccaaagccaggaagacaattgctaaggtcataaatactgacactgagcatatagaggctctaaatgtcactgacgcagctaccaggcagattgaggcctcagtagtggctatcaggcccaaaaaatccaagggcaagaaggctgccagcaggggcccaaattctgtctctgagatctctgaggccccacttgccactcagatagtcacaaaccaagccctggcagccaccctgcgggtcaagagagggtctagggctcggaaggctgccactaaggctcgggcaactgaaagccagactccaaatgctgaccaaggggcccaggccaagatagcctctgctcagaccaacgtaagtgcccttgagactcaggttgctgctgctgtccaggccctggcagatgactatctggctcagttgagcctggagcccacaaccaggacccggggcaaaagaaaccgaaagtccaagcatctgaatggggatgagagaagtggcagtaattacaggcggatcccatggggccggaggcctgcaccaccgcgagatgtggccattttacaagaaagggctaataagttggtgaaatacctgttggttaaggaccagacaaagatccccatcaaacgctcagacatgctgagggatgtcatccaagaatatgatgaatatttcccagaaatcattgaacgagcaagctacactctggagaagatgtttcgagtcaatctgaaagaaattgataagcaaagtagcttgtatattctcatcagcactcaggaatcctctgcaggcatactgggaacgaccaaggacacacccaagctgggtctcctcatggtgattctgagtgtcatttttatgaatggcaacaaggccagtgaggctgtcatctgggaggtgctgcgcaagttggggctgcgccctggggtgaggcattcactctttggggaagtgaggaagctcatcacagacgagtttgtgaagcagaagtacctggagtacaagagggtccctaacagcagaccacctgaatatgagttcttctggggcttgcgctcctaccacgagactagcaagatgaaagtcctcaagtttgcatgcagggtgcagaagaaagaccccaaggactgggctgtgcagtaccgcgaggcagtggagatggaagtccaagctgcagctgtggctgtggctgaggctgaagccagggctgagtggttccaacaccagcactggctttactggcgaacccagcaccagcacgggcttcagtagtggacccagttctattgttggcttcagcggtggaccaagcactggtgttggcttctgcagtggaccaagcaccagtggcttcagcggtggaccgagcacaggagctggcttcggcggtggaccaaacactggtgctggctttggtggtggaccgagcaccagtgctggctttggcagtggagccgccagtcttggtgcctgtggcttctcgtatggctagtgaggtttcagatttattccccatgtttacagataccgctaataaattgcagtagtccttcccatggagccaaagtacatccttggaatctttgtccacacagcagtcaaggcagttatggccaatcagctgagggtgtcatgtgatggaaaaatctgtttgctgttcctgctttattgtttgctttctgtgtgctgtcatattttggtatcagagttacattaaatttgcaaaatgaa

SEQ ID NO: 32851 - DNA, 578 bp, Homo sapiens
aagtaacgatctggactcggttcgggccgtgaaagggagggatgcagacctagttgggaccgcagaaaggaaggatcgagaaatccttcagacggctcacctgttactcggcctcccagaaagatggataggagaaatgactacggatatagggtgcctctatttcagatatacagactgagaccacagaagaggacagtgtcctgctgatgcataccctgttggcggcaaccaaggactccctggccatggacccaccagttgtcaaccggcctaagaaaagcaagaccaagaaggcccctataaagactattactaaggctgcacctgctgcccctccagtcccagctgccaatgagattgccaccaacaagcccaaaataacttggcaggctttaaacctgccagtcattacccagatcagccaggctttacctaccactgaggtaaccaatactcaggcttcttcagtcactgctcagcctaagaaagccaacaagatgaagagagttactgccaaggcagcccaaggctcccaatccccaactggccatgagggtggcactatacagctgaag

SEQ ID NO: 32852 - DNA, 976 bp, Homo sapiens
agagaactacattcctcctaggggaaacaggagaatcaaataggaacggagatacagagtggggaatagagaagtcaaatggagaataagagggagtgataactgaataggggtagtaagaagaaaaagggagctacattgaggagaatggaaagttgaaagtaggtatggaggggaggagactgacaggcaggaacggagacccccctctggaggcggaaagaggcaggaccacttccggccagggagggggataggctcagacacaaggagaggcttggagagagcagacgccttctggattcaagaagacgaggctcacctgttactcggcctcccagaaagatggataggagaaatgactacggatatagggtgcctctatttcaggtgaggcctctctgcattctctctaggccatctgccccatcctgagttcacttactgctcttcagaccccttccaccgtgtagtttcataattccctgcctaactcgtctcagtcctcccttacatggtgaaggagaggagaggaaaacctgcctgactctattccttccttgctccctaccccattttaattaaccactgctcagaggaagggaaggcctttgtggaaagggatgggctttagcgaggccaaatggcccagaggatggtaatcctaagtgtgtagggccctctgcctcccccggggagcctggggcttcccttccctccagatatacagactgagaccacagaagaggacagtgtcctgctgatgcataccctgttggcggcaaccaaggactccctggccatggacccaccagttgtcaaccggcctaagaaaagcaagaccaagaaggcccctataaagactattactaaggctgcacctgctgcccctccagtcccagctgccaatgagattgccaccaacaagcccaaaataacttggcaggctttaaacctgccagtcattacccagatc

SEQ ID NO: 32853 - DNA, 722 bp, Homo sapiens
gggggataggctcagacacaaggagaggcttggagagagcagacgccttctggattcaagaagacgaggcccattcccctcaggctcacctgttactcggcctcccagaaagatggataggagaaatgactacggatatagggtgcctctatttcaggtgaggcctctctgcattctctctaggccatctgccccatcctgagttcacttactgctcttcagaccccttccaccgtgtagtttcataattccctgcctaactcgtctcagtcctcccttacatggtgaaggagaggagaggaaaacctgcctgactctattccttccttgctccctaccccattttaattaaccactgctcagaggaagggaaggcctttgtggaaagggatgggctttagcgaggccaaatggcccagaggatggtaatcctaagtgtgtagggccctctgcctcccccggggagcctggggcttcccttccctccagatatacagactgagaccacagaagaggacagtgtcctgctgatgcataccctgttggcggcaaccaaggactccctggccatggacccaccagttgtcaaccggcctaagaaaagcaagaccaagaaggcccctataaagactattactaaggctgcacctgctgcccctccagtcccagctgccaatgagattgccaccaacaagcccaaaataacttggcaggctttaaac

SEQ ID NO: 32854 - DNA, 1115 bp, Homo sapiens
ataggctcagacacaaggagaggcttggagagagcagacgccttctggattcaagaagacgaggctcacctgttactcggcctcccagaaagatggataggagaaatgactacggatatagggtgcctctatttcagtccaagcatctgaatggggatgagagaagtggcagtaattacaggcggatcccatggggccggaggcctgcaccaccgcgagatgtggccattttacaagaaagggctaataagttggtgaaatacctgttggttaaggaccagacaaagatccccatcaaacgctcagacatgctgagggatgtcatccaagaatatgatgaatatttcccagaaatcattgaacgagcaagctacactctggagaagatgtttcgagtcaatctgaaagaaattgataagcaaagtagcttgtatattctcatcagcactcaggaatcctctgcaggcatactgggaacgaccaaggacacacccaagctgggtctcctcatggtgattctgagtgtcatttttatgaatggcaacaaggccagtgaggctgtcatctgggaggtgctgcgcaagttggggctgcgccctggggtgaggcattcactctttggggaagtgaggaagctcatcacagacgagtttgtgaagcagaagtacctggagtacaagagggtccctaacagcagaccacctgaatatgagttcttctggggcttgcgctcctaccacgagactagcaagatgaaagtcctcaagtttgcatgcagggtgcagaagaaagaccccaaggactgggctgtgcagtaccgcgaggcagtggagatggaagtccaagctgcagctgtggctgtggctgaggctgaagccagggctgagatttattccccatgtttacagataccgctaataaattgcagtagtccttcccatggagccaaagtacatccttggaatctttgtccacacagcagtcaaggcagttatggccaatcagctgagggtgtcatgtgatggaaaaatctgtttgctgttcctgctttattgtttgctttctgtgtgctgtcatattttggtatcagagttacattaaatttgcaaaatgaa

SEQ ID NO: 32855 - DNA, 6484 bp, Homo sapiens
gttaatttccaccaggaggaggcgcgcagcccagctcccctagtctctcttcttaaatccccctacctacggctgccgaggttggccgcgcgtcgggaatctccccgacagtcctggccctcccccgccccccgggttggtttttcccagctgcggaggttgggaggttgggccaggggctggggtgcgaagagagtcggcgcccgcaacgcggagccgggaagtcgtcgctactctggtggaactcagagttggttctggaggcggcggacgcggaggtccctcagaggatccagcgaggggcgccaacaagaggcgaagaggtggcaccagggcggcggcaggaagaggagcgggagcaggagcgcggagcggagcgtcccgacccgccgtgcgtactttctggagggaaggggcgggggaatcggcccctgagggaagcgcccggtggcgagggggttagccaagttccggctgcggcgccactccctcggttccacgagaggaaagttttttttttccagacgcttccgccggctcgcgccctccgggcccagcctcccgagccttcggagcgggcgccgtcccagcccagctccggggaaacgcgagccgcgatgcctggggggtgctcccggggccccgccgccggggacgggcgtctgcggctggcgcgactagcgctggtactcctgggctgggtctcctcgtcttctcccacctcctcggcatcctccttctcctcctcggcgccgttcctggcttccgccgtgtccgcccagcccccgctgccggaccagtgccccgcgctgtgcgagtgctccgaggcagcgcgcacagtcaagtgcgttaaccgcaatctgaccgaggtgcccacggacctgcccgcctacgtgcgcaacctcttccttaccggcaaccagctggccgtgctccctgccggcgccttcgcccgccggccgccgctggcggagctggccgcgctcaacctcagcggcagccgcctggacgaggtgcgcgcgggcgccttcgagcatctgcccagcctgcgccagctcgacctcagccacaacccactggccgacctcagtcccttcgctttctcgggcagcaatgccagcgtctcggcccccagtccccttgtggaactgatcctgaaccacatcgtgccccctgaagatgagcggcagaaccggagcttcgagggcatggtggtggcggccctgctggcgggccgtgcactgcaggggctccgccgcttggagctggccagcaaccacttcctttacctgccgcgggatgtgctggcccaactgcccagcctcaggcacctggacttaagtaataattcgctggtgagcctgacctacgtgtccttccgcaacctgacacatctagaaagcctccacctggaggacaatgccctcaaggtccttcacaatggcaccctggctgagttgcaaggtctaccccacattagggttttcctggacaacaatccctgggtctgcgactgccacatggcagacatggtgacctggctcaaggaaacagaggtagtgcagggcaaagaccggctcacctgtgcatatccggaaaaaatgaggaatcgggtcctcttggaactcaacagtgctgacctggactgtgacccgattcttcccccatccctgcaaacctcttatgtcttcctgggtattgttttagccctgataggcgctattttcctcctggttttgtatttgaaccgcaaggggataaaaaagtggatgcataacatcagagatgcctgcagggatcacatggaagggtatcattacagatatgaaatcaatgcggaccccagattaacgaacctcagttctaactcggatgtctgagaaatattagaggacagaccaaggacaactctgcatgagatgtagacttaagctttatccctactaggcttgctccactttcatcctccactatagatacaacggactttgactaaaagcagtgaaggggatttgcttccttgttatgtaaagtttctcggtgtgttctgttaatgtaagacgatgaacagttgtgtatagtgttttaccctcttctttttcttggaactcctcaacacgtatggagggatttttcaggtttcagcatgaacatgggcttcttgctgtctgtctctctctcagtacagttcaaggtgtagcaagtgtacccacacagatagcattcaacaaaagctgcctcaactttttcgagaaaaatactttattcataaatatcagttttattctcatgtacctaagttgtggagaaaataattgcatcctataaactgcctgcagacgttagcaggctcttcaaaataactccatggtgcacaggagcacctgcatccaagagcatgcttacattttactgttctgcatattacaaaaaataacttgcaacttcataacttctttgacaaagtaaattacttttttgattgcagtttatatgaaaatgtactgatttttttttaataaactgcatcgagatccaaccgactgaattgttaaaaaaaaaaaaaataaagattcttaaaagaattacagtgtgtgcaagtttgctttgaaaaaaggatgaagggcaggagtattcaatggtcttggttccgatgataattattacttaacatagctgagaatcaaactgtagcaatgtctaatataaatagacttgggagatcgttttgaaatggtggatccttttagtatttaaatggagagtttgagtattcatgtgactgtatggtcccaaagttaatgctatttatgaaacagttttgtaagaacataatgaagttggtaaaagctaagcgttctgcacaataaacagttcccagtttggggctttttcaaggctaatgaagttattgttggtctagaaaaatagtatttacttaataaaactctgtttgaaattgttctgtggatttttagagcagaatttgaaacaaatgtaatgcaaataaatataaagataaagtgtcttaaagacaatattctgaaataaaagatataaaatataatttaaaaaatatttctcaatgtcttaatgtaaattgaaacttagattttcttgaggatattttcaaaaaaacatttaaagtggaacataaatgttctttagtttatcagagacccagctaatatgtttaaaaagttgacttgacatggttgaatatgaacttgaggaaataaccacagataaatgtctacatctgtaaacacgtgtctcaagtatttataggttcttatcttcagttcagtgtttaagaatttgaggatattttgattttagctaagctgttcataatgtaagtatatacacctttgtgaagaataaatcacatttaggtgtaaatacaggcaatcattaattgatacatccataatatacaaggcttttattattttttcagtttattatctgtcatttaatctgaaaagtaaattccattaatcagtcttcaggctcttttatcaagtgatttaaatgtagccattattgcttaactgaaagtattaggtaaacttgcatcagtaagtcttagggcttgcttttcctttgaactggttatgtccttcagtgctttatgtttgaaataaaatctacattttcatatttttataaataaaataggatcagatagtattttaggttctagaaatctttgctgattccttctttgaattaaattcagaaattttcaaagtagggctaaaaataagtaaatcttcctttttataggttagaatatatagtcagaatacaaagctgtaattccttaaattccatcaggcttgttttgtgaaatatagtatttattatttaagggttatatttcagatcctataattacctcagaaaaagctaaatatttggcacttaaaattccatcaaacagtttaagtgttcatcagaaattcctaaactgtctggttgccattatttggtaagaacaatgagatactaatctgtcaaaaatagtgaccactatcttagtaaactgttgatggacttagtaagtcttctgatattgtaggaaacaaattataatattgatagagcctctattgagaagaattgtttcttcatcacatgataatctaacagtttaaagtggagctttatctaagaaccagggaagcagtagattcattagtctagcttttctcatcaactctttgaagcaatgatgaatctgataaagtgaagccaagttttccctgttaggtagatggcttctttgaagttataatttattgcttctttttcatccccctacttattctcttgtttggactttccaattgctactgctttgttttccatcacatcactccttcctgttctccaaaatatggaaataaaaaagtcaattaaaagaacaccttattcttaagataaaaaattgttattatttgacaactaattaatgttttgcagccctaatattcttaagtctataagcttataaaacattctaagttccttggaagatagaggctatataaattcaataagtataagggaatatgggaaaaataaaagtatcactttatttaaaaataagacaagtctgtttgttttaaatactgttcttactattaatgcattgttgactctagaaacctgcaagtatccatttttaaaattttattttagttggtaatactctttattactgaacgtaaaattttcaacataaaacacccttcatttatcctttacaagtttcatttgaagaaagttagaaaaaatacttagaaattcaaggacttgatatatcccttaatttagaaagctattcaactatcccataaatttctatttaaagtagcaaaaattttaggataatacagctatttggccctgaattataactgccccctttgattgtaaccattcagtttgcagcattcgtttttgtaatagcagtttggctgctatgggtgtgattcaatggtaacctacaaggcaaatttgtacaggagctgacagatttttctaacaaaataaggagactttgaagcacattgaataggagtttttaaatgaataggattttttaaaggaaaaagagtaggagcttgggggggaaggctggttgaaataaatgagcaaatcacaaataataaatcctttagaaataccttgattggcagtaagtgtggattatgctcatctcagtatttaattagaaataacttacctttgtcttttgtctttttaattaaagtggctgtaaaaaagaaggtccagatgaactgagattgtttgcttaggaattctgttttactcttttccttttacctgatgttctaaaacagggcttaccttgttgaggaccttagaggctttgcaattctagattgtgattctttcatatcattttagtttttctcccaagactacactaaaggagacatcacgagatttgcaaggttaaaaacaattctgcacgtgcttcctcctgctcccaaatccggtcatccacctttcagagcagcaccgtaaagtgaagacagacatttattagatgaaattctggtttcacttttacacttgtgcaagcatttttaacagtaaaggagaggaaagggaggaatttatatttctagataatatatgaaaattaccttgatattgtatttttaagatctttcaccaatactgcagtgctgcactagaaataattagtttaagaaaatacattcaacattgtccaggtgatcctgtcaccttttagatgacgaaaaacatcttgaggatgttttgtacagttattttcccattgttactcttagagacttttgtttcaaaaaggcaggctcattttattttgttttatcttagaacattttagcagctctttgtcatgggttaaaaaaatctagaattaaaaaaatgtttaatatatgatttatataattttgacaagaatacaaattcttagtcgttcaaaattggaagcgctcttagaagtgtcaagctcagctttccattccacaaatgaagtaactggtaactgtgacttattatgttatacagtgacagttattatgttatacagtgtcagttatacagtgacaaccaggacaaaatcctagggttctagattccccttctggtgctctttttaccagatgatggcattactaattgcctaccttgaggcctttgaaatcaccatgtctgataaaaacatgcaattgctttggtgaatttgtttgttttattgttgttgctttgagtgaatgcttcagtttgctctagattttactttgttaaaaattaccatgttttaacccccgaaaacatttaatgtttttgaaatgattttttcataacaatcttatgagtctattatataataggaagtattttggaaatttaatggtgatatttctttggaaaagaaaaataaaaactctggaatgca

SEQ ID NO: 32856 - DNA, 3392 bp, Homo sapiens
tttctctctctctctctcttaaagttggcgcgctctcttcacaagttccatcactacccaagaagtgagggggcgggggggacaggcgggaaggcattaattacacctaaatctgaagtttgcggcctcaagtaccactttgatggggagagcttctgaagcttccatacaacctgccgtgcctttgctgctgccgcagtagattttcagctcatttctttctgctgctgcttcgcgctgctctgtcatgcctaaatctatctcgtcactgccaaaggtgcctgaatcagggtgaattccacgagattcaccagcggttttgctccagtccaaggaggaggcgcgcagcccagctcccctagtctctcttcttaaatccccctacctacggctgccgaggttggccgcgcgtcgggaatctccccgacagtcctggccctcccccgccccccgggttggtttttcccagctgcggaggttgggaggttgggccaggggctggggtgcgaagagagtcggcgcccgcaacgcggagccgggaagtcgtcgctactctggtggaactcagagttggttctggaggcggcggacgcggaggtccctcagaggatccagcgaggggcgccaacaagaggcgaagaggtggcaccagggcggcggcaggaagaggagcgggagcaggagcgcggagcggagcgtcccgacccgccgtgcgtactttctggagggaaggggcgggggaatcggcccctgagggaagcgcccggtggcgagggggttagccaagttccggctgcggcgccactccctcggttccacgagaggaaagttttttttttccagacgcttccgccggctcgcgccctccgggcccagcctcccgagccttcggagcgggcgccgtcccagcccagctccggggaaacgcgagccgcgatgcctggggggtgctcccggggccccgccgccggggacgggcgtctgcggctggcgcgactagcgctggtactcctgggctgggtctcctcgtcttctcccacctcctcggcatcctccttctcctcctcggcgccgttcctggcttccgccgtgtccgcccagcccccgctgccggaccagtgccccgcgctgtgcgagtgctccgaggcagcgcgcacagtcaagtgcgttaaccgcaatctgaccgaggtgcccacggacctgcccgcctacgtgcgcaacctcttccttaccggcaaccagctggccgtgctccctgccggcgccttcgcccgccggccgccgctggcggagctggccgcgctcaacctcagcggcagccgcctggacgaggtgcgcgcgggcgccttcgagcatctgcccagcctgcgccagctcgacctcagccacaacccactggccgacctcagtcccttcgctttctcgggcagcaatgccagcgtctcggcccccagtccccttgtggaactgatcctgaaccacatcgtgccccctgaagatgagcggcagaaccggagcttcgagggcatggtggtggcggccctgctggcgggccgtgcactgcaggggctccgccgcttggagctggccagcaaccacttcctttacctgccgcgggatgtgctggcccaactgcccagcctcaggcacctggacttaagtaataattcgctggtgagcctgacctacgtgtccttccgcaacctgacacatctagaaagcctccacctggaggacaatgccctcaaggtccttcacaatggcaccctggctgagttgcaaggtctaccccacattagggttttcctggacaacaatccctgggtctgcgactgccacatggcagacatggtgacctggctcaaggaaacagaggtagtgcagggcaaagaccggctcacctgtgcatatccggaaaaaatgaggaatcgggtcctcttggaactcaacagtgctgacctggactgtgacccgattcttcccccatccctgcaaacctcttatgtcttcctgggtattgttttagccctgataggcgctattttcctcctggttttgtatttgaaccgcaaggggataaaaaagtggatgcataacatcagagatgcctgcagggatcacatggaagggtatcattacagatatgaaatcaatgcggaccccagattaacgaacctcagttctaactcggatgtctgagaaatattagaggacagaccaaggacaactctgcatgagatgtagacttaagctttatccctactaggcttgctccactttcatcctccactatagatacaacggactttgactaaaagcagtgaaggggatttgcttccttgttatgtaaagtttctcggtgtgttctgttaatgtaagacgatgaacagttgtgtatagtgttttaccctcttctttttcttggaactcctcaacacgtatggagggatttttcaggtttcagcatgaacatgggcttcttgctgtctgtctctctctcagtacagttcaaggtgtagcaagtgtacccacacagatagcattcaacaaaagctgcctcaactttttcgagaaaaatactttattcataaatatcagttttattctcatgtacctaagttgtggagaaaataattgcatcctataaactgcctgcagacgttagcaggctcttcaaaataactccatggtgcacaggagcacctgcatccaagagcatgcttacattttactgttctgcatattacaaaaaataacttgcaacttcataacttctttgacaaagtaaattacttttttgattgcagtttatatgaaaatgtactgatttttttttaataaactgcatcgagatccaaccgactgaattgttaaaaaaaaaaaaaataaagattcttaaaagaattacagtgtgtgcaagtttgctttgaaaaaaggatgaagggcaggagtattcaatggtcttggttccgatgataattattacttaacatagctgagaatcaaactgtagcaatgtctaatataaatagacttgggagatcgttttgaaatggtggatccttttagtatttaaatggagagtttgagtattcatgtgactgtatggtcccaaagttaatgctatttatgaaacagttttgtaagaacataatgaagttggtaaaagctaagcgttctgcacaataaacagttcccagtttggggctttttcaaggctaatgaagttattgttggtctagaaaaatagtatttacttaataaaactctgtttgaaattgttctgtggatttttagagcagaatttgaaacaaatgtaatgcaaataaatataaagataaagtgtcttaaagacaatattctgaaataaaagatataaaatataatttaaa

SEQ ID NO: 32857 - DNA, 2881 bp, Homo sapiens
acccggaggccgaccttccgccgaggcggtgcaggaaggaacgggagagggagaagtttggtagggaaggaattggggattaagcggtccctcagaggatccagcgaggggcgccaacaagaggcgaagaggtggcaccagggcggcggcaggaagaggagcgggagcaggagcgcggagcggagcgtcccgacccgccgtgcgtactttctggagggaaggggcgggggaatcggcccctgagggaagcgcccggtggcgagggggttagccaagttccggctgcggcgccactccctcggttccacgagaggaaagttttttttttccagacgcttccgccggctcgcgccctccgggcccagcctcccgagccttcggagcgggcgccgtcccagcccagctccggggaaacgcgagccgcgatgcctggggggtgctcccggggccccgccgccggggacgggcgtctgcggctggcgcgactagcgctggtactcctgggctgggtctcctcgtcttctcccacctcctcggcatcctccttctcctcctcggcgccgttcctggcttccgccgtgtccgcccagcccccgctgccggaccagtgccccgcgctgtgcgagtgctccgaggcagcgcgcacagtcaagtgcgttaaccgcaatctgaccgaggtgcccacggacctgcccgcctacgtgcgcaacctcttccttaccggcaaccagctggccgtgctccctgccggcgccttcgcccgccggccgccgctggcggagctggccgcgctcaacctcagcggcagccgcctggacgaggtgcgcgcgggcgccttcgagcatctgcccagcctgcgccagctcgacctcagccacaacccactggccgacctcagtcccttcgctttctcgggcagcaatgccagcgtctcggcccccagtccccttgtggaactgatcctgaaccacatcgtgccccctgaagatgagcggcagaaccggagcttcgagggcatggtggtggcggccctgctggcgggccgtgcactgcaggggctccgccgcttggagctggccagcaaccacttcctttacctgccgcgggatgtgctggcccaactgcccagcctcaggcacctggacttaagtaataattcgctggtgagcctgacctacgtgtccttccgcaacctgacacatctagaaagcctccacctggaggacaatgccctcaaggtccttcacaatggcaccctggctgagttgcaaggtctaccccacattagggttttcctggacaacaatccctgggtctgcgactgccacatggcagacatggtgacctggctcaaggaaacagaggtagtgcagggcaaagaccggctcacctgtgcatatccggaaaaaatgaggaatcgggtcctcttggaactcaacagtgctgacctggactgtgacccgattcttcccccatccctgcaaacctcttatgtcttcctgggtattgttttagccctgataggcgctattttcctcctggttttgtatttgaaccgcaaggggataaaaaagtggatgcataacatcagagatgcctgcagggatcacatggaagggtatcattacagatatgaaatcaatgcggaccccagattaacgaacctcagttctaactcggatgtctgagaaatattagaggacagaccaaggacaactctgcatgagatgtagacttaagctttatccctactaggcttgctccactttcatcctccactatagatacaacggactttgactaaaagcagtgaaggggatttgcttccttgttatgtaaagtttctcggtgtgttctgttaatgtaagacgatgaacagttgtgtatagtgttttaccctcttctttttcttggaactcctcaacacgtatggagggatttttcaggtttcagcatgaacatgggcttcttgctgtctgtctctctctcagtacagttcaaggtgtagcaagtgtacccacacagatagcattcaacaaaagctgcctcaactttttcgagaaaaatactttattcataaatatcagttttattctcatgtacctaagttgtggagaaaataattgcatcctataaactgcctgcagacgttagcaggctcttcaaaataactccatggtgcacaggagcacctgcatccaagagcatgcttacattttactgttctgcatattacaaaaaataacttgcaacttcataacttctttgacaaagtaaattacttttttgattgcagtttatatgaaaatgtactgatttttttttaataaactgcatcgagatccaaccgactgaattgttaaaaaaaaaaaaaataaagattcttaaaagaattacagtgtgtgcaagtttgctttgaaaaaaggatgaagggcaggagtattcaatggtcttggttccgatgataattattacttaacatagctgagaatcaaactgtagcaatgtctaatataaatagacttgggagatcgttttgaaatggtggatccttttagtatttaaatggagagtttgagtattcatgtgactgtatggtcccaaagttaatgctatttatgaaacagttttgtaagaacataatgaagttggtaaaagctaagcgttctgcacaataaacagttcccagtttggggctttttcaaggctaatgaagttattgttggtctagaaaaatagtatttacttaataaaactctgtttgaaattgttctgtggatttttagagcagaatttgaaacaaatgtaatgcaaataaatataaagataaagtgtcttaaagacaatattctgaaataaaagatataaaatataatttaaa

SEQ ID NO: 32858 - DNA, 9191 bp, Homo sapiens
gcgcgccccggcgccgcgcccggccgggagccgcctgttgatcgccgcgctcgccccggccacggcgccgcccctgttctcccggccccgctccaccggggctgacggactgacggccagcacagccggctccgggatgagcgcacggacggtattctgaagtctcaggaaactggaccatttaaatgtgcatggcccatgagaaaggcttataagaagccatggcactcccctttcaaaaagagctggagaaatacaagaacattgatgaagatgagcttcttggcaaactctcagaagaggaactgaaacagttggaaaatgttctagatgacctagatcctgagagtgccatgctgccagctggatttcgacagaaagaccagacacagaaggcagccaccggcccctttgaccgcgagcacctcctcatgtacctggagaaggaggctttggaacagaaagacagagaggactttgtgcccttcactggagaaaagaaagggagagtctttatccctaaagaaaagcctatagaaactcgtaaagaagaaaaagtgacccttgacccagaactggaagaagctttggccagtgcctctgacaccgaactctatgatcttgcagctgtccttggagtacacaatttgctcaacaatccaaagttcgatgaagaaacagccaacaataaaggtggcaaaggacctgtcagaaatgttgtcaaaggtgaaaaagtaaagccagtatttgaggaaccaccaaatcccacaaatgtggaaataagcctgcagcagatgaaagccaatgatcctagcttgcaagaagtcaacctcaacaacattaagaacattccaattccaaccctgagggaatttgcaaaggctctggagaccaacactcacgtgaagaagttcagcctggccgcaactcgcagcaatgaccctgtggccattgcttttgcagacatgctgaaagtaaacaagaccttgacaagtctaaacatagaatccaattttatcactggaactgggatcctggccctggtagaggcactgaaagaaaatgacaccttgacagaaatcaagattgacaaccagaggcagcagttgggaacagctgtagagatggaaattgcccagatgctggaggagaattcaaggatcctcaagtttggataccagtttaccaagcaagggccacgaacaagggtggcagctgccatcacaaagaataatgacctggttcgtaagaagagagttgaagcagaccgaaggtaaacttccttgaggagaagtgaagtttcactgtggtatggccattgaaaaacaaaaactcttcttcttccccatcaggaccattttatcaaagttcgttcatttccgttaaccacataactaataatttaattgttattcttttttagcactacttatttatcttggattttgtaatatatgcaattgttttatttgctcatgggcacttctggcaacttgacaaatggaccgatgcagattttagagagtgacgacatggaaaatgaatttaaccactttcttattgggttgtcttgctttcttacatgaacttgtttttttaatcactgaaaggaatttagtgtataatatgtgtttgtaactgtgattatgatagaggcctatctctgtttacatgcatagctttgagttaggctaaatacatcagaagtgttctactgaccacataagaagttagtattgccaatctttcactgcatgtgaaaatgtgaccaatttagcacaaattctctcttagttccagaaaaatcagtaaatgcacatgccctgttgattggagatcagtagtgtcatcttcataaagcaagacaacattatgacactttaaaacagtagcaaagaagtctatttattaacccacaaatgtagcatcaagccagactcacaggtagcaaaatgaattacacacctacttttactgactattcaacataaattgaatctttaacatgactttaaaggctatttacaaagctgttttaaagtttttcaaacatgatagaaattttctaaattttagtaagagagaagcttttaaaacagtacattcctgaataaaacaacaatattgtatcttaatcaaggctgtctgatgcagatgattgcattttttggcaaattttagaagcatttattgctttgtctttagtgtaacaagatcactggattaaatataaacattcaggttaattatctagatttttgtccacagtatatgatccatccagacatttgcaaacgtcaggagaaaaatgtgaattatttatccagatgcatgtcatctcaaggacaaagcctgtgaaagtacaagtgagatggttgcattgtagtatgcattaatctttcaatgtagtggtgtaaaaatgcagtgctaaactaatgaagcaggtgactgcagcctttggctcaagctcacaactctgataactgtcagtgcctgaggttgtgattggtgacattctgacactgcccaaggcaactcaccctctattcctcctttctcccctccctttcttccaattcattgtcttttttttcctcttttctctgtaatttgttactaaacaaattccagaatttgtttagtagctgagtgttcctgagttgcctagtagcaataaaacaagtgaataggaaaataattaatatattattctatttagcttgtaaaacacatggaatctgtttaagatagcccttgtaaaattgaacatttacctgtattgtaagtacccacatctgtgtctctgaagtcctttgaaacatctcattatcttgaaatttttttaatgtttgagaacaccataagcagaatattctaacacctttggcccctgaaaatcctttaattagtttatggcttcatctccttatctatttaaaaaacatagtaaataatgtttatggttttcagtctgatttttccttccctttcacccatttaggtgtgatgtgttggagtcaacttgtacaggcttgccaactgttatattttcaagaattttgcaaactggttgttcaatacagccattatttaaaattaaatgatgtgcacttacaactgaatgaattatattaaggacagaagtaacaaatactgtactcaaaaatcttacattttactattttctaacctcttagattatttacatctagtaggtatgtatgtagaaatattaccaaacagtatgctactgaacgtatcctctcaactccatgttcactaccttcttgttactacagtggcttgaaattggccatggtagaaatatttacaccacagaaattagcaatatgtaagaaattggggttttctccctctccagattgctggttgataaacattcatcagcacaccactgggtgaaattatacatttttttatacatatgtttcgcttatcatgttgccgaagggaagaacatttctcttagatgtcttttctcctctttggatttgttacaaacctgtttaagtgctgagtccctgacctgcctctccaagtaagcctttttcctttttttttttttttttcttactctcattcttgccttgactcttaaaatcctggaccctatagagcattccttgcagccccacagtgctgtgggctgggggctaaagcagttcttggcaaactctggcagaaagcaagaaaaaaagaatcagaattcaatcatggctgtttcttttgtacaagcagttgttgatagtattaaagcaagataatgggacattatcaaaaatatagcactgtttttaccttatgaaatagttgggttgcatgcaacagagtctatgaaatcaaatgttttttactaatcagtttgttttcttattacctgtgtttttaaagtggcttgaaaggtggcatttccatgagtgtgcacatattgatgataacccttagaaaaacatacacttgaggagcctatccatcatttaattagcctaggacttcatctccctctctgcccaaagtgtggaagtggtagctctttcatgatcatgggcacagttaatcctttgctatccattgtgatggggcataatgtatataaaatatttttctatgtatttgttctgccagatactgtgttgagatatttggcaatatctggataactgactgaagggagataacttctccccaggcctatctccctcccccttttagagttgtgcaggtccactttaagtgtaaaatcactcacctggacttgtgggcttgtatcaccaacatctattatggcacatgtagatgacatttaggagaaaaaccttagaagtctagaaatcatatgattagttcagcactgcagctccccatctgcttatagtgtataactggaagctctttcatcctcatcagcatgattaaatgacttcgtttctttcatctttggagggtataatgtaaataagtgtcgtgtgtgtatgtgtgtgtgtactgtcagatatctaactaggtatttggctacatctggacaactgattgaagggagatgctctctccccagtcctcttcccttgtcctttttagaattgctgcaggcccaggttaaatatgaaattactccctaggctttgcagtttatgttaccaaccaccacattttatagctatgtagaggatgactcttaggaaataaatattagaagcctagaaatcatttagttgttctagcaccaaatctatccatttgcctaatgtatttaacattccatcctcatcaacatgatgaagcccctttcttccatctttgtagggcacattgtatataaatattttgtacataaagatcatcaaataccataatggggtatttggcttcatctggaaaattgactggagggagatgctgtctcccagccctgcttccctcgtccctgtccaagttgctgcaggcccaggttagaagattaccaacctggaggggcatgcagttcatcttacaataaaagcccattcatttaaaaactcagaaatcatcccagtgcctgtactcctcaaaccaatttccctaagggaagactggcacaccagcccaaagagcaggtgcttctcttccaacagaaacatggcccctgacagggcaccagcattagggaaaccaatgtcctccgaatagctgccatgagaacatttcagatgctcaaactgaaaattcttaaaaccaatattaagcatcagcatgctttaagtgtaagatagccctttggaatttacaaacacatgtgcagctatttccttcttcacagatatgatgtactcagccccctcctaggcactacgaagaagacagaggaagcataaaaattctggactaatataattttatatgtgtttctgagattggggagtagactgagtgccttttttacaaagaagatcccatatttaattcaagtatttatagcatcagcaaaaatgggcagagggcgggaagttgagaacactaggttctgtgctatgttacctgtattcagtagaagtgtttctggagtcaggttttaagtcatgatcctgaagcttccttcccctcttccactaatgatgcaataatagctgttttcattttaacgagcagagaactaagaggaaaggtcctagctctgccttccacttgcagcttccctttacctcctcttattgctttcatctcaaatatccctgctactcaaccaatcctaaagctaaagtactgagatgcacacaaaggaaaggtgtgagagtgcttggaagcatccagctgagcccactggatgaaaatcagacgatagggcctcctgttgtaatatactagccagagaaaagcgccaagaacttcagggatattattcactgctttattgctccctaaccctagatcagattggattttactttgtagttcaggagttaagaagtcaaattgctgaccgaggtggggaaggatgatggaaattaaaggtttacatttgtttaatggcagaactgagatttgctcagcttatctctttcccatctgtctgtaatagcaatgactgaataatcagtagaccaatggaagaggagttgcaagtttaaatttgtaacctgactctgggttctgttctaggaatagtgcatgttttagaggctttgccagttgggatacattgttgacttgggggaggatgaaggagagaactgatgacctagacatagaaaagagtagttaactaactagatgttcttctgatctcttccatggtagacattctgagcacattggcccagttagttggtatggtgaaggggcaccgtactaacagatttggagactgaaacctaatcccatcaccaacacttagcaggtatatgatcatgggcaattcattcaattgcctgccaattatagactatatagggggaagagcactggatttggagtcaagaaacctggacacttggctccacacttccttagctgggtaactttgggcaaaccgcttggtctctcaagcctaaggttcttcagctataaaatgggaataatacttcactaactacctcacagagttgtggtaagaatataatcagataactggataaaaacactatataaactggaaagcgccgtacaaatgtgagagatcagttttattatcaaatcactgttttccactgcctcttgaatcggctttattctaaccaaccattacatctttctcatcttttggagtatgggtaattgaggcttgggtgtgtcatcagggactggagttatttcagctcccatgtagaggtgggagaggtggttgatggggcagtggaagttagataccagcgatgtatatggtaggacattttcctgggtcactttgacagtaccttgggaaattgtcagtccttgcagagggcctaggctgggcacaagggagaaagcgaacagttgactaagaattgaggggagggtctggagcgctactgccctcctgtcattgctgtgggtgggagaggctaagacttcaggtttgactggaggcctaggagagaagagtgtccttagggtttcaagaattttaatgcctagcagctgagtaacaggcattagttctgatagatagtgaaggggagaaagtgccacctgttgtgagatcacctctccagggcagcagctgccttgttatcaccagcaaccttagccctggtcagtaatatttctgctaagaaaggttttgaagcatggcctccaatgactttcataagcccttggaggcaggactgtgtctcatccatctttgtatcttcagtaccatcttgtaaggtgccttgtacatagtaggtgcttaatgaacaaatgttgcttgaatttagctgtcgtccagccccacagagttatgctccatttgccaccatgtgatatttttgagaaacaatagtgatttggatgccagctctatgtgactttgggcaagactctccatctatcttgtcttcatttcatctgtaaaatgaagtgagtagattcaatgctccctaaggtcccttccagctccaatacttgacaagcttgtgattctaaatcgtttccgttgcctctgaacatgggtgagtaatgcctccactgcagctgtttctctccaggaggctttgttcagaggaggtctgactattgcacagccagttttttcttcctcttcagcagttctttactgtcttcagaatggttctggataagcggccttttctgaaaggatatttaaaaatatatactatttaggctgggcccagtggctcatgcctgtaatcccagcactttgggaggtgaaggtgggtggatcacctgaggtcaggagttcaagaccagcctggccaacatggtgaaaccccgtctctactaaaaatacagaaattagctgggccctgtggcaagagcctgttatcccagctactggggaggctgaggcaggaaaatcgcttgaacccaggaggtggaggttgtagtgagccgagatcacaccactgcactccagcctgggtgacaagaacgaaactccatctcaaaaaataaaataaaatatatactatcttgctcctcagaaccagtggggaagaagagggaaggcaaagaaagaaactgagcatagtaaacacagcatttttttgtaggctcttatttaaaatgtgtgtgtgtgtgtgtatgtgtgtgtttctgagtaagtattgactgggaaaaagagagaagtcaatcaaaagtatactgtgcaattgagagaggctggcccaagatttaaaacttcctgtgggtaatctaactgtgagtagataggaatcggccatatgacgaaatgagatcaataggaaatgtgctttttgaggaaattttattttagtaccaaatgttgccagtgacaatcttcagttaagaagtaagttattctgacctaaaattcttatctctgccactttggtttaaaaacaaaaacccttatatacatggaatagttatattttaattaagcatttattttagttgttttcatccattcaagcaaaatgaataagcagcatttttcattgcacttaaaaatgtaaaatacctgcatgccactaatctgtaacattttaccagttcagatgcctgtaatgtgtgactttatgtgtgtctgtgttgttttgaagagaataaaggaaataatactttgcaaactgtttaaacaagtgtttaaacttctattggcaacatttattgggctaagcagttattgaaaactccgcatagttttattttccatttgaaacttcaatcaaatcaagactattatattcattagggaattaaagactaatttgctttttaaatgtgaagttgaacactgtgtggaaagtaaatgtgtgatgaagcaaaatgtataaagtatgaaatattatacttttaccctggataattattcaggaccccagttggcccaaataggtgcaatttttaatcctttgaaattagccagccagacctaatgctaaggtaaatgtaaactgttttaattaattaagatctttctgctttcgaaggtataatgtatctatttctgtcaggaatgatatttccaaatgaaaatgtaaagaacattgggaaataataaactttcctttcaaagtaaaagtaaa

SEQ ID NO: 32859 - DNA, 1490 bp, Homo sapiens
ggactgacggccagcacagccggctccgggatgagcgcacggacggtattctgaagtctcaggaaactggaccatttaaatgtgcatggcccatgagaaaggcttataagaagccatggcactcccctttcaaaaagagctggagaaatacaagaacattgatgaagatgagcttcttggcaaactctcagaagaggaactgaaacagttggaaaatgttctagatgacctagatcctgagagtgccatgctgccagctggatttcgacagaaagaccagacacagaaggcagccaccggcccctttgaccgcgagcacctcctcatgtacctggagaaggaggctttggaacagaaagacagagaggactttgtgcccttcactggagaaaagaaagggagagtctttatccctaaagaaaagcctatagaaactcgtaaagaagaaaaagtgacccttgacccagaactggaagaagctttggccagtgcctctgacaccgaactctatgatcttgcagctgtccttggagtacacaatttgctcaacaatccaaagttcgatgaagaaacagccaacaataaaggtggcaaaggacctgtcagaaatgttgtcaaaggtgaaaaagtaaagccagtatttgaggaaccaccaaatcccacaaatgtggaaataagcctgcagcagatgaaagccaatgatcctagcttgcaagaagtcaacctcaacaacattaaggcttttgcagacatgctgaaagtaaacaagaccttgacaagtctaaacatagaatccaattttatcactggaactgggatcctggccctggtagaggcactgaaagaaaatgacaccttgacagaaatcaagattgacaaccagaggcagcagttgggaacagctgtagagatggaaattgcccagatgctggaggagaattcaaggatcctcaagtttggataccagtttaccaagcaagggccacgaacaagggtggcagctgccatcacaaagaataatgacctggttcgtaagaagagagttgaagcagaccgaaggtaaacttccttgaggagaagtgaagtttcactgtggtatggccattgaaaaacaaaaactcttcttcttccccatcaggaccattttatcaaagttcgttcatttccgttaaccacataactaataatttaattgttattcttttttagcactacttatttatcttggattttgtaatatatgcaattgttttatttgctcatgggcacttctggcaacttgacaaatggaccgatgcagattttagagagtgacgacatggaaaatgaatttaaccactttcttattgggttgtcttgctttcttacatgaacttgtttttttaatcactgaaaggaatttagtgtataatatgtgtttgtaactgtgattatgatagaggcctatctctgtttacatgcatagctttgagttaggctaaatacatcag

SEQ ID NO: 32860 - DNA, 4668 bp, Homo sapiens
gagtgcgcacgcgcgtcggaggcgaaggaggaacccaccgcacctacagggcggtcgagtgagggagctgctggcgggtgggtctggcaactctttgggaggccgacgcgggcggaccggcgggtgctgggaaccgagcctcggcttgcggccggcagtttccgtgggtctgtgaagaggtcggcggcccctgcgggcgccagtcagctttaagaaaaagtagagatcacttctgactgtactgaacagcaaaaattaagtgacttgctgccctgcacatcatggcactgccattccgtaaggacttagaaaagtacaaagaccttgatgaagatgagctccttgggaatctgtcagaaacagaactgaaacaactggaaactgttttggatgatcttgaccccgagaatgcccttctgcctgcagggttccggcagaagaaccagacatcaaagtccaccacagggccatttgatagagagcatctcctttcatatctggagaaagaagcattggagcataaagacagggaagactatgtgccctacactggagaaaaaaaagggaaaatatttatccccaaacagaaacctgtacagacttttacagaagaaaaagtgtctcttgatccagaattagaagaagctttgacaagtgcttctgatacagaattgtgtgacctcgcagcaattcttgggatgcacaatttgataacgaatacaaagttctgtaatataatgggaagtagtaatggtgttgaccaagaacatttttcaaatgtggtcaaaggtgaaaagattcttccggtatttgatgagccaccaaatccaaccaatgtagaagagagtttgaagagaactaaagaaaacgatgctcatcttgttgaagttaatttgaataatataaagaatatcccaattccaaccctaaaagattttgcaaaggctttggaaaccaacacacatgtgaaatgtttcagtcttgcagccacccggagcaatgaccctgttgctactgcttttgcagaaatgctgaaagtgaacaaaactttgaagagcttaaatgtggagtccaactttatcacgggagttgggattctggcactgattgatgcgttaagagataatgaaaccctggcagagctcaagattgacaatcagaggcagcagttggggacagctgtagaattggaaatggccaagatgcttgaggaaaatacaaatatccttaaatttggatatcagtttacacagcagggaccacgaaccagagcagctaatgctataacaaaaaacaatgacttagtgcgtaagagacgagttgaaggagatcaccagtaagtctgcaaaggtgtaatctttggaagacttcagaagatcaccaagggctcatgttggtgacatcatgtaaaattttcctgggtagaagggaaaagactggaaaaatttttttagtgacatgcattttttttttagttgttatcaaattgtaaaatcagtaatgtgatattttatattctgaaacatttctactttctgctaaaatcaattttaatttagtttaattgaatgatttatgatgaatcttgggcaaaaaaatacaactgtaaaaaatttcacaggtcatttgtgtagaataatttgaacattgtgaggaccaatcttttttaaatcaaaagggatgttgctggtatcagaattgttattgcttcatttagacataaaacacttaagtgttttcttcactccgtgacctggagagttttccattttttaaaatacatgaacttggcaagggtgtgatttttctttatcaagagaacaaaatgccagaatgttaaaacagttaactcaaaatctagtcatctgtgtaggagctaaagcaggtctccagggagagagggtggtcgtctgtgcattccaggttactgcacttgtctgatgtgacgtagcaacacccaggtcttcttaaaacaaagtcatcagctttgccaggttacatactttatttaaaagtatagtgaggtcgaagttcattccagtgtttcattttaataatgtgggcattattaaatttttgtggaagctaatagtaaaaaataaaagctgttttcaccacctccctccccaccccccaaaaaaggcgtacagccaactcttagttatttagggtaagagaaaaaagaaaactgttaaacaatgaaatcaaagataataaatatgatagatttccagtatgaggcacttgcaaaacagtcatttaaactgatggttactgtaagtcagttggaagctggcatgtatgtaaattacttggtgttacaccatatccgaagaagttcctatgtgcagtgcagaattgcataaacagtatttaatcactgctacaaatcttccaaccaagaaggaaaactgctattcttcataaatctaatttttagtatatgcttcctttcatcttatacttttatcaatatttataaaagtcatttctataataaaagcagtctttcttgctcaaagtattaaggtgaacaattgaatagagtactgtggtcgggagactgatttgagactgcagagctgatgctgggtagagggtctggacttgtattcatgttctgtctcagggcagcccctggagcaggagatggcagaggcatttacagctgcagaaaacagggaggaatggaatctgaggtagccctggcctcaaaattcaggcctggctgtatcatttacagagatttttctggagggaaaagtctcatttctgaggaaggcaaggtggctaatcattattaattttttttaaactttttgggccgggcgcagtggctcacgcctgtaatcccagcacttttgggaagccaaagtgggtggatcacttaaggtcaggagttcaagaccagcctggccaacatggtgaaaccctgtctctactaaaaatcaaaaaagtagccgggtgtggtggtgcacacctgtaatcccagctactcaggaggctgaggcaggagaattgcttgaacctgggagatggagattgcagtgagctgagatcgtaccactgcactgcagtctgggtgacaaagcaagactctgtctcaaaaaacaaacaaacaaacaaactttttgaaattgaattgcaatatgtctgctactttggcttgggctggacagtttatctaataagcaaggcagcttcttgtgtgctatggtaataagccttcttaacaggctaagcttccctcataagaactgtggtgtttctctttttttttttttgttttggtttgttttggttttttggttttgttttgttttgttttttaaatcagtatccaatgttttataggggccaaaggttaactttgcactattccctgtcagttaaaggccactgatatttttctaagttagcaaggctcacttgcttgctttcttgcctcccttgcctccatccctctcccttcctaccttctctatttacctatttctctccctccctctcttctcctctctttttttttccccgcatatgcagctttttgattgtacttgattttatagagactgcacagttccagcaagattgggagtcaggcatggagcaggcatctcaggctaccagaaagaattggtcacctagactttcagtcaggcatcctcgtttgcattgtcctgtaagtcaattagttgataaatagttcccccttcatcccttaagttttgtttttgtttttgtttttaatataggtaagtgggactctacctaaaattttgcatcatacttatgggtaatatctttttcatatattatttatcaaagtatgaagttgagtattttgcttgtaccatttcaattctgcattatagtagttcattgtataactgaaagaaatgatttcttcataagtgacattaaatatgaacattcatccaattgaatttacaaaatctttccaaaattataagggagaaaaatcgggtttacttcaatctttaaaaatctggcacctcttagtaactttcagtatttctaaattgctctaaaattttataataaatagattagggttttgcaatagtcttaatttttaagccaaaggttttctgagaccttaggttttgtagtctaaccagcttatgtggttatttaaaagaatattctttgtgtttttaaattgctatttttaaaaaagctttttattacccattttataaaatgttatactcatatttgtctgaatttttccagtattcctacatgaaattgtatgtattaaaaactcaatattagtggcaaatattaatactattaaaatggattttggtgctatattcttgtagctaaagcctagtagaattctcaagaataggtgaaatacactttcaaagttgcctgtcatttaaaagaccaaataagcattttgtattaaataaattagcagatggttagagacttcaaggagagttagcttggtcatttaattgcgacttcatgttatttgattgaaataacccacatccttgctttgtataagatattcgctctggagaagttacatgtaaatagaattctataaattgttttccagttgaccgagtatctgttgtgtttttgtttaaaaagaggattccatgacataataaaaattattttaaaaaa

SEQ ID NO: 32861 - DNA, 2054 bp, Homo sapiens
gactgtactgaacagcaaaaattaagtgacttgctgccctgcacatcatggcactgccattccgtaaggacttagaaaagtacaaagaccttgatgaagatgagctccttgggaatctgtcagaaacagaactgaaacaactggaaactgttttggatgatcttgaccccgagaatgcccttctgcctgcagggttccggcagaagaaccagacatcaaagtccaccacagggccatttgatagagagcatctcctttcatatctggagaaagaagcattggagcataaagacagggaagactatgtgccctacactggagaaaaaaaagggaaaatatttatccccaaacagaaacctgtacagacttttacagaagaaaaagtgtctcttgatccagaattagaagaagctttgacaagtgcttctgatacagaattgtgtgacctcgcagcaattcttgggatgcacaatttgataacgaatacaaagttctgtaatataatgggaagtagtaatggtgttgaccaagaacatttttcaaatgtggtcaaaggtgaaaagattcttccggtatttgatgagccaccaaatccaaccaatgtagaagagagtttgaagagaactaaagaaaacgatgctcatcttgttgaagttaatttgaataatataaagaatatcccaattccaaccctaaaagattttgcaaaggctttggaaaccaacacacatgtgaaatgtttcagtcttgcagccacccggagcaatgaccctgttgctactgcttttgcagaaatgctgaaagtgaacaaaactttgaagagcttaaatgtggagtccaactttatcacgggagttgggattctggcactgattgatgcgttaagagataatgaaaccctggcagagctcaagattgacaatcagaggcagcagttggggacagctgtagaattggaaatggccaagatgcttgaggaaaatacaaatatccttaaatttggatatcagtttacacagcagggaccacgaaccagagcagctaatgctataacaaaaaacaatgacttagtgcgtaagagacgagttgaaggagatcaccagtaagtctgcaaaggtgtaatctttggaagacttcagaagatcaccaagggctcatgttggtgacatcatgtaaaattttcctgggtagaagggaaaagactggaaaaatttttttagtgacatgcattttttttttagttgttatcaaattgtaaaatcagtaatgtgatattttatattctgaaacatttctactttctgctaaaatcaattttaatttagtttaattgaatgatttatgatgaatcttgggcaaaaaaatacaactgtaaaaaatttcacaggtcatttgtgtagaataatttgaacattgtgaggaccaatcttttttaaatcaaaagggatgttgctggtatcagaattgttattgcttcatttagacataaaacacttaagtgttttcttcactccgtgacctggagagttttccattttttaaaatacatgaacttggcaagggtgtgatttttctttatcaagagaacaaaatgccagaatgttaaaacagttaactcaaaatctagtcatctgtgtaggagctaaagcaggtctccctccccaccccccaaaaaaggcgtacagccaactcttagttatttagggtaagagaaaaaagaaaactgttaaacaatgaaatcaaagataataaatatgatagatttccagtatgaggcacttgcaaaacagtcatttaaactgatggttactgtaagtcagttggaagctggcatgtatgtaaattacttggtgttacaccatatccgaagaagttcctatgtgcagtgcagaattgcataaacagtatttaatcactgctacaaatcttccaaccaagaaggaaaactgctattcttcataaatctaatttttagtatatgcttcctttcatcttatacttttatcaatatttataaaagtcatttctataataaaagcagtctttcttgctca

SEQ ID NO: 32862 - DNA, 447 bp, Homo sapiens
gggagtgcgcacgcgcgtcggaggcgaaggaggaacccaccgcacctacagggcggtcgagtgagggagctgctggcgggtgggtctggcaactctttgggaggccgacgcgggcggaccggcgggtgctgggaaccgagcctcggcttgcggccggcagtttccgtgggtctgtgaagaggtcggcggcccctgcgggcgccagtcagattgggacttgactgagattgatccagggctagttaccatgtatttcctgatggaagaatgttaactttaagaaaaagtagagatcacttctgactgtactgaacagcaaaaattaagtgacttgctgccctgcacatcatggcactgccattccgtaaggacttagaaaagtacaaagaccttgatgaagatgagctccttgggaatctgtcagaaacagaactgaaacaactggaa

SEQ ID NO: 32863 - DNA, 1267 bp, Homo sapiens
ccgggctcctcctgctgctgggacagtgctctagtagaacagacagacctactgacacaggggaggtgagaagggaggtgaccaccaggactggctctgtgagtaccacacagtggggagggggtgggggccaccatgtcatcatatcagaaggaactggagaaatacagagacatagatgaagatgagatcctaaggaccttgagccccgaggagctagagcagctggactgcgaactacaggagatggatcctgagaacatgctcctgccagctggactaagacaacgtgaccagacaaagaagagcccaacggggccactggaccgagaggcccttttgcagtacttggagcaacaggcactagaagtcaaagagcgtgatgacttggtgcccttcacaggcgagaagaaggggaaaccctatattcagcccaagagggaaatcccagcagaggagcagatcaccctggagcctgagctggaggaggcactggcacatgccacagatgctgaaatgtgtgacattgcagcaattctggacatgtacacactgatgagtaacaagcaatactatgatgccctctgcagtggagaaatctgcaacactgaaggcattagcagtgtggtacagcctgacaagtataagccagtgccggatgaacccccaaatcccacaaacattgaggagatactaaagagggtccgaagcaatgacaaggagctggaggaggtgaacttgaataatatacaggacatcccaatacccatgctaagtgagctgtgtgaggcaatgaaggcaaatacctatgtgcggagcttcagtctggtagccacgaggagtggtgaccccattgccaatgcagtggctgacatgttgcgtgagaatcgtagcctccagagcctaaacatcgaatccaacttcattagcagcacaggactcatggctgtgctgaaggcagttcgggaaaatgccacactcactgagctccgtgtagacaatcagcgccagtggcctggtgatgcagtggagatggagatggccaccgtgctagagcagtgtccctctattgtccgctttggctaccactttacacagcaggggccacgagctcgggcagcccaggccatgacccgaaacaatgaactacgtcgccagcaaaagaagagataacactgcatttccctttaccaactagcgctgggagcactggacacttaaatcctcatctgtcctcctttcctgtaaataaaagcccttctatcca

SEQ ID NO: 32864 - DNA, 1024 bp, Homo sapiens
agaacagacagacctactgacacaggggaggtgagaagggaggtgaccaccaggactggctctgtgagtaccacacagtggggagggggtgggggccaccatgtcatcatatcagaaggaactggagaaatacagagacatagatgaagatgagatcctaaggaccttgagccccgaggagctagagcagctggactgcgaactacaggagatggatcctgagaacatgctcctgccagctggactaagacaacgtgaccagacaaagaagagcccaacggggccactggaccgagaggcccttttgcagtacttggagcaacaggcactagaagtcaaagagcgtgatgacttggtgcccttcacaggcgagaagaagggtgtggtacagcctgacaagtataagccagtgccggatgaacccccaaatcccacaaacattgaggagatactaaagagggtccgaagcaatgacaaggagctggaggaggtgaacttgaataatatacaggacatcccaatacccatgctaagtgagctgtgtgaggcaatgaaggcaaatacctatgtgcggagcttcagtctggtagccacgaggagtggtgaccccattgccaatgcagtggctgacatgttgcgtgagaatcgtagcctccagagcctaaacatcgaatccaacttcattagcagcacaggactcatggctgtgctgaaggcagttcgggaaaatgccacactcactgagctccgtgtagacaatcagcgccagtggcctggtgatgcagtggagatggagatggccaccgtgctagagcagtgtccctctattgtccgctttggctaccactttacacagcaggggccacgagctcgggcagcccaggccatgacccgaaacaatgaactacgtcgccagcaaaagaagagataacactgcatttccctttaccaactagcgctgggagcactggacacttaaatcctcatctgtcctcctttcctgtaaataaaagcccttctatcc

SEQ ID NO: 32865 - DNA, 493 bp, Homo sapiens
agacagacctactgacacaggggaggctctgtgagtaccacacagtggggagggggtgggggccaccatgtcatcatatcagaaggaactggagaaatacagagacatagatgaagatgagatcctaaggaccttgagccccgaggagctagagcagctggactgcgaactacaggagatggatcctgagaacatgctcctgccagctggactaagacaacgtgaccagacaaagaagagcccaacggggccactggaccgagaggcccttttgcagtacttggagcaacaggcactagaagtcaaagagcgtgatgacttggtgcccttcacaggcgagaagaaggggaaaccctatattcagcccaagagggaaatcccagcagaggagcagatcaccctggagcctgagctggaggaggcactggcacatgccacagatgctgaaatgtgtgacattgcagcaattctggacatgtacacactgatgagt

SEQ ID NO: 32866 - DNA, 1670 bp, Homo sapiens
cgctcctccgcccgaccgcgcgctcgccccgccgctcctgctgcagccccagggcccctcgccgccgccaccatggacgccatcaagaagaagatgcagatgctgaagctcgacaaggagaacgccttggatcgagctgagcaggcggaggccgacaagaaggcggcggaagacaggagcaagcagctcgaggaggacatcgcggccaaggagaagttgctgcgggtgtcggaggacgagcgggaccgggtgctggaggagctgcacaaggcggaggacagcctcctggccgccgaagaggccgccgccaaggctgaagccgacgtagcttctctgaacagacgcatccagctggttgaggaagagttggatcgtgcccaggagcgtctggcaacagctttgcagaagctggaggaagctgagaaggcagcagatgagagtgagagaggcatgaaagtcattgagagtcgagcccaaaaagatgaagaaaaaatggaaattcaggagatccaactgaaagaggccaagcacattgctgaagatgccgaccgcaaatatgaagaggtggcccgtaagctggtcatcattgagagcgacctggaacgtgcagaggagcgggctgagctctcagaaggcaaatgtgccgagcttgaagaagaattgaaaactgtgacgaacaacttgaagtcactggaggctcaggctgagaagtactcgcagaaggaagacagatatgaggaagagatcaaggtcctttccgacaagctgaaggaggctgagactcgggctgagtttgcggagaggtcagtaactaaattggagaaaagcattgatgacttagaagagaaagtggctcatgccaaagaagaaaaccttagtatgcatcagatgctggatcagactttactggagttaaacaacatgtgaaaacctccttagctgcgaccacattctttcgttttgttttgttttgtttttaaacacctgcttaccccttaaatgcaatttatttacttttaccactgtcacagaaacatccacaagataccagctaggtcagggggtggggaaaacacatacaaaaaggcaagcccatgtcagggcgatcctggttcaaatgtgccatttcccgggttgatgctgccacactttgtagagagtttagcaacacagtgtgcttagtcagcgtaggaatcctcactaaagcagaagaagttccattcaaagtgccaatgatagagtcaacaggaaggttaatgttggaaacacaatcaggtgtggattggtgctactttgaacaaaaggtccccctgtggtcttttgttcaacattgtacaatgtagaactctgtccaacactaatttattttgtcttgagttttactacaagatgagactatggatcccgcatgcctgaattcactaaagccaagggtctgtaagccacgctgctcttccgagacttccattcctttctgattggcacacgtgcagctcatgacaatctgtaggataacaatcagtgtggatttccactcttttcagtccttcatgttaaagatttagacaccacatacaactggtaaaggacgttttcttgagagttttaactatatgtaaacattgtataatgatatggaataaaatgcacattgtaggacattttctaaa

SEQ ID NO: 32867 - DNA, 1295 bp, Homo sapiens
gagaggaggaaggggggcaggagaaaaaagcttttccaaaaaagtattggctgtcttgaggaatgcggtcgcccccttgggaaagtacatatctgggagaagcaggcggctccgcgctcgcactcccgctcctccgcccgaccgcgcgctcgccccgccgctcctgctgcagccccagggcccctcgccgccgccaccatggacgccatcaagaagaagatgcagatgctgaagctcgacaaggagaacgccttggatcgagctgagcaggcggaggccgacaagaaggcggcggaagacaggagcaagcagctggaagatgagctggtgtcactgcaaaagaaactcaagggcaccgaagatgaactggacaaatactctgaggctctcaaagatgcccaggagaagctggagctggcagagaaaaaggccaccgatgctgaagccgacgtagcttctctgaacagacgcatccagctggttgaggaagagttggatcgtgcccaggagcgtctggcaacagctttgcagaagctggaggaagctgagaaggcagcagatgagagtgagagaggcatgaaagtcattgagagtcgagcccaaaaagatgaagaaaaaatggaaattcaggagatccaactgaaagaggccaagcacattgctgaagatgccgaccgcaaatatgaagaggtggcccgtaagctggtcatcattgagagcgacctggaacgtgcagaggagcgggctgagctctcagaaggccaagtccgacagctggaagaacaattaagaataatggatcagaccttgaaagcattaatggctgcagaggataagtactcgcagaaggaagacagatatgaggaagagatcaaggtcctttccgacaagctgaaggaggctgagactcgggctgagtttgcggagaggtcagtaactaaattggagaaaagcattgatgacttagaagacgagctgtacgctcagaaactgaagtacaaagccatcagcgaggagctggaccacgctctcaacgatatgacttccatgtaaacgttcatccactctgcctgcttacaccctgccctcatgctaatataagtttctttgcttcacttctcccaagactccctcgtcgagctggatgtcccacctctctgagctctgcatttgtctattctccagctgaccctggttctctctcttagcatcctgccttagagccaggcacacactgtgctttctattgtacagaagctcttcgtttcagtgtcaaataaacactgtgtaagcta

SEQ ID NO: 32868 - DNA, 1606 bp, Homo sapiens
cgcgcgcgcccgcctgcggtttgtctgcgcagccctggaggctgcgacttccggactgctcctggccgcagggggcgccgccatcgcacagagaggcctgggcggggcggaccggcgctgggcagccaggacagccgcggcagccgggtccgcagggcagcagccggcctctcccactgcagccctcccgcccgcctaccgtccggcgcgatggcggggagtagctcgctggaggcggtgcgcaggaagatccggagcctgcaggagcaggcggacgccgctgaggagcgcgcgggcaccctgcagcgcgagctggaccacgagaggaagctgagggagaccgctgaagccgacgtagcttctctgaacagacgcatccagctggttgaggaagagttggatcgtgcccaggagcgtctggcaacagctttgcagaagctggaggaagctgagaaggcagcagatgagagtgagagaggcatgaaagtcattgagagtcgagcccaaaaagatgaagaaaaaatggaaattcaggagatccaactgaaagaggccaagcacattgctgaagatgccgaccgcaaatatgaagaggtggcccgtaagctggtcatcattgagagcgacctggaacgtgcagaggagcgggctgagctctcagaaggcaaatgtgccgagcttgaagaagaattgaaaactgtgacgaacaacttgaagtcactggaggctcaggctgagaagtactcgcagaaggaagacagatatgaggaagagatcaaggtcctttccgacaagctgaaggaggctgagactcgggctgagtttgcggagaggtcagtaactaaattggagaaaagcattgatgacttagaagatcaactctaccagcaacttgagcaaaatcgccgcctcactaatgaactaaagctggccctgaatgaggattaaacttaagagtgaaaaaacttgggctgaattctaggcgtggagcccatgtgcagaaaatctaagactgtcctaccttcaactaatagagttgaaaacagttgctttctgcagaaatgcaaatgcaaggaattggctgaaaggctggccttgcctgcttgtttctctatatggctggaataattacgttctctttaatcacaaaacagcttttatggtagaatacttatatcaattcagcactgctccttgaaatagcaggtcctcttgtttgaactgataaataatgaggagcccccccaaaaaatgttttctatttcctgacagccatgagtcctactttaagtatgtatatatatatatatatgtgtgtgtgtgtgtgtgtgtatatattcctatcagatactcatattcctaacttctaaatatctggtatagtgtttgaaatatgattaaatgtacctatgcttgggcaaaatagcttttgaaaacaggaactcatgccagaagcccctggttgtctgaaaggtatgctttactcagtctaatggtgctgttggagtctggggagaatgtcatgctaataaatagaacactataaaaatattaagagaatgtcctaatgaagtgtgcatgaaacatgttgacaattttttatgag

SEQ ID NO: 32869 - DNA, 1800 bp, Homo sapiens
gcactcccgctcctccgcccgaccgcgcgctcgccccgccgctcctgctgcagccccagggcccctcgccgccgccaccatggacgccatcaagaagaagatgcagatgctgaagctcgacaaggagaacgccttggatcgagctgagcaggcggaggccgacaagaaggcggcggaagacaggagcaagcagctcgaggaggacatcgcggccaaggagaagttgctgcgggtgtcggaggacgagcgggaccgggtgctggaggagctgcacaaggcggaggacagcctcctggccgccgaagaggccgccgccaagctggaagatgagctggtgtcactgcaaaagaaactcaagggcaccgaagatgaactggacaaatactctgaggctctcaaagatgcccaggagaagctggagctggcagagaaaaaggccaccgatgctgaagccgacgtagcttctctgaacagacgcatccagctggttgaggaagagttggatcgtgcccaggagcgtctggcaacagctttgcagaagctggaggaagctgagaaggcagcagatgagagtgagagaggcatgaaagtcattgagagtcgagcccaaaaagatgaagaaaaaatggaaattcaggagatccaactgaaagaggccaagcacattgctgaagatgccgaccgcaaatatgaagaggtggcccgtaagctggtcatcattgagagcgacctggaacgtgcagaggagcgggctgagctctcagaaggcaaatgtgccgagcttgaagaagaattgaaaactgtgacgaacaacttgaagtcactggaggctcaggctgagaagtactcgcagaaggaagacagatatgaggaagagatcaaggtcctttccgacaagctgaaggaggctgagactcgggctgagtttgcggagaggtcagtaactaaattggagaaaagcattgatgacttagaagagaaagtggctcatgccaaagaagaaaaccttagtatgcatcagatgctggatcagactttactggagttaaacaacatgtgaaaacctccttagctgcgaccacattctttcgttttgttttgttttgtttttaaacacctgcttaccccttaaatgcaatttatttacttttaccactgtcacagaaacatccacaagataccagctaggtcagggggtggggaaaacacatacaaaaaggcaagcccatgtcagggcgatcctggttcaaatgtgccatttcccgggttgatgctgccacactttgtagagagtttagcaacacagtgtgcttagtcagcgtaggaatcctcactaaagcagaagaagttccattcaaagtgccaatgatagagtcaacaggaaggttaatgttggaaacacaatcaggtgtggattggtgctactttgaacaaaaggtccccctgtggtcttttgttcaacattgtacaatgtagaactctgtccaacactaatttattttgtcttgagttttactacaagatgagactatggatcccgcatgcctgaattcactaaagccaagggtctgtaagccacgctgctcttccgagacttccattcctttctgattggcacacgtgcagctcatgacaatctgtaggataacaatcagtgtggatttccactcttttcagtccttcatgttaaagatttagacaccacatacaactggtaaaggacgttttcttgagagttttaactatatgtaaacattgtataatgatatggaataaaatgcacattgtaggacattttct

SEQ ID NO: 32870 - DNA, 1717 bp, Homo sapiens
tcttgaggaatgcggtcgcccccttgggaaagtacatatctgggagaagcaggcggctccgcgctcgcactcccgctcctccgcccgaccgcgcgctcgccccgccgctcctgctgcagccccagggcccctcgccgccgccaccatggacgccatcaagaagaagatgcagatgctgaagctcgacaaggagaacgccttggatcgagctgagcaggcggaggccgacaagaaggcggcggaagacaggagcaagcagctggaagatgagctggtgtcactgcaaaagaaactcaagggcaccgaagatgaactggacaaatactctgaggctctcaaagatgcccaggagaagctggagctggcagagaaaaaggccaccgatgctgaagccgacgtagcttctctgaacagacgcatccagctggttgaggaagagttggatcgtgcccaggagcgtctggcaacagctttgcagaagctggaggaagctgagaaggcagcagatgagagtgagagaggcatgaaagtcattgagagtcgagcccaaaaagatgaagaaaaaatggaaattcaggagatccaactgaaagaggccaagcacattgctgaagatgccgaccgcaaatatgaagaggtggcccgtaagctggtcatcattgagagcgacctggaacgtgcagaggagcgggctgagctctcagaaggccaagtccgacagctggaagaacaattaagaataatggatcagaccttgaaagcattaatggctgcagaggataagtactcgcagaaggaagacagatatgaggaagagatcaaggtcctttccgacaagctgaaggaggctgagactcgggctgagtttgcggagaggtcagtaactaaattggagaaaagcattgatgacttagaagagaaagtggctcatgccaaagaagaaaaccttagtatgcatcagatgctggatcagactttactggagttaaacaacatgtgaaaacctccttagctgcgaccacattctttcgttttgttttgttttgtttttaaacacctgcttaccccttaaatgcaatttatttacttttaccactgtcacagaaacatccacaagataccagctaggtcagggggtggggaaaacacatacaaaaaggcaagcccatgtcagggcgatcctggttcaaatgtgccatttcccgggttgatgctgccacactttgtagagagtttagcaacacagtgtgcttagtcagcgtaggaatcctcactaaagcagaagaagttccattcaaagtgccaatgatagagtcaacaggaaggttaatgttggaaacacaatcaggtgtggattggtgctactttgaacaaaaggtccccctgtggtcttttgttcaacattgtacaatgtagaactctgtccaacactaatttattttgtcttgagttttactacaagatgagactatggatcccgcatgcctgaattcactaaagccaagggtctgtaagccacgctgctcttccgagacttccattcctttctgattggcacacgtgcagctcatgacaatctgtaggataacaatcagtgtggatttccactcttttcagtccttcatgttaaagatttagacaccacatacaactggtaaaggacgttttcttgagagttttaactatatgtaaacattgtataatgatatggaataaa

SEQ ID NO: 32871 - DNA, 1049 bp, Homo sapiens
cgcactcccgctcctccgcccgaccgcgcgctcgccccgccgctcctgctgcagccccagggcccctcgccgccgccaccatggacgccatcaagaagaagatgcagatgctgaagctcgacaaggagaacgccttggatcgagctgagcaggcggaggccgacaagaaggcggcggaagacaggagcaagcagctggaagatgagctggtgtcactgcaaaagaaactcaagggcaccgaagatgaactggacaaatactctgaggctctcaaagatgcccaggagaagctggagctggcagagaaaaaggccaccgatgctgaagccgacgtagcttctctgaacagacgcatccagctggttgaggaagagttggatcgtgcccaggagcgtctggcaacagctttgcagaagctggaggaagctgagaaggcagcagatgagagtgagagaggcatgaaagtcattgagagtcgagcccaaaaagatgaagaaaaaatggaaattcaggagatccaactgaaagaggccaagcacattgctgaagatgccgaccgcaaatatgaagaggtggcccgtaagctggtcatcattgagagcgacctggaacgtgcagaggagcgggctgagctctcagaaggcaaatgtgccgagcttgaagaagaattgaaaactgtgacgaacaacttgaagtcactggaggctcaggctgagaagtactcgcagaaggaagacagatatgaggaagagatcaaggtcctttccgacaagctgaaggaggctgagactcgggctgagtttgcggagaggtcagtaactaaattggagaaaagcattgatgacttagaagacgagctgtacgctcagaaactgaagtacaaagccatcagcgaggagctggaccacgctctcaacgatatgacttccatataagtttctttgcttcacttctcccaagactccctcgtcgagctggatgtcccacctctctgagctctgcatttgtctattctccagctgaccctggttctctctcttagcatcctg

SEQ ID NO: 32872 - DNA, 1655 bp, Homo sapiens
cgctcctccgcccgaccgcgcgctcgccccgccgctcctgctgcagccccagggcccctcgccgccgccaccatggacgccatcaagaagaagatgcagatgctgaagctcgacaaggagaacgccttggatcgagctgagcaggcggaggccgacaagaaggcggcggaagacaggagcaagcagctcgaggaggacatcgcggccaaggagaagttgctgcgggtgtcggaggacgagcgggaccgggtgctggaggagctgcacaaggcggaggacagcctcctggccgccgaagaggccgccgccaaggctgaagccgacgtagcttctctgaacagacgcatccagctggttgaggaagagttggatcgtgcccaggagcgtctggcaacagctttgcagaagctggaggaagctgagaaggcagcagatgagagtgagagaggcatgaaagtcattgagagtcgagcccaaaaagatgaagaaaaaatggaaattcaggagatccaactgaaagaggccaagcacattgctgaagatgccgaccgcaaatatgaagaggtggcccgtaagctggtcatcattgagagcgacctggaacgtgcagaggagcgggctgagctctcagaaggccaagtccgacagctggaagaacaattaagaataatggatcagaccttgaaagcattaatggctgcagaggataagtactcgcagaaggaagacagatatgaggaagagatcaaggtcctttccgacaagctgaaggaggctgagactcgggctgagtttgcggagaggtcagtaactaaattggagaaaagcattgatgacttagaagagaaagtggctcatgccaaagaagaaaaccttagtatgcatcagatgctggatcagactttactggagttaaacaacatgtgaaaacctccttagctgcgaccacattctttcgttttgttttgttttgtttttaaacacctgcttaccccttaaatgcaatttatttacttttaccactgtcacagaaacatccacaagataccagctaggtcagggggtggggaaaacacatacaaaaaggcaagcccatgtcagggcgatcctggttcaaatgtgccatttcccgggttgatgctgccacactttgtagagagtttagcaacacagtgtgcttagtcagcgtaggaatcctcactaaagcagaagaagttccattcaaagtgccaatgatagagtcaacaggaaggttaatgttggaaacacaatcaggtgtggattggtgctactttgaacaaaaggtccccctgtggtcttttgttcaacattgtacaatgtagaactctgtccaacactaatttattttgtcttgagttttactacaagatgagactatggatcccgcatgcctgaattcactaaagccaagggtctgtaagccacgctgctcttccgagacttccattcctttctgattggcacacgtgcagctcatgacaatctgtaggataacaatcagtgtggatttccactcttttcagtccttcatgttaaagatttagacaccacatacaactggtaaaggacgttttcttgagagttttaactatatgtaaacattgtataatgatatggaataaaatgcacattgt

SEQ ID NO: 32873 - DNA, 977 bp, Homo sapiens
cgctcctccgcccgaccgcgcgctcgccccgccgctcctgctgcagccccagggcccctcgccgccgccaccatggacgccatcaagaagaagatgcagatgctgaagctcgacaaggagaacgccttggatcgagctgagcaggcggaggccgacaagaaggcggcggaagacaggagcaagcagctggaagatgagctggtgtcactgcaaaagaaactcaagggcaccgaagatgaactggacaaatactctgaggctctcaaagatgcccaggagaagctggagctggcagagaaaaaggccaccgatgctgaagccgacgtagcttctctgaacagacgcatccagctggttgaggaagagttggatcgtgcccaggagcgtctggcaacagctttgcagaagctggaggaagctgagaaggcagcagatgagagtgagagaggcatgaaagtcattgagagtcgagcccaaaaagatgaagaaaaaatggaaattcaggagatccaactgaaagaggccaagcacattgctgaagatgccgaccgcaaatatgaagaggtggcccgtaagctggtcatcattgagagcgacctggaacgtgcagaggagcgggctgagctctcagaaggcaaatgtgccgagcttgaagaagaattgaaaactgtgacgaacaacttgaagtcactggaggctcaggctgagaagtactcgcagaaggaagacagatatgaggaagagatcaaggtcctttccgacaagctgaaggaggctgagactcgggctgagtttgcggagaggtcagtaactaaattggagaaaagcattgatgacttagaagagaaagtggctcatgccaaagaagaaaaccttagtatgcatcagatgctggatcagactttactggagttaaacaacatgtgaaaacctccttagctgcgaccacattctttcgttttgttttgttttgtttt

SEQ ID NO: 32874 - DNA, 1039 bp, Homo sapiens
atcgagctgagcaggcggaggccgacaagaaggcggcggaagacaggagcaagcagctggaagatgagctggtgtcactgcaaaagaaactcaagggcaccgaagatgaactggacaaatactctgaggctctcaaagatgcccaggagaagctggagctggcagagaaaaaggccaccgatgctgaagccgacgtagcttctctgaacagacgcatccagctggttgaggaagagttggatcgtgcccaggagcgtctggcaacagctttgcagaagctggaggaagctgagaaggcagcagatgagagtgagagaggcatgaaagtcattgagagtcgagcccaaaaagatgaagaaaaaatggaaattcaggagatccaactgaaagaggccaagcacattgctgaagatgccgaccgcaaatatgaagaggtggcccgtaagctggtcatcattgagagcgacctggaacgtgcagaggagcgggctgagctctcagaaggcaaatgtgccgagcttgaagaagaattgaaaactgtgacgaacaacttgaagtcactggaggctcaggctgagaagtactcgcagaaggaagacagatatgaggaagagatcaaggtcctttccgacaagctgaaggaggctgagactcgggctgagtttgcggagaggtcagtaactaaattggagaaaagcattgatgacttagaagacgagctgtacgctcagaaactgaagtacaaagccatcagcgaggagctggaccacgctctcaacgatatgacttccatgtaaacgttcatccactctgcctgcttacaccctgccctcatgctaatataagtttctttgcttcacttctcccaagactccctcgtcgagctggatgtcccacctctctgagctctgcatttgtctattctccagctgaccctggttctctctcttagcatcctgccttagagccaggcacacactgtgctttctattgtacagaagctcttcgtttcagtgtcaaataaacactgtgtaagcta

SEQ ID NO: 32875 - DNA, 1018 bp, Homo sapiens
tcctcctcgcctgccaccggtgcacccagtccgctcacccagcccagtccgtccggtcctcaccgcctgccggccggcccaccccccaccgcagccatggacgccatcaagaagaagatgcagatgctgaagctggacaaggagaacgccatcgaccgcgccgagcaggccgaagccgacaagaagcaagctgaggaccgctgcaagcagctggaggaggagcagcaggccctccagaagaagctgaaggggacagaggatgaggtggaaaagtattctgaatccgtgaaggaggcccaggagaaactggagcaggccgagaagaaggccactgatgctgaggcagatgtggcctccctgaaccgccgcattcagctggttgaggaggagctggaccgggcccaggagcgcctggctacagccctgcagaagctggaggaggccgagaaggcggctgatgagagcgagagaggaatgaaggtcatcgaaaaccgggccatgaaggatgaggagaagatggaactgcaggagatgcagctgaaggaggccaagcacatcgctgaggattcagaccgcaaatatgaagaggtggccaggaagctggtgatcctggaaggagagctggagcgctcggaggagagggctgaggtggccgagagtaaatgtggggacctagaggaggagctgaaaattgttaccaacaacttgaaatccctggaggcccaggcggacaagtattccaccaaagaagataaatatgaagaggagatcaaactgttggaggagaagctgaaggaggctgagacccgagcagagtttgccgagaggtctgtggcaaagttggagaaaaccatcgatgacctagaagagaccttggccagtgccaaggaggagaacgtcgagattcaccagaccttggaccagaccctgctggaactcaacaacctgtgagggccagccccacccccagccaggctatggttgccaccccaacccaataaaactgatgttactagcc

SEQ ID NO: 32876 - DNA, 1189 bp, Homo sapiens
cccgctccgtcctcctcgcctgccaccggtgcacccagtccgctcacccagcccagtccgtccggtcctcaccgcctgccggccggcccaccccccaccgcagccatggacgccatcaagaagaagatgcagatgctgaagctggacaaggagaacgccatcgaccgcgccgagcaggccgaagccgacaagaagcaagctgaggaccgctgcaagcagctggaggaggagcagcaggccctccagaagaagctgaaggggacagaggatgaggtggaaaagtattctgaatccgtgaaggaggcccaggagaaactggagcaggccgagaagaaggccactgatgctgaggcagatgtggcctccctgaaccgccgcattcagctggttgaggaggagctggaccgggcccaggagcgcctggctacagccctgcagaagctggaggaggccgagaaggcggctgatgagagcgagagaggaatgaaggtcatcgaaaaccgggccatgaaggatgaggagaagatggaactgcaggagatgcagctgaaggaggccaagcacatcgctgaggattcagaccgcaaatatgaagaggtggccaggaagctggtgatcctggaaggagagctggagcgctcggaggagagggctgaggtggccgagagtaaatgtggggacctagaggaggagctgaaaattgttaccaacaacttgaaatccctggaggcccaggcggacaagtattccaccaaagaagataaatatgaagaggagatcaaactgttggaggagaagctgaaggaggctgagacccgagcagagtttgccgagaggtctgtggcaaagttggagaaaaccatcgatgacctagaagatgaagtctatgcccagaagatgaagtacaaggccattagcgaggaactggacaacgcactcaatgacatcacctccctctgagccccacgccagcgtggccacctcagctctcttctctcctctcctttccattctctctatggggaggggagcaggcaggaggagcagaaattgccaacattgcacagccaggctgggagcagcctagggagagcccccatcatgcccaccacccactctggcactggcttcatcctttacctatccccttccaccctcctttgctgcttaataaattctgaacttggtc

SEQ ID NO: 32877 - DNA, 2147 bp, Homo sapiens
gagaaggcacctcgccccggaccccctatgccccgcagctcagtgactcttcccctcgccctccgccttccccgccgcagcccggctccgcctcccaatggggaaacatcccaaaaaagggcagaaaagaaatttcagcataaagttggcccactgggaaagagaggagcgtccgcggggagcgggggagaagagggaaggcgcgcggaggggagtggggccaggcggagccaggggcggggagcggaggggctcgggacgcgtccgggtgggagcgggggcggggaacgcgcggtgaccagcctggccgcagccgcgtggaaaatatgcggggcacgtggggggcggggcggggagctgggtcctgagccgccgggtgctcgcaggaagggcctggctccaggggcaggggctgggaggggaggcgaggggatgagaggtcaggccggtcctgggggcagcaagcccggccacactccccaccgcgaccggggctctgggctcgcttcctgcttcagtttccccaagctcccgatgagactccgctactaccaccacgtcgataacgcaaacctagagggactcagggtaaactgaggcactcaaactgccgaggagctccgcctcccgagagacatttaatccggggggatttgcaggaaacttctaaattaagggtagcggctgctgcagctgagggggggcacgccggtccctgcgcccgggcagctgccgtgagctcacgccccgaaatagccccaggggccccagccgcagctgccactgggtccggctgtcactcagaggaagcacggagcccccagcccaagggtcccctccccttcgcatcgccggggtttttccagccgaccgtcggccactttttcctccgacggctggcagggaagagggggatgggggcgggaccccaagggaggcggtccccagtgggtgggcgaagggggcggccgcaccccccggccgggccgtgcttctgcccctacaaggtttgggccgaggtgggggagggtcctggttgccggccccgcccggtccctccccgccttttaggcgcccgcgtggccgggacgtcccagtcccgctccgtcctcctcgcctgccaccggtgcacccagtccgctcacccagcccagtccgtccggtcctcaccgcctgccggccggcccaccccccaccgcagccatggacgccatcaagaagaagatgcagatgctgaagctggacaaggagaacgccatcgaccgcgccgagcaggccgaagccgacaagaagcaagctgaggaccgctgcaagcagctggaggaggagcagcaggccctccagaagaagctgaaggggacagaggatgaggtggaaaagtattctgaatccgtgaaggaggcccaggagaaactggagcaggccgagaagaaggccactgatgctgaggcagatgtggcctccctgaaccgccgcattcagctggttgaggaggagctggaccgggcccaggagcgcctggctacagccctgcagaagctggaggaggccgagaaggcggctgatgagagcgagagaggaatgaaggtcatcgaaaaccgggccatgaaggatgaggagaagatggaactgcaggagatgcagctgaaggaggccaagcacatcgctgaggattcagaccgcaaatatgaagaggtggccaggaagctggtgatcctggaaggagagctggagcgctcggaggagagggctgaggtggccgagagccgagccagacagctggaggaggaacttcgaaccatggaccaggccctcaagtccctgatggcctcagaggaggagtattccaccaaagaagataaatatgaagaggagatcaaactgttggaggagaagctgaaggaggctgagacccgagcagagtttgccgagaggtctgtggcaaagttggagaaaaccatcgatgacctagaagagaccttggccagtgccaaggaggagaacgtcgagattcaccagaccttggaccagaccctgctggaactcaacaacctgtgagggccagccccacccccagccaggctatggttgccaccccaacccaataaaactgatgttactagcctctcaaggccctttaatccttt

SEQ ID NO: 32878 - DNA, 1771 bp, Homo sapiens
ctgccaccggtgcacccagtccgctcacccagcccagtccgtccggtcctcaccgcctgccggccggcccaccccccaccgcagccatggacgccatcaagaagaagatgcagatgctgaagctggacaaggagaacgccatcgaccgcgccgagcaggccgaagccgacaagaagcaagctgaggaccgctgcaagcagctggaggaggagcagcaggccctccagaagaagctgaaggggacagaggatgaggtggaaaagtattctgaatccgtgaaggaggcccaggagaaactggagcaggccgagaagaaggccactgatgctgaggcagatgtggcctccctgaaccgccgcattcagctggttgaggaggagctggaccgggcccaggagcgcctggctacagccctgcagaagctggaggaggccgagaaggcggctgatgagagcgagagaggaatgaaggtcatcgaaaaccgggccatgaaggatgaggagaagatggaactgcaggagatgcagctgaaggaggccaagcacatcgctgaggattcagaccgcaaatatgaagaggtggccaggaagctggtgatcctggaaggagagctggagcgctcggaggagagggctgaggtggccgagagtaaatgtggggacctagaggaggagctgaaaattgttaccaacaacttgaaatccctggaggcccaggcggacaagtattccaccaaagaagataaatatgaagaggagatcaaactgttggaggagaagctgaaggaggctgagacccgagcagagtttgccgagaggtctgtggcaaagttggagaaaaccatcgatgacctagaagagagcacctctatcgccaccacggagcactggttcactcctgacaccctggcacttactgacacccccagcccctgcactgagcccacccacaaaacaccatggcccacgctgaaacccctctgcacaggcactccctggctgtcgctctctgattcaccactgcatgtgggcacgtgtggccccatcaaaccatgaccgcctctggtgccaatccctgacctcagagcacttagctggggttccaggatcaaacagagtgactggaaaggaagtagggtggtgaggtgcaggacaggggcaagaaggttgcaaaaggtctggaatggagcttggaaaaatgttggatatcagcaacatggggctttcactgcagcagcaggtctgttttctacctcaagtctgtctgtctggcccttcctttcctggcgcagtctttgtcttaccttctgtctccaacttccttaaaccttctaaagaagaggataaagtagtttatgactcagccctccccaccccacctctatgaccccaaggccttgagtgaggcatccacgtccgtcctgttcccctcatcctagtcagtccatctgtttgtccctgccaaggggccctgaggtccgtgaatgcatgtgtcttccttgacccactccatgtctatatgtcaccttcccctggccctgcctccccacgtctcccccttgtgtctcccttctccctcacctgctgcttcccctcacagagaccttggccagtgccaaggaggagaacgtcgagattcaccagaccttggaccagaccctgctggaactcaacaacctgtgagggccagccccacccccagccaggctatggttgccaccccaacccaataaaactgatgttactagcctctcaaggccctttaatccttt

SEQ ID NO: 32879 - DNA, 1219 bp, Homo sapiens
ctccagtgttcacaggtgagcctaccaacagccactgctcatgatggaggccatcaagaaaaagatgcagatgctgaagttagacaaggagaatgctctggatcgggcagagcaagctgaagctgagcagaagcaggcagaagaaagaagtaaacagctggaggatgagctggcagccatgcagaagaagctgaaagggacagaggatgagctggacaagtattctgaagctttgaaggatgcccaggagaagctggaactggcagagaagaaggctgctgatgctgaggctgaggtggcctccttgaaccgtaggatccagctggttgaagaagagctggaccgtgctcaggagcgcctggccactgccctgcaaaagctggaagaagctgaaaaagctgctgatgagagtgagagaggtatgaaggttattgaaaaccgggccttaaaagatgaagaaaagatggaactccaggaaatccaactcaaagaagctaagcacattgcagaagaggcagataggaagtatgaagaggtggctcgtaagttggtgatcattgaaggagacttggaacgcacagaggaacgagctgagctggcagagtcccgttgccgagagatggatgagcagattagactgatggaccagaacctgaagtgtctgagtgctgctgaagaaaagtactctcaaaaagaagataaatatgaggaagaaatcaagattcttactgataaactcaaggaggcagagacccgtgctgagtttgctgagagatcggtagccaagctggaaaagacaattgatgacctggaagataaactgaaatgcaccaaagaggagcacctctgtacacaaaggatgctggaccagaccctgcttgacctgaatgagatgtagaacgccccagtcccaccctgctgctgctcctccctctgacccagactccgcctgaggccagcctgcgggaagctgacctttaactgagggctgatctttaactggaaggctgctttctcctttcaccaccccctccttccctgtgtctttttcgccaaactgtctctgcctcttcccggagaatccagctgggctagaggctgagcacctttggaaacaacatttaagggaatgtgagcacaatgcataatgtctttaaaaagcatgttgtgatgtacacattttgtaattaccttttttgttgttttgtagcaaccattt

SEQ ID NO: 32880 - DNA, 1088 bp, Homo sapiens
ggaggaggcaggaaccggagcgcgagcagtagctgggtgggcaccatggctgggatcaccaccatcgaggcggtgaagcgcaagatccaggttctgcagcagcaggcagatgatgcagaggagcgagctgagcgcctccagcgagaagttgagggagaaaggcgggcccgggaacaggctgaggctgaggtggcctccttgaaccgtaggatccagctggttgaagaagagctggaccgtgctcaggagcgcctggccactgccctgcaaaagctggaagaagctgaaaaagctgctgatgagagtgagagaggtatgaaggttattgaaaaccgggccttaaaagatgaagaaaagatggaactccaggaaatccaactcaaagaagctaagcacattgcagaagaggcagataggaagtatgaagaggtggctcgtaagttggtgatcattgaaggagacttggaacgcacagaggaacgagctgagctggcagagtctaagtgttctgagctggaggaggagctgaagaatgtcaccaacaacctcaagtctcttgaggctcaggcggagaagtactctcaaaaagaagataaatatgaggaagaaatcaagattcttactgataaactcaaggaggcagagacccgtgctgagtttgctgagagatcggtagccaagctggaaaagacaattgatgacctggaagagcgtctctacagccaacttgagcgaaaccgcctgctttctaatgagctgaagctaacgctgcatgatctgtgtgactgatgggcagggctcaatgatgcccattaaactgagcttactgctcacaccactgacctggaccccaacaaaaagctgattgtctttttaaaagttattattttgccctgagcaaattgcattttaattggggcagttagaatgttgatttcctaacagcattgtgaagttgaccattgtgaagtttctgtccctttagaagagattatgggtgaagaagggaggggcctgagagattatagtgagaaaacttgcgagaattttgttttccacccttatttgctgctctttcacttgggcac

SEQ ID NO: 32881 - DNA, 1771 bp, Homo sapiens
atggctgggatcaccaccatcgaggcggtgaagcgcaagatccaggttctgcagcagcaggcagatgatgcagaggagcgagctgagcgcctccagcgagaagttgagggagaaaggcgggcccgggaacaggctgaggctgaggtggcctccttgaaccgtaggatccagctggttgaagaagagctggaccgtgctcaggagcgcctggccactgccctgcaaaagctggaagaagctgaaaaagctgctgatgagagtgagagaggtatgaaggttattgaaaaccgggccttaaaagatgaagaaaagatggaactccaggaaatccaactcaaagaagctaagcacattgcagaagaggcagataggaagtatgaagaggtggctcgtaagttggtgatcattgaaggagacttggaacgcacagaggaacgagctgagctggcagagtcccgttgccgagagatggatgagcagattagactgatggaccagaacctgaagtgtctgagtgctgctgaagaaaagtactctcaaaaagaagataaatatgaggaagaaatcaagattcttactgataaactcaaggaggcagagacccgtgctgagtttgctgagagatcggtagccaagctggaaaagacaattgatgacctggaagatgagctctatgcccagaaactgaagtacaaggccattagcgaggagctggaccacgccctcaatgacatgacctctatataaactgaaatgcaccaaagaggagcacctctgtacacaaaggatgctggaccagaccctgcttgacctgaatgagatgtagaacgccccagtcccaccctgctgctgctcctccctctgacccagactccgcctgaggccagcctgcgggaagctgacctttaactgagggctgatctttaactggaaggctgctttctcctttcaccaccccctccttccctgtgtctttttcgccaaactgtctctgcctcttcccggagaatccagctgggctagaggctgagcacctttggaaacaacatttaagggaatgtgagcacaatgcataatgtctttaaaaagcatgttgtgatgtacacattttgtaattaccttttttgttgttttgtagcaaccatttgtaaaacattccaaataattccacagtcctgaagcagcaatcgaatccctttctcacttttggaaggtgacttttcaccttaatgcatattcccctctccatagaggagaggaaaaggtgtaggcctgccttaccgagagccaaacagagcccagggagactccgctgtgggaaacctcattgttctgtacaaagtactagctaaaccagaaaggtgattccaggaggagttagccaaacaacaacaaaaacaaaaaatgtgctgttcaagttttcagctttaagatatctttggataatgttatttctattttttatttttttcattagaagttaccaaattaagatggtaagacctctgagaccaaaattttgtcccatctctaccccctcacaactgcttacagaatggatcatgtcccccttatgttgaggtgaccacttaattgctttcctgcctccttgaaagaaagaaagaaagaagactgtgtttttgccactgatttagccatgtgaaactcatctcattacccttttctgggtttgaagctgctgtctctagaagtgccatctcaattgtgctttgtatcagtcagtgctggagaaatcttgaatagcttatgt

SEQ ID NO: 32882 - DNA, 2108 bp, Homo sapiens
gcaggcggaagtaagggtgagaggaggctgcaacgccgagcggaggaggcaggaaccggagcgcgagcagtagctgggtgggcaccatggctgggatcaccaccatcgaggcggtgaagcgcaagatccaggttctgcagcagcaggcagatgatgcagaggagcgagctgagcgcctccagcgagaagttgagggagaaaggcgggcccgggaacaggctgaggctgaggtggcctccttgaaccgtaggatccagctggttgaagaagagctggaccgtgctcaggagcgcctggccactgccctgcaaaagctggaagaagctgaaaaagctgctgatgagagtgagagaggtatgaaggttattgaaaaccgggccttaaaagatgaagaaaagatggaactccaggaaatccaactcaaagaagctaagcacattgcagaagaggcagataggaagtatgaagaggtggctcgtaagttggtgatcattgaaggagacttggaacgcacagaggaacgagctgagctggcagagtctaagtgttctgagctggaggaggagctgaagaatgtcaccaacaacctcaagtctcttgaggctcaggcggagaagtactctcaaaaagaagataaatatgaggaagaaatcaagattcttactgataaactcaaggaggcagagacccgtgctgagtttgctgagagatcggtagccaagctggaaaagacaattgatgacctggaagataaactgaaatgcaccaaagaggagcacctctgtacacaaaggatgctggaccagaccctgcttgacctgaatgagatgtagaacgccccagtcccaccctgctgctgctcctccctctgacccagactccgcctgaggccagcctgcgggaagctgacctttaactgagggctgatctttaactggaaggctgctttctcctttcaccaccccctccttccctgtgtctttttcgccaaactgtctctgcctcttcccggagaatccagctgggctagaggctgagcacctttggaaacaacatttaagggaatgtgagcacaatgcataatgtctttaaaaagcatgttgtgatgtacacattttgtaattaccttttttgttgttttgtagcaaccatttgtaaaacattccaaataattccacagtcctgaagcagcaatcgaatccctttctcacttttggaaggtgacttttcaccttaatgcatattcccctctccatagaggagaggaaaaggtgtaggcctgccttaccgagagccaaacagagcccagggagactccgctgtgggaaacctcattgttctgtacaaagtactagctaaaccagaaaggtgattccaggaggagttagccaaacaacaacaaaaacaaaaaatgtgctgttcaagttttcagctttaagatatctttggataatgttatttctattttttatttttttcattagaagttaccaaattaagatggtaagacctctgagaccaaaattttgtcccatctctaccccctcacaactgcttacagaatggatcatgtcccccttatgttgaggtgaccacttaattgctttcctgcctccttgaaagaaagaaagaaagaagactgtgtttttgccactgatttagccatgtgaaactcatctcattacccttttctgggtttgaagctgctgtctctagaagtgccatctcaattgtgctttgtatcagtcagtgctggagaaatcttgaatagcttatgtacaaaactttttaaattttatattattttgaaactttgctttgggtttgtggcaccctggccaccccatctggctgtgacagcctctgcagtccgtgggctggcagtttgttgatcttttaagtttccttccctacccagtccccattttctggtaaggtttctaggaggtctgttaggtgtacatcctgcagcttattggcttaaaatgtactctccttttatgtggtctctttggggccgattgggagaaagagaaatcaatagtgcaactgttttgatactgaatattgacaagtgtctttttgaaataaagaaccagtccctccaa

SEQ ID NO: 32883 - DNA, 2010 bp, Homo sapiens
aggctgcaacgccgagcggaggaggcaggaaccggagcgcgagcagtagctgggtgggcaccatggctgggatcaccaccatcgaggcggtgaagcgcaagatccaggttctgcagcagcaggcagatgatgcagaggagcgagctgagcgcctccagcgagaagttgagggagaaaggcgggcccgggaacagcgcctggccactgccctgcaaaagctggaagaagctgaaaaagctgctgatgagagtgagagaggtatgaaggttattgaaaaccgggccttaaaagatgaagaaaagatggaactccaggaaatccaactcaaagaagctaagcacattgcagaagaggcagataggaagtatgaagaggtggctcgtaagttggtgatcattgaaggagacttggaacgcacagaggaacgagctgagctggcagagtcccgttgccgagagatggatgagcagattagactgatggaccagaacctgaagtgtctgagtgctgctgaagaaaagtactctcaaaaagaagataaatatgaggaagaaatcaagattcttactgataaactcaaggaggcagagacccgtgctgagtttgctgagagatcggtagccaagctggaaaagacaattgatgacctggaagataaactgaaatgcaccaaagaggagcacctctgtacacaaaggatgctggaccagaccctgcttgacctgaatgagatgtagaacgccccagtcccaccctgctgctgctcctccctctgacccagactccgcctgaggccagcctgcgggaagctgacctttaactgagggctgatctttaactggaaggctgctttctcctttcaccaccccctccttccctgtgtctttttcgccaaactgtctctgcctcttcccggagaatccagctgggctagaggctgagcacctttggaaacaacatttaagggaatgtgagcacaatgcataatgtctttaaaaagcatgttgtgatgtacacattttgtaattaccttttttgttgttttgtagcaaccatttgtaaaacattccaaataattccacagtcctgaagcagcaatcgaatccctttctcacttttggaaggtgacttttcaccttaatgcatattcccctctccatagaggagaggaaaaggtgtaggcctgccttaccgagagccaaacagagcccagggagactccgctgtgggaaacctcattgttctgtacaaagtactagctaaaccagaaaggtgattccaggaggagttagccaaacaacaacaaaaacaaaaaatgtgctgttcaagttttcagctttaagatatctttggataatgttatttctattttttatttttttcattagaagttaccaaattaagatggtaagacctctgagaccaaaattttgtcccatctctaccccctcacaactgcttacagaatggatcatgtcccccttatgttgaggtgaccacttaattgctttcctgcctccttgaaagaaagaaagaaagaagactgtgtttttgccactgatttagccatgtgaaactcatctcattacccttttctgggtttgaagctgctgtctctagaagtgccatctcaattgtgctttgtatcagtcagtgctggagaaatcttgaatagcttatgtacaaaactttttaaattttatattattttgaaactttgctttgggtttgtggcaccctggccaccccatctggctgtgacagcctctgcagtccgtgggctggcagtttgttgatcttttaagtttccttccctacccagtccccattttctggtaaggtttctaggaggtctgttaggtgtacatcctgcagcttattggcttaaaatgtactctccttttatgtggtctctttggggccgattgggagaaagagaaatcaatagtgcaactgttttgatactgaatattgacaagtgtctttttgaaataaagaaccagtccctcc

SEQ ID NO: 32884 - DNA, 1523 bp, Homo sapiens
gttcccccaggagaacaatgatggggtggagggagctggaaagaccatattaggaacaaaaggtggagctatgagcacagataaagactcaagtctggggacctcctggtcactcaggcagcagccccttctttcttgccccagtctccagttctccagtgttcacaggtgagcctaccaacagccactgctcatgatggaggccatcaagaaaaagatgcagatgctgaagttagacaaggagaatgctctggatcgggcagagcaagctgaagctgagcagaagcaggcagaagaaagaagtaaacagctggaggatgagctggcagccatgcagaagaagctgaaagggacagaggatgagctggacaagtattctgaagctttgaaggatgcccaggagaagctggaactggcagagaagaaggctgctgatgctgaggctgaggtggcctccttgaaccgtaggatccagctggttgaagaagagctggaccgtgctcaggagcgcctggccactgccctgcaaaagctggaagaagctgaaaaagctgctgatgagagtgagagaggtatgaaggttattgaaaaccgggccttaaaagatgaagaaaagatggaactccaggaaatccaactcaaagaagctaagcacattgcagaagaggcagataggaagtatgaagaggtggctcgtaagttggtgatcattgaaggagacttggaacgcacagaggaacgagctgagctggcagagtctaagtgttctgagctggaggaggagctgaagaatgtcaccaacaacctcaagtctcttgaggctcaggcggagaagtactctcaaaaagaagataaatatgaggaagaaatcaagattcttactgataaactcaaggaggcagagacccgtgctgagtttgctgagagatcggtagccaagctggaaaagacaattgatgacctggaagatgagctctatgcccagaaactgaagtacaaggccattagcgaggagctggaccacgccctcaatgacatgacctctatataattatcaccgtttctgctctgttctggatctgccccctttactcctcggggaacccaaggccccactctcgctctggattccatttgggtcagcctggctggtccccaaggcattaggatgggggagcaaaaagcaacttatgtattttcttccacccccaccccaaattaaaatgttaagctgctggaaacctcatgccaccctgcatttgtgtcattgacaaagctgttgctgtccctaagaaggagccttgggggtgtgatgtggggaagagctattgtaggctccccctcctctgacttatgtaatcaaagccacttttgtgtgtgtctattttttcttgacatttaaactcagctgatctgattctaccagagtgatggatttagtacaggttactcaggatagtaattttagttatactcctcaagctgaacaagattaaattccttatttccaggttcttaaatca

SEQ ID NO: 32885 - DNA, 1115 bp, Homo sapiens
gggtgggcaccatggctgggatcaccaccatcgaggcggtgaagcgcaagatccaggttctgcagcagcaggcagatgatgcagaggagcgagctgagcgcctccagcgagaagttgagggagaaaggcgggcccgggaacaggctgaggctgaggtggcctccttgaaccgtaggatccagctggttgaagaagagctggaccgtgctcaggagcgcctggccactgccctgcaaaagctggaagaagctgaaaaagctgctgatgagagtgagagaggtatgaaggttattgaaaaccgggccttaaaagatgaagaaaagatggaactccaggaaatccaactcaaagaagctaagcacattgcagaagaggcagataggaagtatgaagaggtggctcgtaagttggtgatcattgaaggagacttggaacgcacagaggaacgagctgagctggcagagtcccgttgccgagagatggatgagcagattagactgatggaccagaacctgaagtgtctgagtgctgctgaagaaaagtactctcaaaaagaagataaatatgaggaagaaatcaagattcttactgataaactcaaggaggcagagacccgtgctgagtttgctgagagatcggtagccaagctggaaaagacaattgatgacctggaagagcgtctctacagccaacttgagcgaaaccgcctgctttctaatgagctgaagctaacgctgcatgatctgtgtgactgatgggcagggctcaatgatgcccattaaactgagcttactgctcacaccactgacctggaccccaacaaaaagctgattgtctttttaaaagttattattttgccctgagcaaattgcattttaattggggcagttagaatgttgatttcctaacagcattgtgaagttgaccattgtgaagtttctgtccctttagaagagattatgggtgaagaagggaggggcctgagagattatagtgagaaaacttgcgagaattttgttttccacccttatttgctgctctttcacttgggcactgactgtaggatatgttcccttgcatggatgtttttaacaataaaaggactgacttgacaa

SEQ ID NO: 32886 - DNA, 3131 bp, Homo sapiens
cgccgagcggaggaggcaggaaccggagcgcgagcagtagctgggtgggcaccatggctgggatcaccaccatcgaggcggtgaagcgcaagatccaggttctgcagcagcaggcagatgatgcagaggagcgagctgagcgcctccagcgagaagttgagggagaaaggcgggcccgggaacaggctgaggctgaggtggcctccttgaaccgtaggatccagctggttgaagaagagctggaccgtgctcaggagcgcctggccactgccctgcaaaagctggaagaagctgaaaaagctgctgatgagagtgagagaggtatgaaggttattgaaaaccgggccttaaaagatgaagaaaagatggaactccaggaaatccaactcaaagaagctaagcacattgcagaagaggcagataggaagtatgaagaggtggctcgtaagttggtgatcattgaaggagacttggaacgcacagaggaacgagctgagctggcagagtcccgttgccgagagatggatgagcagattagactgatggaccagaacctgaagtgtctgagtgctgctgaagaaaagtactctcaaaaagaagataaatatgaggaagaaatcaagattcttactgataaactcaaggaggcagagacccgtgctgagtttgctgagagatcggtagccaagctggaaaagacaattgatgacctggaagataaactgaaatgcaccaaagaggagcacctctgtacacaaaggatgctggaccagaccctgcttgacctgaatgagatgtagaacgccccagtcccaccctgctgctgctcctccctctgacccagactccgcctgaggccagcctgcgggaagctgacctttaactgagggctgatctttaactggaaggctgctttctcctttcaccaccccctccttccctgtgtctttttcgccaaactgtctctgcctcttcccggagaatccagctgggctagaggctgagcacctttggaaacaacatttaagggaatgtgagcacaatgcataatgtctttaaaaagcatgttgtgatgtacacattttgtaattaccttttttgttgttttgtagcaaccatttgtaaaacattccaaataattccacagtcctgaagcagcaatcgaatccctttctcacttttggaaggtgacttttcaccttaatgcatattcccctctccatagaggagaggaaaaggtgtaggcctgccttaccgagagccaaacagagcccagggagactccgctgtgggaaacctcattgttctgtacaaagtactagctaaaccagaaaggtgattccaggaggagttagccaaacaacaacaaaaacaaaaaatgtgctgttcaagttttcagctttaagatatctttggataatgttatttctattttttatttttttcattagaagttaccaaattaagatggtaagacctctgagaccaaaattttgtcccatctctaccccctcacaactgcttacagaatggatcatgtcccccttatgttgaggtgaccacttaattgctttcctgcctccttgaaagaaagaaagaaagaagactgtgtttttgccactgatttagccatgtgaaactcatctcattacccttttctgggtttgaagctgctgtctctagaagtgccatctcaattgtgctttgtatcagtcagtgctggagaaatcttgaatagcttatgtacaaaactttttaaattttatattattttgaaactttgctttgggtttgtggcaccctggccaccccatctggctgtgacagcctctgcagtccgtgggctggcagtttgttgatcttttaagtttccttccctacccagtccccattttctggtaaggtttctaggaggtctgttaggtgtacatcctgcagcttattggcttaaaatgtactctccttttatgtggtctctttggggccgattgggagaaagagaaatcaatagtgcaactgttttgatactgaatattgacaagtgtctttttgaaataaagaaccagtccctccaaccctcagacctatttgacttttatttattaaaactaaatgtgctttctccacagaagctatgaggtttgggttaaaaatagcatctttgtgggtggtagcaacaggatttattctttattattattatttttgagatgaagtttcattcttgttgcctgggctggagcgtaatggctcgatctcggctcactgcaacctccgcctcctggttcaagagattctcctgcctcagcctcccgagtagctgggattacaggcacctgccaccatgcccgggtaattttttatattttaagtagagacagggcttcaccatgttggccaggctggtctcgaactcctgaccttcaggtgatccacctgcctcagcttcccaaaatgctgggattacgggcgtgagccaccgcacccagctggagcaacaggatttaatatagagcaaatgtttagttttatcatctgtaaaatggagataagtattgtcagagtaaacatgaagattagaaagaacacttaatgtgctgggccttttataggttaacactgacatctcaggctgaactatatacattttccttcacaaccatatcaatccttataaactatggatttatgctccttaaaacaatatataatgctgatcactactataaatgcgtggttttaaccaactgtactgaaacagctttgagtttatattctgtttggatatttggagaaaacaacaagtgctctcaagagtatttgcttagaggccggctgtgtgagtggataactttgaaagctgcttttgagacgccagtgtctggcatttcctgcattctggcctggaggccggacgtgaatctgacttctagtaaaaatacacggttcccttgacaaagtcgagctgtttatcccagagactgcacaattttccgttgataggcatggaccaatgctaactggaaatcattgcaaaaagtttttttgtcgggcggagggtgtggtgttaagataaacagtgtgcaacagaagaaattaaaactggaagaaattaaagggttttttttaga

SEQ ID NO: 32887 - DNA, 587 bp, Homo sapiens
gagaaatttcccatgtgggaatccggctggatccctgtgagggaagacccttggagaacgcagcctggagttctggtaaaaagccctagaagaggagaggactcctgtggactgcaggctgcttcctggcagaagtttcctctcttaccctcagtctaaagccttagtttcaattctgccaggcaaggtggggaactataagtcttctcttctggagcccacgatggagcctgccagggagacaagttattcttctgttctggacatccaagggtgactttaaggaggatgcctggaggacatggggagaagtctccagttctccagtgttcacaggtgagcctaccaacagccactgctcatgatggaggccatcaagaaaaagatgcagatgctgaagttagacaaggagaatgctctggatcgggcagagcaagctgaagctgagcagaagcaggcagaagaaagaagtaaacagctggaggatgagctggcagccatgcagaagaagctgaaagggacagaggatgagctggacaagtattctgaagctttgaaggatgcccaggagaagctggaactggcag

SEQ ID NO: 32888 - DNA, 2645 bp, Homo sapiens
tttccagcagctgtggccagcggtgccgacgtcaggccctcccccagcggtgctgacgtcggcggtccggccgggtgacctcatcgccccgacggcagccggcccggggggcggggagaggcgggggcggcccccgcgcaggcaaaggcttggggggccggggcgcggctgtgcagctctcgccggagccgagcccagccgagcgtccgccgctgcccgtgcgcctctgcgcctccgcgccatggccggcctcaactccctggaggcggtgaaacgcaagatccaggccctgcagcagcaggcggacgaggcggaagaccgcgcgcagggcctgcagcgggagctggacggcgagcgcgagcggcgcgagaaagctgaaggtgatgtggccgccctcaaccgacgcatccagctcgttgaggaggagttggacagggctcaggaacgactggccacggccctgcagaagctggaggaggcagaaaaagctgcagatgagagtgagagaggaatgaaggtgatagaaaaccgggccatgaaggatgaggagaagatggagattcaggagatgcagctcaaagaggccaagcacattgcggaagaggctgaccgcaaatacgaggaggtagctcgtaagctggtcatcctggagggtgagctggagagggcagaggagcgtgcggaggtgtctgaactaaaatgtggtgacctggaagaagaactcaagaatgttactaacaatctgaaatctctggaggctgcatctgaaaagtattctgaaaaggaggacaaatatgaagaagaaattaaacttctgtctgacaaactgaaagaggctgagacccgtgctgaatttgcagagagaacggttgcaaaactggaaaagacaattgatgacctggaagagaaacttgcccaggccaaagaagagaacgtgggcttacatcagacactggatcagacactaaacgaacttaactgtatataagcaaaacagaagagtcttgttccaacagaaactctggagctccgtgggtctttctcttctcttgtaagaagttccttttgttattgccatcttcgctttgctggaaatgtcaagcaaattatgaatacatgaccaaatattttgtatcggagaagctttgagcaccagttaaatctcattccttccctttttttttcaaatggcaccagctttttcagctctcttattttttccttaagtagcatttattcctaaggtaggcagggtatttcctagtaagcatactttcttaagacggaggccatttggttcctgggagaataggcagccccacactttgaagaatacagaccccagtatctagtcgtggatataattaaaacgctgaagaccataaccttttgggtcaactgttggtcaaactataggagagaccagggaccatcacatgggtagggattttccatccagagccaataaaaggactggtgggggccgggggtggctattgtgggaagtcataacccacagatagatcaacctaagaatcctggcccttctccactctccaccatgcaggacaaacatcttctcaagcagtcaacgtagaatgcttgggaaatagtcataattacccacatatagtaattaatagatggtaattaattgatccttgatgtgatgttcttttgcatatttccttcattctaaagttgttccctggccgggagcgttggctttcgcctgtaatcccaacactttgggaggccaggacagatcacttgaggtcaggagttcgagaccagcccagccaacatggcgaaaccatgtctctactaaaaatacaaaaattatggtgacgcctgcctgtagtcccagctactcgggaggctgaggcaggaggatcgcttgaacccaggaagtggagactgcagtgagccgatatcgcaccacagcgctccagcctggtcgacagagtgagactccatctcaagaaaaaataaaaataaagttgttctctgaagagcaaatgtctcattccagtaatgacccactcagcaggaatatggtggagttcagtccaattcaggtcagccatatccaaaagaccacaagtcattactaagttgagcaaaagagtttttatctattagcagaaagggcctctctggcagcagagattaaaaactggcccaacttcatttccatacttcagggaacagcaaattgaggatttacttatctaggacttgaattccttctttgggaccaagttaataaaagaccaagaaactcctgattaaactggataatgaaggattctgtagacagggctgcacgtatcggctttgtttgacttctcttttctcagttaacatctcagagctagaacattccacattccccagcagcgtgtgggggctgactaaagtttacaattccaactaaaaatcaccctgcttctggcttatctgaatcccttacccaccccaccccaccaccctactcctatttattcagcaccacactacccaggaaatacactagcaaattgtgcaatggaataaaatccacactttagattcttgcaactgtatcatatgtaatagtatcactttttctacattttggtcaaataaatttttacataaactac

SEQ ID NO: 32889 - DNA, 2630 bp, Homo sapiens
ataaggccctctcctccaccctgccaggctcactctgccccacagccacagcccctgactgccgcagcccccacagagcccgccgcgcaccccacgtcccccacgccagcgcccagccatggaggccatcaagaagaaaatgcagatgctgaagttggacaaggagaatgccatcgaccgcgcggagcaggcggaggcggataagaaagccgctgaggacaagtgcaagcaggtggaggaggagctgacgcacctccagaagaaactaaaagggacagaggacgagctggataaatattccgaggacctgaaggacgcgcaggagaagctggagctcacggagaagaaggcctccgacgctgaaggtgatgtggccgccctcaaccgacgcatccagctcgttgaggaggagttggacagggctcaggaacgactggccacggccctgcagaagctggaggaggcagaaaaagctgcagatgagagtgagagaggaatgaaggtgatagaaaaccgggccatgaaggatgaggagaagatggagattcaggagatgcagctcaaagaggccaagcacattgcggaagaggctgaccgcaaatacgaggaggtagctcgtaagctggtcatcctggagggtgagctggagagggcagaggagcgtgcggaggtgtctgaactaaaatgtggtgacctggaagaagaactcaagaatgttactaacaatctgaaatctctggaggctgcatctgaaaagtattctgaaaaggaggacaaatatgaagaagaaattaaacttctgtctgacaaactgaaagaggctgagacccgtgctgaatttgcagagagaacggttgcaaaactggaaaagacaattgatgacctggaagagaaacttgcccaggccaaagaagagaacgtgggcttacatcagacactggatcagacactaaacgaacttaactgtatataagcaaaacagaagagtcttgttccaacagaaactctggagctccgtgggtctttctcttctcttgtaagaagttccttttgttattgccatcttcgctttgctggaaatgtcaagcaaattatgaatacatgaccaaatattttgtatcggagaagctttgagcaccagttaaatctcattccttccctttttttttcaaatggcaccagctttttcagctctcttattttttccttaagtagcatttattcctaaggtaggcagggtatttcctagtaagcatactttcttaagacggaggccatttggttcctgggagaataggcagccccacactttgaagaatacagaccccagtatctagtcgtggatataattaaaacgctgaagaccataaccttttgggtcaactgttggtcaaactataggagagaccagggaccatcacatgggtagggattttccatccagagccaataaaaggactggtgggggccgggggtggctattgtgggaagtcataacccacagatagatcaacctaagaatcctggcccttctccactctccaccatgcaggacaaacatcttctcaagcagtcaacgtagaatgcttgggaaatagtcataattacccacatatagtaattaatagatggtaattaattgatccttgatgtgatgttcttttgcatatttccttcattctaaagttgttccctggccgggagcgttggctttcgcctgtaatcccaacactttgggaggccaggacagatcacttgaggtcaggagttcgagaccagcccagccaacatggcgaaaccatgtctctactaaaaatacaaaaattatggtgacgcctgcctgtagtcccagctactcgggaggctgaggcaggaggatcgcttgaacccaggaagtggagactgcagtgagccgatatcgcaccacagcgctccagcctggtcgacagagtgagactccatctcaagaaaaaataaaaataaagttgttctctgaagagcaaatgtctcattccagtaatgacccactcagcaggaatatggtggagttcagtccaattcaggtcagccatatccaaaagaccacaagtcattactaagttgagcaaaagagtttttatctattagcagaaagggcctctctggcagcagagattaaaaactggcccaacttcatttccatacttcagggaacagcaaattgaggatttacttatctaggacttgaattccttctttgggaccaagttaataaaagaccaagaaactcctgattaaactggataatgaaggattctgtagacagggctgcacgtatcggctttgtttgacttctcttttctcagttaacatctcagagctagaacattccacattccccagcagcgtgtgggggctgactaaagtttacaattccaactaaaaatcaccctgcttctggcttatctgaatcccttacccaccccaccccaccaccctactcctatttattcagcaccacactacccaggaaatacactagcaaattgtgcaatggaataaaatccacactttagattcttgcaactgtatcatatgtaatagtatcactttttctacattttggtcaaataaatttttacataaactac

SEQ ID NO: 32890 - DNA, 1542 bp, Homo sapiens
actctgccccacagccacagcccctgactgccgcagcccccacagagcccgccgcgcaccccacgtcccccacgccagcgcccagccatggaggccatcaagaagaaaatgcagatgctgaagttggacaaggagaatgccatcgaccgcgcggagcaggcggaggcggataagaaagccgctgaggacaagtgcaagcaggtggaggaggagctgacgcacctccagaagaaactaaaagggacagaggacgagctggataaatattccgaggacctgaaggacgcgcaggagaagctggagctcacggagaagaaggcctccgacgctgaaggtgatgtggccgccctcaaccgacgcatccagctcgttgaggaggagttggacagggctcaggaacgactggccacggccctgcagaagctggaggaggcagaaaaagctgcagatgagagtgagagaggaatgaaggtgatagaaaaccgggccatgaaggatgaggagaagatggagattcaggagatgcagctcaaagaggccaagcacattgcggaagaggctgaccgcaaatacgaggaggtagctcgtaagctggtcatcctggagggtgagctggagagggcagaggagcgtgcggaggtgtctgaactaaaatgtggtgacctggaagaagaactcaagaatgttactaacaatctgaaatctctggaggctgcatctgaaaagtattctgaaaaggaggacaaatatgaagaagaaattaaacttctgtctgacaaactgaaagaggctgagacccgtgctgaatttgcagagagaacggttgcaaaactggaaaagacaattgatgacctggaagagaaacttgcccaggccaaagaagagaacgtgggcttacatcagacactggatcagacactaaacgaacttaactgtatataagcaaaacagaagagtcttgttccaacagaaactctggagctccgtgggtctttctcttctcttgtaagaagttccttttgttattgccatcttcgctttgctggaaatgtcaagcaaattatgaatacatgaccaaatattttgtatcggagaagctttgagcaccagttaaatctcattccttccctttttttttcaaatggcaccagctttttcagctctcttattttttccttaagtagcatttattcctaaggtaggcagggtatttcctagtaagcatactttcttaagacggaggccatttggttcctgggagaataggcagccccacactttgaagaatacagaccccagtatctagtcgtggatataattaaaacgctgaagaccataaccttttgggtcaactgttggtcaaactataggagagaccagggaccaccctactcctatttattcagcaccacactacccaggaaatacactagcaaattgtgcaatggaataaaatccacactttagattcttgcaactgtatcatatgtaatagtatcactttttctacattttggtcaaataaatttttacataaactac

SEQ ID NO: 32891 - DNA, 714 bp, Homo sapiens
atttaagtcaagggccggctggcaaccccagcaagctgtcctgtgagccgccagcatggatgacatctacaaggctgcggtagagcagctgacagaagagcagaaaaatgagttcaaggcagccttcgacatcttcgtgctgggcgctgaggatggctgcatcagcaccaaggagctgggcaaggtgatgaggatgctgggccagaaccccacccctgaggagctgcaggagatgatcgatgaggtggacgaggacggcagcggcacggtggactttgatgagttcctggtcatgatggttcggtgcatgaaggacgacagcaaagggaaatctgaggaggagctgtctgacctcttccgcatgtttgacaaaaatgctgatggctacatcgacctggatgagctgaagataatgctgcaggctacaggcgagaccatcacggaggacgacatcgaggagctcatgaaggacggagacaagaacaacgacggccgcatcgactatgatgagttcctggagttcatgaagggtgtggagtagatgctgaccttcacccagagctgcctatgcccagcctccaactccagctgagtcctggggttggggagggggtcggggtcccaggacctgagcctggccatgtcctcaaccccaaatcccccgactccctccccagatctgtcctgggggatgcaaataaagcctgctctccc

SEQ ID NO: 32892 - DNA, 710 bp, Homo sapiens
aaatcccgggggctagagcaggccaggtcatctttgggtggtggagtgcaaaggaggcgacctgcaacagaggagtcccggtcaccagcaaccatgacggaccagcaggctgaggccaggtcctacctcagcgaagagatgatcgctgagttcaaggctgcctttgacatgtttgatgctgatggtggtggggacatcagcgtcaaggagttgggcacggtgatgaggatgctgggccagacacccaccaaggaggagctggacgccatcatcgaggaggtggatgaggacggcagcggcaccatcgacttcgaggagttcttggtcatgatggtgcgccagatgaaagaggacgcgaaagggaagagcgaggaggagctggccgagtgcttccgcatcttcgacaggaatgcagacggctacatcgacccggaggagctggctgagattttcagggcctccggggagcacgtgacggacgaggagatcgaatctctgatgaaagacggcgacaagaacaacgacggccgcattgacttcgacgagttcctgaagatgatggagggcgtgcagtaaggagtggacagtcgcctctaccaagatcgcgtgtccctagggtgtgggagactccgccctgccgggtccccaccagggaggcgcgaccccttgtgggtctttgtctggaaggaataaaagcaaatgttccaaaa

SEQ ID NO: 32893 - DNA, 780 bp, Homo sapiens
gggcccttggctccaggagggacttgggaagcctgggtcggcctgagggagtcccaggcctgccgcagagtcatcccagtccggccagtgttcacaggcttgcacaatctgatttgaacctcacacatgggaagtaggcaaacagggaaactgaggaccagagaggacggaccagcaggctgaggccaggtcctacctcagcgaagagatgatcgctgagttcaaggctgcctttgacatgtttgatgctgatggtggtggggacatcagcgtcaaggagttgggcacggtgatgaggatgctgggccagacacccaccaaggaggagctggacgccatcatcgaggaggtggatgaggacggcagcggcaccatcgacttcgaggagttcttggtcatgatggtgcgccagatgaaagaggacgcgaaagggaagagcgaggaggagctggccgagtgcttccgcatcttcgacaggaatgcagacggctacatcgacccggaggagctggctgagattttcagggcctccggggagcacgtgacggacgaggagatcgaatctctgatgaaagacggcgacaagaacaacgacggccgcattgacttcgacgagttcctgaagatgatggagggcgtgcagtaaggagtggacagtcgcctctaccaagatcgcgtgtccctagggtgtgggagactccgccctgccgggtccccaccagggaggcgcgaccccttgtgggtctttgtctggaaggaataaaagcaaatgttccaaaa

SEQ ID NO: 32894 - DNA, 1750 bp, Homo sapiens
aaactgccccagcaggccccagggaaggacggcaggctgggatgccgtccccacggactccctctcctctcttagccctggcactaagtgcgttcctctggcaaagaagaaaataatttctgtccctcgccatctgctgcatgggaagatgggaatggagtgagcacggcaagacagatgctgcgtcctgcaatggccccaccatggaccctcgtcatccaaccgaagtcgcccccttgcctggctttatcttcactatattgtgaggctgcttcattgaatcttatcccagactttaacttttccatgactgccgtgattttgccatgttgttcacacagagtgtgtctgaccttagctgcattgccaccgcctttgggaccctgagccttcttgccagcactgtcactcccagaggttgcttccactttccccttttccagaaccacttgttcctttgggtggcatcctggaaacttgctgttgaagtctcaactgcctcagtggttcttcaagggaggtcctcaggccaccacctgagaaattgttagaaatgcaagtttctgggctgcatcccagacctgctgaatcagaaatttggggaggagcacggactttggcaccagagagctgggtgcagctctcagctctgcgtcatccttgctgtgggaccctgggttattgctgagccactgtgagtctgtttcctcgtgggtatagtaggtctgcagtctacggcgaggcacaggccagcccagctccacgaggactgaacaaggtgctgtctcactgccaccatgccggaagtcgagagaaaacccaagatcactgcctcccgcaaactcttgctgaagagcctgatgctggccaaggccaaggaatgctgggagcaggagcacgaggagcgcgaggctgagaaggtgcgctacctggcagagcgcatccccacgctgcagacccgtggcctgtccctcagtgccctgcaggacctgtgccgggagctgcacgccaaggtggaggtggtggatgaggagcgatacgacattgaggccaaatgcctccacaacaccagggagattaaggacctgaagctgaaggtgatggacctccgtgggaagttcaagcgcccgcccctgcgtcgagtccgtgtctcggctgacgccatgctccgggccctgctgggctccaagcacaaggtgtccatggatctgcgggccaacctcaagtctgtgaagaaggaagacacagagaaggagcggcctgtggaggtgggtgactggaggaagaacgtggaggccatgtctggcatggaaggccggaagaagatgtttgatgccgccaagtctccgacctcacaatagaggccagcttgctgtgctgcgctctgagctcctgcttcatgcttcttctccaacccagctcactcacctctctgcctgtgtctggagcatcccttcccacctctcccccacttcttccctccagcctgcatgccctcctctggaactgggattaaacagatacccaagaggcaggaaaaacgcgagtgtctgaagacctcaccctggcagggtgggcttctatccacccatgaggcacctggggcttctcagccaccccgtggtgtaacaagtggaggaggaggagggggtgagaacacctttcctccagccctgtgccacactccttctatgtgtgtacagtgtccacaggcatcacaccttcttcattaaaaacccagtttcctggt

SEQ ID NO: 32895 - DNA, 6142 bp, Homo sapiens
ctcggctctgcccctcacagtctgcagtctacggcgaggcacaggccagcccagctccacgaggactgaacaaggtgctgtctcactgccaccatgccggaagtacagagaaaacccaagatcactgcctcccgcaaactcttgctgaagagcctgatgctggccaaggccaaggaatgctgggagcaggagcacgaggagcgcgaggctgagaaggtgcgctacctggcagagcgcatccccacgctgcagacccgtggcctgtccctcagtgccctgcaggacctgtgccgggagctgcacgccaaggtggaggtggtggatgaggagcgatacgacattgaggccaaatgcctccacaacaccagggagattaaggacctgaagctgaaggtgatggacctccgtgggaagttcaagcgcccgcccctgcgtcgagtccgtgtctcggctgacgccatgctccgggccctgctgggctccaagcacaaggtgtccatggatctgcgggccaacctcaagtctgtgaagaaggaagacacagagaaggagcggcctgtggaggtgggtgactggaggaagaacgtggaggccatgtctggcatggaaggccggaagaagatgtttgatgccgccaagtctccgacctcacaatagaggccagcttgctgtgctgcgctctgagctcctgcttcatgcttcttctccaacccagctcactcacctctctgcctgtgtctggagcatcccttcccacctctcccccacttcttccctccagcctgcatgccctcctctggaactgggattaaacagatacccaagaggcaggaaaaacgcgagtgtctgaagacctcaccctggcagggtgggcttctatccacccatgaggcacctggggcttctcagccaccccgtggtgtaacaagtggaggaggaggagggggtgagaacacctttcctccagccctgtgccacactccttctatgtgtgtacagtgtccacaggcatcacaccttcttcattaaaaacccagtttcctggtcatttctgcagctctgactgtgagccctgagaagaaagggaagacttggggcttgggaagagagggctgtgctgggctccagtcaccctgtctgcagtccggagctcgggatctgaagggagggctaaggaattggtggctgcttgccagggtcccctggggccccttctgcccagtccctgtgacgtcacactgcacacactcaccacccaggatgctcagctcaccagagccctgacctccgagaaatgaccccgtcctgcccctgactctggccatcagaagaggcctctccattaagagccgcttctcctgccggctttcatactctccttcctctgcaaacctggattaactctccctgatgtgtgctgggttgagaggtcagggcactttcaatccctcacctagtcctgctgcacagggcaggaggcctcacagaagagatacttgcagttccaggcctggccaccaggtgacgccttccttctctcctgggctctcctgtccctccggcctctgctctccccacgttcacccaccctcctcccaattgtttccccttcacactcctgcactggtcctatcccccaggactgattctttcccggagatggggtggccacttatctgtcctctggatcaggtcctttctccatcccactacctcctgggtccaaagcctggtgagagcatagggccttctggggtggaaggggggtctggggcagcctctcttcccccaacatactcactagagtggctcctgtgaagcagagaccaaagttctgacttttctttttccttttttttttttttttgagatggagtctcgctgtgtcacccaggctggagtgcagtgacgcgatctcgactcactgcaacctccgcctcccaggttcaagcgattctcctgcttcaacctcctgagtagctgggattacaggtgcgtgccaccacaccccgctaatttttgtatttttagtagagacagggtttcaccatgttggtcaggctggtctcgaactcctgacctcgtaatctgcccacctcggcctcccaaagttctgggattacaggtgtgagcgaccacatccggtcaagttctgacttttcagggcagtgggatggtgacttctgagctaagcctgcaagggaagtggctgttcccagacctggggtcccttggcttttcgaccaccctagcactggccctaggaggggctgagttatcagagcagcaacccttctacccaccctactgagtccccattctaccttcgaatcccatgtattatcttccataagtgccagaaattggtacaaagtgcagtgccagctgctccccagggcatggtctggctctctgggctgctgggctgccagcccctttcagaaagcatggcagtgggaaccagcaacttgggctaccttaggggaagcagcactctgcccagggttcttgctataaataggtcagtgggcagagaggcagatgtgtgcaaaaagcacaaccccaatcacacacagaaacccgtaggcacggacacacccagtctcaatgcacgaagttggagaacctgacagggctggtccaggccacagaggatggggttaggcttcatgccttcatgcccaggcagccacagaaacccactcttccccgcctcacagggctcctccggttggcctggatccaaagcgatctccttgtttcacctctttccagctcttccctagagcctggccccaagttccagagtcaaatcccagttttgcagtcaactattaacctggggccctggcagattggggtatccacccagtcatgtaaaggcaggagacctgctctgggcctgactcaaagcaaacacgtgggtgcagaagacccatgggaggaggaggtggggcccactcaacacacctaagccagtggccctctaggaggggcagaagagccaaccagagggttcctggaggtcatcgggttcctccttctgcttccaggcagcaacagacctaattcatctcctgtgaggatggagcaagggcgaatataggcatagacatatctggagcgcaaggattgagaggccctgtggacaaggggaaggagagcttgggggtgggagagggatctatggaaggggctgttgtagccaagaatggggcctgggctgggggcctggcctctggagagccctgattctactccagtcttctctcaccatggagacaacaccagtagagctgggagctggggcctgccactgagtaacagctcacacatgtagcacacttatgcgtcaggcaccagcatgtacaccttaatttatttaactttcacaacaaccctaggagaaaggtacagctactattctcatggtacagtggggaaaactgaggcacagagaggttagggacttttcatgatcacacagctaataagtggtggtcccaggattcaacccaagaagtctgttagaatccatactcttatcgactattttaataacagcatttcaataatagtaatatgtgatgttaaatgctttatctgagttatatcattgcattctcacaaaaatggtacatttgttagctcaaatttacagatgaggaaatggaggcctggagagttcaagtagctcactctaagttacagggtttgctagctgcagactggagactagatctcaggtcactctgccttggggttgcccttttctgagatcagactggccttaacagagcccaactttcttggaaggacacagctgggggtcgagggtcctgcatatgcacctggggagtccccacacacccgcaccaaaggggaaacattcaaaggagatgcaggtgacatacagatgggctaaggtgaggccttcctccaacatggggccctggctgagagtggagggatagggtgctacttgggggatatctattactaatcagcacacaatagctgggtgggcaccccctctctctgcagctggtggagatgggcctggtgctcctctctgcttggtaggaatgaccagggcaggatgccacctgctacactcttgcctgtcccagagcccttgggagaccagctgttgctcccacctttccccacagggtgcccggtccccacggcgcaaggaggccaagctcagctgtgtgtctgagcccactcagcagcaggcatgatcagggcagggcccagcgctaagggctgctggggctaaagtgccttgctgaaggaggggcagagttaaacattagccacaatggccccccgcgaagtgagtcatactccccacaagtctctgggctgggcagccgggggcgggggggttagcttcgttccaggtgggtgaccaagctgcggaagcccaggacagttcgctgggaccagtgctaatggcagcttctgctcctgacccccatcaggtctctttcctcagacatccccaaagcttgtctgcctgtgggtctttcattaaaggtgacgggcaagggttttctcttccttccaagacacacttctaggctggcttgtgggtcccctgagacgaaggctgagcagggtgagcctcgaaaaccccatagcactggcccagagcactgcggtcaatgtccgaaggaccagagagggagggtgacttgctcaaggtcacaaacctaactggagctaggaagtaggtccccagactcccagtctgaggaaattggatgtggacagggctttggtctcctggccagaggcaaacgcccagggatctgaacaggctgcccatctctggcctcaactcagcaccccaactggctccagtgccaaccattggcctctctcactggttggcacaggctgggtgagcctggccctttgccctgggttcaggagagaggtatggctttgcctggcagtcaggggaggtgttccaacctgggagcccctgggggaggagcgtgtgtgtgaacgcttgtgcctgttcatcagaaggggtgagcatggtgtgtatgcgtgggcatgcagaatgcagggtgatgacctgtctgcccgccctgagtgtcacagacacctgtgtgtcccctgtactagtgcctcccagatgctcttctcctgactggctctttgtgacctaaatttcaactgctccaccccacaaggaggaaaccagggccacaaatgtagtgagattttcataaagctaaatgtattcagtggaaacgaccttcctctgatctaaaagcatgcatgcctttgttttattactggagtattaaattagcccttacttatggaataggaggacagtaggtggcaattgttttctaatgctcttacttcacaaaataaaatggtggcagcacaatgtcagtatttatattacacaatattattagtttgtaaaaaccgaaagccagggagcttactgccctggattctttagggcgtgggtcttatcacctcattcatttcttcccttcccctaagagtgccacaagcatggcagttgctcagctgagacacatgaatgggaacagaactgaaatatcaggatgtgacctcgagccagctggttggggctggggatccccctggatctccactctgtcctgtccgagaaaggggaagctgccctatgagtcttttttctgggggattccagaggttgaacgtctgttctgaggctcctcagaacctcgagggaggggacgagagagatgaccccttgcccaaccactggctgaaaaatcttgaaattccctgactttgaccagggaattcccagttgtgctaagccctgcctggtggaatgtccctggaggaagtaaccaggacacgcatacgtttttaatgtacgtataaagaatcgtaaagtgaacacccatctgccaaccactcattttaagaactaggatatggcacatacttttgaagcccttatgcgtccctccccaatcacaaccccttcctctccacaaaggtaaatacaatcctcaattttgtgtttgttattctcttggttctcttcataatgttactacgtatttatgaattcctaatacatcattcagttttggatctttttgtaaacctt

SEQ ID NO: 32896 - DNA, 5413 bp, Homo sapiens
ctcggctctgcccctcacagtctgcagtctacggcgaggcacaggccagcccagctccacgaggactgaacaaggtgctgtctcactgccaccatgccggaagtcgagagaaaacccaagatcactgcctcccgcaaactcttgctgaagagcctgatgctggccaaggccaaggaatgctgggagcaggagcacgaggagcgcgaggctgagaaggtgcgctacctggcagagcgcatccccacgctgcagacccgtggcctgtccctcagtgccctgcaggacctgtgccgggagctgcacgccaaggtggaggtggtggatgaggagcgatacgacattgaggccaaatgcctccacaacaccagggagattaaggacctgaagctgaaggtgatggacctccgtgggaagttcaagcgcccgcccctgcgtcgagtccgtgtctcggctgacgccatgctccgggccctgctgggctccaagcacaaggtgtccatggatctgcgggccaacctcaagtctgtgaagaaggaagacacagagaaggagcggcctgtggaggtgggtgactggaggaagaacgtggaggccatgtctggcatggaaggccggaagaagatgtttgatgccgccaagtctccgacctcacaatagaggccagcttgctgtgctgcgctctgagctcctgcttcatgcttcttctccaacccagctcactcacctctctgcctgtgtctggagcatcccttcccacctctcccccacttcttccctccagcctgcatgccctcctctggaactgggattaaacagatacccaagaggcaggaaaaacgcgagtgtctgaagacctcaccctggcagggtgggcttctatccacccatgaggcacctggggcttctcagccaccccgtggtgtaacaagtggaggaggaggagggggtgagaacacctttcctccagccctgtgccacactccttctatgtgtgtacagtgtccacaggcatcacaccttcttcattaaaaacccagtttcctggtcatttctgcagctctgactgtgagccctgagaagaaagggaagacttggggcttgggaagagagggctgtgctgggctccagtcaccctgtctgcagtccggagctcgggatctgaagggagggctaaggaattggtggctgcttgccagggtcccctggggccccttctgcccagtccctgtgacgtcacactgcacacactcaccacccaggatgctcagctcaccagagccctgacctccgagaaatgaccccgtcctgcccctgactctggccatcagaagaggcctctccattaagagccgcttctcctgccggctttcatactctccttcctctgcaaacctggattaactctccctgatgtgtgctgggttgagaggtcagggcactttcaatccctcacctagtcctgctgcacagggcaggaggcctcacagaagagatacttgcagttccaggcctggccaccaggtgacgccttccttctctcctgggctctcctgtccctccggcctctgctctccccacgttcacccaccctcctcccaattgtttccccttcacactcctgcactggtcctatcccccaggactgattctttcccggagatggggtggccacttatctgtcctctggatcaggtcctttctccatcccactacctcctgggtccaaagcctggtgagagcatagggccttctggggtggaaggggggtctggggcagcctctcttcccccaacatactcactagagtggctcctgtgaagcagagaccaaagttctgacttttctttttccttttttttttttttttgagatggagtctcgctgtgtcacccaggctggagtgcagtgacgcgatctcgactcactgcaacctccgcctcccaggttcaagcgattctcctgcttcaacctcctgagtagctgggattacaggtgcgtgccaccacaccccgctaatttttgtatttttagtagagacagggtttcaccatgttggtcaggctggtctcgaactcctgacctcgtaatctgcccacctcggcctcccaaagttctgggattacaggtgtgagcgaccacatccggtcaagttctgacttttcagggcagtgggatggtgacttctgagctaagcctgcaagggaagtggctgttcccagacctggggtcccttggcttttcgaccaccctagcactggccctaggaggggctgagttatcagagcagcaacccttctacccaccctactgagtccccattctaccttcgaatcccatgtattatcttccataagtgccagaaattggtacaaagtgcagtgccagctgctccccagggcatggtctggctctctgggctgctgggctgccagcccctttcagaaagcatggcagtgggaaccagcaacttgggctaccttaggggaagcagcactctgcccagggttcttgctataaataggtcagtgggcagagaggcagatgtgtgcaaaaagcacaaccccaatcacacacagaaacccgtaggcacggacacacccagtctcaatgcacgaagttggagaacctgacagggctggtccaggccacagaggatggggttaggcttcatgccttcatgcccaggcagccacagaaacccactcttccccgcctcacagggctcctccggttggcctggatccaaagcgatctccttgtttcacctctttccagctcttccctagagcctggccccaagttccagagtcaaatcccagttttgcagtcaactattaacctggggccctggcagattggggtatccacccagtcatgtaaaggcaggagacctgctctgggcctgactcaaagcaaacacgtgggtgcagaagacccatgggaggaggaggtggggcccactcaacacacctaagccagtggccctctaggaggggcagaagagccaaccagagggttcctggaggtcatcgggttcctccttctgcttccaggcagcaacagacctaattcatctcctgtgaggatggagcaagggcgaatataggcatagacatatctggagcgcaaggattgagaggccctgtggacaaggggaaggagagcttgggggtgggagagggatctatggaaggggctgttgtagccaagaatggggcctgggctgggggcctggcctctggagagccctgattctactccagtcttctctcaccatggagacaacaccagtagagctgggagctggggcctgccactgagtaacagctcacacatgtagcacacttatgcgtcaggcaccagcatgtacaccttaatttatttaactttcacaacaaccctaggagaaaggtacagctactattctcatggtacagtggggaaaactgaggcacagagaggttagggacttttcatgatcacacagctaataagtggtggtcccaggattcaacccaagaagtctgttagaatccatactcttatcgactattttaataacagcatttcaataatagtaatatgtgatgttaaatgctttatctgagttatatcattgcattctcacaaaaatggtacatttgttagctcaaatttacagatgaggaaatggaggcctggagagttcaagtagctcactctaagttacagggtttgctagctgcagactggagactagatctcaggtcactctgccttggggttgcccttttctgagatcagactggccttaacagagcccaactttcttggaaggacacagctgggggtcgagggtcctgcatatgcacctggggagtccccacacacccgcaccaaaggggaaacattcaaaggagatgcaggtgacatacagatgggctaaggtgaggccttcctccaacatggggccctggctgagagtggagggatagggtgctacttgggggatatctattactaatcagcacacaatagctgggtgggcaccccctctctctgcagctggtggagatgggcctggtgctcctctctgcttggtaggaatgaccagggcaggatgccacctgctacactcttgcctgtcccagagcccttgggagaccagctgttgctcccacctttccccacagggtgcccggtccccacggcgcaaggaggccaagctcagctgtgtgtctgagcccactcagcagcaggcatgatcagggcagggcccagcgctaagggctgctggggctaaagtgccttgctgaaggaggggcagagttaaacattagccacaatggccccccgcgaagtgagtcatactccccacaagtctctgggctgggcagccgggggcgggggggttagcttcgttccaggtgggtgaccaagctgcggaagcccaggacagttcgctgggaccagtgctaatggcagcttctgctcctgacccccatcaggtctctttcctcagacatccccaaagcttgtctgcctgtgggtctttcattaaaggtgacgggcaagggttttctcttccttccaagacacacttctaggctggcttgtgggtcccctgagacgaaggctgagcagggtgagcctcgaaaaccccatagcactggcccagagcactgcggtcaatgtccgaaggaccagagagggagggtgacttgctcaaggtcacaaacctaactggagctaggaagtaggtccccagactcccagtctgaggaaattggatgtggacagggctttggtctcctggccagaggcaaacgcccagggatctgaacaggctgcccatctctggcctcaactcagcaccccaactggctccagtgccaaccattggcctctctcactggttggcacaggctgggtgagcctggccctttgccctgggttcaggagagaggtatggctttgcctggcagtcaggggaggtgttccaacctgggagcccctgggggaggagcgtgtgtgtgaacgcttgtgcctgttcatcagaaggggtgagcatggtgtgtatgcgtgggcatgcagaatgcagggtgatgacctgtctgcccgccctgagtgtcacagacacctgtgtgtcccctgtactagtgcctcccagatgctcttctcctgactggctctttgtgacctaaatttcaactgctccaccccacaaggaggaaaccagggccacaaatgtagtgagattttcataaagctaaatgtattcagtggaaacgaccttcctctgatctaaaagcatgcatgcctttgttttattactggagtattaaattagcccttacttatggaataggaggacagtaggtggcaattgttttctaatgctcttacttcacaaaataaaatggtggcagcacaa

SEQ ID NO: 32897 - DNA, 1100 bp, Homo sapiens
ctacggcgaggcacaggccagcccagctccacgaggactgaacaaggtgctgtctcactgccaccatgccggaagtcgagagaaaacccaagatcactgcctcccgcaaactcttgctgaagagcctgatgctggccaaggccaaggaatgctgggagcaggagcacgaggagcgcgaggctgagaaggtgcgctacctggcagagcgcatccccacgctgcagacccgtggcctgtccctcagtgccctgcaggacctgtgccgggagctgcacgccaaggtggaggtggtggatgaggagcgatacgacattgaggccaaatgcctccacaacaccagggagattaaggacctgaagctgaaggtgatggacctccgtgggaagttcaagcgcccgcccctgcgtcgagtccgtgtctcggctgacgccatgctccgggccctgctgggctccaagcacaaggtgtccatggatctgcgggccaacctcaagtctgtgaagaaggaagacacagagaaggagcggcctgtggaggtgggtgactggaggaagaacgtggaggccatgtctggcatggaaggccggaagaagatgtttgatgccgccaagtctccgacctcacaatagaggtacctagagaccagctcccttctctggggtccatcagagtctagaggataatgagggagtccacaatgggcaggcgggttgtacttagtgtggtgcacggatgcacggactaaggcaccgatgagactgatttgagtcggctctcctgggctcagtcctggctccagcaccatgatacttgggcatgtcatttctgtttggcggccctttttgttcccattatctatgaaattgggggctgtatcaaatcagtggttctccaagtgtggtcctgggaccagcagcgtctacatcacctgggatgcaaatgatcagcccccaccccagatccactaaattggaaactctggggtgaggccagccttctaggtgattctgatgcacatgagagtttgagaaccactaggttagagggtccctgggatcccttcatctctgactttctgagaatctatgcacttttaaata

SEQ ID NO: 32898 - DNA, 1750 bp, Homo sapiens
aaactgccccagcaggccccagggaaggacggcaggctgggatgccgtccccacggactccctctcctctcttagccctggcactaagtgcgttcctctggcaaagaagaaaataatttctgtccctcgccatctgctgcatgggaagatgggaatggagtgagcacggcaagacagatgctgcgtcctgcaatggccccaccatggaccctcgtcatccaaccgaagtcgcccccttgcctggctttatcttcactatattgtgaggctgcttcattgaatcttatcccagactttaacttttccatgactgccgtgattttgccatgttgttcacacagagtgtgtctgaccttagctgcattgccaccgcctttgggaccctgagccttcttgccagcactgtcactcccagaggttgcttccactttccccttttccagaaccacttgttcctttgggtggcatcctggaaacttgctgttgaagtctcaactgcctcagtggttcttcaagggaggtcctcaggccaccacctgagaaattgttagaaatgcaagtttctgggctgcatcccagacctgctgaatcagaaatttggggaggagcacggactttggcaccagagagctgggtgcagctctcagctctgcgtcatccttgctgtgggaccctgggttattgctgagccactgtgagtctgtttcctcgtgggtatagtaggtctgcagtctacggcgaggcacaggccagcccagctccacgaggactgaacaaggtgctgtctcactgccaccatgccggaagtacagagaaaacccaagatcactgcctcccgcaaactcttgctgaagagcctgatgctggccaaggccaaggaatgctgggagcaggagcacgaggagcgcgaggctgagaaggtgcgctacctggcagagcgcatccccacgctgcagacccgtggcctgtccctcagtgccctgcaggacctgtgccgggagctgcacgccaaggtggaggtggtggatgaggagcgatacgacattgaggccaaatgcctccacaacaccagggagattaaggacctgaagctgaaggtgatggacctccgtgggaagttcaagcgcccgcccctgcgtcgagtccgtgtctcggctgacgccatgctccgggccctgctgggctccaagcacaaggtgtccatggatctgcgggccaacctcaagtctgtgaagaaggaagacacagagaaggagcggcctgtggaggtgggtgactggaggaagaacgtggaggccatgtctggcatggaaggccggaagaagatgtttgatgccgccaagtctccgacctcacaatagaggccagcttgctgtgctgcgctctgagctcctgcttcatgcttcttctccaacccagctcactcacctctctgcctgtgtctggagcatcccttcccacctctcccccacttcttccctccagcctgcatgccctcctctggaactgggattaaacagatacccaagaggcaggaaaaacgcgagtgtctgaagacctcaccctggcagggtgggcttctatccacccatgaggcacctggggcttctcagccaccccgtggtgtaacaagtggaggaggaggagggggtgagaacacctttcctccagccctgtgccacactccttctatgtgtgtacagtgtccacaggcatcacaccttcttcattaaaaacccagtttcctggt

SEQ ID NO: 32899 - DNA, 633 bp, Homo sapiens
cctcttcccccagctgctacttgcccctctgggccttcactgtggccctttgctctccctcattccccctcccagtcccatctctgctcagtccccacacctggtctggctgctcattctttccctttctgcagctcgagtctccccagtctgcagtctacggcgaggcacaggccagcccagctccacgaggactgaacaaggtgctgtctcactgccaccatgccggaagtcgagagaaaacccaagatcactgcctcccgcaaactcttgctgaagagcctgatgctggccaaggccaaggaatgctgggagcaggagcacgaggagcgcgaggctgagaaggtgcgctacctggcagagcgcatccccacgctgcagacccgtggcctgtccctcagtgccctgcaggacctgtgccgggagctgcacgccaaggtggaggtggtggatgaggagcgatacgacattgaggccaaatgcctccacaacaccagggagattaaggacctgaagctgaaggtgatggacctccgtgggaagttcaagcgcccgcccctgcgtcgagtccgtgtctcggctgacgccatgctccgggccctgctgggctccaagcacaaggtgtccatggat

SEQ ID NO: 32900 - DNA, 706 bp, Homo sapiens
ctggcaaagtgtcacacaccacacagcaccatgtcccagtgcaagaagcggaacagggccatcacggcccgcaggcagcacctgaagagtgtgatgctgcagatagcggccacggagctggagaaggaggagagccgccgtgaggcagagaagcagaactacctggcggagcactgcccgccgctgcatatcccgggctccatgtctgaagtgcaggagctctgcaaacagctgcacgccaagatcgatgcggctgaagaggagaagtacgacatggaggtgagggtgcagaagaccagcaaggagctggaggacatgaaccagaagctatttgatctgcggggcaagttcaagcggcccccactgcggagggtgcgcatgtcggccgatgccatgctcaaggccctgctgggctcgaagcacaaggtgtgcatggacctgagggccaacctgaagcaggtcaagaaggaggacacagagaaggagcgggacctgcgagacgtgggtgactggaggaagaacatcgaggagaagtctggcatggagggccggaagaagatgtttgagtccgagtcctaggccactcgctgcccctacgcctgccccggtgcccggctcccagcagaacatactagggagatgcacccagagcctgccagggagggctggcctcaccaccaccgtcaataaaggatttgaatcccca

SEQ ID NO: 32901 - DNA, 678 bp, Homo sapiens
atgggagatgaggagaagcggaacagggccatcacggcccgcaggcagcacctgaagagtgtgatgctgcagatagcggccacggagctggagaaggaggagagccgccgtgaggcagagaagcagaactacctggcggagcactgcccgccgctgcatatcccgggctccatgtctgaagtgcaggagctctgcaaacagctgcacgccaagatcgatgcggctgaagaggagaagtacgacatggaggtgagggtgcagaagaccagcaaggagctggaggacatgaaccagaagctatttgatctgcggggcaagttcaagcggcccccactgcggagggtgcgcatgtcggccgatgccatgctcaaggccctgctgggctcgaagcacaaggtgtgcatggacctgagggccaacctgaagcaggtcaagaaggaggacacagagaaggagcgggacctgcgagacgtgggtgactggaggaagaacatcgaggagaagtctggcatggagggccggaagaagatgtttgagtccgagtcctaggccactcgctgcccctacgcctgccccggtgcccggctcccagcagaacatactagggagatgcacccagagcctgccagggagggctggcctcaccaccaccgtcaataaaggatttgaatccccatg

SEQ ID NO: 32902 - DNA, 745 bp, Homo sapiens
tcttacttctcaccctggggaattccaagacattgtccttgaaggaggctccaagctcaggacctcaggatgggagatgaggagaagcggaacagggccatcacggcccgcaggcagcacctgaagagtgtgatgctgcagatagcggccacggagctggagaaggaggagagccgccgtgaggcagagaagcagaactacctggcggagcactgcccgccgctgcatatcccgggctccatgtctgaagtgcaggagctctgcaaacagctgcacgccaagatcgatgcggctgaagaggagaagtacgacatggaggtgagggtgcagaagaccagcaaggagctggaggacatgaaccagaagctatttgatctgcggggcaagttcaagcggcccccactgcggagggtgcgcatgtcggccgatgccatgctcaaggccctgctgggctcgaagcacaaggtgtgcatggacctgagggccaacctgaagcaggtcaagaaggaggacacagagaaggagcgggacctgcgagacgtgggtgactggaggaagaacatcgaggagaagtctggcatggagggccggaagaagatgtttgagtccgagtcctaggccactcgctgcccctacgcctgccccggtgcccggctcccagcagaacatactagggagatgcacccagagcctgccagggagggctggcctcaccaccaccgtcaataaaggatttgaatcccca

SEQ ID NO: 32903 - DNA, 743 bp, Homo sapiens
gctgccggcctgacctcgctcccagccctgctgcccagattctaggctccaagctcaggacctcaggatgggagatgaggagaagcggaacagggccatcacggcccgcaggcagcacctgaagagtgtgatgctgcagatagcggccacggagctggagaaggaggagagccgccgtgaggcagagaagcagaactacctggcggagcactgcccgccgctgcatatcccgggctccatgtctgaagtgcaggagctctgcaaacagctgcacgccaagatcgatgcggctgaagaggagaagtacgacatggaggtgagggtgcagaagaccagcaaggagctggaggacatgaaccagaagctatttgatctgcggggcaagttcaagcggcccccactgcggagggtgcgcatgtcggccgatgccatgctcaaggccctgctgggctcgaagcacaaggtgtgcatggacctgagggccaacctgaagcaggtcaagaaggaggacacagagaaggagcgggacctgcgagacgtgggtgactggaggaagaacatcgaggagaagtctggcatggagggccggaagaagatgtttgagtccgagtcctaggccactcgctgcccctacgcctgccccggtgcccggctcccagcagaacatactagggagatgcacccagagcctgccagggagggctggcctcaccaccaccgtcaataaaggatttgaatcccca

SEQ ID NO: 32904 - DNA, 840 bp, Homo sapiens
agtgtcctcggggagtctcaagcagcccggaggagactgacggtccctgggaccctgaaggtcacccgggcggccccctcactgaccctccaaacgcccctgtcctcgccctgcctcctgccattcccggcctgagtctcagcatggcggatgggagcagcgatgcggctagggaacctcgccctgcaccagccccaatcagacgccgctcctccaactaccgcgcttatgccacggagccgcacgccaagaaaaaatctaagatctccgcctcgagaaaattgcagctgaagactctgctgctgcagattgcaaagcaagagctggagcgagaggcggaggagcggcgcggagagaaggggcgcgctctgagcacccgctgccagccgctggagttggccgggctgggcttcgcggagctgcaggacttgtgccgacagctccacgcccgtgtggacaaggtggatgaagagagatacgacatagaggcaaaagtcaccaagaacatcacggagattgcagatctgactcagaagatctttgaccttcgaggcaagtttaagcggcccaccctgcggagagtgaggatctctgcagatgccatgatgcaggcgctgctgggggcccgggctaaggagtccctggacctgcgggcccacctcaagcaggtgaagaaggaggacaccgagaaggaaaaccgggaggtgggagactggcgcaagaacatcgatgcactgagtggaatggagggccgcaagaaaaagtttgagagctgagccttcctgcctactgcccctgccctgaggagggccctgaggaataaagcttctctctgagctg

SEQ ID NO: 32905 - DNA, 1163 bp, Homo sapiens
ctggactctgagtgtggagccaggggcagcagggctgtctctgaactcccaggcttgtgtttgagcaaaggaattctctccccctccctctcccctcggggcgggcccgagcctccagctataaactccccggagcttcagtgccctcagcaaggctcagcctcaagattcacagcatctcagacacagcctaggccgcaccaggatgtcggacaccgaggagcaggaatatgaggaggagcagccggaagaggaggctgcggaggaggaggaggaagcccccgaagagccggagccggtggcagagccagaagaggaacgccccaaaccaagccgccccgtggtgcctcctttgatcccgccaaagatcccagaaggggagcgcgttgacttcgatgacatccaccgcaagcgcatggagaaagacctgctggagctgcagacactcatcgatgtacatttcgagcagcggaagaaggaggaagaggagctggttgccttgaaggagcgcattgagcggcgccggtcagagagagccgagcaacagcgcttcagaactgagaaggaacgcgaacgtcaggctaagctggcggaggagaagatgaggaaggaagaggaagaggccaagaagcgggcagaggatgatgccaagaaaaagaaggtgctgtccaacatgggggcccattttggcggctacctggtcaaggcagaacagaagcgtggtaagcggcagacggggcgggagatgaaggtgcgcatcctctccgagcgtaagaagcctctggacattgactacatgggggaggaacagctccgggcccggtctgcctggctgcctccatcacagccctcctgccctgccagggagaaagcccaggagctgtcggactggatccaccagctggagtctgagaagttcgacctgatggcgaagctgaaacagcagaaatatgagatcaacgtgctgtacaaccgcatcagccacgcccagaagttccgtaagggggcagggaagggccgcgttggaggccgctggaagtgaggatgccgccccggacagtggcacctgggaagcctgggagtgtttgtcccatcggtagcttgaaataaacgctcccctcagacacccgctgggttctctgatgttattatggttgagatgc

SEQ ID NO: 32906 - DNA, 1047 bp, Homo sapiens
agctataaactccccggagcttcagtgccctcagcaaggctcagcctcaagattcacagcatctcagacacagcctaggccgcaccaggatgtcggacaccgaggagcaggaatatgaggaggagcagccggaagaggaggctgcggaggaggaggaggaagcccccgaagagccggagccggtggcagagccagaagaggaacgccccaaaccaagccgccccgtggtgcctcctttgatcccgccaaagatcccagaaggggagcgcgttgacttcgatgacatccaccgcaagcgcatggagaaagacctgctggagctgcagacactcatcgatgtacatttcgagcagcggaagaaggaggaagaggagctggttgccttgaaggagcgcattgagcggcgccggtcagagagagccgagcaacagcgcttcagaactgagaaggaacgcgaacgtcaggctaagctggcggaggagaagatgaggaaggaagaggaagaggccaagaagcgggcagaggatgatgccaagaaaaagaaggtgctgtccaacatgggggcccattttggcggctacctggtcaaggcagaacagaagcgtggtaagcggcagacggggcgggagatgaaggtgcgcatcctctccgagcgtaagaagcctctggacattgactacatgggggaggaacagctccgggcccggtctgcctggctgcctccatcacagccctcctgccctgccagggagaaagcccaggagctgtcggactggatccaccagctggagtctgagaagttcgacctgatggcgaagctgaaacagcagaaatatgagatcaacgtgctgtacaaccgcatcagccacgcccagaagttccgtaagggggcagggaagggccgcgttggaggccgctggaagtgaggatgccgccccggacagtggcacctgggaagcctgggagtgtttgtcccatcggtagcttgaaataaacgctcccctcagacacccgctgggttctctgatgttattatggttgagatgc

SEQ ID NO: 32907 - DNA, 966 bp, Homo sapiens
agctataaactccccggagcttcagtgccctcagcaaggctcagcctcaagattcacagcatctcagacacagcctaggccgcaccaggatgtcggacaccgaggagcaggaatatgaggaggagcagccggaagaggaggctgcggaggaggaggaggaagaagaggaacgccccaaaccaagccgccccgtggtgcctcctttgatcccgccaaagatcccagaaggggagcgcgttgacttcgatgacatccaccgcaagcgcatggagaaagacctgctggagctgcagacactcatcgatgtacatttcgagcagcggaagaaggaggaagaggagctggttgccttgaaggagcgcattgagcggcgccggtcagagagagccgagcaacagcgcttcagaactgagaaggaacgcgaacgtcaggctaagctggcggaggagaagatgaggaaggaagaggaagaggccaagaagcgggcagaggatgatgccaagaaaaagaaggtgctgtccaacatgggggcccattttggcggctacctggtcaaggcagaacagaagcgtggtaagcggcagacggggcgggagatgaaggtgcgcatcctctccgagcgtaagaagcctctggacattgactacatgggggaggaacagctccgggagaaagcccaggagctgtcggactggatccaccagctggagtctgagaagttcgacctgatggcgaagctgaaacagcagaaatatgagatcaacgtgctgtacaaccgcatcagccacgcccagaagttccgtaagggggcagggaagggccgcgttggaggccgctggaagtgaggatgccgccccggacagtggcacctgggaagcctgggagtgtttgtcccatcggtagcttgaaataaacgctcccctcagacacccgctgggttctctgatgttattatggttgagatgc

SEQ ID NO: 32908 - DNA, 551 bp, Homo sapiens
agctataaactccccggagcttcagtgccctcagcaaggctcagcctcaagattcacagcatctcagacacagcctaggccgcaccaggatgtcggacaccgaggagcaggaatatgaggaggagcagccggaagaggaggctgcggaggaggaggaggaaggtgaggtcccggactccgcagaagaggaacgccccaaaccaagccgccccgtggtgcctcctttgatcccgccaaagatcccagaaggggagcgcgttgacttcgatgacatccaccgcaagcgcatggagaaagacctgctggagctgcagacactcatcgatgtacatttcgagcagcggaagaaggaggaagaggagctggttgccttgaaggagcgcattgagcggcgccggtcagagagagccgagcaacagcgcttcagaactgagaaggaacgcgaacgtcaggctaagctggcggaggagaagatgaggaaggaagaggaagaggccaagaagcgggcagaggatgatgccaagaaaaagaagaaaaaaaaaaaaaaaaag

SEQ ID NO: 32909 - DNA, 966 bp, Homo sapiens
agctataaactccccggagcttcagtgccctcagcaaggctcagcctcaagattcacagcatctcagacacagcctaggccgcaccaggatgtcggacaccgaggagcaggaatatgaggaggagcagccggaagaggaggctgcggaggaggaggaggaagcccccgaagagccggagccggtccgccccgtggtgcctcctttgatcccgccaaagatcccagaaggggagcgcgttgacttcgatgacatccaccgcaagcgcatggagaaagacctgctggagctgcagacactcatcgatgtacatttcgagcagcggaagaaggaggaagaggagctggttgccttgaaggagcgcattgagcggcgccggtcagagagagccgagcaacagcgcttcagaactgagaaggaacgcgaacgtcaggctaagctggcggaggagaagatgaggaaggaagaggaagaggccaagaagcgggcagaggatgatgccaagaaaaagaaggtgctgtccaacatgggggcccattttggcggctacctggtcaaggcagaacagaagcgtggtaagcggcagacggggcgggagatgaaggtgcgcatcctctccgagcgtaagaagcctctggacattgactacatgggggaggaacagctccgggagaaagcccaggagctgtcggactggatccaccagctggagtctgagaagttcgacctgatggcgaagctgaaacagcagaaatatgagatcaacgtgctgtacaaccgcatcagccacgcccagaagttccgtaagggggcagggaagggccgcgttggaggccgctggaagtgaggatgccgccccggacagtggcacctgggaagcctgggagtgtttgtcccatcggtagcttgaaataaacgctcccctcagacacccgctgggttctctgatgttattatggttgagatgc

SEQ ID NO: 32910 - DNA, 901 bp, Homo sapiens
agcaaggctcagcctcaagattcacagcatctcagacacagcctaggccgcaccaggatgtcggacaccgaggagcaggaatatgaggagtgagtgctgcactgggagaggaggctgcggaggaggaggaggaagaagaggaacgccccaaaccaagccgccccgtggtgcctcctttgatcccgccaaagatcccagaaggggagcgcgttgacttcgatgacatccaccgcaagcgcatggagaaagacctgctggagctgcagacactcatcgatgtacatttcgagcagcggaagaaggaggaagaggagctggttgccttgaaggagcgcattgagcggcgccggtcagagagagccgagcaacagcgcttcagaactgagaaggaacgcgaacgtcaggctaagctggcggaggagaagatgaggaaggaagaggaagaggccaagaagcgggcagaggatgatgccaagaaaaagaaggtgctgtccaacatgggggcccattttggcggctacctggtcaaggcagaacagaagcgtggtaagcggcagacggggcgggagatgaaggtgcgcatcctctccgagcgtaagaagcctctggacattgactacatgggggaggaacagctccgggagaaagcccaggagctgtcggactggatccaccagctggagtctgagaagttcgacctgatggcgaagctgaaacagcagaaatatgagatcaacgtgctgtacaaccgcatcagccacgcccagaagttccgtaagggggcagggaagggccgcgttggaggccgctggaagtgaggatgccgccccggacagtggcacctgggaagcctgggagtgtttgtcccatcggtagcttgaaataaacgctcccctcagac

SEQ ID NO: 32911 - DNA, 1078 bp, Homo sapiens
atgtctgacatagaagaggtggtggaagagtacgaggaggagcaccccgaggaagaggaggactggagagaggacgaagacgagcaggaggaggcagcggaagaggatgctgaagcagaggctgagaccgaggagaccagggcagaagaagatgaagaagaagaggaagcaaaggaggctgaagatggcccaatggaggagtccaaaccaaagcccaggtcgttcatgcccaacttggtgcctcccaagatccccgatggagagagagtggactttgatgacatccaccggaagcgcatggagaaggacctgaatgagttgcaggcgctgatcgaggctcactttgagaacaggaagaaagaggaggaggagctcgtttctctcaaagacaggatcgagagacgtcgggcagagcgggccgagcagcagcgcatccggaatgagcgggagaaggagcggcagaaccgcctggctgaagagagggctcgacgagaggaggaggagaacaggaggaaggctgaggatgaggcccggaagaagaaggctttgtccaacatgatgcattttgggggttacatccagaagcaggcccagacagagcggaaaagtgggaagaggcagactgagcgggaaaagaagaagaagattctggctgagaggaggaaggtgctggccattgaccacctgaatgaagatcagctgagggagaaggccaaggagctgtggcagagcatctataacttggaggcagagaagttcgacctgcaggagaagttcaagcagcagaaatatgagatcaatgttctccgaaacaggatcaacgataaccagaaagtctccaagacccgcgggaaggctaaagtcaccgggcgctggaaatagagcctggcctccttcaccaaagatctgctcctcgctcgcacctgcctccggcctgcactcccccagttcccgggccctcctgggcaccccaggcagctcctgtttggaaatggggagctggcctaggtgggagccaccactcctgcctgcccccacacccactccacaccagtaataaaaagccaccacacactga

SEQ ID NO: 32912 - DNA, 1052 bp, Homo sapiens
atgtctgacatagaagaggtggtggaagagtacgaggaggaaatggcagccccccagcaccaggaggaggcagcggaagaggatgctgaagcagaggctgagaccgaggagaccagggcagaagatgaagaagaagaggaagcaaaggaggctgaagatggcccaatggaggagtccaaaccaaagcccaggtcgttcatgcccaacttggtgcctcccaagatccccgatggagagagagtggactttgatgacatccaccggaagcgcatggagaaggacctgaatgagttgcaggcgctgatcgaggctcactttgagaacaggaagaaagaggaggaggagctcgtttctctcaaagacaggatcgagagacgtcgggcagagcgggccgagcagcagcgcatccggaatgagcgggagaaggagcggcagaaccgcctggctgaagagagggctcgacgagaggaggaggagaacaggaggaaggctgaggatgaggcccggaagaagaaggctttgtccaacatgatgcattttgggggttacatccagaagcaccctccagacagagcggaaaagtgggaagaggcagactgagcgggaaaagaagaagaagattctggctgagaggaggaaggtgctggccattgaccacctgaatgaagatcagctgagggagaaggccaaggagctgtggcagagcatctataacttggaggcagagaagttcgacctgcaggagaagttcaagcagcagaaatatgagatcaatgttctccgaaacaggatcaacgataaccagaaagtctccaagacccgcgggaaggctaaagtcaccgggcgctggaaatagagcctggcctccttcaccaaagatctgctcctcgctcgcacctgcctccggcctgcactcccccagttcccgggccctcctgggcaccccaggcagctcctgtttggaaatggggagctggcctaggtgggagccaccactcctgcctgcccccacacccactccacaccagtaataaaaagccaccacacactga

SEQ ID NO: 32913 - DNA, 1048 bp, Homo sapiens
atgtctgacatagaagaggtggtggaagagtacgaggaggaggctaagctggagcaggaggaggcagcggaagaggatgctgaagcagaggctgagaccgaggagaccagggcagaagaagatgaagaagaagaggaagcaaaggaggctgaagatggcccaatggaggagtccaaaccaaagcccaggtcgttcatgcccaacttggtgcctcccaagatccccgatggagagagagtggactttgatgacatccaccggaagcgcatggagaaggacctgaatgagttgcaggcgctgatcgaggctcactttgagaacaggaagaaagaggaggaggagctcgtttctctcaaagacaggatcgagagacgtcgggcagagcgggccgagcagcagcgcatccggaatgagcgggagaaggagcggcagaaccgcctggctgaagagagggctcgacgagaggaggaggagaacaggaggaaggctgaggatgaggcccggaagaagaaggctttgtccaacatgatgcattttgggggttacatccagaagcaggcccagacagagcggaaaagtgggaagaggcagactgagcgggaaaagaagaagaagattctggctgagaggaggaaggtgctggccattgaccacctgaatgaagatcagctgagggagaaggccaaggagctgtggcagagcatctataacttggaggcagagaagttcgacctgcaggagaagttcaagcagcagaaatatgagatcaatgttctccgaaacaggatcaacgataaccagaaagtctccaagacccgcgggaaggctaaagtcaccgggcgctggaaatagagcctggcctccttcaccaaagatctgctcctcgctcgcacctgcctccggcctgcactcccccagttcccgggccctcctgggcaccccaggcagctcctgtttggaaatggggagctggcctaggtgggagccaccactcctgcctgcccccacacccactccacaccagtaataaaaagccaccacacactga

SEQ ID NO: 32914 - DNA, 1054 bp, Homo sapiens
atgtctgacatagaagaggtggtggaagagtacgaggaggaggagcaggaagaagcagctgttgaagagcaggaggaggcagcggaagaggatgctgaagcagaggctgagaccgaggagaccagggcagaagaagatgaagaagaagaggaagcaaaggaggctgaagatggcccaatggaggagtccaaaccaaagcccaggtcgttcatgcccaacttggtgcctcccaagatccccgatggagagagagtggactttgatgacatccaccggaagcgcatggagaaggacctgaatgagttgcaggcgctgatcgaggctcactttgagaacaggaagaaagaggaggaggagctcgtttctctcaaagacaggatcgagagacgtcgggcagagcgggccgagcagcagcgcatccggaatgagcgggagaaggagcggcagaaccgcctggctgaagagagggctcgacgagaggaggaggagaacaggaggaaggctgaggatgaggcccggaagaagaaggctttgtccaacatgatgcattttgggggttacatccagaagacagagcggaaaagtgggaagaggcagactgagcgggaaaagaagaagaagattctggctgagaggaggaaggtgctggccattgaccacctgaatgaagatcagctgagggagaaggccaaggagctgtggcagagcatctataacttggaggcagagaagttcgacctgcaggagaagttcaagcagcagaaatatgagatcaatgttctccgaaacaggatcaacgataaccagaaagtctccaagacccgcgggaaggctaaagtcaccgggcgctggaaatagagcctggcctccttcaccaaagatctgctcctcgctcgcacctgcctccggcctgcactcccccagttcccgggccctcctgggcaccccaggcagctcctgtttggaaatggggagctggcctaggtgggagccaccactcctgcctgcccccacacccactccacaccagtaataaaaagccaccacacactga

SEQ ID NO: 32915 - DNA, 1063 bp, Homo sapiens
atgtctgacatagaagaggtggtggaagagtacgaggaggaggagcaggaagaagcagctgttgaagagcaggaggaggcagcggaagaggatgctgaagcagaggctgagaccgaggagaccagggcagaagaagatgaagaagaagaggaagcaaaggaggctgaagatggcccaatggaggagtccaaaccaaagcccaggtcgttcatgcccaacttggtgcctcccaagatccccgatggagagagagtggactttgatgacatccaccggaagcgcatggagaaggacctgaatgagttgcaggcgctgatcgaggctcactttgagaacaggaagaaagaggaggaggagctcgtttctctcaaagacaggatcgagagacgtcgggcagagcgggccgagcagcagcgcatccggaatgagcgggagaaggagcggcagaaccgcctggctgaagagagggctcgacgagaggaggaggagaacaggaggaaggctgaggatgaggcccggaagaagaaggctttgtccaacatgatgcattttgggggttacatccagaagcaggcccagacagagcggaaaagtgggaagaggcagactgagcgggaaaagaagaagaagattctggctgagaggaggaaggtgctggccattgaccacctgaatgaagatcagctgagggagaaggccaaggagctgtggcagagcatctataacttggaggcagagaagttcgacctgcaggagaagttcaagcagcagaaatatgagatcaatgttctccgaaacaggatcaacgataaccagaaagtctccaagacccgcgggaaggctaaagtcaccgggcgctggaaatagagcctggcctccttcaccaaagatctgctcctcgctcgcacctgcctccggcctgcactcccccagttcccgggccctcctgggcaccccaggcagctcctgtttggaaatggggagctggcctaggtgggagccaccactcctgcctgcccccacacccactccacaccagtaataaaaagccaccacacactga

SEQ ID NO: 32916 - DNA, 1122 bp, Homo sapiens
cagacgcctccaggatctgtcggcagctgctgttctgagggagagcagagaccatgtctgacatagaagaggtggtggaagagtacgaggaggaggagcaggaagaagcagctgttgaagagcaggaggaggcagcggaagaggatgctgaagcagaggctgagaccgaggagaccagggcagaagaagatgaagaagaagaggaagcaaaggaggctgaagatggcccaatggaggagtccaaaccaaagcccaggtcgttcatgcccaacttggtgcctcccaagatccccgatggagagagagtggactttgatgacatccaccggaagcgcatggagaaggacctgaatgagttgcaggcgctgatcgaggctcactttgagaacaggaagaaagaggaggaggagctcgtttctctcaaagacaggatcgagagacgtcgggcagagcgggccgagcagcagcgcatccggaatgagcgggagaaggagcggcagaaccgcctggctgaagagagggctcgacgagaggaggaggagaacaggaggaaggctgaggatgaggcccggaagaagaaggctttgtccaacatgatgcattttgggggttacatccagaagcaggcccagacagagcggaaaagtgggaagaggcagactgagcgggaaaagaagaagaagattctggctgagaggaggaaggtgctggccattgaccacctgaatgaagatcagctgagggagaaggccaaggagctgtggcagagcatctataacttggaggcagagaagttcgacctgcaggagaagttcaagcagcagaaatatgagatcaatgttctccgaaacaggatcaacgataaccagaaagtctccaagacccgcgggaaggctaaagtcaccgggcgctggaaatagagcctggcctccttcaccaaagatctgctcctcgctcgcacctgcctccggcctgcactcccccagttcccgggccctcctgggcaccccaggcagctcctgtttggaaatggggagctggcctaggtgggagccaccactcctgcctgcccccacacccactccacaccagtaataaaaagccaccacacactgactggca

SEQ ID NO: 32917 - DNA, 1084 bp, Homo sapiens
gagcagacgcctccaggatctgtcggcagctgctgttctgagggagagcagagaccatgtctgacatagaagaggtggtggaagagtacgaggaggagtgagagcaggaggaggcagcggaagaggatgctgaagcagaggctgagaccgaggagaccagggcagaagaagatgaagaagaagaggaagcaaaggaggctgaagatggcccaatggaggagtccaaaccaaagcccaggtcgttcatgcccaacttggtgcctcccaagatccccgatggagagagagtggactttgatgacatccaccggaagcgcatggagaaggacctgaatgagttgcaggcgctgatcgaggctcactttgagaacaggaagaaagaggaggaggagctcgtttctctcaaagacaggatcgagagacgtcgggcagagcgggccgagcagcagcgcatccggaatgagcgggagaaggagcggcagaaccgcctggctgaagagagggctcgacgagaggaggaggagaacaggaggaaggctgaggatgaggcccggaagaagaaggctttgtccaacatgatgcattttgggggttacatccagaagacagagcggaaaagtgggaagaggcagactgagcgggaaaagaagaagaagattctggctgagaggaggaaggtgctggccattgaccacctgaatgaagatcagctgagggagaaggccaaggagctgtggcagagcatctataacttggaggcagagaagttcgacctgcaggagaagttcaagcagcagaaatatgagatcaatgttctccgaaacaggatcaacgataaccagaaagtctccaagacccgcgggaaggctaaagtcaccgggcgctggaaatagagcctggcctccttcaccaaagatctgctcctcgctcgcacctgcctccggcctgcactcccccagttcccgggccctcctgggcaccccaggcagctcctgtttggaaatggggagctggcctaggtgggagccaccactcctgcctgcccccacacccactccacaccagtaataaaaagccaccacac

SEQ ID NO: 32918 - DNA, 1132 bp, Homo sapiens
agtccccgctgagactgagcagacgcctccaggatctgtcggcagctgctgttctgagggagagcagagaccatgtctgacatagaagaggtggtggaagagtacgaggaggaggagcaggaagaagcagctgttgaagagcaggaggaggcagcggaagaggatgctgaagcagaggctgagaccgaggagaccagggcagaagaagatgaagaagaagaggaagcaaaggaggctgaagatggcccaatggaggagtccaaaccaaagcccaggtcgttcatgcccaacttggtgcctcccaagatccccgatggagagagagtggactttgatgacatccaccggaagcgcatggagaaggacctgaatgagttgcaggcgctgatcgaggctcactttgagaacaggaagaaagaggaggaggagctcgtttctctcaaagacaggatcgagagacgtcgggcagagcgggccgagcagcagcgcatccggaatgagcgggagaaggagcggcagaaccgcctggctgaagagagggctcgacgagaggaggaggagaacaggaggaaggctgaggatgaggcccggaagaagaaggctttgtccaacatgatgcattttgggggttacatccagaagacagagcggaaaagtgggaagaggcagactgagcgggaaaagaagaagaagattctggctgagaggaggaaggtgctggccattgaccacctgaatgaagatcagctgagggagaaggccaaggagctgtggcagagcatctataacttggaggcagagaagttcgacctgcaggagaagttcaagcagcagaaatatgagatcaatgttctccgaaacaggatcaacgataaccagaaagtctccaagacccgcgggaaggctaaagtcaccgggcgctggaaatagagcctggcctccttcaccaaagatctgctcctcgctcgcacctgcctccggcctgcactcccccagttcccgggccctcctgggcaccccaggcagctcctgtttggaaatggggagctggcctaggtgggagccaccactcctgcctgcccccacacccactccacaccagtaataaaaagccaccacacactgactggca

SEQ ID NO: 32919 - DNA, 1141 bp, Homo sapiens
ccccgctgagactgagcagacgcctccaggatctgtcggcagctgctgttctgagggagagcagagaccatgtctgacatagaagaggtggtggaagagtacgaggaggagtatctggagcatgcagaagcagctgttgaagagcaggaggaggcagcggaagaggatgctgaagcagaggctgagaccgaggagaccagggcagaagaagatgaagaagaagaggaagcaaaggaggctgaagatggcccaatggaggagtccaaaccaaagcccaggtcgttcatgcccaacttggtgcctcccaagatccccgatggagagagagtggactttgatgacatccaccggaagcgcatggagaaggacctgaatgagttgcaggcgctgatcgaggctcactttgagaacaggaagaaagaggaggaggagctcgtttctctcaaagacaggatcgagagacgtcgggcagagcgggccgagcagcagcgcatccggaatgagcgggagaaggagcggcagaaccgcctggctgaagagagggctcgacgagaggaggaggagaacaggaggaaggctgaggatgaggcccggaagaagaaggctttgtccaacatgatgcattttgggggttacatccagaagcacaccctccagacagagcggaaaagtgggaagaggcagactgagcgggaaaagaagaagaagattctggctgagaggaggaaggtgctggccattgaccacctgaatgaagatcagctgagggagaaggccaaggagctgtggcagagcatctataacttggaggcagagaagttcgacctgcaggagaagttcaagcagcagaaatatgagatcaatgttctccgaaacaggatcaacgataaccagaaagtctccaagacccgcgggaaggctaaagtcaccgggcgctggaaatagagcctggcctccttcaccaaagatctgctcctcgctcgcacctgcctccggcctgcactcccccagttcccgggccctcctgggcaccccaggcagctcctgtttggaaatggggagctggcctaggtgggagccaccactcctgcctgcccccacacccactccacaccagtaataaaaagccaccacacactga

SEQ ID NO: 32920 - DNA, 1159 bp, Homo sapiens
ccccgctgagactgagcagacgcctccaggatctgtcggcagctgctgttctgagggagagcagagaccatgtctgacatagaagaggtggtggaagagtacgaggaggagtatctggagcatgcagaagcagctgttgaagaagaggaggactggagagaggacgaagacgagcaggaggaggcagcggaagaggatgctgaagcagaggctgagaccgaggagaccagggcagaagaagatgaagaagaagaggaagcaaaggaggctgaagatggcccaatggaggagtccaaaccaaagcccaggtcgttcatgcccaacttggtgcctcccaagatccccgatggagagagagtggactttgatgacatccaccggaagcgcatggagaaggacctgaatgagttgcaggcgctgatcgaggctcactttgagaacaggaagaaagaggaggaggagctcgtttctctcaaagacaggatcgagagacgtcgggcagagcgggccgagcagcagcgcatccggaatgagcgggagaaggagcggcagaaccgcctggctgaagagagggctcgacgagaggaggaggagaacaggaggaaggctgaggatgaggcccggaagaagaaggctttgtccaacatgatgcattttgggggttacatccagaagacagagcggaaaagtgggaagaggcagactgagcgggaaaagaagaagaagattctggctgagaggaggaaggtgctggccattgaccacctgaatgaagatcagctgagggagaaggccaaggagctgtggcagagcatctataacttggaggcagagaagttcgacctgcaggagaagttcaagcagcagaaatatgagatcaatgttctccgaaacaggatcaacgataaccagaaagtctccaagacccgcgggaaggctaaagtcaccgggcgctggaaatagagcctggcctccttcaccaaagatctgctcctcgctcgcacctgcctccggcctgcactcccccagttcccgggccctcctgggcaccccaggcagctcctgtttggaaatggggagctggcctaggtgggagccaccactcctgcctgcccccacacccactccacaccagtaataaaaagccaccacacactga

SEQ ID NO: 32921 - DNA, 1330 bp, Homo sapiens
acattcctccctccgcagggctggctcaccaggccccagcccacatgcctgcttaaagccctctccatcctctgcctcacccagtccccgctgagactgagcagacgcctccaggatctgtcggcagctgctgttctgaggtcacacagctcatgaggggtggaactagattcaccctaggcctcgctgatctctgtacaacgggggccagagctcttctgaggaaggcaggcttccctttgtacctgcactgacttttttctccttttggagggagagcagagaccatgtctgacatagaagaggtggtggaagagtacgaggaggaggagcaggaagaagcagctgttgaagagcaggaggaggcagcggaagaggatgctgaagcagaggctgagaccgaggagaccagggcagaagaagatgaagaagaagaggaagcaaaggaggctgaagatggcccaatggaggagtccaaaccaaagcccaggtcgttcatgcccaacttggtgcctcccaagatccccgatggagagagagtggactttgatgacatccaccggaagcgcatggagaaggacctgaatgagttgcaggcgctgatcgaggctcactttgagaacaggaagaaagaggaggaggagctcgtttctctcaaagacaggatcgagagacgtcgggcagagcgggccgagcagcagcgcatccggaatgagcgggagaaggagcggcagaaccgcctggctgaagagagggctcgacgagaggaggaggagaacaggaggaaggctgaggatgaggcccggaagaagaaggctttgtccaacatgatgcattttgggggttacatccagaagcaggcccagacagagcggaaaagtgggaagaggcagactgagcgggaaaagaagaagaagattctggctgagaggaggaaggtgctggccattgaccacctgaatgaagatcagctgagggagaaggccaaggagctgtggcagagcatctataacttggaggcagagaagttcgacctgcaggagaagttcaagcagcagaaatatgagatcaatgttctccgaaacaggatcaacgataaccagaaagtctccaagacccgcgggaaggctaaagtcaccgggcgctggaaatagagcctggcctccttcaccaaagatctgctcctcgctcgcacctgcctccggcctgcactcccccagttcccgggccctcctgggcaccccaggcagctcctgtttggaaatggggagctggcctaggtgggagccaccactcctgcctgcccccacacccactccacaccagtaat

SEQ ID NO: 32922 - DNA, 1060 bp, Homo sapiens
gcctgcagccggtgctgtccacagggagctccagcccttctcacactcgacccgcagaaaccacccaccttcaccatgtctgacgaggaagttgaacaggtggaggagcagtacgaagaagaagaggaagcccaggaggaagctgcagaagtccatgaggaagttcatgaaccagaggagaaaccgagacccaaactcactgctcctaagatcccagaaggggagaaagtggacttcgatgacatccagaagaagcgtcagaacaaagacctaatggagctccaggccctcatcgacagccactttgaagcccggaagaaggaggaggaggagctggtcgctctcaaagagagaatcgagaagcgccgtgcagagagagcggagcagcagaggattcgtgcagagaaggagagggagcgccagaacagactggcggaggaaaaggccagaagggaggaggaggatgccaagaggagggcagaggacgacctgaagaagaagaaagctctgtcttccatgggagccaactacagcagctacctggccaaggctgaccagaagagaggcaagaagcagacagcccgggaaatgaagaagaagattctggctgagagacgcaagccgctcaacatcgatcaccttggtgaagacaaactgagggacaaggccaaggagctctgggagaccctgcaccagctggagattgacaagttcgagtttggggagaagctgaaacgccagaaatatgacatcaccacgctcaggagccgcattgaccaggcccagaagcacagcaagaaggctgggaccccagccaagggcaaagtcggcgggcgctggaagtagagaggccagaaaggcccctcgaggcagagaccctccgccctcttgcacaccagggccgctcgtgggactccacatcctccagcccccacaatcctgtcaggggctccctgacagtcctgggggtggagaggccatcccggggcgtcccccgcgtctgtgtccttgctgccttcatcccctggggcctgtgaataaagctgcagaacccccttca

SEQ ID NO: 32923 - DNA, 1210 bp, Homo sapiens
ttcctatacttggtaaggggcctgcacgggcatagccccccccagcaagactccgcacacaccccggccacccagtcactggccaatgggctcctaggaagatcaaatgtcactataacacgagggtgtgagccgggcgccagtgcctgcagccggtgctgtccacagggagctccagcccttctcacactcgacccgcagaaaccacccaccttcaccatgtctgacgaggaagttgaacaggtggaggagcagtacgaagaagaagaggaagcccaggaggaagaggaagttcaagaagacaccgcagaggaggacgcggaagaggagaaaccgagacccaaactcactgctcctaagatcccagaaggggagaaagtggacttcgatgacatccagaagaagcgtcagaacaaagacctaatggagctccaggccctcatcgacagccactttgaagcccggaagaaggaggaggaggagctggtcgctctcaaagagagaatcgagaagcgccgtgcagagagagcggagcagcagaggattcgtgcagagaaggagagggagcgccagaacagactggcggaggaaaaggccagaagggaggaggaggatgccaagaggagggcagaggacgacctgaagaagaagaaagctctgtcttccatgggagccaactacagcagctacctggccaaggctgaccagaagagaggcaagaagcagacagcccgggaaatgaagaagaagattctggctgagagacgcaagccgctcaacatcgatcaccttggtgaagacaaactgagggacaaggccaaggagctctgggagaccctgcaccagctggagattgacaagttcgagtttggggagaagctgaaacgccagaaatatgacatcaccacgctcaggagccgcattgaccaggcccagaagcacagcaagaaggctgggaccccagccaagggcaaagtcggcgggcgctggaagtagagaggccagaaaggcccctcgaggcagagaccctccgccctcttgcacaccagggccgctcgtgggactccacatcctccagcccccacaatcctgtcaggggctccctgacagtcctgggggtggagaggccatcccggggcgtcccccgcgtctgtgtccttgctgccttcatcccctggggcctgtgaataaagctgcagaacccccttca

SEQ ID NO: 32924 - DNA, 794 bp, Homo sapiens
cacagggagctccagcccttctcacactcgacccgcagaaaccacccaccttcaccatgtctgacgaggaagttgaacaggtggaggagcagtacgaagaagaagaggaagcccaggaggaagaggagaaaccgagacccaaactcactgctcctaagatcccagaaggggagaaagtggacttcgatgacatccagaagaagcgtcagaacaaagacctaatggagctccaggccctcatcgacagccactttgaagcccggaagaaggaggaggaggagctggtcgctctcaaagagagaatcgagaagcgccgtgcagagagagcggagcagcagaggattcgtgcagagaaggagagggagcgccagaacagactggcggaggaaaaggccagaagggaggaggaggatgccaagaggagggcagaggacgacctgaagaagaagaaagctctgtcttccatgggagccaactacagcagctacctggccaaggctgaccagaagagaggcaagaagcagacagcccgggaaatgaagaagaagattctggctgagagacgcaagccgctcaacatcgatcaccttggtgaagacaaactgagggacaaggccaaggagctctgggagaccctgcaccagctggagattgacaagttcgagtttggggagaagctgaaacgccagaaatatgacatcaccacgctcaggagccgcattgaccaggcccagaagcacagcaagaaggctgggaccccagccaagggcaaagtcggcgggcgctggaagtag

SEQ ID NO: 32925 - DNA, 1184 bp, Homo sapiens
acttggtaaggggcctgcacgggcatagccccccccagcaagactccgcacacaccccggccacccagtcactggccaatgggctcctaggaagatcaaatgtcactataacacgagggtgtgagccgggcgccagtgcctgcagccggtgctgtccacagggagctccagcccttctcacactcgacccgcagaaaccacccaccttcaccatgtctgacgaggaagttgaacaggtggaggagcagtacgaagaagaagaggaagcccaggaggaagctgcagaagtccatgaggaagaggagaaaccgagacccaaactcactgctcctaagatcccagaaggggagaaagtggacttcgatgacatccagaagaagcgtcagaacaaagacctaatggagctccaggccctcatcgacagccactttgaagcccggaagaaggaggaggaggagctggtcgctctcaaagagagaatcgagaagcgccgtgcagagagagcggagcagcagaggattcgtgcagagaaggagagggagcgccagaacagactggcggaggaaaaggccagaagggaggaggaggatgccaagaggagggcagaggacgacctgaagaagaagaaagctctgtcttccatgggagccaactacagcagctacctggccaaggctgaccagaagagaggcaagaagcagacagcccgggaaatgaagaagaagattctggctgagagacgcaagccgctcaacatcgatcaccttggtgaagacaaactgagggacaaggccaaggagctctgggagaccctgcaccagctggagattgacaagttcgagtttggggagaagctgaaacgccagaaatatgacatcatgaatgtccgggccagagtgcagatgctggccaagttcagcaagaaggctgggaccccagccaagggcaaagtcggcgggcgctggaagtagagaggccagaaaggcccctcgaggcagagaccctccgccctcttgcacaccagggccgctcgtgggactccacatcctccagcccccacaatcctgtcaggggctccctgacagtcctgggggtggagaggccatcccggggcgtcccccgcgtctgtgtccttgctgccttcatcccctggggcctgtgaataaagctgcagaacccccttc

SEQ ID NO: 32926 - DNA, 1208 bp, Homo sapiens
acttggtaaggggcctgcacgggcatagccccccccagcaagactccgcacacaccccggccacccagtcactggccaatgggctcctaggaagatcaaatgtcactataacacgagggtgtgagccgggcgccagtgcctgcagccggtgctgtccacagggagctccagcccttctcacactcgacccgcagaaaccacccaccttcaccatgtctgacgaggaagttgaacaggtggaggagcagtacgaagaagaagaggaagcccaggaggaagctgcagaagtccatgaggaagacaccgcagaggaggacgcggaagaggagaaaccgagacccaaactcactgctcctaagatcccagaaggggagaaagtggacttcgatgacatccagaagaagcgtcagaacaaagacctaatggagctccaggccctcatcgacagccactttgaagcccggaagaaggaggaggaggagctggtcgctctcaaagagagaatcgagaagcgccgtgcagagagagcggagcagcagaggattcgtgcagagaaggagagggagcgccagaacagactggcggaggaaaaggccagaagggaggaggaggatgccaagaggagggcagaggacgacctgaagaagaagaaagctctgtcttccatgggagccaactacagcagctacctggccaaggctgaccagaagagaggcaagaagcagacagcccgggaaatgaagaagaagattctggctgagagacgcaagccgctcaacatcgatcaccttggtgaagacaaactgagggacaaggccaaggagctctgggagaccctgcaccagctggagattgacaagttcgagtttggggagaagctgaaacgccagaaatatgacatcaccacgctcaggagccgcattgaccaggcccagaagcacagcaagaaggctgggaccccagccaagggcaaagtcggcgggcgctggaagtagagaggccagaaaggcccctcgaggcagagaccctccgccctcttgcacaccagggccgctcgtgggactccacatcctccagcccccacaatcctgtcaggggctccctgacagtcctgggggtggagaggccatcccggggcgtcccccgcgtctgtgtccttgctgccttcatcccctggggcctgtgaataaagctgcagaacccccttc

SEQ ID NO: 32927 - DNA, 1178 bp, Homo sapiens
acttggtaaggggcctgcacgggcatagccccccccagcaagactccgcacacaccccggccacccagtcactggccaatgggctcctaggaagatcaaatgtcactataacacgagggtgtgagccgggcgccagtgcctgcagccggtgctgtccacagggagctccagcccttctcacactcgacccgcagaaaccacccaccttcaccatgtctgacgaggaagttgaacaggtggaggagcagtacgaagaagaagaggaagcccaggaggaagaggaagttcaagaagaggagaaaccgagacccaaactcactgctcctaagatcccagaaggggagaaagtggacttcgatgacatccagaagaagcgtcagaacaaagacctaatggagctccaggccctcatcgacagccactttgaagcccggaagaaggaggaggaggagctggtcgctctcaaagagagaatcgagaagcgccgtgcagagagagcggagcagcagaggattcgtgcagagaaggagagggagcgccagaacagactggcggaggaaaaggccagaagggaggaggaggatgccaagaggagggcagaggacgacctgaagaagaagaaagctctgtcttccatgggagccaactacagcagctacctggccaaggctgaccagaagagaggcaagaagcagacagcccgggaaatgaagaagaagattctggctgagagacgcaagccgctcaacatcgatcaccttggtgaagacaaactgagggacaaggccaaggagctctgggagaccctgcaccagctggagattgacaagttcgagtttggggagaagctgaaacgccagaaatatgacatcaccacgctcaggagccgcattgaccaggcccagaagcacagcaagaaggctgggaccccagccaagggcaaagtcggcgggcgctggaagtagagaggccagaaaggcccctcgaggcagagaccctccgccctcttgcacaccagggccgctcgtgggactccacatcctccagcccccacaatcctgtcaggggctccctgacagtcctgggggtggagaggccatcccggggcgtcccccgcgtctgtgtccttgctgccttcatcccctggggcctgtgaataaagctgcagaacccccttc

SEQ ID NO: 32928 - DNA, 1211 bp, Homo sapiens
acttggtaaggggcctgcacgggcatagccccccccagcaagactccgcacacaccccggccacccagtcactggccaatgggctcctaggaagatcaaatgtcactataacacgagggtgtgagccgggcgccagtgcctgcagccggtgctgtccacagggagctccagcccttctcacactcgacccgcagaaaccacccaccttcaccatgtctgacgaggaagttgaacaggtggaggagcagtacgaagaagaagaggaagcccaggaggaagctgcagaagtccatgaggaaggtatgaggacacaggacttcttccacgaggagaaaccgagacccaaactcactgctcctaagatcccagaaggggagaaagtggacttcgatgacatccagaagaagcgtcagaacaaagacctaatggagctccaggccctcatcgacagccactttgaagcccggaagaaggaggaggaggagctggtcgctctcaaagagagaatcgagaagcgccgtgcagagagagcggagcagcagaggattcgtgcagagaaggagagggagcgccagaacagactggcggaggaaaaggccagaagggaggaggaggatgccaagaggagggcagaggacgacctgaagaagaagaaagctctgtcttccatgggagccaactacagcagctacctggccaaggctgaccagaagagaggcaagaagcagacagcccgggaaatgaagaagaagattctggctgagagacgcaagccgctcaacatcgatcaccttggtgaagacaaactgagggacaaggccaaggagctctgggagaccctgcaccagctggagattgacaagttcgagtttggggagaagctgaaacgccagaaatatgacatcaccacgctcaggagccgcattgaccaggcccagaagcacagcaagaaggctgggaccccagccaagggcaaagtcggcgggcgctggaagtagagaggccagaaaggcccctcgaggcagagaccctccgccctcttgcacaccagggccgctcgtgggactccacatcctccagcccccacaatcctgtcaggggctccctgacagtcctgggggtggagaggccatcccggggcgtcccccgcgtctgtgtccttgctgccttcatcccctggggcctgtgaataaagctgcagaacccccttc

SEQ ID NO: 32929 - DNA, 844 bp, Homo sapiens
tccacagggagctccagcccttctcacactcgacccgcagaaaccacccaccttcaccatgtctgacgaggaagttgaacaggtggaggagcagtacgaagaagaagaggaagcccaggaggaagctgcagaagtccatgaggaagttcatgaaccagaggaagttcaagaagaggagaaaccgagacccaaactcactgctcctaagatcccagaaggggagaaagtggacttcgatgacatccagaagaagcgtcagaacaaagacctaatggagctccaggccctcatcgacagccactttgaagcccggaagaaggaggaggaggagctggtcgctctcaaagagagaatcgagaagcgccgtgcagagagagcggagcagcagaggattcgtgcagagaaggagagggagcgccagaacagactggcggaggaaaaggccagaagggaggaggaggatgccaagaggagggcagaggacgacctgaagaagaagaaagctctgtcttccatgggagccaactacagcagctacctggccaaggctgaccagaagagaggcaagaagcagacagcccgggaaatgaagaagaagattctggctgagagacgcaagccgctcaacatcgatcaccttggtgaagacaaactgagggacaaggccaaggagctctgggagaccctgcaccagctggagattgacaagttcgagtttggggagaagctgaaacgccagaaatatgacatcaccacgctcaggagccgcattgaccaggcccagaagcacagcaagaaggctgggaccccagccaagggcaaagtcggcgggcgctggaagtag

SEQ ID NO: 32930 - DNA, 1042 bp, Homo sapiens
gcctgcagccggtgctgtccacagggagctccagcccttctcacactcgacccgcagaaaccacccaccttcaccatgtctgacgaggaagttgaacaggtggaggagcagtacgaagaagaagaggaagcccaggaggaagaggaagttcaagaagaggagaaaccgagacccaaactcactgctcctaagatcccagaaggggagaaagtggacttcgatgacatccagaagaagcgtcagaacaaagacctaatggagctccaggccctcatcgacagccactttgaagcccggaagaaggaggaggaggagctggtcgctctcaaagagagaatcgagaagcgccgtgcagagagagcggagcagcagaggattcgtgcagagaaggagagggagcgccagaacagactggcggaggaaaaggccagaagggaggaggaggatgccaagaggagggcagaggacgacctgaagaagaagaaagctctgtcttccatgggagccaactacagcagctacctggccaaggctgaccagaagagaggcaagaagcagacagcccgggaaatgaagaagaagattctggctgagagacgcaagccgctcaacatcgatcaccttggtgaagacaaactgagggacaaggccaaggagctctgggagaccctgcaccagctggagattgacaagttcgagtttggggagaagctgaaacgccagaaatatgacatcatgaatgtccgggccagagtgcagatgctggccaagttcagcaagaaggctgggaccccagccaagggcaaagtcggcgggcgctggaagtagagaggccagaaaggcccctcgaggcagagaccctccgccctcttgcacaccagggccgctcgtgggactccacatcctccagcccccacaatcctgtcaggggctccctgacagtcctgggggtggagaggccatcccggggcgtcccccgcgtctgtgtccttgctgccttcatcccctggggcctgtgaataaagctgcagaacccccttca

SEQ ID NO: 32931 - DNA, 818 bp, Homo sapiens
ccttcaccatgtctgacgaggaagttgaacaggtggaggagcagtacgaagaagaagaggaagcccaggaggaagctgcagaagtccatgaggaagttcatgaaccagaggaagttcaagaagacaccgcagaggaggacgcggaagaggagaaaccgagacccaaactcactgctcctaagatcccagaaggggagaaagtggacttcgatgacatccagaagaagcgtcagaacaaagacctaatggagctccaggccctcatcgacagccactttgaagcccggaagaaggaggaggaggagctggtcgctctcaaagagagaatcgagaagcgccgtgcagagagagcggagcagcagaggattcgtgcagagaaggagagggagcgccagaacagactggcggaggaaaaggccagaagggaggaggaggatgccaagaggagggcagaggacgacctgaagaagaagaaagctctgtcttccatgggagccaactacagcagctacctggccaaggctgaccagaagagaggcaagaagcagacagcccgggaaatgaagaagaagattctggctgagagacgcaagccgctcaacatcgatcaccttggtgaagacaaactgagggacaaggccaaggagctctgggagaccctgcaccagctggagattgacaagttcgagtttggggagaagctgaaacgccagaaatatgacatcaccacgctcaggagccgcattgaccaggcccagaagcacagcaagaaggctgggaccccagccaagggcaaagtcggcgggcgctggaagtag

SEQ ID NO: 32932 - DNA, 1238 bp, Homo sapiens
acttggtaaggggcctgcacgggcatagccccccccagcaagactccgcacacaccccggccacccagtcactggccaatgggctcctaggaagatcaaatgtcactataacacgagggtgtgagccgggcgccagtgcctgcagccggtgctgtccacagggagctccagcccttctcacactcgacccgcagaaaccacccaccttcaccatgtctgacgaggaagttgaacaggtggaggagcagtacgaagaagaagaggaagcccaggaggaagctgcagaagtccatgaggaagcacaccctggagaagagagtgtccgagaagacaccgcagaggaggacgcggaagaggagaaaccgagacccaaactcactgctcctaagatcccagaaggggagaaagtggacttcgatgacatccagaagaagcgtcagaacaaagacctaatggagctccaggccctcatcgacagccactttgaagcccggaagaaggaggaggaggagctggtcgctctcaaagagagaatcgagaagcgccgtgcagagagagcggagcagcagaggattcgtgcagagaaggagagggagcgccagaacagactggcggaggaaaaggccagaagggaggaggaggatgccaagaggagggcagaggacgacctgaagaagaagaaagctctgtcttccatgggagccaactacagcagctacctggccaaggctgaccagaagagaggcaagaagcagacagcccgggaaatgaagaagaagattctggctgagagacgcaagccgctcaacatcgatcaccttggtgaagacaaactgagggacaaggccaaggagctctgggagaccctgcaccagctggagattgacaagttcgagtttggggagaagctgaaacgccagaaatatgacatcaccacgctcaggagccgcattgaccaggcccagaagcacagcaagaaggctgggaccccagccaagggcaaagtcggcgggcgctggaagtagagaggccagaaaggcccctcgaggcagagaccctccgccctcttgcacaccagggccgctcgtgggactccacatcctccagcccccacaatcctgtcaggggctccctgacagtcctgggggtggagaggccatcccggggcgtcccccgcgtctgtgtccttgctgccttcatcccctggggcctgtgaataaagctgcagaacccccttc

SEQ ID NO: 32933 - DNA, 644 bp, Homo sapiens
acttggtaaggggcctgcacgggcatagccccccccagcaagactccgcacacaccccggccacccagtcactggccaatgggctcctaggaagatcaaatgtcactataacacgagggtgtgagccgggcgccagtgcctgcagccggtgctgtccacagggagctccagcccttctcacactcgacccgcagaaaccacccaccttcaccatgtctgacgaggaagttgaacaggtggaggagcagtacgaagaagaagaggaagcccaggaggaagctgcagaagtccatgaggaagagaggagggcagaggacgacctgaagaagaagaaagctctgtcttccatgggagccaactacagcagctacctggccaaggctgaccagaagagaggcaagaagcagacagcccgggaaatgaagaagaagattctggctgagagacgcaagccgctcaacatcgatcaccttggtgaagacaaactgagggacaaggccaaggagctctgggagcccccacaatcctgtcaggggctccctgacagtcctgggggtggagaggccatcccggggcgtcccccgcgtctgtgtccttgctgccttcatcccctggggcctgtgaataaagctgcagaaccccct

SEQ ID NO: 32934 - DNA, 1791 bp, Homo sapiens
attttgcctttttgttaggtttcctaaagacaaaaaaaaatggaggaatctgtaaaccaaatgcagccactgaatgagaagcagatagccaattctcaggatggatatgtatggcaagtcactgacatgaatcgactacaccggttcttatgtttcggttctgaaggtgggacttattatatcaaagaacagaagttgggccttgaaaatgctgaagctttaattagattgattgaagatggcagaggatgtgaagtgatacaagaaataaagtcatttagtcaagaaggcagaaccacaaagcaagagcctatgctctttgcacttgccatttgttcccagtgctccgacataagcacaaaacaagcagcatttaaagctgtttctgaagtttgtcgcattcctacccatctctttacttttatccagtttaagaaagatctgaaggaaagcatgaaatgtggcatgtggggtcgtgccctccggaaggctatagcggactggtacaatgagaaaggtggcatggcccttgctctggcagttacaaaatataaacagagaaatggctggtctcacaaagatctattaagattgtcacatcttaaaccttccagtgaaggacttgcaattgtgaccaaatatattacaaagggctggaaagaagttcatgaattgtataaagaaaaagcactctctgtggagactgaaaaattattaaagtatctggaggctgtagagaaagtgaagcgcacaagagatgagctagaagtcattcatctaatagaagaacatagattagttagagaacatcttttaacaaatcacttaaagtctaaagaggtatggaaggctttgttacaagaaatgccgcttactgcattactaaggaatctaggaaagatgactgctaattcagtacttgaaccaggaaattcagaagtatctttagtatgtgaaaaactgtgtaatgaaaaactattaaaaaaggctcgtatacatccatttcatattttgatcgcattagaaacttacaagacaggtcatggtctcagagggaaactgaagtggcgccctgatgaagaaattttgaaagcattggatgctgctttttataaaacatttaagacagttgaaccaactggaaaacgtttcttactagctgttgatgtcagtgcttctatgaaccaaagagttttgggtagtatactcaacgctagtacagttgctgcagcaatgtgcatggttgtcacacgaacagaaaaagattcttatgtagttgctttttccgatgaaatggtaccatgtccagtgactacagatatgaccttacaacaggttttaatggctatgagtcagatcccagcaggtggaactgattgctctcttccaatgatctgggctcagaagacaaacacacctgctgatgtcttcattgtattcactgataatgagacctttgctggaggtgtccatcctgctattgctctgagggagtatcgaaagaaaatggatattccagctaaattgattgtttgtggaatgacatcaaatggtttcaccattgcagacccagatgatagaggcatgttggatatgtgcggctttgatactggagctctggatgtaattcgaaatttcacattagatatgatttaaccataagcagcagcacgatccagagatccattgccatcagtgatctcactaaaaatatacagctacttcccagctaatctccacccaatgaatgatgatggtatagtatgtgcataatggaaagttaccttactg

SEQ ID NO: 32935 - DNA, 1909 bp, Homo sapiens
cacaggccgacgtcgagagggcctgctttactcctcctctttctcctccttctcccgcggcttctgcgcggagaggcgtcgcccgggatctgggttttggaagaaggatctttgtgggaagacagggtgaatttatcacagaggaataacgagggagaggagaaaggtttcctaaagacaaaaaaaaatggaggaatctgtaaaccaaatgcagccactgaatgagaagcagatagccaattctcaggatggatatgtatggcaagtcactgacatgaatcgactacaccggttcttatgtttcggttctgaaggtgggacttattatatcaaagaacagaagttgggccttgaaaatgctgaagctttaattagattgattgaagatggcagaggatgtgaagtgatacaagaaataaagtcatttagtcaagaaggcagaaccacaaagcaagagcctatgctctttgcacttgccatttgttcccagtgctccgacataagcacaaaacaagcagcatttaaagctgtttctgaagtttgtcgcattcctacccatctctttacttttatccagtttaagaaagatctgaaggaaagcatgaaatgtggcatgtggggtcgtgccctccggaaggctatagcggactggtacaatgagaaaggtggcatggcccttgctctggcagttacaaaatataaacagagaaatggctggtctcacaaagatctattaagattgtcacatcttaaaccttccagtgaaggacttgcaattgtgaccaaatatattacaaagggctggaaagaagttcatgaattgtataaagaaaaagcactctctgtggagactgaaaaattattaaagtatctggaggctgtagagaaagtgaagcgcacaagagatgagctagaagtcattcatctaatagaagaacatagattagttagagaacatcttttaacaaatcacttaaagtctaaagaggtatggaaggctttgttacaagaaatgccgcttactgcattactaaggaatctaggaaagatgactgctaattcagtacttgaaccaggaaattcagaagtatctttagtatgtgaaaaactgtgtaatgaaaaactattaaaaaaggctcgtatacatccatttcatattttgatcgcattagaaacttacaagacaggtcatggtctcagagggaaactgaagtggcgccctgatgaagaaattttgaaagcattggatgctgctttttataaaacatttaagacagttgaaccaactggaaaacgtttcttactagctgttgatgtcagtgcttctatgaaccaaagagttttgggtagtatactcaacgctagtacagttgctgcagcaatgtgcatggttgtcacacgaacagaaaaagattcttatgtagttgctttttccgatgaaatggtaccatgtccagtgactacagatatgaccttacaacaggttttaatggctatgagtcagatcccagcaggtggaactgattgctctcttccaatgatctgggctcagaagacaaacacacctgctgatgtcttcattgtattcactgataatgagacctttgctggaggtgtccatcctgctattgctctgagggagtatcgaaagaaaatggatattccagctaaattgattgtttgtggaatgacatcaaatggtttcaccattgcagacccagatgatagagacactgtaaaatagttttgctttgttgaataatacgtgtgtacctaaaagagccttgcaaaataccctactaaataaatcattttagacatggagtgcaggtggacactgtgtgaactgtttttggtcagttattgtagaaattgatagatgtaccaaataaactctatgcacattaaa

SEQ ID NO: 32936 - DNA, 1857 bp, Homo sapiens
cacaggccgacgtcgagagggcctgctttactcctcctctttctcctccttctcccgcggcttctgcgcggagaggcgtcgcccgggatctgggttttggaagaaggatctttgtgggaagacagggtgaatttatcacagaggaataacgagggagaggagaaaggtttcctaaagacaaaaaaaaatggaggaatctgtaaaccaaatgcagccactgaatgagaagcagatagccaattctcaggatggatatgtatggcaagtcactgacatgaatcgactacaccggttcttatgtttcggttctgaaggtgggacttattatatcaaagaacagaagttgggccttgaaaatgctgaagctttaattagattgattgaagatggcagaggatgtgaagtgatacaagaaataaagtcatttagtcaagaaggcagaaccacaaagcaagagcctatgctctttgcacttgccatttgttcccagtgctccgacataagcacaaaacaagcagcatttaaagctgtttctgaagtttgtcgcattcctacccatctctttacttttatccagtttaagaaagatctgaaggaaagcatgaaatgtggcatgtggggtcgtgccctccggaaggctatagcggactggtacaatgagaaaggtggcatggcccttgctctggcagttacaaaatataaacagagaaatggctggtctcacaaagatctattaagattgtcacatcttaaaccttccagtgaaggacttgcaattgtgaccaaatatattacaaagggctggaaagaagttcatgaattgtataaagaaaaagcactctctgtggagactgaaaaattattaaagtatctggaggctgtagagaaagtgaagcgcacaagagatgagctagaagtcattcatctaatagaagaacatagattagttagagaacatcttttaacaaatcacttaaagtctaaagaggtatggaaggctttgttacaagaaatgccgcttactgcattactaaggaatctaggaaagatgactgctaattcagtacttgaaccaggaaattcagaagtatctttagtatgtgaaaaactgtgtaatgaaaaactattaaaaaaggctcgtatacatccatttcatattttgatcgcattagaaacttacaagacaggtcatggtctcagagggaaactgaagtggcgccctgatgaagaaattttgaaagcattggatgctgctttttataaaacatttaagacagttgaaccaactggaaaacgtttcttactagctgttgatgtcagtgcttctatgaaccaaagagttttgggtagtatactcaacgctagtacagttgctgcagcaatgtgcatggttgtcacacgaacagaaaaagattcttatgtagttgctttttccgatgaaatggtaccatgtccagtgactacagatatgaccttacaacaggttttaatggctatgagtcagatcccagcaggtggaactgattgctctcttccaatgatctgggctcagaagacaaacacacctgctgatgtcttcattgtattcactgataatgagacctttgctggaggtgtccatcctgctattgctctgagggagtatcgaaagaaaatggatattccagctaaattgattgtttgtggaatgacatcaaatggtttcaccattgcagacccagatgatagagccttgcaaaataccctactaaataaatcattttagacatggagtgcaggtggacactgtgtgaactgtttttggtcagttattgtagaaattgatagatgtaccaaataaactctatgcacattaaa

SEQ ID NO: 32937 - DNA, 1898 bp, Homo sapiens
cacaggccgacgtcgagagggcctgctttactcctcctctttctcctccttctcccgcggcttctgcgcggagaggcgtcgcccgggatctgggttttggaagaaggatctttgtgggaagacagggtgaatttatcacagaggaataacgagggagaggagaaaggtttcctaaagacaaaaaaaaatggaggaatctgtaaaccaaatgcagccactgaatgagaagcagatagccaattctcaggatggatatgtatggcaagtcactgacatgaatcgactacaccggttcttatgtttcggttctgaaggtgggacttattatatcaaagaacagaagttgggccttgaaaatgctgaagctttaattagattgattgaagatggcagaggatgtgaagtgatacaagaaataaagtcatttagtcaagaaggcagaaccacaaagcaagagcctatgctctttgcacttgccatttgttcccagtgctccgacataagcacaaaacaagcagcatttaaagctgtttctgaagtttgtcgcattcctacccatctctttacttttatccagtttaagaaagatctgaaggaaagcatgaaatgtggcatgtggggtcgtgccctccggaaggctatagcggactggtacaatgagaaaggtggcatggcccttgctctggcagttacaaaatataaacagagaaatggctggtctcacaaagatctattaagattgtcacatcttaaaccttccagtgaaggacttgcaattgtgaccaaatatattacaaagggctggaaagaagttcatgaattgtataaagaaaaagcactctctgtggagactgaaaaattattaaagtatctggaggctgtagagaaagtgaagcgcacaagagatgagctagaagtcattcatctaatagaagaacatagattagttagagaacatcttttaacaaatcacttaaagtctaaagaggtatggaaggctttgttacaagaaatgccgcttactgcattactaaggaatctaggaaagatgactgctaattcagtacttgaaccaggaaattcagaagtatctttagtatgtgaaaaactgtgtaatgaaaaactattaaaaaaggctcgtatacatccatttcatattttgatcgcattagaaacttacaagacaggtcatggtctcagagggaaactgaagtggcgccctgatgaagaaattttgaaagcattggatgctgctttttataaaacatttaagacagttgaaccaactggaaaacgtttcttactagctgttgatgtcagtgcttctatgaaccaaagagttttgggtagtatactcaacgctagtacagttgctgcagcaatgtgcatggttgtcacacgaacagaaaaagattcttatgtagttgctttttccgatgaaatggtaccatgtccagtgactacagatatgaccttacaacaggttttaatggctatgagtcagatcccagcaggtggaactgattgctctcttccaatgatctgggctcagaagacaaacacacctgctgatgtcttcattgtattcactgataatgagacctttgctggaggtgtccatcctgctattgctctgagggagtatcgaaagaaaatggatattccagctaaattgattgtttgtggaatgacatcaaatggtttcaccattgcagacccagatgatagaggcatgttggatatgtgcggctttgatactggagctctggatccttgcaaaataccctactaaataaatcattttagacatggagtgcaggtggacactgtgtgaactgtttttggtcagttattgtagaaattgatagatgtaccaaataaactctatgcacattaaa

SEQ ID NO: 32938 - DNA, 3081 bp, Homo sapiens
tcctgcttgtcggcatcgctccccacaggccgacgtcgagagggcctgctttactcctcctctttctcctccttctcccgcggcttctgcgcggagaggcgtcgcccgggatctgggttttggaagaaggatctttgtgggaagacagggtgaatttatcacagaggaataacgagggagaggagaaaggtttcctaaagacaaaaaaaaatggaggaatctgtaaaccaaatgcagccactgaatgagaagcagatagccaattctcaggatggatatgtatggcaagtcactgacatgaatcgactacaccggttcttatgtttcggttctgaaggtgggacttattatatcaaagaacagaagttgggccttgaaaatgctgaagctttaattagattgattgaagatggcagaggatgtgaagtgatacaagaaataaagtcatttagtcaagaaggcagaaccacaaagcaagagcctatgctctttgcacttgccatttgttcccagtgctccgacataagcacaaaacaagcagcatttaaagctgtttctgaagtttgtcgcattcctacccatctctttacttttatccagtttaagaaagatctgaaggaaagcatgaaatgtggcatgtggggtcgtgccctccggaaggctatagcggactggtacaatgagaaaggtggcatggcccttgctctggcagttacaaaatataaacagagaaatggctggtctcacaaagatctattaagattgtcacatcttaaaccttccagtgaaggacttgcaattgtgaccaaatatattacaaagggctggaaagaagttcatgaattgtataaagaaaaagcactctctgtggagactgaaaaattattaaagtatctggaggctgtagagaaagtgaagcgcacaagagatgagctagaagtcattcatctaatagaagaacatagattagttagagaacatcttttaacaaatcacttaaagtctaaagaggtatggaaggctttgttacaagaaatgccgcttactgcattactaaggaatctaggaaagatgactgctaattcagtacttgaaccaggaaattcagaagtatctttagtatgtgaaaaactgtgtaatgaaaaactattaaaaaaggctcgtatacatccatttcatattttgatcgcattagaaacttacaagacaggtcatggtctcagagggaaactgaagtggcgccctgatgaagaaattttgaaagcattggatgctgctttttataaaacatttaagacagttgaaccaactggaaaacgtttcttactagctgttgatgtcagtgcttctatgaaccaaagagttttgggtagtatactcaacgctagtacagttgctgcagcaatgtgcatggttgtcacacgaacagaaaaagattcttatgtagttgctttttccgatgaaatggtaccatgtccagtgactacagatatgaccttacaacaggttttaatggctatgagtcagatcccagcaggtggaactgattgctctcttccaatgatctgggctcagaagacaaacacacctgctgatgtcttcattgtattcactgataatgagacctttgctggaggtgtccatcctgctattgctctgagggagtatcgaaagaaaatggatattccagctaaattgattgtttgtggaatgacatcaaatggtttcaccattgcagacccagatgatagaggcatgttggatatgtgcggctttgatactggagctctggatgtaattcgaaatttcacattagatatgatttaaccataagcagcagcacgatccagagatccattgccatcagtgatctcactaaaaatatacagctacttcccagctaatctccacccaatgaatgatgatggtatagtatgtgcataatggaaagttaccttactgaaaaaaaaaaaagaaggaaaaataagatgggcccaaaggtctatctactaaactagctcttggggaaatagcttcaggatactgtagtttcctctatctaatagagaactttttgttaacagacactgtaaaatagttttgctttgttgaataatacgtgtgtacctaaaagaggtaagagcaaaaagtgtaattccacatcatgttacttgagaagtgcttaacgttttcttaaatgttttcattgggaaaggacagctttgataatgtccaaatactctgaaatgcactagaccatataactgtgatgaaatatgaaactcatctgtaaacttttataccaagggggtaaaaaaaaaaactaaggcatttgattaaattatgaatgagttttacaaattcctttcagagttttactaagatcacacaaataacagctttcttattcagtgaaaaagatattttatttctgatgttttatttgcacttgtggaatatgttaccattaatcagaaacatcatggcaacccctaagaatagactaagtttgtgttggctgagggattctatttggtttgcttttttttttttgctttgttatattttattgctacaaggggtgtgacttgataatgatttcctctgaattataataacatagccagatgtagtctcacactgtttttcatactcttaagtgtaaataatataaaatgtttcaagcgcttaactccccctcattcacaaagtataacaattaaaatctcaactataaccagtttagctttttccttacttttaaaataaaattttttacttttaactatttttttagttaatatttttaaaagtatacatgtcaatggcctctttgtccattattcattttgtggcaaaatattcttctttgatagtgtaaacaaataataaagcaatctaggtcctttaggtttgaaaggcaatttttgagtagcatattaccagctagccagtcactaggaatttttttcagtattatttgtatgtattaaacttttcattacactaaagtgcattattttattgagcaagtatccttcattgtgaggtttaacattaaagcaatctgttgaaatgcca

SEQ ID NO: 32939 - DNA, 2143 bp, Homo sapiens
gactgagcgcgggaggacgctctagccaccctagagacatcgaaactcttcccaggccttgcagcacccgtagcggattcggaagggctggggcctgagaagaaagggcggtgattcacagcgccgaggaggcaacatccgggatcctcgcccctctggggcggaggcggggcaaaagaagaggggcaggactcgttcccgggaaccgaacctggaatccccggcggcagtggggctgttgctgttgctgtggctgtcgctgcccgtcaggctgccttcttttgtcgtttcccagcgctgcgcaggacttctcctggcggcgctgcggatccagggggtcggctgccaggtacaggtttcctaaagacaaaaaaaaatggaggaatctgtaaaccaaatgcagccactgaatgagaagcagatagccaattctcaggatggatatgtatggcaagtcactgacatgaatcgactacaccggttcttatgtttcggttctgaaggtgggacttattatatcaaagaacagaagttgggccttgaaaatgctgaagctttaattagattgattgaagatggcagaggatgtgaagtgatacaagaaataaagtcatttagtcaagaaggcagaaccacaaagcaagagcctatgctctttgcacttgccatttgttcccagtgctccgacataagcacaaaacaagcagcatttaaagctgtttctgaagtttgtcgcattcctacccatctctttacttttatccagtttaagaaagatctgaaggaaagcatgaaatgtggcatgtggggtcgtgccctccggaaggctatagcggactggtacaatgagaaaggtggcatggcccttgctctggcagttacaaaatataaacagagaaatggctggtctcacaaagatctattaagattgtcacatcttaaaccttccagtgaaggacttgcaattgtgaccaaatatattacaaagggctggaaagaagttcatgaattgtataaagaaaaagcactctctgtggagactgaaaaattattaaagtatctggaggctgtagagaaagtgaagcgcacaagagatgagctagaagtcattcatctaatagaagaacatagattagttagagaacatcttttaacaaatcacttaaagtctaaagaggtatggaaggctttgttacaagaaatgccgcttactgcattactaaggaatctaggaaagatgactgctaattcagtacttgaaccaggaaattcagaagtatctttagtatgtgaaaaactgtgtaatgaaaaactattaaaaaaggctcgtatacatccatttcatattttgatcgcattagaaacttacaagacaggtcatggtctcagagggaaactgaagtggcgccctgatgaagaaattttgaaagcattggatgctgctttttataaaacatttaagacagttgaaccaactggaaaacgtttcttactagctgttgatgtcagtgcttctatgaaccaaagagttttgggtagtatactcaacgctagtacagttgctgcagcaatgtgcatggttgtcacacgaacagaaaaagattcttatgtagttgctttttccgatgaaatggtaccatgtccagtgactacagatatgaccttacaacaggttttaatggctatgagtcagatcccagcaggtggaactgattgctctcttccaatgatctgggctcagaagacaaacacacctgctgatgtcttcattgtattcactgataatgagacctttgctggaggtgtccatcctgctattgctctgagggagtatcgaaagaaaatggatattccagctaaattgattgtttgtggaatgacatcaaatggtttcaccattgcagacccagatgatagaggcatgttggatatgtgcggctttgatactggagctctggatgtaattcgaaatttcacattagatatgatttaaccataagcagcagcacgatccagagatccattgccatcagtgatctcactaaaaatatacagctacttcccagctaatctccacccaatgaatgatgatggtatagtatgtgcataatggaaagttaccttactgaaaaaaaaaaaagaa

SEQ ID NO: 32940 - DNA, 1987 bp, Homo sapiens
gggttgaggctgggcaaacgccgcgaaactatcgctcttccccgtcccgcttccgcgcctgtccaccctgggtaacggaaccagcatcgcggtagggacatcctcgctaggcccggccggaccattcctcagggtgggccctttccgaagccgggaccgctcctgcttgtcggcatcgctccccacaggccgacgtcgagagggcctgctttactcctcctctttctcctccttctcccgcggcttctgcgcggagaggcgtcgcccgggatctgggttttggaagaaggatctttgtgggaagacagggtgaatttatcacagaggaataacgagggagaggagaaaggtttcctaaagacaaaaaaaaatggaggaatctgtaaaccaaatgcagccactgaatgagaagcagatagccaattctcaggatggatatgtatggcaagtcactgacatgaatcgactacaccggttcttatgtttcggttctgaaggtgggacttattatatcaaagaacagaagttgggccttgaaaatgctgaagctttaattagattgattgaagatggcagaggatgtgaagtgatacaagaaataaagtcatttagtcaagaaggcagaaccacaaagcaagagcctatgctctttgcacttgccatttgttcccagtgctccgacataagcacaaaacaagcagcatttaaagctgtttctgaagtttgtcgcattcctacccatctctttacttttatccagtttaagaaagatctgaaggaaagcatgaaatgtggcatgtggggtcgtgccctccggaaggctatagcggactggtacaatgagaaaggtggcatggcccttgctctggcagttacaaaatataaacagagaaatggctggtctcacaaagatctattaagattgtcacatcttaaaccttccagtgaaggacttgcaattgtgaccaaatatattacaaagggctggaaagaagttcatgaattgtataaagaaaaagcactctctgtggagactgaaaaattattaaagtatctggaggctgtagagaaagtgaagcgcacaagagatgagctagaagtcattcatctaatagaagaacatagattagttagagaacatcttttaacaaatcacttaaagtctaaagaggtatggaaggctttgttacaagaaatgccgcttactgcattactaaggaatctaggaaagatgactgctaattcagtacttgaaccaggaaattcagaagtatctttagtatgtgaaaaactgtgtaatgaaaaactattaaaaaaggctcgtatacatccatttcatattttgatcgcattagaaacttacaagacaggtcatggtctcagagggaaactgaagtggcgccctgatgaagaaattttgaaagcattggatgctgctttttataaaacatttaagacagttgaaccaactggaaaacgtttcttactagctgttgatgtcagtgcttctatgaaccaaagagttttgggtagtatactcaacgctagtacagttgctgcagcaatgtgcatggttgtcacacgaacagaaaaagattcttatgtagttgctttttccgatgaaatggtaccatgtccagtgactacagatatgaccttacaacaggttttaatggctatgagtcagatcccagcaggtggaactgattgctctcttccaatgatctgggctcagaagacaaacacacctgctgatgtcttcattgtattcactgataatgagacctttgctggaggtgtccatcctgctattgctctgagggagtatcgaaagaaaatggatattccagctaaattgattgtttgtggaatgacatcaaatggtttcaccattgcagacccagatgatagaggcatgttggatatgtgcggctttgatactggagctctggatgtaattcgaaatttcacattagatatgatttaa

SEQ ID NO: 32941 - DNA, 613 bp, Homo sapiens
gttgctgttgctgtggctgtcgctgcccgtcaggctgccttcttttgtcgtttcccagcgctgcgcaggacttctcctggcggcgctgcggatccagggggtcggctgccaggtacaggggttgaggctgggcaaacgccgcgaaactatcgctcttccccgtcccgcttccgcgcctgtccaccctgggtaacggaaccagcatcgcggtagggacatcctcgctaggcccggccggaccattcctcagggtgggccctttccgaagccgggaccgctcctgcttgtcggcatcgctccccacaggccgacgtcgagagggcctgctttactcctcctctttctcctccttctcccgcggcttctgcgcggagaggcgtcgcccgggatctgggttttggaagaaggatctttgtgggaagacagggtgaatttatcacagaggaataacgagggagaggagaaaggtttcctaaagacaaaaaaaaatggaggaatctgtaaaccaaatgcagccactgaatgagaagcagatagccaattctcaggatggatatgtatggcaagtcactgacatgaatcgactacaccggttcttatgtttcggttctga

SEQ ID NO: 32942 - DNA, 3403 bp, Homo sapiens
gcactcttgttgcatcatcagcgtgcacctccacgatgaaacaggtctgggctacaaaagtatggccgcttctgaggcggcggtggtgtcttcgccgtctttgaaaacagacacatcccctgtccttgaaactgcaggaacggtcgcagcaatggctgcgaccccgtcagcaagggctgcagccgcggtggttgcggccgcggccaggaccggatccgaagccagggtctccaaggccgctttggctaccaagctgctgtccttgagcggcgtgttcgccgtgcacaagcccaaagggcccacttcagccgagctgctgaatcggttgaaggagaagctgctggcagaagctggaatgccttctccagaatggaccaagaggaaaaagcagactttgaaaattgggcatggagggactctagacagcgcagcccgaggagttctggttgttggaattggaagcggaacaaaaatgttgaccagtatgttgtcagggtccaagagatatactgccattggagaactggggaaagctactgatacactagattctacggggagggtaacagaagaaaaaccttacgataaaataacacaagaagatattgaaggcattctacagaaatttactggaaatataatgcaagtgccccccctctattctgcattaaagaaagatggacaaagactttcgactttgatgaagagaggtgaagtcgtagaagcaaaacctgccaggccagtgactgtatacagtatctcccttcaaaaattccagccaccatttttcacattagatgttgaatgtggaggaggtttttatatcagaagcttggtcagtgacattggaaaagaactatcttcctgtgccaatgtgctagagctgacccgaaccaaacagggaccatttacgctagaagaacatgcccttcctgaagacaaatggacaattgatgacattgcacagtctcttgagcattgctcatctcttttcccagcagagttggcacttaaaaaatcaaaacctgagtctaatgaacaggttttgagctgtgaatatataactctaaatgagccaaagagagaagatgatgtaattaagacgtgttgagattggcctgggaatatcatcattttctagttgacatttgaatcctgtgtgcagatgcagaatgacaagctgcattcaaaagacaaacaatatgtcttttttttttttgcatgaagaaaaatgtctatcatttacagtttcaatagcacataatttattttctatgcattataaatggccttgcagttggctcagttgtttgttgtgttgtgaaatgttttaggattttttgtattgtgaaaatatgaatatgattggattcagaaaaattaactttctgaatttgatctgtcttcagtcttgtgaaaaagttgaacaaatttcctaatcaaagaaaaaagtatgagctccatgtttctttagtttcacaaaaatgaccataatttagtgttatttttactttatttaggcttcctggtggcttcattttattgaaattctttaaattgtttaaagtggccattattgatctctttcttctgttttggagagtttattattaaaaacatttctttgataaaatggccatcatctagtaatacctgtgtttgtttagatcttggaaatgaataagctttgataatatttgtaaatgaaccaaattattactgctaccactaacaggttgtaaatagaagactaatacttaattaaagtcaccttcctaccattagagcagaagacagctcctatagttttgtattttggcagctatgagatattttcatggtaatgtcaacatggtcaagcactttgtaccaagttattaagtaacataatttttaaaatttaaagaatgtgtcttcaactaaaaactttattctttagcatttatttatatttctctgtagggtgttccctgtgacattgtctctttagtttgctctttcaagagatacttacagatgttgagatggctgccctgcatttccagctaatctcttctgctctaaatatttaaaaacagttcttctcaaacattttcattcagatagctttctgaaagttccctatccctctttaccataattttttaaatgtagccacattgtaatagtaaacttcatatataatgagtgcttcatatttttgttatgggaaagcaatatattatgcagccagtctgtagaaacattcagatccctcttcctttactcaaatacagtttcaaaaggaagactcatgagaaatttcataaaatacaagtttttagatgtttatgctttgcctttctttttaaaggtgttttcctgctttgtagtctctaactctgaaatttaaaatatgtaaactaaagtggttttatttgtgcttaacccaatttaaactcaatgtaaaatgttatatatgcatcagtacagcattttcaacatattggcaacatattttaaatgaaaacactaaaacaattcttagtatgagacaaaactgtaaggaaaaagagtgttaataccatgatgcattaacataaaatatcaaacacacaaagtcataaaatgaaaatttacagttttacctgttcatatctagtgccccacagtgtgtgtcaaccaaaggtggcagtggctacatctgcctgttggactggtacaggttacaatatgtcctcttccattgcaaattaaagtccaaatagagaaatacttaggttttagaacacatcagaggtatttctgctgtatttttcaccttaaaaattgacacagagtttactaatagaggagtagagattgttgaccatttttaaaaaacgatagccactctttttcttttatgtttaaaactgaagttttgccaaatgggaaaattactgttacctctaccatcttaatgtagtaactttagaatttaaatttttatattactattttcctttttgttgttcacatagtcttaaggcacctatacttttaaattgactttttcatttgatattatctatatgtatgtagttgtgataatgattattttaattatattactttatactcttaatttatttagagtatttctctattgctgaatacttaagtagttttaaattttattatgataaattcctgggagggggattatttagtgaaataatatgaagaactttatgacttatgtttgccttattgcattcccaaagagttgtaacattttacagtgttaccatttgagtaggggttttatatgttgttgctaatttagtaaacataggagagaaatcaaagtttttctgatttgcttttatgtgatttatctgtatactttgttcatttatataaataaatgtcttaatggttt

SEQ ID NO: 32943 - DNA, 1777 bp, Homo sapiens
cggcctttcgaggggaaacatcgcttcacgggcagaaggcatgtaggccaagtaggcgaaggaaacgcacgcgaactgtctaccgtctacgtccaccgatccaagactctcgccatgtcacctcgccccagaaagtgtctgcaaaggacacgcaaccacgctcactcagcgccgggccctatttccttctccacagccggttttccccgaagactataaaatgcgaacctcttccggctgtggaacatggcggcgcccgtggaaaggaccacatttgggggcggggcctggcggtacttccgtccaggtccagcgggtgctgtgatcttcaagtatggggtctgctggcttgtcgcggctgcatgggcttttcgcggtctataagcccccggggctaaaatggaagcacctgcgggatacagtggagctacaacttctgaagggtctcaatgccaggaagcctcccgctcctaaacagcgtgttcgcttcttgctgggccccatggaaggcagcgaagagaaggagctgaccctcacagccaccagcgtaccctctttcatcaaccatccactggtatgtggaccagcattcgcccatctcaaggttggcgtgggacatcggttggatgcccaggcttctggagtacttgtgctcggcgtgggacatggatgcaggctcctcaccgatatgtacaatgctcatcttaccaaggattacacagtgcgtggcctcctgggcaaagctacagatgacttccgtgaggacgggaggctggtagagaagacaacctatgaccacgtgaccagagagaagctggaccgcattctggccgttatccaaggctcccatcagaaggccctggtgatgtactccaacctcgacctgaagacccaggaggcctatgagatggccgtgagaggcctgatccggcccatgaacaagtccccgatgctgataactggcatccgatgcctctactttgcacctccggaattcctcttagaggtgcagtgcatgcatgagacgcagaaagagctgcggaagttggttcatgaaatcggcctggaactaaagaccactgctgtctgcacccaagtgcggcgcacgcgcgacggcttcttcacgctagacagtgccctcctgaggacccagtgggacctaaccaacatccaggatgctatccgggctgctacccctcaggtagctgcagagctggagaagagcttgagcccggggctggacaccaagcagctccccagtccgggatggtcctgggactcccagggcccgagctctaccttggggctggagaggggtgcggggcagtgaatgcccaggcagctcctggggcagtggatggataaatagaagaactgctatgagctggacctgatagctgtgcagaaagtgagagcaggggcaccttttctacgtaagacacaaaactcaagctgtaacagaaaggtcaatggacttgacccaactgagaaggaaaaacttctgtatggaggaaaagacagtaaacatgacagactgatagaaagtattggcagaccaggcgtggtggcgggcacttgtaatcccagctactcccaaggctgaggcaggagaattgcttgagcccaggagtttaaggttgtagtgcgctagacggcgcctgtgaatagccactgcactctagtctggggaacatatgagacccctgccatctcaaaaaaaaaaaaattctcaataaactatgtgcccacgaaaattaaaaattaaaaaaaattgtaa

SEQ ID NO: 32944 - DNA, 1606 bp, Homo sapiens
aaaatcacgtgacctattcacctgggcagagcgctttcccaaacgcctgttctctgtgctttcttactcctcactttcctctgttttccgagggggaaactgactcagtattgttccttgtcacacggttactacgttgtagagtctgtttgaatccgcctgtttcttaactactgctatactgccctctgcaccatgggcttctgctttgtcttctacatcatacttccctgttgtctaatcccccaagtgtttggacagaacaagatattcctggtcagcatcgtggtgcacgcctgtaatcccagctactctggaggctgaggcaggaggatcgcttgagcccaagagtttgacgttacagtctcaatgccaggaagcctcccgctcctaaacagcgtgttcgcttcttgctgggccccatggaaggcagcgaagagaaggagctgaccctcacagccaccagcgtaccctctttcatcaaccatccactggtatgtggaccagcattcgcccatctcaaggttggcgtgggacatcggttggatgcccaggcttctggagtacttgtgctcggcgtgggacatggatgcaggctcctcaccgatatgtacaatgctcatcttaccaaggattacacagtgcgtggcctcctgggcaaagctacagatgacttccgtgaggacgggaggctggtagagaagacaacctatgaccacgtgaccagagagaagctggaccgcattctggccgttatccaaggctcccatcagaaggccctggtgatgtactccaacctcgacctgaagacccaggaggcctatgagatggccgtgagaggcctgatccggcccatgaacaagtccccgatgctgataactggcatccgatgcctctactttgcacctccggaattcctcttagaggtgcagtgcatgcatgagacgcagaaagagctgcggaagttggttcatgaaatcggcctggaactaaagaccactgctgtctgcacccaagtgcggcgcacgcgcgacggcttcttcacgctagacagtgccctcctgaggacccagtgggacctaaccaacatccaggatgctatccgggctgctacccctcaggtagctgcagagctggagaagagcttgagcccggggctggacaccaagcagctccccagtccgggatggtcctgggactcccagggcccgagctctaccttggggctggagaggggtgcggggcagtgaatgcccaggcagctcctggggcagtggatggataaatagaagaactgctatgagctggacctgatagctgtgcagaaagtgagagcaggggcaccttttctacgtaagacacaaaactcaagctgtaacagaaaggtcaatggacttgacccaactgagaaggaaaaacttctgtatggaggaaaagacagtaaacatgacagactgatagaaagtattggcagaccaggcgtggtggcgggcacttgtaatcccagctactcccaaggctgaggcaggagaattgcttgagcccaggagtttaaggttgtagtgcgctagacggcgcctgtgaatagccactgcactctagtctg

SEQ ID NO: 32945 - DNA, 3644 bp, Homo sapiens
atgagaaggcagtgggggtctgccatgagggcggccgagcaggcgggctgcatggtgagcgcctcccgggccggacagcccgaggcgggcccgtggagctgcagcggggtaatcctgagccgtagcccgggcctggtgctttgccacgggggcatcttcgtccccttcctgcgagctggcagcgaagtcctgaccgcggccggcgccgtcttcctgcctggcgacagttgcagggacgacctgcgcctgcacgtgcagtgggccccaacggccgcgggtcccgggggcggcgcggagcggggccgcccagggctgtgcacgccccagtgcgcgagcctcgagcccggcccacctgccccgtcccgcgggcgtcccctgcagccccggcttcctgctgagctgctgctgctgctgagctgcccggccttctgggcccacttcgcgcgcctcttcggggacgaggcagcggaacagtggcgcttctcgagcgcggcgcgggatgacgaagtgtcggaggacgaggaggcggatcaactgagagcgctgggctggtttgcgctgctgggcgtgcggctaggccaggaggaggtggaggaggagcgcgggccagccatggcggtgtcgcctctcggggccgtgcccaagggtgcgccattgctggtctgcggctcccctttcggcgccttctgccccgacatctttctcaacacgctgagctgcggggtgctcagcaacgtggccggcccactgctgcttaccgacgcacgctgcctgcccggcaccgagggcggcggcgtgttcaccgcgcggcccgcgggggcgctggtggcgctggtggtggcgccgctctgttggaaggccggcgaatgggtgggcttcacgctgctctgcgccgccgccccccttttccgcgccgcccgcgacgcgcttcaccgcctgccgcacagcaccgctgccctggccgcccttctgccgccagaggtgggcgtcccgtggggtctgcccctccgagactccgggcccctgtgggcagccgcggcagtgttggtggagtgcggcaccgtatggggctccggagtggctgtggcaccccgccttgtagtgacctgtcggcacgtgtcccctcgggaagcagccagggtcctggtgcgctccaccacccccaagagtgtggccatctggggccgtgtggtatttgccactcaggagacatgtccctatgacatagcagtggtgagcctggaggaggacctggatgatgtccccatccctgtgcccgctgagcacttccatgaaggcgaggctgtgagtgtggtgggctttggcgtctttggccagtcttgcgggccctcggtgacctcaggcatcctttcggctgtggtgcaggtgaatggcacgcccgtaatgctgcagaccacgtgtgctgtgcacagcggctccagtgggggacccctcttctccaaccactcaggaaacctccttggcataatcaccagcaacacccgggacaataatacgggggccacctacccccacctgaacttcagcattcccatcacggtgctccagccggccctgcagcagtacagccagacccaagacctaggtggcctccgtgagctggaccgcgctgctgagccagtcagggtggtgtggcggttgcagcggcccctggcagaggccccgcggagcaagctctgaggctgtgttaccacctttggaaagaagagtgacctttttctgctgtaggaagtgatgttgaggtgacggtggcctcaggattcagggcccagcccctgcaggggcccaggctgcctctcatctccacccactgactgcagactgggctttgggctctggggcaaacttctcttcagccccatggatccttaacctggcagcccgttttggggtgctttcttgagcccccagttctctgtcccctagcactagactcagctgtattgtttttccttctggggagcccactccaactgcacagaagttctgggcctgacaggtagattccagctggaaggcaggcccgtgcctggttttgcgtctgttcccctgagggccatcgtcatcctggagcttcaatggggccttggctcctgtctgcctctcagtcagagtcagggctgacaaaggactcagcttccttagcatctcagcagaaaccttgctctgaagaccagagacagaagggacagaaacaggagtgcctcctgctgtgccaggcccatgggcagtgcaggcagatccctgaaggtcagcactcctgggtcttcatatgccaacaggggcgctcttgacactgtgccttcattttccagcccacagcctgggtctcagggatcttgaggggtagaacatgtctggttggggcttgggaataaacatgatctattgaaaaacctctgtatttatatatcaaattgtttctttttttcaggagttgaactgggaataggcaagtaccaggcaaagaaacacaccctttccttttttttttttttttttctttagagctgtggtcttgctctctcacccaggctggagtgcagtgttgcgatcacagctcactgcagcctcaaactcctgggctccaggagacctcctgcctcagcctcctgaatagctgggactacagtcgcgcaccaccacgcctggctaattttttatttttgtagaaatggggtattgctttgttgcccgtgctggcttcagccttctggtttcaagcagtcctcctgcctcagcttcccaaagtgctgggattacaggtgtgagccactgtgcccaacccagaaatacaccctttctgtgctgttttctcagcagggtgtgagctcacgggatacggtcctgccagactggccctcatagctggtcatgtgccagtcagagctgggtggggcttgcaggtcccggaaggtggtggtcttgacctggcagcagatgcttaaagaatgcctaaggtgggtggcagttggggagttcaagggtgaatgaggccagggcagcccccaggagctgaggccaactctttgagtcaggactgtgccgtgtgcccagggccttgcatgtgtgggccctcgagtgatttctactggcaggctgaaagccctgtgaggggcggctgtgggcggaggccacgcaggaagagtgcttaggagtaacttgtttctaacacctgtgtgctgagtgccaatgctgggtgtggtgttatgatatatattggttttcatccagcattcctgactcgtaactctcatagtccttgttccagtctttgttagaatactgggtatgttagggcttgggacaggcctctgacctctgggtatcctttcactaatgttcgcccacctttttcacagtgggtcctaaagaccttcccatgagagggtctcaatcctaggggaaggaatgttgatgtcatgaaccttccataaaaacccaagaggacagggttcagagagcttctggatagctgaacacctggcacttcctggagtgtggcgtgcccagggagggcacggaagctctgcactccttccccttccctcattccttgctctatgtgcatctcttcatctgtatcctttgcgatatcctttataataaaccggtaaacataa

SEQ ID NO: 32946 - DNA, 3397 bp, Homo sapiens
ccgggtaggggtcctcgctcgctagcttgctgtttctcggagaagctcccgagtgtccggcctagaggccatgagaaggcagtgggggtctgccatgagggcggccgagcaggcgggctgcatggtgagcgcctcccgggccggacagcccgaggcgggcccgtggagctgcagcggggtaatcctgagccgtagcccgggcctggtgctttgccacgggggcatcttcgtccccttcctgcgagctggcagcgaagtcctgaccgcggccggcgccgtcttcctgcctggcgacagttgcagggacgacctgcgcctgcacgtgcagtgggccccaacggccgcgggtcccgggggcggcgcggagcggggccgcccagggctgtgcacgccccagtgcgcgagcctcgagcccggcccacctgccccgtcccgcgggcgtcccctgcagccccggcttcctgctgagctgctgctgctgctgagctgcccggccttctgggcccacttcgcgcgcctcttcggggacgaggcagcggaacagtggcgcttctcgagcgcggcgcgggatgacgaagtgtcggaggacgaggaggcggatcaactgagagcgctgggctggtttgcgctgctgggcgtgcggctaggccaggaggaggtggaggaggagcgcgggccagccatggcggtgtcgcctctcggggccgtgcccaagggtgcgccattgctggtctgcggctcccctttcggcgccttctgccccgacatctttctcaacacgctgagctgcggggtgctcagcaacgtggccggcccactgctgcttaccgacgcacgctgcctgcccggcaccgagggcggcggcgtgttcaccgcgcggcccgcgggggcgctggtggcgctggtggtggcgccgctctgttggaaggccggcgaatgggtgggcttcacgctgctctgcgccgccgccccccttttccgcgccgcccgcgacgcgcttcaccgcctgccgcacagcaccgctgccctggccgcccttctgccgccagaggtgggcgtcccgtggggtctgcccctccgagactccgggcccctgtgggcagccgcggcagtgttggtggagtgcggcaccgtatggggctccggagtggctgtggcaccccgccttgtagtgacctgtcggcacgtgtcccctcgggaagcagccagggtcctggtgcgctccaccacccccaagcataatcaccagcaacacccgggacaataatacgggggccacctacccccacctgaacttcagcattcccatcacggtgctccagccggccctgcagcagtacagccagacccaagacctaggtggcctccgtgagctggaccgcgctgctgagccagtcagggtggtgtggcggttgcagcggcccctggcagaggccccgcggagcaagctctgaggctgtgttaccacctttggaaagaagagtgacctttttctgctgtaggaagtgatgttgaggtgacggtggcctcaggattcagggcccagcccctgcaggggcccaggctgcctctcatctccacccactgactgcagactgggctttgggctctggggcaaacttctcttcagccccatggatccttaacctggcagcccgttttggggtgctttcttgagcccccagttctctgtcccctagcactagactcagctgtattgtttttccttctggggagcccactccaactgcacagaagttctgggcctgacaggtagattccagctggaaggcaggcccgtgcctggttttgcgtctgttcccctgagggccatcgtcatcctggagcttcaatggggccttggctcctgtctgcctctcagtcagagtcagggctgacaaaggactcagcttccttagcatctcagcagaaaccttgctctgaagaccagagacagaagggacagaaacaggagtgcctcctgctgtgccaggcccatgggcagtgcaggcagatccctgaaggtcagcactcctgggtcttcatatgccaacaggggcgctcttgacactgtgccttcattttccagcccacagcctgggtctcagggatcttgaggggtagaacatgtctggttggggcttgggaataaacatgatctattgaaaaacctctgtatttatatatcaaattgtttctttttttcaggagttgaactgggaataggcaagtaccaggcaaagaaacacaccctttccttttttttttttttttttctttagagctgtggtcttgctctctcacccaggctggagtgcagtgttgcgatcacagctcactgcagcctcaaactcctgggctccaggagacctcctgcctcagcctcctgaatagctgggactacagtcgcgcaccaccacgcctggctaattttttatttttgtagaaatggggtattgctttgttgcccgtgctggcttcagccttctggtttcaagcagtcctcctgcctcagcttcccaaagtgctgggattacaggtgtgagccactgtgcccaacccagaaatacaccctttctgtgctgttttctcagcagggtgtgagctcacgggatacggtcctgccagactggccctcatagctggtcatgtgccagtcagagctgggtggggcttgcaggtcccggaaggtggtggtcttgacctggcagcagatgcttaaagaatgcctaaggtgggtggcagttggggagttcaagggtgaatgaggccagggcagcccccaggagctgaggccaactctttgagtcaggactgtgccgtgtgcccagggccttgcatgtgtgggccctcgagtgatttctactggcaggctgaaagccctgtgaggggcggctgtgggcggaggccacgcaggaagagtgcttaggagtaacttgtttctaacacctgtgtgctgagtgccaatgctgggtgtggtgttatgatatatattggttttcatccagcattcctgactcgtaactctcatagtccttgttccagtctttgttagaatactgggtatgttagggcttgggacaggcctctgacctctgggtatcctttcactaatgttcgcccacctttttcacagtgggtcctaaagaccttcccatgagagggtctcaatcctaggggaaggaatgttgatgtcatgaaccttccataaaaacccaagaggacagggttcagagagcttctggatagctgaacacctggcacttcctggagtgtggcgtgcccagggagggcacggaagctctgcactccttccccttccctcattccttgctctatgtgcatctcttcatctgtatcctttgcgatatcctttataataaaccggtaaacataa

SEQ ID NO: 32947 - DNA, 1175 bp, Homo sapiens
cccactgggtagaaggaacagggagcggccaggatgctgaatctgctgctgctggcgctgcccgtcctggcgagccgcgcctacgcggcccctgccccaggccaggccctgcagcgagtgggcatcgtcgggggtcaggaggcccccaggagcaagtggccctggcaggtgagcctgagagtccacggcccatactggatgcacttctgcgggggctccctcatccacccccagtgggtgctgaccgcagcgcactgcgtgggaccggacgtcaaggatctggccgccctcagggtgcaactgcgggagcagcacctctactaccaggaccagctgctgccggtcagcaggatcatcgtgcacccacagttctacaccgcccagatcggagcggacatcgccctgctggagctggaggagccggtgaacgtctccagccacgtccacacggtcaccctgccccctgcctcagagaccttccccccggggatgccgtgctgggtcactggctggggcgatgtggacaatgatgagcgcctcccaccgccatttcctctgaagcaggtgaaggtccccataatggaaaaccacatttgtgacgcaaaataccaccttggcgcctacacgggagacgacgtccgcatcgtccgtgacgacatgctgtgtgccgggaacacccggagggactcatgccagggcgactccggagggcccctggtgtgcaaggtgaatggcacctggctgcaggcgggcgtggtcagctggggcgagggctgtgcccagcccaaccggcctggcatctacacccgtgtcacctactacttggactggatccaccactatgtccccaaaaagccgtgagtcaggcctgggttggccacctgggtcactggaggaccaacccctgctgtccaaaacaccactgcttcctacccaggtggcgactgccccccacaccttccctgccccgtcctgagtgccccttcctgtcctaagccccctgctctcttctgagccccttcccctgtcctgaggacccttccctatcctgagcccccttccctgtcctaagcctgacgcctgcaccgggccctccagccctcccctgcccagatagctggtggtgggcgctaatcctcctgagtgctggacctcattaaagtgcatggaaatca

SEQ ID NO: 32948 - DNA, 1353 bp, Homo sapiens
ggtaagtccccactctcagagaccctgacatcagcgtcacctggagcagagtggcccagcctcagactcagagcaccaagacccaggcccgcaggcctggacccaccccggtccccccgtcccagctccattcttcaccccacaatctgtagcccccagccctgccctgtgaggcccggccaggcccacgatgctcctccttgctccccagatgctgaatctgctgctgctggcgctgcccgtcctggcgagccgcgcctacgcggcccctgccccaggccaggccctgcagcgagtgggcatcgtcgggggtcaggaggcccccaggagcaagtggccctggcaggtgagcctgagagtccacggcccatactggatgcacttctgcgggggctccctcatccacccccagtgggtgctgaccgcagcgcactgcgtgggaccggacgtcaaggatctggccgccctcagggtgcaactgcgggagcagcacctctactaccaggaccagctgctgccggtcagcaggatcatcgtgcacccacagttctacaccgcccagatcggagcggacatcgccctgctggagctggaggagccggtgaacgtctccagccacgtccacacggtcaccctgccccctgcctcagagaccttccccccggggatgccgtgctgggtcactggctggggcgatgtggacaatgatgagcgcctcccaccgccatttcctctgaagcaggtgaaggtccccataatggaaaaccacatttgtgacgcaaaataccaccttggcgcctacacgggagacgacgtccgcatcgtccgtgacgacatgctgtgtgccgggaacacccggagggactcatgccagggcgactccggagggcccctggtgtgcaaggtgaatggcacctggctgcaggcgggcgtggtcagctggggcgagggctgtgcccagcccaaccggcctggcatctacacccgtgtcacctactacttggactggatccaccactatgtccccaaaaagccgtgagtcaggcctgggttggccacctgggtcactggaggaccaacccctgctgtccaaaacaccactgcttcctacccaggtggcgactgccccccacaccttccctgccccgtcctgagtgccccttcctgtcctaagccccctgctctcttctgagccccttcccctgtcctgaggacccttccctatcctgagcccccttccctgtcctaagcctgacgcctgcaccgggccctccagccctcccctgcccagatagctggtggtgggcgctaatcctcctgagtgctggacctcattaaagtgcatggaaatca

SEQ ID NO: 32949 - DNA, 963 bp, Homo sapiens
ggagcagagtggcccagcctcagactcagagcaccaagacccaggcccgcaggcctggacccaccccggtccccccgtcccagctccattcttcaccccacaatctgtagcccccagccctgccctgtgaggcccggccaggcccacgatgctcctccttgctccccagatgctgagcctgctgctgctggcgctgcccgtcctggcgagcccggcctacgtggcccctgccccaggccaggccctgcagcaaacgggcattgttggggggcaggaggcccccaggagcaagtggccctggcaggtgagcctgagagtccgcggcccatactggatgcacttctgcgggggctccctcatccacccccagtgggtgctaaccgcggcgcactgcgtggaaccggacatcaaggatctggccgccctcagggtgcaactgcgggagcagcacctctactaccaggaccagctgctgccggtcagcaggatcatcgtgcacccacagttctacatcatccagaccggggcggacatcgccctgctggagctggaggagcccgtgaacatctccagccacatccacacggtcacgctgccccctgcctcggagaccttccccccggggatgccgtgctgggtcactggctggggcgacgtggacaataatgtgcacctgccgccgccatacccgctgaaggaggtggaagtccccgtagtggaaaaccacctttgcaacgcggaatatcacaccggcctccatacgggccacagctttcaaatcgtccgcgatgacatgctgtgtgcggggagcgaaaatcacgactcctgccagggtgactctggagggcccctggtctgcaaggtgaatggcacctaactgcaggcgggcgtggtcagctgggaggagagctgtgcccagcccaaccggcctggcatctacacccgtgtcacctactacttgga

SEQ ID NO: 32950 - DNA, 827 bp, Homo sapiens
cccgctgggtagaaggaacagggagtggccaggatgctgagcctgctgctgctggcgctgcccgtcctggcgagcccggcctacgtggcccctgccccaggccaggccctgcagcaaacgggcattgttggggggcaggaggcccccaggagcaagtggccctggcaggtgagcctgagagtccgcggcccatactggatgcacttctgcgggggctccctcatccacccccagtgggtgctaaccgcggcgcactgcgtggaaccggacatcaaggatctggccgccctcagggtgcaactgcgggagcagcacctctactaccaggaccagctgctgccggtcagcaggatcatcgtgcacccacagttctacatcatccagaccggggcggacatcgccctgctggagctggaggagcccgtgaacatctccagccacatccacacggtcacgctgccccctgcctcggagaccttccccccggggatgccgtgctgggtcactggctggggcgacgtggacaataatgtgcacctgccgccgccatacccgctgaaggaggtggaagtccccgtagtggaaaaccacctttgcaacgcggaatatcacaccggcctccatacgggccacagctttcaaatcgtccgcgatgacatgctgtgtgcggggagcgaaaatcacgactcctgccagggtgactctggagggcccctggtctgcaaggtgaatggcacctaactgcaggcgggcgtggtcagctgggaggagagctgtgcccagcccaaccggcctggcatctacacccgtgtcacctactacttgga

SEQ ID NO: 32951 - DNA, 1105 bp, Homo sapiens
ccatggcccttggggcctgtggcctcctgctgctcctggctgtgcccggtgtgtccctcaggactttgcagccagggtgtggccggccgcaggtttcggatgcaggcggccggatcgtggggggtcacgctgccccggccggcgcatggccatggcaggccagcctccgcctgcggagggtgcacgtgtgcggcgggtcactgctcagcccccagtgggtgctcacagctgcccactgcttctccgggtccctgaactcatccgactaccaggtgcacctgggggaactggagatcactctgtctccccacttctccaccgtgaggcagatcatcctgcactccagcccctcaggacagccggggaccagcggggacatcgccctggtggagctcagtgtccccgtgaccctctccagccggatcctgcccgtctgcctcccggaggcctcagatgacttctgccctgggatccggtgctgggtgaccggctggggctatacgcgggagggagagcctctgccacccccgtacagcctgcgggaggtgaaagtctccgtggtggacacagagacctgccgccgggactatcccggccccgggggcagcatccttcagcccgacatgctgtgtgcccggggccccggggatgcctgccaggacgactccggggggcctctggtctgccaggtgaacggtgcctgggtgcaggctggcactgtgagctggggtgagggctgcggccgccccaacaggccgggagtctacactcgtgtccctgcctacgtgaactggatccgccgccacatcacagcatcagggggctcagagtctgggtaccccaggctccccctcctggctggcttcttcctccccggcctcttccttctgctagtctcctgtgtcctgctggccaagtgcctgctgcacccatctgcggatggtactcccttccccgcccctgactgatggcaggaatccaagtgcatttcttaaataagttactatttattccgctccgccccctccctctcccttgagaagctgagtcttctgcatcagattattgcaacatttaacctgaatttaaaagcacacgaaacaaa

SEQ ID NO: 32952 - DNA, 1701 bp, Homo sapiens
aaggtcaatgatagcatctgcctagagtcaaacctccgtgcttctcagacagtgccttttcaccatgagtgggtgcccatttttaggaaacaactttggatatacttttaaaaaactccccgtagaaggcagcgaagaagacaaatcacaaactggtgtgaatagagccagcaaaggaggtcttatctatgggaactacctgcatttggaaaaagttttgaatgcacaagaactgcaaagtgaaacaaaaggaaataaaatccatgatgaacatctttttatcataactcatcaagcttatgaactctggtttaagcaaatcctctgggagttggattctgttcgagagatctttcagaatggccatgtcagagatgaaaggaacatgcttaaggttgtttctcggatgcaccgagtgtcagtgatcctgaaactgctggtgcagcagttttccattctggagacgatgacagccttggacttcaatgacttcagagagtacttatctccagcatcaggcttccagagtttgcaattccgactattagaaaacaagataggtgttcttcagaacatgagagtcccttataacagaagacattatcgtgataacttcaaaggagaagaaaatgaactgctacttaaatctgagcaggaaaagacacttctggaattagtggaggcatggctggaaagaactccaggtttagagccacatggatttaacttctggggaaagcttgaaaaaaatatcaccagaggcctggaagaggaattcataaggattcaggctaaagaagagtctgaagaaaaagaggaacaggtggctgaatttcagaagcaaaaagaggtgctactgtccttatttgatgagaaacgtcatgaacatctccttagtaaaggtgaaagacggctgtcatacagagcacttcagggagcattgatgatatatttttacagggaagagcctaggttccaggtgccttttcagttgctgacttctcttatggacatagattcactgatgaccaaatggagatataaccatgtgtgcatggtgcacagaatgctgggcagcaaagctggcaccggtggttcctcaggctatcactacctgcgatcaactgtgagtgataggtacaaggtatttgtagatttatttaatctttcaacatacctgattccccgacactggataccgaagatgaacccaaccattcacaaatttctatatacagcagaatactgtgatagctcctacttcagcagtgatgaatcagattaaaatcgtctgcaaaatctatgaagaatactggtttcacagcctattttttattttctatggattttcataaatacagtttgaatatatgtatgcatatattgttcagcaccacgatgctctgatttaattctagaaacaatttgattacctcttgtttgtgacaagactaagcattaagatgagaaagaatacatttaaatagtaacattgtacatagggtgttttcctattaaaaattcagtttcccctgagacttaatgtaaccacttaatgtaatcactatctcattgtttcatctttataaacttgtaaacttcatctatttcaaatattttatgcagtacattatattattctgtacaaaggctttcaaacaaaatttttaaaataataaagtattaatctttctccctgta

SEQ ID NO: 32953 - DNA, 5325 bp, Homo sapiens
aattctcctggctagcagttatccatctagtgcatatgtatctagagctggccaggcctttagtttacaaaataaatagaaagccttgtccccactctggaggagcttgctgccttgttagaaggtgagatatgttcgaatagaacatttggggaaaccatttgagacctggtataatgaagtgctaagattgtgggcaaggtggggaggaggtaggccttcctgactagtttaggctacaatagttgggaagactgcaagaagccagcaggcttcagtcatgccctaaaagagcgattggtttagaaaaaaaacaaaagggaactactaacatgtattctattctaggcaggtgtcaggcaaagttgtatcttattttggtctcactagattcttgcaaagcttatctgcatatccaggttttataaaaggttaagaaactgaagctcctagaagtaaatgagcccttagttatcaaatattgtctgcattgtgcaacttcttttttagcccgtagtctttgttttcatactttagttttagagaattactccaaattcatcatgattgaagacaataaggagaacaaagaccattccttagaaaggggaagagcaagtctcattttttccttaaagaatgaagttggaggacttataaaagccctgaaaatctttcaggagaagcatgtgaatctgttacatatcgagtcccgaaaatcaaaaagaagaaactcagaatttgagatttttgttgactgtgacatcaacagagaacaattgaatgatatttttcatctgctgaagtctcataccaatgttctctctgtgaatctaccagataattttactttgaaggaagatggtatggaaactgttccttggtttccaaagaagatttctgacctggaccattgtgccaacagagttctgatgtatggatctgaactagatgcagaccatcctggcttcaaagacaatgtctaccgtaaacgtcgaaagtattttgcggacttggctatgaactataaacatggagaccccattccaaaggttgaattcactgaagaggagattaagacctggggaaccgtattccaagagctcaacaaactctacccaacccatgcttgcagagagtatctcaaaaacttacctttgctttctaaatattgtggatatcgggaggataatatcccacaattggaagatgtctccaactttttaaaagagcgtacaggtttttccatccgtcctgtggctggttacttatcaccaagagatttcttatcaggtttagcctttcgagtttttcactgcactcaatatgtgagacacagttcagatcccttctataccccagagccagatacctgccatgaactcttaggtcatgtcccgcttttggctgaacctagttttgcccaattctcccaagaaattggcttggcttctcttggcgcttcagaggaggctgttcaaaaactggcaacgtgctactttttcactgtggagtttggtctatgtaaacaagatggacagctaagagtctttggtgctggcttactttcttctatcagtgaactcaaacatgcactttctggacatgccaaagtaaagccctttgatcccaagattacctgcaaacaggaatgtcttatcacaacttttcaagatgtctactttgtatctgaaagttttgaagatgcaaaggagaagatgagagaatttaccaaaacaattaagcgtccatttggagtgaagtataatccatatacacggagtattcagatcctgaaagacaccaagagcataaccagtgccatgaatgagctgcagcatgatctcgatgttgtcagtgatgcccttgctaaggtcagcaggaagccgagtatctaacagtagccagtcatccaggaacatttgagcatcaattcggaggtctgggccatctcttgctttccttgaacacctgatcctggagggacagcatcttctggccaaacaatattatcgaattccactacttaaggaatcactagtctttgaaaatttgtacctggatattctatttaccacttatttttttgtttagttttatttctttttttttttggtagcagctttaatgagacaatttatataccatacaagccactgaccacccatttttaatagagaagttgtttgacccaatagatagatctaatctcagcctaactctattttccccaatcctccttgagtaaaatgaccctttaggatcgcttagaataacttgaggagtattatggcgctgactcatattgttacctaagatccccttatttctaaagtatctgttacttattgctgaatttgtgccaagctcaatcacattcacactaaaatttaacaggagaccctgctgtctttgttgctagcatgagcaaaagtatagaggcctttgcacatggaggatacctagtaaagagcaagtagtctagtttcaagtgtagtatcttgtagggaaatgggagtagctaagcctggaaaggttgaatggggcataatcattaagactaggctaaaaattcgagactttattttttaggcattagggagccccttcccaagtgactatcttccttgaaactttgttttctttcaatgacatcacacgatactggttttattctggactatctatcctactcatgggtccaagggaaacttagtagagatgcgacttgcatggggctgtactcagacatgtggtcctaggtattataatgggattgtccccagattaacaggaagcattgttatcaaaggaagagttcaaactgagatagataagagaagcacaaagtaaaagatagaaaaaacagtgctgagtactttatttctaaggtataaggtgaggccataaacagaaaggtatgcaatgagagtagaggctgcagaaaaggggaggaaatagaatgtcagaaaggtcaagaagagtggtttaggactgagactgtaagtaatgtaaggattgccaaggaatggtttttatgcagagtcagctgtgtagcacagggagtaagcagtcctgttataaatgggtgaagctgaactccaaaatacaaacttatgtctctttaatttgcccctttcctccctctagtcactaaatgaagatgttcttcaagtttctgtctttgcacttctactctttttgccatctcttcatggggaatgtcacccagatacatgacttcagttcttattttgaatgactcctctatttgcagttataaccctgacatctttcttgaatttttttgccccttaattccaacgaactcctggatgtctatgtagatgtctcataatttaggccaatgctgtacaacttcatgtggcatcatccacatagaatgaataggggttgttcaatatgacagccctgccaagcatctcaaattgaacaggtctataaaggaactcagaatcacttgaatatcacagtccatcagcttcctttcccagtaatttaatttccattaatggtatattaaacatcgtattttcaatcatttttaggtttagtcagctacttaaaaataggctttttcttcacataaataaattgtataccatttaatgtgttttatttcaacagactaatagatcttttaacacttcttagtcctcaaaataaattattaaaaactttgtatttcatgtcatattatataaggaaatagaattttgaagaataattcatgctgttttaaatttttacattgtacattttaatagctaatcaactcttaagtatacatttgatggtaaatagatgctagctaatctagaatcatttgaaatattgattatctgatttatagtttggttgcaaggaaatctactgtaagcaaatcataatagatagcaaatcttagaacatgtagaaaaaaagaaattaaaaaaagcaaatcttagaacatgtagaaaaaggaaattaaaaaatagatagcaaataacacaaattatgcatactatatgtggttattttcatacaactttgataacggtgaagaatcatacttattgaattttaaaatgatgatgtttaaaatcactctatgactaaagcacatgagaataaatgttaaaggcacagccttataatccacaacttcagaacaatggaatttttttttttttttttttttttttttttttttttttttttttgagacggagtcttgctctgtcgcccaggctggagtgcagtggtgcgatcttggctcactgcaagctccacctcccaggttcacggcattctcctgcctctgtctcctgagtagctgggactacaggcgcccgccaccacgtccggctcattttttgtatttttagtagagacaaggtttcaccgtgttagccaggatggtttcaatctcctgacattgtgatctgcccacctcggcctcccaaagtgctgggattacaggcgtgagccactgcacccggccaaacattggaaatttttaatgatggatttcagttcttctcacctctgggtatttgtaatatttggtaaatcaggagtcctgagagtcttagaattttcatgcattttaaatatatgtcttcaaagcacctaggaatatgtaaatagttacccaaatgtgagaacagaattgaactaaaagcttcgtttataatttttttttttttttgagacagagtctcactctgttgcccaggctggagcgcagttgcgtgatttcagctcgctgcaacctgggactgcaggcgtgcttcaccatgccccgctaatttttgtttttttagtagagatggggtttcgccatgttggccaggctggtctcgaacttctgaccgcaggtgatccatccgcctcggcctcccaaagtgctgggattacaagcatgagccaccatgcccagccggttaataattcttaatcagtaaatcattattcaaagacatagttaatatcttcatgacttcttaaggatgctcaaaagctggtcttcagaatacctacatttctttatctacatattctgtcatttggagttatacaagtagtaatgacacaccaaaatgtaaataattattgttagcttttaagttggcttccaaattcaaaaaagaaaaaaatcctgaattctctaaaggaacatatgatagagtccatatgttaattcataggaagtgtttaaggtactatggtctattttggtctaatctttgttttactatgtaatatatatttatgatttacaagtttgttattcagtgggataataaatgaacacaaaattta

SEQ ID NO: 32954 - DNA, 1427 bp, Homo sapiens
ttttagagaattactccaaattcatcatgattgaagacaataaggagaacaaagaccattccttagaaaggggaagagcaagtctcattttttccttaaagaatgaagttggaggacttataaaagccctgaaaatctttcaggagaagcatgtgaatctgttacatatcgagtcccgaaaatcaaaaagaagaaactcagaatttgagatttttgttgactgtgacatcaacagagaacaattgaatgatatttttcatctgctgaagtctcataccaatgttctctctgtgaatctaccagataattttactttgaaggaagatggtatggaaactgttccttggtttccaaagaagatttctgacctggaccattgtgccaacagagttctgatgtatggatctgaactagatgcagaccatcctggcttcaaagacaatgtctaccgtaaacgtcgaaagtattttgcggacttggctatgaactataaacatggagaccccattccaaaggttgaattcactgaagaggagattaagacctggggaaccgtattccaagagctcaacaaactctacccaacccatgcttgcagagagtatctcaaaaacttacctttgctttctaaatattgtggatatcgggaggataatatcccacaattggaagatgtctccaactttttaaaagagcgtacaggtttttccatccgtcctgtggctggttacttatcaccaagagatttcttatcaggtttagcctttcgagtttttcactgcactcaatatgtgagacacagttcagatcccttctataccccagagccagatacctgccatgaactcttaggtcatgtcccgcttttggctgaacctagttttgcccaattctcccaagaaattggcttggcttctcttggcgcttcagaggaggctgttcaaaaactggcaacgtgctactttttcactgtggagtttggtctatgtaaacaagatggacagctaagagtctttggtgctggcttactttcttctatcagtgaactcaaacatgcactttctggacatgccaaagtaaagccctttgatcccaagattacctgcaaacaggaatgtcttatcacaacttttcaagatgtctactttgtatctgaaagttttgaagatgcaaaggagaagatgagagaatttaccaaaacaattaagcgtccatttggagtgaagtataatccatatacacggagtattcagatcctgaaagacaccaagagcataaccagtgccatgaatgagctgcagcatgatctcgatgttgtcagtgatgcccttgctaagtcactaaatgaagatgttcttcaagtttctgtctttgcacttctactctttttgccatctcttcatggggaatgtcacccagatacatga

SEQ ID NO: 32955 - DNA, 2992 bp, Homo sapiens
accgggatccatgcagccagcaatgatgatgttttccagtaaatactgggcacggagagggttttccctggattcagcagtgcccgaagagcatcagctacttggcagctcaacactaaataaacctaactctggcaaaaatgacgacaaaggcaacaagggaagcagcaaacgtgaagctgctaccgaaagtggcaagacagcagttgttttctccttgaagaatgaagttggtggattggtaaaagcactgaggctctttcaggaaaaacgtgtcaacatggttcatattgaatccaggaaatctcggcgaagaagttctgaggttgaaatctttgtggactgtgagtgtgggaaaacagaattcaatgagctcattcagttgctgaaatttcaaaccactattgtgacgctgaatcctccagagaacatttggacagaggaagaagagctagaggatgtgccctggttccctcggaagatctctgagttagacaaatgctctcacagagttctcatgtatggttctgagcttgatgctgaccacccaggatttaaggacaatgtctatcgacagagaagaaagtattttgtggatgtggccatgggttataaatatggcccaagactgttagctgctattggcgactgggaatttcagctcttttctgtatcaagttctttgagctcaagctccttgtgtatgttgagcgtgcacatattgatggatgttagatccattgttgttgctgttgatatttaatttcatgatagtttttgcagatgaaaatcacttctctagaatatgaagaggactttctgcaaggtgagaaaatagtgggaagccctatcctgtggtgcacaggacaaataaaaacaaataatttctaggagttaaatctttgttctccctgaggctccttaggtgcagtagtttattttcattacgtctcttgtaaaggcagcaccaatattaacaacgcgaacaaaacaaactaatgtttttgtttgctcccatctgaaagttccttaaggcccgtagactcatttacgaaaattcatgtgtgcaaaactcatttgcaaaagcaaataaaatatgtgatcgcaaatgctctttacctgactggcctaggggactagctgaaaatgcgtttatgcctttatgtttactctatggcgtggcttagcagtcgtggggctcctaacctcctctacagatgagtccccgtcaagccacgtatgtcagatgacttgaatgttttgaaattcaggcatcatttagatggttgttaagttgctgtactgatttgtgagtttttgtttgtaaaaaaatattattaaatcattgtgctctgtagccttggaaatgtttttgaagttcattcattacaatgttcagccaaggaaacatctctgtatttagttaagttcggacttttctgtccctttgggtttacatatgctgctttctttcctggtgaaaattttggttacaagtgtgactgagtgatgatgtctagataagggtcaggaaaactgaattgagaaaattagaaaaaagaaacccttatatgtaaattgtacataggaataattggaggctaccagaaagtttgttacaatcctgaatctttgctttttgcatagtaattgaaatatatgaggcaagacaaatacatacctgccagactctctgaggcataactattttttccctaacatttaaatctgtgttttgctttaggctgattgattgatttactcacttaacaaatattatttttttgttttgttttgttttgttttgagatagagtatctgtcatccaagctgaggtgcagtggcacgatctcagctcactgcaacctccgcctcctgggttcaagcgattctcctgcctcagtctctctagtagctggaattataggcacacgccaccatgcccggttaattttagtatttttagtatttttgtatttttagttgatgcagaatatatatatatattctggcaatatttttccagtctcagaggcataagccatcttcttgaatactcattgagtatttggctgtatattgtagacacctggatgcaggtgatactatttcatgaaggtggtaccaactaatatagtactaggtaacactatggttactggctaaaaatgagagtcatcaattactgattgaaatttctacacacctggtgtgacacctcagttgtgagacatgcaacaaatgcttgataagagttaattataaattttgtgatgatgaattttttttttaacttttactttaggtttaggggtacatgtgaaggtttgttacataggtaaacacatgtcatggggttttgttgtacatattatttcatcacccaggtgttaagcctagtacccaatagtttactttcctgctcctcaccctcctctcaccctccaccctccaggagaccccagtgtctgtggtttccttctttgtgttcataagttcttatcatttagctcccacttacaagtgagaacatgcagtatttagttttctgttccttcattagtttgctaaggataatagcctccagctccatccatgttgctgcaaaagacattatctcatttttttatggctgcatagtattccatcgtgtatatgtaccacatttttctcatgcaatctgtcactgatggacatgtaggttgattctgtgtctttgctattgtaaatagtgctgcagtgaacttccgcatgcatgtgtcttgatgatagaatgatttatattcctctgggtatatactcagtaacgggattgctaggttgaatggtaattctgcttttagctctttgatgaatggccatactgctttccacaatggttgaactaatttacactcccaccaacagtgtataagtgtttccttttctctgcaaccttgccagcatctgttatttttttgacttttaaataataaacattctgactggtgtg

SEQ ID NO: 32956 - DNA, 2360 bp, Homo sapiens
cattgctcttcagcaccagggttctggacagcgccccaagcaggcagctgatcgcacgccccttcctctcaatctccgccagcgctgctactgcccctctagtaccccctgctgcagagaaagaatattacaccgggatccatgcagccagcaatgatgatgttttccagtaaatactgggcacggagagggttttccctggattcagcagtgcccgaagagcatcagctacttggcagctcaacactaaataaacctaactctggcaaaaatgacgacaaaggcaacaagggaagcagcaaacgtgaagctgctaccgaaagtggcaagacagcagttgttttctccttgaagaatgaagttggtggattggtaaaagcactgaggctctttcaggaaaaacgtgtcaacatggttcatattgaatccaggaaatctcggcgaagaagttctgaggttgaaatctttgtggactgtgagtgtgggaaaacagaattcaatgagctcattcagttgctgaaatttcaaaccactattgtgacgctgaatcctccagagaacatttggacagaggaagaagagctagaggatgtgccctggttccctcggaagatctctgagttagacaaatgctctcacagagttctcatgtatggttctgagcttgatgctgaccacccaggatttaaggacaatgtctatcgacagagaagaaagtattttgtggatgtggccatgggttataaatatggtcagcccattcccagggtggagtatactgaagaagaaactaaaacttggggtgttgtattccgggagctctccaaactctatcccactcatgcttgccgagagtatttgaaaaacttccctctgctgactaaatactgtggctacagagaggacaatgtgcctcaactcgaagatgtctccatgtttctgaaagaaaggtctggcttcacggtgaggccggtggctggatacctgagcccacgagactttctggcaggactggcctacagagtgttccactgtacccagtacatccggcatggctcagatcccctctacaccccagaaccagacacatgccatgaactcttgggacatgttccactacttgcggatcctaagtttgctcagttttcacaagaaataggtctggcgtctctgggagcatcagatgaagatgttcagaaactagccacgtgctatttcttcacaatcgagtttggcctttgcaagcaagaagggcaactgcgggcatatggagcaggactcctttcctccattggagaattaaagcacgccctttctgacaaggcatgtgtgaaagcctttgacccaaagacaacttgcttacaggaatgccttatcaccaccttccaggaagcctactttgtttcagaaagttttgaagaagccaaagaaaagatgagggactttgcaaagtcaattacccgtcccttctcagtatacttcaatccctacacacagagtattgaaattctgaaagacaccagaagtattgaaaatgtggtgcaggaccttcgcagcgacttgaatacagtgtgtgatgctttaaacaaaatgaaccaatatctggggatttgatgcctggaactatgttgttgccagcatgatctttttggggcttagcagcagttcagtcaatgtcatataacgcaaataaccttctgtgtcatggcttggctaataagcatgcaattccatatatctataccatcttgtaactcactgtgttagtatataaagcaccataagaaatccaatggcagataaccactcattgtatgaaataacgtattatgtttaaacatcttaaaaagatttgacattcctgcttagtgtccttaaccaaactgcatctagttaaaatttgtaacaaatagccctcttatgagtctcatttatgcccttttctttttcagatctaagcctttcctctgtgttcattagataaaatgaaaaaaagcagtgaagctgtttccattttcaatagtatcagtgttttcacgcattatttgagataaacccagaattgtaggaaacttcccatcacaataacaaaggttcaatattctatttcaaaaattgttgaggtaacacagcagttggaatgatttttaggttgagtatttacacaatgcaagaaaacacctttttacaaatggaattatgtaggttgcgttgaccttgtagaacctgagttatgacaagcttcctgaagtattttggaagatagtacttccggaaaggacattaggaaagactaaacagtggacaatcaatcttgggactatgaattttatgctggaataaagtaaattatcatgttc

SEQ ID NO: 32957 - DNA, 1616 bp, Homo sapiens
cgcgagggcgacgcagttcgcaggcgcgtcggcgcgcctgttctggggcgcttggcttcaccgcgcaggcgcggtcgccgctgttgttgtggtccccatggagctgccgtagcggacccagcacagccaggagcgtccgggatgagctcagccgcggccgaccactgggcgtggttgctggtgctcagcttcgtgtttggatgcaatgttcttaggatcctcctcccgtccttctcatccttcatgtccagggtgctgcagaaggacgcggagcaggagtcacagatgagagcggagatccaggacatgaagcaggagctctccacagtcaacatgatggacgagtttgccagatatgccaggctggaaagaaagatcaacaagatgacggataagctcaaaacccatgtgaaagctcggacagctcaattagccaagataaaatgggtgataagtgtcgctttctacgtattgcaggctgccctgatgatctcactcatttggaagtattattctgtccctgtggctgtcgtgccgagtaaatggataacccctctagaccgcctggtagcctttcctactagagtagcaggtggtgttggaattacctgttggattttagtctgtaacaaagttgtcgctattgtgcttcatccgttcagctgaacaggaggatggatacagccgcgaggctaaaaaacggatttcctcttcctagcttaaaatctgatttacactgttttgttttttaagaaacaaaagtgcatagtttagattttttttttgttgaatatgtttgttcttggactttatgagagagtcttataagaatcacgattttctacacctgtcattgagccaagaaagtccagtttatgacacgtatgtactagtgaacaccgtcctcgatctgtacgaaatgtgaaatgtttagggacatctccatgctgtcacttgtgatttgccctcttatgtattttggtcatattgccaactggaaagtcaaaattttctaacaactttaagtaagttctttgaagacttagtgctgtttttaatccagtttagaaagtaacttaattttaataccactactaaaaattcgaaaatttcttctttaatcacattcaatatggttaaaagaacaacactaattgacattgcgtgggctttttctccctttgtttaaaatgtcatttgttgagcaagagttgtatagtattatctacttacttgaggctgttaatttttcattacagtgttttgtaaatgtatccacgagaccatgatgcattgttttgtgctcaacttgtgttttgtatttaaagcattttgaatgaagtgtattttataagcatttaatatttatgctctttagaatggaacacagaaaacaaaccttataagtcctgattaatctgaaccaataacctgtgtggcctacaaagtataattctattaaatgttccttaaaacacttttttctaattaaaatctttgcaaatgcttgtgtaacttcctgccttacagctacttgtttgctgtgagccacccgcaactgacaagtggctgttaactgagtcaccatatcccagtaaagctgaattttctcacta

SEQ ID NO: 32958 - DNA, 1464 bp, Homo sapiens
atgcgcagacaccctcaggcgactggcgggtcgcggcttccaagctctaaatggagagttgtccctactgtgcggcaggcggaggagacctatgtccagggtgctgcagaaggacgcggagcaggagtcacagatgagagcggagatccaggacatgaagcaggagctctccacagtcaacatgatggacgagtttgccagatatgccaggctggaaagaaagatcaacaagatgacggataagctcaaaacccatgtgaaagctcggacagctcaattagccaagataaaatgggtgataagtgtcgctttctacgtattgcaggctgccctgatgatctcactcatttggaagtattattctgtccctgtggctgtcgtgccgagtaaatggataacccctctagaccgcctggtagcctttcctactagagtagcaggtggtgttggaattacctgttggattttagtctgtaacaaagttgtcgctattgtgcttcatccgttcagctgaacaggaggatggatacagccgcgaggctaaaaaacggatttcctcttcctagcttaaaatctgatttacactgttttgttttttaagaaacaaaagtgcatagtttagattttttttttgttgaatatgtttgttcttggactttatgagagagtcttataagaatcacgattttctacacctgtcattgagccaagaaagtccagtttatgacacgtatgtactagtgaacaccgtcctcgatctgtacgaaatgtgaaatgtttagggacatctccatgctgtcacttgtgatttgccctcttatgtattttggtcatattgccaactggaaagtcaaaattttctaacaactttaagtaagttctttgaagacttagtgctgtttttaatccagtttagaaagtaacttaattttaataccactactaaaaattcgaaaatttcttctttaatcacattcaatatggttaaaagaacaacactaattgacattgcgtgggctttttctccctttgtttaaaatgtcatttgttgagcaagagttgtatagtattatctacttacttgaggctgttaatttttcattacagtgttttgtaaatgtatccacgagaccatgatgcattgttttgtgctcaacttgtgttttgtatttaaagcattttgaatgaagtgtattttataagcatttaatatttatgctctttagaatggaacacagaaaacaaaccttataagtcctgattaatctgaaccaataacctgtgtggcctacaaagtataattctattaaatgttccttaaaacacttttttctaattaaaatctttgcaaatgcttgtgtaacttcctgccttacagctacttgtttgctgtgagccacccgcaactgacaagtggctgttaactgagtcaccatatcccagtaaagctgaattttctcacta

SEQ ID NO: 32959 - DNA, 699 bp, Homo sapiens
ggatcctcctcccgtccttctcatccttcgtaagtggctgcctggcctcccaagggccggtggggatgccgccccagtcccccggcgggtctggcgtagatgtccagggtgctgcagaaggacgcggagcaggagtcacagatgagagcggagatccaggacatgaagcaggagctctccacagtcaacatgatggacgagtttgccagatatgccaggctggaaagaaagatcaacaagatgacggataagctcaaaacccatgtgaaagctcggacagctcaattagccaagataaaatgggtgataagtgtcgctttctacgtattgcaggctgccctgatgatctcactcatttggaagtattattctgtccctgtggctgtcgtgccgagtaaatggataacccctctagaccgcctggtagcctttcctactagagtagcaggtggtgttggaattacctgttggattttagtctgtaacaaagttgtcgctattgtgcttcatccgttcagctgaacaggaggatggatacagccgcgaggctaaaaaacggatttcctcttcctagcttaaaatctgatttacactgttttgttttttaagaaacaaaagtgcatagtttagattttttttttgttgaatatgtttgttcttggactttatgagagagtcttataagaatcacgattttct

SEQ ID NO: 32960 - DNA, 1392 bp, Homo sapiens
agcggacccagcacagccaggagcgtccgggatgagctcagccgcggccgaccactgggcgtggttgctggtgctcagcttcgtgtttggatgcaatgttcttaggatcctcctcccgtccttctcatccttcatgtccagggtgctgcagaaggacgcggagcaggagtcacagatgagagcggagatccaggacatgaagcaggagctctccacagtcaacatgatggacgagtttgccagatatgccaggctggaaagaaagatcaacaagatgacggataagctcaaaacccatgtgaaagctcggacagctcaattagccaagataaaatgggtgataagtgtcgctttctacgtattgcaggctgccctgatgatctcactcatttggaagtattattctgtccctgtggctgtcgtgccgagtaaatggataacccctctagaccgcctggtagcctttcctactagagtagcagtattctccagcagtatttggacttccaaatgtttctcttcccctgataaatctatattagaaaaataggcaatttagtgctgtttaaaatgaatggatctctatttcaagatggcatgtctagtacacttacgtgcaccgcctcacaagcacactgaaatgacagaaaaggacactatgaattaggacaatggactgaaaaataagcagaaaatttaaacacaccagtgaccacagtgcaactgcaactgacgatcagtttccaccaaactgcaacagagagagtggctttgccgtctgggccagctgaggactctccttggaacccaaagaagcagtttgtttccacctactcccaagagctgaagattataagccagaagcaaacaaaggcaggcaaggaaatttgaggttgttgcatctggaagtaaacatgtagctacttcttctaataaaacagagttctatcttttgatttggtctggacacctggaggtcagcaaccgagagcaggaaggaggcacagcaacaacagaacaacaacaagaggctgcgacaggggcggcgtgggtcaaaaggaagcaacctggaggacggtcctccttgcggcttggagcagagcttcaggttgggcaccacgacagagctgggccagaagtctaacacagcctgtttggaacacaacccgggatacttgtgtggttgggttcagtcagtcaagggaaacaagaagctaacccgtggctgggagtgttcatgcaatgctcgtggaatactcagcgcaaagcctgcccgcaagcacaaagggtatcaaggaagagttaaatgggaagttgggtcatggtgtggaatcatattaaggtcagcattgatggcttccggaacttagatagaaagcagtgtcttaatgc

SEQ ID NO: 32961 - DNA, 2800 bp, Homo sapiens
aaacaagacggctccgcccttctcaagatggcgctgcactcaatgcggaaagcgcgtgagcgctggagcttcatccgggcacttcataagggatccgcagctgctcccgctctccagaaagacagcaagaagcgagtattttccggcattcaacctacaggaatcctccacctgggcaattacctgggagccattgagagctgggtgaggttacaggatgaatatgactctgtattatacagcattgttgacctccactccattactgtcccccaagacccagctgtccttcggcagagcatcctggacatgactgctgttcttcttgcctgtggcataaacccggaaaaaagcatccttttccaacaatctcaggtgtctgaacacacacaattaagttggatcctttcctgcatggtcagactacctcgattacaacatttacatcagtggaaggcaaagactaccaagcagaagcacgatggcacggtgggcctgctcacatacccagtactccaggcagccgacattctgttgtacaagtccacacacgttcctgttggggaggatcaagtccagcacatggaactagttcaggatctagcacaaggtttcaacaagaagtatggggagttctttccagtgcccgagtccattctcacatccatgaagaaggtaaaatccctacgtgatccttctgccaaaatgtcgaaatcagaccctgacaaactggccaccgtccgaataacagacagcccagaggagatagtgcagaaattccgcaaggctgtgacagacttcacctcggaggtcacctatgacccggctggccgcgctggcgtgtccaacatagtggcggtgcatgccgcggtgacggggctctccgtggaggaagtggtgcgccgcagcgcgggcatgaacactgctcgctacaagctggccgtggcagatgctgtgattgagaagtttgccccaattaagcgtgaaattgaaaaactgaagctggacaaggaccatttagagaaggttttacaaattggatcagcaaaagccaaagaattagcatacactgtgtgccaggaggtgaagaaattggtgggttttctataggaagtttcaacgaatcacagcaaggcttttgtgccttgcactccatgcattctgataacggcagctttcctaaaaagaaaaagttatagttttgggacatttaatttggtatagctgattattggctttatttgatgaatattgctttgtagctttgaaatacgacagtgttccaaatcccatcaacaaaatgctgtgaacaacaacaacaaaaaataaatcaagaaggcatagctgtctgaatccccaattattgaggcacactccttggcctgcagaaatgtgattgaagtaaggagtaatttgggaaatggagtatcatttgtgcttctctctggagtacttactgtaacagatgcacacgttatctacttcaacccttttataaagcaatatatagaggtcttagatgtataatccttgagatgccatttgatcagatgccaatttgtattcagagctcataaaaacaagtccattcttatagtttgtttgtcactgagacggtgcctgatttaatatatttaagctgcttaacttgttttccaagagataacaccaactgttccagcaataatttgttttttaattcagagatatgggatatgatcttctaaggaggttgcattattttgacctgatttatttattgtacaagagcccaagtccctgaattatattcttaataagtgctttcttgcattcatttcagtttagtctcaccaaccccctatgaattaggagaattattgtcattttacacatgaggaaagtgaggctgagagaatccaattagcttgtacgatatcactccataagagaagcaaatctgagagtaaaacccttaccccttattcttaagaatagtgcttgtttattcagtacaaaaaaaatgctgaaaggcagcgttttttagactctaaacattctgattttgaaggtgggtgttggaacgactgatgatgttttttatatcatcaattcagccaatggatgcgaacttaaaatctggattcacagaaccgtggtcacatttccccatcaaaatccccaaggcgggtcccaagttctctcctctacgctcattgcagaaatactttgaaataggttctgccagtctacaatagcagtgaagactgacaaatcagatattcccaatgactgacagcttctcatcttgcctctacctcagttaagtaatgtcaccctgaaacctagcttttctgcacttccatttctgacacctgaaaatgaaaatgataatcctaacttatacaccaagacctgttagcaagatcgattttgtaacagaaattgcttataagttttttatcagtaaggaccatgatcaccatttgtacatacataactaggttgttgagcaaagcatttttgctcatgtttcttaaggaagtagagtagtccttgtgtcagaacacatgttaatccacaaaacgccccatcccagattccaaattaaaacatcgtttttaggattcttggagctagcctggatcatgggtaaaggaaacattttgccttttgtatcttatactggaatgggatgtctgtaagtcctagaacctctttgagcatatttcttacaagcctctgttttttcccctttaaaggaaactttgaaaggattgtgaatactggaaaatgacaaaactaaaggtagatctatcaa

SEQ ID NO: 32962 - DNA, 2811 bp, Homo sapiens
caagatggcgctgcactcaatgcggaaagcgcgtgagcgctggagcttcatccgggcacttcataagggatccgcagctgctcccgctctccagaaagacagcaagaagcgagtattttccggcattcaacctacaggaatcctccacctgggcaattacctgggagccattgagagctgggtgaggttacaggatgaatatgactctgtattatacagcattgttgacctccactccattactgtcccccaagacccagctgtccttcggcagagcatcctggacatgactgctgttcttcttgcctgtggcataaacccggaaaaaagcatccttttccaacaatctcaggtgtctgaacacacacaattaagttggatcctttcctgcatggtcagactacctcgattacaacatttacatcagtggaaggcaaagactaccaagcagaagcacgatggcacggtgggcctgctcacatacccagtactccaggcagccgacattctgttgtacaagtccacacacgttcctgttggggaggatcaagtccagcacatggaactagttcaggatctagcacaaggtttcaacaagaagtatggggagttctttccagtgcccgagtccattctcagtatgtgtgtgttggtgtttttaacctagcatccatgaagaaggtaaaatccctacgtgatccttctgccaaaatgtcgaaatcagaccctgacaaactggccaccgtccgaataacagacagcccagaggagatagtgcagaaattccgcaaggctgtgacagacttcacctcggaggtcacctatgacccggctggccgcgctggcgtgtccaacatagtggcggtgcatgccgcggtgacggggctctccgtggaggaagtggtgcgccgcagcgcgggcatgaacactgctcgctacaagctggccgtggcagatgctgtgattgagaagtttgccccaattaagcgtgaaattgaaaaactgaagctggacaaggaccatttagagaaggttttacaaattggatcagcaaaagccaaagaattagcatacactgtgtgccaggaggtgaagaaattggtgggttttctataggaagtttcaacgaatcacagcaaggcttttgtgccttgcactccatgcattctgataacggcagctttcctaaaaagaaaaagttatagttttgggacatttaatttggtatagctgattattggctttatttgatgaatattgctttgtagctttgaaatacgacagtgttccaaatcccatcaacaaaatgctgtgaacaacaacaacaaaaaataaatcaagaaggcatagctgtctgaatccccaattattgaggcacactccttggcctgcagaaatgtgattgaagtaaggagtaatttgggaaatggagtatcatttgtgcttctctctggagtacttactgtaacagatgcacacgttatctacttcaacccttttataaagcaatatatagaggtcttagatgtataatccttgagatgccatttgatcagatgccaatttgtattcagagctcataaaaacaagtccattcttatagtttgtttgtcactgagacggtgcctgatttaatatatttaagctgcttaacttgttttccaagagataacaccaactgttccagcaataatttgttttttaattcagagatatgggatatgatcttctaaggaggttgcattattttgacctgatttatttattgtacaagagcccaagtccctgaattatattcttaataagtgctttcttgcattcatttcagtttagtctcaccaaccccctatgaattaggagaattattgtcattttacacatgaggaaagtgaggctgagagaatccaattagcttgtacgatatcactccataagagaagcaaatctgagagtaaaacccttaccccttattcttaagaatagtgcttgtttattcagtacaaaaaaaatgctgaaaggcagcgttttttagactctaaacattctgattttgaaggtgggtgttggaacgactgatgatgttttttatatcatcaattcagccaatggatgcgaacttaaaatctggattcacagaaccgtggtcacatttccccatcaaaatccccaaggcgggtcccaagttctctcctctacgctcattgcagaaatactttgaaataggttctgccagtctacaatagcagtgaagactgacaaatcagatattcccaatgactgacagcttctcatcttgcctctacctcagttaagtaatgtcaccctgaaacctagcttttctgcacttccatttctgacacctgaaaatgaaaatgataatcctaacttatacaccaagacctgttagcaagatcgattttgtaacagaaattgcttataagttttttatcagtaaggaccatgatcaccatttgtacatacataactaggttgttgagcaaagcatttttgctcatgtttcttaaggaagtagagtagtccttgtgtcagaacacatgttaatccacaaaacgccccatcccagattccaaattaaaacatcgtttttaggattcttggagctagcctggatcatgggtaaaggaaacattttgccttttgtatcttatactggaatgggatgtctgtaagtcctagaacctctttgagcatatttcttacaagcctctgttttttcccctttaaaggaaactttgaaaggattgtgaatactggaaaatgacaaaactaaaggtagatctatcaagccaa

SEQ ID NO: 32963 - DNA, 1508 bp, Homo sapiens
cttgccgccacctccagttctgggagcggagcgccgccgctgttgccgggcaacgcgaaagacagcaagaagcgagtattttccggcattcaacctacaggaatcctccacctgggcaattacctgggagccattgagagctgggtgaggttacaggatgaatatgactctgtattatacagcattgttgacctccactccattactgtcccccaagacccagctgtccttcggcagagcatcctggacatgactgctgttcttcttgcctgtggcataaacccggaaaaaagcatccttttccaacaatctcaggtgtctgaacacacacaattaagttggatcctttcctgcatggtcagactacctcgattacaacatttacatcagtggaaggcaaagactaccaagcagaagcacgatggcacggtgggcctgctcacatacccagtactccaggcagccgacattctgttgtacaagtccacacacgttcctgttggggaggatcaagtccagcacatggaactagttcaggatctagcacaaggtttcaacaagaagtatggggagttctttccagtgcccgagtccattctcacatccatgaagaaggtaaaatccctacgtgatccttctgccaaaatgtcgaaatcagaccctgacaaactggccaccgtccgaataacagacagcccagaggagatagtgcagaaattccgcaaggctgtgacagacttcacctcggaggtcacctatgacccggctggccgcgctggcgtgtccaacatagtggcggtgcatgccgcggtgacggggctctccgtggaggaagtggtgcgccgcagcgcgggcatgaacactgctcgctacaagctggccgtggcagatgctgtgattgagaagtttgccccaattaagcgtgaaattgaaaaactgaagctggacaaggaccatttagagaaggttttacaaattggatcagcaaaagccaaagaattagcatacactgtgtgccaggaggtgaagaaattggtgggttttctataggaagtttcaacgaatcacagcaaggcttttgtgccttgcactccatgcattctgataacggcagctttcctaaaaagaaaaagttatagttttgggacatttaatttggtatagctgattattggctttatttgatgaatattgctttgtagctttgaaatacgacagtgttccaaatcccatcaacaaaatgctgtgaacaacaacaacaaaaaataaatcaagaaggcatagctgtctgaatccccaattattgaggcacactccttggcctgcagaaatgtgattgaagtaaggagtaatttgggaaatggagtatcatttgtgcttctctctggagtacttactgtaacagatgcacacgttatctacttcaacccttttataaagcaatatatagaggtcttagatgtataatccttgagatgccatttgatcagatgccaatttgtattcag

SEQ ID NO: 32964 - DNA, 2690 bp, Homo sapiens
caatgaccagctaatggctcgattctcaagagggtttcattggtctcaacctggccccccaggcaacccacccctgattggacagtctcatcaagaaggttggtcaagagctcaagtgtttctgagaatctgggtgatttataagaaacccttagctgaatgcagggtggggagaacgaaagacaaaagcatcttttttcagaagggaaactgaaagaaagaggggaagagtattaaagaccatttctggctgggcagggcactctcagcagctcaactgcccagcgtgaccagtggccacctctgcagtgtcttccacaacctgggatgaaattgattctgcagtaaagatgttggtgtcattaaaaatgagctacaaagctgccgcgggggaggattacaaggctgactgtcctccagggaacccagcacctaccagtaatcatggcccagatgccacagaagctgaagaggattttgtggacccatggacagtacagacaagcagtgcaaaaggcatagactacgataagctcattgttcggtttggaagtagtaaaattgacaaagagctaataaaccgaatagagagagccaccggccaaagaccacaccacttcctgcgcagaggcatcttcttctcacacagagatatgaatcaggttcttgatgcctatgaaaataagaagccattttatctgtacacgggccggggcccctcttctgaagcaatgcatgtaggtcacctcattccatttattttcacaaagtggctccaggatgtatttaacgtgcccttggtcatccagatgacggatgacgagaagtatctgtggaaggacctgaccctggaccaggcctatagctatgctgtggagaatgccaaggacatcatcgcctgtggctttgacatcaacaagactttcatattctctgacctggactacatggggatgagctcaggtttctacaaaaatgtggtgaagattcaaaagcatgttaccttcaaccaagtgaaaggcattttcggcttcactgacagcgactgcattgggaagatcagttttcctgccatccaggctgctccctccttcagcaactcattcccacagatcttccgagacaggacggatatccagtgccttatcccatgtgccattgaccaggatccttactttagaatgacaagggacgtcgcccccaggatcggctatcctaaaccagccctgctgcactccaccttcttcccagccctgcagggcgcccagaccaaaatgagtgccagcgaccccaactcctccatcttcctcaccgacacggccaagcagatcaaaaccaaggtcaataagcatgcgttttctggagggagagacaccatcgaggagcacaggcagtttgggggcaactgtgatgtggacgtgtctttcatgtacctgaccttcttcctcgaggacgacgacaagctcgagcagatcaggaaggattacaccagcggagccatgctcaccggtgagctcaagaaggcactcatagaggttctgcagcccttgatcgcagagcaccaggcccggcgcaaggaggtcacggatgagatagtgaaagagttcatgactccccggaagctgtccttcgactttcagtagcactcgttttacatatgcttataaaagaagtgatgtatcagtaatgtatcaataatcccagcccagtcaaagcaccgccacctgtaggcttctgtctcatggtaattactgggcctggcctctgtaagcctgtgtatgttatcaatactgtttcttcctgtgagttccattatttctatctcttatgggcaaagcattgtgggtaattggtgctggctaacattgcatggtcggatagagaagtccagctgtgagtctctccccaaagcagccccacagtggagcctttggctggaagtccatgggccaccctgttcttgtccatggaggactccgagggttccaagtatactcttaagacccactctgtttaaaaatatatattctatgtatgcgtatatggaattgaaatgtcattattgtaacctagaaagtgctttgaaatattgatgtggggaggtttattgagcacaagatgtatttcagcccatgccccctcccaaaaagaaattgataagtaaaagcttcgttatacatttgactaagaaatcacccagctttaaagctgcttttaacaatgaagattgaacagagttcagcaattttgattaaattaagacttgggggtgaaactttccagtttactgaactccagaccatgcatgtagtccactccagaaatcatgctcgcttcccttggcacaccagtgttctcctgccaaatgaccctagaccctctgtcctgcagagtcagggtggcttttcccctgactgtgtccgatgccaaggagtcctggcctccgcagatgcttcattttgacccttggctgcagtggaagtcagcacagagcagtgccctggctgtgtccctggacgggtggacttagctagggagaaagtcgaggcagcagccctcgaggccctcacagatgtctaggcaggcctcatttcatcacgcagcatgtgcaggcctggaagagcaaagccaaatctcagggaagtccttggttgatgtatctgggtctcctctggagcactctgccctcc

SEQ ID NO: 32965 - DNA, 3092 bp, Homo sapiens
tgtcaagccctatgctgggtctggtgtgggtggaaatcaaacacaaaacacagatccccccggaggccccagagcgatgaaagcaacaaacaagatacgaccagagatgggttttgaaggatgaataggagttagctgagctgtcaatagtaagaagtaaggttggtccaaggcacagcgctttctgaaggaacaggaagtgaaaggaaggcgagcggctatgagagaccgcgttaagcggcacggggcgctttaggcgctgcccagtcccggcccctccagcccggggcccgccgctcaccacacgcaccggaagcgctcggttctcccggaggcagaccggccagcacactaccatccagtcacgttccgacgcgacgccgcggccgccagccaatcagtggcggcctctgccccgcccccgcgcgaacagccaatgacggcgccgtcgggccggaagttgttccgtccggacggcgtttccacggacgcccaggagacagccggttgctgagccgggagcgctgactggcccggctgggcaggtcttgactcgtctgctgaacaaatcctctgacctcaggccggctgtgaacgtagttcctgagagatagcaaacatgcccaacagtgagcccgcatctctgctggagctgttcaacagcatcgccacacaaggggagctcgtaaggtccctcaaagcgggaaatgcgtcaaaggatgaaattgattctgcagtaaagatgttggtgtcattaaaaatgagctacaaagctgccgcgggggaggattacaaggctgactgtcctccagggaacccagcacctaccagtaatcatggcccagatgccacagaagctgaagaggattttgtggacccatggacagtacagacaagcagtgcaaaaggcatagactacgataagctcattgttcggtttggaagtagtaaaattgacaaagagctaataaaccgaatagagagagccaccggccaaagaccacaccacttcctgcgcagaggcatcttcttctcacacagagatatgaatcaggttcttgatgcctatgaaaataagaagccattttatctgtacacgggccggggcccctcttctgaagcaatgcatgtaggtcacctcattccatttattttcacaaagtggctccaggatgtatttaacgtgcccttggtcatccagatgacggatgacgagaagtatctgtggaaggacctgaccctggaccaggcctatagctatgctgtggagaatgccaaggacatcatcgcctgtggctttgacatcaacaagactttcatattctctgacctggactacatggggatgagctcaggtttctacaaaaatgtggtgaagattcaaaagcatgttaccttcaaccaagtgaaaggcattttcggcttcactgacagcgactgcattgggaagatcagttttcctgccatccaggctgctccctccttcagcaactcattcccacagatcttccgagacaggacggatatccagtgccttatcccatgtgccattgaccaggatccttactttagaatgacaagggacgtcgcccccaggatcggctatcctaaaccagccctgctgcactccaccttcttcccagccctgcagggcgcccagaccaaaatgagtgccagcgaccccaactcctccatcttcctcaccgacacggccaagcagatcaaaaccaaggtcaataagcatgcgttttctggagggagagacaccatcgaggagcacaggcagtttgggggcaactgtgatgtggacgtgtctttcatgtacctgaccttcttcctcgaggacgacgacaagctcgagcagatcaggaaggattacaccagcggagccatgctcaccggtgagctcaagaaggcactcatagaggttctgcagcccttgatcgcagagcaccaggcccggcgcaaggaggtcacggatgagatagtgaaagagttcatgactccccggaagctgtccttcgactttcagtagcactcgttttacatatgcttataaaagaagtgatgtatcagtaatgtatcaataatcccagcccagtcaaagcaccgccacctgtaggcttctgtctcatggtaattactgggcctggcctctgtaagcctgtgtatgttatcaatactgtttcttcctgtgagttccattatttctatctcttatgggcaaagcattgtgggtaattggtgctggctaacattgcatggtcggatagagaagtccagctgtgagtctctccccaaagcagccccacagtggagcctttggctggaagtccatgggccaccctgttcttgtccatggaggactccgagggttccaagtatactcttaagacccactctgtttaaaaatatatattctatgtatgcgtatatggaattgaaatgtcattattgtaacctagaaagtgctttgaaatattgatgtggggaggtttattgagcacaagatgtatttcagcccatgccccctcccaaaaagaaattgataagtaaaagcttcgttatacatttgactaagaaatcacccagctttaaagctgcttttaacaatgaagattgaacagagttcagcaattttgattaaattaagacttgggggtgaaactttccagtttactgaactccagaccatgcatgtagtccactccagaaatcatgctcgcttcccttggcacaccagtgttctcctgccaaatgaccctagaccctctgtcctgcagagtcagggtggcttttcccctgactgtgtccgatgccaaggagtcctggcctccgcagatgcttcattttgacccttggctgcagtggaagtcagcacagagcagtgccctggctgtgtccctggacgggtggacttagctagggagaaagtcgaggcagcagccctcgaggccctcacagatgtctaggcaggcctcatttcatcacgcagcatgtgcaggcctggaagagcaaagccaaatctcagggaagtccttggttgatgtatctgggtctcctctggagcactctgccctcctgtcacccag

SEQ ID NO: 32966 - DNA, 2466 bp, Homo sapiens
cggacggcgtttccacggacgcccaggagacagccggttgctgagccgggagcgctgactggcccggctgggcagggatgaaattgattctgcagtaaagatgttggtgtcattaaaaatgagctacaaagctgccgcgggggaggattacaaggctgactgtcctccagggaacccagcacctaccagtaatcatggcccagatgccacagaagctgaagaggattttgtggacccatggacagtacagacaagcagtgcaaaaggcatagactacgataagctcattgttcggtttggaagtagtaaaattgacaaagagctaataaaccgaatagagagagccaccggccaaagaccacaccacttcctgcgcagaggcatcttcttctcacacagagatatgaatcaggttcttgatgcctatgaaaataagaagccattttatctgtacacgggccggggcccctcttctgaagcaatgcatgtaggtcacctcattccatttattttcacaaagtggctccaggatgtatttaacgtgcccttggtcatccagatgacggatgacgagaagtatctgtggaaggacctgaccctggaccaggcctatagctatgctgtggagaatgccaaggacatcatcgcctgtggctttgacatcaacaagactttcatattctctgacctggactacatggggatgagctcaggtttctacaaaaatgtggtgaagattcaaaagcatgttaccttcaaccaagtgaaaggcattttcggcttcactgacagcgactgcattgggaagatcagttttcctgccatccaggctgctccctccttcagcaactcattcccacagatcttccgagacaggacggatatccagtgccttatcccatgtgccattgaccaggatccttactttagaatgacaagggacgtcgcccccaggatcggctatcctaaaccagccctgctgcactccaccttcttcccagccctgcagggcgcccagaccaaaatgagtgccagcgaccccaactcctccatcttcctcaccgacacggccaagcagatcaaaaccaaggtcaataagcatgcgttttctggagggagagacaccatcgaggagcacaggcagtttgggggcaactgtgatgtggacgtgtctttcatgtacctgaccttcttcctcgaggacgacgacaagctcgagcagatcaggaaggattacaccagcggagccatgctcaccggtgagctcaagaaggcactcatagaggttctgcagcccttgatcgcagagcaccaggcccggcgcaaggaggtcacggatgagatagtgaaagagttcatgactccccggaagctgtccttcgactttcagtagcactcgttttacatatgcttataaaagaagtgatgtatcagtaatgtatcaataatcccagcccagtcaaagcaccgccacctgtaggcttctgtctcatggtaattactgggcctggcctctgtaagcctgtgtatgttatcaatactgtttcttcctgtgagttccattatttctatctcttatgggcaaagcattgtgggtaattggtgctggctaacattgcatggtcggatagagaagtccagctgtgagtctctccccaaagcagccccacagtggagcctttggctggaagtccatgggccaccctgttcttgtccatggaggactccgagggttccaagtatactcttaagacccactctgtttaaaaatatatattctatgtatgcgtatatggaattgaaatgtcattattgtaacctagaaagtgctttgaaatattgatgtggggaggtttattgagcacaagatgtatttcagcccatgccccctcccaaaaagaaattgataagtaaaagcttcgttatacatttgactaagaaatcacccagctttaaagctgcttttaacaatgaagattgaacagagttcagcaattttgattaaattaagacttgggggtgaaactttccagtttactgaactccagaccatgcatgtagtccactccagaaatcatgctcgcttcccttggcacaccagtgttctcctgccaaatgaccctagaccctctgtcctgcagagtcagggtggcttttcccctgactgtgtccgatgccaaggagtcctggcctccgcagatgcttcattttgacccttggctgcagtggaagtcagcacagagcagtgccctggctgtgtccctggacgggtggacttagctagggagaaagtcgaggcagcagccctcgaggccctcacagatgtctaggcaggcctcatttcatcacgcagcatgtgcaggcctggaagagcaaagccaaatctcagggaagtccttggttgatgtatctgggtctcctctggagcactctgccctcctgtcacccagtagagtaaataaactt

SEQ ID NO: 32967 - DNA, 2938 bp, Homo sapiens
atttggaggccagcggggggtgaggggtggctgatgcaatgaccagctaatggctcgattctcaagagggtttcattggtctcaacctggccccccaggcaacccacccctgattggacagtctcatcaagaaggttggtcaagagctcaagtgtttctgagaatctgggtgatttataagaaacccttagctgaatgcagggtggggagaacgaaagacaaaagcatcttttttcagaagggaaactgaaagaaagaggggaagagtattaaagaccatttctggctgggcagggcactctcagcagctcaactgcccagcgtgaccagtggccacctctgcagtgtcttccacaacctggtcttgactcgtctgctgaacaaatcctctgacctcaggccggctgtgaacgtagttcctgagagatagcaaacatgcccaacagtgagcccgcatctctgctggagctgttcaacagcatcgccacacaaggggagctcgtaaggtccctcaaagcgggaaatgcgtcaaaggatgaaattgattctgcagtaaagatgttggtgtcattaaaaatgagctacaaagctgccgcgggggaggattacaaggctgactgtcctccagggaacccagcacctaccagtaatcatggcccagatgccacagaagctgaagaggattttgtggacccatggacagtacagacaagcagtgcaaaaggcatagactacgataagctcattgttcggtttggaagtagtaaaattgacaaagagctaataaaccgaatagagagagccaccggccaaagaccacaccacttcctgcgcagaggcatcttcttctcacacagagatatgaatcaggttcttgatgcctatgaaaataagaagccattttatctgtacacgggccggggcccctcttctgaagcaatgcatgtaggtcacctcattccatttattttcacaaagtggctccaggatgtatttaacgtgcccttggtcatccagatgacggatgacgagaagtatctgtggaaggacctgaccctggaccaggcctatagctatgctgtggagaatgccaaggacatcatcgcctgtggctttgacatcaacaagactttcatattctctgacctggactacatggggatgagctcaggtttctacaaaaatgtggtgaagattcaaaagcatgttaccttcaaccaagtgaaaggcattttcggcttcactgacagcgactgcattgggaagatcagttttcctgccatccaggctgctccctccttcagcaactcattcccacagatcttccgagacaggacggatatccagtgccttatcccatgtgccattgaccaggatccttactttagaatgacaagggacgtcgcccccaggatcggctatcctaaaccagccctgctgcactccaccttcttcccagccctgcagggcgcccagaccaaaatgagtgccagcgaccccaactcctccatcttcctcaccgacacggccaagcagatcaaaaccaaggtcaataagcatgcgttttctggagggagagacaccatcgaggagcacaggcagtttgggggcaactgtgatgtggacgtgtctttcatgtacctgaccttcttcctcgaggacgacgacaagctcgagcagatcaggaaggattacaccagcggagccatgctcaccggtgagctcaagaaggcactcatagaggttctgcagcccttgatcgcagagcaccaggcccggcgcaaggaggtcacggatgagatagtgaaagagttcatgactccccggaagctgtccttcgactttcagtagcactcgttttacatatgcttataaaagaagtgatgtatcagtaatgtatcaataatcccagcccagtcaaagcaccgccacctgtaggcttctgtctcatggtaattactgggcctggcctctgtaagcctgtgtatgttatcaatactgtttcttcctgtgagttccattatttctatctcttatgggcaaagcattgtgggtaattggtgctggctaacattgcatggtcggatagagaagtccagctgtgagtctctccccaaagcagccccacagtggagcctttggctggaagtccatgggccaccctgttcttgtccatggaggactccgagggttccaagtatactcttaagacccactctgtttaaaaatatatattctatgtatgcgtatatggaattgaaatgtcattattgtaacctagaaagtgctttgaaatattgatgtggggaggtttattgagcacaagatgtatttcagcccatgccccctcccaaaaagaaattgataagtaaaagcttcgttatacatttgactaagaaatcacccagctttaaagctgcttttaacaatgaagattgaacagagttcagcaattttgattaaattaagacttgggggtgaaactttccagtttactgaactccagaccatgcatgtagtccactccagaaatcatgctcgcttcccttggcacaccagtgttctcctgccaaatgaccctagaccctctgtcctgcagagtcagggtggcttttcccctgactgtgtccgatgccaaggagtcctggcctccgcagatgcttcattttgacccttggctgcagtggaagtcagcacagagcagtgccctggctgtgtccctggacgggtggacttagctagggagaaagtcgaggcagcagccctcgaggccctcacagatgtctaggcaggcctcatttcatcacgcagcatgtgcaggcctggaagagcaaagccaaatctcagggaagtccttggttgatgtatctgggtctcctctggagcactctgccctcctgtcacccagtagagtaaataaacttccttggctcctgct

SEQ ID NO: 32968 - DNA, 801 bp, Homo sapiens
aatgaccagctaatggctcgattctcaagagggtttcattggtctcaacctggccccccaggcaacccacccctgattggacagtctcatcaagaaggatgaaattgattctgcagtaaagatgttggtgtcattaaaaatgagctacaaagctgccgcgggggaggattacaaggctgactgtcctccagggaacccagcacctaccagtaatcatggcccagatgccacagaagctgaagaggattttgtggacccatggacagtacagacaagcagtgcaaaaggcatagactacgataagctcattgttcggtttggaagtagtaaaattgacaaagagctaataaaccgaatagagagagccaccggccaaagaccacaccacttcctgcgcagaggcatcttcttctcacacagagatatgaatcaggttcttgatgcctatgaaaataagaagccattttatctgtacacgggccggggcccctcttctgaagcaatgcatgtaggtcacctcattccatttattttcacaaagtggctccaggatgtatttaacgtgcccttggtcatccagatgacggatgacgagaagtatctgtggaaggacctgaccctggaccaggcctatagctatgctgtggagaatgccaaggacatcatcgcctgtggctttgacatcaacaagactttcatattctctgacctggactacatggggatgagctcaggtttctacaaaaatgtggtgaagattcaaaagcatgttaccttcaaccaagtgaaaggcattttcgg

SEQ ID NO: 32969 - DNA, 568 bp, Homo sapiens
aggagacagccggttgctgagccgggagcgctgactggcccggctgggcaggggaaactgaaagaaagaggggaagagtattaaagaccatttctggctgggcagggcactctcagcagctcaactgcccagcgtgaccagtggccacctctgcagtgtcttccacaacctggtcttgactcgtctgctgaacaaatcctctgacctcaggccggctgtgaacgtagttcctgagagatagcaaacatgcccaacagtgagcccgcatctctgctggagctgttcaacagcatcgccacacaaggggagctcgtaaggtccctcaaagcgggaaatgcgtcaaaggatgaaattgattctgcagtaaagatgttggtgtcattaaaaatgagctacaaagctgccgcgggggaggattacaaggctgactgtcctccagggaacccagcacctaccagtaatcatggcccagatgccacagaagctgaagaggattttgtggacccatggacagtacagacaagcagtgcaaaaggcatagactacgataagctcattgttcggtttg

SEQ ID NO: 32970 - DNA, 707 bp, Homo sapiens
ggacggcgtttccacggacgcccaggagacagccggttgctgagccgggagcgctgactggcccggctgggcagggtgaatctacttctcttaacaaagtctcaatgtcctatttgcaatttatgtggtaaacactgaagacaatggtccttaaccttttggcatctcagcctcctttcgaaagtcttgactcgtctgctgaacaaatcctctgacctcaggccggctgtgaacgtagttcctgagagatagcaaacatgcccaacagtgagcccgcatctctgctggagctgttcaacagcatcgccacacaaggggagctcgtaaggtccctcaaagcgggaaatgcgtcaaaggatgaaattgattctgcagtaaagatgttggtgtcattaaaaatgagctacaaagctgccgcgggggaggattacaaggctgactgtcctccagggaacccagcacctaccagtaatcatggcccagatgccacagaagctgaagaggattttgtggacccatggacagtacagacaagcagtgcaaaaggcatagactacgataagctcattgttcggtttggaagtagtaaaattgacaaagagctaataaaccgaatagagagagccaccggccaaagaccacaccacttcctgcgcagaggcatcttcttctcacacagagatatgaatcaggttcttgatgcctat

SEQ ID NO: 32971 - DNA, 591 bp, Homo sapiens
aatgaccagctaatggctcgattctcaagagggtttcattggtctcaacctggccccccaggcaacccacccctgattggacagtctcatcaagaagagtgtactatttgttaaacaggtgaatctacttctcttaacaaagtctcaatgtcctatttgcaatttatgtggtaaacactgaagacaatggtccttaaccttttggcatctcagcctcctttcgaaagtcttgactcgtctgctgaacaaatcctctgacctcaggccggctgtgaacgtagttcctgagagatagcaaacatgcccaacagtgagcccgcatctctgctggagctgttcaacagcatcgccacacaaggggagctcgtaaggtccctcaaagcgggaaatgcgtcaaaggatgaaattgattctgcagtaaagatgttggtgtcattaaaaatgagctacaaagctgccgcgggggaggattacaaggctgactgtcctccagggaacccagcacctaccagtaatcatggcccagatgccacagaagctgaagaggattttgtggacccatggacagtacagacaagcagtgcaaaaggc

SEQ ID NO: 32972 - DNA, 572 bp, Homo sapiens
agacagccggttgctgagccgggagcgctgactggcccggctgggcagggcaacccacccctgattggacagtctcatcaagaaggttggtcaagagctcaagtgtttctgagaatctgggtgatttataagaaacccttagctgaatgcagggtggggagaacgaaagacaaaagcatcttttttcagaagggaaactgaaagaaagaggggaagagtattaaagaccatttctggctgggcagggcactctcagcagctcaactgcccagcgtgaccagtggccacctctgcagtgtcttccacaacctgggtgaatctacttctcttaacaaagtctcaatgtcctatttgcaatttatgtggtaaacactgaagacaatggtccttaaccttttggcatctcagcctcctttcgaaagtcttgactcgtctgctgaacaaatcctctgacctcaggccggctgtgaacgtagttcctgagagatagcaaacatgcccaacagtgagcccgcatctctgctggagctgttcaacagcatcgccacacaaggggagctcgtaaggtccct

SEQ ID NO: 32973 - DNA, 562 bp, Homo sapiens
gagacagccggttgctgagccgggagcgctgactggcccggctgggcaggaagggaaactgaaagaaagaggggaagagtattaaagaccatttctggctgggcagggcactctcagcagctcaactgcccagcgtgaccagtggccacctctgcagtgtcttccacaacctggtcttgactcgtctgctgaacaaatcctctgacctcaggccggctgtgaacgtagttcctgagagatagcaaacatgcccaacagtgagcccgcatctctgctggagctgttcaacagcatcgccacacaaggggagctcgtaaggtccctcaaagcgggaaatgcgtcaaaggatgaaattgattctgcagtaaagatgttggtgtcattaaaaatgagctacaaagctgccgcgggggaggattacaaggctgactgtcctccagggaacccagcacctaccagtaatcatggcccagatgccacagaagctgaagaggattttgtggacccatggacagtacagacaagcagtgcaaaaggcatagactacgataagctcattgtt

SEQ ID NO: 32974 - DNA, 530 bp, Homo sapiens
gatgcggggaatttacagtttctctttccaccgcccacgactacacaaaatcagtcacactgacgctgagggtggggaacgggaagagggtggggaggttatttggaggccagcggggggtgaggggtggctgatgcaatgaccagctaatggctcgattctcaagagggtttcattggtctcaacctggccccccaggcaacccacccctgattggacagtctcatcaagaagaagggaaactgaaagaaagaggggaagagtattaaagaccatttctggctgggcagggcactctcagcagctcaactgcccagcgtgaccagtggccacctctgcagtgtcttccacaacctggtcttgactcgtctgctgaacaaatcctctgacctcaggccggctgtgaacgtagttcctgagagatagcaaacatgcccaacagtgagcccgcatctctgctggagctgttcaacagcatcgccacacaaggggagctcgtaaggtccctcaaagcgggaaatgcgtcaaag

SEQ ID NO: 32975 - DNA, 560 bp, Homo sapiens
gagacagccggttgctgagccgggagcgctgactggcccggctgggcaggaagggaaactgaaagaaagaggggaagagtattaaagaccatttctggctgggcagggcactctcagcagctcaactgcccagcgtgaccagtggccacctctgcagtgtcttccacaacctgggtgaatctacttctcttaacaaagtctcaatgtcctatttgcaatttatgtggtaaacactgaagacaatggtccttaaccttttggcatctcagcctcctttcgaaagtcttgactcgtctgctgaacaaatcctctgacctcaggccggctgtgaacgtagttcctgagagatagcaaacatgcccaacagtgagcccgcatctctgctggagctgttcaacagcatcgccacacaaggggagctcgtaaggtccctcaaagcgggaaatgcgtcaaaggatgaaattgattctgcagtaaagatgttggtgtcattaaaaatgagctacaaagctgccgcgggggaggattacaaggctgactgtcctccagggaacccagca

SEQ ID NO: 32976 - DNA, 562 bp, Homo sapiens
gacagccggttgctgagccgggagcgctgactggcccggctgggcaggggcactctcagcagctcaactgcccagcgtgaccagtggccacctctgcagtgtcttccacaacctggtcttgactcgtctgctgaacaaatcctctgacctcaggccggctgtgaacgtagttcctgagagatagcaaacatgcccaacagtgagcccgcatctctgctggagctgttcaacagcatcgccacacaaggggagctcgtaaggtccctcaaagcgggaaatgcgtcaaaggatgaaattgattctgcagtaaagatgttggtgtcattaaaaatgagctacaaagctgccgcgggggaggattacaaggctgactgtcctccagggaacccagcacctaccagtaatcatggcccagatgccacagaagctgaagaggattttgtggacccatggacagtacagacaagcagtgcaaaaggcatagactacgataagctcattgttcggtttggaagtagtaaaattgacaaagagctaataaaccgaatagagagagccaccg

SEQ ID NO: 32977 - DNA, 538 bp, Homo sapiens
gtgatttataagaaacccttagctgaatgcagggtggggagaacgaaagacaaaagcatcttttttcagaagggaaactgaaagaaagaggggaagagtattaaagaccatttctggctgggcagggcactctcagcagctcaactgcccagcgtgaccagtggccacctctgcagtgtcttccacaacctggcctcctttcgaaagtcttgactcgtctgctgaacaaatcctctgacctcaggccggctgtgaacgtagttcctgagagatagcaaacatgcccaacagtgagcccgcatctctgctggagctgttcaacagcatcgccacacaaggggagctcgtaaggtccctcaaagcgggaaatgcgtcaaaggatgaaattgattctgcagtaaagatgttggtgtcattaaaaatgagctacaaagctgccgcgggggaggattacaaggctgactgtcctccagggaacccagcacctaccagtaatcatggcccagatgccacagaagctgaagaggattttgtggac

SEQ ID NO: 32978 - DNA, 658 bp, Homo sapiens
ggctcgattctcaagagggtttcattggtctcaacctggccccccaggcaacccacccctgattggacagtctcatcaagaaggttggtcaagagctcaagtgtttctgagaatctgggtgatttataagaaacccttagctgaatgcagggtggggagaacgaaagacaaaagcatcttttttcagaagggaaactgaaagaaagaggggaagagtattaaagaccatttctggctgggcagggcactctcagcagctcaactgcccagcgtgaccagtggccacctctgcagtgtcttccacaacctgggtgaatctacttctcttaacaaagtctcaatgtcctatttgcaatttatgtggtaaacactgaagacaatggtccttaaccttttggcatctcagcctcctttcgaaagtcttgactcgtctgctgaacaaatcctctgacctcaggccggctgtgaacgtagttcctgagagatagcaaacatgcccaacagtgagcccgcatctctgctggagctgttcaacagcatcgccacacaaggggagctcgtaaggtccctcaaagcgggaaatgcgtcaaaggatgaaattgattctgcagtaaagatgttggtgtcattaaaaatgagctacaaagctgccgcgggg

SEQ ID NO: 32979 - DNA, 410 bp, Homo sapiens
ctcagcagctcaactgcccagcgtgaccagtggccacctctgcagtgtcttccacaacctggtctcaatgtcctatttgcaatttatgtggtaaacactgaagacaatggtccttaaccttttggcatctcagcctcctttcgaaagtcttgactcgtctgctgaacaaatcctctgacctcaggccggctgtgaacgtagttcctgagagatagcaaacatgcccaacagtgagcccgcatctctgctggagctgttcaacagcatcgccacacaaggggagctcgtaaggtccctcaaagcgggaaatgcgtcaaaggatgaaattgattctgcagtaaagatgttggtgtcattaaaaatgagctacaaagctgccgcgggggaggattacaaggctgactgtcctc

SEQ ID NO: 32980 - DNA, 564 bp, Homo sapiens
agcgctgactggcccggctgggcaggaagggaaactgaaagaaagaggggaagagtattaaagaccatttctggctgggcagggcactctcagcagctcaactgcccagcgtgaccagtggccacctctgcagtgtcttccacaacctggagtgtactatttgttaaacaggtgaatctacttctcttaacaaagtctcaatgtcctatttgcaatttatgtggtaaacactgaagacaatggtccttaaccttttggcatctcagcctcctttcgaaagtcttgactcgtctgctgaacaaatcctctgacctcaggccggctgtgaacgtagttcctgagagatagcaaacatgcccaacagtgagcccgcatctctgctggagctgttcaacagcatcgccacacaaggggagctcgtaaggtccctcaaagcgggaaatgcgtcaaaggatgaaattgattctgcagtaaagatgttggtgtcattaaaaatgagctacaaagctgccgcgggggaggattacaaggctgactgtcctccagggaacccagcacctacca

SEQ ID NO: 32981 - DNA, 517 bp, Homo sapiens
taagaaacccttagctgaatgcagggtggggagaacgaaagacaaaagcatcttttttcagaagggaaactgaaagaaagaggggaagagtattaaagaccatttctggctgggcagggcactctcagcagctcaactgcccagcgtgaccagtggccacctctgcagtgtcttccacaacctggatgttcctgaactccaagttgaaaaacctctgaagttcaactcaattctgaaagtcaacaaagaaataaaggaggatgtcaatagtcttgactcgtctgctgaacaaatcctctgacctcaggccggctgtgaacgtagttcctgagagatagcaaacatgcccaacagtgagcccgcatctctgctggagctgttcaacagcatcgccacacaaggggagctcgtaaggtccctcaaagcgggaaatgcgtcaaaggatgaaattgattctgcagtaaagatgttggtgtcattaaaaatgagctacaaagctgccgcgggggaggattac

SEQ ID NO: 32982 - DNA, 547 bp, Homo sapiens
gatgcaatgaccagctaatggctcgattctcaagagggtttcattggtctcaacctggccccccaggcaacccacccctgattggacagtctcatcaagaaggatgaaattgattctgcagtaaagatgttggtgtcattaaaaatgagctacaaagctgccgcgggggaggattacaaggctgactgtcctccagggaacccagcacctaccagtaatcatggcccagatgccacagaagctgaagaggattttgtggacccatggacagtacagacaagcagtgcaaaaggcatagactacgataagctcattgttcggtttggaagtagtaaaattgacaaagagctaataaaccgaatagagagagccaccggccaaagaccacaccacttcctgcgcagaggcatcttcttctcacacagagatatgaatcaggttcttgatgcctatgaaaataagaagccattttatctgtacacgggccggggcccctcttctgaagcaatgcatgtaggtcacctcattccatttattttcacaaagt

SEQ ID NO: 32983 - DNA, 528 bp, Homo sapiens
ccggttgctgagccgggagcgctgactggcccggctgggcagggatgaaattgattctgcagtaaagatgttggtgtcattaaaaatgagctacaaagctgccgcgggggaggattacaaggctgactgtcctccagggaacccagcacctaccagtaatcatggcccagatgccacagaagctgaagaggattttgtggacccatggacagtacagacaagcagtgcaaaaggcatagactacgataagctcattgttcggtttggaagtagtaaaattgacaaagagctaataaaccgaatagagagagccaccggccaaagaccacaccacttcctgcgcagaggcatcttcttctcacacagagatatgaatcaggttcttgatgcctatgaaaataagaagccattttatctgtacacgggccggggcccctcttctgaagcaatgcatgtaggtcacctcattccatttattttcacaaagtggctccaggatgtatttaacgtgcccttggtcatccagat

SEQ ID NO: 32984 - DNA, 847 bp, Homo sapiens
ggagcgctgactggcccggctgggcaggaagggaaactgaaagaaagaggggaagagtattaaagaccatttctggctgggcagggcactctcagcagctcaactgcccagcgtgaccagtggccacctctgcagtgtcttccacaacctgggatgaaattgattctgcagtaaagatgttggtgtcattaaaaatgagctacaaagctgccgcgggggaggattacaaggctgactgtcctccagggaacccagcacctaccagtaatcatggcccagatgccacagaagctgaagaggattttgtggacccatggacagtacagacaagcagtgcaaaaggcatagactacgataagctcattgttcggtttggaagtagtaaaattgacaaagagctaataaaccgaatagagagagccaccggccaaagaccacaccacttcctgcgcagaggcatcttcttctcacacagagatatgaatcaggttcttgatgcctatgaaaataagaagccattttatctgtacacgggccggggcccctcttctgaagcaatgcatgtaggtcacctcattccatttattttcacaaagtggctccaggatgtatttaacgtgcccttggtcatccagatgacggatgacgagaagtatctgtggaaggacctgaccctggaccaggcctatagctatgctgtggagaatgccaaggacatcatcgcctgtggctttgacatcaacaagactttcatattctctgacctggactacatggggatgagctcaggtttctacaaaaatgtggtgaagattcaaaagcatgttaccttcaaccaagtgaaagg

SEQ ID NO: 32985 - DNA, 2508 bp, Homo sapiens
ggggagtaaggccggggcggagtgaggaaacaagggagggagtgatggagggacgctggcgcggcgcccagtggcctggccctcccgggagtatccttagagcccggcttgctgcccgccgcgttctggcactgtgaggcgcggagcctgccaccgacccctcgcccctttcctctgagcgccgccgacccaccccgtctccctttcccactggcacccttcatcgtctccgcctgttcgcttttcccgaggagagaggcccccatttttatttagcgcctgccatgtgccagaggctttgcgtagtgttgcacttagtcccctcaacggtaatgttagcaggcttctccatgcccattccacagatgaggaaaccgaaggggaagcagaaaagtaatgcgacccttgcccaaggtttcgaataagtccaagctgggattgaaacccaggcgtctgtgaccccagaactcctgatctttccactgcactgtgccgcctcggtgaacagatgcggggaatttacagtttctctttccaccgcccacgactacacaaaatcagtcacactgacgctgagggtggggaacgggaagagggtggggaggttatttggaggccagcggggggtgaggggtggctgatgcaatgaccagctaatggctcgattctcaagagggtttcattggtctcaacctggccccccaggcaacccacccctgattggacagtctcatcaagaagggcactctcagcagctcaactgcccagcgtgaccagtggccacctctgcagtgtcttccacaacctgggatgaaattgattctgcagtaaagatgttggtgtcattaaaaatgagctacaaagctgccgcgggggaggattacaaggctgactgtcctccagggaacccagcacctaccagtaatcatggcccagatgccacagaagctgaagaggattttgtggacccatggacagtacagacaagcagtgcaaaaggcatagactacgataagctcattgttcggtttggaagtagtaaaattgacaaagagctaataaaccgaatagagagagccaccggccaaagaccacaccacttcctgcgcagaggcatcttcttctcacacagagatatgaatcaggttcttgatgcctatgaaaataagaagccattttatctgtacacgggccggggcccctcttctgaagcaatgcatgtaggtcacctcattccatttattttcacaaagtggctccaggatgtatttaacgtgcccttggtcatccagatgacggatgacgagaagtatctgtggaaggacctgaccctggaccaggcctatagctatgctgtggagaatgccaaggacatcatcgcctgtggctttgacatcaacaagactttcatattctctgacctggactacatggggatgagctcaggtttctacaaaaatgtggtgaagattcaaaagcatgttaccttcaaccaagtgaaaggcattttcggcttcactgacagcgactgcattgggaagatcagttttcctgccatccaggctgctccctccttcagcaactcattcccacagatcttccgagacaggacggatatccagtgccttatcccatgtgccattgaccaggatccttactttagaatgacaagggacgtcgcccccaggatcggctatcctaaaccagccctgctgcactccaccttcttcccagccctgcagggcgcccagaccaaaatgagtgccagcgaccccaactcctccatcttcctcaccgacacggccaagcagatcaaaaccaaggtcaataagcatgcgttttctggagggagagacaccatcgaggagcacaggcagtttgggggcaactgtgatgtggacgtgtctttcatgtacctgaccttcttcctcgaggacgacgacaagctcgagcagatcaggaaggattacaccagcggagccatgctcaccggtgagctcaagaaggcactcatagaggttctgcagcccttgatcgcagagcaccaggcccggcgcaaggaggtcacggatgagatagtgaaagagttcatgactccccggaagctgtccttcgactttcagtagcactcgttttacatatgcttataaaagaagtgatgtatcagtaatgtatcaataatcccagcccagtcaaagcaccgccacctgtaggcttctgtctcatggtaattactgggcctggcctctgtaagcctgtgtatgttatcaatactgtttcttcctgtgagttccattatttctatctcttatgggcaaagcattgtgggtaattggtgctggctaacattgcatggtcggatagagaagtccagctgtgagtctctccccaaagcagccccacagtggagcctttggctggaagtccatgggccaccctgttcttgtccatggaggactccgagggttccaagtatactcttaagacccactctgtttaaaaatatat

SEQ ID NO: 32986 - DNA, 584 bp, Homo sapiens
aatgtctttgccttttaagataatgttcatgctgttatttggcggggaaagcaatctttcttttagtgtttaaaaaaaatggaacatgatgggtcccaaaaggtgtcaagaaatccttgctctaaagaagtcattttcttgtcctctgggaacttgccagtccaaagtcttgactcgtctgctgaacaaatcctctgacctcaggccggctgtgaacgtagttcctgagagatagcaaacatgcccaacagtgagcccgcatctctgctggagctgttcaacagcatcgccacacaaggggagctcgtaaggtccctcaaagcgggaaatgcgtcaaaggatgaaattgattctgcagtaaagatgttggtgtcattaaaaatgagctacaaagctgccgcgggggaggattacaaggctgactgtcctccagggaacccagcacctaccagtaatcatggcccagatgccacagaagctgaagaggattttgtggacccatggacagtacagacaagcagtgcaaaaggcatagactacgataagctcattgttcggtttggaagtagtaaaattgacaaaga

SEQ ID NO: 32987 - DNA, 553 bp, Homo sapiens
agaaattaatgtctttgccttttaagataatgttcatgctgttatttggcggggaaagcaatctttcttttagtgtttaaaaaaaatggaacatgatgggtcccaaaaggtgtcaagaaatccttgctctaaagaagtcattttcttgtcctctgggaacttgccagtccaaagagtgtactatttgttaaacaggtgaatctacttctcttaacaaagtctcaatgtcctatttgcaatttatgtggtaaacactgaagacaatggtccttaaccttttggcatctcagcctcctttcgaaagtcttgactcgtctgctgaacaaatcctctgacctcaggccggctgtgaacgtagttcctgagagatagcaaacatgcccaacagtgagcccgcatctctgctggagctgttcaacagcatcgccacacaaggggagctcgtaaggtccctcaaagcgggaaatgcgtcaaaggatgaaattgattctgcagtaaagatgttggtgtcattaaaaatgagctacaaagctgccgcgggggaggattacaa

SEQ ID NO: 32988 - DNA, 640 bp, Homo sapiens
actctcagcagctcaactgcccagcgtgaccagtggccacctctgcagtgtcttccacaacctggacaatggtccttaaccttttggcatctcagcctcctttcgaaagtcttgactcgtctgctgaacaaatcctctgacctcaggccggctgtgaacgtagttcctgagagatagcaaacatgcccaacagtgagcccgcatctctgctggagctgttcaacagcatcgccacacaaggggagctcgtaaggtccctcaaagcgggaaatgcgtcaaaggatgaaattgattctgcagtaaagatgttggtgtcattaaaaatgagctacaaagctgccgcgggggaggattacaaggctgactgtcctccagggaacccagcacctaccagtaatcatggcccagatgccacagaagctgaagaggattttgtggacccatggacagtacagacaagcagtgcaaaaggcatagactacgataagctcattgttcggtttggaagtagtaaaattgacaaagagctaataaaccgaatagagagagccaccggccaaagaccacaccacttcctgcgcagaggcatcttcttctcacacagagatatgaatcaggttcttgatgcctatgaaaataa

SEQ ID NO: 32989 - DNA, 2080 bp, Homo sapiens
actctcagcagctcaactgcccagcgtgaccagtggccacctctgcagtgtcttccacaacctggagtgtactatttgttaaacaggtgaatctacttctcttaacaaagtctcaatgtcctatttgcaatttatgtggtaaacactgaagacaatggtccttaaccttttggcatctcagcctcctttcgaaagtcttgactcgtctgctgaacaaatcctctgacctcaggccggctgtgaacgtagttcctgagagatagcaaacatgcccaacagtgagcccgcatctctgctggagctgttcaacagcatcgccacacaaggggagctcgtaaggtccctcaaagcgggaaatgcgtcaaaggatgaaattgattctgcagtaaagatgttggtgtcattaaaaatgagctacaaagctgccgcgggggaggattacaaggctgactgtcctccagggaacccagcacctaccagtaatcatggcccagatgccacagaagctgaagaggattttgtggacccatggacagtacagacaagcagtgcaaaaggcatagactacgataagctcattgttcggtttggaagtagtaaaattgacaaagagctaataaaccgaatagagagagccaccggccaaagaccacaccacttcctgcgcagaggcatcttcttctcacacagagatatgaatcaggttcttgatgcctatgaaaataagaagccattttatctgtacacgggccggggcccctcttctgaagcaatgcatgtaggtcacctcattccatttattttcacaaagtggctccaggatgtatttaacgtgcccttggtcatccagatgacggatgacgagaagtatctgtggaaggacctgaccctggaccaggcctatagctatgctgtggagaatgccaaggacatcatcgcctgtggctttgacatcaacaagactttcatattctctgacctggactacatggggatgagctcaggtttctacaaaaatgtggtgaagattcaaaagcatgttaccttcaaccaagtgaaaggcattttcggcttcactgacagcgactgcattgggaagatcagttttcctgccatccaggctgctccctccttcagcaactcattcccacagatcttccgagacaggacggatatccagtgccttatcccatgtgccattgaccaggatccttactttagaatgacaagggacgtcgcccccaggatcggctatcctaaaccagccctgctgcactccaccttcttcccagccctgcagggcgcccagaccaaaatgagtgccagcgaccccaactcctccatcttcctcaccgacacggccaagcagatcaaaaccaaggtcaataagcatgcgttttctggagggagagacaccatcgaggagcacaggcagtttgggggcaactgtgatgtggacgtgtctttcatgtacctgaccttcttcctcgaggacgacgacaagctcgagcagatcaggaaggattacaccagcggagccatgctcaccggtgagctcaagaaggcactcatagaggttctgcagcccttgatcgcagagcaccaggcccggcgcaaggaggtcacggatgagatagtgaaagagttcatgactccccggaagctgtccttcgactttcagtagcactcgttttacatatgcttataaaagaagtgatgtatcagtaatgtatcaataatcccagcccagtcaaagcaccgccacctgtaggcttctgtctcatggtaattactgggcctggcctctgtaagcctgtgtatgttatcaatactgtttcttcctgtgagttccattatttctatctcttatgggcaaagcattgtgggtaattggtgctggctaacattgcatggtcggatagagaagtccagctgtgagtctctccccaaagcagccccacagtggagcctttggctggaagtccatgggccaccctgttcttgtccatggaggactccgagggttccaagtatactcttaagacccactctgtttaaaaatatatattctatgtatgcg

SEQ ID NO: 32990 - DNA, 821 bp, Homo sapiens
aactgcccagcgtgaccagtggccacctctgcagtgtcttccacaacctggagtgtactatttgttaaacaggtgaatctacttctcttaacaaagtctcaatgtcctatttgcaatttatgtggtaaacactgaagacaatggtccttaaccttttggcatctcagcctcctttcgaaagtcttgactcgtctgctgaacaaatcctctgacctcaggccggctgtgaacgtagttcctgagagatagcaaacatgcccaacagtgagcccgcatctctgctggagctgttcaacagcatcgccacacaaggggagctcgtaaggtccctcaaagcgggaaatgcgtcaaagtaaagatgttggtgtcattaaaaatgagctacaaagctgccgcgggggaggattacaaggctgactgtcctccagggaacccagcacctaccagtaatcatggcccagatgccacagaagctgaagaggattttgtggacccatggacagtacagacaagcagtgcaaaaggcatagactacgataagctcattgttcggtttggaagtagtaaaattgacaaagagctaataaaccgaatagagagagccaccggccaaagaccacaccacttcctgcgcagaggcatcttcttctcacacagagatatgaatcaggttcttgatgcctatgaaaataagaagccattttatctgtacacgggccggggcccctcttctgaagcaatgcatgtaggtcacctcattccatttattttcacaaagtggctccaggatgtatttaacgtgcccttggtcatccagatga

SEQ ID NO: 32991 - DNA, 848 bp, Homo sapiens
aggagacagccggttgctgagccgggagcgctgactggcccggctgggcaggatgttcctgaactccaagttgaaaaacctctgaagttcaactcaattctgaaagtcaacaaagaaataaaggaggatgtcaatagtcttgactcgtctgctgaacaaatcctctgacctcaggccggctgtgaacgtagttcctgagagatagcaaacatgcccaacagtgagcccgcatctctgctggagctgttcaacagcatcgccacacaaggggagctcgtaaggtccctcaaagcgggaaatgcgtcaaaggatgaaattgattctgcagtaaagatgttggtgtcattaaaaatgagctacaaagctgccgcgggggaggattacaaggctgactgtcctccagggaacccagcacctaccagtaatcatggcccagatgccacagaagctgaagaggattttgtggacccatggacagtacagacaagcagtgcaaaaggcatagactacgataagctcattgttcggtttggaagtagtaaaattgacaaagagctaataaaccgaatagagagagccaccggccaaagaccacaccacttcctgcgcagaggcatcttcttctcacacagagatatgaatcaggttcttgatgcctatgaaaataagaagccattttatctgtacacgggccggggcccctcttctgaagcaatgcatgtaggtcacctcattccatttattttcacaaagtggctccaggatgtatttaacgtgcccttggtcatccagatgacggatgacgagaagtatctgtggaaggacctgaccctggaccaggcctatag

SEQ ID NO: 32992 - DNA, 1218 bp, Homo sapiens
ggagggtgtttatcgcggctagagagatgtcgctgctgcggtcgctgcgcgtgtttctggtcgcgcggaccgggagctacccggctgggtctcttctgcgtcagtcgccccagccaaggcacacattttatgctgggccccgtctgtctgcctcggcctccagcaaggagctcctcatgaagctgcggcggaaaacaggctactcctttgtaaattgcaagaaagctctggagacttgtggcggggacctcaaacaggcagagatctggctccacaaggaggcccagaaggagggctggagcaaagctgccaagctccaagggaggaagaccaaagaaggcctgattgggctgttgcaggaaggaaacacaactgtattagtagaggtaaactgtgagacagattttgtttctagaaatttaaaatttcaactgttggtccagcaagtagcccttggaaccatgatgcattgtcagaccctaaaggatcaaccctctgcatacagtaaagtgcagtggctcacgcctgtaaacctagcactttgggaggctgaagcaggtggatcacttgagggtttcttgaattcctctgagctttctggacttccagctgggcctgacagagaaggctcactcaaggatcagttggctttagcaattggaaaactgggagaaaacatgattcttaaacgagctgcatgggtgaaggtgccatctgggttctacgttggctcttatgtccacggagcaatgcagagtccctcacttcacaagctggtgctggggaagtatggggccctggtcatctgtgagacgtctgaacagaaaacaaaccttgaagacgttggccgccgccttgggcagcatgtggtgggcatggcccccctctctgttggctccctggacgatgagcctgggggagaggcagagactaagatgctgtcccagccgtatttgctggatccctccattaccttggggcagtatgtgcagcctcagggggtgtcggtagtagactttgtgcggtttgaatgtggagaaggtgaagaggcagcagaaactgaataggttccagagacttttggcccaggaggaatatttacttttagctctggacatcattacaaaaaggaatatttcccaaacctcttcagaccgagaatgcatgggtaaaattattaaatagttgtataataaaaataattttttccttgtttgc

SEQ ID NO: 32993 - DNA, 1450 bp, Homo sapiens
gtgtttatcgcggctagagagatgtcgctgctgcggtcgctgcgcgtgtttctggtcgcgcggaccgggagctacccggctgggtctcttctgcgtcagtcgccccagccaaggcacacattttatgctgggccccgtctgtctgcctcggcctccagcaaggagctcctcatgaagctgcggcggaaaacaggctactcctttgtaaattgcaagaaagctctggagacttgtggcggggacctcaaacagacggagtcttgctctgtggcccaggccggcgtgcaatgagttgtgtagtttttgcctgtacggtcatgcgtctcttaataggaagatacattctgagaaatggcgtcgttaggagattttggcttatgcacatcatagagtacctacacaaacctagatggtatattgtactacaacctgggctatatggaattgccagctgctcctaggctacaaaccgttacaaaatgttactggactgaatactgtaggcagttgtaacacagtggcagagatctggctccacaaggaggcccagaaggagggctggagcaaagctgccaagctccaagggaggaagaccaaagaaggcctgattgggctgttgcaggaaggaaacacaactgtattagtagaggtaaactgtgagacagattttgtttctagaaatttaaaatttcaactgttggtccagcaagtagcccttggaaccatgatgcattgtcagaccctaaaggatcaaccctctgcatacagtaaaggtttcttgaattcctctgagctttctggacttccagctgggcctgacagagaaggctcactcaaggatcagttggctttagcaattggaaaactgggagaaaacatgattcttaaacgagctgcatgggtgaaggtgccatctgggttctacgttggctcttatgtccacggagcaatgcagagtccctcacttcacaagctggtgctggggaagtatggggccctggtcatctgtgagacgtctgaacagaaaacaaaccttgaagacgttggccgccgccttgggcagcatgtggtgggcatggcccccctctctgttggctccctggacgatgagcctgggggagaggcagagactaagatgctgtcccagccgtatttgctggatccctccattaccttggggcagtatgtgcagcctcagggggtgtcggtagtagactttgtgcggtttgaatgtggagaaggtgaagaggcagcagaaactgaataggttccagagacttttggcccaggaggaatatttacttttagctctggacatcattacaaaaaggaatatttcccaaacctcttcagaccgagaatgcatgggtaaaattattaaatagttgtataataaaaataattttttccttgtttgcgtaatactggatttagcttttctgtgcctttc

SEQ ID NO: 32994 - DNA, 2159 bp, Homo sapiens
attttacctggggtgggaggtggggggtaattcccgtatgaaatgtgtcgtctcaagaaatcaagtagaggcgaggactgtgttcctccggccagcaggtggcaccatactcgtttggtgcgttccgctggagaattctggcccttccgccgcgccgtaggtttgttgcctcaccagtgcgcccgccggagggtgtttatcgcggctagagagatgtcgctgctgcggtcgctgcgcgtgtttctggtcgcgcggaccgggagctacccggctgggtctcttctgcgtcagtcgccccagccaaggcacacattttatgctgggccccgtctgtctgcctcggcctccagcaaggagctcctcatgaagctgcggcggaaaacaggctactcctttgtaaattgcaagaaagctctggagacttgtggcggggacctcaaacaggcagagatctggctccacaaggaggcccagaaggagggctggagcaaagctgccaagctccaagggaggaagaccaaagaaggcctgattgggctgttgcaggaaggaaacacaactgtattagtagaggtaaactgtgagacagattttgtttctagaaatttaaaatttcaactgttggtccagcaagtagcccttggaaccatgatgcattgtcagaccctaaaggatcaaccctctgcatacagtaaaggtttcttgaattcctctgagctttctggacttccagctgggcctgacagagaaggctcactcaaggatcagttggctttagcaattggaaaactgggagaaaacatgattcttaaacgagctgcatgggtgaaggtgccatctgggttctacgttggctcttatgtccacggagcaatgcagagtccctcacttcacaagctggtgctggggaagtatggggccctggtcatctgtgagacgtctgaacagaaaacaaaccttgaagacgttggccgccgccttgggcagcatgtggtgggcatggcccccctctctgttggctccctggacgatgagcctgggggagaggcagagactaagatgctgtcccagccgtatttgctggatccctccattaccttggggcagtatgtgcagcctcagggggtgtcggtagtagactttgtgcggtttgaatgtggagaaggtgaagaggcagcagaaactgaataggttccagagacttttggcccaggaggaatatttacttttagctctggacatcattacaaaaaggaatatttcccaaacctcttcagaccgagaatgcatgggtaaaattattaaatagttgtataataaaaataattttttccttgtttgcgtaatactggatttagcttttctgtgcctttcaaaaacaacaggtgggccttattgacgtgatagtgtcgtggagaacaggcatcaacaatactgctgctcccttcaacatagatttattatggtatttctgaaatttctaacttatatgttctgtcttacaccttttatgacatagaactcttttgttctgtttttgctttgcgacactgtgaaccgtgcttctgcctcggaacctccctagttatattacttgtgccacatggatttctttaggattattgattcaaacctagagttgtctggaaaatgtgggttctcttctttgtgattgtctgtagtatgctttgaaggtgctctgcagtggtagacacactggttctggcctcatttaatgaaattaataacacatgcccctatttctcttttggatgatgtgtgggtgggtgggtactgaggtttcctggccagctgtaaggcagattttgacattcttgtgccagaaacagaaattagagtagtccagttacccagagagctcacttaacattgcctctttacttccccagtactgaaacatttcttcaagtataacataaaattaccgtaacaagcagacccagaatactgaaaataactccatttgttcattataggtatctttatttgaaaagtgaaaaatgctttgacacattacagatctgggtatttggattttgcctatggagtgcatatatgatttcaatgatttacaggctaaatagattttagaaataatcatcttaaaattgaaaacaaaggtaggtcctggtataata

SEQ ID NO: 32995 - DNA, 1951 bp, Homo sapiens
gtaggtttgttgcctcaccagtgcgcccgccggagggtgtttatcgcggctagagagatgtcgctgctgcggtcgctgcgcgtgtttctggtcgcgcggaccgggagctacccggctgggtctcttctgcgtcagtcgccccagccaaggcacacattttatgctgggccccgtctgtctgcctcggcctccagcaaggagctcctcatgaagctgcggcggaaaacaggctactcctttgtaaattgcaagaaagctctggagacttgtggcggggacctcaaacaggcagagatctggctccacaaggaggcccagaaggagggctggagcaaagctgccaagctccaagggaggaagaccaaagaaggcctgattgggctgttgcaggaaggaaacacaactgtattagtagaggtaaactgtgagacagattttgtttctagaaatttaaaatttcaactgttggtccagcaagtagcccttggaaccatgatgcattgtcagaccctaaaggatcaaccctctgcatacagtaaagaaaactgggagaaaacatgattcttaaacgagctgcatgggtgaaggtgccatctgggttctacgttggctcttatgtccacggagcaatgcagagtccctcacttcacaagctggtgctggggaagtatggggccctggtcatctgtgagacgtctgaacagaaaacaaaccttgaagacgttggccgccgccttgggcagcatgtggtgggcatggcccccctctctgttggctccctggacgatgagcctgggggagaggcagagactaagatgctgtcccagccgtatttgctggatccctccattaccttggggcagtatgtgcagcctcagggggtgtcggtagtagactttgtgcggtttgaatgtggagaaggtgaagaggcagcagaaactgaataggttccagagacttttggcccaggaggaatatttacttttagctctggacatcattacaaaaaggaatatttcccaaacctcttcagaccgagaatgcatgggtaaaattattaaatagttgtataataaaaataattttttccttgtttgcgtaatactggatttagcttttctgtgcctttcaaaaacaacaggtgggccttattgacgtgatagtgtcgtggagaacaggcatcaacaatactgctgctcccttcaacatagatttattatggtatttctgaaatttctaacttatatgttctgtcttacaccttttatgacatagaactcttttgttctgtttttgctttgcgacactgtgaaccgtgcttctgcctcggaacctccctagttatattacttgtgccacatggatttctttaggattattgattcaaacctagagttgtctggaaaatgtgggttctcttctttgtgattgtctgtagtatgctttgaaggtgctctgcagtggtagacacactggttctggcctcatttaatgaaattaataacacatgcccctatttctcttttggatgatgtgtgggtgggtgggtactgaggtttcctggccagctgtaaggcagattttgacattcttgtgccagaaacagaaattagagtagtccagttacccagagagctcacttaacattgcctctttacttccccagtactgaaacatttcttcaagtataacataaaattaccgtaacaagcagacccagaatactgaaaataactccatttgttcattataggtatctttatttgaaaagtgaaaaatgctttgacacattacagatctgggtatttggattttgcctatggagtgcatatatgatttcaatgatttacaggctaaatagattttagaaataatcatcttaaaattgaaaacaaaggtaggtcctggtataatattaaacataaagttattaaacattttaagcattgtt

SEQ ID NO: 32996 - DNA, 930 bp, Homo sapiens
gtaggtttgttgcctcaccagtgcgcccgccggagggtgtttatcgcggctagagagatgtcgctgctgcggtcgctgcgcgtgtttctggtcgcgcggaccgggagctacccggctgggtctcttctgcgtcagtcgccccagccaaggcacacattttatgctgggccccgtctgtctgcctcggcctccagcaaggagctcctcatgaagctgcggcggaaaacaggctactcctttgtaaattgcaagaaagctctggagacttgtggcggggacctcaaacaggcagagatctggctccacaaggaggcccagaaggagggctggagcaaagctgccaagctccaagggaggaagaccaaagaaggcctgattgggctgttgcaggaaggaaacacaactgtattagtagaggtaaactgtgagacagattttgtttctagaaatttaaaatttcaactgttggtccagcaagtagcccttggaaccatgatgcattgtcagaccctaaaggatcaaccctctgcatacagtaaaggtttcttgaattcctctgagctttctggacttccagctgggcctgacagagaaggctcactcaaggatcagttggctttagcaattggtctgcctttccaaattggagctgtctctgaacttcagcttcctgaatccaacttcttgcagaacacctcctcttgactgctctaagcaccttaaaaataacaccttcaggatgtagctcttctttactaaacttgtatctgagtctccacttttgataggtggtatctatctagtcacctaaggcagaagcctgagagtttcctagaaaccccccatatccaatgagtcaccagggctgaccaactttacctcctaagcatttgtcaaatctgtcaccatccctccatccctactccactg

SEQ ID NO: 32997 - DNA, 1749 bp, Homo sapiens
tggagcccggctgcggatctgggaagcgcctcttcacggcactgggatccgcatctgcctgggatcatcaagccctagaagctgggtttctttaaattagggctgccgttttctgtttctccctgggctgcggaaagccagaagattttatctagcttatacaaggctgctggtgttccctctttttttccacgagggtgtttttggctgcaattgcatgaaatcccaatggtgtagaccagtggcgatggatctaggagtttaccaactgagacatttttcaatttctttcttgtcatccttgctggggactgaaaacgcttctgtgagacttgataatagctcctctggtgcaagtgtggtagctattgacaacaaaatcgagcaagctatggatctagtgaaaagccatttgatgtatgcggtcagagaagaagtggaggtcctcaaagagcaaatcaaagaactaatagagaaaaattcccagctggagcaggagaacaatctgctgaagacactggccagtcctgagcagcttgcccagtttcaggcccagctgcagactggctccccccctgccaccacccagccacagggcaccacacagccccccgcccagccagcatcgcagggctcaggaccaaccgcatagctgcctatgcccccgcagaactggctgctgcgtgtgaactgaacagacggagaagatgtgctagggagaatctgcctccacagtcacccatttcattgctcgctgcgaaagagacgtgagactgacatatgccattatctcttttccagtattaaacactcatatgcttatggcttggagaaatttcttagttgggtgaattaaaggttaatccgagaattagcatggatataccgggacctcatgcagcttggcagatatctgagaaatggtttaattcatgctcaggagctgtgtgcctttccatcccttccggctccctacccctcacttccaagggttctctctcctgcttgcgcttagtgtcctacatggggttgtgaagcgatggagctcctcactggactcgcctctctcctctcctccccccaggaggaacttgaaaggagggtaaaaagactaaaatgagggggaacagagttcactgtacaaatttgacaactgtcaccaaaattcataaaaaacaatagtactgtgcctctttcttctcaaacaatggatgacacaaaactatgagagtgacaaaatggtgacaggtagctgggacctaggctatcttaccatgaaggttgttttgcttattgtatatttgtgtatgtagtgtaactattttgtacaatagaggactgtaactactatttaggttgtacagattgaaatttagttgtttcattggctgtctgaggaggtgtggacttttatatatagatctacataaaaactgctacatgacaaaaaccacacctaaagaaattttaagaatttggcacagttactcactttgtgtaatctgaaatctagctgctgaatacgctgaagtaaatccttgttcactgaagtctttcaattgagctggttgaatactttgaaaaatgctcagttctaactaatgaaatggatttcccagtaggggtttctgcatatcacctgtatagtagttatatgcatatgtttctgtgcatgttctctacacaattgtaaggtgtcactgtatttaactgttgcacttgtcaactttcaataaagcatataaatgt

SEQ ID NO: 32998 - DNA, 4820 bp, Homo sapiens
ccgggggtggcgaggggaaggcgacatttgcttggcgctgcctccgtgcagagcggccgggagggctttgcagcggccgccgacgcggcgggaggagggggctgaggcggcttcggagttggccggagaaggtgggcatttctcgcttttcctccccttcctgcgctctccccctccctcctgccccgcaccccacgtgaagcagaatataaaggggggtgtgaggctagaggggaaagtgaatggcgaaggactgaagggatccccccttcgggtccccggccgccctgttcaccctcgttcatcctcctttccgaagctcgctctcgaaggcaggagcgaccggcgcctttggctgaggaggaggagaaggaggaatcgcgccaggcggagcgtcaggtcccgttttcctctccggcgtctccaatacaaagattacggtgcagaaggaaattgcactcgtctcctccgcgcccccggtacccaacacaatgcaccagccgcctgagtccaccgccgcggccgccgccgctgcagacattagcgctaggaagatggcgcacccggcaatgttccctcgaaggggcagcggtagtggcagcgcctctgctctcaatgcagcaggtaccggcgtcggtagtaatgccacatcttccgaggattttccgcctccgtcgctgcttcagccgccgccccctgcagcatcttctacgtcgggaccacagcctccgcctccacaaagcctgaacctcctttcgcaggctcagctgcaggcacagcctcttgcgccaggcggaactcaaatgaaaaagaaaagtggcttccagataactagcgttactcctgctcagatctccgctagtatcagctctaacaacagtatagcagaggacactgagagctatgatgatctggatgaatctcacacggaagatctctcttcttcggagatccttgatgtgtcactttccagggctactgacttaggggagcccgaacgcagctcctcagaagagaccctaaataacttccaggaagccgagacacctggggcagtctctcccaaccagccccaccttcctcagcctcatttgcctcaccttccacaacagaatgttgtgatcaatgggaatgctcatccacaccacctccatcaccaccatcagattcatcatgggcaccacctccaacatggtcaccaccatccatctcatgttgctgtggccagtgcatccattactggtgggccaccctcaagcccagtatctagaaaactctctacaactggaagctctgacagtatcacaccagttgcaccaacttctgctgtatcatccagtggttcacctgcatctgtaatgactaatatgcgtgctccaagtactacaggtggaataggtataaattctgttactggcactagtacagtaaataatgttaacattactgctgtgggtagttttaatcctaatgtgacaagcagcatgcttggtaatgttaatataagtacaagcaatattcctagtgctgctggtgtgagtgttgggcctggagttaccagtggtgttaatgtgaatatcttgagtggcatgggcaatggtactatttcttcctctgctgctgttagcagtgttcctaatgcagctgcagggatgactgggggatcggtttcaagtcagcagcaacaaccaacagttaacacttcgaggttcagagttgtgaagttagattctagttctgagccctttaaaaaaggtagatggacttgcactgagttctatgaaaaagaaaatgctgtacctgctacagaaggtgtgctgataaataaagtggtggagactgtaaagcaaaatccgatagaagtgacttctgaaagggagagcactagtgggagttcagtgagcagtagtgtcagcacactgagtcactatacagagagtgtgggaagtggagagatgggagcccctactgtggtggtgcagcagcagcagcagcaacaacaacaacaacagcaacaaccagctctccaaggtgtgaccctccaacagatggattttggtagcactggtccacagagtattccagcagttagtataccacagagtatttctcagtcacagatctcacaagtacaattacagtctcaagaactgagctatcagcaaaagcaaggtcttcagccagtacctctgcaagccactatgagtgctgcaactggtatccagccatcgcctgtaaatgtggttggtgtaacttcagctttaggtcagcagccttccatttccagtttggctcaaccccagctaccatattctcaggcggctcctccagtgcaaactccccttccaggggcaccaccaccccaacagttacagtatggacaacagcaaccaatggtttctacacagatggccccaggccatgtcaaatcagtgactcaaaatcctgcttcagagtatgtacaacagcagccaattcttcaaacagcaatgtcctccggacagcccagttctgcaggagtaggagcaggaacaacagtgattcctgtggctcagccacagggtatccagctgccagtgcagcccacagcagtcccagcacaacctgcaggggcatctgtccagcctgttggccaggctccggcagcagtgtctgctgtacctactggcagtcagattgcaaatattggtcagcaagcaaacatacctactgcagtgcagcagccctctacccaggttccaccttcagttattcagcagggtgctcctccatcttcgcaagtggttccacctgctcaaactgggattattcatcagggagttcaaactagtgctccaagccttcctcaacaattggttattgcatcccaaagttccttgttaactgtgcctccccagccacaaggagtagaaccagtagctcaaggaattgtttcacagcagttgcctgcagttagttctttgccctctgctagtagtatttctgttacaagtcaggttagttcaactggtccttctggaatgccttctgccccaacaaacttggttccaccacaaaatatagcacaaacccctgctacccaaaatggtaatttggttcaaagtgttagtcaacctcccttgatagcaactaatacaaatttgcctttggcacaacagataccactaagttctacccagttctccgcacaatcattagctcaggcaattggaagccaaattgaagatgccaggcgtgcagcggagccctccttagttggcttacctcagactatcagtggtgacagtgggggaatgtcagcagtttcagatgggagtagcagcagcctagcagcctctgcttctcttttcccgttgaaggtgctaccgctgacgacacccctggtggatggcgaggatgagagctcctctggtgcaagtgtggtagctattgacaacaaaatcgagcaagctatggatctagtgaaaagccatttgatgtatgcggtcagagaagaagtggaggtcctcaaagagcaaatcaaagaactaatagagaaaaattcccagctggagcaggagaacaatctgctgaagacactggccagtcctgagcagcttgcccagtttcaggcccagctgcagactggctccccccctgccaccacccagccacagggcaccacacagccccccgcccagccagcatcgcagggctcaggaccaaccgcatagctgcctatgcccccgcagaactggctgctgcgtgtgaactgaacagacggagaagatgtgctagggagaatctgcctccacagtcacccatttcattgctcgctgcgaaagagacgtgagactgacatatgccattatctcttttccagtattaaacactcatatgcttatggcttggagaaatttcttagttgggtgaattaaaggttaatccgagaattagcatggatataccgggacctcatgcagcttggcagatatctgagaaatggtttaattcatgctcaggagctgtgtgcctttccatcccttccggctccctacccctcacttccaagggttctctctcctgcttgcgcttagtgtcctacatggggttgtgaagcgatggagctcctcactggactcgcctctctcctctcctccccccaggaggaacttgaaaggagggtaaaaagactaaaatgagggggaacagagttcactgtacaaatttgacaactgtcaccaaaattcataaaaaacaatagtactgtgcctctttcttctcaaacaatggatgacacaaaactatgagagtgacaaaatggtgacaggtagctgggacctaggctatcttaccatgaaggttgttttgcttattgtatatttgtgtatgtagtgtaactattttgtacaatagaggactgtaactactatttaggttgtacagattgaaatttagttgtttcattggctgtctgaggaggtgtggacttttatatatagatctacataaaaactgctacatgacaaaaaccacacctaaagaaattttaagaatttggcacagttactcactttgtgtaatctgaaatctagctgctgaatacgctgaagtaaatccttgttcactgaagtctttcaattgagctggttgaatactttgaaaaatgctcagttctaactaatgaaatggatttcccagtaggggtttctgcatatcacctgtatagtagttatatgcatatgtttctgtgcatgttctctacacaattgtaaggtgtcactgtatttaactgttgcacttgtcaactttcaataaagcatataaatgttgataaacaa

SEQ ID NO: 32999 - DNA, 349 bp, Homo sapiens
aagcttttcctatagtctagtgataatcctgcttaccgctgccggtaagaactagataattgaaatcaagacactcgaagtcttacagtggtgggactgggcatgcccagtagctcagacggttcgggttacaaataggaagctttcgccgttaagcagccgcgggacacagctccggggaccggggtctgactcccttaaacggtgtttttggctgcaattgcatgaaatcccaatggtgtagaccagtggcgatggatctaggagtttaccaactgagacatttttcaatttctttcttgtcatccttgctggggactgaaaacgcttctgtgagacttgataatag

SEQ ID NO: 33000 - DNA, 690 bp, Homo sapiens
cgctgcaccagcccgtctggccaccaacgccgcggagaaaggagccgccgccgcctgcggccctctcccgcccggtcgcgggagcagcgggctcgctctcgaaggcaggagcgaccggcgcctttggctgaggaggaggagaaggaggaatcgcgccaggcggagcgtcaggtcccgttttcctctccggcgtctccaatacaaagattacggtgcagaaggaaattgcactcgtctcctccgcgcccccggtacccaacacaatgcaccagccgcctgagtccaccgccgcggccgccgccgctgcagacattagcgctaggaagatggcgcacccggcaatgttccctcgaaggggcagcggtagtggcagcgcctctgctctcaatgcagcaggtaccggcgtcggtagtaatgccacatcttccgaggattttccgcctccgtcgctgcttcagccgccgccccctgcagcatcttctacgtcgggaccacagcctccgcctccacaaagcctgaacctcctttcgcaggctcagctgcaggcacagcctcttgcgccaggcggaactcaaatgaaaaagaaaagtggcttccagataactagcgttactcctgctcagatctccgctagtatcagctctaacaacagtatagcagaggacactgagagctatgatgatctggatg

SEQ ID NO: 33001 - DNA, 2335 bp, Homo sapiens
ctttccgaagctcgctctcgaaggcaggagcgaccggcgcctttggctgaggaggaggagaaggaggaatcgcgccaggcggagcgtcaggtcccgttttcctctccggcgtctccaatacaaagattacggtgcagaaggaaattgcactcgtctcctccgcgcccccggtacccaacacaatgcaccagccgcctgagtccaccgccgcggccgccgccgctgcagacattagcgctaggaagatggcgcacccggcaatgttccctcgaaggggcagcggtagtggcagcgcctctgctctcaatgcagcaggtaccggcgtcggtagtaatgccacatcttccgaggattttccgcctccgtcgctgcttcagccgccgccccctgcagcatcttctacgtcgggaccacagcctccgcctccacaaagcctgaacctcctttcgcaggctcagctgcaggcacagcctcttgcgccaggcggaactcaaatgaaaaagaaaagtggcttccagataactagcgttactcctgctcagatctccgctagtatcagctctaacaacagtatagcagaggacactgagagctatgatgatctggatgaatctcacacggaagatctctcttcttcggagatccttgatgtgtcactttccagggctactgacttaggggagcccgaacgcagctcctcagaagagaccctaaataacttccaggaagccgagacacctggggcagtctctcccaaccagccccaccttcctcagcctcatttgcctcaccttccacaacagaatgttgtgatcaatgggaatgctcatccacaccacctccatcaccaccatcagattcatcatgggcaccacctccaacatggtcaccaccatccatctcatgttgctgtggccagtgcatccattactggtgggccaccctcaagcccagtatctagaaaactctctacaactggaagctctgacagtatcacaccagttgcaccaacttctgctgtatcatccagtggttcacctgcatctgtaatgactaatatgcgtgctccaagtactacaggtggaataggtataaattctgttactggcactagtacagtaaataatgttaacattactgctgtgggtagttttaatcctaatgtgacaagcagcatgcttggtaatgttaatataagtacaagcaatattcctagtgctgctggtgtgagtgttgggcctggagttaccagtggtgttaatgtgaatatcttgagtggcatgggcaatggtactatttcttcctctgctgctgttagcagtgttcctaatgcagctgcagggatgactgggggatcggtttcaagtcagcagcaacaaccaacagttaacacttcgaggttcagagttgtgaagttagattctagttctgagccctttaaaaaaggtagatggacttgcactgagttctatgaaaaagaaaatgctgtacctgctacagaaggtgtgctgataaataaagtggtggagactgtaaagcaaaatccgatagaagtgacttctgaaagggagagcactagtgggagttcagtgagcagtagtgtcagcacactgagtcactatacagagagtgtgggaagtggagagatgggagcccctactgtggtggtgcagcagcagcagcagcaacaacaacaacaacagcaacaaccagctctccaaggtgtgaccctccaacagatggattttggtagcactggtccacagagtattccagcagttagtataccacagagtatttctcagtcacagatctcacaagtacaattacagtctcaagaactgagctatcttaccatgaaggttgttttgcttattgtatatttgtgtatgtagtgtaactattttgtacaatagaggactgtaactactatttaggttgtacagattgaaatttagttgtttcattggctgtctgaggaggtgtggacttttatatatagatctacataaaaactgctacatgacaaaaaccacacctaaagaaattttaagaatttggcacagttactcactttgtgtaatctgaaatctagctgctgaatacgctgaagtaaatccttgttcactgaagtctttcaattgagctggttgaatactttgaaaaatgctcagttctaactaatgaaatggatttcccagtaggggtttctgcatatcacctgtatagtagttatatgcatatgtttctgtgcatgttctctacacaattgtaaggtgtcactgtatttaactgttgcacttgtcaactttcaataaagcatataaatgttgat

SEQ ID NO: 33002 - DNA, 2213 bp, Homo sapiens
atatcccagtgctgactcccgggcgtgcagaccgctaactagctcactcgctctcagctcctgccaccgctcagccgtcacagcccaggggagcccgagagcctgagagcctgcaaaccggggagggagggagcaaaggagggagggagcaagggcgcgccctggctctccctctgccctgctgcccgcccttcctgcctccacagcttgtcttttccaggcaccctggagtcccctcaggccagctcggtgggcgcgcacctgccagccgcccctgacctcgcaggccaggcgacctccgagcctgagaagatggcccagtccaagctcgattgccgctcacctgtcggcctcgactgctgcaactgctgcctggacctggcccatcggagtgggctccagcgaggcagcagcggggagaacaacaacccgggcagccctacagtgagcaactttcggcagctgcaggaaaagctggtctttgagaacctcaataccgacaagctcaacagcataatgcggcaggattcgctagagccggtgctgcgggacccctgctacctgatcaacgagggcatctgcaaccgcaacatcgaccagaccatgctctccatcctgctcttcttccacagtgcctccggagccagcgtggtggccatagacaacaagatcgaacaggccatggatctggtgaagaatcatctgatgtatgctgtgagagaggaggtggagatcctgaaggagcagatccgagagctggtggagaagaactcccagctagagcgtgagaacaccctgttgaagaccctggcaagcccagagcagctggagaagttccagtcctgtctgagccctgaagagccagctcccgaatccccacaagtgcccgaggcccctggtggttctgcggtgtaagtggctctgtcctcagggtgggcagagccactaaacttgttttacctagttctttccagtttgtttttggctccccaagcatcatctcacgaggagaactttacacctagcacagctggtgccaagagatgtcctaaggacatggccacctgggtccactccagcgacagacccctgacaagagcaggtctctggaggctgagttgcatggggcctagtaacaccaagccagtgagcctctaatgctactgcgccctgggggctcccagggcctgggcaacttagctgcaactggcaaaggagaagggtagtttgaggtgtgacaccagtttgctccagaaagtttaaggggtctgtttctcatctccatggacatcttcaacagcttcacctgacaacgactgttcctatgaagaagccacttgtgttttaagcagaggcaacctctctcttctcctctgtttcgtgaaggcaggggacacagatgggagagattgagccaagtcagccttctgttggttaatatggtataatgcatggctttgtgcacagcccagtgtgggattacagctttgggatgaccgcttacaaagttctgtttggttagtattggcatagtttttctatatagccataaatgcgtatatatacccatagggctagatctgtatcttagtgtagcgatgtatacatatacacatccacctacatgttgaagggcctaaccagccttgggagtattgactggtcccttacctcttatggctaagtctttgactgtgttcatttaccaagttgacccagtttgtcttttaggttaagtaagactcgagagtaaaggcaaggaggggggccagcctctgaatgcggccacggatgccttgctgctgcaaccctttccccagctgtccactgaaacgtgaagtcctgttttgaatgccaaacccaccattcactggtgctgactacatagaatggggttgagagaagatcagtttgggcttcacagtgtcatttgaaaacgttttttgttttgttttgtaattattgtggaaaactttcaagtgaacagaaggatggtgtcctactgtggatgagggatgaacaaggggatggctttgatccaatggagcctgggaggtgtgcccagaaagcttgtctgtagcgggttttgtgagagtgaacactttccactttttgacaccttatcctgatgtatggttccaggatttggattttgattttccaaatgtagcttgaaatttcaataaactttgctctgtttttctaaaaataaa

SEQ ID NO: 33003 - DNA, 1216 bp, Homo sapiens
aattgctagagctgcttttccaagacagtgtccatctctccaccaagattctccttgggctccctcccactcatcatcgccttctgcatctgcatctgcattctcctccccattttcctgcccctgaaattcggagctctgggccctggccatgcagggcagttcacatgatccacagagaacaaggcactttctctttctctgtctttccttcttgcttccctccttctggactttggggattttccatgaaaccaaagtaactatgtaagtggcagtggccttcctgtctatagtctcccacactggagtggaaccagaagggaagagagaagataagcgagaagcaaggacaaattaaaccatggcatttcagcctccttattcctccagcctcttcagaaaaagggacaatgcctccggagccagcgtggtggccatagacaacaagatcgaacaggccatggatctggtgaagaatcatctgatgtatgctgtgagagaggaggtggagatcctgaaggagcagatccgagagctggtggagaagaactcccagctagagcgtgagaacaccctgttgaagaccctggcaagcccagagcagctggagaagttccagtcctgtctgagccctgaagagccagctcccgaatccccacaagtgcccgaggcccctggtggttctgcggtgtaagtggctctgtcctcagggtgggcagagccactaaacttgttttacctagttctttccagtttgtttttggctccccaagcatcatctcacgaggagaactttacacctagcacagctggtgccaagagatgtcctaaggacatggccacctgggtccactccagcgacagacccctgacaagagcaggtctctggaggctgagttgcatggggcctagtaacaccaagccagtgagcctctaatgctactgcgccctgggggctcccagggcctgggcaacttagctgcaactggcaaaggagaagggtagtttgaggtgtgacaccagtttgctccagaaagtttaaggggtctgtttctcatctccatggacatcttcaacagcttcacctgacaacgactgttcctatgaagaagccacttgtgttttaagcagaggcaacctctctcttctcctctgtttcgtgaaggcaggggacacagatgggagagattgagccaagtcagccttctgttgg

SEQ ID NO: 33004 - DNA, 2266 bp, Homo sapiens
ctccacaggtccgccccaatccccgctcacacttgggaaacttgggactgcgctggggccgcgtgtggcacctcaggggggcggcccccggcctcaagaggagggggaggagaaggaggaagaggaggaagtgagcccgaaggatccgctcggagctgtttgtccagctgtttctattcgcacccggagcagtacagccagaagggggccgagccgaaggtggctggctttaggcgctaatttccaactcttttcctcacagcttgtcttttccaggcaccctggagtcccctcaggccagctcggtgggcgcgcacctgccagccgcccctgacctcgcaggccaggcgacctccgagcctgagaagatggcccagtccaagctcgattgccgctcacctgtcggcctcgactgctgcaactgctgcctggacctggcccatcggagtgggctccagcgaggcagcagcggggagaacaacaacccgggcagccctacagtgagcaactttcggcagctgcaggaaaagctggtctttgagaacctcaataccgacaagctcaacagcataatgcggcaggattcgctagagccggtgctgcgggacccctgctacctgatcaacgagggcatctgcaaccgcaacatcgaccagaccatgctctccatcctgctcttcttccacagtgcctccggagccagcgtggtggccatagacaacaagatcgaacaggccatggatctggtgaagaatcatctgatgtatgctgtgagagaggaggtggagatcctgaaggagcagatccgagagctggtggagaagaactcccagctagagcgtgagaacaccctgttgaagaccctggcaagcccagagcagctggagaagttccagtcctgtctgagccctgaagagccagctcccgaatccccacaagtgcccgaggcccctggtggttctgcggtgtaagtggctctgtcctcagggtgggcagagccactaaacttgttttacctagttctttccagtttgtttttggctccccaagcatcatctcacgaggagaactttacacctagcacagctggtgccaagagatgtcctaaggacatggccacctgggtccactccagcgacagacccctgacaagagcaggtctctggaggctgagttgcatggggcctagtaacaccaagccagtgagcctctaatgctactgcgccctgggggctcccagggcctgggcaacttagctgcaactggcaaaggagaagggtagtttgaggtgtgacaccagtttgctccagaaagtttaaggggtctgtttctcatctccatggacatcttcaacagcttcacctgacaacgactgttcctatgaagaagccacttgtgttttaagcagaggcaacctctctcttctcctctgtttcgtgaaggcaggggacacagatgggagagattgagccaagtcagccttctgttggttaatatggtataatgcatggctttgtgcacagcccagtgtgggattacagctttgggatgaccgcttacaaagttctgtttggttagtattggcatagtttttctatatagccataaatgcgtatatatacccatagggctagatctgtatcttagtgtagcgatgtatacatatacacatccacctacatgttgaagggcctaaccagccttgggagtattgactggtcccttacctcttatggctaagtctttgactgtgttcatttaccaagttgacccagtttgtcttttaggttaagtaagactcgagagtaaaggcaaggaggggggccagcctctgaatgcggccacggatgccttgctgctgcaaccctttccccagctgtccactgaaacgtgaagtcctgttttgaatgccaaacccaccattcactggtgctgactacatagaatggggttgagagaagatcagtttgggcttcacagtgtcatttgaaaacgttttttgttttgttttgtaattattgtggaaaactttcaagtgaacagaaggatggtgtcctactgtggatgagggatgaacaaggggatggctttgatccaatggagcctgggaggtgtgcccagaaagcttgtctgtagcgggttttgtgagagtgaacactttccactttttgacaccttatcctgatgtatggttccaggatttggattttgattttccaaatgtagcttgaaatttcaataaactttgctctgtttttctaaaaat

SEQ ID NO: 33005 - DNA, 2199 bp, Homo sapiens
gtcatatcccagtgctgactcccgggcgtgcagaccgctaactagctcactcgctctcagctcctgccaccgctcagccgtcacagcccaggggagcccgagagcctgagagcctgcaaaccggggagggagggagcaaaggagggagggagcaagggcgcgccctggctctccctctgccctgctgcccgcccttcctgcctccacaggcaccctggagtcccctcaggccagctcggtgggcgcgcacctgccagccgcccctgacctcgcaggccaggcgacctccgagcctgagaagatggcccagtccaagctcgattgccgctcacctgtcggcctcgactgctgcaactgctgcctggacctggcccatcggagtgggctccagcgaggcagcagcggggagaacaacaacccgggcagccctacagtgagcaactttcggcagctgcaggaaaagctggtctttgagaacctcaataccgacaagctcaacagcataatgcggcaggattcgctagagccggtgctgcgggacccctgctacctgatcaacgagggcatctgcaaccgcaacatcgaccagaccatgctctccatcctgctcttcttccacagtgcctccggagccagcgtggtggccatagacaacaagatcgaacaggccatggatctggtgaagaatcatctgatgtatgctgtgagagaggaggtggagatcctgaaggagcagatccgagagctggtggagaagaactcccagctagagcgtgagaacaccctgttgaagaccctggcaagcccagagcagctggagaagttccagtcctgtctgagccctgaagagccagctcccgaatccccacaagtgcccgaggcccctggtggttctgcggtgtaagtggctctgtcctcagggtgggcagagccactaaacttgttttacctagttctttccagtttgtttttggctccccaagcatcatctcacgaggagaactttacacctagcacagctggtgccaagagatgtcctaaggacatggccacctgggtccactccagcgacagacccctgacaagagcaggtctctggaggctgagttgcatggggcctagtaacaccaagccagtgagcctctaatgctactgcgccctgggggctcccagggcctgggcaacttagctgcaactggcaaaggagaagggtagtttgaggtgtgacaccagtttgctccagaaagtttaaggggtctgtttctcatctccatggacatcttcaacagcttcacctgacaacgactgttcctatgaagaagccacttgtgttttaagcagaggcaacctctctcttctcctctgtttcgtgaaggcaggggacacagatgggagagattgagccaagtcagccttctgttggttaatatggtataatgcatggctttgtgcacagcccagtgtgggattacagctttgggatgaccgcttacaaagttctgtttggttagtattggcatagtttttctatatagccataaatgcgtatatatacccatagggctagatctgtatcttagtgtagcgatgtatacatatacacatccacctacatgttgaagggcctaaccagccttgggagtattgactggtcccttacctcttatggctaagtctttgactgtgttcatttaccaagttgacccagtttgtcttttaggttaagtaagactcgagagtaaaggcaaggaggggggccagcctctgaatgcggccacggatgccttgctgctgcaaccctttccccagctgtccactgaaacgtgaagtcctgttttgaatgccaaacccaccattcactggtgctgactacatagaatggggttgagagaagatcagtttgggcttcacagtgtcatttgaaaacgttttttgttttgttttgtaattattgtggaaaactttcaagtgaacagaaggatggtgtcctactgtggatgagggatgaacaaggggatggctttgatccaatggagcctgggaggtgtgcccagaaagcttgtctgtagcgggttttgtgagagtgaacactttccactttttgacaccttatcctgatgtatggttccaggatttggattttgattttccaaatgtagcttgaaatttcaataaactttgctctgtttttctaaaaat

SEQ ID NO: 33006 - DNA, 1812 bp, Homo sapiens
acgcaggaaggggggggtcaccgccgctctgggatccgtcatcgaagcgtccctgcggccgctgcgccgtgaaaaccagctgctgcagccgcagaggcagccggaggcagaggggcggcgggcaggaccagacagggctgggcagggggctggccgagcgccgtgcgccgcttgggagaaggccggaagcttaccagccgagaaggaattcctagctagcttcagagccggtgcctccggagccagcgtggtggccatagacaacaagatcgaacaggccatggatctggtgaagaatcatctgatgtatgctgtgagagaggaggtggagatcctgaaggagcagatccgagagctggtggagaagaactcccagctagagcgtgagaacaccctgttgaagaccctggcaagcccagagcagctggagaagttccagtcctgtctgagccctgaagagccagctcccgaatccccacaagtgcccgaggcccctggtggttctgcggtgtaagtggctctgtcctcagggtgggcagagccactaaacttgttttacctagttctttccagtttgtttttggctccccaagcatcatctcacgaggagaactttacacctagcacagctggtgccaagagatgtcctaaggacatggccacctgggtccactccagcgacagacccctgacaagagcaggtctctggaggctgagttgcatggggcctagtaacaccaagccagtgagcctctaatgctactgcgccctgggggctcccagggcctgggcaacttagctgcaactggcaaaggagaagggtagtttgaggtgtgacaccagtttgctccagaaagtttaaggggtctgtttctcatctccatggacatcttcaacagcttcacctgacaacgactgttcctatgaagaagccacttgtgttttaagcagaggcaacctctctcttctcctctgtttcgtgaaggcaggggacacagatgggagagattgagccaagtcagccttctgttggttaatatggtataatgcatggctttgtgcacagcccagtgtgggattacagctttgggatgaccgcttacaaagttctgtttggttagtattggcatagtttttctatatagccataaatgcgtatatatacccatagggctagatctgtatcttagtgtagcgatgtatacatatacacatccacctacatgttgaagggcctaaccagccttgggagtattgactggtcccttacctcttatggctaagtctttgactgtgttcatttaccaagttgacccagtttgtcttttaggttaagtaagactcgagagtaaaggcaaggaggggggccagcctctgaatgcggccacggatgccttgctgctgcaaccctttccccagctgtccactgaaacgtgaagtcctgttttgaatgccaaacccaccattcactggtgctgactacatagaatggggttgagagaagatcagtttgggcttcacagtgtcatttgaaaacgttttttgttttgttttgtaattattgtggaaaactttcaagtgaacagaaggatggtgtcctactgtggatgagggatgaacaaggggatggctttgatccaatggagcctgggaggtgtgcccagaaagcttgtctgtagcgggttttgtgagagtgaacactttccactttttgacaccttatcctgatgtatggttccaggatttggattttgattttccaaatgtagcttgaaatttcaataaactttgctctgtttttctaaaaataaa

SEQ ID NO: 33007 - DNA, 2027 bp, Homo sapiens
tttgcatggcccctgacgccatgtgacgcagccggctcctcctatataaagaagcaggagccaaaatatctccgagtctgggttggactggcggccgtggagtttgtgacatacgaggtgacacccctcgagtcacttcccttcaactccagctggagcgcctgcttggctttgggttcgttctgcagccttcgccccgctcctagcctcagggccggactccagcgcagagcccagcccagcgcagcctgccagcagccacccagccgcccagccgcccagccccgcacgaaacccggccagagcttcctagcagcccgagccatgaacaccgaaatgtatcagacccccatggaggtggcggtctaccagctgcacaatttctccatctccttcttctcttctctgcttggaggggatgtggtttccgttaagctggacaacagtgcctccggagccagcgtggtggccatagacaacaagatcgaacaggccatggatctggtgaagaatcatctgatgtatgctgtgagagaggaggtggagatcctgaaggagcagatccgagagctggtggagaagaactcccagctagagcgtgagaacaccctgttgaagaccctggcaagcccagagcagctggagaagttccagtcctgtctgagccctgaagagccagctcccgaatccccacaagtgcccgaggcccctggtggttctgcggtgtaagtggctctgtcctcagggtgggcagagccactaaacttgttttacctagttctttccagtttgtttttggctccccaagcatcatctcacgaggagaactttacacctagcacagctggtgccaagagatgtcctaaggacatggccacctgggtccactccagcgacagacccctgacaagagcaggtctctggaggctgagttgcatggggcctagtaacaccaagccagtgagcctctaatgctactgcgccctgggggctcccagggcctgggcaacttagctgcaactggcaaaggagaagggtagtttgaggtgtgacaccagtttgctccagaaagtttaaggggtctgtttctcatctccatggacatcttcaacagcttcacctgacaacgactgttcctatgaagaagccacttgtgttttaagcagaggcaacctctctcttctcctctgtttcgtgaaggcaggggacacagatgggagagattgagccaagtcagccttctgttggttaatatggtataatgcatggctttgtgcacagcccagtgtgggattacagctttgggatgaccgcttacaaagttctgtttggttagtattggcatagtttttctatatagccataaatgcgtatatatacccatagggctagatctgtatcttagtgtagcgatgtatacatatacacatccacctacatgttgaagggcctaaccagccttgggagtattgactggtcccttacctcttatggctaagtctttgactgtgttcatttaccaagttgacccagtttgtcttttaggttaagtaagactcgagagtaaaggcaaggaggggggccagcctctgaatgcggccacggatgccttgctgctgcaaccctttccccagctgtccactgaaacgtgaagtcctgttttgaatgccaaacccaccattcactggtgctgactacatagaatggggttgagagaagatcagtttgggcttcacagtgtcatttgaaaacgttttttgttttgttttgtaattattgtggaaaactttcaagtgaacagaaggatggtgtcctactgtggatgagggatgaacaaggggatggctttgatccaatggagcctgggaggtgtgcccagaaagcttgtctgtagcgggttttgtgagagtgaacactttccactttttgacaccttatcctgatgtatggttccaggatttggattttgattttccaaatgtagcttgaaatttcaataaactttgctctgtttttctaaaaataaa

SEQ ID NO: 33008 - DNA, 1316 bp, Homo sapiens
gaagtgagcccgaaggatccgctcggagctgtttgtccagctgtttctattcgcacccggagcagtacagccagaagggggccgagccgaaggtggctggctttaggcgctaatttccaactcttttcctcacagcttgtcttttccaggcaccctggagtcccctcaggccagctcggtgggcgcgcacctgccagccgcccctgacctcgcaggccaggcgacctccgagcctgagaagatggcccagtccaagctcgattgccgctcacctgtcggcctcgactgctgcaactgctgcctggacctggcccatcggagtgggctccagcgaggcagcagcggggagaacaacaacccgggcagccctacagtgagcaactttcggcaggattcgctagagccggtgctgcgggacccctgctacctgatcaacgagggcatctgcaaccgcaacatcgaccagaccatgctctccatcctgctcttcttccacagtgcctccggagccagcgtggtggccatagacaacaagatcgaacaggccatggatctggtgaagaatcatctgatgtatgctgtgagagaggaggtggagatcctgaaggagcagatccgagagctggtggagaagaactcccagctagagcgtgagaacaccctgttgaagaccctggcaagcccagagcagctggagaagttccagtcctgtctgagccctgaagagccagctcccgaatccccacaagtgcccgaggcccctggtggttctgcggtgtaagtggctctgtcctcagggtgggcagagccactaaacttgttttacctagttctttccagtttgtttttggctccccaagcatcatctcacgaggagaactttacacctagcacagctggtgccaagagatgtcctaaggacatggccacctgggtccactccagcgacagacccctgacaagagcaggtctctggaggctgagttgcatggggcctagtaacaccaagccagtgagcctctaatgctactgcgccctgggggctcccagggcctgggcaacttagctgcaactggcaaaggagaagggtagtttgaggtgtgacaccagtttgctccagaaagtttaaggggtctgtttctcatctccatggacatcttcaacagcttcacctgacaacgactgttcctatgaagaagccacttgtgttttaagcagaggcaacctctctcttctcctctgtttcgtgaaggcaggggacacagatgggagagattgagccaagtcagccttctgttggttaatatggtataatg

SEQ ID NO: 33009 - DNA, 546 bp, Homo sapiens
agggtaacgacagacggagatcaactaaggtggcaggtaaggttcagaaaaggagaaggacaacaaatttggagaaataggagaaggcaccctggagtcccctcaggccagctcggtgggcgcgcacctgccagccgcccctgacctcgcaggccaggcgacctccgagcctgagaagatggcccagtccaagctcgattgccgctcacctgtcggcctcgactgctgcaactgctgcctggacctggcccatcggagtgggctccagcgaggcagcagcggggagaacaacaacccgggcagccctacagtgagcaactttcggcagctgcaggaaaagctggtctttgagaacctcaataccgacaagctcaacagcataatgcggcaggattcgctagagccggtgctgcgggacccctgctacctgatcaacgagggcatctgcaaccgcaacatcgaccagaccatgctctccatcctgctcttcttccacagtgcctccggagccagcgtggtggccatagacaacaagatcgaacaggc

SEQ ID NO: 33010 - DNA, 576 bp, Homo sapiens
gggggctggccgagcgccgtgcgccgcttgggagaaggccggaagcttaccagccgagaaggaattcctagctagcttcagagccgggtaggtttgcctgggaccttgtaggccggctgtgggggactccccgggtcgcacagccccattgtttgcatattgcccgagcaggccacggtggcctgcgcgccccaggactcgcaagcagctccgatcggttggaactcggggcggcggcagcagcgctgagccggcctggatgaggagatgcagcttcctgcaggggccaaggaaggatctggggacaaactgtccggaactctgggccagggaggcgagaaggagagagagaggaagagccgaggcagatggaggactttggccacaactgccatgtactcaagagtagaaccgagtgggtaatgggtcgctttgctttttgtcttggcagtgcctccggagccagcgtggtggccatagacaacaagatcgaacaggccatggatctggtgaagaatcatctgatgtatgctgtgagagaggaggtggagatcctgaaggagcagatccgagagc

SEQ ID NO: 33011 - DNA, 567 bp, Homo sapiens
aagggtgcgggcggggtggggcgaggggtggagggacaggatccagccgctcggggcccccgcccgccagccggagaagtggcggaggaccgttctccgccgtcccctctaggcttgtcttttccaggcaccctggagtcccctcaggccagctcggtgggcgcgcacctgccagccgcccctgacctcgcaggccaggcgacctccgagcctgagaagatggcccagtccaagctcgattgccgctcacctgtcggcctcgactgctgcaactgctgcctggacctggcccatcggagtgggctccagcgaggcagcagcggggagaacaacaacccgggcagccctacagtgagcaactttcggcagctgcaggaaaagctggtctttgagaacctcaataccgacaagctcaacagcataatgcggcaggattcgctagagccggtgctgcgggacccctgctacctgatcaacgagggcatctgcaaccgcaacatcgaccagaccatgctctccatcctgctcttcttccacagtgcctccggagccagcgtggtggccata

SEQ ID NO: 33012 - DNA, 503 bp, Homo sapiens
aaaggccagacttgtgaatgaaggagccgatgcgggggtggggagtactgactgaaattattccaagtctctgagtcctgagaaaccctggaaacccaccacttgcccacccagaacatccctccatcttacagagctggggcacgcccctcaggcctgtgaacatgcaatcgctacatctattgaaagggtaacgacagacggagatcaactaaggtggcagcttgtcttttccaggcaccctggagtcccctcaggccagctcggtgggcgcgcacctgccagccgcccctgacctcgcaggccaggcgacctccgagcctgagaagatggcccagtccaagctcgattgccgctcacctgtcggcctcgactgctgcaactgctgcctggacctggcccatcggagtgggctccagcgaggcagcagcggggagaacaacaacccgggcagccctacagtgagcaactttcggcagctgcaggaaaagctggtctttgag

SEQ ID NO: 33013 - DNA, 425 bp, Homo sapiens
tctatttcaaaggccagacttgtgaatgaaggagccgatgcgggggtggggagtactgactgaaatcttgtcttttccaggcaccctggagtcccctcaggccagctcggtgggcgcgcacctgccagccgcccctgacctcgcaggccaggcgacctccgagcctgagaagatggcccagtccaagctcgattgccgctcacctgtcggcctcgactgctgcaactgctgcctggacctggcccatcggagtgggctccagcgaggcagcagcggggagaacaacaacccgggcagccctacagtgagcaactttcggcagctgcaggaaaagctggtctttgagaacctcaataccgacaagctcaacagcataatgcggcaggattcgctagagccggtgctgcgggacccctgctacctga

SEQ ID NO: 33014 - DNA, 956 bp, Homo sapiens
acatctattgaaagggtaacgacagacggagatcaactaaggtggcaggtaaggttcagaaaaggagaaggacaacaaatttggagaaataggagaagcttgtcttttccaggcaccctggagtcccctcaggccagctcggtgggcgcgcacctgccagccgcccctgacctcgcaggccaggcgacctccgagcctgagaagatggcccagtccaagctcgattgccgctcacctgtcggcctcgactgctgcaactgctgcctggacctggcccatcggagtgggctccagcgaggcagcagcggggagaacaacaacccgggcagccctacagtgagcaactttcggcagctgcaggaaaagctggtctttgagaacctcaataccgacaagctcaacagcataatgcggcaggattcgctagagccggtgctgcgggacccctgctacctgatcaacgagggcatctgcaaccgcaacatcgaccagaccatgctctccatcctgctcttcttccacagtgcctccggagccagcgtggtggccatagacaacaagatcgaacaggccatggatctggtgaagaatcatctgatgtatgctgtgagagaggaggtggagatcctgaaggagcagatccgagagctggtggagaagaactcccagctagagcgtgagaacaccctgttgaagaccctggcaagcccagagcagctggagaagttccagtcctgtctgagccctgaagagccagctcccgaatccccacaagtgcccgaggcccctggtggttctgcggtgtaagtggctctgtcctcagggtgggcagagccactaaacttgttttacctagttctttccagtttgtttttggctccccaagcatcatctcacgaggagaactttacacctagcacagctggtgccaagagatgtcctaaggacatggccac

SEQ ID NO: 33015 - DNA, 521 bp, Homo sapiens
gcgtgcgtatttctggcggaggatgcgccatgagcgctgaaagagcctgaaccgaagcgtccggctcgccgagagagtgagagccgggccggctcccaggagcgcgggcgaggcttgtcttttccaggcaccctggagtcccctcaggccagctcggtgggcgcgcacctgccagccgcccctgacctcgcaggccaggcgacctccgagcctgagaagatggcccagtccaagctcgattgccgctcacctgtcggcctcgactgctgcaactgctgcctggacctggcccatcggagtgggctccagcgaggcagcagcggggagaacaacaacccgggcagccctacagtgagcaactttcggcagctgcaggaaaagctggtctttgagaacctcaataccgacaagctcaacagcataatgcggcaggattcgctagagccggtgctgcgggacccctgctacctgatcaacgagggcatctgcaaccgcaacatcgaccagaccatgctctccat

SEQ ID NO: 33016 - DNA, 581 bp, Homo sapiens
agagagaaggaaggggaggactgaggagagacggcgaaggggcagagggaaaccgggacagagactgcctctgaggggttcagggaagagaggacacagcgagctggggaaaggagcttgtcttttccaggcaccctggagtcccctcaggccagctcggtgggcgcgcacctgccagccgcccctgacctcgcaggccaggcgacctccgagcctgagaagatggcccagtccaagctcgattgccgctcacctgtcggcctcgactgctgcaactgctgcctggacctggcccatcggagtgggctccagcgaggcagcagcggggagaacaacaacccgggcagccctacagtgagcaactttcggcagctgcaggaaaagctggtctttgagaacctcaataccgacaagctcaacagcataatgcggcaggattcgctagagccggtgctgcgggacccctgctacctgatcaacgagggcatctgcaaccgcaacatcgaccagaccatgctctccatcctgctcttcttccacagtgcctccggagccagcgtggtggccatagacaacaagat

SEQ ID NO: 33017 - DNA, 569 bp, Homo sapiens
atgcaatcgctacatctattgaaagggtaacgacagacggagatcaactaaggtggcagccctacagtgagcaactttcggcagctgcaggaaaagctggtctttgagaacctcaataccgacaagctcaacagcataatgcggcaggattcgctagagccggtgctgcgggacccctgctacctgatcaacgagggcatctgcaaccgcaacatcgaccagaccatgctctccatcctgctcttcttccacagtgcctccggagccagcgtggtggccatagacaacaagatcgaacaggccatggatctggtgaagaatcatctgatgtatgctgtgagagaggaggtggagatcctgaaggagcagatccgagagctggtggagaagaactcccagctagagcgtgagaacaccctgttgaagaccctggcaagcccagagcagctggagaagttccagtcctgtctgagccctgaagagccagctcccgaatccccacaagtgcccgaggcccctggtggttctgcggtgtaagtggctctgtcctcagggtgggcagagccact

SEQ ID NO: 33018 - DNA, 802 bp, Homo sapiens
gctgctctatttcaaaggccagacttgtgaatgaaggagccgatgcgggggtggggagtactgactgaaatgtaagtcagttttacgtgaaaactgaacgtcatgaaaagtttagttttttcagacactaatcgttatttaatcctacacatttaaagtattccaagtctctgagtcctgagaaaccctggaaacccaccacttgcccacccagaacatccctccatcttacagagctggggcacgcccctcaggcctgtgaacatgcaatcgctacatctattgaaagggtaacgacagacggagatcaactaaggtggcagcttgtcttttccaggcaccctggagtcccctcaggccagctcggtgggcgcgcacctgccagccgcccctgacctcgcaggccaggcgacctccgagcctgagaagatggcccagtccaagctcgattgccgctcacctgtcggcctcgactgctgcaactgctgcctggacctggcccatcggagtgggctccagcgaggcagcagcggggagaacaacaacccgggcagccctacagtgagcaactttcggcagctgcaggaaaagctggtctttgagaacctcaataccgacaagctcaacagcataatgcggcaggattcgctagagccggtgctgcgggacccctgctacctgatcaacgagggcatctgcaaccgcaacatcgaccagaccatgctctccatcctgctcttcttccacagtgcctccggagccagcgtggtggccatagacaacaagatcgaacaggccatgg

SEQ ID NO: 33019 - DNA, 2383 bp, Homo sapiens
ggaggaggaggaggaggagaggagcagtcagcaggcccgaggaggcaggacttcctggtgtgggggttgtcaacagcccagaaagagaaagacggagaggcagagacccaggggagccgaggagcggagacacggacccagcagggtcacgcgggaggagactcgggacacccactcgctggctgccaccgggagcagaggggggctcggccgccccctcccacatcagtctccagacccttggggcttcagaggccgctcctaggctcctcggaggaggcgcgggtttcttcttttccggagagcaaactttcctcggagatgcctggcaggatgagccgcggcccccggagaggacgggacagcctctgatcgccgcctgcgtgccccgccactgcccatggccaggaggccccagggaacggacagcccgacctcttaggcgccgggaccctcaggctcagatcagtggccgaggccccagagtttgcaaactcagctctggagttcagcagcaacagcagcaggaaaaacctgcccctgctcccccctcccgccacctcccctctcctcttctcccctcacccagcaggcacccccggttcccgccaggccctcctgccatgtcggacccagacgtccccaggggctcggatgtccccgccatgtggcccccttgttccaggggtgcctgagccccttcaaggagccccaacccacccccaaccttggcccagccctgagccccagggaccatgagcgggggcaagaagaagagtagtttccaaatcaccagcgtcaccacggactatgagggccctgggagcccaggggcttcggatccccctaccccacagcccccaaccgggcccccgccccgcctgcccaatggggagcccagccccgatccggggggcaagggcaccccccggaatggctccccaccacctggggccccttcctcccgtttccgggtggtgaagctgccccacggcctgggagagccttatcgccgcggtcgctggacgtgtgtggatgtttatgagcgagacctggagccccacagcttcggcggactcctggagggaattcgaggggcctcagggggcgccgggggcagatctttggattccaggttggagctggccagcctcggcctgggcgcccccaccccaccgtcaggcctgtctcagggccccacctcctggctccgtccaccccccacctctcctggacctcaggcccgctccttcactgggggactgggccagctggtggtgcccagcaaagccaaggcagagaaacccccactgtcggcctcctcaccccagcagcgccccccagagcctgagaccggtgagagtgcgggcacatcccgggctgccacgcccctgccctctctgagggtggaagcggaggctgggggctcaggggccaggacccctccactgtcccggaggaaagctgtagacatgcggctgcggatggagttgggtgctccagaagagatggggcaggtgcccccacttgactctcgccccagctccccagccctctacttcacccacgatgccagcctggttcacaaatctccagaccccttcggagcagtagcagctcagaagttcagcctggcccactccatgttggccatcagtggtcacctagacagcgacgatgatagtggctccggaagcctggttggcattgacaacaaaatcgagcaagccatggacttggtgaagtcccacctcatgtttgcggtccgggaggaggtggaggtgctgaaggagcagatccgggaattggcggagcggaacgctgcgctggagcaggagaatgggctgctgcgcgccctggccagcccggagcagctggctcagctgccctcctcgggggtcccacggcttgggccccctgcgcccaatgggccctccgtctgagcctcccttcccttacaatgtgcctttggggctgcccggccttgcgtcagccgcctgccccctcttcctatgcagctttaatgtccccgtgtccccggggtgggagttcaaggctcagtaatggcctggtcccccggcccctgccccatctcctcatcatccccagccttgatggaggagggagggcttcaggacggggcgtcagagggagccccctctgggagggaaccaacccccaccctccctcctgggaccccccagcagtagacggcttgggggagtcggaggctccccggcagacaccccacccccatcttgttcccttgaggtgcctcctctcctctgcccaggggagggagtgtggacagtatctggaagttctgggattcaggttgttattaaaataataataataattaaaaactctgaagaaacttgaa

SEQ ID NO: 33020 - DNA, 3326 bp, Homo sapiens
gcggcggttagctcccagttcggcctctgaggaaaacgggcgttcgcctgcggttggtccgactgttagcaacatgagcggcctggatggggtcaagaggaccactcccctccaaacccacagcatcattatttctgaccaagtcccgagcgaccaggacgcacaccagtacctgaggctccgcgaccaaagcgaggcgacacaggtgatggcggagccgggtgagggaggctcggagaccgtcgcgctcccgcctccaccgccttcagaggaggggggcgtaccccaggatgccgcgggccgtggcggtactccccagatccgagttgttgggggtcgcggtcatgtggcgatcaaagccgggcaggaagagggccagcctcccgccgaaggcctggcagccgcttctgtggtgatggcagccgaccgcagcctgaaaaagggcgttcagggtggagagaaggccctagaaatctgtggcgcccagagatccgcgtctgagctgacggcgggggcggaggctgaggcggaggaggtgaagacaggaaagtgcgccaccgtctcagcagccgtggctgagagggagagcgctgaggtggtgaaggaaggcctggcggagaaggaggtaatggaggagcagatggaggtagaggagcagccgccagaaggtgaagaaatagaagtggcggaggaggatagattggaggaggaggcgagggaggaagaagggccctggcctttgcatgaggctctccgcatggaccctctggaggccatccagctggaactggacactgtgaatgctcaggccgacagggccttccaacagctggagcacaagtttgggcggatgcgtcgacactacctggagcggaggaactacatcattcagaatatcccgggcttctggatgactgcttttcgaaaccacccccagttgtccgccatgattaggggccaagatgcagagatgttaaggtacataaccaatttagaggtgaaggaactcagacaccctagaaccggttgcaagttcaagttcttctttagaagaaacccctacttcagaaacaagctgattgtcaaggaatatgaggtaagatcctccggccgagtggtgtctctttctactccaattatatggcgcagggggcatgaaccccagtccttcattcgcagaaaccaagacctcatctgcagcttcttcacttggttttcagaccacagccttccagagtccgacaaaattgctgagattattaaagaggatctgtggccaaatccactgcaatactacctgttgcgtgaaggagtccgtagagcccgacgtcgcccgctaagggagcctgtagagatccccaggccctttgggttccagtctggttaacatttgcccttgggaatactcctgcacaaggtctcctaccaccttctgctggacctgtgcttgggcatcagcaatgagtatgccttctattgtgctttgtttttgctgacttttctgcaccctgtttcctttggatattcagttctctcaacctcaagattgagacggtggtgggtatgcttctccacttccatatgaccttcatgctgttctggaatatcacatgctacgaggtcatccttcacactacttgtaagccaagcaaatgatactgtagattgtactgcctttatctgcactgcttggaccctgtttattcccagggcctctgaactggttgctgtcacttggatttctagctttgggagcctgttccacctactcagctctgcattgagcagtatgggcacatgccctgtggacagttactggacgttaatgaactcagaggagaaaagcagtgagccacttgttctgtgtgatttatggtacttcattgctcttccttcacctctagtcactttctattgctacctgccctacattggctcctgccaaggtccctctctctccctgttttccttttttttttttttttttttttttttgagacggaggacggagtcttgctctgtcgcccaggttggagtgcagtggcgcgatctcggctcactgcaacctccacctcccgggttcaagcgattctcctgcctcagcctcccgagtagctgggactacaggcgcgcgccgccacgcccggctaatttttatatttttagtagagacggggtttcaccatgctggccaggctggtctcgaaccccgatctcgtgatccgccctccttagcctcccaatcctctcttaaaaaagtgatagctcagaaacatttgtaaaagcaaggtttttatttcattttggctctgtcattttcagaggcaaagaagttggcctgtaaaatagagtgctagagctcttacgcccctccccttcttcccaacttcctacttcctagcccttttatcaactcctagaatagttaaagagagacacatctagatgggatgaaaggtgccctaagcaggagaaactgaacaaaaggctagaggcatgggccaggtaaaaattgggcctagagtgaagactgtgctgtcgttaagagctttcgaggaaggagtacttactccccaatgatgatgaatggaaaaatacttttcagggagaattgaaggggttaaagtgttaaatatgttgcctagacaagggttctttaaagaaagacagcgcaactttgaatgctttcttacttgttttgtgacctaatttatgtggaagattgttatttcattaggatttagtaaaatttttttttctgattctaaacttattgtgaaaattgagctgtacagatattcttttgatttcaattgggaacatttggaagaacaacagtcttacttgcctgtacaatatagagacatatgaatagtcataacagttttcaacttgttcttgtttctgttaaactatattcctagaaacatagtttgaacaacttggtctttgttaggcttgtcaaattgccttcatggaaaaataatctacaaaagtatggtttaattgattgtcttacatgataattttccctggtaacaacttagtaagtgatatatcttttttcctaaattgcttaaatactgtgaaattgctctgacaaattggaagtgtaccattggcatatttgtcttcctttttatgcatgatggtaaaataaaagcatgttgttctgctagatttcttatttttcaccttacccataaatgtaatgcttgaatgaagttgttcatattaattaaaaattatggaatcattaaagtcctttaatccattaaagttcttaatggattaaaatcattaaagttcttaatggattaaaatca

SEQ ID NO: 33021 - DNA, 1108 bp, Homo sapiens
agttcggcctctgaggaaaacgggcgttcgcctgcggttggtccgactgttagcaacatgagcggcctggatggggtcaagaggaccactcccctccaaacccacagcatcattatttctgaccaagtcccgagcgaccaggacgcacaccagtacctgaggctccgcgaccaaagcgaggcgacacaggtgatggcggagccgggtgagggaggctcggagaccgtcgcgctcccgcctccaccgccttcagaggaggggggcgtaccccaggatgccgcgggccgtggcggtactccccagatccgagttgttgggggtcgcggtcatgtggcgatcaaagccgggcaggaagagggccagcctcccgccgaaggcctggcagccgcttctgtggtgatggcagccgaccgcagcctgaaaaagggcgttcagggtggagagaaggccctagaaatctgtggcgcccagagatccgcgtctgagctgacggcgggggcggaggctgaggcggaggaggtgaagacaggaaagtgcgccaccgtctcagcagccgtggccaagatgcagagatgttaaggtacataaccaatttagaggtgaaggaactcagacaccctagaaccggttgcaagttcaagttcttctttagaagaaacccctacttcagaaacaagctgattgtcaaggaatatgaggtaagatcctccggccgagtggtgtctctttctactccaattatatggcgcagggggcatgaaccccagtccttcattcgcagaaaccaagacctcatctgcagcttcttcacttggttttcagaccacagccttccagagtccgacaaaattgctgagattattaaagaggatctgtggccaaatccactgcaatactacctgttgcgtgaaggagtccgtagagcccgacgtcgcccgctaagggagcctgtagagatccccaggccctttgggttccagtctggttaacatttgcccttgggaatactcctgcacaaggtctcctaccaccttctgctggacctgtgcttgggcatcagcaatgagtatgccttctattgtgctttgtttttgctgacttttctgca

SEQ ID NO: 33022 - DNA, 2815 bp, Homo sapiens
agagcgaggtggtgaggagagctggttgcgtgagtctcctcagctctgcttaccggtgcgactagcggcagcgacgcggctaaaagcgaaggggcgagtgcgagtcccctgagctgtacgaacgcggtcgccatggaccgcccagatgaggggcctccggccaagacccgccgcctgagcagctccgagtctccacagcgcgacccgcccccgccgccgccgccgccgccgctcctccgactgccgctgcctccaccccagcagcgcccgaggctccaggaggaaacggaggcggcacaggtgctggccgatatgaggggggtgggactgggccccgcgctgcccccgccgcctccctatgtcattctcgaggagggggggatccgcgcatacttcacgctcggtgctgagtgtcccggctgggattctaccatcgagtcggggtatggggaggcgcccccgcccacggagagcctggaagcactccccactcctgaggcctcgggggggagcctggaaatcgattttcaggttgtacagtcgagcagttttggtggagagggggccctagaaacctgtagcgcagtggggtgggcgccccagaggttagttgacccgaagagcaaggaagaggcgatcatcatagtggaggatgaggatgaggatgagcgggagagtatgaggagcagcaggaggcggcggcggcggcggaggaggaagcagaggaaggtgaagagggaaagcagagagagaaatgccgagaggatggagagcatcctgcaggcactggaggatattcagctggatctggaggcagtgaacatcaaggcaggcaaagccttcctgcgtctcaagcgcaagttcatccagatgcgaagacccttcctggagcgcagagacctcatcatccagcatatcccaggcttctgggtcaaagcattcctcaaccaccccagaatttcaattttgatcaaccgacgtgatgaagacattttccgctacttgaccaatctgcaggtacaggatctcagacatatctccatgggctacaaaatgaagctgtacttccagactaacccctacttcacaaacatggtgattgtcaaggagttccagcgcaaccgctcaggccggctggtgtctcactcaaccccaatccgctggcaccggggccaggaaccccaggcccgtcgtcacgggaaccaggatgcgagccacagctttttcagctggttctcaaaccatagcctcccagaggctgacaggattgctgagattatcaagaatgatctgtgggttaaccctctacgctactacctgagagaaaggggctccaggataaagagaaagaagcaagaaatgaagaaacgtaaaaccaggggcagatgtgaggtggtgatcatggaagacgcccctgactattatgcagtggaagacattttcagcgagatctcagacattgatgagacaattcatgacatcaagatctctgacttcatggagaccaccgactacttcgagaccactgacaatgagataactgacatcaatgagaacatctgcgacagcgagaatcctgaccacaatgaggtccccaacaacgagaccactgataacaacgagagtgctgatgaccacgaaaccactgacaacaatgagagtgcagatgacaacaacgagaatcctgaagacaataacaagaacactgatgacaacgaagagaaccctaacaacaacgagaacacttacggcaacaacttcttcaaaggtggcttctggggcagccatggcaacaaccaggacagcagcgacagtgacaatgaagcagatgaggccagtgatgatgaagataatgatggcaacgaaggtgacaatgagggcagtgatgatgatggcaatgaaggtgacaatgaaggcagcgatgatgacgacagagacattgagtactatgagaaagttattgaagactttgacaaggatcaggctgactacgaggacgtgatagagatcatctcagacgaatcagtggaagaagagggcattgaggaaggcatccagcaagatgaggacatctatgaggaaggaaactatgaggaggaaggaagtgaagatgtctgggaagaaggggaagattcggacgactctgacctagaggatgtgcttcaggtcccaaacggttgggccaatccggggaagagggggaaaaccggataagggttttccccttttggggatcacctctctgtatcccccacccactatcccatttgccctcctcctcagctagggccacgcggccccacattgcacttctggggggtgaccgacttcgtacacgggtttaaagtttatttttatggtttagtcattgcagagttcttattttggggggagggaaagggggctagtccccttcttttggccctccgcccccgcaggcttctgtgtgctgctaactgtatttattgtgatgccttggtcagggcccctctacccacttctcccagtcagttgtggccccagcccctctccctgtgctgtgtggagtggacaccctgacccccgaagcggggagggccgctgtggccttcgtcacagccgcgcagtgcccatggaggcgctgctgccaccttcctctcccaagttctttctccatccctctcctcttcccgccgcgccgctagcccgcctcggtgtctatgcaaggccgcttcgccattgcggtattctttgcggtattcttgtccccgtcccccagaaggctcgcctctccccgtggaccctgttaatcccaataaaattctgagcaagttca

SEQ ID NO: 33023 - DNA, 2712 bp, Homo sapiens
cccgcggccggcccgagccgccacccggcgcccggcaggggggagcctggctgcgggcggggaccggggggcgggccgcgccgcgcggagaaaagcgctggccggagggcccgcggccgggccgccggggtgagcgtgccgaggcggctgtggcgcaggcttccagcccccaccatgccgtggcccctgctgctgctgctggccgtgagtggggcccagacaacccggccatgcttccccgggtgccaatgcgaggtggagaccttcggccttttcgacagcttcagcctgactcgggtggattgtagcggcctgggcccccacatcatgccggtgcccatccctctggacacagcccacttggacctgtcctccaaccggctggagatggtgaatgagtcggtgttggcggggccgggctacacgacgttggctggcctggatctcagccacaacctgctcaccagcatctcacccactgccttctcccgccttcgctacctggagtcgcttgacctcagccacaatggcctgacagccctgccagccgagagcttcaccagctcacccctgagcgacgtgaaccttagccacaaccagctccgggaggtctcagtgtctgccttcacgacgcacagtcagggccgggcactacacgtggacctctcccacaacctcattcaccgcctcgtgccccaccccacgagggccggcctgcctgcgcccaccattcagagcctgaacctggcctggaaccggctccatgccgtgcccaacctccgagacttgcccctgcgctacctgagcctggatgggaaccctctagctgtcattggtccgggtgccttcgcggggctgggaggccttacacacctgtctctggccagcctgcagaggctccctgagctggcgcccagtggcttccgtgagctaccgggcctgcaggtcctggacctgtcgggcaaccccaagcttaactgggcaggagctgaggtgttttcaggcctgagctccctgcaggagctggacctttcgggcaccaacctggtgcccctgcctgaggcgctgctcctccacctcccggcactgcagagcgtcagcgtgggccaggatgtgcggtgccggcgcctggtgcgggagggcacctacccccggaggcctggctccagccccaaggtggccctgcactgcgtagacacccgggattctgctgccaggggccccaccatcttgtgacaaatggtgtggcccagggccacataacagactgctgtcctgggctgcctcaggtcccgagtaacttatgttcaatgtgccaacaccagtggggagcccgcaggcctatgtggcagcgtcaccacaggagttgtgggcctaggagaggctttggacctgggagccacacctaggagcaaagtctcacccctttgtctacgttgcttccccaaaccatgagcagagggacttcgatgccaaaccagactcgggtcccctcctgcttcccttccccacttatcccccaagtgccttccctcatgcctgggccggcctgacccgcaatgggcagagggtgggtgggaccccctgctgcagggcagagttcaggtccactgggctgagtgtccccttgggcccatggcccagtcactcaggggcgagtttcttttctaacatagccctttctttgccatgaggccatgaggcccgcttcatccttttctatttccctagaaccttaatggtagaaggaattgcaaagaatcaagtccacccttctcatgtgacagatggggaaactgaggccttgagaaggaaaaaggctaatctaagttcctgcgggcagtggcatgactggagcacagcctcctgcctcccagcccggacccaatgcactttcttgtctcctctaataagccccaccctccccgcctgggctccccttgctgcccttgcctgttccccattagcacaggagtagcagcagcaggacaggcaagagcctcacaagtgggactctgggcctctgaccagctgtgcggcatgggctaagtcactctgcccttcggagcctctggaagcttagggcacattggttccagcctagccagtttctcaccctgggttggggtcccccagcatccagactggaaacctacccattttcccctgagcatcctctagatgctgccccaaggagttgctgcagttctggagcctcatctggctgggatctccaaggggcctcctggattcagtccccactggccctgagcacgacagcccttcttaccctcccaggaatgccgtgaaaggagacaaggtctgcccgacccatgtctatgctctacccccagggtagcatctcagcttccgaaccctgggctgtttccttagtcttcattttataaaagttgttgcctttttaacggagtgtcactttcaaccggcctcccctacccctgctggccggggatggagacatgtcatttgtaaaagcagaaaaaggttgcatttgttcacttttgtaatattgtcctgggcctgtgttggggtgttgggggaagctgggcatcagtggccacatgggcatcaggggctggccccacagagaccccacagggcagtgagctctgtcttcccccacctgcctagcccatcatctatctaaccggtccttgatttaataaacactataaaaagttctttgcttta

SEQ ID NO: 33024 - DNA, 2507 bp, Homo sapiens
gaaaagcgctggccggagggcccgcggccgggccgccggggtgagcgtgccgaggcggctgtggcgcaggcttccagcccccaccatgccgtggcccctgctgctgctgctggccgtgagtggggcccagacaacccggccatgcttccccgggtgccaatgcgaggtggagaccttcggccttttcgacagcttcagcctgactcgggtggattgtagcggcctgggcccccacatcatgccggtgcccatccctctggacacagcccacttggacctgtcctccaaccggctggagatggtgaatgagtcggtgttggcggggccgggctacacgacgttggctggcctggatctcagccacaacctgctcaccagctcacccctgagcgacgtgaaccttagccacaaccagctccgggaggtctcagtgtctgccttcacgacgcacagtcagggccgggcactacacgtggacctctcccacaacctcattcaccgcctcgtgccccaccccacgagggccggcctgcctgcgcccaccattcagagcctgaacctggcctggaaccggctccatgccgtgcccaacctccgagacttgcccctgcgctacctgagcctggatgggaaccctctagctgtcattggtccgggtgccttcgcggggctgggaggccttacacacctgtctctggccagcctgcagaggctccctgagctggcgcccagtggcttccgtgagctaccgggcctgcaggtcctggacctgtcgggcaaccccaagcttaactgggcaggagctgaggtgttttcaggcctgagctccctgcaggagctggacctttcgggcaccaacctggtgcccctgcctgaggcgctgctcctccacctcccggcactgcagagcgtcagcgtgggccaggatgtgcggtgccggcgcctggtgcgggagggcacctacccccggaggcctggctccagccccaaggtggccctgcactgcgtagacacccgggattctgctgccaggggccccaccatcttgtgacaaatggtgtggcccagggccacataacagactgctgtcctgggctgcctcaggtcccgagtaacttatgttcaatgtgccaacaccagtggggagcccgcaggcctatgtggcagcgtcaccacaggagttgtgggcctaggagaggctttggacctgggagccacacctaggagcaaagtctcacccctttgtctacgttgcttccccaaaccatgagcagagggacttcgatgccaaaccagactcgggtcccctcctgcttcccttccccacttatcccccaagtgccttccctcatgcctgggccggcctgacccgcaatgggcagagggtgggtgggaccccctgctgcagggcagagttcaggtccactgggctgagtgtccccttgggcccatggcccagtcactcaggggcgagtttcttttctaacatagccctttctttgccatgaggccatgaggcccgcttcatccttttctatttccctagaaccttaatggtagaaggaattgcaaagaatcaagtccacccttctcatgtgacagatggggaaactgaggccttgagaaggaaaaaggctaatctaagttcctgcgggcagtggcatgactggagcacagcctcctgcctcccagcccggacccaatgcactttcttgtctcctctaataagccccaccctccccgcctgggctccccttgctgcccttgcctgttccccattagcacaggagtagcagcagcaggacaggcaagagcctcacaagtgggactctgggcctctgaccagctgtgcggcatgggctaagtcactctgcccttcggagcctctggaagcttagggcacattggttccagcctagccagtttctcaccctgggttggggtcccccagcatccagactggaaacctacccattttcccctgagcatcctctagatgctgccccaaggagttgctgcagttctggagcctcatctggctgggatctccaaggggcctcctggattcagtccccactggccctgagcacgacagcccttcttaccctcccaggaatgccgtgaaaggagacaaggtctgcccgacccatgtctatgctctacccccagggtagcatctcagcttccgaaccctgggctgtttccttagtcttcattttataaaagttgttgcctttttaacggagtgtcactttcaaccggcctcccctacccctgctggccggggatggagacatgtcatttgtaaaagcagaaaaaggttgcatttgttcacttttgtaatattgtcctgggcctgtgttggggtgttgggggaagctgggcatcagtggccacatgggcatcaggggctggccccacagagaccccacagggcagtgagctctgtcttcccccacctgcctagcccatcatctatctaaccggtccttgatttaataaacact

SEQ ID NO: 33025 - DNA, 542 bp, Homo sapiens
agaccccggctgggaggaagaggcgagcggtgggtcccaggctccggccctgggctggggagaggaagggacagggcggctggcgttgccctccccgcgcttcttggaaagagtgtgatccagagttgcgtctgtttggtagggagacaggctccgctttgagacccactctccgtttgcagcccgcccccggggtagggggccaaccctcggacccgcccccaccatgccgtggcccctgctgctgctgctggccgtgagtggggcccagacaacccggccatgcttccccgggtgccaatgcgaggtggagaccttcggccttttcgacagcttcagcctgactcgggtggattgtagcggcctgggcccccacatcatgccggtgcccatccctctggacacagcccacttggacctgtcctccaaccggctggagatggtgaatgagtcggtgttggcggggccgggctacacgacgttggctggcctggatctcagccacaacctgctcaccagcatctcacccactgccttctccc

SEQ ID NO: 33026 - DNA, 3554 bp, Homo sapiens
gtacacagaagtcaagaattgaggtttgggaacctctgcctagatttcagaagatgtatggaaacacctggatgcccaggcaaaagtttgctgcaggggtgggaccctcatggagaacctctgctagggcagtgcagaaaggaaatgtggggttggagtagagtccctactggggcaccgcctagtggagctgtgagaagaggggcaccatcctctagaccgcagaatggcagatccactaacagcttgcactgtgcacctggaaaagctgcagacactcaacgccagtccgtgaaagcagccagaaaggaggctgcaccctgcaaagccacgggggtggagctgcccaagactgtgggaacccacctcttgcatcagcatgactcagatatgcgggacatggagtcaaaggagatcattttggaactttaataagatttgactgccctgctggattttgaacttgcctggggcctgtagcccctttgttttggctaatttcttccatgtggaacagctgtatttacccaatgcctgtacccccactgtatctaggaagtaactaacttgcttttgattttacaggctcgtaggtggaagggacttgtctcagatgagacattggactgtggacttttgggttaatactgaaatgagttaagactttgggggactgttgggaaggcatgattggttttgaaatgtgagaacatgagatttgggagggaccaggggtggaatgatatggtttagctgtgcccgcacccaaatctcaacttgaattgtatctcccagtattcccatgtgttgtgggagggacccagtgggaggtaattgaatcatggggccagtctttcccgagctattctcgtgatagtgaataagtctcacaagatctgatgggtttatcaggggcttcagcttttgcttcctcctcattctctcttgccgccgccatgtaagaagtgccttttgccttccaccatgattgttagaccttccacagccacgtggaattcccccaccatgccgtggcccctgctgctgctgctggccgtgagtggggcccagacaacccggccatgcttccccgggtgccaatgcgaggtggagaccttcggccttttcgacagcttcagcctgactcgggtggattgtagcggcctgggcccccacatcatgccggtgcccatccctctggacacagcccacttggacctgtcctccaaccggctggagatggtgaatgagtcggtgttggcggggccgggctacacgacgttggctggcctggatctcagccacaacctgctcaccagcatctcacccactgccttctcccgccttcgctacctggagtcgcttgacctcagccacaatggcctgacagccctgccagccgagagcttcaccagctcacccctgagcgacgtgaaccttagccacaaccagctccgggaggtctcagtgtctgccttcacgacgcacagtcagggccgggcactacacgtggacctctcccacaacctcattcaccgcctcgtgccccaccccacgagggccggcctgcctgcgcccaccattcagagcctgaacctggcctggaaccggctccatgccgtgcccaacctccgagacttgcccctgcgctacctgagcctggatgggaaccctctagctgtcattggtccgggtgccttcgcggggctgggaggccttacacacctgtctctggccagcctgcagaggctccctgagctggcgcccagtggcttccgtgagctaccgggcctgcaggtcctggacctgtcgggcaaccccaagcttaactgggcaggagctgaggtgttttcaggcctgagctccctgcaggagctggacctttcgggcaccaacctggtgcccctgcctgaggcgctgctcctccacctcccggcactgcagagcgtcagcgtgggccaggatgtgcggtgccggcgcctggtgcgggagggcacctacccccggaggcctggctccagccccaaggtggccctgcactgcgtagacacccgggattctgctgccaggggccccaccatcttgtgacaaatggtgtggcccagggccacataacagactgctgtcctgggctgcctcaggtcccgagtaacttatgttcaatgtgccaacaccagtggggagcccgcaggcctatgtggcagcgtcaccacaggagttgtgggcctaggagaggctttggacctgggagccacacctaggagcaaagtctcacccctttgtctacgttgcttccccaaaccatgagcagagggacttcgatgccaaaccagactcgggtcccctcctgcttcccttccccacttatcccccaagtgccttccctcatgcctgggccggcctgacccgcaatgggcagagggtgggtgggaccccctgctgcagggcagagttcaggtccactgggctgagtgtccccttgggcccatggcccagtcactcaggggcgagtttcttttctaacatagccctttctttgccatgaggccatgaggcccgcttcatccttttctatttccctagaaccttaatggtagaaggaattgcaaagaatcaagtccacccttctcatgtgacagatggggaaactgaggccttgagaaggaaaaaggctaatctaagttcctgcgggcagtggcatgactggagcacagcctcctgcctcccagcccggacccaatgcactttcttgtctcctctaataagccccaccctccccgcctgggctccccttgctgcccttgcctgttccccattagcacaggagtagcagcagcaggacaggcaagagcctcacaagtgggactctgggcctctgaccagctgtgcggcatgggctaagtcactctgcccttcggagcctctggaagcttagggcacattggttccagcctagccagtttctcaccctgggttggggtcccccagcatccagactggaaacctacccattttcccctgagcatcctctagatgctgccccaaggagttgctgcagttctggagcctcatctggctgggatctccaaggggcctcctggattcagtccccactggccctgagcacgacagcccttcttaccctcccaggaatgccgtgaaaggagacaaggtctgcccgacccatgtctatgctctacccccagggtagcatctcagcttccgaaccctgggctgtttccttagtcttcattttataaaagttgttgcctttttaacggagtgtcactttcaaccggcctcccctacccctgctggccggggatggagacatgtcatttgtaaaagcagaaaaaggttgcatttgttcacttttgtaatattgtcctgggcctgtgttggggtgttgggggaagctgggcatcagtggccacatgggcatcaggggctggccccacagagaccccacagggcagtgagctctgtcttcccccacctgcctagcccatcatctatctaaccggtccttgatttaataaacactataaaaagtt

SEQ ID NO: 33027 - DNA, 643 bp, Homo sapiens
aataaggaaagaagcagcaagcagactgggtgtgttaacaagtctgggccactgcaggaggtacattgcccaatttctgcaccccgaggccctccaaagtctaggagaagctcctgggaggtccagggcccaagaccaaagcctctatcaactctcccacctgtgaactgcccctctcccaagcccccaccatgccgtggcccctgctgctgctgctggccgtgagtggggcccagacaacccggccatgcttccccgggtgccaatgcgaggtggagaccttcggccttttcgacagcttcagcctgactcgggtggattgtagcggcctgggcccccacatcatgccggtgcccatccctctggacacagcccacttggacctgtcctccaaccggctggagatggtgaatgagtcggtgttggcggggccgggctacacgacgttggctggcctggatctcagccacaacctgctcaccagcatctcacccactgccttctcccgccttcgctacctggagtcgcttgacctcagccacaatggcctgacagccctgccagccgagagcttcaccagctcacccctgagcgacgtgaaccttagccacaaccagctccgggaggtctcagtgtctgcctt

SEQ ID NO: 33028 - DNA, 3010 bp, Homo sapiens
agcattgaccaataggagaccgtagtgatagcgacggggaaattcaaacgtgtttgcggaaaggagtttgggttccatcttttcatttccccagcgcagctttctgtagaaatggaatccgaggatttaagtggcagagaattgacaattgattccataatgaacaaagtgagagacattaaaaataagtttaaaaatgaagaccttactgatgaactaagcttgaataaaatttctgctgatactacagataactcgggaactgttaaccaaattatgatgatggcaaacaacccagaggactggttgagtttgttgctcaaactagagaaaaacagtgttccgctaagtgatgctcttttaaataaattgattggtcgttacagtcaagcaattgaagcgcttcccccagataaatatggccaaaatgagagttttgctagaattcaagtgagatttgctgaattaaaagctattcaagagccagatgatgcacgtgactactttcaaatggccagagcaaactgcaagaaatttgcttttgttcatatatcttttgcacaatttgaactgtcacaaggtaatgtcaaaaaaagtaaacaacttcttcaaaaagctgtagaacgtggagcagtaccactagaaatgctggaaattgccctgcggaatttaaacctccaaaaaaagcagctgctttcagaggaggaaaagaagaatttatcagcatctacggtattaactgcccaagaatcattttccggttcacttgggcatttacagaataggaacaacagttgtgattccagaggacagactactaaagccaggtttttatatggagagaacatgccaccacaagatgcagaaataggttaccggaattcattgagacaaactaacaaaactaaacagtcatgcccatttggaagagtcccagttaaccttctaaatagcccagattgtgatgtgaagacagatgattcagttgtaccttgttttatgaaaagacaaacctctagatcagaatgccgagatttggttgtgcctggatctaaaccaagtggaaatgattcctgtgaattaagaaatttaaagtctgttcaaaatagtcatttcaaggaacctctggtgtcagatgaaaagagttctgaacttattattactgattcaataaccctgaagaataaaacggaatcaagtcttctagctaaattagaagaaactaaagagtatcaagaaccagaggttccagagagtaaccagaaacagtggcaatctaagagaaagtcagagtgtattaaccagaatcctgctgcatcttcaaatcactggcagattccggagttagcccgaaaagttaatacagagcagaaacataccacttttgagcaacctgtcttttcagtttcaaaacagtcaccaccaatatcaacatctaaatggtttgacccaaaatctatttgtaagacaccaagcagcaataccttggatgattacatgagctgttttagaactccagttgtaaagaatgactttccacctgcttgtcagttgtcaacaccttatggccaacctgcctgtttccagcagcaacagcatcaaatacttgccactccacttcaaaatttacaggttttagcatcttcttcagcaaatgaatgcatttcggttaaaggaagaatttattccatattaaagcagataggaagtggaggttcaagcaaggtatttcaggtgttaaatgaaaagaaacagatatatgctataaaatatgtgaacttagaagaagcagataaccaaactcttgatagttaccggaacgaaatagcttatttgaataaactacaacaacacagtgataagatcatccgactttatgattatgaaatcacggaccagtacatctacatggtaatggagtgtggaaatattgatcttaatagttggcttaaaaagaaaaaatccattgatccatgggaacgcaagagttactggaaaaatatgttagaggcagttcacacaatccatcaacatggcattgttcacagtgatcttaaaccagctaactttctgatagttgatggaatgctaaagctaattgattttgggattgcaaaccaaatgcaaccagatacaacaagtgttgttaaagattctcaggttggcacagttaattatatgccaccagaagcaatcaaagatatgtcttcctccagagagaatgggaaatctaagtcaaagataagccccaaaagtgatgtttggtccttaggatgtattttgtactatatgacttacgggaaaacaccatttcagcagataattaatcagatttctaaattacatgccataattgatcctaatcatgaaattgaatttcccgatattccagagaaagatcttcaagatgtgttaaagtgttgtttaaaaagggacccaaaacagaggatatccattcctgagctcctggctcatccatatgttcaaattcaaactcatccagttaaccaaatggccaagggaaccactgaagaaatgaaatatgttctgggccaacttgttggtctgaattctcctaactccattttgaaagctgctaaaactttatatgaacactatagtggtggtgaaagtcataattcttcatcctccaagacttttgaaaaaaaaaggggaaaaaaatgatttgcagttattcgtaatgtcagataccacctataaaatatattggactgttatactcttgaatccctgtggaaatctacatttgaagacaacatcactctgaagtgttatcagcaaaaaaaattcagtagattatctttaaaagaaaactgtaaaaatagcaaccacttatggcactgtatatattgtagacttgttttctctgttttatgctcttgtgtaatctacttgacatcattttactcttggaatagtgggtggatagcaagtatattctaaaaaactttgtaaataaagttttgtggctaaaatgacactaacattt

SEQ ID NO: 33029 - DNA, 541 bp, Homo sapiens
gtaggtaagttctgtcttaccggtgcaccggcgcactgaggaacagccgcagccggtgtaggggctcattgttagcgctggtcggtgaggggtggggcgaggtgggggcagctcggagccagaaatggaatccgaggatttaagtggcagagaattgacaattgattccataatgaacaaagtgagagacattaaaaataagtttaaaaatgaagaccttactgatgaactaagcttgaataaaatttctgctgatactacagataactcgggaactgttaaccaaattatgatgatggcaaacaacccagaggactggttgagtttgttgctcaaactagagaaaaacagtgttccgctaagtgatgctcttttaaataaattgattggtcgttacagtcaagcaattgaagcgcttcccccagataaatatggccaaaatgagagttttgctagaattcaagtgagatttgctgaattaaaagctattcaagagccagatgatgcacgtgactactttcaaatggccagagcaaactgc

SEQ ID NO: 33030 - DNA, 569 bp, Homo sapiens
agttaaagtaggagttatgactgttcagtttttttcttagaaatggaatccgaggatttaagtggcagagaattgacaattgattccataatgaacaaagtgagagacattaaaaataagtttaaaaatgaagaccttactgatgaactaagcttgaataaaatttctgctgatactacagataactcgggaactgttaaccaaattatgatgatggcaaacaacccagaggactggttgagtttgttgctcaaactagagaaaaacagtgttccgctaagtgatgctcttttaaataaattgattggtcgttacagtcaagcaattgaagcgcttcccccagataaatatggccaaaatgagagttttgctagaattcaagtgagatttgctgaattaaaagctattcaagagccagatgatgcacgtgactactttcaaatggccagagcaaactgcaagaaatttgcttttgttcatatatcttttgcacaatttgaactgtcacaaggtaatgtcaaaaaaagtaaacaacttcttcaaaaagctgtagaacgtggagcagtacc

SEQ ID NO: 33031 - DNA, 549 bp, Homo sapiens
atgcgacgcggctaaacgagctggagggggaggggatgtctcactgcctcagcgggtctggccggtggggtgatgcaggaggttttgttgaggaaaaatggaatccgaggatttaagtggcagagaattgacaattgattccataatgaacaaagtgagagacattaaaaataagtttaaaaatgaagaccttactgatgaactaagcttgaataaaatttctgctgatactacagataactcgggaactgttaaccaaattatgatgatggcaaacaacccagaggactggttgagtttgttgctcaaactagagaaaaacagtgttccgctaagtgatgctcttttaaataaattgattggtcgttacagtcaagcaattgaagcgcttcccccagataaatatggccaaaatgagagttttgctagaattcaagtgagatttgctgaattaaaagctattcaagagccagatgatgcacgtgactactttcaaatggccagagcaaactgcaagaaatttgcttttgttcatatatcttttgcaca

SEQ ID NO: 33032 - DNA, 3477 bp, Homo sapiens
aaaaagcactgaaattcttgagctggcggcagggctgaacgtagctcagtgaaagatcctttcttgccacatcctctctaagccaggctgtgagaaccgcgggaaacgaaggagaagggtggcggtggggtcagtaaagggccggcccaaggtgcatcttttaggtcctgatgctaggagcagccgtccctgcccctatattcctctcactgggtaggtttgctcgggagtggctacctcccaggcaaaaattcggcctggttaaactggaaagaccaggaaagcccgcccacgggcgtccggggaacgcctgcaaagtgccagcaccctaccaacccaggcgccgcacgggtggggtcgcggccgcaggctcttccggggcgggcctagcctgacgcaggaggaggggcggcccccgtcgcacaagaaccaatcacgactgtcgcttctacgtggctagcattgaccaataggagaccgtagtgatagcgacggggaaattcaaacgtgtttgcggaaaggagtttgggttccatcttttcatttccccagcgcagctttctgtagtttttttcttagaaatggaatccgaggatttaagtggcagagaattgacaattgattccataatgaacaaagtgagagacattaaaaataagtttaaaaatgaagaccttactgatgaactaagcttgaataaaatttctgctgatactacagataactcgggaactgttaaccaaattatgatgatggcaaacaacccagaggactggttgagtttgttgctcaaactagagaaaaacagtgttccgctaagtgatgctcttttaaataaattgattggtcgttacagtcaagcaattgaagcgcttcccccagataaatatggccaaaatgagagttttgctagaattcaagtgagatttgctgaattaaaagctattcaagagccagatgatgcacgtgactactttcaaatggccagagcaaactgcaagaaatttgcttttgttcatatatcttttgcacaatttgaactgtcacaaggtaatgtcaaaaaaagtaaacaacttcttcaaaaagctgtagaacgtggagcagtaccactagaaatgctggaaattgccctgcggaatttaaacctccaaaaaaagcagctgctttcagaggaggaaaagaagaatttatcagcatctacggtattaactgcccaagaatcattttccggttcacttgggcatttacagaataggaacaacagttgtgattccagaggacagactactaaagccaggtttttatatggagagaacatgccaccacaagatgcagaaataggttaccggaattcattgagacaaactaacaaaactaaacagtcatgcccatttggaagagtcccagttaaccttctaaatagcccagattgtgatgtgaagacagatgattcagttgtaccttgttttatgaaaagacaaacctctagatcagaatgccgagatttggttgtgcctggatctaaaccaagtggaaatgattcctgtgaattaagaaatttaaagtctgttcaaaatagtcatttcaaggaacctctggtgtcagatgaaaagagttctgaacttattattactgattcaataaccctgaagaataaaacggaatcaagtcttctagctaaattagaagaaactaaagagtatcaagaaccagaggttccagagagtaaccagaaacagtggcaatctaagagaaagtcagagtgtattaaccagaatcctgctgcatcttcaaatcactggcagattccggagttagcccgaaaagttaatacagagaaacataccacttttgagcaacctgtcttttcagtttcaaaacagtcaccaccaatatcaacatctaaatggtttgacccaaaatctatttgtaagacaccaagcagcaataccttggatgattacatgagctgttttagaactccagttgtaaagaatgactttccacctgcttgtcagttgtcaacaccttatggccaacctgcctgtttccagcagcaacagcatcaaatacttgccactccacttcaaaatttacaggttttagcatcttcttcagcaaatgaatgcatttcggttaaaggaagaatttattccatattaaagcagataggaagtggaggttcaagcaaggtatttcaggtgttaaatgaaaagaaacagatatatgctataaaatatgtgaacttagaagaagcagataaccaaactcttgatagttaccggaacgaaatagcttatttgaataaactacaacaacacagtgataagatcatccgactttatgattatgaaatcacggaccagtacatctacatggtaatggagtgtggaaatattgatcttaatagttggcttaaaaagaaaaaatccattgatccatgggaacgcaagagttactggaaaaatatgttagaggcagttcacacaatccatcaacatggcattgttcacagtgatcttaaaccagctaactttctgatagttgatggaatgctaaagctaattgattttgggattgcaaaccaaatgcaaccagatacaacaagtgttgttaaagattctcaggttggcacagttaattatatgccaccagaagcaatcaaagatatgtcttcctccagagagaatgggaaatctaagtcaaagataagccccaaaagtgatgtttggtccttaggatgtattttgtactatatgacttacgggaaaacaccatttcagcagataattaatcagatttctaaattacatgccataattgatcctaatcatgaaattgaatttcccgatattccagagaaagatcttcaagatgtgttaaagtgttgtttaaaaagggacccaaaacagaggatatccattcctgagctcctggctcatccatatgttcaaattcaaactcatccagttaaccaaatggccaagggaaccactgaagaaatgaaatatgttctgggccaacttgttggtctgaattctcctaactccattttgaaagctgctaaaactttatatgaacactatagtggtggtgaaagtcataattcttcatcctccaagacttttgaaaaaaaaaggggaaaaaaatgatttgcagttattcgtaatgtcagataccacctataaaatatattggactgttatactcttgaatccctgtggaaatctacatttgaagacaacatcactctgaagtgttatcagcaaaaaaaattcagtagattatctttaaaagaaaactgtaaaaatagcaaccacttatggcactgtatatattgtagacttgttttctctgttttatgctcttgtgtaatctacttgacatcattttactcttggaatagtgggtggatagcaagtatattctaaaaaactttgtaaataaagttttgtggctaaaatgacactaacattt

SEQ ID NO: 33033 - DNA, 2071 bp, Homo sapiens
agacactggcggctagaggggcccggacttgccctcccagctctaacttccgccggaagtgccttccagccgcaggcgcccttcttcttctgtgcgctcgggctcctggtcccggctccccggttaccggggcgcgagtatgaccacaatggcggccgccaccctgctgcgcgcgacgccccacttcagcggtctcgccgccggccggaccttcctgctgcagggtctgttgcggctgctgaaagccccggcattgcctctcttgtgccgcggcctggccgtggaggccaagaagacttacgtgcgcgacaagccacatgtgaatgtgggtaccatcggccatgtggaccacgggaagaccacgctgactgcagccatcacgaagattctagctgagggaggtggggctaagttcaagaagtacgaggagattgacaatgccccggaggagcgagctcggggtatcaccatcaatgcggctcatgtggagtatagcactgccgcccgccactacgcccacacagactgcccgggtcatgcagattatgttaagaatatgatcacaggcactgcacccctcgacggctgcatcctggtggtagcagccaatgacggccccatgccccagacccgagagcacttattactggccagacagattggggtggagcatgtggtggtgtatgtgaacaaggctgacgctgtccaggactctgagatggtggaactggtggaactggagatccgggagctgctcaccgagtttggctataaaggggaggagaccccagtcatcgtaggctctgctctctgtgcccttgagggtcgggaccctgagttaggcctgaagtctgtgcagaagctactggatgctgtggacacttacatcccagtgcccgcccgggacctggagaagcctttcctgctgcctgtggaggcggtgtactccgtccctggccgtggcaccgtggtgacaggtacactagagcgtggcattttaaagaagggagacgagtgtgagctcctaggacatagcaagaacatccgcactgtggtgacaggcattgagatgttccacaagagcctggagagggccgaggccggagataacctcggggccctggtccgaggcttgaagcgggaggacttgcggcggggcctggtcatggtcaagccaggttccatcaagccccaccagaaggtggaggcccaggtttacatcctcagcaaggaggaaggtggccgccacaagccctttgtgtcccacttcatgcctgtcatgttctccctgacttgggacatggcctgtcggattatcctgcccccagagaaggagcttgccatgcccggggaggacctgaagttcaacctaatcttgcggcagccaatgatcttagagaaaggccagcgtttcaccctgcgagatggcaaccggactattggcaccggtctagtcaccaacacgctggccatgactgaggaggagaagaatatcaaatggggttgagtgtgcagatctctgctcagcttcccttgcgtttaaggcctgccctagccagggctccctcctgcttccagtaccctctcatggcataggctgcaacccagcagagggcagctagatggacatttcccctgctcggaagggttggcctgcctggctggggaggtcagtaaactttgaatagtaagccagcctgtgtcctgtgtcctttgtgcaaattggagaggataggggaggacaaaaagggtgttgaaccccagacagatggggagcttgtgagatcccagagcagttttaacggataaatcaagtccagtgagcttagtgattgcctagacacagtaggatgccgttattcagcctcctgggagatagtgggaaagaatgttctatcgctctggagccagcatggcttcagctcaggtgccaaacccatcttgtttcctcggaatactaagtgaatgtctagcatccattcacattctgtgggaacagggactggacaggcatacctcagatgctgtaggtttgcttccagactaccacaataaagcaggtcacaaattt

SEQ ID NO: 33034 - DNA, 2162 bp, Homo sapiens
gaagttgagccgagattagcaggagtcgggagggaggctcctagacctgcagagaaaggggtgcgataggcaaaggcaccatgcctctgcgggatgaaaccctccgagaggtgtgggcctctgacagtgggcatgaagaagaaagcctgagcccggaggccccgcggcgccccaaacagcgacccgccccggcacagaggctaaggaagaagaggacggaggcccccgaatccccctgccccacgggatccaagccccggaagcccggagctgggcggacggggaggccgcgggaggagccttccccagacccagcccaggcccgggcgccgcagacggtctacgccaggttcctcagggaccccgaggccaagaagcgcgacccccgggaaacctttctggtagcccgtgccccagacgcggaggacgaggaggaggaggaagaggaggacgaggaggacgaggaagaggaggcagaggaaaagaaagagaaaatccttctgcctcccaagaagcccctgagagagaagagctccgcagacctgaaggagaggagggccaaggcccagggcccaaggggagacctgggaagccctgaccccccaccgaaacctctgcgtgttaggaataaggaagctccagcaggggaggggaccaagatgagaaagaccaagaagaaagggtctggggaggccgacaaggacccctcagggagcccagccagtgcgaggaagagcccagcagccatgtttctggttggggaaggcagtcctgacaagaaagccctgaagaagaaaggcactcccaaaggcgcgaggaaggaggaagaagaggaggaggaggcagctacggtgataaagaagagcaatcaaaagggcaaagccaaaggaaaaggcaaaaagaaagcgaaggaggagagggccccgtctccccccgtggaggtggacgaaccccgggagtttgtgctccggcctgccccccagggccgcacggtgcgctgccggctgacccgggacaaaaagggcatggatcgaggcatgtatccctcctacttcctgcacctggacacggagaagaaggtgttcctcttggctggcaggaaacgaaaacggagcaagacagccaattacctcatctccatcgaccctaccaatctgtcccgaggaggggagaatttcatcgggaagctgaggtccaacctcctggggaaccgcttcacggtctttgacaacgggcagaacccacagcgtgggtacagcactaatgtggcaagccttcggcaggagctggcagctgtgatctatgaaaccaacgtgctgggcttccgtggcccccggcgcatgaccgtcatcattcctggcatgagtgcggagaacgagagggtccccatccggccccgaaatgctagtgacggcctgctggtgcgctggcagaacaagacgctggagagcctcatagaactgcacaacaagccacctgtctggaacgatgacagtggctcctacaccctcaacttccaaggccgggtcacccaggcctcagtcaagaacttccagattgtccacgctgatgaccccgactatatcgtgctgcagttcggccgcgtggcggaggacgccttcaccctagactaccggtacccgctgtgcgccctgcaggccttcgccatcgccctctccagtttcgacgggaagctggcctgcgagtgaccccagcagcccctcagcgcccccagagcccgtcagcgtgggggaaaggattcagtggaggctggcagggtccctccagcaaagctcccgcggaaaactgctcctgtgtcggggctgacctctcactgcctctcggtgacctccgtcctctccccagcctggcacaggccgaggcaggaggagcccggacggcgggtaggacggagatgaagaacatctggagttggagccgcacatctggtctcggagctcgcctgcgccgctgtgcccccctcctccccgcgccccagtcacttcctgtccgggagcagtagtcattgttgttttaacctcccctctccccgggaccgcgctagggctccgaggagctggggcgggctaggaggagggggtaggtgatgggggacgagggccaggcacccacatccccaataaagccgcgtccttggccaa

SEQ ID NO: 33035 - DNA, 1941 bp, Homo sapiens
gcgataggcaaaggcaccatgcctctgcgggatgaaaccctccgagaggtgtgggcctctgacagtgggcatgaagaagaaagcctgagcccggaggccccgcggcgccccaaacagcgacccgccccggcacagaggctaaggaagaagaggacggaggcccccgaatccccctgccccacgggatccaagccccggaagcccggagaggaggaggaggaagaggaggacgaggaggacgaggaagaggaggcagaggaaaagaaagagaaaatccttctgcctcccaagaagcccctgagagagaagagctccgcagacctgaaggagaggagggccaaggcccagggcccaaggggagacctgggaagccctgaccccccaccgaaacctctgcgtgttaggaataaggaagctccagcaggggaggggaccaagatgagaaagaccaagaagaaagggtctggggaggccgacaaggacccctcagggagcccagccagtgcgaggaagagcccagcagccatgtttctggttggggaaggcagtcctgacaagaaagccctgaagaagaaaggcactcccaaaggcgcgaggaaggaggaagaagaggaggaggaggcagctacggtgataaagaagagcaatcaaaagggcaaagccaaaggaaaaggcaaaaagaaagcgaaggaggagagggccccgtctccccccgtggaggtggacgaaccccgggagtttgtgctccggcctgccccccagggccgcacggtgcgctgccggctgacccgggacaaaaagggcatggatcgaggcatgtatccctcctacttcctgcacctggacacggagaagaaggtgttcctcttggctggcaggaaacgaaaacggagcaagacagccaattacctcatctccatcgaccctaccaatctgtcccgaggaggggagaatttcatcgggaagctgaggtccaacctcctggggaaccgcttcacggtctttgacaacgggcagaacccacagcgtgggtacagcactaatgtggcaagccttcggcaggagctggcagctgtgatctatgaaaccaacgtgctgggcttccgtggcccccggcgcatgaccgtcatcattcctggcatgagtgcggagaacgagagggtccccatccggccccgaaatgctagtgacggcctgctggtgcgctggcagaacaagacgctggagagcctcatagaactgcacaacaagccacctgtctggaacgatgacagtggctcctacaccctcaacttccaaggccgggtcacccaggcctcagtcaagaacttccagattgtccacgctgatgaccccgactatatcgtgctgcagttcggccgcgtggcggaggacgccttcaccctagactaccggtacccgctgtgcgccctgcaggccttcgccatcgccctctccagtttcgacgggaagctggcctgcgagtgaccccagcagcccctcagcgcccccagagcccgtcagcgtgggggaaaggattcagtggaggctggcagggtccctccagcaaagctcccgcggaaaactgctcctgtgtcggggctgacctctcactgcctctcggtgacctccgtcctctccccagcctggcacaggccgaggcaggaggagcccggacggcgggtaggacggagatgaagaacatctggagttggagccgcacatctggtctcggagctcgcctgcgccgctgtgcccccctcctccccgcgccccagtcacttcctgtccgggagcagtagtcattgttgttttaacctcccctctccccgggaccgcgctagggctccgaggagctggggcgggctaggaggagggggtaggtgatgggggacgagggccaggcacccacatccccaataaagccgcgtccttggccaa

SEQ ID NO: 33036 - DNA, 1938 bp, Homo sapiens
gcgataggcaaaggcaccatgcctctgcgggatgaaaccctccgagaggtgtgggcctctgacagtgggcatgaagaagaaagcctgagcccggaggccccgcggcgccccaaacagcgacccgccccggcacagaggctaaggaagaagaggacggaggcccccgaatccccctgccccacgggatccaagccccggaagcccggagaggaggaggaggaagaggaggacgaggaggacgaggaagaggaggcagaggaaaagaaagagaaaatccttctgcctcccaagaagcccctgagagagaagagctccgcagacctgaaggagaggagggccaaggcccagggcccaaggggagacctgggaagccctgaccccccaccgaaacctctgcgtgttaggaataaggaagctccagcaggggaggggaccaagatgagaaagaccaagaagaaagggtctggggaggccgacaaggacccctcagggagcccagccagtgcgaggaagagcccagcagccatgtttctggttggggaaggcagtcctgacaagaaagccctgaagaagaaaggcactcccaaaggcgcgaggaaggaggaagaagaggaggaggaggcagctacggtgataaagaagagcaatcaaaagggcaaagccaaaggaaaaggcaaaaagacccagaaggaggagagggccccgtctccccccgtggaggtggacgaaccccgggagtttgtgctccggcctgccccccagggccgcacggtgcgctgccggctgacccgggacaaaaagggcatggatcgaggcatgtatccctcctacttcctgcacctggacacggagaagaaggtgttcctcttggctggcaggaaacgaaaacggagcaagacagccaattacctcatctccatcgaccctaccaatctgtcccgaggaggggagaatttcatcgggaagctgaggtccaacctcctggggaaccgcttcacggtctttgacaacgggcagaacccacagcgtgggtacagcactaatgtggcaagccttcggcaggagctggcagctgtgatctatgaaaccaacgtgctgggcttccgtggcccccggcgcatgaccgtcatcattcctggcatgagtgcggagaacgagagggtccccatccggccccgaaatgctagtgacggcctgctggtgcgctggcagaacaagacgctggagagcctcatagaactgcacaacaagccacctgtctggaacgatgacagtggctcctacaccctcaacttccaaggccgggtcacccaggcctcagtcaagaacttccagattgtccacgctgatgaccccgactatatcgtgctgcagttcggccgcgtggcggaggacgccttcaccctagactaccggtacccgctgtgcgccctgcaggccttcgccatcgccctctccagtttcgacgggaagctggcctgcgagtgaccccagcagcccctcagcgcccccagagcccgtcagcgtgggggaaaggattcagtggaggctggcagggtccctccagcaaagctcccgcggaaaactgctcctgtgtcggggctgacctctcactgcctctcggtgacctccgtcctctccccagcctggcacaggccgaggcaggaggagcccggacggcgggtaggacggagatgaagaacatctggagttggagccgcacatctggtctcggagctcgcctgcgccgctgtgcccccctcctccccgcgccccagtcacttcctgtccgggagcagtagtcattgttgttttaacctcccctctccccgggaccgcgctagggctccgaggagctggggcgggctaggaggagggggtaggtgatgggggacgagggccaggcacccacatccccaataaagccgcgtccttggc

SEQ ID NO: 33037 - DNA, 1754 bp, Homo sapiens
ggaagtggagagtggagggtcagaagggagtggaccagttcaggtcccagagggaatcctccctccctctgagccgtctttcttctcctccctatttcgcagatatcccgagattaggtccccagcttccaaagagaggatcagaatgtctcaggataatgacacattgatgagagacatcctggggcatgagctcgctgctatgaggctgcagaagctggaacagcagcggcggctgtttgaaaagaagcagcgacagaagcgccaggagctcctcatggttcaggccaatcctgacgcttccccgtggctttggcgctcttgtctgcgggaggagcgccttttaggtgacagaggccttgggaaccctttcctccggaagaaagtgtcagaggcacatctgccctctggcatccacagtgccctgggcaccgtgagctgtggtggagacggcaggggcgagcgcggcctcccgacaccgcggacagaagcagtgttcaggaatctcggtctccagtcccctttcttatcctggctcccagacaattccgatgcagaattggaggaagtctccgtggagaatggttccgtctctcccccaccttttaaacagtctccgagaatccgacgcaagggttggcaagcccaccaacgacctgggacccgtgcagagggtgagagtgactcccaggatatgggagatgcacacaagtcacccaatatgggaccaaaccctggaatggatggtgactgtgtatatgaaaacttggccttccaaaaggaagaagacttggaaaagaagagagaggcctctgagtctacagggacgaactcctcagcagcacacaacgaagagttgtccaaggccctgaaaggcgagggtggcacggacagcgaccatatgaggcacgaagcctccttggcaatccgctccccctgccctgggctggaggaggacatggaagcctacgtgctgcggccagcgctcccgggcaccatgatgcagtgctacctcacccgtgacaagcacggcgtggacaagggcttgttccccctctactacctctacctggagacctctgacagcctgcagcgcttcctcctggctgggcgaaagagaagaaggagcaaaacttctaattacctcatctccctggatcctacacacctatctcgggacggggacaatttcgtgggcaaagtcagatccaatgtcttcagcaccaagttcaccatctttgacaatggggtgaatcctgaccgggagcatttaaccaggaatactgcccggatcagacaggagctgggggctgtgtgttatgagcccaacgtcttaggatacctggggcctcggaaaatgactgtgattctcccaggaaccaacagccagaaccagcgaatcaatgtccagccactaaatgaacaggagtcgctactgagtcgttaccaacgtggggacaaacaagggttgcttttgttgcacaacaaaaccccgtcgtgggacaaggagaacggtgtctacacgctcaatttccatggtcgagtcactcgggcttcggtgaagaacttccaaatcgtggatcccaaacaccaagaacatctggtgctccagttcggccgagtgggcccagacacattcaccatggacttctgctttccatttagcccgctccaggccttcagcatctgcttgtccagtttcaattagaagctggctgttgaataactcaataaaataccatacccttgccagc

SEQ ID NO: 33038 - DNA, 2175 bp, Homo sapiens
acgcggcggcgtgccagcctagccactctagcgacggcggggaagagtgtgtacgtggtgggggcttcctcggtggcgggcatggaggcttcgcgctgccggctcagtcccagcggcgacagtgtcttccatgaagaaatgatgaagatgcgacaggctaagctggattatcagaggctactacttgagaagaggcaaaggaaaaagcgccttgagccatttatggtgcagcccaatccagaagccaggctacgtcgggcaaagccaagggccagtgatgagcagactcccttggtgaactgtcatactccccacagcaatgtcatcttacatggtattgatggtccagctgctgtcctgaaaccagacgaagttcatgctccatcagtaagctcctctgttgtggaagaagatgctgaaaacaccgtggatactgcttccaagccaggacttcaggagcgtctccaaaagcatgatatctctgaaagtgtgaacttcgatgaggagactgatggaatatcccagtcagcatgtttagaaagacccaattctgcatcaagccagaattcaaccgatacaggcacttccggttctgctactgccgcccaaccagctgataacctcctgggagacatagacgacctggaggactttgtgtatagtcctgcccctcaaggtgtcacagtaagatgtcggataatccgggataaaaggggaatggatcggggtctcttccccacctactatatgtacttggaaaaagaagaaaatcagaagatatttcttcttgcagctagaaagcggaaaaagagcaaaacagccaactaccttatctccattgatccagttgatttatctcgtgaaggagaaagttatgtcggcaagcttagatccaacctcatggggaccaagtttacagtttatgaccgtggcatctgccccatgaagggccggggtttggtaggagcggcccacacccggcaggagctggctgccatctcctatgaaacaaacgtacttggatttaaaggtcctaggaaaatgtctgtgatcattcctggaatgacactgaatcataagcagatcccctatcagccacaaaacaaccatgacagtttgctctcaaggtggcagaacagaactatggaaaatctggttgagctgcacaacaaggcccccgtctggaacagtgacactcagtcctatgtcctcaacttccgtggccgggtcactcaggcgtctgtgaagaacttccagatagtccacaaaaatgaccctgattatatagtcatgcagtttggacgtgtggcagatgacgtgttcacactggattacaactacccactttgtgcagtacaggcctttggcatcggtctttctagctttgacagtaagctggcgtgtgaatgagagaacagtcaggcagggagcccttctccccacagagctttcaggagcagacagtggcctccccttcccctccctgccccaggacttaaagagcaatagtttgccccttttggaatgatctctgaatatataaaacacacacacaaagagcaatagtttgccccttttggaacgacccctgaatatataaaacacacacacgaagagcaatagtttgccccttttggaacgacccctgaatatataaaacacacacacaccccgcgcactctcactccttttccaggtttcatagacttggtgagggatcacagcttagcatgggtgagagatgatttaaagcacagggagattcttgtcacattggggtctccaaagctagaatgggatttcatgtgcttggaaacttgcagtagaatcagggactgacatcgcagttcctctcctctcttcattccctcacagcagattggccggcaccaatcttagtcaagagtggctgtgatcacatttgtgatcaattatgtgagaattttatataattgtcttcatttcaattaaggctgaaagcataaactctagaggtgactcagtcaggactgacagtaatgtgataattgccttcattttcaacccaggagtgcctctcacagctatatgactacggatccattagtgaggagcgacacacacacctgtaggcatcctgtgcaaacactttgtcattatcaagagagatggcagtattgaccatttagtttagtt

SEQ ID NO: 33039 - DNA, 3076 bp, Homo sapiens
gcgacggcggggaagagtgtgtacgtggtgggggcttcctcggtggcgggcatggaggcttcgcgctgccggctcagtcccagcggcgacagtgtcttccatgaagaaatgatgaagatgcgacaggctaagctggattatcagaggctactacttgagaagaggcaaaggaaaaagcgccttgagccatttatggtgcagcccaatccagaagccaggctacgtcgggcaaagccaagggccagtgatgagcagactcccttggtgaactgtcatactccccacagcaatgtcatcttacatggtattgatggtccagctgctgtcctgaaaccagacgaagttcatgctccatcagtaagctcctctgttgtggaagaagatgctgaaaacaccgtggatactgcttccaagccaggacttcaggagcgtctccaaaagcatgatatctctgaaagtgtgaacttcgatgaggagactgatggaatatcccagtcagcatgtttagaaagacccaattctgcatcaagccagaattcaaccgatacaggcacttccggttctgctactgccgcccaaccagctgataacctcctgggagacatagacgacctggaggactttgtgtatagtcctgcccctcaaggtgtcacagtaagatgtcggataatccgggataaaaggggaatggatcggggtctcttccccacctactatatgtacttggaaaaagaagaaaatcagaagatatttcttcttgcagctagaaagcggaaaaagagcaaaacagccaactaccttatctccattgatccagttgatttatctcgtgaaggagaaagttatgtcggcaagcttagatccaacctcatggggaccaagtttacagtttatgaccgtggcatctgccccatgaagggccggggtttggtaggagcggcccacacccggcaggagctggctgccatctcctatgaaacaaacgtacttggatttaaaggtcctaggaaaatgtctgtgatcattcctggaatgacactgaatcataagcagatcccctatcagccacaaaacaaccatgacagtttgctctcaaggtggcagaacagaactatggaaaatctggttgagctgcacaacaaggcccccgtctggaacagtgacactcagtcctatgtcctcaacttccgtggccgggtcactcaggcgtctgtgaagaacttccagatagtccacaaaaatgaccctgattatatagtcatgcagtttggacgtgtggcagatgacgtgttcacactggattacaactacccactttgtgcagtacaggcctttggcatcggtctttctagctttgacagtaagctggcgtgtgaatgagagaacagtcaggcagggagcccttctccccacagagctttcaggagcagacagtggcctccccttcccctccctgccccaggacttaaagagcaatagtttgccccttttggaatgatctctgaatatataaaacacacacacaaagagcaatagtttgccccttttggaacgacccctgaatatataaaacacacacacgaagagcaatagtttgccccttttggaacgacccctgaatatataaaacacacacgaagagcaatagtttgccccttttggaacgacccctgaatatataaaacacacacacgaagagcaatagtttgccccttttggaacgacccctgaatatataaaacacacacacaccccgcgcactctcactccttttccaggtttcatagacttggtgagggatcacagcttagcatgggtgagagatgatttaaagcacagggagattcttgtcacattggggtctccaaagctagaatgggatttcatgtgcttggaaacttgcagtagaatcagggactgacatcgcagttcctctcctctcttcattccctcacagcagattggccggcaccaatcttagtcaagagtggctgtgatcacatttgtgatcaattatgtgagaattttatataattgtcttcatttcaattaaggctgaaagcataaactctagaggtgactcagtcaggactgacagtaatgtgataattgccttcattttcaacccaggagtgcctctcacagctatatgactacggatccattagtgaggagcgacacacacacctgtaggcatcctgtgcaaacactttgtcattatcaagagagatggcagtattgaccatttagtttagttaaaaaaaaaaaaaaaaaggtggcaggagaggctttggggaggatcagccagcagacatgagcactgctggcccgtgtggcagagctgtggactttcttctcggctccctcaaccctggctcaggcacagaaggtgttttgctacgtttttttgattattacacccctccacgtattatgtgactcttacaccagttcacccttcccagaatgtatccaaaccttgagaatgcaggagctctgtgagctccaccgtcagcaccattcagctgcatcccttgtgcacagaactgtttgccagcgttgggtgggacacccgtggcggctgctccctcagacctcccttctgtggactgacctctcacctccgcctgttgttcctgcaccacatcagataagcatgtgaaggagggccaactggcagctgcgggacccttggcttgtcccccaccgacaagtcccacctgctgggtgaggacgagactgtttccatctcaggcatgtatcccaccaagtgcctccctcacagccatgcccagaagcctcacacctcgtcaccaccaccaccccccaccccatcctgaggcactgcctggcagataaccctggttggccacagaagctattaatacacgacagcatgtggggaaggacttatggtgggccaggtggacctcatcctgcttcttcctccctctggtttaaagagatatataaactaatttcacataatttgtgtgtgcaggtgattggtttttacataagtcctatttataccttttatatgttacagaaataaaagttaatttatataaaaatg

SEQ ID NO: 33040 - DNA, 995 bp, Homo sapiens
attccgggctcgaaggctgtgcggtctgccaggagctgcggccccgtccggcccgggctgtgtcttccatgaagaaatgatgaagatgcgacaggctaagctggattatcagaggctactacttgagaagaggcaaaggaaaaagcgccttgagccatttatggtgcagcccaatccagaagccaggctacgtcgggcaaagccaagggccagtgatgagcagactcccttggtgaactgtcatactccccacagcaatgtcatcttacatggtattgatggtccagctgctgtcctgaaaccagacgaagttcatgctccatcagtaagctcctctgttgtggaagaagatgctgaaaacaccgtggatactgcttccaagccaggacttcaggagcgtctccaaaagcatgatatctctgaaagtgtgaacttcgatgaggagactgatggaatatcccagtcagcatgtttagaaagacccaattctgcatcaagccagaattcaaccttttcctcattctgtcagaagactgaagacacgggatacaggcacttccggttctgctactgccgcccaaccagctgataacctcctgggagacatagacgacctggaggactttgtgtatagtcctgcccctcaaggtgtcacagtaagatgtcggataatccgggataaaaggggaatggatcggggtctcttccccacctactatatgtacttggaaaaagaagaaaatcagaagatatttcttcttgcagctagaaagcggaaaaagagcaaaacagccaactaccttatctccattgatccagttgatttatctcgtgaaggagaaagttatgtcggcaagcttagatccaacctcatggggaccaagtttacagtttatgaccgtggcatctgccccatgaagggccggggtttggtaggagcggcccacacccggcaggagctggctgccatctcctatgaaacaaacgtacttgga

SEQ ID NO: 33041 - DNA, 1373 bp, Homo sapiens
actctagcgacggcggggaagagtgtgtacgtggtgggggcttcctcggtggcgggcatggaggcttcgcgctgccggctcagtcccagcggcgacagtgtcttccatgaagaaatgatgaagatgcgacaggctaagctggattatcaggtattgatggtccagctgctgtcctgaaaccagacgaagttcatgctccatcagtaagctcctctgttgtggaagaagatgctgaaaacaccgtggatactgcttccaagccaggacttcaggagcgtctccaaaagcatggatacaggcacttccggttctgctactgccgcccaaccagctgataacctcctgggagacatagacgacctggaggactttgtgtatagtcctgcccctcaaggtgtcacagtaagatgtcggataatccgggataaaaggggaatggatcggggtctcttccccacctactatatgtacttggaaaaagaagaaaatcagaagatatttcttcttgcagctagaaagcggaaaaagagcaaaacagccaactaccttatctccattgatccagttgatttatctcgtgaaggagaaagttatgtcggcaagcttagatccaacctcatggggaccaagtttacagtttatgaccgtggcatctgccccatgaagggccggggtttggtaggagcggcccacacccggcaggagctggctgccatctcctataaccatgacagtttgctctcaaggtggcagaacagaactatggaaaatctggttgagctgcacaacaaggcccccgtctggaacagtgacactcagtcctatgtcctcaacttccgtggccgggtcactcaggcgtctgtgaagaacttccagatagtccacaaaaatgaccctgattatatagtcatgcagtttggacgtgtggcagatgacgtgttcacactggattacaactacccactttgtgcagtacaggcctttggcatcggtctttctagctttgacagtaagctggcgtgtgaatgagagaacagtcaggcagggagcccttctccccacagagctttcaggagcagacagtggcctccccttcccctccctgccccaggacttaaagagcaatagtttgccccttttggaatgatctctgaatatataaaacacacacacaaagagcaatagtttgccccttttggaacgacccctgaatatataaaacacacacacgaagagcaatagtttgccccttttggaacgacccctgaatatataaaacacacacgaagagcaatagtttgccccttttggaacgacccctgaatatataaaacacacacacgaagagcaatagtttgccccttttggaacga

SEQ ID NO: 33042 - DNA, 1951 bp, Homo sapiens
ggaagagtgtgtacgtggtgggggcttcctcggtggcgggcatggaggcttcgcgctgccggctcagtcccagcggcgacagtgtcttccatgaagaaatgatgaagatgcgacaggctaagctggattatcagaggctactacttgagaagaggcaaaggaaaaagcgccttgagccatttatggtgcagcccaatccagaagccaggctacgtcgggcaaagccaagggccagtgatgagcagactcccttggtgaactgtcatactccccacagcaatgtcatcttacatggtattgatggtccagctgctgtcctgaaaccagacgaagttcatgctccatcagtaagctcctctgttgtggaagaagatgctgaaaacaccgtggatactgcttccaagccaggacttcaggagcgtctccaaaagcatgatatctctgaaagtgtgaacttcgatgaggagactgatggaatatcccagtcagcatgtttagaaagacccaattctgcatcaagccagaattcaaccgatacaggcacttccggttctgctactgccgcccaaccagctgataacctcctgggagacatagacgacctggaggactttgtgtatagtcctgcccctcaaggtgtcacagtaagatgtcggataatccgggataaaaggggaatggatcggggtctcttccccacctactatatgtacttggaaaaagaagaaaatcagaagatatttcttcttgcagctagaaagcggaaaaagagcaaaacagccaactaccttatctccattgatccagttgatttatctcgtgaaggagaaagttatgtcggcaagcttagatccaacctcatggggaccaagtttacagtttatgaccgtggcatctgccccatgaagggccggggtttggtaggagcggcccacacccggcaggagctggctgccatctcctatgaaacaaacgtacttggatttaaaggtcctaggaaaatgtctgtgatcattcctggaatgacactgaatcataagcagatcccctatcagccacaaaacaaccatgacagtttgctctcaaggtggcagaacagaactatggaaaatctggttgagctgcacaacaaggcccccgtctggaacagtgacactcagtcctatgtcctcaacttccgtggccgggtcactcaggcgtctgtgaagaacttccagatagtccacaaaaatgaccctgattatatagtcatgcagtttggacgtgtggcagatgacgtgttcacactggattacaactacccactttgtgcagtacaggcctttggcatcggtctttctagctttgacaaatgtatccaaaccttgagaatgcaggagctctgtgagctccaccgtcagcaccattcagctgcatcccttgtgcacagaactgtttgccagcgttgggtgggacacccgtggcggctgctccctcagacctcccttctgtggactgacctctcacctccgcctgttgttcctgcaccacatcagataagcatgtgaaggagggccaactggcagctgcgggacccttggcttgtcccccaccgacaagtcccacctgctgggtgaggacgagactgtttccatctcaggcatgtatcccaccaagtgcctccctcacagccatgcccagaagcctcacacctcgtcaccaccaccaccccccaccccatcctgaggcactgcctggcagataaccctggttggccacagaagctattaatacacgacagcatgtggggaaggacttatggtgggccaggtggacctcatcctgcttcttcctccctctggtttaaagagatatataaactaatttcacataatttgtgtgtgcaggtgattggtttttacataagtcctatttataccttttatatgttacagaaataaaagttaattta

SEQ ID NO: 33043 - DNA, 3876 bp, Homo sapiens
tagcgggcgcctccttttcatccctcatccttcatccctggctttcgcgctctagcggagtgggatctgcgaacacgtgaggcgggggcgcggtccccaggctgccgagatggccctgagcgacgaaccggccgcgggcggccccgaggaggaggcggaggacgagacactggcctttggcgcggcgctggaagcgttcggcgagagcgcggagacccgggcgctgctgggccgcctgcgggaggtgcacggcggcggcgcggagcgcgaggtggccctggagcggttccgcgaatggatgatgaacttgttgttggacatagtgcaagatcagacatctccagcttcccttgtacatctggcttttaaatttctttacatcatcaccaaggttcgaggctataaaacatttcttcgtttatttcctcatgaagttgccgatgtagagcctgttttagatttggtcacaattcagaatcccaaggaccatgaagcttgggaaacccgctacatgcttttgctctggctctccgtgacctgcctgatcccttttgatttttctcgccttgacgggaacctcctcacccagcctgggcaagcacgaatgtccataatggaccgtattctccaaatagcagagtcctacttgattgtcagtgacaaggcccgagatgcagctgctgtccttgtgtccagatttatcacacgtcctgatgtcaagcaaagcaagatggctgagttcctggactggagcctgtgcaatctggcccgttcctccttccagaccatgcagggggtcatcaccatggatgggacgctgcaggccctggcacaaatatttaaacatggaaaacgtgaagactgtttgccctatgctgccactgtcctcaggtgcctcgatggctgcagactccctgagagcaaccagaccctgctgcggaagctgggggtgaagcttgtgcagcgactggggctgacattcctgaagccgaaggtggcagcatggaggtaccagcgtggctgccgatctttggctgcaaatctgcagctcctcactcagggtcagagtgagcagaagccactcatcctgaccgaagatgacgacgaagatgacgacgtcccagagggggtggagcgtgtgatagagcagctgctggtcgggctgaaggacaaggacacggtcgtgcggtggtctgcagccaagggcatcggtaggatggctggcaggcttcccagagccctggcggatgatgtggtcgggtctgtgctggactgcttcagtttccaggagactgacaaggcgtggcatgggggatgtctggcgctggcagagctgggcaggagaggcctgttgctgccgtctcgactcgtggatgttgtcgccgtgatcctgaaggcgctgacctacgacgagaagcggggtgcctgcagcgtgggcaccaacgtcagggacgccgcctgctacgtgtgctgggccttcgcgcgtgcctatgagcctcaggagctgaagccctttgtgactgcaatctcgagtgcactggtgattgctgcggtgtttgaccgagacataaactgcagaagagcagcctctgccgccttccaggagaatgtggggagacagggcactttccctcatggtattgatattttgaccacagctgactattttgccgtcggtaacagatccaactgtttcctggttataagtgtgtttattgccggctttcctgagtacacgcagccaatgatagaccacctggttaccatgaagatcagccactgggatggggtcatccgagagttggctgcgagggcgctgcacaacctggcccagcaggcacccgagttcagcgccacgcaagtcttcccgaggctgctgtccatgacactgagtccagatcttcacatgaggcatgggtcgattctcgcctgcgcagaagttgcttacgccttgtacaaacttgcagcccaagagaacaggcccgtcacggaccatctggacgagcaggcagtgcagggcctgaagcagattcaccagcagctctatgatcgtcagttatacaggggtctgggaggacagctcatgagacaagcagtgtgtgttttaatagaaaagttgtcactttccaaaatgccctttagaggtgacaccgtaattgatggttggcaatggctgataaatgacactttgagacatctccatctcatctcaagtcactcccgccagcagatgaaggatgcagcagtctcggccctggctgctctatgcagtgaatattacatgaaggagccgggggaggcagatcccgcaattcaggaggagctgatcacgcagtacctggctgagcttcggaaccccgaggagatgactcgctgtggcttctcgttggccttgggcgcccttccaggcttccttctgaaaggccggctccagcaggttctcacaggtttaagagcagttacccacacttcccccgaggacgtaagttttgctgagtccaggagagacggcttgaaggccattgcgaggatttgccagactgttggtgtgaaagcaggagccccagacgaagctgtgtgcggagagaatgtttcccagatttactgtgcgctgctgggctgcatggacgactacaccacggacagcagaggggacgtgggcacctgggtccgcaaggccgccatgaccagtctgatggatctgacacttctgctggctcggagccagcctgagctgatcgaggcccatacctgtgagcgcatcatgtgctgtgtggcccagcaggccagtgagaagattgaccgtttccgtgctcacgccgccagcgtgttcctgacgctcctgcactttgacagccctcccatcccccacgtgccccaccgaggagaactggaaaagctgtttcccaggtccgatgtggcctccgtgaactggagtgcaccttcccaggccttcccacgcatcacccagctccttgggctgcccacctaccgctaccacgtcctgctggggctagtcgtgtccctgggcggcttgacggagtcgacgatccggcactccacccagagcctctttgagtacatgaagggcattcagagcgacccgcaggccctgggcagcttcagcgggacccttctgcagatctttgaggacaaccttctgaatgagagggtgtccgtgccgctgctgaagacgctggaccacgtgctcacccacggctgcttcgacatcttcaccacggaggaggaccacccctttgctgtgaagttgcttgcgctctgtaagaaagaaatcaagaattcaaaagatatccagaagctcctgtcaggcatcgcagtgttctgcgagatggtgcagttccccggcgacgtgaggaggcaggccctcctgcagctgtgtctgctcctctgccaccgtttcccgctgatccggaagaccacggccagccaggtgtacgagacattgctcacctacagtgacgtcgtgggcgcggatgtgctggacgaggtggtgactgtgctcagtgacactgcgtgggacgcggagcttgcagtggtgagagagcagcgcaaccgtctgtgtgaccttctgggcgtacccaggccccagctggtgccccagcctggtgcctgctgaagccagtcctggagcccatacctcacccctgcctggtgaggatgtcttgttcctgagggaggccggtgtggaaagcctcgcacagtggtgcctccagctgttgaagggtagcgctggcccttggaggctggcactagctgacagcttttcctctctgcacctgcgctctggtgacttggggtggacgcctctgccttcacttgaacacaaatgtgcttcctataaaatcatgtaccaag

SEQ ID NO: 33044 - DNA, 4036 bp, Homo sapiens
tagcgggcgcctccttttcatccctcatccttcatccctggctttcgcgctctagcggagtgggatctgcgaacacgtgaggcgggggcgcggtccccaggctgccgagatggccctgagcgacgaaccggccgcgggcggccccgaggaggaggcggaggacgagacactggcctttggcgcggcgctggaagcgttcggcgagagcgcggagacccgggcgctgctgggccgcctgcgggaggtgcacggcggcggcgcggagcgcgaggtggccctggagcggttccgcgtaataatggacaaataccaggagcagcctcatctgttggacccgcaccttgaatggatgatgaacttgttgttggacatagtgcaagatcagacatctccagcttcccttgtacatctggcttttaaatttctttacatcatcaccaaggttcgaggctataaaacatttcttcgtttatttcctcatgaagttgccgatgtagagcctgttttagatttggtcacaattcagaatcccaaggaccatgaagcttgggaaacccgctacatgcttttgctctggctctccgtgacctgcctgatcccttttgatttttctcgccttgacgggaacctcctcacccagcctgggcaagcacgaatgtccataatggaccgtattctccaaatagcagagtcctacttgattgtcagtgacaaggcccgagatgcagctgctgtccttgtgtccagatttatcacacgtcctgatgtcaagcaaagcaagatggctgagttcctggactggagcctgtgcaatctggcccgttcctccttccagaccatgcagggggtcatcaccatggatgggacgctgcaggccctggcacaaatatttaaacatggaaaacgtgaagactgtttgccctatgctgccactgtcctcaggtgcctcgatggctgcagactccctgagagcaaccagaccctgctgcggaagctgggggtgaagcttgtgcagcgactggggctgacattcctgaagccgaaggtggcagcatggaggtaccagcgtggctgccgatctttggctgcaaatctgcagctcctcactcagggtcagagtgagcagaagccactcatcctgaccgaagatgacgacgaagatgacgacgtcccagagggggtggagcgtgtgatagagcagctgctggtcgggctgaaggacaaggacacggtcgtgcggtggtctgcagccaagggcatcggtaggatggctggcaggcttcccagagccctggcggatgatgtggtcgggtctgtgctggactgcttcagtttccaggagactgacaaggcgtggcatgggggatgtctggcgctggcagagctgggcaggagaggcctgttgctgccgtctcgactcgtggatgttgtcgccgtgatcctgaaggcgctgacctacgacgagaagcggggtgcctgcagcgtgggcaccaacgtcagggacgccgcctgctacgtgtgctgggccttcgcgcgtgcctatgagcctcaggagctgaagccctttgtgactgcaatctcgagtgcactggtgattgctgcggtgtttgaccgagacataaactgcagaagagcagcctctgccgccttccaggagaatgtggggagacagggcactttccctcatggtattgatattttgaccacagctgactattttgccgtcggtaacagatccaactgtttcctggttataagtgtgtttattgccggctttcctgagtacacgcagccaatgatagaccacctggttaccatgaagatcagccactgggatggggtcatccgagagttggctgcgagggcgctgcacaacctggcccagcaggcacccgagttcagcgccacgcaagtcttcccgaggctgctgtccatgacactgagtccagatcttcacatgaggcatgggtcgattctcgcctgcgcagaagttgcttacgccttgtacaaacttgcagcccaagagaacaggcccgtcacggaccatctggacgagcaggcagtgcagggcctgaagcagattcaccagcagctctatgatcgtcagttatacaggggtctgggaggacagctcatgagacaagcagtgtgtgttttaatagaaaagttgtcactttccaaaatgccctttagaggtgacaccgtaattgatggttggcaatggctgataaatgacactttgagacatctccatctcatctcaagtcactcccgccagcagatgaaggatgcagcagtctcggccctggctgctctatgcagtgaatattacatgaaggagccgggggaggcagatcccgcaattcaggaggagctgatcacgcagtacctggctgagcttcggaaccccgaggagatgactcgctgtggcttctcgttggccttgggcgcccttccaggcttccttctgaaaggccggctccagcaggttctcacaggtttaagagcagttacccacacttcccccgaggacgtaagttttgctgagtccaggagagacggcttgaaggccattgcgaggatttgccagactgttggtgtgaaagcaggagccccagacgaagctgtgtgcggagagaatgtttcccagatttactgtgcgctgctgggctgcatggacgactacaccacggacagcagaggggacgtgggcacctgggtccgcaaggccgccatgaccagtctgatggatctgacacttctgctggctcggagccagcctgagctgatcgaggcccatacctgtgagcgcatcatgtgctgtgtggcccagcaggccagtgagaagattgaccgtttccgtgctcacgccgccagcgtgttcctgacgctcctgcactttgacagccctcccatcccccacgtgccccaccgaggagaactggaaaagctgtttcccaggtccgatgtggcctccgtgaactggagtgcaccttcccaggccttcccacgcatcacccagctccttgggctgcccacctaccgctaccacgtcctgctggggctagtcgtgtccctgggcggcttgacggagtcgacgatccggcactccacccagagcctctttgagtacatgaagggcattcagagcgacccgcaggccctgggcagcttcagcgggacccttctgcagatctttgaggacaaccttctgaatgagagggtgtccgtgccgctgctgaagacgctggaccacgtgctcacccacggctgcttcgacatcttcaccacggaggaggaccacccctttgctgtgaagttgcttgcgctctgtaagaaagaaatcaagaattcaaaagatatccagaagctcctgtcaggcatcgcagttgactttccaagtgcgacactcgtgtgtgtaggcacagtgcagatgtacgcacacacacacctccggcttggggccccaggcccgcactgtgctcacggatctgctctgcccaggttctgcgagatggtgcagttccccggcgacgtgaggaggcaggccctcctgcagctgtgtctgctcctctgccaccgtttcccgctgatccggaagaccacggccagccaggtgtacgagacattgctcacctacagtgacgtcgtgggcgcggatgtgctggacgaggtggtgactgtgctcagtgacactgcgtgggacgcggagcttgcagtggtgagagagcagcgcaaccgtctgtgtgaccttctgggcgtaccccccagctggtgccccacctggtgcctgctgaagccagtcctggagcccatacctcacccctgcctggtgaggatgtcttgttcctgagggaggccggtgtggaaagcctcgcacagtggtgcctccagctgttgaagggtagcgctggcccttggaggctggcactagctgacagcttttcctctctgcacctgcgctctggtgacttggggtggacgcctctgccttcacttgaacacaaatgtgcttcctataaaatcatgtaccaag

SEQ ID NO: 33045 - DNA, 4426 bp, Homo sapiens
ggccagcgtcggttgccgccttagcgggcgcctccttttcatccctcatccttcatccctggctttcgcgctctagcggagtgggatctgcgaacacgtgaggcgggggcgcggtccccaggctgccgagatggccctgagcgacgaaccggccgcgggcggccccgaggaggaggcggaggacgagacactggcctttggcgcggcgctggaagcgttcggcgagagcgcggagacccgggcgctgctgggccgcctgcgggaggtgcacggcggcggcgcggagcgcgaggtggccctggagcggttccgcgtaataatggacaaataccaggagcagcctcatctgttggacccgcaccttgaatggatgatgaacttgttgttggacatagtgcaagatcagacatctccagcttcccttgtacatctggcttttaaatttctttacatcatcaccaaggttcgaggctataaaacatttcttcgtttatttcctcatgaagttgccgatgtagagcctgttttagatttggtcacaattcagaatcccaaggaccatgaagcttgggaaacccgctacatgcttttgctctggctctccgtgacctgcctgatcccttttgatttttctcgccttgacgggaacctcctcacccagcctgggcaagcacgaatgtccataatggaccgtattctccaaatagcagagtcctacttgattgtcagtgacaaggcccgagatgcagctgctgtccttgtgtccagatttatcacacgtcctgatgtcaagcaaagcaagatggctgagttcctggactggagcctgtgcaatctggcccgttcctccttccagaccatgcagggggtcatcaccatggatgggacgctgcaggccctggcacaaatatttaaacatggaaaacgtgaagactgtttgccctatgctgccactgtcctcaggtgcctcgatggctgcagactccctgagagcaaccagaccctgctgcggaagctgggggtgaagcttgtgcagcgactggggctgacattcctgaagccgaaggtggcagcatggaggtaccagcgtggctgccgatctttggctgcaaatctgcagctcctcactcagggtcagagtgagcagaagccactcatcctgaccgaagatgacgacgaagatgacgacgtcccagagggggtggagcgtgtgatagagcagctgctggtcgggctgaaggacaaggacacggtcgtgcggtggtctgcagccaagggcatcggtaggatggctggcaggcttcccagagccctggcggatgatgtggtcgggtctgtgctggactgcttcagtttccaggagactgacaaggcgtggcatgggggatgtctggcgctggcagagctgggcaggagaggcctgttgctgccgtctcgactcgtggatgttgtcgccgtgatcctgaaggcgctgacctacgacgagaagcggggtgcctgcagcgtgggcaccaacgtcagggacgccgcctgctacgtgtgctgggccttcgcgcgtgcctatgagcctcaggagctgaagccctttgtgactgcaatctcgagtgcactggtgattgctgcggtgtttgaccgagacataaactgcagaagagcagcctctgccgccttccaggagaatgtggggagacagggcactttccctcatggtattgatattttgaccacagctgactattttgccgtcggtaacagatccaactgtttcctggttataagtgtgtttattgccggctttcctgagtacacgcagccaatgatagaccacctggttaccatgaagatcagccactgggatggggtcatccgagagttggctgcgagggcgctgcacaacctggcccagcaggcacccgagttcagcgccacgcaagtcttcccgaggctgctgtccatgacactgagtccagatcttcacatgaggcatgggtcgattctcgcctgcgcagaagttgcttacgccttgtacaaacttgcagcccaagagaacaggcccgtcacggaccatctggacgagcaggcagtgcagggcctgaagcagattcaccagcagctctatgatcgtcagttatacaggggtctgggaggacagctcatgagacaagcagtgtgtgttttaatagaaaagttgtcactttccaaaatgccctttagaggtgacaccgtaattgatggttggcaatggctgataaatgacactttgagacatctccatctcatctcaagtcactcccgccagcagatgaaggatgcagcagtctcggccctggctgctctatgcagtgaatattacatgaaggagccgggggaggcagatcccgcaattcaggaggagctgatcacgcagtacctggctgagcttcggaaccccgaggagatgactcgctgtggcttctcgttggccttgggcgcccttccaggcttccttctgaaaggccggctccagcaggttctcacaggtttaagagcagttacccacacttcccccgaggacgtaagttttgctgagtccaggagagacggcttgaaggccattgcgaggatttgccagactgttggtgtgaaagcaggagccccagacgaagctgtgtgcggagagaatgtttcccagatttactgtgcgctgctgggctgcatggacgactacaccacggacagcagaggggacgtgggcacctgggtccgcaaggccgccatgaccagtctgatggatctgacacttctgctggctcggagccagcctgagctgatcgaggcccatacctgtgagcgcatcatgtgctgtgtggcccagcaggccagtgagaagattgaccgtttccgtgctcacgccgccagcgtgttcctgacgctcctgcactttgacagccctcccatcccccacgtgccccaccgaggagaactggaaaagctgtttcccaggtccgatgtggcctccgtgaactggagtgcaccttcccaggccttcccacgcatcacccagctccttgggctgcccacctaccgctaccacgtcctgctggggctagtcgtgtccctgggcggcttgacggagtcgacgatccggcactccacccagagcctctttgagtacatgaagggcattcagagcgacccgcaggccctgggcagcttcagcgggacccttctgcagatctttgaggacaaccttctgaatgagagggtgtccgtgccgctgctgaagacgctggaccacgtgctcacccacggctgcttcgacatcttcaccacggaggaggaccacccctttgctgtgaagttgcttgcgctctgtaagaaagaaatcaagaattcaaaagatatccagaagctcctgtcaggcatcgcagtgttctgcgagatggtgcagttccccggcgacgtgaggaggcaggccctcctgcagctgtgtctgctcctctgccaccgtttcccgctgatccggaagaccacggccagccaggtgtacgagacattgctcacctacagtgacgtcgtgggcgcggatgtgctggacgaggtggtgactgtgctcagtgacactgcgtgggacgcggagcttgcagtggtgagagagcagcgcaaccgtctgtgtgaccttctgggcgtacccaggccccagctggtgccccagcctggtgcctgctgaagccagtcctggagcccatacctcacccctgcctggtgaggatgtcttgttcctgagggaggccggtgtggaaagcctcgcacagtggtgcctccagctgttgaagggtagcgctggcccttggaggctggcactagctgacagcttttcctctctgcacctgcgctctggtgacttggggtggacgcctctgccttcacttgaacacaaatgtgcttcctataaaatcatgtaccaagaagttcctgccttttgtctctgagcctgatgtgtgtaggggtgatggaaaggctcactgcccaggggtcagccagaggggaggtgggctgcactcctcctgcctggagaccaggcccccttcttgcctggtgctgtccctgctgtgggagacgtctggccacaggcagtgccccacccagtcttggagagagatgaatgttaaatcagaggttcaaatgctagagaactgagaagccctggtggcaggcatggtctggagtgctgggcagatgctgtttctgggcccgtctgcctggtgggggtgctgtcctcccccctgtgcacacgtgagcatcgtgcatgtggcccctctgcagtgcaggagtcactgattgatgggtgtgccgaccagcagcttcacaaatgtctgctgcaaggggaatcgtcagagtccaatgtgtgcctctacagtaatgtcggaaataaataccattcttg

SEQ ID NO: 33046 - DNA, 2203 bp, Homo sapiens
tagcgggcgcctccttttcatccctcatccttcatccctggctttcgcgctctagcggagtgggatctgcgaacacgtgaggcgggggcgcggtccccaggctgccgagatggccctgagcgacgaaccggccgcgggcggccccgaggaggaggcggaggacgagacactggcctttggcgcggcgctggaagcgttcggcgagagcgcggagacccgggcgctgctgggccgcctgcgggaggtgcacggcggcggcgcggagcgcgaggtggccctggagcggttccgcgtaataatggacaaataccaggagcagcctcatctgttggacccgcaccttgaatggatgatgaacttgttgttggacatagtgcaagatcagacatctccagcttcccttgtacatctggcttttaaatttctttacatcatcaccaaggttcgaggctataaaacatttcttcgtttatttcctcatgaagttgccgatgtagagcctgttttagatttggtcacaattcagaatcccaaggaccatgaagcttgggaaacccgctacatgcttttgctctggctctccgtgacctgcctgatcccttttgatttttctcgccttgacgggaacctcctcacccagcctgggcaagcacgaatgtccataatggaccgtattctccaaatagcagagtcctacttgattgtcagtgacaaggcccgagatgcagctgctgtccttgtgtccagatttatcacacgtcctgatgtcaagcaaagcaagatggctgagttcctggactggagcctgtgcaatctggcccgttcctccttccagaccatgcagggggtcatcaccatggatgggacgctgcaggccctggcacaaatatttaaacatggaaaacgtgaagactgtttgccctatgctgccactgtcctcaggtgcctcgatggctgcagactccctgagagcaaccagaccctgctgcggaagctgggggtgaagcttgtgcagcgactggggctgacattcctgaagccgaaggtggcagcatggaggtaccagcgtggctgccgatctttggctgcaaatctgcagctcctcactcagggtcagagtgagcagaagccactcatcctgaccgaagatgacgacgaagatgacgacgtcccagagggggtggagcgtgtgatagagcagctgctggtcgggctgaaggacaaggacacggtcgtgcggtggtctgcagccaagggcatcggtaggatggctggcaggcttcccagagccctggcggatgatgtggtcgggtctgtgctggactgcttcagtttccaggagactgacaaggcgtggcatgggggatgtctggcgctggcagagctgggcaggagaggcctgttgctgccgtctcgactcgtggatgttgtcgccgtgatcctgaaggcgctgacctacgacgagaagcggggtgcctgcagcgtgggcaccaacgtcagggacgccgcctgctacgtgtgctgggccttcgcgcgtgcctatgagcctcaggagctgaagccctttgtgactgcaatctcgagtgcactggtgattgctgcggtgtttgaccgagacataaactgcagaagagcagcctctgccgccttccaggagaatgtggggagacagggcactttccctcatggtattgatattttgaccacagctgactattttgccgtcggtaacagatccaactgtttcctggttataagtgtgtttattgccggctttcctgagtacacgcagccaatgatagaccacctggttaccatgaagatcagccactgggatggggtcatccgagagttggctgcgagggcgctgcacaacctggcccagcaggcacccgagttcagcgccacgcaagtcttcccgaggctgctgtccatgacactgagtccagatcttcacatgaggcatgggtcgattctcgcctgcgcagaagttgcttacgccttgtacaaacttgcagcccaagagaacaggcccgtcacggaccatctggacgagcaggcagtgcagggcctgaagcagattcaccagcagccgtgcatctgcagctggggtctgatgtctcctgaaagtaaagcagaattttgtgtgtgcgtctgtcggatttctctggggagacagtgtgttcatctttctgggctttga

SEQ ID NO: 33047 - DNA, 3717 bp, Homo sapiens
cctcatccttcatccctggctttcgcgctctagcggagtgggatctgcgaacacgtgaggcgggggcgcggtccccaggctgccgagatggccctgagcgacgaaccggccgcgggcggccccgaggaggaggcggaggacgagacactggcctttggcgcggcgctggaagcgttcggcgagagcgcggagacccgggcgctgctgggccgcctgcgggaggtgcacggcggcggcgcggagcgcgaggtggccctggagcggttccgcgtaataatggacaaataccaggagcagcctcatctgttggacccgcaccttgaatggatgatgaacttgttgttggacatagtgcaagatcagacatctccagcttcccttgtacatctggcttttaaatttctttacatcatcaccaaggttcgaggctataaaacatttcttcgtttatttcctcatgaagttgccgatgtagagcctgttttagatttggtcacaattcagaatcccaaggaccatgaagcttgggaaacccgctacatgcttttgctctggctctccgtgacctgcctgatcccttttgatttttctcgccttgacgggaacctcctcacccagcctgggcaagcacgaatgtccataatggaccgtattctccaaatagcagagtcctacttgattgtcagtgacaaggcccgagatgcagctgctgtccttgtgtccagatttatcacacgtcctgatgtcaagcaaagcaagatggctgagttcctggactggagcctgtgcaatctggcccgttcctccttccagaccatgcagggggtcatcaccatggatgggacgctgcaggccctggcacaaatatttaaacatggaaaacgtgaagactgtttgccctatgctgccactgtcctcaggtgcctcgatggctgcagactccctgagagcaaccagaccctgctgcggaagctgggggtgaagcttgtgcagcgactggggctgacattcctgaagccgaaggtggcagcatggaggtaccagcgtggctgccgatctttggctgcaaatctgcagctcctcactcagggtcagagtgagcagaagccactcatcctgaccgaagatgacgacgaagatgacgacgtcccagagggggtggagcgtgtgatagagcagctgctggtcgggctgaaggacaaggacacggtcgtgcggtggtctgcagccaagggcatcggtaggatggctggcaggcttcccagagccctggcggatgatgtggtcgggtctgtgctggactgcttcagtttccaggagactgacaaggcgtggcatgggggatgtctggcgctggcagagctgggcaggagaggcctgttgctgccgtctcgactcgtggatgttgtcgccgtgatcctgaaggcgctgacctacgacgagaagcggggtgcctgcagcgtgggcaccaacgtcagggacgccgcctgctacgtgtgctgggccttcgcgcgtgcctatgagcctcaggagctgaagccctttgtgactgcaatctcgagtgcactggtgattgctgcggtgtttgaccgagacataaactgcagaagagcagcctctgccgccttccaggagaatgtggggagacagggcactttccctcatggtattgatattttgaccacagctgactattttgccgtcggtaacagatccaactgtttcctggttataagtgtgtttattgccggctttcctgagtacacgcagccaatgatagaccacctggttaccatgaagatcagccactgggatggggtcatccgagagttggctgcgagggcgctgcacaacctggcccagcaggcacccgagttcagcgccacgcaagtcttcccgaggctgctgtccatgacactgagtccagatcttcacatgaggcatgggtcgattctcgcctgcgcagaagttgcttacgccttgtacaaacttgcagcccaagagaacaggcccgtcacggaccatctggacgagcaggcagtgcagggcctgaagcagattcaccagcagctctatgatcgtcagttatacaggggtctgggaggacagctcatgagacaagcagtgtgtgttttaatagaaaagttgtcactttccaaaatgccctttagaggtgacaccgtaattgatggttggcaatggctgataaatgactcgctgtggcttctcgttggccttgggcgcccttccaggcttccttctgaaaggccggctccagcaggttctcacaggtttaagagcagttacccacacttcccccgaggacgtaagttttgctgagtccaggagagacggcttgaaggccattgcgaggatttgccagactgttggtgtgaaagcaggagccccagacgaagctgtgtgcggagagaatgtttcccagatttactgtgcgctgctgggctgcatggacgactacaccacggacagcagaggggacgtgggcacctgggtccgcaaggccgccatgaccagtctgatggatctgacacttctgctggctcggagccagcctgagctgatcgaggcccatacctgtgagcgcatcatgtgctgtgtggcccagcaggccagtgagaagattgaccgtttccgtgctcacgccgccagcgtgttcctgacgctcctgcactttgacagccctcccatcccccacgtgccccaccgaggagaactggaaaagctgtttcccaggtccgatgtggcctccgtgaactggagtgcaccttcccaggccttcccacgcatcacccagctccttgggctgcccacctaccgctaccacgtcctgctggggctagtcgtgtccctgggcggcttgacggagtcgacgatccggcactccacccagagcctctttgagtacatgaagggcattcagagcgacccgcaggccctgggcagcttcagcgggacccttctgcagatctttgaggacaaccttctgaatgagagggtgtccgtgccgctgctgaagacgctggaccacgtgctcacccacggctgcttcgacatcttcaccacggaggaggaccacccctttgctgtgaagttgcttgcgctctgtaagaaagaaatcaagaattcaaaagatatccagaagctcctgtcaggcatcgcagtgttctgcgagatggtgcagttccccggcgacgtgaggaggcaggccctcctgcagctgtgtctgctcctctgccaccgtttcccgctgatccggaagaccacggccagccaggtgtacgagacattgctcacctacagtgacgtcgtgggcgcggatgtgctggacgaggtggtgactgtgctcagtgacactgcgtgggacgcggagcttgcagtggtgagagagcagcgcaaccgtctgtgtgaccttctgggcgtacccaggccccagctggtgccccagcctggtgcctgctgaagccagtcctggagcccatacctcacccctgcctggtgaggatgtcttgttcctgagggaggccggtgtggaaagcctcgcacagtggtgcctccagctgttgaagggtagcgctggcccttggaggctggcactagctgacagcttttcctctctgcacctgcgctctggtgacttggggtggacgcctctgccttcacttgaacacaaatgtgcttcctataaaatcatgtacc

SEQ ID NO: 33048 - DNA, 3685 bp, Homo sapiens
tagcgggcgcctccttttcatccctcatccttcatccctggctttcgcgctctagcggagtgggatctgcgaacacgtgaggcgggggcgcggtccccaggctgccgagatggccctgagcgacgaaccggccgcgggcggccccgaggaggaggcggaggacgagacactggcctttggcgcggcgctggaagcgttcggcgagagcgcggagacccgggcgctgctgggccgcctgcgggaggtgcacggcggcggcgcggagcgcgaggtggccctggagcggttccgcgtaataatggacaaataccaggagcagcctcatctgttggacccgcaccttgaatggatgatgaacttgttgttggacatagtgcaagatcagacatctccagcttcccttgtacatctggcttttaaatttctttacatcatcaccaaggttcgaggctataaaacatttcttcgtttatttcctcatgaagttgccgatgtagagcctgttttagatttggtcacaattcagaatcccaaggaccatgaagcttgggaaacccgctacatgcttttgctctggctctccgtgacctgcctgatcccttttgatttttctcgccttgacgggaacctcctcacccagcctgggcaagcacgaatgtccataatggaccgtattctccaaatagcagagtcctacttgattgtcagtgacaaggcccgagatgcagctgctgtccttgtgtccagatttatcacacgtcctgatgtcaagcaaagcaagatggctgagttcctggactggagcctgtgcaatctggcccgttcctccttccagaccatgcagggggtcatcaccatggatgggacgctgcaggccctggcacaaatatttaaacatggaaaacgtgaagactgtttgccctatgctgccactgtcctcaggtgcctcgatggctgcagactccctgagagcaaccagaccctgctgcggaagctgggggtgaagcttgtgcagcgactggggctgacattcctgaagccgaaggtggcagcatggaggtaccagcgtggctgccgatctttggctgcaaatctgcagctcctcactcagggtcagagtgagcagaagccactcatcctgaccgaagatgacgacgaagatgacgacgtcccagagggggtggagcgtgtgatagagcagctgctggtcgggctgaaggacaaggacacggtcgtgcggtggtctgcagccaagggcatcggtaggatggctggcaggcttcccagagccctggcggatgatgtggtcgggtctgtgctggactgcttcagtttccaggagactgacaaggcgtggcatgggggatgtctggcgctggcagagctgggcaggagaggcctgttgctgccgtctcgactcgtggatgttgtcgccgtgatcctgaaggcgctgacctacgacgagaagcggggtgcctgcagcgtgggcaccaacgtcagggacgccgcctgctacgtgtgctgggccttcgcgcgtgcctatgagcctcaggagctgaagccctttgtgactgcaatctcgagtgcactggtgattgctgcggtgtttgaccgagacataaactgcagaagagcagcctctgccgccttccaggagaatgtggggagacagggcactttccctcatggtattgatattttgaccacagctgactattttgccgtcggtaacagatccaactgtttcctggttataagtgtgtttattgccggctttcctgagtacacgcagccaatgatagaccacctggttaccatgaagatcagccactgggatggggtcatccgagagttggctgcgagggcgctgcacaacctggcccagcaggcacccgagttcagcgccacgcaagtcttcccgaggctgctgtccatgacactgagtccagatcttcacatgaggcatgggtcgattctcgcctgcgcagaagttgcttacgccttgtacaaacttgcagcccaagagaacaggcccgtcacggaccatctggacgagcaggcagtgcagggcctgaagcagattcaccagcagctctatgatcgtcagttatacaggggtctgggaggacagctcatgagacaagcagtgtgtgttttaatagaaaagttgtcactttccaaaatgccctttagaggtgacaccgtaattgatggttggcaatggctgataaatgacactttgagacatctccatctcatctcaagtcactcccgccagcagatgaaggatgcagcagtctcggccctggctgctctatgcagtgaatattacatgaaggagccgggggaggcagatcccgcaattcaggaggagctgatcacgcagtacctggctgagcttcggaaccccgaggagatgactcgctgtggcttctcgttggccttgggcgcccttccaggcttccttctgaaaggccggctccagcaggttctcacaggtttaagagcagttacccacacttcccccgaggacgtaagttttgctgagtccaggagagacggcttgaaggccattgcgaggatttgccagactgttggtgtgaaagcaggagccccagacgaagctgtgtgcggagagaatgtttcccagatttactgtgcgctgctgggctgcatggacgactacaccacggacagcagaggggacgtgggcacctgggtccgcaaggccgccatgaccagtctgatggatctgacacttctgctggctcggagccagcctgagctgatcgaggcccatacctgtgagcgcatcatgtgctgtgtggcccagcaggccagtgagaagattgaccgtttccgtgctcacgccgccagcgtgttcctgacgctcctgcactttgacagccctcccatcccccacgtgccccaccgaggagaactggaaaagctgtttcccaggtccgatgtggcctccgtgaactggagtgcaccttcccaggccttcccacgcatcacccagctccttgggctgcccacctaccgctaccacgtcctgctggggctagtcgtgtccctgggcggcttgacggagtcgacgatccggcactccacccagagcctctttgagtacatgaagggcattcagagcgacccgcaggccctgggcagcttcagcgggacccttctgcagatctttgaggacaaccttctgaatgagagggtgtccgtgccgctgctgaagacgctggaccacgtgctcacccacggctgcttcgacatcttcaccacggaggaggaccacccctttgctgtgaagttgcttgcgctctgtaagaaagaaatcaagaattcaaaagatatccagaagctcctgtcaggcatcgcagtgttctgcgagatggtgcagttccccggcgacgtgaggaggcaggccctcctgcagctgtgtctgctcctctgccaccgtttcccgctgatccggaagaccacggccagccaggtgtacgagacattgctcacctacagtgacgtcgtgggcgcggatgtgctggacgaggtggtgactgtgctcagtgacactgcgtgggacgcggagcttgcagtggtgagagagcagcgcaaccgtctgtgtgaccttctgggcgtacccaggccccagctggtgccccagcctggagcttgt

SEQ ID NO: 33049 - DNA, 1966 bp, Homo sapiens
attctcgtctatgctccagcagccgtacctcactccggtggaggcgggacttcctacagcacttccggccagagcctcaagcttcgctgctgggcagttggctggaggggctgctgctgggaacacctggagtctccgcgggcagatctcatattttggattctggatatattataatgagtgacactttgacagcggatgtcattggtcgaagagttgaagttaatggagaacatgcaacagtacgttttgctggtgttgtccctcccgtggcaggaccctggttaggagtagaatgggacaatcccgagagaggaaagcatgatgggagccacgaagggactgtgtattttaaatgcaggcacccgacaggaggatcctttattcgtccgaacaaggtaaattttggaacagactttcttactgcaattaagaaccgctatgtgttagaagatggaccagaggaagatagaaaagagcaaattgttacaattggaaataaacctgtggagactatcggttttgactctattatgaaacagcaaagtcagctgagcaagttgcaagaagtttctctgaggaactgtgcagtaagttgtgctggtgaaaaaggaggagttgctgaagcatgtcctaatatcagaaaggtagatttgtcaaaaaacctgttgtcatcatgggatgaagtgatacacattgctgatcagctcagacacctggaagtccttaatgtcagtgaaaataaactaaaatttccctccggttcagtattaactggaacgctttctgtactgaaggttttagtcctcaatcaaacaggaataacgtgggctgaggtgctgcggtgtgtcgcggggtgcccaggcctggaggaactctaccttgagtctaacaacattttcatttccgaaaggccaacagatgttctccagacagtcaagttattagatctttcctctaatcaattaattgatgaaaatcagctgtatctgatagcccacctgcccaggttagaacaattaatcctctctgacactggaatttcttctctacattttccggatgctggaattgggtgcaaaacgtccatgttcccatccttgaagtacctggtagtaaacgacaatcagatatcacaatggtcgtttttcaatgagctagagaagttaccaagtctacgggctttgtcctgcctaagaaaccccctgaccaaagaggacaaagaagcagagacggcgcgactactcattatcgccagcattggccagctgaagacgctgaacaaatgtgagattctccccgaggagaggcggagagctgagcttgactaccgaaaagcttttggaaatgagtggaaacaggctggtggacataaggatccggaaaaaaacagactcagcgaagaattcctcacagcccatcccagataccagttcctctgcctgaaatatggtgcacctgaagattgggaactcaaaacacagcaaccacttatgctgaaaaaccagctactaacactgaagataaaataccctcatcaacttgatcagaaagtcctggagaaacaactgccgggctccatgacaattcaaaaggtgaagggattgctgtcacgtcttctcaaagttcctgtgtcagaccttctgttgtcctatgaaagtcccaaaaagccgggcagagaaatcgagctggaaaatgacctaaagtcattacagttttattctgtggaaaatggagattgtctattagtgcgatggtgacaaccaactaataaaatttaaagaccacactgcttatcgtgtctggggttcaccggaaataaatgattcactggaacaattctactgtcaaaacaaagggggtttacaacttgtcctaagtataacaagggatgtattttttgttgggaagtgaccatttctaggcttatacataatagcaataataaaggctttgaacctactaa

SEQ ID NO: 33050 - DNA, 1956 bp, Homo sapiens
ctacagcacttccggccagagcctcaagcttcgctgctgggcagttggctggaggggctgctgctgggaacacctggagtctccgcgggcaggtgagcttcagaggttcggggagctttcggaacgagcattcctggccgatctcatattttggattctggatatattataatgagtgacactttgacagcggatgtcattggtcgaagagttgaagttaatggagaacatgcaacagtacgttttgctggtgttgtccctcccgtggcaggaccctggttaggagtagaatgggacaatcccgagagaggaaagcatgatgggagccacgaagggactgtgtattttaaatgcaggcacccgacaggaggatcctttattcgtccgaacaaggtaaattttggaacagactttcttactgcaattaagaaccgctatgtgttagaagatggaccagaggaagatagaaaagagcaaattgttacaattggaaataaacctgtggagactatcggttttgactctattatgaaacagcaaagtcagctgagcaagttgcaagaagtttctctgaggaactgtgcagtaagttgtgctggtgaaaaaggaggagttgctgaagcatgtcctaatatcagaaaggtagatttgtcaaaaaacctgttgtcatcatgggatgaagtgatacacattgctgatcagctcagacacctggaagtccttaatgtcagtgaaaataaactaaaatttccctccggttcagtattaactggaacgctttctgtactgaaggttttagtcctcaatcaaacaggaataacgtgggctgaggtgctgcggtgtgtcgcggggtgcccaggcctggaggaactctaccttgagtctaacaacattttcatttccgaaaggccaacagatgttctccagacagtcaagttattagatctttcctctaatcaattaattgatgaaaatcagctgtatctgatagcccacctgcccaggttagaacaattaatcctctctgacactggaatttcttctctacattttccggatgctggaattgggtgcaaaacgtccatgttcccatccttgaagtacctggtagtaaacgacaatcagatatcacaatggtcgtttttcaatgagctagagaagttaccaagtctacgggctttgtcctgcctaagaaaccccctgaccaaagaggacaaagaagcagagacggcgcgactactcattatcgccagcattggccagctgaagacgctgaacaaatgtgagattctccccgaggagaggcggagagctgagcttgactaccgaaaagcttttggaaatgagtggaaacaggctggtggacataaggatccggaaaaaaacagactcagcgaagaattcctcacagcccatcccagataccagttcctctgcctgaaatatggtgcacctgaagattgggaactcaaaacacagcaaccacttatgctgaaaaaccagctactaacactgaagataaaataccctcatcaacttgatcagaaagtcctggagaaacaactgccgggctccatgacaattcaaaaggtgaagggattgctgtcacgtcttctcaaagttcctgtgtcagaccttctgttgtcctatgaaagtcccaaaaagccgggcagagaaatcgagctggaaaatgacctaaagtcattacagttttattctgtggaaaatggagattgtctattagtgcgatggtgacaaccaactaataaaatttaaagaccacactgcttatcgtgtctggggttcaccggaaataaatgattcactggaacaattctactgtcaaaacaaagggggtttacaacttgtcctaagtataacaagggatgtattttttgttgggaagtgaccatttctaggcttatacataatagcaataataaaggctttgaacct

SEQ ID NO: 33051 - DNA, 1980 bp, Homo sapiens
agagcctcaagcttcgctgctgggcagttggctggaggggctgctgctgggaacacctggagtctccgcgggcagatctcatattttggattctggatatattataatgagtgacactttgacagcggatgtcattggtcgaagagttgaagttaatggagaacatgcaacagtacgttttgctggtgttgtccctcccgtggcaggaccctggttaggagtagaatgggacaatcccgagagaggaaagcatgatgggagccacgaagggactgtgtattttaaatgcaggcacccgacaggaggatcctttattcgtccgaacaaggtaaattttggaacagactttcttactgcaattaagaaccgctatgtgttagaagatggaccagaggaagatagaaaagagcaaattgttacaattggaaataaacctgtggagactatcggttttgactctattatgaaacagcaaagtcagctgagcaagttgcaagaagtttctctgaggaactgtgcagtaagttgtgctggtgaaaaaggaggagttgctgaagcatgtcctaatatcagaaaggtagatttgtcaaaaaacctgttgtcatcatgggatgaagtgatacacattgctgatcagctcagacacctggaagtccttaatgtcagtgaaaataaactaaaatttccctccggttcagtattaactggaacgctttctgtactgaaggttttagtcctcaatcaaacaggaataacgtgggctgaggctcatgcgcagtgtggtggcagcaggcacggtctcgacatgcagaaagacgccagcaagttcgtggatctgtgcgtgctgcagaaatgctccaccagcaactgcatcatcagtgccaaggaccacacatccatgcggatgaacgtggccaaggtgctgcggtgtgtcgcggggtgcccaggcctggaggaactctaccttgagtctaacaacattttcatttccgaaaggccaacagatgttctccagacagtcaagttattagatctttcctctaatcaattaattgatgaaaatcagctgtatctgatagcccacctgcccaggttagaacaattaatcctctctgacactggaatttcttctctacattttccggatgctggaattgggtgcaaaacgtccatgttcccatccttgaagtacctggtagtaaacgacaatcagatatcacaatggtcgtttttcaatgagctagagaagttaccaagtctacgggctttgtcctgcctaagaaaccccctgaccaaagaggacaaagaagcagagacggcgcgactactcattatcgccagcattggccagctgaagacgctgaacaaatgtgagattctccccgaggagaggcggagagctgagcttgactaccgaaaagcttttggaaatgagtggaaacaggctggtggacataaggatccggaaaaaaacagactcagcgaagaattcctcacagcccatcccagataccagttcctctgcctgaaatatggtgcacctgaagattgggaactcaaaacacagcaaccacttatgctgaaaaaccagctactaacactgaagataaaataccctcatcaacttgatcagaaagtcctggagaaacaactgccgggctccatgacaattcaaaaggtgaagggattgctgtcacgtcttctcaaagttcctgtgtcagaccttctgttgtcctatgaaagtcccaaaaagccgggcagagaaatcgagctggaaaatgacctaaagtcattacagttttattctgtggaaaatggagattgtctattagtgcgatggtgacaaccaactaataaaatttaaagaccacactgcttatcgtgtctggggttcaccggaaataaatgattcactggaacaattctactgtcaaaacaaagggggtttacaacttgtcctaagtataacaagggatgtat

SEQ ID NO: 33052 - DNA, 4122 bp, Homo sapiens
ccgggcgggagtagctggtggaccccgttgagctgccgaacttccgggactcccccgcgaccccttcccagcttcccgtccgctccgccgcagcgattgtctcggtgggttgattcggcacaaaccgcccgacccaggggccggtgcgcgtgtggaaggggaagcactcccctcgtggtcgcctggaggtgcgctggaggagggggtgacataaccagggactcgaggtccgccgtgggaatgatccacgaactgctcttggctctgagcgggtaccctgggtccattttcacctggaacaagcggagtggcctgcaggtatcgcaggacttccctttcctccaccccagtgagaccagtgtcctgaatcgactctgccggctcggcacagactatattcgcttcactgagttcattgaacagtacacgggccatgtgcaacagcaggatcaccatccatctcaacagggccaaggtgggttacatggaatctacctgcgggccttctgcacagggctggattctgttttgcagccttatcgccaagcactgcttgatttggaacaagagttcctgggtgatccccatctctccatatcacatgtcaactacttcctagaccagttccagcttctttttccctctgtgatggttgtagtagaacaaattaaaagtcaaaagattcatggttgtcaaatcctggaaacagtctacaaacacagctgtggggggttgcctcctgttcgaagtgcactggaaaaaatcctggccgtttgtcatggggtcatgtataaacagctctcagcctggatgctccatggactcctcttggaccagcatgaagaattctttatcaaacaggggccatcttctggtaatgtcagtgcccagccagaagaggacgaggaggatctgggcattgggggactgacaggaaaacaactgagagaactgcaggacttgcgcctgattgaggaagagaacatgctggcaccatctctgaagcagttttccctacgagtggagattttgccatcctacattccagtgagggttgctgaaaaaatcctatttgttggagaatctgtccagatgtttgagaatcaaaatgtgaacctgactagaaaaggatccattttgaaaaaccaggaagacacttttgctgcagagctgcaccgtctcaagcagcagccactcttcagcttggtggactttgaacaggtggtggatcgcattcgcagcactgtggctgagcatctctggaagttgatggtagaagaatccgatttactgggtcagctgaagatcattaaagacttttaccttctgggacgtggagaactgtttcaggccttcattgacacagctcaacacatgttgaaaacaccacccactgcagtaactgagcatgatgtgaatgtggcctttcaacagtcagcacacaaggtattgctagatgatgacaaccttctccctctgttgcacttgacaatcgagtatcacggaaaggagcacaaagatgctactcaggcaagagaagggccttctcgggaaacttctccccgggaagcccctgcatctggctgggcagccctaggtctttcctacaaagtacagtggccactacatattctcttcaccccagctgtcctggaaaagtacaatgttgtttttaagtacttactgagtgtgcgccgggtgcaagctgagctgcagcactgctgggccctacaaatgcagcgcaagcacctcaagtcgaaccagactgatgcaatcaagtggcgcctaagaaatcacatggcatttttggtggataatcttcagtactatctccaggtagatgtgttggagtctcagttctcccagctgcttcatcagatcaattctacccgagactttgaaagcatccgattggctcatgaccacttcctgagcaatttgctggctcaatcctttatcctattgaaacctgtgtttcactgcctgaatgaaatcctagatctctgtcacagtttttgttcgctggtcagtcagaacctaggcccactggatgagcgtggagccgcccagctgagcattctcgtgaagggctttagccgccagtcttcactcctgttcaagattctctccagtgttcggaatcatcagatcaactcagatttggctcaactactgttacgactagattataacaaatactatacccaggctggtggaactctgggcagtttcgggatgtgaaaatttctggctcataaattgaaataacagccacgttcccaaggttgtaacagaagattcaaaacatcccattctagccacacacaaataaatatctgcggcttagtgataggactctaccttttctcctagaagcagttactgaacatccaggagtacaactccttcccatcattcccatgtggaagggtctctcccatcaaggagaacatgtggcatctctgatcctttacattgagaacatttgttggatatgttcatttattcaatagtcatttattgagcacctactacgtaccttggtactgttcaagctgtgggagatacagcggtaaacaaacaatatagagcagaaagttaaatattttatggttcatatgtgaaaaagtaattatgtttataaatagactaactgctggatgttaccaccaagtaagaaagcaacaggtaagataggctttctctctccctataccaagtaatttatacctacacagattgggcaattctagctaatgaaaatatacttaaaagtatttcttaggccgggcatggtggctcacacctgtaatcccagcactttgggaggccgaggcgggcggatcacctgaagtcaggagtttgagaccagcctgaccaacatgatgaaacctcgattctactaaaaatacaaaaattagccaggtgtggtggcatgtgcctgtaatcccagctactcaggaggctgagacaggagaattgcttgaacctgggaagcagacgctgcagtgagctgagattgtgccattgcattccagcccgggcaacaagagcgaaattccgtctcaaaaaaaaaaaaaaaaaaaaaaaaagtattattctccaagaaaaaggtccttaagaaaaaattgagatcaagttgttagatttttaaatactgaagattgcaggcccaattacccatcttacacaaaccataggggttgaagttatcttaatatggcccagccatcactggtaatcaatattcatatcagtgtaagtaaaaagaaatattcactgaacaacgccctccaaactgaaaaagaatgcagtgttctggcatcaggttatagtcactgcatctggttttcatcactacatattctacacacactgggaagctctgacaacttattccctgctattatcaactaaagatcaccctttctactgctgtctctggagcaggagctggcaaactatggcctgctgtctgtttttgtacagttttactgaaacacagccatgcccatttgtttactcattgtctatggttgctttcatgccctcacagcaaaggcgagtagttgtgatggatcaaatggcccacaaagcctgaaatatttactctttgaccctttacagaaaaaaaccttgttgacccctgctttagagaatgagaagccatgcagggatcagtgatgccagaggaagggaaggaactgcttccagctattgtgacaataataataataataatattgggtctttgactagaacgtgtaacatttccaggtgttctcacttgtgcttcccatgtttatcttacggaaggtcattccatcaagcttatggtcactgtcccttcatggcagttggtcctttcgttctccctttagctctaagagttggggagtacccacaggtgagctgtgatctcagctcagagagagagcatgaggtcttttttaactgtcaggaaacagagctgtgcccaattccactcaacttttggcacaactgttaatctgggccttcacctaccttaaactgagtttctgcaagcatagcattttagacaccctggaataaccttttgggaatgatgccacagaataaagttcactcttaacttttcaa

SEQ ID NO: 33053 - DNA, 5116 bp, Homo sapiens
gggcggtgctgggcgggacgggcgggcgcggggcggcggctggagagctccgctgagcaccgggtcgcgcgcggccgagtcgcggaggcgcctccgctgcagtcgctgcgtctccaagcaacatggctgacaaggccaagcctgccaaagctgccaacaggacgccccccaagtccccgggggacccctcgaaggaccgggcagccaagaggctgtcgctggaatcggagggtgctggtgagggggcagccgcatcccctgagctcagtgccctggaggaggccttccggcgctttgccgtgcacggggacgccagggccaccgggagggagatgcacggcaagaactggtcgaagctgtgcaaggactgccaggtgatcgacggcaggaacgtgaccgtcactgacgtggacatcgtcttcagcaagatcaaagggaagtcttgccggaccatcacctttgagcagttccaggaggcgctggaggagctcgccaagaagcgattcaaagacaagagcagcgaggaggccgttcgcgaggtgcacaggctcatcgagggcaaggcgcccatcatctcaggggtgacgaaagccatctcgtcgcccacagtgtcgaggctcacggacaccaccaagttcacgggctcccacaaggagcgcttcgacccctctggcaagggcaagggcaaggctggccgcgtggatctggtggacgagtcaggctatgtgtccggctacaagcacgcaggcacctacgaccagaaggtgcaagggggcaagtagcccccgctccatgcctcgcggcactgccggtgtccccagagcagggactctgtcacctcgcacttcattacattcctgtactaactggggcagaactcagacgggtgccccagagggggctggggggcggccaggcccaggcctccctcctgcccctcctcctaccggatgcccccagcactcccctctcaaaccaggtttgggccccagttcgctgaccctcctaatacacctgcctcgtcctcagccatttccaaagtgtctcgcggatcacaccacactgggcacgtggtttgcaggtcaaaggggcgttttaaagcagctggctgtcatggcaacaggaggctgtgctgacctcctgagcggcagacaccttccaggagccctgagggtggcaggagctaaccccaaccagcaggcaactaacacggaattggccccacaccggacgtgggaggtgtctgtggggcccgaggcctgtcctgtgtgcagcggacaccacggggccttcctgctttcctgggcagagggcagagtgaggccacctggcgggggtgctgggcgcctggcacatgtgtggggaagccggtcacatggacacacctgtgcacacatgcctacaggccagctctgtgccaagggcaacctaggtaaaacgaaagccgtcaggggcagtgggcggcttcccggctgaccacagtggcttggactgtgagggtagagtaggctcgctttgctttcctgagaagatgcggtggctgcctatgttctcagagcgggtctgggaagattcagaatgtccggtccctgtggtgttgccaggcaagagacacgaagtgccgagacactcctcgcctcaccgcgtgacagagcctctgcccggccctcccgttcgcccgtcctcactagctgcaccctgtttgctcgcagacctcccattgccacagcccaagcaccttcttcaactctcccaaaatggctcagcctaacctctcctggccaatcccccccgccggagagcaggacactagggaggacccccagtcctgcagtgtctgtgggggtttctctgccagcagggggctgagcagagcccatccaggacactccacactgccaggacacacccaggcggcccgcccttgcctgtctgcacctggggagaagccggcgctcctgctccctcctggggaggctgacgggtgtggccacccgctgtcacaatggcacactgccactgtcccttggcacgcacacagccacagccacacgtgtgacctgctgggccgtggttctggagtctacctgcggatgagcctgcggcagtcctggggaaacttttccagagcctgttagcccgtggctacggtcaggctctggccagggcagagggctgcccagggccaggctcacagtacaggagggtggcgaggcccctccctcactggcacgcatgagcaccacccgcctccccgactcccaagagtgcacctgctgcggccacagctccgtggaaggactccccctacctgagcagagcagaagccccagggcggagctcccagccagcatggtccgctgagggctggggggcggtctccgaggcccctcaacagagaagcctccacctgaggatggggaggacctggcaggcagcttccacggcagggctgggaagttcagtgcctggaaataaagagcaaggaaaaatggacctcaggcttcgtggctcctttaggatgtcacctcaccggcctggggaaggcggggggtgcccaagcccagccctgtgcccccgctgaacctggctggaccgcgtgtgaaaggcagaactaacgtgcggaaacatttgaaaacaactctgaatgtgcggttcggaatcacccgatcacagacgagcggtcaccggaatcgcccggtcacagacgagcagtcatcggactcacccgatcacagacgagcggtcaccggaatcgcccgatcacagacgagcggccaccggaatcgcccaatcacagacaagcagtcatcggaatcacccgatcacagacgagcagtcatcggactcacccgatcacagacgagcggtcaccagactcgcccgatcacagacgagcagtcatcggaatcacccgatcacagacgagcagtcatcggactcacccgatcacagacgagcggtcaccagaatcgcccgatcacagacgagcagtcatcggaatcacccgatcacagacgagtggccaccggaatcacccgataacagcccatcacaactccaaagcccttgtgttgaaaaggccgaggacgagtggtcaccaaacagggtggctccccaggtcccgaagcctgagacccggaaggccctggcacccttacaccctcggactcctgccctcctcggcctccctggccccagcgcggctccaccctgggctgcgtctcctggtcacaggctgcgtttctcctttctgtccgtgggcagcccagtccccacagtcacggccaagccacgcagaacgaacatgactccagaggacctcgccctggagctgagcctggcgccgggtcaggacggagggaagggcgggttggggtccgcgggtcctcacaccgcacggcaggcacagaggctcgccaggccctgatccggtctgtggggacgagggacactgaggagaggtgctgggcaccaggacgctgcctcctggtccctggttggcctcagacaagcacggcctcgagaaaagagccaagcgcatcgggagcacaccagaaaccggccctgagcacgagaagagcctccgcccggcccgggcaccacccgacctcgcagggagcaggccctgtcaccgacgggtcacctcgcccacacggccagcaccgactcaccacagcccttcccagacctggctggagtggccggagcggcggggctcatggctcccatcttggcccctggaggtgagctcattcacagaagtggtcccttcactctgagagagaaaatcgtggcgtgcatcccaaaccctaggccacgcctgtgggtttcgtgaatgagatcgaggctgctgtggcaccctgcccgtcctggcctggagcaccctgggatcctggagggagaggccccacgcccccactctccctccacacttccagggttggtgcccacgagttagaggcacgccctcccccagcggccctcaggcttttctcagacatgcgggagccaggagagcacccttctccactcagctccaaagcgaatctttgaaaacacccactcggctcccatctctgtcacctagccaggaggggtagcaaaaataaagtcacgaggacatagtggtcaccactgtcagttacaacttgtctgtggaatccgtaattgcatctgtgtgccgcctccgaacacagaacattgtttggacggcagccccactgcacataacagacccgtgcatcttcctcagtcagtttctgaatattgtgaattcaggcaggtgtgtgttctcttctgcatgtttttatgcactgccaattagcttctactaaccacggttcaacagaaaataaatgtgtatttgtgaataacaaactgcacaacctgcaaaccaggagagagggacaggttctgtcaggggtgacaccaggacacagggacaggttctgtcgggggtgacaccaggacacagggacaggttctgtcatgggtgacacgaggacacagggacaggttctatcatgggtgacaccaggagagagggacaggttctgttgggggtgacaagaggagacagggacaggttctgtcgggggtgacaccaggagagagggacaggttctgtcaggggtgacaccaggagagagggacaggttctgttgggggtgacaccaggacacaggaataggttctgtcgggaggacagtgctgatcgtgtctcagcatcaggaaaggagaaaggcagagggagagcgctgagaagactgttcacgccagagtgcttatttatttttaatttactgctataggataagcaaccaggtagtgttcctaacaattagcgttaccaaaattaaagttcaaattatatgtttaaaatattgtagaagatatatatttatactggactacttttacaccttctaatatcctgtccaagtttgggcgcagatggtggagttgggctggcatcatgtcctgtggccgccccacttgcctgttggtgccactccatcccgggccccagggatgccagctcagggctgaccacagcagccctgcgtgggcatcacctcctaccccagcccccatcctgggctgctgcggccgc

SEQ ID NO: 33054 - DNA, 5180 bp, Homo sapiens
gcgctttcctctccggcacccggcgggcgcccgggcgcggcgccgccggcacccgagaggcgcggtagccggcgcgggcggcgggggccgggccgcggcgggcgcccgggcggggtccgcgctgagccgccttctcggccgcctggtccctgcggcggctgcccggcggcccgggcgcgcggcgcttcgccatgtacaccttcgtggtacgcgatgagaacagcagcgtctacgccgaggtctcccggctgctcctcgccaccggccactggaagaggctgcggcgagacaaccccagattcaacctgatgctgggagagaggaatcggctgcccttcgggagactgggtcacgagcccgggctggtacagttggtgaattactacaggggtgctgacaaactgtgtcgcaaagcttctttagtgaagctaatcaagacaagccctgaactggctgagtcctgcacatggttccctgaatcttatgtgatttatccaaccaatctcaagactccagttgctccagcacagaatggaattcagccaccaatcagtaactcaaggacagatgaaagagaattctttctcgcctcttataacagaaagaaagaggatggagagggcaacgtttggattgcaaagtcatcagccggtgccaaaggtgaaggcattctcatctcctcagaggcttcagagcttctcgatttcatagacaaccagggccaagtgcacgtgatccagaaatatcttgagcaccctctgctgcttgagccaggtcatcgcaagtttgacatccgaagctgggtcttggtggatcatcagtataatatctacctctatagagagggtgtgcttcggactgcttcagaaccatatcatgttgataatttccaagacaaaacctgccatttgaccaatcactgcattcaaaaagagtattcaaagaactacgggaagtatgaagaaggaaatgaaatgttcttcaaggagttcaatcagtacctaacaagtgctttgaacattaccctagaaagtagtatcttactacaaatcaaacatataataaggaactgcctcctgagcgtggagcctgccattagcaccaagcacctcccttaccagagcttccagctcttcggctttgacttcatggtcgatgaggagctgaaggtgtggctcattgaggtcaacggtgcccctgcatgtgctcagaagctctatgcagaactgtgccaaggcatcgtggacatagccatttccagtgtcttcccacccccagatgtggagcaacctcagacccagccagctgccttcatcaagctgtgacagagggcactccctgctgccttggaaaaagcacggggtcctgctccagggaatggtgaaatgactggattgctctttatccagcccacagcaggggaaagaaaggcaactcgcaaagatgagatggaagaaggcacgtgagcagaggaggcagctcccaaagagagggctgctcagggggcttcccagatgtagctctcagcagtgctgttgagacttttgaaaacaactttggtacacaaaggcagctttgtgagcagagctccttcccctctccccgggaacggcagggcactgggacctctggtcggtgcctcccacccactgcagccctagtgccttagctccatgcccggctgcagccccactgctctggactatggattggacgtcagagcatattggaggttgcctgtgtgttccccacccatcccttcggtaacactctgccacactaagctctgtacaagcatgcaccaacagtccttagttttgtgctgtgcactggcctctcggcaaaggtggtttccctcatcaccttcctgatggtgtttggtcagtcacctgtcagggtttgtgcgggttgggccccaaaacagcatatgctgctctaagtctgctctctgcatgttttagaaacaaagtggcaagtctgccctgaacctgtaagcatcaaataagcatgagagagaaaaaaacatgatatattgctttacttaataggttgaatatggtaggtctttgaaaatatgatgattcaattttctcaattttctttgctttaaccaaaattctaaatgcagttttgcctagttccctttttttttctttttttacttttttttaaacgtttgtaaaaacctctttgaggatgaggagtcagtaaaattccactccccaagtggccctgccccagacaaaggttgctttccccctttttgttctttttatgcccccaagcactttctgcagtagctagagggacaggtttccttccaggaaggattcgagttcctgtgcctgtgggtattaggagagtatatatcctgcctgaatggggaagtcttctaaaatgggaaagaagtggtttcatctccacacagtgtcttgtaaatctcaacaaatgtgtactgttagaagtggcttccgcttactggattaactaatactttataggcttttcaggaggccacatcactagcagtagggagaacaagatgtcatttgtgttcagtgtaagctgagtaaacaggcccttcctagagtgtcctggaaatcacagcaacccattgaaaactgccctccccaccagaacgtgctacgttctttcttcatgcctatgtgtgctccattcctcatttctacttggctcaagaaaacatttctgcagtcaggtgagacttttacaaaagaggagaaaatcaatgcctccttgaacatgatgagatgtgagaacttacaatgaaaaaggcaataatgatagaaattatttcttaggtacagcaatagttgataggatgtgagggtgttaccttggggtgaagtggagaaggtcccaggtgaattggctctcatggaaatttggaattacaaaataaacgtcctgggggttacccagaatacagatttaaaagtttgcctgtagagcaaaataaaacagtcagttgtagtcattaatccttgaggcccaacgcagccgatgggttggtgtttgggaaattctgagatgggagtgagatctgatcggatcctgggaagatgtatacccagttagaacgtgtagggttctgggtccctggcaagtctaggtgggcgggtgacagggaaagcatgggcatttttgtattgctgtcacatgctaacagaggtttgtaattatcttttggacccaaattatagagacattcacgagttttctagccctcacagtaacagagctaagaattcagatgtcaggaagtctgtgaatcttgatggattttctgagaaacctgactcaatggcatatataagagggaagtaagacttttaagaaaagaaaaagttatgcctcattcctcatgtggcttccaataagtatcttaggaacttatttcctttttaaaaaatattttttaaatttttaaaatttgattttaaatttcaaataaatttaaataaattttaaataaattttaaataaaattttacagagacgtggtctcactgtgttgcccaggctggattgcagtggctattcgcagttgtaatcatagcacactgcagcctcgaatttctgggcttgagcagtcctcccgtctcagcctcctgagtagctgagactacaggtgcacaccaccaagcctggctttatgtatttatttctgttcatgcggaatgattggttcagaactgttcctttcccttccatgatgtccttgacacagaaggttatgcctggctcccagtcaggcttcatacttttggtccatgtaagtgctacccgttgctgggggaggagtcatggtttatttggaaatgtcagttgcaatcatggttctgtcatttgactgcacagtatcagaggagcctgttaacctctctgtgccttagtttcttagcccatgaaagagatcattgcctgacccagggactacctcaagggcttttgatgaggacaagtgacagtaggaagatgcaagagcctttagtaccaaggttctcaacactgactacatgctggaatgactgtgaagcttttaaaaaatgttagtgcccactcttcccctgtacccccggacagttaaatcagaacctcagacagcaatatgccttgagatgccttgaaccatgcttgagaaggaaggacaaacacattattatcttggaagaattgcataaggcttatgacttaaaaaaaaaaattctttttggaaacacaagcatttctttaaggatgaccggatgttgccgtatgtatttatggcacaagcaggtgttgtctaagcagtttctctgtttgcttgtcatagcagcatttggaaactcaaacatgctttcatttacataaatagtttatgaagctttgacaacaaatgtaaacagacacgaaattataaatctgctaaatatgtattaagggtattaattattgaaagtccctttccccaaaactcaactcctatggcaattatgaactccattttaccaagaacatttaagtgcctcagcatctgtatgatatagtggagcaggtgctgacataggtaccagctgacatgatgtgtcactagctctgtgggatgattgccacatacatggaacacctgggagtgctggaaatgtactgtgatcgaagtgacaaagtgtgttttcattcacagtggaggctacatcaagcaaggggaggtccagccctcttgcaagtgtggtgagaggctctactagcaaagacatgggcaccggagtaggtcccgtgtagcatgcgggtgctgtagagaaaattcagtgacgtacatggctctggttctggacacaaaatctgtactggagaggaaatgactgctgaaataaggcgattgtatgaatatttaaaatgcctggaacactaaagtaaagtaatgatatttcaagtgtttttgtgctctttggttcttgttgtaggtattgactgtcctgggatatcactggtcatttaaattcaccatataattagccgggcatggtggcatgtggtggtggctgaggtgggaggatcgcttgaggctgaggtgtgaggctgcagtgaaccatgttcacaccactgtactctagcttgagcaacagagcaagaccctgtctcaaaagtaaataaataataaagtaaatataaatcca

SEQ ID NO: 33055 - DNA, 1645 bp, Homo sapiens
agtgcagcgcggggcggggcgggccggtgcgcctggcagtcggctgcgtactcctgcgagcgccggagaggggctggaggcggggcgagggcgcggctcgaggcatccctgcagggcgctcctccgagtccctcggcgctctgagcccacagggaagaaggaggggccggcgtcagtgacgtcagcgagaccgaggtgagcgtgggcgttgccagtggtgctctgtcagtgcctatggattatggcagggaaagtaaaatgggtcactgatatcgagaagtcagtgctgatcaataactttgaaaagagaggatgggtccaagtgacagaaaacgaggactggaatttttactggatgagtgtgcaaaccatccgaaatgtgttcagcgttgaagctggatatcggctctcagatgaccaaatagtcaaccattttccaaaccactatgaactgacccggaaggacctgatggtgaagaacatcaaaagatacaggaaggagctggagaaagaagggagtcctctggcagaaaaagatgaaaatggaaaatacctctatctggactttgttccagtcacctatatgctgcccgctgactacaacctgtttgtagaggagttccggaagagcccgtccagcacctggatcatgaagccttgtggcaaggcccagggaaagggcatcttccttatcaacaagctctcacagatcaaaaagtggtcccgggacagcaagacatcttcgtttgtgtctcaatctaataaggaagcctacgtgatctctctctatattaacaacccgttactaattggcgggaggaagttcgacctgcgcttgtacgttctggtgtccacgtaccgtccactgcgctgttacatgtacaagcttgggttttgccggttctgcacagtgaaatacaccccgagtaccagtgagctggacaacatgttcgttcatctcaccaacgtcgccatccagaaacacggggaggactacaaccacatccatgggggcaagtggacagtgagtaacctgcggctctacctggagagcacccgcggcaaggaggtgaccagcaagctgttcgacgagatccactggatcatcgtgcagtccctgaaggctgtggcgccggtgatgaacaatgacaagcactgctttgaatgctatggctacgacatcatcatcgacgacaagctgaagccctggctgatcgaggtgaatgcgtccccgtctctcacgtccagcactgccaatgaccgaatcctcaagtacaacctgattaatgacaccctcaacatcgccgtcccgaatggtgaaatcccagactgcaaatggaacaagtcgccacctaaggaagtcctcggcaattacgagattctgtatgatgaagaattggcccagggtgacggggctgaccgggagctgagaagccgtcagggtcagtctctggggcccagagcaggccgatcgagagactcggggagagcggtcctcaccacctggaagtgagtcccacctggaccttatcaaaactactcactccacctgggcccctgctgaagccctattttgaaatttcccttttgtagagcttttttcctttcctaagccctgtaaataaacgaaggcacttctttggaa

SEQ ID NO: 33056 - DNA, 1686 bp, Homo sapiens
agtgcagcgcggggcggggcgggccggtgcgcctggcagtcggctgcgtactcctgcgagcgccggagaggggctggaggcggggcgagggcgcggctcgaggcatccctgcagggcgctcctccgagtccctcggcgctctgagcccacagggaagaaggaggggccggcgtcagtgacgtcagcgagaccgaggtgagcgtgggcgttgccagtggtgctctgtcagtgcctatggattatggcagggaaagtaaaatgggtcactgatatcgagaagtcagtgctgatcaataactttgaaaagagaggatgggtccaagtgacagaaaacgaggactggaatttttactggatgagtgtgcaaaccatccgaaatgtgttcagcgttgaagctggatatcggctctcagatgaccaaatagtcaaccattttccaaaccactatgaactgacccggaaggacctgatggtgaagaacatcaaaagatacaggaaggagctggagaaagaagggagtcctctggcagaaaaagatgaaaatggaaaatacctctatctggactttgttccagtcacctatatgctgcccgctgactacaacctgtttgtagaggagttccggaagagcccgtccagcacctggatcatgaagccttgtggcaaggcccagggaaagggcatcttccttatcaacaagctctcacagatcaaaaagtggtcccgggacagcaagacatcttcgtttgtgtctcaatctaataaggaagcctacgtgatctctctctatattaacaacccgttactaattggcgggaggaagttcgacctgcgcttgtacgttctggtgtccacgtaccgtccactgcgctgttacatgtacaagcttgggttttgccggttctgcacagtgaaatacaccccgagtaccagtgagctggacaacatgttcgttcatctcaccaacgtcgccatccagaaacacggggaggactacaaccacatccatgggggcaagtggacagtgagtaacctgcggctctacctggagagcacccgcggcaaggaggtgaccagcaagctgttcgacgagatccactggatcatcgtgcagtccctgaaggctgtggcggtgaatgcgtccccgtctctcacgtccagcactgccaatgaccgaatcctcaagtacaacctgattaatgacaccctcaacatcgccgtcccgaatggtgaaatcccagactgcaaatggaacaagtcgccacctaaggaagtcctcggcaattacgagattctgtatgatgaagaattggcccagggtgacggggctgaccgggagctgagaagccgtcagggtcagtctctggggcccagagcaggccgatcgagagactcggggagagcggtcctcaccacctggaagtgagtcccacctggaccttatcaaaactactcactccacctgggcccctgctgaagccctattttgaaatttcccttttgtagagcttttttcctttcctaagccctgtaaataaacgaaggcacttctttggaaggttatggagtctgtttgactagtgctaaaggaaacaattcatgcggatgtataaaactcgctcttttttttttaatttttaacctaagcagaattttcatattaaaaactcacttttttgacagaaa

SEQ ID NO: 33057 - DNA, 421 bp, Homo sapiens
agtgcagcgcggggcggggcgggccggtgcgcctggcagtcggctgcgtactcctgcgagcgccggagaggggctggaggcggggcgagggcgcggctcgaggcatccctgcagggcgctcctccgagtccctcggcgctctgagcccacagggaagaaggaggggccggcgtcagtgacgtcagcgagaccgaggtgagcgtgggcgttgccagtggtgctctgtcagtgcctatggattatggcagggaaagtaaaatgggtcactgatatcgagaagtcagtgctgatcaataactttgaaaagagaggatgggtccaagtgacagaaaacgaggactggaatttttactggctccttgaccttcctgaatttcggtacagatcctgtttaaatgagtttcctgacttcagagtctga

SEQ ID NO: 33058 - DNA, 4124 bp, Homo sapiens
agctgagcgttatgagcgcctgcgcagtggctccgagcgggcggttgcttgttggttgttgtagtaaccggggaagcagccgtcggcggctgccctgagccttcctggggaaggaggagggaggtaggcgcagagcgcggtccacgcctgctcgccccgaaccatgggaagatgagacaggaatctgtgccatccaaattgcttgatccagtgaatctgctaggaaaggtctctgaggcccccgtctgctgactgcatgacaaaccctaaaggaaatgccaatcgtgatggcccgggacctggaggaaacagcatcatcctcagaggatgaggaggtcataagtcaagaggatcatccatgcatcatgtggactggaggctgcaggagaattccagttttggtattccatgccgacgctattcttacaaaggacaacaatattagagtaattggagaacgttatcatttgtcttataagattgtacgaacggacagtcgcctagtacgcagcattctgacagcccatggatttcatgaagttcacccaagcagcactgactataacctaatgtggacaggatcccacctgaagcccttcttactgcgcaccctctctgaagcacaaaaagttaatcactttcccaggtcttatgaacttacccggaaggaccgactgtacaaaaacattattcgaatgcagcatacacatggattcaaggcttttcacatcctcccccagaccttcctcctgccagctgagtacgcggaattttgtaattcatattcgaaggaccggggaccttggatagtaaaaccagtggcatcttcaagggggcggggcgtctacctgatcaacaatccaaaccagatctccctggaagagaacattttggtctcccgttacattaacaaccccctgctcatagatgatttcaagtttgacgtgcgcctctatgtgctcgtgacttcctatgatcctcttgtcatctatctctatgaagaaggattggctaggtttgcaactgtgcgatatgatcaaggagccaagaacattcggaaccagttcatgcatctgacaaactacagtgtcaacaagaaaagtggagattacgtcagttgtgacgatccagaagtggaggattatggaaacaaatggagcatgagtgctatgcttaggtacctgaaacaagaaggcagagatacaaccgcattgatggcccatgtagaagacctgatcattaagactataatctctgctgaactagctattgctactgcctgtaaaacctttgttcctcatcgcagcagttgttttgaactctatggctttgacgtgctcatagattctactctgaagccatggttgttggaagtgaatctctctccttctttggcctgtgatgcgcctctggacctaaagattaaagccagtatgatttcagatatgttcactgttgtaggatttgtgtgccaagatcctgcccagcgggcatcaactcggccaatttatcccacctttgagtcttccaggcgaaaccctttccagaaacctcagcgttgccgtccactctctgccagtgatgcggaaatgaaaaacctcgtgggctcagcccgggagaaagggccagggaagttgggtggttctgtgcttggtctgtcaatggaggagatcaaagttttacgaagggtgaaggaggagaatgatcggcgaggtggatttattcgcatatttcctacatctgagacatgggaaatatatgggtcctacctcgagcataagacctcaatgaactatatgctggcaacacgcctcttccaggacagaatgactgctgatggagcgccagaattgaagatagagagtctgaattcaaaggccaagctgcatgctgcactttacgagaggaagctcctgtctctggaggtgcgaaaacgtagacgacggagtagcagattgagggcaatgaggccaaaatacccagtgattacccaaccagctgaaatgaatgttaaaactgagacagagagtgaagaggaggaagaagtcgcattagataatgaagatgaagaacaggaggcttcccaggaggagtctgcaggatttcttagagaaaatcaagccaaatatacaccctcattgacagctttggtagaaaatacacccaaagaaaattccatgaaagttcgtgaatggaataataaaggtggacactgctgcaaacttgagactcaggagctagagcctaaatttaacctgatgcagattcttcaagataatggcaatcttagcaaaatgcaggcccgaatagcattctctgcctatctccagcatgttcaaattcgcctgatgaaagacagtggcggtcagacgttcagtgccagttgggctgccaaagaggatgaacagatggagctggttgttcgtttcctcaagcgagcatcaaataacctccagcattcactgaggatggtattacccagtcgacgattggcacttctggaacgcagaagaatcctggcccaccagctgggtgactttatcattgtatacaacaaggaaacagaacaaatggctgaaaagaaatcaaagaagaaagttgaggaagaagaggaagatggggtgaatatggaaaactttcaggagttcatcagacaagcaagtgaggctgaactggaggaggtgttgactttttatacccaaaagaacaagtctgctagtgtcttcctggggactcactctaaaatttctaagaacaacaacaattattctgatagtggggcaaaaggtgatcaccctgagactataatggaagaagtgaaaataaagccacctaaacagcaacagacgacagaaattcattctgataaattatctcgatttaccacttcagcagaaaaagaggcaaaattagtttatagcaattcctcctctggtcctactgctactctgcagaaaattcccaacacccatttgtcatctgttacaacctctgacctctctccagggccttgccaccattcttctttatctcaaattccttcagctatccccagcatgcctcaccagccaacaattttactgaacacagtctctgccagtgcttctccctgcctacatcccggggcacagaacatcccaagccctactggcctgccacgctgtcgatcaggaagtcacaccattggtcccttttcttccttccaaagtgctgcacacatctatagccagaaactgtctcgtccctcttcagcaaaggcagcaggatcgtgctatctaaacaagcatcattcaggaatagccaaaacacaaaaagagggagaagatgcttctttatatagcaaacggtacaaccaaagtatggttacagctgaacttcagcggctagctgagaagcaggcagcgagacagtattctccatccagccacatcaacctcctcacccaacaggtaacaaacctgaatttggcaactggcatcataaacagaagcagtgcttcagctcccccaaccctccgacccatcatcagtcctagtggcccgacatggtctacacagtcagacccccaagctcccgagaatcactccagctctcctggaagcaggagcctgcagacagggggatttgcctgggaaggagaagtagaaaacaacgtgtacagccaggctacaggggtggtcccccagcacaagtatcaccccacagcaggcagctatcagcttcaatttgccctgcagcaacttgaacaacaaaaacttcagtcccggcagctcctggaccagagtcgagcccggcaccaggcaatctttggcagccagacactacctaactccaatttatggacaatgaataatggtgcaggttgtagaatttccagtgccacagctagtggccagaagccaaccactctgccacaaaaagtggtaccacctccaagttcttgcgcctccctggttcccaaacccccacccaaccacgaacaagtgctcagaagggcaacatcccagaaagcttccaaagggtcctccgcggaagggcagctgaatggactccagagcagccttaaccctgcagcctttgtgcccatcaccagctctacagttaattctcacacagccctgtga

SEQ ID NO: 33059 - DNA, 4683 bp, Homo sapiens
gggaagcagccgtcggcggctgccctgagccttcctggggaaggaggagggaggtaggcgcagagcgcggtccacgcctgctcgccccgaaccatgggaagatgagacaggaatctgtgccatccaaattgcttgatccagtgaatctgctaggaaaggtctctgaggcccccgtctgctgactgcatgacaaaccctaaaggaaatgccaatcgtgatggcccgggacctggaggaaacagcatcatcctcagaggatgaggaggtcataagtcaagaggatcatccatgcatcatgtggactggaggctgcaggagaattccagttttggtattccatgccgacgctattcttacaaaggacaacaatattagagtaattggagaacgttatcatttgtcttataagattgtacgaacggacagtcgcctagtacgcagcattctgacagcccatggatttcatgaagttcacccaagcagcactgactataacctaatgtggacaggatcccacctgaagcccttcttactgcgcaccctctctgaagcacaaaaagttaatcactttcccaggtcttatgaacttacccggaaggaccgactgtacaaaaacattattcgaatgcagcatacacatggattcaaggcttttcacatcctcccccagaccttcctcctgccagctgagtacgcggaattttgtaattcatattcgaaggaccggggaccttggatagtaaaaccagtggcatcttcaagggggcggggcgtctacctgatcaacaatccaaaccagatctccctggaagagaacattttggtctcccgttacattaacaaccccctgctcatagatgatttcaagtttgacgtgcgcctctatgtgctcgtgacttcctatgatcctcttgtcatctatctctatgaagaaggattggctaggtttgcaactgtgcgatatgatcaaggagccaagaacattcggaaccagttcatgcatctgacaaactacagtgtcaacaagaaaagtggagattacgtcagttgtgacgatccagaagtggaggattatggaaacaaatggagcatgagtgctatgcttaggtacctgaaacaagaaggcagagatacaaccgcattgatggcccatgtagaagacctgatcattaagactataatctctgctgaactagctattgctactgcctgtaaaacctttgttcctcatcgcagcagttgttttgaactctatggctttgacgtgctcatagattctactctgaagccatggttgttggaagtgaatctctctccttctttggcctgtgatgcgcctctggacctaaagattaaagccagtatgatttcagatatgttcactgttgtaggatttgtgtgccaagatcctgcccagcgggcatcaactcggccaatttatcccacctttgagtcttccaggcgaaaccctttccagaaacctcagcgttgccgtccactctctgccagtgatgcggaaatgaaaaacctcgtgggctcagcccgggagaaagggccagggaagttgggtggttctgtgcttggtctgtcaatggaggagatcaaagttttacgaagggtgaaggaggagaatgatcggcgaggtggatttattcgcatatttcctacatctgagacatgggaaatatatgggtcctacctcgagcataagacctcaatgaactatatgctggcaacacgcctcttccaggacagaatgactgctgatggagcgccagaattgaagatagagagtctgaattcaaaggccaagctgcatgctgcactttacgagaggaagctcctgtctctggaggtgcgaaaacgtagacgacggagtagcagattgagggcaatgaggccaaaatacccagtgattacccaaccagctgaaatgaatgttaaaactgagacagagagtgaagaggaggaagaagtcgcattagataatgaagatgaagaacaggaggcttcccaggaggagtctgcaggatttcttagagaaaatcaagccaaatatacaccctcattgacagctttggtagaaaatacacccaaagaaaattccatgaaagttcgtgaatggaataataaaggtggacactgctgcaaacttgagactcaggagctagagcctaaatttaacctgatgcagattcttcaagataatggcaatcttagcaaaatgcaggcccgaatagcattctctgcctatctccagcatgttcaaattcgcctgatgaaagacagtggcggtcagacgttcagtgccagttgggctgccaaagaggatgaacagatggagctggttgttcgtttcctcaagcgagcatcaaataacctccagcattcactgaggatggtattacccagtcgacgattggcacttctggaacgcagaagaatcctggcccaccagctgggtgactttatcattgtatacaacaaggaaacagaacaaatggctgaaaagaaatcaaagaagaaagttgaggaagaagaggaagatggggtgaatatggaaaactttcaggagttcatcagacaagcaagtgaggctgaactggaggaggtgttgactttttatacccaaaagaacaagtctgctagtgtcttcctggggactcactctaaaatttctaagaacaacaacaattattctgatagtggggcaaaaggtgatcaccctgagactataatggaagaagtgaaaataaagccacctaaacagcaacagacgacagaaattcattctgataaattatctcgatttaccacttcagcagaaaaagaggcaaaattagtttatagcaattcctcctctggtcctactgctactctgcagaaaattcccaacacccatttgtcatctgttacaacctctgacctctctccagggccttgccaccattcttctttatctcaaattccttcagctatccccagcatgcctcaccagccaacaattttactgaacacagtctctgccagtgcttctccctgcctacatcccggggcacagaacatcccaagccctactggcctgccacgctgtcgatcaggaagtcacaccattggtcccttttcttccttccaaagtgctgcacacatctatagccagaaactgtctcgtccctcttcagcaaaggcaggatcgtgctatctaaacaagcatcattcaggaatagccaaaacacaaaaagagggagaagatgcttctttatatagcaaacggtacaaccaaagtatggttacagctgaacttcagcggctagctgagaagcaggcagcgagacagtattctccatccagccacatcaacctcctcacccaacaggtaacaaacctgaatttggcaactggcatcataaacagaagcagtgcttcagctcccccaaccctccgacccatcatcagtcctagtggcccgacatggtctacacagtcagacccccaagctcccgagaatcactccagctctcctggaagcaggagcctgcagacagggggatttgcctgggaaggagaagtagaaaacaacgtgtacagccaggctacaggggtggtcccccagcacaagtatcaccccacagcaggcagctatcagcttcaatttgccctgcagcaacttgaacaacaaaaacttcagtcccggcagctcctggaccagagtcgagcccggcaccaggcaatctttggcagccagacactacctaactccaatttatggacaatgaataatggtgcaggttgtagaatttccagtgccacagctagtggccagaagccaaccactctgccacaaaaagtggtaccacctccaagttcttgcgcctccctggttcccaaacccccacccaaccacgaacaagtgctcagaagggcaacatcccagaaagcttccaaagggtcctccgcggaagggcagctgaatggactccagagcagccttaaccctgcagcctttgtgcccatcaccagctctacagatcctgctcacactaaaatatgaaccacaaacacacagagaaacaacctgttcaccactcctgggtgcatgattgagggtgaagcatccaccagcacttcaaggggtccatagtatttttttttttgctgcctcaaagtccccaaagccttcgagcagaagtggcagtagatggttgccaatcagccaatgcagactttcactgggacaacaagaaagcagatcttctgggttttgatggaacttggcagtggggacattcagctgatgcattatataccccgtcagagcacacttgtatcttttaccttccctttgccccatgcccccaaactgcttaggtcttctctgtccctttactgctgctgcacagagatgatataaaagaggctctttggctatttgcattttgcttcctcttcttttccagattacagtatgaagctttattttctttgtacaagcttaaaatttcaacatcatcatccgccaaagttgttcctcccttttcggaggatctagggggaaagaggagcattcatcacaagtttcctagagagaggagacaaatcggtgtgccattgacaacatgagccagggtaaaggcaccctttggaattactgatttcaaagattaataaagtaattctattttt

SEQ ID NO: 33060 - DNA, 2561 bp, Homo sapiens
atgaaagaaatcaaagttttacgaagggtgaaggaggagaatgatcggcgaggtggatttattcgcatatttcctacatctgagacatgggaaatatatgggtcctacctcgagcataagacctcaatgaactatatgctggcaacacgcctcttccaggacaggggaaacccaagaagaagcttattgacaggaagaacacgaatgactgctgatggagcgccagaattgaagatagagagtctgaattcaaaggccaagctgcatgctgcactttacgagaggaagctcctgtctctggaggtgcgaaaacgtagacgacggagtagcagattgagggcaatgaggccaaaatacccagtgattacccaaccagctgaaatgaatgttaaaactgagacagagagtgaagaggaggaagaagtcgcattagataatgaagatgaagaacaggaggcttcccaggaggagtctgcaggatttcttagagaaaatcaagccaaatatacaccctcattgacagctttggtagaaaatacacccaaagaaaattccatgaaagttcgtgaatggaataataaaggtggacactgctgcaaacttgagactcaggagctagagcctaaatttaacctgatgcagattcttcaagataatggcaatcttagcaaaatgcaggcccgaatagcattctctgcctatctccagcatgttcaaattcgcctgatgaaagacagtggcggtcagacgttcagtgccagttgggctgccaaagaggatgaacagatggagctggttgttcgtttcctcaagcgagcatcaaataacctccagcattcactgaggatggtattacccagtcgacgattggcacttctggaacgcagaagaatcctggcccaccagctgggtgactttatcattgtatacaacaaggaaacagaacaaatggctgaaaagaaatcaaagaagaaagttgaggaagaagaggaagatggggtgaatatggaaaactttcaggagttcatcagacaagcaagtgaggctgaactggaggaggtgttgactttttatacccaaaagaacaagtctgctagtgtcttcctggggactcactctaaaatttctaagaacaacaacaattattctgatagtggggcaaaaggtgatcaccctgagactataatggaagaagtgaaaataaagccacctaaacagcaacagacgacagaaattcattctgataaattatctcgatttaccacttcagcagaaaaagaggcaaaattagtttatagcaattcctcctctggtcctactgctactctgcagaaaattcccaacacccatttgtcatctgttacaacctctgacctctctccagggccttgccaccattcttctttatctcaaattccttcagctatccccagcatgcctcaccagccaacaattttactgaacacagtctctgccagtgcttctccctgcctacatcccggggcacagaacatcccaagccctactggcctgccacgctgtcgatcaggaagtcacaccattggtcccttttcttccttccaaagtgctgcacacatctatagccagaaactgtctcgtccctcttcagcaaaggcaggatcgtgctatctaaacaagcatcattcaggaatagccaaaacacaaaaagagggagaagatgcttctttatatagcaaacggtacaaccaaagtatggttacagctgaacttcagcggctagctgagaagcaggcagcgagacagtattctccatccagccacatcaacctcctcacccaacaggtaacaaacctgaatttggcaactggcatcataaacagaagcagtgcttcagctcccccaaccctccgacccatcatcagtcctagtggcccgacatggtctacacagtcagacccccaagctcccgagaatcactccagctctcctggaagcaggagcctgcagacagggggatttgcctgggaaggagaagtagaaaacaacgtgtacagccaggctacaggggtggtcccccagcacaagtatcaccccacagcaggcagctatcagcttcaatttgccctgcagcaacttgaacaacaaaaacttcagtcccggcagctcctggaccagagtcgagcccggcaccaggcaatctttggcagccagacactacctaactccaatttatggacaatgaataatggtgcaggttgtagaatttccagtgccacagctagtggccagaagccaaccactctgccacaaaaagtggtaccacctccaagttcttgcgcctccctggttcccaaacccccacccaaccacgaacaagtgctcagaagggcaacatcccagaaagcttccaatacccgcttcagatcctcctttcaaaactatttgtggtatttcttccaagcagtcagctgaactgaggacgacagcctacaaacaactacatgcatctgaactgtctcttgtaaatgagcttttttcagagccagaatcatactctccaggaaatatggagaaagaaa

SEQ ID NO: 33061 - DNA, 3548 bp, Homo sapiens
agctgagcgttatgagcgcctgcgcagtggctccgagcgggcggttgcttgttggttgttgtagtaaccggggaagcagccgtcggcggctgccctgagccttcctggggaaggaggagggaggtaggcgcagagcgcggtccacgcctgctcgccccgaaccatgggaagatgagacaggaatctgtgccatccaaattgcttgatccagtgaatctgctaggaaaggtctctgaggcccccgtctgctgactgcatgacaaaccctaaaggaaatgccaatcgtgatggcccgggacctggaggaaacagcatcatcctcagaggatgaggaggtcataagtcaagaggatcatccatgcatcatgtggactggaggctgcaggagaattccagttttggtattccatgccgacgctattcttacaaaggacaacaatattagagtaattggagaacgttatcatttgtcttataagattgtacgaacggacagtcgcctagtacgcagcattctgacagcccatggatttcatgaagttcacccaagcagcactgactataacctaatgtggacaggatcccacctgaagcccttcttactgcgcaccctctctgaagcacaaaaagttaatcactttcccaggtcttatgaacttacccggaaggaccgactgtacaaaaacattattcgaatgcagcatacacatggattcaaggcttttcacatcctcccccagaccttcctcctgccagctgagtacgcggaattttgtaattcatattcgaaggaccggggaccttggatagtaaaaccagtggcatcttcaagggggcggggcgtctacctgatcaacaatccaaaccagatctccctggaagagaacattttggtctcccgttacattaacaaccccctgctcatagatgatttcaagtttgacgtgcgcctctatgtgctcgtgacttcctatgatcctcttgtcatctatctctatgaagaaggattggctaggtttgcaactgtgcgatatgatcaaggagccaagaacattcggaaccagttcatgcatctgacaaactacagtgtcaacaagaaaagtggagattacgtcagttgtgacgatccagaagtggaggattatggaaacaaatggagcatgagtgctatgcttaggtacctgaaacaagaaggcagagatacaaccgcattgatggcccatgtagaagacctgatcattaagactataatctctgctgaactagctattgctactgcctgtaaaacctttgttcctcatcgcagcagttgttttgaactctatggctttgacgtgctcatagattctactctgaagccatggttgttggaagtgaatctctctccttctttggcctgtgatgcgcctctggacctaaagattaaagccagtatgatttcagatatgttcactgttgtaggatttgtgtgccaagatcctgcccagcgggcatcaactcggccaatttatcccacctttgagtcttccaggcgaaaccctttccagaaacctcagcgttgccgtccactctctgccagtgatgcggaaatgaaaaacctcgtgggctcagcccgggagaaagggccagggaagttgggtggttctgtgcttggtctgtcaatggaggagatcaaagttttacgaagggtgaaggaggagaatgatcggcgaggtggatttattcgcatatttcctacatctgagacatgggaaatatatgggtcctacctcgagcataagacctcaatgaactatatgctggcaacacgcctcttccaggacagaatgactgctgatggagcgccagaattgaagatagagagtctgaattcaaaggccaagctgcatgctgcactttacgagaggaagctcctgtctctggaggtgcgaaaacgtagacgacggagtagcagattgagggcaatgaggccaaaatacccagtgattacccaaccagctgaaatgaatgttaaaactgagacagagagtgaagaggaggaagaagtcgcattagataatgaagatgaagaacaggaggcttcccaggaggagtctgcaggatttcttagagaaaatcaagccaaatatacaccctcattgacagctttggtagaaaatacacccaaagaaaattccatgaaagttcgtgaatggaataataaaggtggacactgctgcaaacttgagactcaggagctagagcctaaatttaacctgatgcagattcttcaagataatggcaatcttagcaaaatgcaggcccgaatagcattctctgcctatctccagcatgttcaaattcgcctgatgaaagacagtggcggtcagacgttcagtgccagttgggctgccaaagaggatgaacagatggagctggttgttcgtttcctcaagcgagcatcaaataacctccagcattcactgaggatggtattacccagtcgacgattggcacttctggaacgcagaagaatcctggcccaccagctgggtgactttatcattgtatacaacaaggaaacagaacaaatggctgaaaagaaatcaaagaagaaagttgaggaagaagaggaagatggggtgaatatggaaaactttcaggagttcatcagacaagcaagtgaggctgaactggaggaggtgttgactttttatacccaaaagaacaagtctgctagtgtcttcctggggactcactctaaaatttctaagaacaacaacaattattctgatagtggggcaaaaggtgatcaccctgagactataatggaagaagtgaaaataaagccacctaaacagcaacagacgacagaaattcattctgataaattatctcgatttaccacttcagcagaaaaagaggcaaaattagtttatagcaattcctcctctggtcctactgctactctgcagaaaattcccaacacccatttgtcatctgttacaacctctgacctctctccagggccttgccaccattcttctttatctcaaattccttcagctatccccagcatgcctcaccagccaacaattttactgaacacagtctctgccagtgcttctccctgcctacatcccggggcacagaacatcccaagccctactggcctgccacgctgtcgatcaggaagtcacaccattggtcccttttcttccttccaaagtgctgcacacatctatagccagaaactgtctcgtccctcttcagcaaaggcaggatcgtgctatctaaacaagcatcattcaggaatagccaaaacacaaaaagagggagaagatgcttctttatatagcaaacggtacaaccaaagtatggttacagctgaacttcagcggctagctgagaagcaggcagcgagacagtattctccatccagccacactgatccatggaagtatgataggagtataaggatgtgttctccactgaacattttagaacctgaattcaagaaatacttgatgggtatctattcacctcactcctccaaaaaaaaaaaaaag

SEQ ID NO: 33062 - DNA, 2542 bp, Homo sapiens
agtctaagggcacagaatggaaaggttctcattttcctcctccaatgagaattggcaccccaacagcaggccctgggccctcggctgtgatggaggggtgtctcggggtagcagaactaaggaagctctccaccttcagtgcatacttggaggaccacagctacaacgtggagcagatatggagggatattgaggacgtcatcatcaagaccctcatctcggcccaccccatcatcaggcataactaccacacctgcttccccaaccacacactcaacagcgcctgctttgagatcctgggctttgacattttgttggaccacaaactcaaaccctggctgctggaggtcaaccactctccaagcttctccaccgactctcggttggataaagaggtgaaagatggtctgctgtatgacaccttagtcctgatcaacctggaaagctgtgacaagaagaaagtcttggaggaggagagacaacgggggcagttcctgcagcagtgttgttctcgggagatgaggattgaggaagccaagggtttccgggccgtgcagttaaagaaaactgaaacgtatgagaaggaaaactgtggagggttccgactgatttatcccagtctgaattcggagaagtatgagaagtttttccaggacaacaactccctcttccagaatactgttgcttccagggctcgggaggagtatgcccggcaactgatccaggagctgagactaaaacgggagaaaaagcccttccaaatgaagaagaaggtagagatgcagggggaatcggcaggcgagcaagtgagaaagaagggcatgaggggctggcaacagaaacaacagcagaaagacaaggccgccacccaagcctccaaacagtacatccagccattgacattagtatcctacacacctgacttgctcttgagtgtcagaggtgaaaggaaaaatgaaacagacagcagcctcaaccaggaggctcccacggaggaggccagctctgttttccccaagctgacgtctgcgaagcccttcagttctctacccgatctgaggaatatcaatctcagcagctcgaagttggagcccagtaaacccaacttcagcatcaaggaggccaagtctgcctctgcagtgaacgtattcactggcactgtgcacttaacctccgtagaaaccaccccagaatccaccacccaactctcaatctccccaaagtctccgccaaccctggctgtgaccgccagctctgagtacagtggcccagagacggacagggtggtatcctttaaatgcaagaagcagcagacccctccacacttaacccagaagaaaatgttaaaatcttttctgcccacaaaatccaagagcttctgggagagtccgaacacaaactggactttgctaaagagtgacatgaacaagccacatttgatatccgagctactcaccaagcttcaactgagtgggaagctctccttcttcccagctcactacaaccccaagctggggatgaataacctgtcacaaaacccctccctgcctggggagtgccactcccgcagtgacagctctggcgagaagaggcagctggatgtgtcctccctcctcttgcagagtcctcagagctataatgttactctgagggacctgctggtgattgccactccagcccaactggatccaaggccttgtagaagccacgcaagtgctatgagggacccatgtatgcaggatcaagaagcatacagccattgcctgatctctggccaaaaaggatgtgagaggagctagaatcagactggatctctgccacttttcccttcctacctcttaacttgcaggaaacaatgtgtctcttccgacagtgtctccagtgttcacagaatcaactgaagttttgtttgctcatctagatatactggtcttccattagttcctagtagcagcaatggggccaacagccctgcctctgttccctcccagttagcttacagtgctacaggaccatgatttctggggttggattggtgctgccccaggacacactccagttgccgtaccagtggcacttctctgggttcttcacatggcaccatcatccagaatactcccccagataaagcaacttcgggagtagtgtttcagagaaggactcatgatttccaggagtcaaaagccctcagtccaccaacagaactatgccagttggtcttcgtctccaagataaaagatgaggtcagggatgggcatggtgcataactctgagccctgagtgagagaactgaggcagctgcaacttcacaaggtcaaggcccgacctccgcccatccccaccagcccaaagacttgccacctcagtgcccgagcatcctctggtgacctccctcaccagcccaacttaatctcaccagtgaaaacagaggtgaggcgagagtacccagcctgaagatgcttcttctatcagcctgcagaaatgttacactttcccttcaggcatccattaataaaagaaattgccatgcttactgccagga

SEQ ID NO: 33063 - DNA, 3551 bp, Homo sapiens
aattggattcgggagggagggggcatggcagctactgcaggggccaatcgaaggcctagaaggccccgtatgcaaatatgagggccgggcggacccaaagttagggcgagcgcgggttggggttggggctgtctggcagccaatgggagcgttactccttcatccttcgaggagggggccggcaggtgtggttgcaagctggactagcagcccagcggggcgagacgggggagtaggaattgcgggggcctggtatttccccagagcctcctcccaggccagggagatgccacagtgcccgactttggaaagccaggaaggggaaaactccgaagagaagggggacagttccaaagaagatccaaaagaaaccgtcgcgctggcttttgtgagagagaacccaggggcacaaaacggacttcagaatgcccagcagcaaggcaagaagaagaggaagaaaaagagattggtgatcaatctatccagctgccggtatgagagtgtgcgcagggctgcccaacagtacggctttagagagggaggggaagacgatgactggactctctattggacagattactcagtgtcactggagcgggtgatggaaatgaaaagttaccagaagatcaatcacttccccgggatgagtgaaatctgccggaaggacttgctggccaggaacatgagccgcatgttaaagatgttccctaaagatttccgctttttccctaggacctggtgtcttcctgctgactggggagatttgcagacctacagcaggtcaagaaaaaataagacatacatttgtaagccggattcgggctgccaagggaaaggtatattcatcacccggacagtgaaagaaatcaaaccaggggaggatatgatctgtcagctgtatatttcaaagccctttatcattgatgggtttaagtttgacctacggatttatgtactggtgacatcctgtgaccctctcaggatttttgtgtacaatgaaggactggcccgctttgcgacgacctcttactcccgcccttgcacagacaacctggatgatatctgcatgcacctgactaattattccattaataagcacagttcaaatttcagtcgagatgcacactctggcagtaagaggaagctctccaccttcagtgcatacttggaggaccacagctacaacgtggagcagatatggagggatattgaggacgtcatcatcaagaccctcatctcggcccaccccatcatcaggcataactaccacacctgcttccccaaccacacactcaacagcgcctgctttgagatcctgggctttgacattttgttggaccacaaactcaaaccctggctgctggaggtcaaccactctccaagcttctccaccgactctcggttggataaagaggtgaaagatggtctgctgtatgacaccttagtcctgatcaacctggaaagctgtgacaagaagaaagtcttggaggaggagagacaacgggggcagttcctgcagcagtgttgttctcgggagatgaggattgaggaagccaagggtttccgggccgtgcagttaaagaaaactgaaacgtatgagaaggaaaactgtggagggttccgactgatttatcccagtctgaattcggagaagtatgagaagtttttccaggacaacaactccctcttccagaatactgttgcttccagggctcgggaggagtatgcccggcaactgatccaggagctgagactaaaacgggagaaaaagcccttccaaatgaagaagaaggtagagatgcagggggaatcggcaggcgagcaagtgagaaagaagggcatgaggggctggcaacagaaacaacagcagaaagacaaggccgccacccaagcctccaaacagtacatccagccattgacattagtatcctacacacctgacttgctcttgagtgtcagaggtgaaaggaaaaatgaaacagacagcagcctcaaccaggaggctcccacggaggaggccagctctgttttccccaagctgacgtctgcgaagcccttcagttctctacccgatctgaggaatatcaatctcagcagctcgaagttggagcccagtaaacccaacttcagcatcaaggaggccaagtctgcctctgcagtgaacgtattcactggcactgtgcacttaacctccgtagaaaccaccccagaatccaccacccaactctcaatctccccaaagtctccgccaaccctggctgtgaccgccagctctgagtacagtggcccagagacggacagggtggtatcctttaaatgcaagaagcagcagacccctccacacttaacccagaagaaaatgttaaaatcttttctgcccacaaaatccaagagcttctgggagagtccgaacacaaactggactttgctaaagagtgacatgaacaagccacatttgatatccgagctactcaccaagcttcaactgagtgggaagctctccttcttcccagctcactacaaccccaagctggggatgaataacctgtcacaaaacccctccctgcctggggagtgccactcccgcagtgacagctctggcgagaagaggcagctggatgtgtcctccctcctcttgcagagtcctcagagctataatgttactctgagggacctgctggtgattgccactccagcccaactggatccaaggccttgtagaagccacgcaagtgctatgagggacccatgtatgcaggatcaagaagcatacagccattgcctgatctctggccaaaaaggatgtgagaggagctagaatcagactggatctctgccacttttcccttcctacctcttaacttgcaggaaacaatgtgtctcttccgacagtgtctccagtgttcacagaatcaactgaagttttgtttgctcatctagatatactggtcttccattagttcctagtagcagcaatggggccaacagccctgcctctgttccctcccagttagcttacagtgctacaggaccatgatttctggggttggattggtgctgccccaggacacactccagttgccgtaccagtggcacttctctgggttcttcacatggcaccatcatccagaatactcccccagataaagcaacttcgggagtagtgtttcagagaaggactcatgatttccaggagtcaaaagccctcagtccaccaacagaactatgccagttggtcttcgtctccaagataaaagatgaggtcagggatgggcatggtgcataactctgagccctgagtgagagaactgaggcagctgcaacttcacaaggtcaaggcccgacctccgcccatccccaccagcccaaagacttgccacctcagtgcccgagcatcctctggtgacctccctcaccagcccaacttaatctcaccagtgaaaacagaggtgaggcgagagtacccagcctgaagatgcttcttctatcagcctgcagaaatgttacactttcccttcaggcatccattaataaaagaaattgccatgctt

SEQ ID NO: 33064 - DNA, 587 bp, Homo sapiens
gagcgcgggttggggttggggctgtctggcagccaatgggagcgttactccttcatccttcgaggagggggccggcaggtgtggttgcaagctggactagcagcccagcggggcgagacgggggagtaggaattgcgggggcctggtatttccccagagcctcctcccaggccagggagatgccacagtgcccgactttggaaagccaggaaggggaaaactccgaagagaagggggacagttccaaagaagatccaaaagaaaccgtcgcgctggcttttgtgagagagaacccaggggcacaaaacggacttcagaatgcccagcagcaaggcaagaagaagaggaagaaaaagaggatgcctttaaaaaatagcaggaaaagaagatttccttgttttaagaaggcgctgatttgtcctggaaatttagtacgccttcagtatgatagcaccatactgacttatcaggatccaactgcagcttgtgcattccagttcttgtttaatatttcaccatgccttgctccattcagactgattgatgaaggaaagcttgtccactttcttattcatagcttcccttaa

SEQ ID NO: 33065 - DNA, 2548 bp, Homo sapiens
atttttccttagtctaagggcacagaatggaaaggttctcattttcctcctccaatgagaattggcaccccaacagcaggccctgggccctcggctgtgatggaggggtgtctcggggtagcagaactaaggaagctctccaccttcagtgcatacttggaggaccacagctacaacgtggagcagatatggagggatattgaggacgtcatcatcaagaccctcatctcggcccaccccatcatcaggcataactaccacacctgcttccccaaccacacactcaacagcgcctgctttgagatcctgggctttgacattttgttggaccacaaactcaaaccctggctgctggaggtcaaccactctccaagcttctccaccgactctcggttggataaagaggtgaaagatggtctgctgtatgacaccttagtcctgatcaacctggaaagctgtgacaagaagaaagtcttggaggaggagagacaacgggggcagttcctgcagcagtgttgttctcgggagatgaggattgaggaagccaagggtttccgggccgtgcagttaaagaaaactgaaacgtatgagaaggaaaactgtggagggttccgactgatttatcccagtctgaattcggagaagtatgagaagtttttccaggacaacaactccctcttccagaatactgttgcttccagggctcgggaggagtatgcccggcaactgatccaggagctgagactaaaacgggagaaaaagcccttccaaatgaagaagaaggtagagatgcagggggaatcggcaggcgagcaagtgagaaagaagggcatgaggggctggcaacagaaacaacagcagaaagacaaggccgccacccaagcctccaaacagtacatccagccattgacattagtatcctacacacctgacttgctcttgagtgtcagaggtgaaaggaaaaatgaaacagacagcagcctcaaccaggaggctcccacggaggaggccagctctgttttccccaagctgacgtctgcgaagcccttcagttctctacccgatctgaggaatatcaatctcagcagctcgaagttggagcccagtaaacccaacttcagcatcaaggaggccaagtctgcctctgcagtgaacgtattcactggcactgtgcacttaacctccgtagaaaccaccccagaatccaccacccaactctcaatctccccaaagtctccgccaaccctggctgtgaccgccagctctgagtacagtggcccagagacggacagggtggtatcctttaaatgcaagaagcagcagacccctccacacttaacccagaagaaaatgttaaaatcttttctgcccacaaaatccaagagcttctgggagagtccgaacacaaactggactttgctaaagagtgacatgaacaagccacatttgatatccgagctactcaccaagcttcaactgagtgggaagctctccttcttcccagctcactacaaccccaagctggggatgaataacctgtcacaaaacccctccctgcctggggagtgccactcccgcagtgacagctctggcgagaagaggcagctggatgtgtcctccctcctcttgcagagtcctcagagctataatgttactctgagggacctgctggtgattgccactccagcccaactggatccaaggccttgtagaagccacgcaagtgctatgagggacccatgtatgcaggatcaagaagcatacagccattgcctgatctctggccaaaaaggatgtgagaggagctagaatcagactggatctctgccacttttcccttcctacctcttaacttgcaggaaacaatgtgtctcttccgacagtgtctccagtgttcacagaatcaactgaagttttgtttgctcatctagatatactggtcttccattagttcctagtagcagcaatggggccaacagccctgcctctgttccctcccagttagcttacagtgctacaggaccatgatttctggggttggattggtgctgccccaggacacactccagttgccgtaccagtggcacttctctgggttcttcacatggcaccatcatccagaatactcccccagataaagcaacttcgggagtagtgtttcagagaaggactcatgatttccaggagtcaaaagccctcagtccaccaacagaactatgccagttggtcttcgtctccaagataaaagatgaggtcagggatgggcatggtgcataactctgagccctgagtgagagaactgaggcagctgcaacttcacaaggtcaaggcccgacctccgcccatccccaccagcccaaagacttgccacctcagtgcccgagcatcctctggtgacctccctcaccagcccaacttaatctcaccagtgaaaacagaggtgaggcgagagtacccagcctgaagatgcttcttctatcagcctgcagaaatgttacactttcccttcaggcatccattaataaaagaaattgccatgcttactgcc

SEQ ID NO: 33066 - DNA, 3454 bp, Homo sapiens
gagcgcgggttggggttggggctgtctggcagccaatgggagcgttactccttcatccttcgaggagggggccggcaggtgtggttgcaagctggactagcagcccagcggggcgagacgggggagtaggaattgcgggggcctggtatttccccagagcctcctcccaggccagggagatgccacagtgcccgactttggaaagccaggaaggggaaaactccgaagagaagggggacagttccaaagaagatccaaaagaaaccgtcgcgctggcttttgtgagagagaacccaggggcacaaaacggacttcagaatgcccagcagcaaggcaagaagaagaggaagaaaaagagattggtgatcaatctatccagctgccggtatgagagtgtgcgcagggctgcccaacagtacggctttagagagggaggggaagacgatgactggactctctattggacagattactcagtgtcactggagcgggtgatggaaatgaaaagttaccagaagatcaatcacttccccgggatgagtgaaatctgccggaaggacttgctggccaggaacatgagccgcatgttaaagatgttccctaaagatttccgctttttccctaggacctggtgtcttcctgctgactggggagatttgcagacctacagcaggtcaagaaaaaataagacatacatttgtaagccggattcgggctgccaagggaaaggtatattcatcacccggacagtgaaagaaatcaaaccaggggaggatatgatctgtcagctgtatatttcaaagccctttatcattgatgggtttaagtttgacctacggatttatgtactggtgacatcctgtgaccctctcaggatttttgtgtacaatgaaggactggcccgctttgcgacgacctcttactcccgcccttgcacagacaacctggatgatatctgcatgcacctgactaattattccattaataagcacagttcaaatttcagtcgagatgcacactctggcagtaagaggaagctctccaccttcagtgcatacttggaggaccacagctacaacgtggagcagatatggagggatattgaggacgtcatcatcaagaccctcatctcggcccaccccatcatcaggcataactaccacacctgcttccccaaccacacactcaacagcgcctgctttgagatcctgggctttgacattttgttggaccacaaactcaaaccctggctgctggaggtcaaccactctccaagcttctccaccgactctcggttggataaagaggtgaaagatggtctgctgtatgacaccttagtcctgatcaacctggaaagctgtgacaagaagaaagtcttggaggaggagagacaacgggggcagttcctgcagcagtgttgttctcgggagatgaggattgaggaagccaagggtttccgggccgtgcagttaaagaaaactgaaacgtatgagaaggaaaactgtggagggttccgactgatttatcccagtctgaattcggagaagtatgagaagtttttccaggacaacaactccctcttccagaatactgttgcttccagggctcgggaggagtatgcccggcaactgatccaggagctgagactaaaacgggagaaaaagcccttccaaatgaagaagaaggtagagatgcagggggaatcggcaggcgagcaagtgagaaagaagggcatgaggggctggcaacagaaacaacagcagaaagacaaggccgccacccaagcctccaaacagtacatccagccattgacattagtatcctacacacctgacttgctcttgagtgtcagaggtgaaaggaaaaatgaaacagacagcagcctcaaccaggaggctcccacggaggaggccagctctgttttccccaagctgacgtctgcgaagcccttcagttctctacccgatctgaggaatatcaatctcagcagctcgaagttggagcccagtaaacccaacttcagcatcaaggaggccaagtctgcctctgcagtgaacgtattcactggcactgtgcacttaacctccgtagaaaccaccccagaatccaccacccaactctcaatctccccaaagtctccgccaaccctggctgtgaccgccagctctgagtacagtggcccagagacggacagggtggtatcctttaaatgcaagaagcagcagacccctccacacttaacccagaagaaaatgttaaaatcttttctgcccacaaaatccaagagcttctgggagagtccgaacacaaactggactttgctaaagagtgacatgaacaagccacatttgatatccgagctactcaccaagcttcaactgagtgggaagctctccttcttcccagctcactacaaccccaagctggggatgaataacctgtcacaaaacccctccctgcctggggagtgccactcccgcagtgacagctctggcgagaagaggcagctggatgtgtcctccctcctcttgcagagtcctcagagctataatgttactctgagggacctgctggtgattgccactccagcccaactggatccaaggccttgtagaagccacgcaagtgctatgagggacccatgtatgcaggatcaagaagcatacagccattgcctgatctctggccaaaaaggatgtgagaggagctagaatcagactggatctctgccacttttcccttcctacctcttaacttgcaggaaacaatgtgtctcttccgacagtgtctccagtgttcacagaatcaactgaagttttgtttgctcatctagatatactggtcttccattagttcctagtagcagcaatggggccaacagccctgcctctgttccctcccagttagcttacagtgctacaggaccatgatttctggggttggattggtgctgccccaggacacactccagttgccgtaccagtggcacttctctgggttcttcacatggcaccatcatccagaatactcccccagataaagcaacttcgggagtagtgtttcagagaaggactcatgatttccaggagtcaaaagccctcagtccaccaacagaactatgccagttggtcttcgtctccaagataaaagatgaggtcagggatgggcatggtgcataactctgagccctgagtgagagaactgaggcagctgcaacttcacaaggtcaaggcccgacctccgcccatccccaccagcccaaagacttgccacctcagtgcccgagcatcctctggtgacctccctcaccagcccaacttaatctcaccagtgaaaacagaggtgaggcgagagtacccagcctgaagatgcttcttctatcagcctgcagaaatgttacactttcccttcaggcatccattaataaaagaaattgccatgcttactgccagga

SEQ ID NO: 33067 - DNA, 580 bp, Homo sapiens
aaatatgagggccgggcggacccaaagttagggcgagcgcgggttggggttggggctgtctggcagccaatgggagcgttactccttcatccttcgaggagggggccggcaggtgtggttgcaagctggactagcagcccagcggggcgagacgggggagtaggaattgcggaaccactggaggccttcagagggatgcttccagtagggaaatgaggaccaaaagatgaaaaggaggggcctggtatttccccagagcctcctcccaggccagggagatgccacagtgcccgactttggaaagccaggaaggggaaaactccgaagagaagggggacagttccaaagaagatccaaaagaaaccgtcgcgctggcttttgtgagagagaacccaggggcacaaaacggacttcagaatgcccagcagcaaggcaagaagaagaggaagaaaaagagattggtgatcaatctatccagctgccggtatgagagtgtgcgcagggctgcccaacagtacggctttagagagggaggggaagacgatgactggactctctattggacagattactcagtgtc

SEQ ID NO: 33068 - DNA, 1887 bp, Homo sapiens
tcttttctttcgtaagctctctgggcgagggtggtggtatgttttgtgaggtttagcttagccccaaatcctcaagccccgccgccgccgcagtgcgggtgcaggaaccgggccagtactgcgcccagggcgcagcagagcgctggggaggaacaaaggcggcgcctaggcgcctgtgttatccgagagactttcgggggccgcgggcagcccgtctgccgcgaccgaggggtctggggcgtcccggctgggccccgtgtctgtgcgcacggtttcgctgatgctgaggggccactttctgtctcgcgttgttctctggggaccgggagaggaggaggcacccaaaaagagcgggggcgttgggcgagctgggggacgtgggagggggaacgggaacaaagcgcagcctagggttagcgtgggaagaccctccgcggtctttggcgttttggaaagatacccacacattcccgggaaaacatgcgtgagtgcatctccatccacgttggccaggctggtgtccagattggcaatgcctgctgggagctctactgcctggaacacggcatccagcccgatggccagatgccaagtgacaagaccattgggggaggagatgattccttcaacaccttcttcagtgagacgggggctggcaagcatgtgccccgggcagtgtttgtagacttggaacccacagtcattgatgaagttcgcactggcacctaccgccagctcttccaccctgagcaacttatcacaggcaaagaagatgctgccaataactatgcccgagggcactacaccattggcaaggagatcattgacctcgtgttggaccgaattcgcaagctggccgaccagtgcacgggtctccagggcttcttggttttccacagctttggtgggggaactggttctgggttcacctcgctgctcatggaacgtctctcagttgattatggcaagaagtccaagctggagttctctatttacccggcgccccaggtttccacagctgtagttgagccctacaactccatcctcaccacccacaccaccctggagcactctgattgtgccttcatggtagacaatgaggccatctatgacatctgtcgtagaaacctcgatattgagcgtccaacctatactaacctgaataggttaataggtcaaattgtgtcctccatcactgcttccctgagatttgatggagccctgaatgttgacctgacagaattccagaccaacctggtgccctatccccgcatccacttccctctggccacatatgcccctgtcatctctgctgagaaagcctaccatgaacagctttctgtagcagagatcaccaatgcttgctttgagccagccaaccagatggtgaaatgtgaccctcgccatggtaaatacatggcttgctgcctgttgtaccgtggtgacgtggttcccaaagatgtcaatgctgccattgccaccatcaagaccaagcgtaccatccagtttgtggattggtgccccactggcttcaaggttggcatcaactaccagcctcccactgtggtgcctggtggagacctggccaaggtacagagagctgtgtgcatgctgagcaacaccacagccattgctgaggcctgggctcgcctggaccacaagtttgacctgatgtatgccaaacgtgcctttgttcactggtacgttggggaggggatggaggaaggtgagttttcagaggcccgtgaggacatggctgcccttgagaaggattatgaggaggttggtgtggattctgttgaaggagagggtgaggaagaaggagaggaatactaaagttaaaacgtcacaaaggtgctgcttttacagggaagcttattctgtttt

SEQ ID NO: 33069 - DNA, 1915 bp, Homo sapiens
ataatggatgctcggccgactgcttctgcacggtctctttgtctaaaggatgcaaacagtctacggatgctagagaaaaaggggtgggggagagattacctcatcccacgtcgcttgcaccaatcaccagtctcctgtcatggcttctctgggcagattgggggtctggaccaacaggaaaaggccccggcccatccccatggtgaccgagttgtatatagggagccgcatccgcctatgtgccgcaggttctcttacatcgaccgcctaagagtcgcgctgtaagaagcaacaacctctcctcttcgtctccgccatcagctcggcagtcgcgaagcagcaaccatgcgtgagtgcatctccatccacgttggccaggctggtgtccagattggcaatgcctgctgggagctctactgcctggaacacggcatccagcccgatggccagatgccaagtgacaagaccattgggggaggagatgattccttcaacaccttcttcagtgagacgggggctggcaagcatgtgccccgggcagtgtttgtagacttggaacccacagtcattgatgaagttcgcactggcacctaccgccagctcttccaccctgagcaacttatcacaggcaaagaagatgctgccaataactatgcccgagggcactacaccattggcaaggagatcattgacctcgtgttggaccgaattcgcaagctggccgaccagtgcacgggtctccagggcttcttggttttccacagctttggtgggggaactggttctgggttcacctcgctgctcatggaacgtctctcagttgattatggcaagaagtccaagctggagttctctatttacccggcgccccaggtttccacagctgtagttgagccctacaactccatcctcaccacccacaccaccctggagcactctgattgtgccttcatggtagacaatgaggccatctatgacatctgtcgtagaaacctcgatattgagcgtccaacctatactaacctgaataggttaataggtcaaattgtgtcctccatcactgcttccctgagatttgatggagccctgaatgttgacctgacagaattccagaccaacctggtgccctatccccgcatccacttccctctggccacatatgcccctgtcatctctgctgagaaagcctaccatgaacagctttctgtagcagagatcaccaatgcttgctttgagccagccaaccagatggtgaaatgtgaccctcgccatggtaaatacatggcttgctgcctgttgtaccgtggtgacgtggttcccaaagatgtcaatgctgccattgccaccatcaagaccaagcgtaccatccagtttgtggattggtgccccactggcttcaaggttggcatcaactaccagcctcccactgtggtgcctggtggagacctggccaaggtacagagagctgtgtgcatgctgagcaacaccacagccattgctgaggcctgggctcgcctggaccacaagtttgacctgatgtatgccaaacgtgcctttgttcactggtacgttggggaggggatggaggaaggtgagttttcagaggcccgtgaggacatggctgcccttgagaaggattatgaggaggttggtgtggattctgttgaaggagagggtgaggaagaaggagaggaatactaaagttaaaacgtcacaaaggtgctgcttttacagggaagcttattctgttttaaacattgaaaagttgtggtctgatcagttaatttgtatgtagcagtgtatgctctcatatacaattactgacctatgctctaaaacatgaatgctttgttacagacccaagctgtccatttctgtgatgggttttgaataaagtattccctgtcttaaatga

SEQ ID NO: 33070 - DNA, 1518 bp, Homo sapiens
tttgtgacctgcccgcccctccccggcactgtgatgccggggggcagctgcgggcccggcgcgcctgtccccggcgtccccccctcccggtgtgtcacaacggcggaggcggctgtatctggagcagtcggggcgggcaggcccagctgagagcgggaatgcatatcagtccacgtgggccaagcgggagttcagattggcaatgcctgctgggagctcttctgcctggaacacggcatccaggcagacggcacttttgatgctcaagctagcaagatcaacgatgatgactccttcaccacctttttcagcgagactggcaatgggaagcatgtgccccgggccgtcatgatagatctggagcctactgtagtggatgaggttcgggcaggaacctaccgccagctcttccatccagagcagctgatcacaggaaaggaggatgcagccaacaactatgcccggggccactacacggtgggcaaggagagcattgacctggtgctggaccgcatacggaagctgacagatgcttgctctggcctgcagggcttcctgattttccacagttttggtgggggcactggctccggcttcacttctctgctgatggaacgcctctccctggattatggcaagaaatccaagctggagtttgccatctacccagccccccaggtctctactgcagtggtggagccctacaactccatcctgaccacccacaccacactggaacattcagattgtgctttcatggtggacaacgaagccatctatgacatctgccgcaggaaccttgacattgagcgccctacctataccaacctcaaccgcctcatcagtcagattgtgtcctcaatcactgcttctctccgctttgacggggccctcaatgtggacctcactgagttccagaccaacctggtgccctacccccgcatccacttcccgctggtcacctacgcgcccatcatctctgccgagaaagcctatcacgaacagctctctgtggccgagataaccagctcctgctttgagcccaacagccagatggtgaagtgcgacccgagacatggcaagtacatggcctgctgcatgctctaccggggcgacgtggtgcccaaggatgtgaatgtcgctattgctgccatcaagaccaagaggaccatccagtttgtagactggtgtcccacaggcttcaaggtgggcatcaactaccagcccccgaccgtggtccccgggggagacctggccaaggtgcagcgggccgtctgcatgctcagcaacaccacggccattgcggaggcctgggcccgcctcgaccacaagttcgacctcatgtacgccaagcgggcctttgtgcattggtatgtgggagaggggatggaagaaggagaattttctgaggccagggaagacttagctgccctggagaaggattatgaagaagtggggactgattcgtttgaagaagaaaatgaaggggaggaattttaaatatataccttccccttg

SEQ ID NO: 33071 - DNA, 2018 bp, Homo sapiens
aggcggctgtatctggagcagtcggggcgggcaggcccagctgagaggtgcgcgggcgaggacagcggcagcgatgcgggaatgcatatcagtccacgtgggccaagcgggagttcagattggcaatgcctgctgggagctcttctgcctggaacacggcatccaggcagacggcacttttgatgctcaagctagcaagatcaacgatgatgactccttcaccacctttttcagcgagactggcaatgggaagcatgtgccccgggccgtcatgatagatctggagcctactgtagtggatgaggttcgggcaggaacctaccgccagctcttccatccagagcagctgatcacaggaaaggaggatgcagccaacaactatgcccggggccactacacggtgggcaaggagagcattgacctggtgctggaccgcatacggaagctgacagatgcttgctctggcctgcagggcttcctgattttccacagttttggtgggggcactggctccggcttcacttctctgctgatggaacgcctctccctggattatggcaagaaatccaagctggagtttgccatctacccagccccccaggtctctactgcagtggtggagccctacaactccatcctgaccacccacaccacactggaacattcagattgtgctttcatggtggacaacgaagccatctatgacatctgccgcaggaaccttgacattgagcgccctacctataccaacctcaaccgcctcatcagtcagattgtgtcctcaatcactgcttctctccgctttgacggggccctcaatgtggacctcactgagttccagaccaacctggtgccctacccccgcatccacttcccgctggtcacctacgcgcccatcatctctgccgagaaagcctatcacgaacagctctctgtggccgagataaccagctcctgctttgagcccaacagccagatggtgaagtgcgacccgagacatggcaagtacatggcctgctgcatgctctaccggggcgacgtggtgcccaaggatgtgaatgtcgctattgctgccatcaagaccaagaggaccatccagtttgtagactggtgtcccacaggcttcaaggtgggcatcaactaccagcccccgaccgtggtccccgggggagacctggccaaggtgcagcgggccgtctgcatgctcagcaacaccacggccattgcggaggcctgggcccgcctcgaccacaagttcgacctcatgtacgccaagcgggcctttgtgcattggtatgtgggagaggggatggaagaaggagaattttctgaggccagggaagacttagctgccctggagaaggattatgaagaagtggggactgattcgtttgaagaagaaaatgaaggggaggaattttaaatatataccttccccttggctgtgtctctttatttatgctgtgccattcaaagcacatgttcaagagaacagaacactctccccgccccagcctgattcctgccttacccaggaggagggtgcctggccccagtacccagggtggcacgactgggctaagtggacactgagcttcatcaggccctccctgggtaggagcagctttgtgtcactaaagaaagtgagggccactgtctccggcgggtgaggctgcagcccagtttcacatgcgaggaggcctaatcaggagtttcaattccagatcgggctgggtccagccccaaaacatggcctgctggctggggagtgggaacactcagagaaaggggagatctgggcctgggaagattccggggcaggggtgagcggacgttcacatgagtgggtctatagcccgctccgggcatcatctagacttagcatgcattcactcccccatcacatattccaatacacaccctgtcctaggcactgagagctggagagttggtgataagcgagacgaacacatttcctgccctcatacacacataaataaagtgaatgagatcatgtc

SEQ ID NO: 33072 - DNA, 3496 bp, Homo sapiens
ggggcagtattctgtgttgagggaggaaaaacactcccttccaaaagcatgacaggcagaaagcagagaagggccaggactggctgagggcggggagctgggcctctggggtggacacacccttggtcacattgtgagggtagcttggttggccagtcccaccactgcagtgaccacagttgtgttgggctcacaccagtgaaccgaagctctggattctgagagtctgaggattccgtgaagatctcagacttgggctcagagcaaggatgcgtgaaattgtccatattcagattggccagtgtggcaaccagatcggagccaagttctgggagatgattggtgaggaacacgggatcgacttggctgggagcgaccgcggggcctcggccttgcagctggagagaatcagcgtgtactacaacgaagcctacggtaggaaatatgtgccccgagcagtcttggtggacctagaacctgggacgatggacagcattcgatctagcaaattaggagctctctttcaacccgacagttttgtccatggtaactctggggctggcaacaactgggccaaaggccactacacggagggagccgagctgatcgagaatgtcctagaggtggtgaggcacgagagtgagagctgtgactgcctgcagggcttccagatcgtccactccctgggcgggggcacaggctccgggatgggcactctgctcatgaacaagattagagaggagtacccggaccggatcatgaattccttcagcgtcatgccttctcccaaggtgtcggacactgtggtggagccctacaacgcggttctgtctatccaccagctgattgagaatgcagatgcctgtttctgcattgacaatgaggccctctatgacatctgcttccgtaccctgaagctgacgacacccacctatggggatctcaaccacctagtgtccttgaccatgagcggcataaccacctccctccggttcccgggtcagctcaacgcagacctgcgcaagctggcggtgaacatggtccccttcccccgcctgcacttctttatgcccggctttgccccactcacggcccagggcagccagcagtaccgagccctctccgtggccgagctcacccagcagatgttcgatgcccgcaataccatggctgcctgtgacctccgccgtggccgctacctcacagtggcctgcattttccggggcaagatgtccaccaaggaagtggaccagcaactgctctccgtgcagaccaggaacagcagctgctttgtggagtggattcccaacaacgtcaaggtggctgtctgcgacatcccgccccgggggctgagcatggccgccaccttcattggcaacaacacggccatccaagagatctttaatagggtctctgagcatttctcagccatgttcaaaaggaaagcttttgtgcactggtacaccagcgaagggatggacataaacgaatttggggaagctgaaaataacatccatgatttggtatccgagtaccaacaatttcaagatgccaaagcagttctagaggaagatgaagaggtcacggaggaggcagaaatggagccagaagataagggacattaactgtgagagaagctgtgccgcggagtcgcttacagaacagtttctcattagatgagtgtttctcctgcagcactccaaaacccactctgcactgcagcacagtgaatgatatgcactcaccattagcttcgacacagggactgagggagacaggtggggagcagctgacaggcattagggtctttgctgacatctactaaccttgaagagtttgatgttcagtgcatacttattaacttaaaaaaatagcaaatttattgtaaagtgctccctttgtttcaaagtgtttgccaggcatccagactacacgtgtggatttgcagggagccactggagttggtgttacatttttatactttagcagcactgataggcaccctggaatcctcacttggtatccgagggctactaagactctttccttaggttctttcctctgagcaaacactgactggcatcctgctttccagtgcctgccagcctccagaagagccaggtgcctgactagtacatggggagctacagagccaaggtcaatgtgagtcaacatccactagaaatatccatgttgtgtagacctgtgcatacaacatgctaactggaaaagaggaaaaaagaaaagccacagtcctctccacaaaaatacctggtccaaacaagaaaaacaaaaagacaagcaaaactaaagaactgcagtcttctgatctttatttctgaagagctagcctttaacatatatgtttatatagtttaaatttcttactactgttagatcccaggaattcattaataatcatccttggctttccttttaaaggctattttgaaatggtcttttcactttcattcagtcatcaccccccaaaatgctctgcagcctctctgctctttgagaaagggcacaccatgcgctcggcaaccattcaaatgcaggaattaagcagcaatggctgcagtgtccttctcagttatggaggacatcgtctcattagggaacttttacagttcaaattaatttgcagaagttgccataaatgtttgcataatgacatagctttaagcactacatgattttaatctgctcacattataacaggaccaaatacacaagagcgtaatcaaatcatctgtaacttcttaattacagtttacctatttctgacatgcagcactgccatctcttccagcaccatcagggttttaatggccctctagaattaccactgagatacactatttgatccatggataaccggtaatgggaaaatgctccgaccctcaatgcagtaaatatttacttgcaggcaactgggttctcatctcttgatttgcttttgtaatcagcaataataaaatagcaggtagatggatgacagttgctcattctgagaaacttcactcttttcacttatgcatcacgaggaaataactaaaatacataccaagagaaaaataccttgccatcggatcatcaacaagtcttctatttacaaacttcaaaaaacacaaaacaacattcatgttttaaatgctttctacttgtggttcaagaagcactagatttagtaagaaactctacctatatacttagtttgaagttagtaacttcctgagatgctaaagacttacagcctgcgattatacaaggatttacacatgcttcctctggtgctttacttcccaaacctaaaaaagcaatgaaatagatgtaaggaaggagggatttaaaccttttaaaaaacttttgctgacttatattactgtaaagatttgtttgctcaatagtaatcattaaactacaaagtaattcaattttaaatggcaaaattgctttatttcagactaaataaattccttttcttgaagcctaa

SEQ ID NO: 33073 - DNA, 1998 bp, Homo sapiens
ggggggctcgggctgggggcgcggcctgtgccggccgccccaccctccttgcataaaagccggagcccgcggggccggcgctctcagcccgtcggttcccgagcgccttcccggtgaccccgcagtgggtgtgtgaggggaggacggacagacccagacgccgccggaccaggaggacgctgacgaggcaccatgcgtgagatcgtgcacatccaggcgggccagtgcggcaaccagatcggcgccaagttttgggaggtcatcagtgatgagcatgggattgaccccactggcagttaccatggagacagtgatttgcagctggagagaatcaatgtttactacaatgaagccactggtaacaaatatgttcctcgggccatcctcgtggatctggagccaggcacgatggattcggttaggtctggaccattcggccagatcttcagaccagacaatttcgtgtttggccagagtggagccgggaataactgggccaagggccactacacagagggagccgagctggtcgactcggtcctggatgtggtgaggaaggagtcagagagctgtgactgtctccagggcttccagctgacccactctctggggggcggcacggggtccgggatgggcaccctgctcatcagcaagatccgggaagagtacccagaccgcatcatgaacaccttcagcgtcatgccctcacccaaggtgtcagacacggtggtggagccctacaacgccaccctctcggtccaccagctggtggaaaacacagatgaaacctactgcattgacaacgaggccctgtatgacatctgcttccgcaccctgaagctgaccacccccacctacggggacctcaaccacctggtgtcggccaccatgagcggggtcaccacctgcctgcgcttcccgggccagctgaacgcagacctgcgcaagctggcggtgaacatggtgcccttccctcgcctgcacttcttcatgcccggcttcgcgcccctgaccagccggggcagccagcagtaccgggcgctcacggtgcccgagctcacccagcagatgttcgactccaagaacatgatggccgcctgcgacccgcgccacggccgctacctgacggtggctgccatcttccggggccgcatgtccatgaaggaggtggacgagcagatgctcaacgtgcagaacaagaacagcagctacttcgtggagtggatccccaacaacgtgaagacggccgtgtgcgacatcccgccccgcggcctgaagatgtcggccaccttcatcggcaacagcacggccatccaggagctgttcaagcgcatctccgagcagttcacggccatgttccggcgcaaggccttcctgcactggtacacgggcgagggcatggacgagatggagttcaccgaggccgagagcaacatgaacgacctggtgtccgagtaccagcagtaccaggacgccacggccgacgaacaaggggagttcgaggaggaggagggcgaggacgaggcgtagatgcccccgcgagacgggttagggaaagcggaggaggaaagcgagggggtggggggcttcccgggacgataacctggcagtggaaggaaagaagcatggtctactttaggtgtgcgctgggtctctggtgctcttcactgttgcctgtcactttttttttccttttttgtaatattgatgacatcaatgtaacatttgagatatttctgaattactgttgtaatggctaaaatcacataaacgtttgtgtcggaatggtgtcctctctttctcttcctttttctctttattaacgatttaaatgtaactttctgaacacattgcattgaattcttcctttaacaaaaagcaaaggcgtaggtaaaagctcaaatgaatttattctttcggtatggtaaaattgaaccaatcacagttaagatgagagatcaacctgagttttaaaatacctttaataaatattagttg

SEQ ID NO: 33074 - DNA, 1769 bp, Homo sapiens
gacatcagccgatgcgaagggcggggccgcggctataagagcgcgcggccgcggtccccgaccctcagcagccagcccggcccgcccgcgcccgtccgcagccgcccgccagacgcgcccagtatgagggagatcgtgcacatccaggccggccagtgcggcaaccagatcggggccaagttctgggaagtcatcagtgatgagcatggcatcgaccccagcggcaactacgtgggcgactcggacttgcagctggagcggatcagcgtctactacaacgaggcctcttctcacaagtacgtgcctcgagccattctggtggacctggaacccggaaccatggacagtgtccgctcaggggcctttggacatctcttcaggcctgacaatttcatctttggtcagagtggggccggcaacaactgggccaagggtcactacacggagggggcggagctggtggattcggtcctggatgtggtgcggaaggagtgtgaaaactgcgactgcctgcagggcttccagctgacccactcgctggggggcggcacgggctccggcatgggcacgttgctcatcagcaaggtgcgtgaggagtatcccgaccgcatcatgaacaccttcagcgtcgtgccctcacccaaggtgtcagacacggtggtggagccctacaacgccacgctgtccatccaccagctggtggagaacacggatgagacctactgcatcgacaacgaggcgctctacgacatctgcttccgcaccctcaagctggccacgcccacctacggggacctcaaccacctggtatcggccaccatgagcggagtcaccacctccttgcgcttcccgggccagctcaacgctgacctgcgcaagctggccgtcaacatggtgcccttcccgcgcctgcacttcttcatgcccggcttcgcccccctcacagcccggggcagccagcagtaccgggccctgaccgtgcccgagctcacccagcagatgttcgatgccaagaacatgatggccgcctgcgacccgcgccacggccgctacctgacggtggccaccgtgttccggggccgcatgtccatgaaggaggtggacgagcagatgctggccatccagagcaagaacagcagctacttcgtggagtggatccccaacaacgtgaaggtggccgtgtgtgacatcccgccccgcggcctcaagatgtcctccaccttcatcgggaacagcacggccatccaggagctgttcaagcgcatctccgagcagttcacggccatgttccggcgcaaggccttcctgcactggtacacgggcgagggcatggacgagatggagttcaccgaggccgagagcaacatgaacgacctggtgtccgagtaccagcagtaccaggacgccacggccgaggaagagggcgagatgtacgaagacgacgaggaggagtcggaggcccagggccccaagtgaagctgctcgcagctggagtgagaggcaggtggcggccggggccgaagccagcagtgtctaaacccccggagccatcttgctgccgacaccctgctttcccctcgccctagggctcccttgccgccctcctgcagtatttatggcctcgtcctccccacctaggccacgtgtgagctgctcctgtctctgtcttattgcagctccaggcctgacgttttacggttttgttttttactggtttgtgtttatattttcggggatacttaataaatctattgctgtcagataccctt

SEQ ID NO: 33075 - DNA, 1978 bp, Homo sapiens
agaactgggagctgcttcctggcagggcccgcctctgctgggagaccggacggtgagtcagccttaagcccggcaccagacccctctgaggatggagcaggagctggctgccctgaggctgcaaaacttcttccctcgtggagacagggaggcacctcagacactcaccccggactcccttgaacagggacagggaggaaccccaggcagctagaccccagcagcagccacacgagcacactgtggggcagggaggggcatctcttgagaacaaaagatccatttctcgactttccaaactggagagcttcttgagagaaaagagagagacaggtacaggtccacgccacccacacacagccctgtgcacacagaccggacacaggcgtccacagttctgggaagtcatcagtgatgagcatggcatcgaccccagcggcaactacgtgggcgactcggacttgcagctggagcggatcagcgtctactacaacgaggcctcttctcacaagtacgtgcctcgagccattctggtggacctggaacccggaaccatggacagtgtccgctcaggggcctttggacatctcttcaggcctgacaatttcatctttggtcagagtggggccggcaacaactgggccaagggtcactacacggagggggcggagctggtggattcggtcctggatgtggtgcggaaggagtgtgaaaactgcgactgcctgcagggcttccagctgacccactcgctggggggcggcacgggctccggcatgggcacgttgctcatcagcaaggtgcgtgaggagtatcccgaccgcatcatgaacaccttcagcgtcgtgccctcacccaaggtgtcagacacggtggtggagccctacaacgccacgctgtccatccaccagctggtggagaacacggatgagacctactgcatcgacaacgaggcgctctacgacatctgcttccgcaccctcaagctggccacgcccacctacggggacctcaaccacctggtatcggccaccatgagcggagtcaccacctccttgcgcttcccgggccagctcaacgctgacctgcgcaagctggccgtcaacatggtgcccttcccgcgcctgcacttcttcatgcccggcttcgcccccctcacagcccggggcagccagcagtaccgggccctgaccgtgcccgagctcacccagcagatgttcgatgccaagaacatgatggccgcctgcgacccgcgccacggccgctacctgacggtggccaccgtgttccggggccgcatgtccatgaaggaggtggacgagcagatgctggccatccagagcaagaacagcagctacttcgtggagtggatccccaacaacgtgaaggtggccgtgtgtgacatcccgccccgcggcctcaagatgtcctccaccttcatcgggaacagcacggccatccaggagctgttcaagcgcatctccgagcagttcacggccatgttccggcgcaaggccttcctgcactggtacacgggcgagggcatggacgagatggagttcaccgaggccgagagcaacatgaacgacctggtgtccgagtaccagcagtaccaggacgccacggccgaggaagagggcgagatgtacgaagacgacgaggaggagtcggaggcccagggccccaagtgaagctgctcgcagctggagtgagaggcaggtggcggccggggccgaagccagcagtgtctaaacccccggagccatcttgctgccgacaccctgctttcccctcgccctagggctcccttgccgccctcctgcagtatttatggcctcgtcctccccacctaggccacgtgtgagctgctcctgtctctgtcttattgcagctccaggcctgacgttttacggttttgttttttactggtttgtgtttatattttcggggatacttaataaatctattgctgtcagat

SEQ ID NO: 33076 - DNA, 2670 bp, Homo sapiens
gtacatgaccggcatcgactaatcagggccaggctcgatgaggctttgtctccctaccgcgcgcggggccgattctcccgcctcccagccccggcgcacgcgcgccccgcccagcctgctttccctccgcgccctcccctctcctttctccctctcagaaccttcctgccgtcgcgtttgcacctcgctgctccagcctctggggcgcattccaaccttccagcctgcgacctgcggagaaaaaaaattacttattttcttgccccatacataccttgaggcgagcaaaaaaattaaattttaaccatgagggaaatcgtgcacatccaggctggtcagtgtggcaaccagatcggtgccaagttctgggaggtgatcagtgatgaacatggcatcgaccccaccggcacctaccacggggacagcgacctgcagctggaccgcatctctgtgtactacaatgaagccacaggtggcaaatatgttcctcgtgccatcctggtggatctagaacctgggaccatggactctgttcgctcaggtccttttggccagatctttagaccagacaactttgtatttggtcagtctggggcaggtaacaactgggccaaaggccactacacagagggcgccgagctggttgattctgtcctggatgtggtacggaaggaggcagagagctgtgactgcctgcagggcttccagctgacccactcactgggcgggggcacaggctctggaatgggcactctccttatcagcaagatccgagaagaataccctgatcgcatcatgaataccttcagtgtggtgccttcacccaaagtgtctgacaccgtggtcgagccctacaatgccaccctctccgtccatcagttggtagagaatactgatgagacctattgcattgacaacgaggccctctatgatatctgcttccgcactctgaagctgaccacaccaacctacggggatctgaaccaccttgtctcagccaccatgagtggtgtcaccacctgcctccgtttccctggccagctcaatgctgacctccgcaagttggcagtcaacatggtccccttcccacgtctccatttctttatgcctggctttgcccctctcaccagccgtggaagccagcagtatcgagctctcacagtgccggaactcacccagcaggtcttcgatgccaagaacatgatggctgcctgtgacccccgccacggccgatacctcaccgtggctgctgtcttccgtggtcggatgtccatgaaggaggtcgatgagcagatgcttaacgtgcagaacaagaacagcagctactttgtggaatggatccccaacaatgtcaagacagccgtctgtgacatcccacctcgtggcctcaagatggcagtcaccttcattggcaatagcacagccatccaggagctcttcaagcgcatctcggagcagttcactgccatgttccgccggaaggccttcctccactggtacacaggcgagggcatggacgagatggagttcaccgaggctgagagcaacatgaacgacctcgtctctgagtatcagcagtaccaggatgccaccgcagaagaggaggaggatttcggtgaggaggccgaagaggaggcctaaggcagagcccccatcacctcaggcttctcagttcccttagccgtcttactcaactgcccctttcctctccctcagaatttgtgtttgctgcctctatcttgttttttgttttttcttctggggggggtctagaacagtgcctggcacatagtaggcgctcaataaatacttgtttgttgaatgtctcctctctctttccactctgggaaacctaggtttctgccattctgggtgaccctgtatttctttctggtgcccattccatttgtccagttaatacttcctcttaaaaatctccaagaagctgggtctccagatcccatttagaaccaaccaggtgctgaaaacacatgtagataatggccatcatcctaagcccaaagtagaaaatggtagaaggtagtgggtagaagtcactatataaggaaggggatgggattttccattctaaaagttttggagagggaaatccaggctattaaagtcactaaatttctaagtatgtccatttcccatctcagcttcaagggaggtgtcagcagtattatctccactttcaatctccctccaagctctactctggaggagtctgtcccactctgtcaagtggaatccttccctttccaactctacctccctcactcagctcctttcccctgatcagagaaagggatcaagggggttgggaggggggaaagagaccagccttggtccctaagcctccagaaacgtcttcttaatccccaccttttcttactcccaaaaaagaatgaacacccctgactctggagtggtgtatactgccacatcagtgtttgagtcagtccccagaggagaggggaaccctcctccatcttttttgcaacatctcatttcttccttttgctgttgcttcccccctcacacacttggttttgttctatcctacatttgagatttctattttatgttgaacttgctgctttttttcatattgaaaagatgacatcgccccaagagccaaaaataaatgggaattgaaaaaagctg

SEQ ID NO: 33077 - DNA, 2632 bp, Homo sapiens
cgcgtgcgccgcagtcacgtggagggcggggggggtggtcgactgcggcggcagctctttcctcagacccccagccttttgtgcgccgcgcggtggggcggtgcccagcttgggggaaggagagcggcgcttatcgaagtgtggtcgacctccatccgcccaccgagcacttgggacccgctgcacatatccagagcagggaaagctgtggctttctcgggggagcgagtgtctaggggaagggtgtggcaggcccacgggatgccatgccctagaacaacggcctgagcgcttgtggaattaaaatgggagatgtggggccgagttctgggaggtgatcagtgatgaacatggcatcgaccccaccggcacctaccacggggacagcgacctgcagctggaccgcatctctgtgtactacaatgaagccacaggtggcaaatatgttcctcgtgccatcctggtggatctagaacctgggaccatggactctgttcgctcaggtccttttggccagatctttagaccagacaactttgtatttggtcagtctggggcaggtaacaactgggccaaaggccactacacagagggcgccgagctggttgattctgtcctggatgtggtacggaaggaggcagagagctgtgactgcctgcagggcttccagctgacccactcactgggcgggggcacaggctctggaatgggcactctccttatcagcaagatccgagaagaataccctgatcgcatcatgaataccttcagtgtggtgccttcacccaaagtgtctgacaccgtggtcgagccctacaatgccaccctctccgtccatcagttggtagagaatactgatgagacctattgcattgacaacgaggccctctatgatatctgcttccgcactctgaagctgaccacaccaacctacggggatctgaaccaccttgtctcagccaccatgagtggtgtcaccacctgcctccgtttccctggccagctcaatgctgacctccgcaagttggcagtcaacatggtccccttcccacgtctccatttctttatgcctggctttgcccctctcaccagccgtggaagccagcagtatcgagctctcacagtgccggaactcacccagcaggtcttcgatgccaagaacatgatggctgcctgtgacccccgccacggccgatacctcaccgtggctgctgtcttccgtggtcggatgtccatgaaggaggtcgatgagcagatgcttaacgtgcagaacaagaacagcagctactttgtggaatggatccccaacaatgtcaagacagccgtctgtgacatcccacctcgtggcctcaagatggcagtcaccttcattggcaatagcacagccatccaggagctcttcaagcgcatctcggagcagttcactgccatgttccgccggaaggccttcctccactggtacacaggcgagggcatggacgagatggagttcaccgaggctgagagcaacatgaacgacctcgtctctgagtatcagcagtaccaggatgccaccgcagaagaggaggaggatttcggtgaggaggccgaagaggaggcctaaggcagagcccccatcacctcaggcttctcagttcccttagccgtcttactcaactgcccctttcctctccctcagaatttgtgtttgctgcctctatcttgttttttgttttttcttctggggggggtctagaacagtgcctggcacatagtaggcgctcaataaatacttgtttgttgaatgtctcctctctctttccactctgggaaacctaggtttctgccattctgggtgaccctgtatttctttctggtgcccattccatttgtccagttaatacttcctcttaaaaatctccaagaagctgggtctccagatcccatttagaaccaaccaggtgctgaaaacacatgtagataatggccatcatcctaagcccaaagtagaaaatggtagaaggtagtgggtagaagtcactatataaggaaggggatgggattttccattctaaaagttttggagagggaaatccaggctattaaagtcactaaatttctaagtatgtccatttcccatctcagcttcaagggaggtgtcagcagtattatctccactttcaatctccctccaagctctactctggaggagtctgtcccactctgtcaagtggaatccttccctttccaactctacctccctcactcagctcctttcccctgatcagagaaagggatcaagggggttgggaggggggaaagagaccagccttggtccctaagcctccagaaacgtcttcttaatccccaccttttcttactcccaaaaaagaatgaacacccctgactctggagtggtgtatactgccacatcagtgtttgagtcagtccccagaggagaggggaaccctcctccatcttttttgcaacatctcatttcttccttttgctgttgcttcccccctcacacacttggttttgttctatcctacatttgagatttctattttatgttgaacttgctgctttttttcatattgaaaagatgacatcgccccaagagccaaaaataaatgggaattgaaaaaagctg

SEQ ID NO: 33078 - DNA, 2671 bp, Homo sapiens
gtacatgaccggcatcgactaatcagggccaggctcgatgaggctttgtctccctaccgcgcgcggggccgattctcccgcctcccagccccggcgcacgcgcgccccgcccagcctgctttccctccgcgccctcccctctcctttctccctctcagaaccttcctgccgtcgcgtttgcacctcgctgctccagcctctggggcgcattccaaccttccagcctgcgacctgcggagaaaaaaaattacttattttcttgccccatacataccttgaggcgagcaaaaaaattaaattttaaccatgagggaaatcgtgcacatccaggctggtcagtgtggcaaccagatcggtgccaagttctgggaggtgatcagtgatgaacatggcatcgaccccaccggcacctaccacggggacagcgacctgcagctggaccgcatctctgtgtactacaatgaagccacaggtggcaaatatgttcctcgtgccatcctggtggatctagaacctgggaccatggactctgttcgctcaggtccttttggccagatctttagaccagacaactttgtatttggtcagtctggggcaggtaacaactgggccaaaggccactacacagagggcgccgagctggttgattctgtcctggatgtggtacggaaggaggcagagagctgtgactgcctgcagggcttccagctgacccactcactgggcgggggcacaggctctggaatgggcactctccttatcagcaagatccgagaagaataccctgatcgcatcatgaataccttcagtgtggtgccttcacccaaagtgtctgacaccgtggtcgagccctacaatgccaccctctccgtccatcagttggtagagaatactgatgagacctattgcattgacaacgaggccctctatgatatctgcttccgcactctgaagctgaccacaccaacctacggggatctgaaccaccttgtctcagccaccatgagtggtgtcaccacctgcctccgtttccctggccagctcaatgctgacctccgcaagttggcagtcaacatggtccccttcccacgtctccatttctttatgcctggctttgcccctctcaccagccgtggaagccagcagtatcgagctctcacagtgccggaactcacccagcaggtcttcgatgccaagaacatgatggctgcctgtgacccccgccacggccgatacctcaccgtggctgctgtcttccgtggtcggatgtccatgaaggaggtcgatgagcagatgcttaacgtgcagaacaagaacagcagctactttgtggaatggatccccaacaatgtcaagacagccgtctgtgacatcccacctcgtggcctcaagatggcagtcaccttcattggcaatagcacagccatccaggagctcttcaagcgcatctcggagcagttcactgccatgttccgccggaaggccttcctccactggtacacaggcgagggcatggacgagatggagttcaccgaggctgagagcaacatgaacgacctcgtctctgagtatcagcagtaccaggatgccaccgcagaagaggaggaggatttcggtgaggaggccgaagaggaggcctaaggcagagcccccatcacctcaggcttctcagttcccttagccgtcttactcaactgcccctttcctctccctcagaatttgtgtttgctgcctctatcttgttttttgttttttcttctgggggggggtctagaacagtgcctggcacatagtaggcgctcaataaatacttgtttgttgaatgtctcctctctctttccactctgggaaacctaggtttctgccattctgggtgaccctgtatttctttctggtgcccattccatttgtccagttaatacttcctcttaaaaatctccaagaagctgggtctccagatcccatttagaaccaaccaggtgctgaaaacacatgtagataatggccatcatcctaagcccaaagtagaaaatggtagaaggtagtgggtagaagtcactatataaggaaggggatgggattttccattctaaaagttttggagagggaaatccaggctattaaagtcactaaatttctaagtatgtccatttcccatctcagcttcaagggaggtgtcagcagtattatctccactttcaatctccctccaagctctactctggaggagtctgtcccactctgtcaagtggaatccttccctttccaactctacctccctcactcagctcctttcccctgatcagagaaagggatcaagggggttgggaggggggaaagagaccagccttggtccctaagcctccagaaacgtcttcttaatccccaccttttcttactcccaaaaaagaatgaacacccctgactctggagtggtgtatactgccacatcagtgtttgagtcagtccccagaggagaggggaaccctcctccatcttttttgcaacatctcatttcttccttttgctgttgcttcccccctcacacacttggttttgttctatcctacatttgagatttctattttatgttgaacttgctgctttttttcatattgaaaagatgacatcgccccaagagccaaaaataaatgggaattgaaaaaagctg

SEQ ID NO: 33079 - DNA, 2823 bp, Homo sapiens
ggcgcttatcgaagtgtggtcgacctccatccgcccaccgagcacttgggacccgctgcacatatccagagcagggaaagctgtggctttctcgggggagcgagtgtctaggggaagggtgtggcaggcccacgggatgccatgccctagaacaacggcctgagcgcttgtggaattaaaatgggagatgtggggccgaggtgggcgaattgggatccctccaggtcaggggttcgagaccatcctgggcaacaaagcgagaccctcccccatgccacgtttctacaaaaaataaaagtaaaaaattagctgggcgtggtggcgcgcgtctgtggtcccagctactcgagaggctgagatgggaggatcggttgagcctgggagttccacgctgtagtcatccgtgattgcaccactgcactgcaggctgggcaacaggaagaccctgtcttaaaaattagaagaagctgggcgcggtggctcacccttgtaatcccagcactttgggaggccaagttctgggaggtgatcagtgatgaacatggcatcgaccccaccggcacctaccacggggacagcgacctgcagctggaccgcatctctgtgtactacaatgaagccacaggtggcaaatatgttcctcgtgccatcctggtggatctagaacctgggaccatggactctgttcgctcaggtccttttggccagatctttagaccagacaactttgtatttggtcagtctggggcaggtaacaactgggccaaaggccactacacagagggcgccgagctggttgattctgtcctggatgtggtacggaaggaggcagagagctgtgactgcctgcagggcttccagctgacccactcactgggcgggggcacaggctctggaatgggcactctccttatcagcaagatccgagaagaataccctgatcgcatcatgaataccttcagtgtggtgccttcacccaaagtgtctgacaccgtggtcgagccctacaatgccaccctctccgtccatcagttggtagagaatactgatgagacctattgcattgacaacgaggccctctatgatatctgcttccgcactctgaagctgaccacaccaacctacggggatctgaaccaccttgtctcagccaccatgagtggtgtcaccacctgcctccgtttccctggccagctcaatgctgacctccgcaagttggcagtcaacatggtccccttcccacgtctccatttctttatgcctggctttgcccctctcaccagccgtggaagccagcagtatcgagctctcacagtgccggaactcacccagcaggtcttcgatgccaagaacatgatggctgcctgtgacccccgccacggccgatacctcaccgtggctgctgtcttccgtggtcggatgtccatgaaggaggtcgatgagcagatgcttaacgtgcagaacaagaacagcagctactttgtggaatggatccccaacaatgtcaagacagccgtctgtgacatcccacctcgtggcctcaagatggcagtcaccttcattggcaatagcacagccatccaggagctcttcaagcgcatctcggagcagttcactgccatgttccgccggaaggccttcctccactggtacacaggcgagggcatggacgagatggagttcaccgaggctgagagcaacatgaacgacctcgtctctgagtatcagcagtaccaggatgccaccgcagaagaggaggaggatttcggtgaggaggccgaagaggaggcctaaggcagagcccccatcacctcaggcttctcagttcccttagccgtcttactcaactgcccctttcctctccctcagaatttgtgtttgctgcctctatcttgttttttgttttttcttctggggggggtctagaacagtgcctggcacatagtaggcgctcaataaatacttgtttgttgaatgtctcctctctctttccactctgggaaacctaggtttctgccattctgggtgaccctgtatttctttctggtgcccattccatttgtccagttaatacttcctcttaaaaatctccaagaagctgggtctccagatcccatttagaaccaaccaggtgctgaaaacacatgtagataatggccatcatcctaagcccaaagtagaaaatggtagaaggtagtgggtagaagtcactatataaggaaggggatgggattttccattctaaaagttttggagagggaaatccaggctattaaagtcactaaatttctaagtatgtccatttcccatctcagcttcaagggaggtgtcagcagtattatctccactttcaatctccctccaagctctactctggaggagtctgtcccactctgtcaagtggaatccttccctttccaactctacctccctcactcagctcctttcccctgatcagagaaagggatcaagggggttgggaggggggaaagagaccagccttggtccctaagcctccagaaacgtcttcttaatccccaccttttcttactcccaaaaaagaatgaacacccctgactctggagtggtgtatactgccacatcagtgtttgagtcagtccccagaggagaggggaaccctcctccatcttttttgcaacatctcatttcttccttttgctgttgcttcccccctcacacacttggttttgttctatcctacatttgagatttctattttatgttgaacttgctgctttttttcatattgaaaagatgacatcgccccaagagccaaaaataaatgggaattgaaaaaagctg

SEQ ID NO: 33080 - DNA, 2903 bp, Homo sapiens
tggggcggtgcccagcttgggggaaggagagcggcgcttatcgaagtgtggtcgacctccatccgcccaccgagcacttgggacccgctgcacatatccagagcagggaaagctgtggctttctcgggggagcgagtgtctaggggaagggtgtggcaggcccacgggatgccatgccctagaacaacggcctgagcgcttgtggaattaaaatgggagatgtggggccgaggtgggcgaattgggatccctccaggtcaggggttcgagaccatcctgggcaacaaagcgagaccctcccccatgccacgtttctacaaaaaataaaagtaaaaaattagctgggcgtggtggcgcgcgtctgtggtcccagctactcgagaggctgagatgggaggatcggttgagcctgggagttccacgctgtagtcatccgtgattgcaccactgcactgcaggctgggcaacaggaagaccctgtcttaaaaattagaagaagctgggcgcggtggctcacccttgtaatcccagcactttgggaggccaaggtgggcggatcacgaggtcaagagatctagaccatcctggccaacatgttctgggaggtgatcagtgatgaacatggcatcgaccccaccggcacctaccacggggacagcgacctgcagctggaccgcatctctgtgtactacaatgaagccacaggtggcaaatatgttcctcgtgccatcctggtggatctagaacctgggaccatggactctgttcgctcaggtccttttggccagatctttagaccagacaactttgtatttggtcagtctggggcaggtaacaactgggccaaaggccactacacagagggcgccgagctggttgattctgtcctggatgtggtacggaaggaggcagagagctgtgactgcctgcagggcttccagctgacccactcactgggcgggggcacaggctctggaatgggcactctccttatcagcaagatccgagaagaataccctgatcgcatcatgaataccttcagtgtggtgccttcacccaaagtgtctgacaccgtggtcgagccctacaatgccaccctctccgtccatcagttggtagagaatactgatgagacctattgcattgacaacgaggccctctatgatatctgcttccgcactctgaagctgaccacaccaacctacggggatctgaaccaccttgtctcagccaccatgagtggtgtcaccacctgcctccgtttccctggccagctcaatgctgacctccgcaagttggcagtcaacatggtccccttcccacgtctccatttctttatgcctggctttgcccctctcaccagccgtggaagccagcagtatcgagctctcacagtgccggaactcacccagcaggtcttcgatgccaagaacatgatggctgcctgtgacccccgccacggccgatacctcaccgtggctgctgtcttccgtggtcggatgtccatgaaggaggtcgatgagcagatgcttaacgtgcagaacaagaacagcagctactttgtggaatggatccccaacaatgtcaagacagccgtctgtgacatcccacctcgtggcctcaagatggcagtcaccttcattggcaatagcacagccatccaggagctcttcaagcgcatctcggagcagttcactgccatgttccgccggaaggccttcctccactggtacacaggcgagggcatggacgagatggagttcaccgaggctgagagcaacatgaacgacctcgtctctgagtatcagcagtaccaggatgccaccgcagaagaggaggaggatttcggtgaggaggccgaagaggaggcctaaggcagagcccccatcacctcaggcttctcagttcccttagccgtcttactcaactgcccctttcctctccctcagaatttgtgtttgctgcctctatcttgttttttgttttttcttctggggggggtctagaacagtgcctggcacatagtaggcgctcaataaatacttgtttgttgaatgtctcctctctctttccactctgggaaacctaggtttctgccattctgggtgaccctgtatttctttctggtgcccattccatttgtccagttaatacttcctcttaaaaatctccaagaagctgggtctccagatcccatttagaaccaaccaggtgctgaaaacacatgtagataatggccatcatcctaagcccaaagtagaaaatggtagaaggtagtgggtagaagtcactatataaggaaggggatgggattttccattctaaaagttttggagagggaaatccaggctattaaagtcactaaatttctaagtatgtccatttcccatctcagcttcaagggaggtgtcagcagtattatctccactttcaatctccctccaagctctactctggaggagtctgtcccactctgtcaagtggaatccttccctttccaactctacctccctcactcagctcctttcccctgatcagagaaagggatcaagggggttgggaggggggaaagagaccagccttggtccctaagcctccagaaacgtcttcttaatccccaccttttcttactcccaaaaaagaatgaacacccctgactctggagtggtgtatactgccacatcagtgtttgagtcagtccccagaggagaggggaaccctcctccatcttttttgcaacatctcatttcttccttttgctgttgcttcccccctcacacacttggttttgttctatcctacatttgagatttctattttatgttgaacttgctgctttttttcatattgaaaagatgacatcgccccaagagccaaaaataaatgggaattgaaaaaagctg

SEQ ID NO: 33081 - DNA, 2824 bp, Homo sapiens
ggcgcttatcgaagtgtggtcgacctccatccgcccaccgagcacttgggacccgctgcacatatccagagcagggaaagctgtggctttctcgggggagcgagtgtctaggggaagggtgtggcaggcccacgggatgccatgccctagaacaacggcctgagcgcttgtggaattaaaatgggagatgtggggccgaggtgggcgaattgggatccctccaggtcaggggttcgagaccatcctgggcaacaaagcgagaccctcccccatgccacgtttctacaaaaaataaaagtaaaaaattagctgggcgtggtggcgcgcgtctgtggtcccagctactcgagaggctgagatgggaggatcggttgagcctgggagttccacgctgtagtcatccgtgattgcaccactgcactgcaggctgggcaacaggaagaccctgtcttaaaaattagaagaagctgggcgcggtggctcacccttgtaatcccagcactttgggaggccaagttctgggaggtgatcagtgatgaacatggcatcgaccccaccggcacctaccacggggacagcgacctgcagctggaccgcatctctgtgtactacaatgaagccacaggtggcaaatatgttcctcgtgccatcctggtggatctagaacctgggaccatggactctgttcgctcaggtccttttggccagatctttagaccagacaactttgtatttggtcagtctggggcaggtaacaactgggccaaaggccactacacagagggcgccgagctggttgattctgtcctggatgtggtacggaaggaggcagagagctgtgactgcctgcagggcttccagctgacccactcactgggcgggggcacaggctctggaatgggcactctccttatcagcaagatccgagaagaataccctgatcgcatcatgaataccttcagtgtggtgccttcacccaaagtgtctgacaccgtggtcgagccctacaatgccaccctctccgtccatcagttggtagagaatactgatgagacctattgcattgacaacgaggccctctatgatatctgcttccgcactctgaagctgaccacaccaacctacggggatctgaaccaccttgtctcagccaccatgagtggtgtcaccacctgcctccgtttccctggccagctcaatgctgacctccgcaagttggcagtcaacatggtccccttcccacgtctccatttctttatgcctggctttgcccctctcaccagccgtggaagccagcagtatcgagctctcacagtgccggaactcacccagcaggtcttcgatgccaagaacatgatggctgcctgtgacccccgccacggccgatacctcaccgtggctgctgtcttccgtggtcggatgtccatgaaggaggtcgatgagcagatgcttaacgtgcagaacaagaacagcagctactttgtggaatggatccccaacaatgtcaagacagccgtctgtgacatcccacctcgtggcctcaagatggcagtcaccttcattggcaatagcacagccatccaggagctcttcaagcgcatctcggagcagttcactgccatgttccgccggaaggccttcctccactggtacacaggcgagggcatggacgagatggagttcaccgaggctgagagcaacatgaacgacctcgtctctgagtatcagcagtaccaggatgccaccgcagaagaggaggaggatttcggtgaggaggccgaagaggaggcctaaggcagagcccccatcacctcaggcttctcagttcccttagccgtcttactcaactgcccctttcctctccctcagaatttgtgtttgctgcctctatcttgttttttgttttttcttctgggggggggtctagaacagtgcctggcacatagtaggcgctcaataaatacttgtttgttgaatgtctcctctctctttccactctgggaaacctaggtttctgccattctgggtgaccctgtatttctttctggtgcccattccatttgtccagttaatacttcctcttaaaaatctccaagaagctgggtctccagatcccatttagaaccaaccaggtgctgaaaacacatgtagataatggccatcatcctaagcccaaagtagaaaatggtagaaggtagtgggtagaagtcactatataaggaaggggatgggattttccattctaaaagttttggagagggaaatccaggctattaaagtcactaaatttctaagtatgtccatttcccatctcagcttcaagggaggtgtcagcagtattatctccactttcaatctccctccaagctctactctggaggagtctgtcccactctgtcaagtggaatccttccctttccaactctacctccctcactcagctcctttcccctgatcagagaaagggatcaagggggttgggaggggggaaagagaccagccttggtccctaagcctccagaaacgtcttcttaatccccaccttttcttactcccaaaaaagaatgaacacccctgactctggagtggtgtatactgccacatcagtgtttgagtcagtccccagaggagaggggaaccctcctccatcttttttgcaacatctcatttcttccttttgctgttgcttcccccctcacacacttggttttgttctatcctacatttgagatttctattttatgttgaacttgctgctttttttcatattgaaaagatgacatcgccccaagagccaaaaataaatgggaattgaaaaaagctg

SEQ ID NO: 33082 - DNA, 2633 bp, Homo sapiens
cgcgtgcgccgcagtcacgtggagggcggggggggtggtcgactgcggcggcagctctttcctcagacccccagccttttgtgcgccgcgcggtggggcggtgcccagcttgggggaaggagagcggcgcttatcgaagtgtggtcgacctccatccgcccaccgagcacttgggacccgctgcacatatccagagcagggaaagctgtggctttctcgggggagcgagtgtctaggggaagggtgtggcaggcccacgggatgccatgccctagaacaacggcctgagcgcttgtggaattaaaatgggagatgtggggccgagttctgggaggtgatcagtgatgaacatggcatcgaccccaccggcacctaccacggggacagcgacctgcagctggaccgcatctctgtgtactacaatgaagccacaggtggcaaatatgttcctcgtgccatcctggtggatctagaacctgggaccatggactctgttcgctcaggtccttttggccagatctttagaccagacaactttgtatttggtcagtctggggcaggtaacaactgggccaaaggccactacacagagggcgccgagctggttgattctgtcctggatgtggtacggaaggaggcagagagctgtgactgcctgcagggcttccagctgacccactcactgggcgggggcacaggctctggaatgggcactctccttatcagcaagatccgagaagaataccctgatcgcatcatgaataccttcagtgtggtgccttcacccaaagtgtctgacaccgtggtcgagccctacaatgccaccctctccgtccatcagttggtagagaatactgatgagacctattgcattgacaacgaggccctctatgatatctgcttccgcactctgaagctgaccacaccaacctacggggatctgaaccaccttgtctcagccaccatgagtggtgtcaccacctgcctccgtttccctggccagctcaatgctgacctccgcaagttggcagtcaacatggtccccttcccacgtctccatttctttatgcctggctttgcccctctcaccagccgtggaagccagcagtatcgagctctcacagtgccggaactcacccagcaggtcttcgatgccaagaacatgatggctgcctgtgacccccgccacggccgatacctcaccgtggctgctgtcttccgtggtcggatgtccatgaaggaggtcgatgagcagatgcttaacgtgcagaacaagaacagcagctactttgtggaatggatccccaacaatgtcaagacagccgtctgtgacatcccacctcgtggcctcaagatggcagtcaccttcattggcaatagcacagccatccaggagctcttcaagcgcatctcggagcagttcactgccatgttccgccggaaggccttcctccactggtacacaggcgagggcatggacgagatggagttcaccgaggctgagagcaacatgaacgacctcgtctctgagtatcagcagtaccaggatgccaccgcagaagaggaggaggatttcggtgaggaggccgaagaggaggcctaaggcagagcccccatcacctcaggcttctcagttcccttagccgtcttactcaactgcccctttcctctccctcagaatttgtgtttgctgcctctatcttgttttttgttttttcttctgggggggggtctagaacagtgcctggcacatagtaggcgctcaataaatacttgtttgttgaatgtctcctctctctttccactctgggaaacctaggtttctgccattctgggtgaccctgtatttctttctggtgcccattccatttgtccagttaatacttcctcttaaaaatctccaagaagctgggtctccagatcccatttagaaccaaccaggtgctgaaaacacatgtagataatggccatcatcctaagcccaaagtagaaaatggtagaaggtagtgggtagaagtcactatataaggaaggggatgggattttccattctaaaagttttggagagggaaatccaggctattaaagtcactaaatttctaagtatgtccatttcccatctcagcttcaagggaggtgtcagcagtattatctccactttcaatctccctccaagctctactctggaggagtctgtcccactctgtcaagtggaatccttccctttccaactctacctccctcactcagctcctttcccctgatcagagaaagggatcaagggggttgggaggggggaaagagaccagccttggtccctaagcctccagaaacgtcttcttaatccccaccttttcttactcccaaaaaagaatgaacacccctgactctggagtggtgtatactgccacatcagtgtttgagtcagtccccagaggagaggggaaccctcctccatcttttttgcaacatctcatttcttccttttgctgttgcttcccccctcacacacttggttttgttctatcctacatttgagatttctattttatgttgaacttgctgctttttttcatattgaaaagatgacatcgccccaagagccaaaaataaatgggaattgaaaaaagctg

SEQ ID NO: 33083 - DNA, 2904 bp, Homo sapiens
tggggcggtgcccagcttgggggaaggagagcggcgcttatcgaagtgtggtcgacctccatccgcccaccgagcacttgggacccgctgcacatatccagagcagggaaagctgtggctttctcgggggagcgagtgtctaggggaagggtgtggcaggcccacgggatgccatgccctagaacaacggcctgagcgcttgtggaattaaaatgggagatgtggggccgaggtgggcgaattgggatccctccaggtcaggggttcgagaccatcctgggcaacaaagcgagaccctcccccatgccacgtttctacaaaaaataaaagtaaaaaattagctgggcgtggtggcgcgcgtctgtggtcccagctactcgagaggctgagatgggaggatcggttgagcctgggagttccacgctgtagtcatccgtgattgcaccactgcactgcaggctgggcaacaggaagaccctgtcttaaaaattagaagaagctgggcgcggtggctcacccttgtaatcccagcactttgggaggccaaggtgggcggatcacgaggtcaagagatctagaccatcctggccaacatgttctgggaggtgatcagtgatgaacatggcatcgaccccaccggcacctaccacggggacagcgacctgcagctggaccgcatctctgtgtactacaatgaagccacaggtggcaaatatgttcctcgtgccatcctggtggatctagaacctgggaccatggactctgttcgctcaggtccttttggccagatctttagaccagacaactttgtatttggtcagtctggggcaggtaacaactgggccaaaggccactacacagagggcgccgagctggttgattctgtcctggatgtggtacggaaggaggcagagagctgtgactgcctgcagggcttccagctgacccactcactgggcgggggcacaggctctggaatgggcactctccttatcagcaagatccgagaagaataccctgatcgcatcatgaataccttcagtgtggtgccttcacccaaagtgtctgacaccgtggtcgagccctacaatgccaccctctccgtccatcagttggtagagaatactgatgagacctattgcattgacaacgaggccctctatgatatctgcttccgcactctgaagctgaccacaccaacctacggggatctgaaccaccttgtctcagccaccatgagtggtgtcaccacctgcctccgtttccctggccagctcaatgctgacctccgcaagttggcagtcaacatggtccccttcccacgtctccatttctttatgcctggctttgcccctctcaccagccgtggaagccagcagtatcgagctctcacagtgccggaactcacccagcaggtcttcgatgccaagaacatgatggctgcctgtgacccccgccacggccgatacctcaccgtggctgctgtcttccgtggtcggatgtccatgaaggaggtcgatgagcagatgcttaacgtgcagaacaagaacagcagctactttgtggaatggatccccaacaatgtcaagacagccgtctgtgacatcccacctcgtggcctcaagatggcagtcaccttcattggcaatagcacagccatccaggagctcttcaagcgcatctcggagcagttcactgccatgttccgccggaaggccttcctccactggtacacaggcgagggcatggacgagatggagttcaccgaggctgagagcaacatgaacgacctcgtctctgagtatcagcagtaccaggatgccaccgcagaagaggaggaggatttcggtgaggaggccgaagaggaggcctaaggcagagcccccatcacctcaggcttctcagttcccttagccgtcttactcaactgcccctttcctctccctcagaatttgtgtttgctgcctctatcttgttttttgttttttcttctgggggggggtctagaacagtgcctggcacatagtaggcgctcaataaatacttgtttgttgaatgtctcctctctctttccactctgggaaacctaggtttctgccattctgggtgaccctgtatttctttctggtgcccattccatttgtccagttaatacttcctcttaaaaatctccaagaagctgggtctccagatcccatttagaaccaaccaggtgctgaaaacacatgtagataatggccatcatcctaagcccaaagtagaaaatggtagaaggtagtgggtagaagtcactatataaggaaggggatgggattttccattctaaaagttttggagagggaaatccaggctattaaagtcactaaatttctaagtatgtccatttcccatctcagcttcaagggaggtgtcagcagtattatctccactttcaatctccctccaagctctactctggaggagtctgtcccactctgtcaagtggaatccttccctttccaactctacctccctcactcagctcctttcccctgatcagagaaagggatcaagggggttgggaggggggaaagagaccagccttggtccctaagcctccagaaacgtcttcttaatccccaccttttcttactcccaaaaaagaatgaacacccctgactctggagtggtgtatactgccacatcagtgtttgagtcagtccccagaggagaggggaaccctcctccatcttttttgcaacatctcatttcttccttttgctgttgcttcccccctcacacacttggttttgttctatcctacatttgagatttctattttatgttgaacttgctgctttttttcatattgaaaagatgacatcgccccaagagccaaaaataaatgggaattgaaaaaagctg

SEQ ID NO: 33084 - DNA, 2903 bp, Homo sapiens; identical to SEQ ID NO: 33080

SEQ ID NO: 33085 - DNA, 2632 bp, Homo sapiens; identical to SEQ ID NO: 33077

SEQ ID NO: 33086 - DNA, 2903 bp, Homo sapiens; identical to SEQ ID NO: 33080

SEQ ID NO: 33087 - DNA, 2670 bp, Homo sapiens; identical to SEQ ID NO: 33076

SEQ ID NO: 33088 - DNA, 2903 bp, Homo sapiens
tggggcggtgcccagcttgggggaaggagagcggcgcttatcgaagtgtggtcgacctccatccgcccaccgagcacttgggacccgctgcacatatccagagcagggaaagctgtggctttctcgggggagcgagtgtctaggggaagggtgtggcaggcccacgggatgccatgccctagaacaacggcctgagcgcttgtggaattaaaatgggagatgtggggccgaggtgggcgaattgggatccctccaggtcaggggttcgagaccatcctgggcaacaaagcgagaccctcccccatgccacgtttctacaaaaaataaaagtaaaaaattagctgggcgtggtggcgcgcgtctgtggtcccagctactcgagaggctgagatgggaggatcggttgagcctgggagttccacgctgtagtcatccgtgattgcaccactgcactgcaggctgggcaacaggaagaccctgtcttaaaaattagaagaagctgggcgcggtggctcacccttgtaatcccagcactttgggaggccaaggtgggcggatcacgaggtcaagagatctagaccatcctggccaacatgttctgggaggtgatcagtgatgaacatggcatcgaccccaccggcacctaccacggggacagcgacctgcagctggaccgcatctctgtgtactacaatgaagccacaggtggcaaatatgttcctcgtgccatcctggtggatctagaacctgggaccatggactctgttcgctcaggtccttttggccagatctttagaccagacaactttgtatttggtcagtctggggcaggtaacaactgggccaaaggccactacacagagggcgccgagctggttgattctgtcctggatgtggtacggaaggaggcagagagctgtgactgcctgcagggcttccagctgacccactcactgggcgggggcacaggctctggaatgggcactctccttatcagcaagatccgagaagaataccctgatcgcatcatgaataccttcagtgtggtgccttcacccaaagtgtctgacaccgtggtcgagccctacaatgccaccctctccgtccatcagttggtagagaatactgatgagacctattgcattgacaacgaggccctctatgatatctgcttccgcactctgaagctgaccacaccaacctacggggatctgaaccaccttgtctcagccaccatgagtggtgtcaccacctgcctccgtttccctggccagctcaatgctgacctccgcaagttggcagtcaacatggtccccttcccacgtctccatttctttatgcctggctttgcccctctcaccagccgtggaagccagcagtatcgagctctcacagtgccggaactcacccagcaggtcttcgatgccaagaacatgatggctgcctgtgacccccgccacggccgatacctcaccgtggctgctgtcttccgtggtcggatgtccatgaaggaggtcgatgagcagatgcttaacgtgcagaacaagaacagcagctactttgtggaatggatccccaacaatgtcaagacagccgtctgtgacatcccacctcgtggcctcaagatggcagtcaccttcattggcaatagcacagccatccaggagctcttcaagcgcatctcggagcagttcactgccatgttccgccggaaggccttcctccactggtacacaggcgagggcatggacgagatggagttcaccgaggctgagagcaacatgaacgacctcgtctctgagtatcagcagtaccaggatgccaccgcagaagaggaggaggatttcggtgaggaggccgaagaggaggcctaaggcagagcccccatcacctcaggcttctcagttcccttagccgtcttactcaactgcccctttcctctccctcagaatttgtgtttgctgcctctatcttgttttttgttttttcttctggggggggtctagaacagtgcctggcacatagtaggcgctcaataaatacttgtttgttgaatgtctcctctctctttccactctgggaaacctaggtttctgccattctgggtgaccctgtatttctttctggtgcccattccatttgtccagttaatacttcctcttaaaaatctccaagaagctgggtctccagatcccatttagaaccaaccaggtgctgaaaacacatgtagataatggccatcatcctaagcccaaagtagaaaatggtagaaggtagtgggtagaagtcactatataaggaaggggatgggattttccattctaaaagttttggagagggaaatccaggctattaaagtcactaaatttctaagtatgtccatttcccatctcagcttcaagggaggtgtcagcagtattatctccactttcaatctccctccaagctctactctggaggagtctgtcccactctgtcaagtggaatccttccctttccaactctacctccctcactcagctcctttcccctgatcagagaaagggatcaagggggttgggaggggggaaagagaccagccttggtccctaagcctccagaaacgtcttcttaatccccaccttttcttactcccaaaaaagaatgaacacccctgactctggaatggtgtatactgccacatcagtgtttgagtcagtccccagaggagaggggaaccctcctccatcttttttgcaacatctcatttcttccttttgctgttgcttcccccctcacacacttggttttgttctatcctacatttgagatttctattttgtgttgaacttgctgctttttttcatattgaaaagatgacatcgccccaagagccaaaaataaatgggaattgaaaaaagctg

SEQ ID NO: 33089 - DNA, 2823 bp, Homo sapiens; identical to SEQ ID NO: 33079

SEQ ID NO: 33090 - DNA, 2670 bp, Homo sapiens; identical to SEQ ID NO: 33076

SEQ ID NO: 33091 - DNA, 2670 bp, Homo sapiens; identical to SEQ ID NO: 33076

SEQ ID NO: 33092 - DNA, 2670 bp, Homo sapiens
gtacatgaccggcatcgactaatcagggccaggctcgatgaggctttgtctccctaccgcgcgcggggccgattctcccgcctcccagccccggcgcacgcgcgccccgcccagcctgctttccctccgcgccctcccctctcctttctccctctcagaaccttcctgccgtcgcgtttgcacctcgctgctccagcctctggggcgcattccaaccttccagcctgcgacctgcggagaaaaaaaattacttattttcttgccccatacataccttgaggcgagcaaaaaaattaaattttaaccatgagggaaatcgtgcacatccaggctggtcagtgtggcaaccagatcggtgccaagttctgggaggtgatcagtgatgaacatggcatcgaccccaccggcacctaccacggggacagcgacctgcagctggaccgcatctctgtgtactacaatgaagccacaggtggcaaatatgttcctcgtgccatcctggtggatctagaacctgggaccatggactctgttcgctcaggtccttttggccagatctttagaccagacaactttgtatttggtcagtctggggcaggtaacaactgggccaaaggccactacacagagggcgccgagctggttgattctgtcctggatgtggtacggaaggaggcagagagctgtgactgcctgcagggcttccagctgacccactcactgggcgggggcacaggctctggaatgggcactctccttatcagcaagatccgagaagaataccctgatcgcatcatgaataccttcagtgtggtgccttcacccaaagtgtctgacaccgtggtcgagccctacaatgccaccctctccgtccatcagttggtagagaatactgatgagacctattgcattgacaacgaggccctctatgatatctgcttccgcactctgaagctgaccacaccaacctacggggatctgaaccaccttgtctcagccaccatgagtggtgtcaccacctgcctccgtttccctggccagctcaatgctgacctccgcaagttggcagtcaacatggtccccttcccacgtctccatttctttatgcctggctttgcccctctcaccagccgtggaagccagcagtatcgagctctcacagtgccggaactcacccagcaggtcttcgatgccaagaacatgatggctgcctgtgacccccgccacggccgatacctcaccgtggctgctgtcttccgtggtcggatgtccatgaaggaggtcgatgagcagatgcttaacgtgcagaacaagaacagcagctactttgtggaatggatccccaacaatgtcaagacagccgtctgtgacatcccacctcgtggcctcaagatggcagtcaccttcattggcaatagcacagccatccaggagctcttcaagcgcatctcggagcagttcactgccatgttccgccggaaggccttcctccactggtacacaggcgagggcatggacgagatggagttcaccgaggctgagagcaacatgaacgacctcgtctctgagtatcagcagtaccaggatgccaccgcagaagaggaggaggatttcggtgaggaggccgaagaggaggcctaaggcagagcccccatcacctcaggcttctcagttcccttagccgtcttactcaactgcccctttcctctccctcagaatttgtgtttgctgcctctatcttgttttttgttttttcttctggggggggtctagaacagtgcctggcacatagtaggcgctcaataaatacttgtttgttgaatgtctcctctctctttccactctgggaaacctaggtttctgccattctgggtgaccctgtatttctttctggtgcccattccatttgtccagttaatacttcctcttaaaaatctccaagaagctgggtctccagatcccatttagaaccaaccaggtgctgaaaacacatgtagataatggccatcatcctaagcccaaagtagaaaatggtagaaggtagtgggtagaagtcactatataaggaaggggatgggattttccattctaaaagttttggagagggaaatccaggctattaaagtcactaaatttctaagtatgtccatttcccatctcagcttcaagggaggtgtcagcagtattatctccactttcaatctccctccaagctctactctggaggagtctgtcccactctgtcaagtggaatccttccctttccaactctacctccctcactcagctcctttcccctgatcagagaaagggatcaagggggttgggaggggggaaagagaccagccttggtccctaagcctccagaaacgtcttcttaatccccaccttttcttactcccaaaaaagaatgaacacccctgactctggaatggtgtatactgccacatcagtgtttgagtcagtccccagaggagaggggaaccctcctccatcttttttgcaacatctcatttcttccttttgctgttgcttcccccctcacacacttggttttgttctatcctacatttgagatttctattttgtgttgaacttgctgctttttttcatattgaaaagatgacatcgccccaagagccaaaaataaatgggaattgaaaaaagctg

SEQ ID NO: 33093 - DNA, 1339 bp, Homo sapiens
ccctctcagaaccttcctgccgtcgcgtttgcacctcgctgctccagcctctggggcgcattccaaccttccagcctgcgacctgcggagaaaaaaaattacttattttcttgccccatacataccttgaggcgagcaaaaaaattaaattttaaccatgagggaaatcgtgcacatccaggctggtcagtgtggcaaccagatcggtgccaagttctgggaggtgatcagtgatgaacatggcatcgaccccaccggcacctaccacggggacagcgacctgcagctgacccactcactgggcgggggcacaggctctggaatgggcactctccttatcagcaagatccgagaagaataccctgatcgcatcatgaataccttcagtgtggtgccttcacccaaagtgtctgacaccgtggtcgagccctacaatgccaccctctccgtccatcagttggtagagaatactgatgagacctattgcattgacaacgaggccctctatgatatctgcttccgcactctgaagctgaccacaccaacctacggggatctgaaccaccttgtctcagccaccatgagtggtgtcaccacctgcctccgtttccctggccagctcaatgctgacctccgcaagttggcagtcaacatggtccccttcccacgtctccatttctttatgcctggctttgcccctctcaccagccgtggaagccagcagtatcgagctctcacagtgccggaactcacccagcaggtcttcgatgccaagaacatgatggctgcctgtgacccccgccacggccgatacctcaccgtggctgctgtcttccgtggtcggatgtccatgaaggaggtcgatgagcagatgcttaacgtgcagaacaagaacagcagctactttgtggaatggatccccaacaatgtcaagacagccgtctgtgacatcccacctcgtggcctcaagatggcagtcaccttcattggcaatagcacagccatccaggagctcttcaagcgcatctcggagcagttcactgccatgttccgccggaaggccttcctccactggtacacaggcgagggcatggacgagatggagttcaccgaggctgagagcaacatgaacgacctcgtctctgagtatcagcagtaccaggatgccaccgcagaagaggaggaggatttcggtgaggaggccgaagaggaggcctaaggcagagcccccatcacctcaggcttctcagttcccttagccgtcttactcaactgcccctttcctctccctcagaatttgtgtttgctgcctctatcttgttttttgttttttcttctg

SEQ ID NO: 33094 - DNA, 2903 bp, Homo sapiens; identical to SEQ ID NO: 33080

SEQ ID NO: 33095 - DNA, 2823 bp, Homo sapiens; identical to SEQ ID NO: 33079

SEQ ID NO: 33096 - DNA, 2903 bp, Homo sapiens; identical to SEQ ID NO: 33080

SEQ ID NO: 33097 - DNA, 2903 bp, Homo sapiens; identical to SEQ ID NO: 33080

SEQ ID NO: 33098 - DNA, 2632 bp, Homo sapiens; identical to SEQ ID NO: 33077

SEQ ID NO: 33099 - DNA, 2670 bp, Homo sapiens; identical to SEQ ID NO: 33076

SEQ ID NO: 33100 - DNA, 882 bp, Homo sapiens
agaaccttcctgccgtcgcgtttgcacctcgctgctccagcctctggggcgcattccaaccttccagcctgcgacctgcggagaaaaaaaattacttattttcttgccccatacataccttgaggcgagcaaaaaaattaaattttaaccatgagggaaatcgtgcacatccaggctggtcagtgtggcaaccagatcggtgccaagttctgggaggtgatcagtgatgaacatggcatcgaccccaccggcacctaccacggggacagcgacctgcagctggaccgcatctctgtgtactacaatgaagccacaggtggcaaatatgttcctcgtgccatcctggtggatctagaacctgggaccatggactctgttcgctcaggtccttttggccagatctttagaccagacaactttgtatttggtcagtctggggcaggtaacaactgggccaaaggccactacacagagggcgccgagctggttgattctgtcctggatgtggtacggaaggaggaggtcgatgagcagatgcttaacgtgcagaacaagaacagcagctactttgtggaatggatccccaacaatgtcaagacagccgtctgtgacatcccacctcgtggcctcaagatggcagtcaccttcattggcaatagcacagccatccaggagctcttcaagcgcatctcggagcagttcactgccatgttccgccggaaggccttcctccactggtacacaggcgagggcatggacgagatggagttcaccgaggctgagagcaacatgaacgacctcgtctctgagtatcagcagtaccaggatgccaccgcagaagaggaggaggatttcggtgaggaggccgaagaggaggcctaa

SEQ ID NO: 33101 - DNA, 2632 bp, Homo sapiens
cgcgtgcgccgcagtcacgtggagggcggggggggtggtcgactgcggcggcagctctttcctcagacccccagccttttgtgcgccgcgcggtggggcggtgcccagcttgggggaaggagagcggcgcttatcgaagtgtggtcgacctccatccgcccaccgagcacttgggacccgctgcacatatccagagcagggaaagctgtggctttctcgggggagcgagtgtctaggggaagggtgtggcaggcccacgggatgccatgccctagaacaacggcctgagcgcttgtggaattaaaatgggagatgtggggccgagttctgggaggtgatcagtgatgaacatggcatcgaccccaccggcacctaccacggggacagcgacctgcagctggaccgcatctctgtgtactacaatgaagccacaggtggcaaatatgttcctcgtgccatcctggtggatctagaacctgggaccatggactctgttcgctcaggtccttttggccagatctttagaccagacaactttgtatttggtcagtctggggcaggtaacaactgggccaaaggccactacacagagggcgccgagctggttgattctgtcctggatgtggtacggaaggaggcagagagctgtgactgcctgcagggcttccagctgacccactcactgggcgggggcacaggctctggaatgggcactctccttatcagcaagatccgagaagaataccctgatcgcatcatgaataccttcagtgtggtgccttcacccaaagtgtctgacaccgtggtcgagccctacaatgccaccctctccgtccatcagttggtagagaatactgatgagacctattgcattgacaacgaggccctctatgatatctgcttccgcactctgaagctgaccacaccaacctacggggatctgaaccaccttgtctcagccaccatgagtggtgtcaccacctgcctccgtttccctggccagctcaatgctgacctccgcaagttggcagtcaacatggtccccttcccacgtctccatttctttatgcctggctttgcccctctcaccagccgtggaagccagcagtatcgagctctcacagtgccggaactcacccagcaggtcttcgatgccaagaacatgatggctgcctgtgacccccgccacggccgatacctcaccgtggctgctgtcttccgtggtcggatgtccatgaaggaggtcgatgagcagatgcttaacgtgcagaacaagaacagcagctactttgtggaatggatccccaacaatgtcaagacagccgtctgtgacatcccacctcgtggcctcaagatggcagtcaccttcattggcaatagcacagccatccaggagctcttcaagcgcatctcggagcagttcactgccatgttccgccggaaggccttcctccactggtacacaggcgagggcatggacgagatggagttcaccgaggctgagagcaacatgaacgacctcgtctctgagtatcagcagtaccaggatgccaccgcagaagaggaggaggatttcggtgaggaggccgaagaggaggcctaaggcagagcccccatcacctcaggcttctcagttcccttagccgtcttactcaactgcccctttcctctccctcagaatttgtgtttgctgcctctatcttgttttttgttttttcttctggggggggtctagaacagtgcctggcacatagtaggcgctcaataaatacttgtttgttgaatgtctcctctctctttccactctgggaaacctaggtttctgccattctgggtgaccctgtatttctttctggtgcccattccatttgtccagttaatacttcctcttaaaaatctccaagaagctgggtctccagatcccatttagaaccaaccaggtgctgaaaacacatgtagataatggccatcatcctaagcccaaagtagaaaatggtagaaggtagtgggtagaagtcactatataaggaaggggatgggattttccattctaaaagttttggagagggaaatccaggctattaaagtcactaaatttctaagtatgtccatttcccatctcagcttcaagggaggtgtcagcagtattatctccactttcaatctccctccaagctctactctggaggagtctgtcccactctgtcaagtggaatccttccctttccaactctacctccctcactcagctcctttcccctgatcagagaaagggatcaagggggttgggaggggggaaagagaccagccttggtccctaagcctccagaaacgtcttcttaatccccaccttttcttactcccaaaaaagaatgaacacccctgactctggaatggtgtatactgccacatcagtgtttgagtcagtccccagaggagaggggaaccctcctccatcttttttgcaacatctcatttcttccttttgctgttgcttcccccctcacacacttggttttgttctatcctacatttgagatttctattttgtgttgaacttgctgctttttttcatattgaaaagatgacatcgccccaagagccaaaaataaatgggaattgaaaaaagctg

SEQ ID NO: 33102 - DNA, 2632 bp, Homo sapiens; identical to SEQ ID NO: 33077

SEQ ID NO: 33103 - DNA, 2670 bp, Homo sapiens; identical to SEQ ID NO: 33076

SEQ ID NO: 33104 - DNA, 2632 bp, Homo sapiens; identical to SEQ ID NO: 33077

SEQ ID NO: 33105 - DNA, 2823 bp, Homo sapiens; identical to SEQ ID NO: 33079

SEQ ID NO: 33106 - DNA, 2823 bp, Homo sapiens; identical to SEQ ID NO: 33079

SEQ ID NO: 33107 - DNA, 2823 bp, Homo sapiens
ggcgcttatcgaagtgtggtcgacctccatccgcccaccgagcacttgggacccgctgcacatatccagagcagggaaagctgtggctttctcgggggagcgagtgtctaggggaagggtgtggcaggcccacgggatgccatgccctagaacaacggcctgagcgcttgtggaattaaaatgggagatgtggggccgaggtgggcgaattgggatccctccaggtcaggggttcgagaccatcctgggcaacaaagcgagaccctcccccatgccacgtttctacaaaaaataaaagtaaaaaattagctgggcgtggtggcgcgcgtctgtggtcccagctactcgagaggctgagatgggaggatcggttgagcctgggagttccacgctgtagtcatccgtgattgcaccactgcactgcaggctgggcaacaggaagaccctgtcttaaaaattagaagaagctgggcgcggtggctcacccttgtaatcccagcactttgggaggccaagttctgggaggtgatcagtgatgaacatggcatcgaccccaccggcacctaccacggggacagcgacctgcagctggaccgcatctctgtgtactacaatgaagccacaggtggcaaatatgttcctcgtgccatcctggtggatctagaacctgggaccatggactctgttcgctcaggtccttttggccagatctttagaccagacaactttgtatttggtcagtctggggcaggtaacaactgggccaaaggccactacacagagggcgccgagctggttgattctgtcctggatgtggtacggaaggaggcagagagctgtgactgcctgcagggcttccagctgacccactcactgggcgggggcacaggctctggaatgggcactctccttatcagcaagatccgagaagaataccctgatcgcatcatgaataccttcagtgtggtgccttcacccaaagtgtctgacaccgtggtcgagccctacaatgccaccctctccgtccatcagttggtagagaatactgatgagacctattgcattgacaacgaggccctctatgatatctgcttccgcactctgaagctgaccacaccaacctacggggatctgaaccaccttgtctcagccaccatgagtggtgtcaccacctgcctccgtttccctggccagctcaatgctgacctccgcaagttggcagtcaacatggtccccttcccacgtctccatttctttatgcctggctttgcccctctcaccagccgtggaagccagcagtatcgagctctcacagtgccggaactcacccagcaggtcttcgatgccaagaacatgatggctgcctgtgacccccgccacggccgatacctcaccgtggctgctgtcttccgtggtcggatgtccatgaaggaggtcgatgagcagatgcttaacgtgcagaacaagaacagcagctactttgtggaatggatccccaacaatgtcaagacagccgtctgtgacatcccacctcgtggcctcaagatggcagtcaccttcattggcaatagcacagccatccaggagctcttcaagcgcatctcggagcagttcactgccatgttccgccggaaggccttcctccactggtacacaggcgagggcatggacgagatggagttcaccgaggctgagagcaacatgaacgacctcgtctctgagtatcagcagtaccaggatgccaccgcagaagaggaggaggatttcggtgaggaggccgaagaggaggcctaaggcagagcccccatcacctcaggcttctcagttcccttagccgtcttactcaactgcccctttcctctccctcagaatttgtgtttgctgcctctatcttgttttttgttttttcttctggggggggtctagaacagtgcctggcacatagtaggcgctcaataaatacttgtttgttgaatgtctcctctctctttccactctgggaaacctaggtttctgccattctgggtgaccctgtatttctttctggtgcccattccatttgtccagttaatacttcctcttaaaaatctccaagaagctgggtctccagatcccatttagaaccaaccaggtgctgaaaacacatgtagataatggccatcatcctaagcccaaagtagaaaatggtagaaggtagtgggtagaagtcactatataaggaaggggatgggattttccattctaaaagttttggagagggaaatccaggctattaaagtcactaaatttctaagtatgtccatttcccatctcagcttcaagggaggtgtcagcagtattatctccactttcaatctccctccaagctctactctggaggagtctgtcccactctgtcaagtggaatccttccctttccaactctacctccctcactcagctcctttcccctgatcagagaaagggatcaagggggttgggaggggggaaagagaccagccttggtccctaagcctccagaaacgtcttcttaatccccaccttttcttactcccaaaaaagaatgaacacccctgactctggaatggtgtatactgccacatcagtgtttgagtcagtccccagaggagaggggaaccctcctccatcttttttgcaacatctcatttcttccttttgctgttgcttcccccctcacacacttggttttgttctatcctacatttgagatttctattttgtgttgaacttgctgctttttttcatattgaaaagatgacatcgccccaagagccaaaaataaatgggaattgaaaaaagctg

SEQ ID NO: 33108 - DNA, 2632 bp, Homo sapiens; identical to SEQ ID NO: 33077

SEQ ID NO: 33109 - DNA, 2823 bp, Homo sapiens; identical to SEQ ID NO: 33079

SEQ ID NO: 33110 - DNA, 624 bp, Homo sapiens
atgggcactctccttatcagcaagatccgagaagaataccctgatcgcatcatgaataccttcagtgtggtgccttcacccaaagtgtctgacaccgtggtcgagccctacaatgccaccctctccgtccatcagttggtagagaatactgatgagacctattgcattgacaacgaggccctctatgatatctgcttccgcactctgaagctgaccacaccaacctacggggatctgaaccaccttgtctcagccaccatgagtggtgtcaccacctgcctccgtttccctggccagctcaatgctgacctccgcaagttggcagtcaacatggtccccttcccacgtctccatttctttatgcctggctttgcccctctcaccagccgtggaagccagcagtatcgagctctcacagtgccggaactcacccagcaggtcttcgatgccaagaacatgatggctgcctgtgacccccgccacggccgatacctcaccgtggctgctgtcttccgtggtcggatgtccatgaaggaggtcgatgagcagatgcttaacgtgcagaacaagaacagcagctactttgtggaatggccccaacaatgtcaagacagccgtctgtga

SEQ ID NO: 33111 - DNA, 1395 bp, Homo sapiens
agaaccttcctgccgtcgcgtttgcacctcgctgctccagcctctggggcgcattccaaccttccagcctgcgacctgcggagaaaaaaaattacttattttcttgccccatacataccttgaggcgagcaaaaaaattaaattttaaccatgagggaaatcgtgcacatccaggctggtcagtgtggcaaccagatcggtgccaagttctgggaggtgatcagtgatgaacatggcatcgaccccaccggcacctaccacggggacagcgacctgcagctggaccgcatctctgtgtactacaatgaagccacaggtggcaaatatgttcctcgtgccatcctggtggatctagaacctgggaccatggactctgttcgctcaggtccttttggccagatctttagaccagacaactttgtatttggtcagtctggggcaggtaacaactgcctgcagggcttccagctgacccactcactgggcgggggcacaggctctggaatgggcactctccttatcagcaagatccgagaagaataccctgatcgcatcatgaataccttcagtgtggtgccttcacccaaagtgtctgacaccgtggtcgagccctacaatgccaccctctccgtccatcagttggtagagaatactgatgagacctattgcattgacaacgaggccctctatgatatctgcttccgcactctgaagctgaccacaccaacctacggggatctgaaccaccttgtctcagccaccatgagtggtgtcaccacctgcctccgtttccctggccagctcaatgctgacctccgcaagttggcagtcaacatggtccccttcccacgtctccatttctttatgcctggctttgcccctctcaccagccgtggaagccagcagtatcgagctctcacagtgccggaactcacccagcaggtcttcgatgccaagaacatgatggctgcctgtgacccccgccacggccgatacctcaccgtggctgctgtcttccgtggtcggatgtccatgaaggaggtcgatgagcagatgcttaacgtgcagaacaagaacagcagctactttgtggaatggatccccaacaatgtcaagacagccgtctgtgacatcccacctcgtggcctcaagatggcagtcaccttcattggcaatagcacagccatccaggagctcttcaagcgcatctcggagcagttcactgccatgttccgccggaaggccttcctccactggtacacaggcgagggcatggacgagatggagttcaccgaggctgagagcaacatgaacgacctcgtctctgagtatcagcagtaccaggatgccaccgcagaagaggaggaggatttcggtgaggaggccgaagaggag

SEQ ID NO: 33112 - DNA, 1339 bp, Homo sapiens; identical to SEQ ID NO: 33093

SEQ ID NO: 33113 - DNA, 1339 bp, Homo sapiens; identical to SEQ ID NO: 33093

SEQ ID NO: 33114 - DNA, 1455 bp, Homo sapiens
agaaccttcctgccgtcgcgtttgcacctcgctgctccagcctctggggcgcattccaaccttccagcctgcgacctgcggagaaaaaaaattacttattttcttgccccatacataccttgaggcgagcaaaaaaattaaattttaaccatgagggaaatcgtgcacatccaggctggtcagtgtggcaaccagatcggtgccaagttctgggaggtgatcagtgatgaacatggcatcgaccccaccggcacctaccacggggacagcgacctgcagctggaccgcatctctgtgtactacaatgaagccacaggtggcaaatatgttcctcgtgccatcctggtggatctagaacctgggaccatggactctgttcgctcaggtccttttggccagatctttagaccagacaactttgtatttggtcagtctggggcaggtaacaactgggccaaaggccactacacagagggcgccgagctggttgattctgtcctggatgtggtacggaaggaggcagagagctgtgactgcctgcagggcttccagctgacccactcactgggcgggggcacaggctctggaatgggcactctccttatcagcaagatccgagaagaataccctgatcgcatcatgaataccttcagtgtggtgccttcacccaaagtgtctgacaccgtggtcgagccctacaatgccaccctctccgtccatcagttggtagagaatactgatgagacctattgcattgacaacgaggccctctatgatatctgcttccgcactctgaagctgaccacaccaacctacggggatctgaaccaccttgtctcagccaccatgagtggtgtcaccacctgcctccgtttccctggccagctcaatgctgacctccgcaagttggcagtcaacatggtccccttcccacgtctccatttctttatgcctggctttgcccctctcaccagccgtggaagccagcagtatcgagctctcacagtgccggaactcacccagcaggtcttcgatgccaagaacatgatggctgcctgtgacccccgccacggccgatacctcaccgtggctgctgtcttccgtggtcggatgtccatgaaggaggtcgatgagcagatgcttaacgtgcagaacaagaacagcagctactttgtggaatggatccccaacaatgtcaagacagccgtctgtgacatcccacctcgtggcctcaagatggcagtcaccttcattggcaatagcacagccatccaggagctcttcaagcgcatctcggagcagttcactgccatgttccgccggaaggccttcctccactggtacacaggcgagggcatggacgagatggagttcaccgaggctgagagcaacatgaacgacctcgtctctgagtatcagcagtaccaggatgccaccgcagaaggggggggtcta

SEQ ID NO: 33115 - DNA, 1455 bp, Homo sapiens; identical to SEQ ID NO: 33114

SEQ ID NO: 33116 - DNA, 1455 bp, Homo sapiens; identical to SEQ ID NO: 33114

SEQ ID NO: 33117 - DNA, 1395 bp, Homo sapiens; identical to SEQ ID NO: 33111

SEQ ID NO: 33118 - DNA, 1395 bp, Homo sapiens; identical to SEQ ID NO: 33111

SEQ ID NO: 33119 - DNA, 1395 bp, Homo sapiens; identical to SEQ ID NO: 33111

SEQ ID NO: 33120 - DNA, 1455 bp, Homo sapiens; identical to SEQ ID NO: 33114

SEQ ID NO: 33121 - DNA, 1455 bp, Homo sapiens; identical to SEQ ID NO: 33114

SEQ ID NO: 33122 - DNA, 1455 bp, Homo sapiens; identical to SEQ ID NO: 33114

SEQ ID NO: 33123 - DNA, 1339 bp, Homo sapiens; identical to SEQ ID NO: 33093

SEQ ID NO: 33124 - DNA, 1395 bp, Homo sapiens; identical to SEQ ID NO: 33111

SEQ ID NO: 33125 - DNA, 1458 bp, Homo sapiens
agaaccttcctgccgtcgcgtttgcacctcgctgctccagcctctggggcgcattccaaccttccagcctgcgacctgcggagaaaaaaaattacttattttcttgccccatacataccttgaggcgagcaaaaaaattaaattttaaccatgagggaaatcgtgcacatccaggctggtcagtgtggcaaccagatcggtgccaagttctgggaggtgatcagtgatgaacatggcatcgaccccaccggcacctaccacggggacagcgacctgcagctggaccgcatctctgtgtactacaatgaagccacaggtggcaaatatgttcctcgtgccatcctggtggatctagaacctgggaccatggactctgttcgctcaggtccttttggccagatctttagaccagacaactttgtatttggtcagtctggggcaggtaacaactgggccaaaggccactacacagagggcgccgagctggttgattctgtcctggatgtggtacggaaggaggcagagagctgtgactgcctgcagggcttccagctgacccactcactgggcgggggcacaggctctggaatgggcactctccttatcagcaagatccgagaagaataccctgatcgcatcatgaataccttcagtgtggtgccttcacccaaagtgtctgacaccgtggtcgagccctacaatgccaccctctccgtccatcagttggtagagaatactgatgagacctattgcattgacaacgaggccctctatgatatctgcttccgcactctgaagctgaccacaccaacctacggggatctgaaccaccttgtctcagccaccatgagtggtgtcaccacctgcctccgtttccctggccagctcaatgctgacctccgcaagttggcagtcaacatggtccccttcccacgtctccatttctttatgcctggctttgcccctctcaccagccgtggaagccagcagtatcgagctctcacagtgccggaactcacccagcaggtcttcgatgccaagaacatgatggctgcctgtgacccccgccacggccgatacctcaccgtggctgctgtcttccgtggtcggatgtccatgaaggaggtcgatgagcagatgcttaacgtgcagaacaagaacagcagctactttgtggaatggatccccaacaatgtcaagacagccgtctgtgacatcccacctcgtggcctcaagatggcagtcaccttcattggcaatagcacagccatccaggagctcttcaagcgcatctcggagcagttcactgccatgttccgccggaaggccttcctccactggtacacaggcgagggcatggacgagatggagttcaccgaggctgagagcaacatgaacgacctcgtctctgagtatcagcagtaccaggatgccaccgcagaagaggggggggtctag

SEQ ID NO: 33126 - DNA, 1339 bp, Homo sapiens; identical to SEQ ID NO: 33093

SEQ ID NO: 33127 - DNA, 1339 bp, Homo sapiens; identical to SEQ ID NO: 33093

SEQ ID NO: 33128 - DNA, 1339 bp, Homo sapiens; identical to SEQ ID NO: 33093

SEQ ID NO: 33129 - DNA, 1395 bp, Homo sapiens; identical to SEQ ID NO: 33111

SEQ ID NO: 33130 - DNA, 1395 bp, Homo sapiens; identical to SEQ ID NO: 33111

SEQ ID NO: 33131 - DNA, 1339 bp, Homo sapiens; identical to SEQ ID NO: 33093

SEQ ID NO: 33132 - DNA, 2472 bp, Homo sapiens
agctggagcgttcggtggacagtgagcatgcgtaccatatctgaagttcgtaaattgaaattgaacatgcgtaattaatctttctgaataggaaaaaatatatacacaacaaaactctccgtttatggaacatgcgcatttgttctcagtaagtttttcgttttgaaagtgagcatgcgcatggtgagtaggttggtccgaagtttgaaccggacagaagcgctggtcggcgtctggcggttgtttttagaggtaatacacctagtttgtggctcagcatgtcaattgtaacagtgcaacttggtcagtgtggcaatcagattggttttgaagtttttgatgctttgcttagtgactcacacagttcccagggactctgctctatgagagagaatgaggcatatcaagcatcttgcaaagaaagattcttcagtgaggaggagaatggagttccaattgcccgggctgttcttgttgacatggaacccaaagttatcaatcaaatgctgtcaaaggctgcccagtctggccaatggaaatatggtcaacatgcatgcttctgtcaaaaacaaggttctggaaacaactgggcatatggttactctgttcatggacccaggcatgaagaatctataatgaacataatccggaaggaagtggagaaatgtgactctttcagtggttttttcatcataatgagtatggctgggggcacaggatcaggattaggagctttcgttacacagaatttagaagatcagtactcaaactcattgaaaatgaatcagattatttggccttatggaactggtgaggttattgttcaaaactacaactccattttgacactttctcacttgtaccgatcttcagacgccctccttcttcatgagaatgatgccatccataagatctgtgcaaaactgatgaatatcaagcagatctcctttagtgatatcaatcaagtcctcgcacatcagctgggaagtgtgttccagcctacttattctgcagaaagctcatttcactacagacgaaatccactaggagacttaatggagcatttagttccccatcctgaattcaagatgctgagtgttcgtaacattcctcacatgtctgagaattcattggcatacaccacatttacttgggctggcctcctcaagcatttgagacagatgctcatttctaatgcaaagatggaagaaggtattgataggcatgtatggcctcctttatcaggacttcctcctcttagtaaaatgtctctcaacaaggacctgcattttaacacttccattgctaacttggtcattcttcgtgggaaagatgtgcaaagtgcagatgtggagggatttaaagatccagctctgtatacttcctggttgaagcctgttaatgctttcaacgtgtggaaaacccagcgggcctttagcaaatatgagaagtctgcagtgttggtcagcaacagccagttcttagtaaaaccacttgatatgattgttgggaaggcatggaatatgtttgcttcaaaagcctacattcatcagtacacaaaatttggaatcgaagaagaggactttttagacagtttcacgtcattagagcaggttgttgccagttactgtaatctctgatcttgaacaatgggaaaagtataccttaaggcatttctggactaaaatattttcaatactattttctctgtaaagttttcaaagttctccatcctggctaacacggtgaaacaccgtctctaccagaaaatacaaaaaattagccaggcgcggtggcgggtgcctgtagtcccagctactcgggaggctgaggcaggagaatgacgtgaacccaggaggcggagcttgcagtgagccgagatcgcgccactgcactccagcctgggcgacagagcgagactccgtctcaaaaaaaaaaaaaaaaaaaaatgttttcaaagttccattctgttaaagtaaccacgtagaatgctgagtctattctgcatactatgcccacagaaaaggaagaaaactttttaaaatggagaatcgcatgttttcaatgaaaacattcacttggtatttcatttgtaagaaaaaaaaatggtgcttttataaagaactttggggaaacactttgctgaaatgttgggactctggaactagccaagaaaagagaatattctctttgtctacatgttcctaaatctttactccaaaacaactccaaaaacaactcacaaagcatgaaccaaactttcacagcataatttcaagctaaggaattgtaattctgtacttaatatattcatgtttgaaatgaatgctttgaaccacaggagggagatgttgtcaaatgctacagtgtgaacatgtattttgaatattctgtaacagggcaagtttccactctaagcagctatttaaaaataaatatgaggattttggtaataaatgcttatgcttaagt

SEQ ID NO: 33133 - DNA, 2307 bp, Homo sapiens
agctggagcgttcggtggacagtgagcatgcgtaccatatctgaagttcgtaaattgaaattgaacatgcgtaattaatctttctgaataggaaaaaatatatacacaacaaaactctccgtttatggaacatgcgcatttgttctcagtaagtttttcgttttgaaagtgagcatgcgcatggtgagtaggttggtccgaagtttgaaccggacagaagcgctggtcggcgtctggcggttgtttttagaggtaatacacctagtttgtggctcagcatgtcaattgtaacagtgcaacttggtcagtgtggcaatcagattggttttgaagtttttgatgctttgcttagtgactcacacagttcccagggactctgctctatgagagagaatgaggcatatcaagcatcttgcaaagaaagattcttcagtgaggaggagaatggagttccaattgcccgggctgttcttgttgacatggaacccaaagttatcaatcaaatgctgtcaaaggctgcccagtctggccaatggaaatatggtcaacatgcatgcttctgtcaaaaacaaggttctggaaacaactgggcatatggttactctgttcatggacccaggcatgaagaatctataatgaacataatccggaaggaagtggagaaatgtgactctttcagtggttttttcatcataatgagtatggctgggggcacaggatcaggattaggagctttcgttacacagaatttagaagatcagtactcaaactcattgaaaatgaatcagattatttggccttatggaactggtgaggttattgttcaaaactacaactccattttgacactttctcacttgtaccgatcttcagacgccctccttcttcatgagaatgatgccatccataagatctgtgcaaaactgatgaatatcaagcagatctcctttagtgatatcaatcaagtcctcgcacatcagctgggaagtgtgttccagcctacttattctgcagaaagctcatttcactacagacgaaatccactaggtattgataggcatgtatggcctcctttatcaggacttcctcctcttagtaaaatgtctctcaacaaggacctgcattttaacacttccattgctaacttggtcattcttcgtgggaaagatgtgcaaagtgcagatgtggagggatttaaagatccagctctgtatacttcctggttgaagcctgttaatgctttcaacgtgtggaaaacccagcgggcctttagcaaatatgagaagtctgcagtgttggtcagcaacagccagttcttagtaaaaccacttgatatgattgttgggaaggcatggaatatgtttgcttcaaaagcctacattcatcagtacacaaaatttggaatcgaagaagaggactttttagacagtttcacgtcattagagcaggttgttgccagttactgtaatctctgatcttgaacaatgggaaaagtataccttaaggcatttctggactaaaatattttcaatactattttctctgtaaagttttcaaagttctccatcctggctaacacggtgaaacaccgtctctaccagaaaatacaaaaaattagccaggcgcggtggcgggtgcctgtagtcccagctactcgggaggctgaggcaggagaatgacgtgaacccaggaggcggagcttgcagtgagccgagatcgcgccactgcactccagcctgggcgacagagcgagactccgtctcaaaaaaaaaaaaaaaaaaaaatgttttcaaagttccattctgttaaagtaaccacgtagaatgctgagtctattctgcatactatgcccacagaaaaggaagaaaactttttaaaatggagaatcgcatgttttcaatgaaaacattcacttggtatttcatttgtaagaaaaaaaaatggtgcttttataaagaactttggggaaacactttgctgaaatgttgggactctggaactagccaagaaaagagaatattctctttgtctacatgttcctaaatctttactccaaaacaactccaaaaacaactcacaaagcatgaaccaaactttcacagcataatttcaagctaaggaattgtaattctgtacttaatatattcatgtttgaaatgaatgctttgaaccacaggagggagatgttgtcaaatgctacagtgtgaacatgtattttgaatattctgtaacagggcaagtttccactctaagcagctatttaaaaataaatatgaggattttggtaataaatgcttatgcttaagt

SEQ ID NO: 33134 - DNA, 1710 bp, Homo sapiens
agctggagcgttcggtggacagtgagcatgcgtaccatatctgaagttcgtaaattgaaattgaacatgcgtaattaatctttctgaataggaaaaaatatatacacaacaaaactctccgtttatggaacatgcgcatttgttctcagtaagtttttcgttttgaaagtgagcatgcgcatggtgagtaggttggtccgaagtttgaaccggacagaagcgctggtcggcgtctggcggttgtttttagaggtaatacacctagtttgtggctcagcatgtcaattgtaacagtgcaacttggtcagtgtggcaatcagattggttttgaagtttttgatgctttgcttagtgactcacacagttcccagggactctgctctatgagagagaatgaggcatatcaagcatcttgcaaagaaagattcttcagtgaggaggagaatggaggtattgataggcatgtatggcctcctttatcaggacttcctcctcttagtaaaatgtctctcaacaaggacctgcattttaacacttccattgctaacttggtcattcttcgtgggaaagatgtgcaaagtgcagatgtggagggatttaaagatccagctctgtatacttcctggttgaagcctgttaatgctttcaacgtgtggaaaacccagcgggcctttagcaaatatgagaagtctgcagtgttggtcagcaacagccagttcttagtaaaaccacttgatatgattgttgggaaggcatggaatatgtttgcttcaaaagcctacattcatcagtacacaaaatttggaatcgaagaagaggactttttagacagtttcacgtcattagagcaggttgttgccagttactgtaatctctgatcttgaacaatgggaaaagtataccttaaggcatttctggactaaaatattttcaatactattttctctgtaaagttttcaaagttctccatcctggctaacacggtgaaacaccgtctctaccagaaaatacaaaaaattagccaggcgcggtggcgggtgcctgtagtcccagctactcgggaggctgaggcaggagaatgacgtgaacccaggaggcggagcttgcagtgagccgagatcgcgccactgcactccagcctgggcgacagagcgagactccgtctcaaaaaaaaaaaaaaaaaaaaatgttttcaaagttccattctgttaaagtaaccacgtagaatgctgagtctattctgcatactatgcccacagaaaaggaagaaaactttttaaaatggagaatcgcatgttttcaatgaaaacattcacttggtatttcatttgtaagaaaaaaaaatggtgcttttataaagaactttggggaaacactttgctgaaatgttgggactctggaactagccaagaaaagagaatattctctttgtctacatgttcctaaatctttactccaaaacaactccaaaaacaactcacaaagcatgaaccaaactttcacagcataatttcaagctaaggaattgtaattctgtacttaatatattcatgtttgaaatgaatgctttgaaccacaggagggagatgttgtcaaatgctacagtgtgaacatgtattttgaatattctgtaacagggcaagtttccactctaagcagctatttaaaaataaatatgaggattttggtaataaatgcttatgcttaagt

SEQ ID NO: 33135 - DNA, 1154 bp, Homo sapiens
catgtcaattgtaacagtgcaacttggtcagtgtggcaatcagattggttttgaagtttttgatgctttgcttagtgactcacacagttcccagggactctgctctatgagagagaatgaggcatatcaagcatcttgcaaagaaagattcttcagtgaggaggagaatggagttccaattgcccgggctgttcttgttgacatggaacccaaagttatcaatcaaatgctgtcaaaggctgcccagtctggccaatggaaatatggtcaacatgcatgcttctgtcaaaaacaaggttctggaaacaactgggcatatggttactctgttcatggacccaggcatgaagaatctataatgaacataatccggaaggaagtggagaaatgtgactctttcagtggttttttcatcataatgagtatggctgggggcacaggatcaggattaggagctttcgttacacagaatttagaagatcagtactcaaactcattgaaaatgaatcagattatttggccttatggaactggtgaggttattgttcaaaactacaactccattttgacactttctcacttgtaccgatcttcagacgccctccttcttcatgagaatgatgccatccataagatctgtgcaaaactgatgaatatcaagcagatctcctttagtgatatcaatcaagtcctcgcacatcagctgggaagtgtgttccagcctacttattctgcagaaagctcatttcactacagacgaaatccactagagggatttaaagatccagctctgtatacttcctggttgaagcctgttaatgctttcaacgtgtggaaaacccagcgggcctttagcaaatatgagaagtctgcagtgttggtcagcaacagccagttcttagtaaaaccacttgatatgattgttgggaaggcatggaatatgtttgcttcaaaagcctacattcatcagtacacaaaatttggaatcgaagaagaggactttttagacagtttcacgtcattagagcaggttgttgccagttactgtaatctctgatcttgaacaatgggaaaagtataccttaaggcatttctggactaaaatattttcaatactattttctctgtaaagttttcaaagttctccatcctgg

SEQ ID NO: 33136 - DNA, 1680 bp, Homo sapiens
atctttctgaataggaaaaaatatatacacaacaaaactctccgtttatggaacatgcgcatttgttctcagtaagtttttcgttttgaaagtgagcatgcgcatggtgagtaggttggtccgaagtttgaaccggacagaagcgctggtcggcgtctggcggttgtttttagaggtaatacacctagtttgtggctcagcatgtcaattgtaacagtgcaacttggtcagtgtggcaatcagattggttttgaagtttttgatgctttgcttagtgactcacacagttcccagggactctgctctatgagagagaatgaggcatatcaagcatcttgcaaagaaagattcttcagtgaggaggagaatggagttccaattgcccgggctgttcttgttgacatggaacccaaagttatcaatcaaatgctgtcaaaggctgcccagtctggccaatggaaatatggtcaacatgcatgcttctgtcaaaaacaaggttctggaaacaactgggcatatggttactctgttcatggacccaggcatgaagaatctataatgaacataatccggaaggaagtggagaaatgtgactctttcagtggttttttcatcataatgagtatggctgggggcacaggatcaggattaggagctttcgttacacagaatttagaagatcagtactcaaactcattgaaaatgaatcagattatttggccttatggaactggtgaggttattgttcaaaactacaactccattttgacactttctcacttgtaccgatcttcagacgccctccttcttcatgagaatgatgccatccataagatctgtgcaaaactgatgaatatcaagcagatctcctttagtgatatcaatcaagtcctcgcacatcagctgggaagtgtgttccagcctacttattctgcagaaagctcatttcactacagacgaaatccactaggagacttaatggagcatttagttccccatcctgaattcaagatgctgagtgttcgtaacattcctcacatgtctgagaattcattggcatacaccacatttacttgggctggcctcctcaagcatttgagacagatgctcatttctaatgcaaagatggaagaaggtattgataggcatgtatggcctcctttatcaggacttcctcctcttagtaaaatgtctctcaacaaggacctgcattttaacacttccattgctaacttggtcattcttcgtgggaaagatgtgcaaagtgcagatgtgggtaagaaattcagagcctacattcatcagtacacaaaatttggaatcgaagaagaggactttttagacagtttcacgtcattagagcaggttgttgccagttactgtaatctctgatcttgaacaatgggaaaagtataccttaaggcatttctggactaaaatattttcaatactattttctctgtaaagttttcaaagttctccatcctggctaacacggtgaaacaccgtctctaccagaaaatacaaaaaattagccaggcgcggtggcgggtgcctgtagtcccagctactcgggaggctgaggcaggagaatgacgtgaacccaggaggcggagcttgcagtgagccgagatcgcgccactgcactccagcctgggcgacagagcgagactccgtctc

SEQ ID NO: 33137 - DNA, 1027 bp, Homo sapiens
gaagttcgtaaattgaaattgaacatgcgtaattaatctttctgaataggaaaaaatatatacacaacaaaactctccgtttatggaacatgcgcatttgttctcagtaagtttttcgttttgaaagtgagcatgcgcatggtgagtaggttggtccgaagtttgaaccggacagaagcgctggtcggcgtctggcggttattgttcaaaactacaactccattttgacactttctcacttgtaccgatcttcagacgccctccttcttcatgagaatgatgccatccataagatctgtgcaaaactgatgaatatcaagcagatctcctttagtgatatcaatcaagtcctcgcacatcagctgggaagtgtgttccagcctacttattctgcagaaagctcatttcactacagacgaaatccactaggagacttaatggagcatttagttccccatcctgaattcaagatgctgagtgttcgtaacattcctcacatgtctgagaattcattggcatacaccacatttacttgggctggcctcctcaagcatttgagacagatgctcatttctaatgcaaagatggaagaaggtattgataggcatgtatggcctcctttatcaggacttcctcctcttagtaaaatgtctctcaacaaggacctgcattttaacacttccattgctaacttggtcattcttcgtgggaaagatgtgcaaagtgcagatgtggagggatttaaagatccagctctgtatacttcctggttgaagcctgttaatgctttcaacgtgtggaaaacccagcgggcctttagcaaatatgagaagtctgcagtgttggtcagcaacagccagttcttagtaaaaccacttgatatgattgttgggaaggcatggaatatgtttgcttcaaaagcctacattcatcagtacacaaaatttggaatcgaagaagaggactttttagacagtttcacgtcattagagcaggttgttgccagttactgtaatctctgatcttg

SEQ ID NO: 33138 - DNA, 1577 bp, Homo sapiens
attgtcagctggagcgttcggtggacagtgagcatgcgtaccatatctgaagttcgtaaattgaaattgaacatgcgtaattaatctttctgaataggaaaaaatatatacacaacaaaactctccgtttatggaacatgcgcatttgttctcagtaagtttttcgttttgaaagtgagcatgcgcatggtgagtaggttggtccgaagtttgaaccggacagaagcgctggtcggcgtctggcggttgtttttagaggtaatacacctagtttgtggctcagcatgtcaattgtaacagtgcaacttggtcagtgtggcaatcagattggttttgaagtttttgatgctttgcttagtgactcacacagttcccagggactctgctctatgagagagaatgaggcatatcaagcatcttgcaaagaaagattcttcagtgaggaggagaatggagttccaattgcccgggctgttcttgttgacatggaacccaaagttatcaatcaaatgctgtcaaaggctgcccagtctggccaatggaaatatggtcaacatgcatgcttctgtcaaaaacaaggttctggaaacaactgggcatatggtagagacaaggattcagcatgttacccagactggtctggaactcctggcctccagtgatccacctgcctcggcctcccaaagtgctgagattacagttactctgttcatggacccaggcatgaagaatctataatgaacataatccggaaggaagtggagaaatgtgactctttcagtggttttttcatcataatgagtatggctgggggcacaggatcaggattaggagctttcgttacacagaatttagaagatcagtactcaaactcattgaaaatgaatcagattatttggccttatggaactggtgaggttattgttcaaaactacaactccattttgacactttctcacttgtaccgatcttcagacgccctccttcttcatgagaatgatgccatccataagatctgtgcaaaactgatgaatatcaagcagatctcctttagtgatatcaatcaagtcctcgcacatcagctgggaagtgtgttccagcctacttattctgcagaaagctcatttcactacagacgaaatccactaggtattgataggcatgtatggcctcctttatcaggacttcctcctcttagtaaaatgtctctcaacaaggacctgcattttaacacttccattgctaacttggtcattcttcgtgggaaagatgtgcaaagtgcagatgtggagggatttaaagatccagctctgtatacttcctggttgaagcctgttaatgctttcaacgtgtggaaaacccagcgggcctttagcaaatatgagaagtctgcagtgttggtcagcaacagccagttcttagtaaaaccacttgatatgattgttgggaaggcatggaatatgtttgcttcaaaagcctacattcatcagtacacaaaatttggaatcgaagaagaggactttttagacagtttcacgtcattagagcaggttgttgccagttactgtaatctctga

SEQ ID NO: 33139 - DNA, 726 bp, Homo sapiens
agcggccgcgggctagcaagctcccggagccggcggcgcaccaccatgacccagtcggtggtcgtacaggtcggccagtgcggaaaccagatcggctgctgcttctgggacctggcactaagggagcacgccgcggtcaaccagaaaggaatttatgatgaggcaataagcagcttctttagaaatgtggacaccagagtggttggtgatggtggaagtatttccaagggaaaaatatgttctttaaaagcacgagcagtcttgattgatatggaagaaggggtagtgaatgaaattctgcagggaccactgagagatgtatttgatacgaaacagctcatcactgatatttctggctcaggaaataattgggccgtgggtcacaaagttttcggcagtctttaccaagaccagattttagagaaattcagaaagtcggcagagcactgtgattgcttgcagtgtttctttataatacattccatgggaggaggtaaaatttttcactcatttgcctgtaacagtgttaaaggataagtgggaattcattttgcaaacgtaagtcttgtttttagacctgtgcttgataaagatagaactattcggagggtgtgtagtttgagtatataaacatacacctttttatcttaaaattttgtggaattatgtcactattttcttttcttttctttttttttttttttaatgtaagccctcttaagagtc

SEQ ID NO: 33140 - DNA, 2050 bp, Homo sapiens
atggaatcagaccaaaggaaagtggttggtgatggtggaagtatttccaagggaaaaatatgttctttaaaagcacgagcagtcttgattgatatggaagaaggggtagtgaatgaaattctgcagggaccactgagagatgtatttgatacgaaacagctcatcactgatatttctggctcaggaaataattgggccgtgggtcacaaagttttcggcagtctttaccaagaccagattttagagaaattcagaaagtcggcagagcactgtgattgcttgcagtgtttctttataatacattccatgggaggaggaacaggatctggacttggcacatttcttttaaaggtgcttgaagacgaattcccagaagtatacagatttgtgacttccatttatccttctggtgaggatgatgtcataacctcaccttataatagcatcttggcaatgaaggaacttaatgagcatgcagactgtgtattgcccattgacaatcaatctttatttgacatcattagcaaaatcgacctcatggtgaattctggaaagttgggtacaactgtgaagccaaagagtctggttacttcaagttctggggctttaaaaaagcagcataagaagccctttgatgcaatgaataacattgtggcaaatttgctcctcaacctaacgagctctgcaagatttgaagggtcccttaatatggaccttaatgaaatcagcatgaatttagttccttttcctcaacttcattatctcgtgtcaagcctaacacctctgtatacactgacagatgttaacattcctcctagaagattggatcagatgttttcagatgcctttagtaaagatcaccagctgcttcgggcagaccccaaacacagtctttacctcgcctgtgcactcatggttagaggaaatgtacaaatttcagatcttcgtagaaatattgaaagattaaaaccatctctacaatttgtctcctggaatcaagaaggctggaagaccagcctgtgttccgtacctcctgtgggccattctcattcgttattagctttagcaaataacacatgtgtgaagcccaccttcatggaactgaaagagagattcatgaggctctacaagaaaaaggctcaccttcatcactatctacaagttgaagggatggaagaaagctgtttcacagaagctgtgtcatctttatcagcactcatacaggaatatgaccaactggacgccacaaaaaacatgcctgtgcaggatttacccagactaagcatagctatgtgaaaaagaaaccctcaaaaatactttcttaatttcacattgttttttctgacctttctgtttcaacatttttgtaatttggaaactccagttttttcatattatcgggaaatatttttgtctaaaagagtgatttctgtttaatcgcaatttgttggtaataccaatgtgtgaaattagtgaaatcttagtaccttaacttcaaacatttctcttcagaaaagttcccttttctaaaattgagataacatagttcttgaatattttgctgtatttatagcctcatatttaggcatttatgcactgatgtgtcttcaataaaaatcttgtacagatatatttttataattatttataatttatattttgatattctatttaagttatcctgattctttaaaagtagttattgggagtagaagaacacaatataaatatttccgtgtaatagccaccaacttttcaggcataggttttattacaactgttaaggaggttttgcttcttctttagataacaacttgtttgcccaaaagaatcctaatttgtacacttaacatgtatttgtattaaactttttaaataattgctttcttatcaaaccaattgattttataataaatgtctatatttttcaacagtgctacttgttattgttctgcatgacatttatgcaaatgaacagaatgttactaagcttgatatcttccaaactttgcaataaatggctataattgttccggttactataatcttc

SEQ ID NO: 33141 - DNA, 2142 bp, Homo sapiens
ctctagcagagcgccgttgctgggggaatgcagaagcggccgcgggctagcaagctcccggagccggcggcgcaccaccatgacccagtcggtggtcgtacaggtcggccagtgcggaaaccagatcggctgctgcttctgggacctggcactaagggagcacgccgcggtcaaccagaaaggaatttatgatgaggcaataagcagcttctttagaaatgtggacaccagagtggttggtgatggtggaagtatttccaagggaaaaatatgttctttaaaagcacgagcagtcttgattgatatggaagaaggggtagtgaatgaaattctgcagggaccactgagagatgtatttgatacgaaacagctcatcactgatatttctggctcaggaaataattgggccgtgggtcacaaagttttcggcagtctttaccaagaccagattttagagaaattcagaaagtcggcagagcactgtgattgcttgcagtgtttctttataatacattccatgggaggaggaacaggatctggacttggcacatttcttttaaaggtgcttgaagacgaattcccagaagtatacagatttgtgacttccatttatccttctggtgaggatgatgtcataacctcaccttataatagcatcttggcaatgaaggaacttaatgagcatgcagactgtgtattgcccattgacaatcaatctttatttgacatcattagcaaaatcgacctcatggtgaattctggaaagttgggtacaactgtgaagccaaagagtctggttacttcaagttctggggctttaaaaaagcagcataagaagccctttgatgcaatgaataacattgtggcaaatttgctcctcaacctaacgagctctgcaagatttgaagggtcccttaatatggaccttaatgaaatcagcatgaatttagttccttttcctcaacttcattatctcgtgtcaagcctaacacctctgtatacactgacagatgttaacattcctcctagaagattggatcagatgttttcagatgcctttagtaaagatcaccagctgcttcgggcagaccccaaacacagtctttacctcgcctgtgcactcatggttagaggaaatgtacaaatttcagatcttcgtagaaatattgaaagattaaaaccatctctacaatttgtctcctggaatcaagaaggctggaagaccagcctgtgttccgtacctcctgtgggccattctcattcgttattagctttagcaaataacacatgtgtgaagcccaccttcatggaactgaaagagagattcatgaggctctacaagaaaaaggctcaccttcatcactatctacaagttgaagggatggaagaaagctgtttcacagaagctgtgtcatctttatcagcactcatacaggaatatgaccaactggacgccacaaaaaacatgcctgtgcaggatttacccagactaagcatagctatgtgaaaaagaaaccctcaaaaatactttcttaatttcacattgttttttctgacctttctgtttcaacatttttgtaatttggaaactccagttttttcatattatcgggaaatatttttgtctaaaagagtgatttctgtttaatcgcaatttgttggtaataccaatgtgtgaaattagtgaaatcttagtaccttaacttcaaacatttctcttcagaaaagttcccttttctaaaattgagataacatagttcttgaatattttgctgtatttatagcctcatatttaggcatttatgcactgatgtgtcttcaataaaaatcttgtacagatatatttttataattatttataatttatattttgatattctatttaagttatcctgattctttaaaagtagttattgggagtagaagaacacaatataaatatttccgtgtaatagccaccaacttttcaggcataggttttattacaactgttaaggaggttttgcttcttctttagataacaacttgtttgcccaaaagaatcctaatttgtacacttaacatgtatttgtattaaactttttaaataattgctttcttatcaaaccaattgattttataataaatgtctatatttttcaa

SEQ ID NO: 33142 - DNA, 625 bp, Homo sapiens
ggtgaccatggaatcagaccaaaggaaagtggttggtgatggtggaagtatttccaagggaaaaatatgttctttaaaagcacgagcagtcttgattgatatggaagaaggggtagtgaatgaaattctgcagggaccactgagagatgtatttgatacgaaacagctcatcactgatatttctggctcaggaaataattgggccgtgggtcacaaagttttcggcagtctttaccaagaccagattttagagaaattcagaaagtcggcagagcactgtgattgcttgcagtgtttctttataatacattccatgggaggaggaacaggatctggacttggcacatttcttttaaaggtgcttgaagacgaattcccagaagtatacagatttgtgacttccatttatccttctggtgaggatgatgtcataacctcaccttataatagcatcttggcaatgaaggaacttaatgagcatgcagactgtgtattgcccattgacaatcaatctttatttgacatcattagcaaaatcgacctcatggtgaattctggaaagttgggtacaactgtgaagccaaagagtctggttacttcaagttctggggctttaaaaaagcag

SEQ ID NO: 33143 - DNA, 1949 bp, Homo sapiens
acaacatccggggccgtggcccgacaagtcacaataacagcaactgcgcagatgcgcgattcggcgggggaggtggcttcgcaccacagcgcgcttgcgcgcaggcccaagcaggcgcccacccagaggggagggaggacgccgtaccccgccctcactgaggcgcggagccggatccggaggcgccgagccgcatccggagccgcgcacgcgcaatctgcatgaacgaaggccagtgcttaaagacgtgccattcattgccagaactcgattctcattggagcggaggaagttcgtgggtggagctggttgtttggcgcctgcgtcttgcggcgagcgggctggcgtgcggcgccgttgcgggcgggagcggctgcaacgccggtgcctgaggagcgatgccgagggaaatcatcaccctacagttgggccagtgcggcaatcagattgggttcgagttctggaaacagctgtgcgccgagcatggtatcagccccgagggcatcgtggaggagttcgccaccgagggcactgaccgcaaggacgtctttttctaccaggcagacgatgagcactacatcccccgggccgtgctgctggacttggaaccccgggtgatccactccatcctcaactccccctatgccaagctctacaacccagagaacatctacctgtcggaacatggaggaggagctggcaacaactgggccagcggattctcccagggagaaaagatccatgaggacatttttgacatcatagaccgggaggcagatggtagtgacagtctagagggctttgtgctgtgtcactccattgctggggggacaggctctggactgggttcctacctcttagaacggctgaatgacaggtatcctaagaagctggtgcagacatactcagtgtttcccaaccaggacgagatgagcgatgtggtggtccagccttacaattcactcctcacactcaagaggctgacgcagaatgcagactgtgtggtggtgctggacaacacagccctgaaccggattgccacagaccgcctgcacatccagaacccatccttctcccagatcaaccagctggtgtctaccatcatgtcagccagcaccaccaccctgcgctaccctggctacatgaacaatgacctcatcggcctcatcgcctcgctcattcccaccccacggctccacttcctcatgaccggctacacccctctcactacggaccagtcagtggccagcgtgaggaagaccacggtcctggatgtcatgaggcggctgctgcagcccaagaacgtgatggtgtccacaggccgagaccgccagaccaaccactgctacatcgccatcctcaacatcatccagggagaggtggaccccacccaggtccacaagagcttgcagaggatccgggaacgcaagttggccaacttcatcccgtggggccccgccagcatccaggtggccctgtcgaggaagtctccctacctgccctcggcccaccgggtcagcgggctcatgatggccaaccacaccagcatctcctcgctcttcgagagaacctgtcgccagtatgacaagctgcgtaagcgggaggccttcctggagcagttccgcaaggaggacatgttcaaggacaactttgatgagatggacacatccagggagattgtgcagcagctcatcgatgagtaccatgcggccacacggccagactacatctcctggggcacccaggagcagtgagtcccccaggacagggaccctcatctgccttactggttggcccaagccctgcctgactgaccaccccctcagagcacagatcagggacctcacgcatctctttctcatatacatggactctctgttggcctgcaaacacatttacttctcctcttatgagactatttatctttaataaagcactggatataaatc

SEQ ID NO: 33144 - DNA, 1815 bp, Homo sapiens
aggagcgggcgtggcctgactctgcgcctgtgcggaattccagctgcgactgctgagggagaaaatgatgcccaggttgggctccccggcccaccggccgaggagaggcctgcgctgcacacgcgcagaccgagcatccgcgtcaagaggcgaagagagcgcgcgctccccacgtcctgcgctcctggctgccgggcattcgtctcagccgtgactctcgccaggccggggctggcgcgcccacgtctgaagagcgatgccccgggagatcatcaccctgcagctgggccagtgcggcaaccagattgggttcgagttctggaaacagctgtgcgccgagcatggtatcagccccgagggcatcgtggaggaattcgccaccgagggcactgaccgcaaggacgtctttttctaccaggcagacgatgagcactacatcccccgggccgtgctgctggacttggaaccccgggtgatccactccatcctcaactccccctatgccaagctctacaacccagagaacatctacctgtcggaacatggaggaggagctggcaacaactgggccagcggattctcccagggtgagaaaattcatgaagacatctttgacatcatagaccgagaagcagatggaagtgacagtttggagggcttcgtgctgtgtcactccatcgctgggggtacgggttctggcctgggctcctacctcctggagcgactgaatgacaggtaccccaagaagctagtgcagacttattcagtgtttccctaccaggacgagatgagcgacgtagtggttcagccctacaattcactcctgacactcaagaggctgacgcagaacgcagattgtgtggtggtgctggacaacacagccctgaaccggattgccacagaccgcctgcacatccagaacccgtccttctcccagatcaaccagctggtgtccaccatcatgtcggccagcaccaccaccctgcgctaccccggctacatgaacaatgacctcatcggcctcatcgcctcgctcattcccaccccacggctccacttcctcatgaccggctacaccccgctcactacagaccagtcagtggccagcgtgaggaagaccacggtcctggatgtcatgaggcggctgctgcagcccaagaacgtgatggtgtccacaggccgagaccgccagaccaaccactgctacatcgccatcctcaacatcatccagggagaggtggaccccacccaggtccacaagagcctgcagaggatccgggaacggaagttggccaacttcatcccgtggggccccgccagcatccaggtggccctgtcgaggaagtctccctacctgccctcggcccaccgggtcagcgggctcatgatggccaaccacaccagcatctcctcgctctttgaaagttcctgccagcagtttgacaagctgcggaagcgggatgccttcctcgagcagttccgtaaggaggacatgttcaaggacaactttgatgagatggacaggtctagggaggttgttcaggagctcattgatgagtaccatgcggccacccagccagactacatttcctggggcacccaggagcagtgatttccctccccactactccttctccttctagatggtaaccacagcctcgaccatgcctgctccctctgacccagcttcacctcatggacaacccttcttggttcatctccagcccgtgagctggtcctgcttcctcccttccatgccctaacttttaatatgcttgttcagctctaataaagtaataaagcttggttgtcagt

SEQ ID NO: 33145 - DNA, 3067 bp, Homo sapiens
ccgggcgggagtagctggtggaccccgttgagctgccgaacttccgggactcccccgcgaccccttcccagcttcccgtccgctccgccgcagcgattgtctcggtgggttgattcggcacaaaccgcccgacccaggggccggtgcgcgtgtggaaggggaagcactcccctcgtggtcgcctggaggtgcgctggaggagggggtgacataaccagggactcgaggtccgccgtgggaatgatccacgaactgctcttggctctgagcgggtaccctgggtccattttcacctggaacaagcggagtggcctgcaggtatcgcaggacttccctttcctccaccccagtgagaccagtgtcctgaatcgactctgccggctcggcacagactatattcgcttcactgagttcattgaacagtacacgggccatgtgcaacagcaggatcaccatccatctcaacagggccaaggtgggttacatggaatctacctgcgggccttctgcacagggctggattctgttttgcagccttatcgccaagcactgcttgatttggaacaagagttcctgggtgatccccatctctccatatcacatgtcaactacttcctagaccagttccagcttctttttccctctgtgatggttgtagtagaacaaattaaaagtcaaaagattcatggttgtcaaatcctggaaacagtctacaaacacagctgtggggggttgcctcctgttcgaagtgcactggaaaaaatcctggccgtttgtcatggggtcatgtataaacagctctcagcctggatgctccatggactcctcttggaccagcatgaagaattctttatcaaacaggggccatcttctggtaatgtcagtgcccagccagaagaggacgaggaggatctgggcattgggggactgacaggaaaacaactgagagaactgcaggacttgcgcctgattgaggaagagaacatgctggcaccatctctgaagcagttttccctacgagtggagattttgccatcctacattccagtgagggttgctgaaaaaatcctatttgttggagaatctgtccagatgtttgagaatcaaaatgtgaacctgactagaaaaggatccattttgaaaaaccaggaagacacttttgctgcagagctgcaccgtctcaagcagcagccactcttcagcttggtggactttgaacaggtggtggatcgcattcgcagcactgtggctgagcatctctggaagttgatggtagaagaatccgatttactgggtcagctgaagatcattaaagacttttaccttctgggacgtggagaactgtttcaggccttcattgacacagctcaacacatgttgaaaacaccacccactgcagtaactgagcatgatgtgaatgtggcctttcaacagtcagcacacaaggtattgctagatgatgacaaccttctccctctgttgcacttgacaatcgagtatcacggaaaggagcacaaagatgctactcaggcaagagaagggccttctcgggaaacttctccccgggaagcccctgcatctggctgggcagccctaggtctttcctacaaagtacagtggccactacatattctcttcaccccagctgtcctggaaaagtacaatgttgtttttaagtacttactgagtgtgcgccgggtgcaagctgagctgcagcactgctgggccctacaaatgcagcgcaagcacctcaagtcgaaccagactgatgcaatcaagtggcgcctaagaaatcacatggcatttttggtggataatcttcagtactatctccaggtagatgtgttggagtctcagttctcccagctgcttcatcagatcaattctacccgagactttgaaagcatccgattggctcatgaccacttcctgagcaatttgctggctcaatcctttatcctattgaaacctgtgtttcactgcctgaatgaaatcctagatctctgtcacagtttttgttcgctggtcagtcagaacctaggcccactggatgagcgtggagccgcccagctgagcattctcgtgaagggctttagccgccagtcttcactcctgttcaagattctctccagtgttcggaatcatcagatcaactcagatttggctcaactactgttacgactagattataacaaatactatacccaggctggtggaactctgggcagtttcgggatgtgaaaatttctggctcataaattgaaataacagccacgttcccaaggttgtaacagaagattcaaaacatcccattctagccacacacaaataaatatctgcggcttagtgataggactctaccttttctcctagaagcagttactgaacatccaggagtacaactccttcccatcattcccatgtggaagggtctctcccatcaaggagaacatgtggcatctctgatcctttacattgagaacatttgttggatatgttcatttattcaatagtcatttattgagcacctactacgtaccttggtactgttcaagctgtgggagatacagcggtaaacaaacaatatagagcagaaagttaaatattttatggttcatatgtgaaaaagtaattatgtttataaatagactaactgctggatgttaccaccaagtaagaaagcaacaggtaagataggctttctctctccctataccaagtaatttatacctacacagattgggcaattctagctaatgaaaatatacttaaaagtatttcttaggccgggcatggtggctcacacctgtaatcccagcactttgggaggccgaggcgggcggatcacctgaagtcaggagtttgagaccagcctgaccaacatgatgaaacctcgattctactaaaaatacaaaaattagccaggtgtggtggcatgtgcctgtaatcccagctactcaggaggctgagacaggagaattgcttgaacctgggaagcagacgctgcagtgagctgagattgtgccattgcattccagcccgggcaacaagagcgaaattccgtctc

SEQ ID NO: 33146 - DNA, 1927 bp, Homo sapiens
atggaatctacctgcgggccttctgcacagggctggattctgttttgcagccttatcgccaagcactgcttgatttggaacaagagttcctgggtgatccccatctctccatatcacatgtcaactacttcctagaccagttccagcttctttttccctctgtgatggttgtagtagaacaaattaaaagtcaaaagattcatggttgtcaaatcctggaaacagtctacaaacacagctgtggggggttgcctcctgttcgaagtgcactggaaaaaatcctggccgtttgtcatggggtcatgtataaacagctctcagcctggatgctccatggactcctcttggaccagcatgaagaattctttatcaaacaggggccatcttctggtaatgtcagtgcccagccagaagaggacgaggaggatctgggcattgggggactgacaggaaaacaactgagagaactgcaggacttgcgcctgattgaggaagagaacatgctggcaccatctctgaagcagttttccctacgagtggagattttgccatcctacattccagtgagggttgctgaaaaaatcctatttgttggagaatctgtccagatgtttgagaatcaaaatgtgaacctgactagaaaaggatccattttgaaaaaccaggaagacacttttgctgcagagctgcaccgtctcaagcagcagccactcttcagcttggtggactttgaacaggtggtggatcgcattcgcagcactgtggctgagcatctctggaagttgatggtagaagaatccgatttactgggtcagctgaagatcattaaagacttttaccttctgggacgtggagaactgtttcaggccttcattgacacagctcaacacatgttgaaaacaccacccactgcagtaactgagcatgatgtgaatgtggcctttcaacagtcagcacacaaggtattgctagatgatgacaaccttctccctctgttgcacttgacaatcgagtatcacggaaaggagcacaaagcagatgctactcaggcaagagaagggccttctcgggaaacttctccccgggaagcccctgcatctggctgggcagccctaggtctttcctacaaagtacagtggccactacatattctcttcaccccagctgtcctggaaaaaaatagacaattttaaaaaccaaacagaatgggactgtcttctgcaagcctacctacaaacaggtacaatgttgtttttaagtacttactgagtgtgcgccgggtgcaagctgagctgcagcactgctgggccctacaaatgcagcgcaagcacctcaagtcgaaccagactgatgcaatcaagtggcgcctaagaaatcacatggcatttttggtggataatcttcagtactatctccaggtagatgtgttggagtctcagttctcccagctgcttcatcagatcaattctacccgagactttgaaagcatccgattggctcatgaccacttcctgagcaatttgctggctcaatcctttatcctattgaaacctgtgtttcactgcctgaatgaaatcctagatctctgtcacagtttttgttcgctggtcagtcagaacctaggcccactggatgagcgtggagccgcccagctgagcattctcgtgaagggctttagccgccagtcttcactcctgttcaagattctctccagtgttcggaatcatcagatcaactcagatttggctcaactactgttacgactagattataacaaatactatacccaggctggtggaactctgggcagtttcgggatgtgaaaatttctggctcataaattgaaataacagccacgttcccaaggttgtaacagaagattcaaaacatcccattctagccacacacaaataaatatctgcggctt

SEQ ID NO: 33147 - DNA, 3849 bp, Homo sapiens
gaagtcgcccggcgcgggagcgcgaactctcgcgagaatgccgccagctccggaggcgactgcggcaggagcccgagctctcgcgcgacaggcaccaattcgttagacgcgcgctgcaggagcgcggaacatggcgcggcacgggccaccgtggagtcggttggacgcgcagcaggagcgcgacgtgcgggagctcgtccggggtgtcgccggcctccaggacgaggcagaccccaacttccagctcgccctaaacttcgcctggtccaacttcagatttcatcgtttcttggatgtcaacagccacaaaatagaaaaaacaatcgaaggaatttatgaaaaatttgtcattcattctgatctaagcaaagctgctagttggaagagattaacggaggaatttctaaatgcaccacttcccagtataaaggaaataaagacagatgcacattattccatactgtcacttcttctgtgtctgtcagactctccttcaaacagcagttatgtggagacaccaagaaataaagaagtggaaaagaaagatgatttcgactggggaaaatacttgatggaagatgaagaaatggacattggtccgtacatggacacaccaaattggtctgaagaaagtgaagaggaaaatgatcaacagcccttaagcagagaggactctggaattcaggtagacaggacaccgttagaagaacaagatcaaaacagaaaactggatccttgtatcagttggaaagatgagccagatgaccgaagctggctggaacatcatgtggtccatcagtactggacagccaggccctcccagtttcctcatagtttacatttgcactctaatttagctgctgtctgggaccaacacttgtacagcagtgatccattgtatgttccagatgacagggttttggttactgagactcaggttattcgggaaaccctatggttactttcaggagtgaaaaagctctttatatttcagttgatagatgggaaggtaactgtgagaaacaatattatagtaactcatttaacacatagctgtttacgatctgtgctggaacaaatagcagcatatggccaggttgtgtttcgactccaggagttcattgatgaagtcatgggacacagttctgagagcatgctgcctggaagtgggtctgttcctaagaagtcaactgaagctccctttagaacctaccaggctttcatgtgggccctgtacaaatatttcattagtttcaaagaggaacttgcagaaattgagaagtgcatcatcaataatgatactacaataactcttgcaatagtggtggacaagttggcacctcgattgtctcagctcaaggttctgcacaaagtgtttagtactggagtagcagaagttccacctgatactcgaaatgtcgtccgggcctctcacctgcttaacaccctgtacaaggccattcttgaatatgacaatgttggagaagcctctgagcaaaccgtctccctccttttctctctctgggtggaaacggtgcggccttacctgcagacggtggacgagtggatcgtgcacgggcacctgtgggatggcgccagggagttcatcatccagagaaacaaaaatgttccagttaatcacagagacttctggtatgcaacttacacgttatatagcgtatcagaaaagacagaaaatgaagaaaaaatgagtgataacgctagtgcgagttccggcagtgaccaggggccctccagcaggcagcacaccatggtgtccttcctcaaacctgtcctgaagcagatcataatggctggcaagtcgatgcagctgctgaagaacctgcagtgtgcggagagcaccacctgccaggcaggagccagagatgcagaaagaaaaagtttatacactctctttctggaatctgtacagtcccgtcttcgacatggagaagattccactccacaggttcttactgagcaacaggcaaccaaggagaacctgatgaagatgcagtccattgctgaaagccatcttgaactggatgatgttcatgatccactgcttgccattaactttgcaaggatgtatttggagcagagtgactttcacgagaagtttgctggtggtgatgtatgtgtggatagatcatcggaatctgtgacatgccagacttttgaattaacgctgagatcctgcctctatcctcatattgacaagcagtatctagattgctgtggaaatctcatgcaaactctaaaaaaagattacaggttggtagaatacttgcaagctatgaggaattttttcttaatggaaggaggagataccatgtatgacttctacacgtcaatttttgataaaataagagaaaaggaaacatggcagaatgtgtcttttcttaatgtccaactccaagaagcagtaggacagcgttatcctgaagatagttcacgtctatctatatcttttgaaaatgttgacacagctaagaagaagctgcctgttcatatcttagatggtctgaccctcagctacaaggtcccatggcccgtggacattgttataagtttggaatgtcaaaaaatttataatcaagtgtttcttctcttattgcaaataaagtgggcaaaatatagtctggatgttttactttttggtgaactggttagtactgcagaaaaaccacgacttaaagaaggccttatacatgaacaagacacagttgctcagttcggaccacaaaaagaaccagtaagacagcagattcatcgcatgttcctcttaagagtgaagctcatgcatttcgtgaacagcttgcacaactacatcatgaccaggattctacacagtacagggctggagtttcaacatcaagtcgaggaagccaaggatttagatcaattgattaaaattcactataggtatctgtcaaccatccatgaccggtgtctgctgagagaaaaggtcagctttgtgaaagaagctatcatgaaggtgttgaacttggctctcatgtttgcagacggttggcaggcaggcctgggcacttggcgaatggaatctatagagaaaatggaatctgattttaaaaactgccatatgtttcttgtaaccattttaaacaaagccgtctgtagaggatcctttccccatttggaatctctagcgttgtcactcatggctggcatggaacaaagttaaatgtcttcagcgtaataaatatctccgactttgtcatcatacatgtacatttccaccatgtgcagctgaaaagtgaaaatatttttattttggtttatttgtaaaacttgtccacagtcagcctggcacagtcgctcatgcctctaatcccagcacgatgggaggccaagacaggcagatcacttgagcccaggagtttgaggccagcctgggcaacatggtgaaacccggtgtctaccaaaaatacaaaatgtatccagacatggtggtgtgtacctgtagtcccagctactcaggaggcaaagatgggaggattacttgagcccaggaggtcaaggctacagtgagccatgattgcactactgcagtgcaacctgggtgacagagtgagaccctgactcagaaagaaccacttgcccacagtccagacagatggattgtaggtgggttttctggagattagtagatactgtatagagttgtatacataaaattgtgtcagtagtacaaagtgtatataggctgtttactcttacatttcctactgtaagatacagatttatggtactgatacctttaaattatatcatattttgaaaatgtaattactgatattcaaaataaattaaaggacttaaaatcat

SEQ ID NO: 33148 - DNA, 3341 bp, Homo sapiens
gttagacgcgcgctgcaggagcgcggaacatggcgcggcacgggccaccgtggagtcggttggacgcgcagcaggagcgcgacgtgcgggagctcgtccggggtgtcgccggcctccaggacgaggcagaccccaacttccagctcgccctaaacttcgcctggtccaacttcagatttcatcgtttcttggatgtcaacagccacaaaatagaaaaaacaatcgaaggaatttatgaaaaatttgtcattcattctgatctaagcaaagctgctagttggaagagattaacggaggaatttctaaatgcaccacttcccagtataaaggaaataaagacagatgcacattattccatactgtcacttcttctgtgtctgtcagactctccttcaaacagcagttatgtggagacaccaagaaataaagaagtggaaaagaaagatgatttcgactggggaaaatacttgatggaagatgaagaaatggacattggtccgtacatggacacaccaaattggtctgaagaaagtgaagaggaaaatgatcaacagcccttaagcagagaggactctggaattcaggtagacaggacaccgttagaagaacaagatcaaaacagaaaactggatccttgtatcagttggaaagatgagccagatgaccgaagctggctggaacatcatgtggtccatcagtactggacagccaggccctcccagtttcctcatagtttacatttgcactctaatttagctgctgtctgggaccaacacttgtacagcagtgatccattgtatgttccagatgacagggttttggttactgagactcaggttattcgggaaaccctatggttactttcaggagtgaaaaagctctttatatttcagttgatagatgggaaggtaactgtgagaaacaatattatagtaactcatttaacacatagctgtttacgatctgtgctggaacaaatagcagcatatggccaggttgtgtttcgactccaggagttcattgatgaagtcatgggacacagttctgagagcatgctgcctggaagtgggtctgttcctaagaagtcaactgaagctccctttagaacctaccaggctttcatgtgggccctgtacaaatatttcattagtttcaaagaggaacttgcagaaattgagaagtgcatcatcaataatgatactacaataactcttgcaatagtggtggacaagttggcacctcgattgtctcagctcaaggttctgcacaaagtgtttagtactggagtagcagaagttccacctgatactcgaaatgtcgtccgggcctctcacctgcttaacaccctgtacaaggccattcttgaatatgacaatgttggagaagcctctgagcaaaccgtctccctccttttctctctctgggtggaaacggtgcggccttacctgcagacggtggacgagtggatcgtgcacgggcacctgtgggatggcgccagggagttcatcatccagagaaacaaaaatgttccagttaatcacagagacttctggtatgcaacttacacgttatatagcgtatcagaaaagacagaaaatgaagaaaaaatgagtgataacgctagtgcgagttccggcagtgaccaggggccctccagcaggcagcacaccatggtgtccttcctcaaacctgtcctgaagcagatcataatggctggcaagtcgatgcagctgctgaagaacctgcagtgtgcggagagcaccacctgccaggcaggagccagagatgcagaaagaaaaagtttatacactctctttctggaatctgtacagtcccgtcttcgacatggagaagattccactccacaggttcttactgagcaacaggcaaccaaggagaacctgatgaagatgcagtccattgctgaaagccatcttgaactggatgatgttcatgatccactgcttgccattaactttgcaaggatgtatttggagcagagtgactttcacgagaagtttgctggtggtgatgtatgtgtggatagatcatcggaatctgtgacatgccagacttttgaattaacgctgagatcctgcctctatcctcatattgacaagcagtatctagattgctgtggaaatctcatgcaaactctaaaaaaagattacaggttggtagaatacttgcaagctatgaggaattttttcttaatggaaggaggagataccatgtatgacttctacacgtcaatttttgataaaataagagaaaaggaaacatggcagaatgtgtcttttcttaatgtccaactccaagaagcagtaggacagcgttatcctgaagatagttcacgtctatctatatcttttgaaaatgttgacacagctaagaagaagctgcctgttcatatcttagatggtctgaccctcagctacaaggtcccatggcccgtggacattgttataagtttggaatgtcaaaaaatttataatcaagtgtttcttctcttattgcaaataaagtgggcaaaatatagtctggatgttttactttttggtgaactggttagtactgcagaaaaaccacgacttaaagaaggccttatacatgaacaagacacagttgctcagttcggaccacaaaaagaaccagtaagacagcagattcatcgcatgttcctcttaagagtgaagctcatgcatttcgtgaacagcttgcacaactacatcatgaccaggattctacacagtacagggctggagtttcaacatcaagtcgaggaagccaaggatttagatcaattgattaaaattcactataggtatctgtcaaccatccatgaccggtgtctgctgagagaaaaggtcagctttgtgaaagaagctatcatgaaggtgttgaacttggctctcatgtttgcagacggttggcaggcaggcctgggcacttggcgaatggaatctatagagaaaatggaatctgattttaaaaactgccatatgtttcttgtaaccattttaaacaaagccgtctgtagaggatcctttccccattgtgagtatatcatgttaaaatatttctacctctgtatttccttgtaactaagtgtatgtgtcattgttttgttactgatcccatgaagaattagaaattctcaccattttcaaaactgaaaagtcccttagcagttgtcccatgctttgaattgctttttaagcattacggtgaggtgagtgtaagcctgaggatcttactttctggtataccatttattacaacagatttctaaaactcctattaaataaagttgatggcagaatagatttctgtcacacttc

SEQ ID NO: 33149 - DNA, 1754 bp, Homo sapiens
gtcttaatgactagaattcaggttccaaggagaagcccacaaggctaagggtattggatataacggaaagtggaagctatacctgacttccagagaatgtggaccggatataagatcttaatcttctcttatcttactacagaaatctggatggagaagcagtatttatctcaaagagaagtggacctagaggcttatttcactaggaatcacaccgttttgcaaggtactcgattcaaaagagccattttccaagggcaatactgtagaaattttggctgttgtgaagacagagatgatggctgtgtcactgagttctatgcggcgaatgcgttgtgctactgtgataaattctgtgacagagaaaattctgattgctgtcctgactacaagtccttttgccgtgaagagaaagaatggcctcctcacacacagccttggtatccagaaggttgcttcaaagatggtcaacattatgaagagggatcagtaattaaagaaaactgcaactcctgcacatgctcaggacagcaatggaaatgttcccagcatgtatgccttgttcgttcagaattaattgaacaggtcaataaaggagactatggatggacagcacagaattacagccaattttggggaatgactttagaagatggttttaaatttcgccttggcactttgccacctagtcccatgctcctgagcatgaatgaaatgacagcttctttacctgcaacaactgatcttccagagttttttgttgcttcttataaatggcctggatggactcatggcccattggatcaaaaaaattgtgctgcatcctgggcattttccactgcaagtgtggctgctgaccgaatagcaattcagtctaagggtcgatacacggccaatctatcccctcagaatttgatctcttgctgtgccaagaaccgtcatggatgcaatagtggaagcatcgatagggcttggtggtacctgagaaaacgtggactggtatcccacgcatgctacccacttttcaaagaccaaaatgctaccaacaatggatgtgccatggcaagcaggtctgatgggcgaggaaaacggcatgccacgaagccatgtcccaacaacgtagaaaaatctaacaggatctatcaatgttctcctccatacagagtctcttccaacgaaactgagataatgaaagaaatcatgcaaaatggaccagttcaagccataatgcaagtccgtgaagatttcttccattataagacagggatatacagacatgttaccagcacaaataaagaatcagaaaaatatcgaaagcttcagacacatgcagtcaaactcactggatggggcacactgagaggagcacaagggcagaaagaaaaattttggattgctgccaattcctggggaaagtcatggggagagaatggctatttcaggattcttcgaggagtaaatgagtccgacattgaaaagttgattatcgcagcttggggccaactgacgagttctgatgaaccataacatatcattaaatttccataaggtcatgcctttaagtaaccccctaaattgaagtttagcaatatgacattcttggtgacagtggaatctttgtctcttcaccgtgttaacataatctatctattttcttattttcccctctggtctatgcttctgcttccttcatattactgagcattaacaacaccaataaaggacagcagagtccctaaatgtctttaaagttc

SEQ ID NO: 33150 - DNA, 1381 bp, Homo sapiens
gaagtatactcattcaagtaaaggatcagtttcagggttcaggctgaagtgtcttaatgactagaattcaggttccaaggagaagcccacaaggctaagggtattggatataacggaaagtggaagctatacctgacttccagagaatgtggaccggatataagatcttaatcttctcttatcttactacagaaatctggatggagaagcagtatttatctcaaagagaagtggacctagaggcttatttcactaggaatcacaccgttttgcaaggtactcgattcaaaagagccattttccaagggcaatactgtagaaattttggctgttgtgaagacagagatgatggctgtgtcactgagttctatgcggcgaatgcgttgtgctactgtgataaattctgtgacagagaaaattctgattgctgtcctgactacaagtccttttgccgtgaagagaaagaatggcctcctcacacacagccttggtatccagaaggcagatggacagcacagaattacagccaattttggggaatgactttagaagatggttttaaatttcgccttggcactttgccacctagtcccatgctcctgagcatgaatgaaatgacaagactggtatcccacgcatgctacccacttttcaaagaccaaaatgctaccaacaatggatgtgccatggcaagcaggtctgatgggcgaggaaaacggcatgccacgaagccatgtcccaacaacgtagaaaaatctaacaggatctatcaatgttctcctccatacagagtctcttccaacgaaactgagataatgaaagaaatcatgcaaaatggaccagttcaagccataatgcaagtccgtgaagatttcttccattataagacagggatatacagacatgttaccagcacaaataaagaatcagaaaaatatcgaaagcttcagacacatgcagtcaaactcactggatggggcacactgagaggagcacaagggcagaaagaaaaattttggattgctgccaattcctggggaaagtcatggggagagaatggctatttcaggattcttcgaggagtaaatgagtccgacattgaaaagttgattatcgcagcttggggccaactgacgagttctgatgaaccataacatatcattaaatttccataaggtcatgcctttaagtaaccccctaaattgaagtttagcaatatgacattcttggtgacagtggaatctttgtctcttcaccgtgttaacataatctatctattttcttattttcccctctggtctatgcttctgcttccttcatattactgagcattaacaacaccaataaaggacagcagagtccctaaatgtctttaaagttc

SEQ ID NO: 33151 - DNA, 692 bp, Homo sapiens
taatcttctcttatcttactacagaaatctggatggagaagcagtatttatctcaaagagaagtggacctagaggcttatttcactaggaatcacaccgttttgcaaggtactcgattcaaaagagccattttccaagggcaatactgtagaaattttggctgttgtgaagacagagatgatggctgtgtcactgagttctatgcggcgaatgcgttgtgctactgtgataaattctgtgacagagaaaattctgattgctgtcctgactacaagtccttttgccgtgaagagaaagaatggcctcctcacacacagccttggtatccagaaggttgcttcaaagatggtcaacattatgaagagggatcagtaattaaagaaaactgcaactcctgcacatgctcaggacagcaatggaaatgttcccagcatgtatgccttgttcgttcagaattaattgaacaggtcaataaaggagactatggatggacagcacagaattacagccaattttggggaatgactttagaagatggttttaaatttcgccttggcactttgccacctagtcccatgctcctgagcatgaatgaaatgacagtaagtgttccttctgattcacgtatgtgcatgtatttgtaaaagtgtgtttgtgtgtgcattaaaagcaattataaatcactaaaataa

SEQ ID NO: 33152 - DNA, 1045 bp, Homo sapiens
atgtggaccggatataagatcttaatcttctcttatcttactacagaaatctggatggagaagcagtatttatctcaaagagaagtggacctagaggcttatttcactaggaatcacaccgttttgcaaggtactcgattcaaaagagccattttccaagggcaatactgtagaaattttggctgttgtgaagacagagatgatggctgtgtcactgagttctatgcggcgaatgcgttgtgctactgtgataaattctgtgacagagaaaattctgattgctgtcctgactacaagtccttttgccgtgaagagaaagaatggcctcctcacacacagccttggtatccagaagatggacagcacagaattacagccaattttggggaatgactttagaagatggttttaaatttcgccttggcactttgccacctagtcccatgctcctgagcatgaatgaaatgacaactggtatcccacgcatgctacccacttttcaaagaccaaaatgctaccaacaatggatgtgccatggcaagcaggtctgatgggcgaggaaaacggcatgccacgaagccatgtcccaacaacgtagaaaaatctaacaggatctatcaatgttctcctccatacagagtctcttccaacgaaactgagataatgaaagaaatcatgcaaaatggaccagttcaagccataatgcaagtccgtgaagatttcttccattataagacagggatatacagacatgttaccagcacaaataaagaatcagaaaaatatcgaaagcttcagacacatgcagtcaaactcactggatggggcacactgagaggagcacaagggcagaaagaaaaattttggattgctgccaattcctggggaaagtcatggggagagaatggctatttcaggattcttcgaggagtaaatgagtccgacattgaaaagttgattatcgcagcttggggccaactgacgagttctgatgaaccataacatatcattaaatttccataaggtcatgcctttaagtaacccc

SEQ ID NO: 33153 - DNA, 782 bp, Homo sapiens
ggtaggtaaatggagtacagatgggaaatcaaaccagtgtgtgactgggcatgatttagagcaactgttattgatatgacagatcctagcaggcaacctcatgagagcctggatgttcgtttcaatgcaggcagaaatctggatggagaagcagtatttatctcaaagagaagtggacctagaggcttatttcactaggaatcacaccgttttgcaaggtactcgattcaaaagagccattttccaagggcaatactgtagaaattttggctgttgtgaagacagagatgatggctgtgtcactgagttctatgcggcgaatgcgttgtgctactgtgataaattctgtgacagagaaaattctgattgctgtcctgactacaagtccttttgccgtgaagagaaagaatggcctcctcacacacagccttggtatccagaaggttgcttcaaagatggtcaacattatgaagagggatcagtaattaaagaaaactgcaactcctgcacatgctcaggacagcaatggaaatgttcccagcatgtatgccttgttcgttcagaattaattgaacaggtcaataaaggagactatggatggacagcacagaattacagccaattttggggaatgactttagaagatggttttaaatttcgccttggcactttgccacctagtcccatgctcctgagcatgaatgaaatgacagaatgattgaatgggctggcaagatggccgatcaagaacagctctggttggcagctcccagcgagaccaa

SEQ ID NO: 33154 - DNA, 4510 bp, Homo sapiens
gctgaggccaggagggcgcactggggattggaggcgagggaagtgcagggcgcatcccaggcggcagggctcccagcatcggcagtcgccatcaccgccagaccgcagagacaggttcggatccgcggtcctcttgcctctttccaggcctcgatgagtgttaaatcgccatttaatgtgatgtcaagaaataatttggaagcacctccttgtaagatgacagagccatttaattttgagaaaaatgaaaacaagcttccaccacatgagtctttaagaagtcctggaacacttcctaaccaccctaatttcaggctgaaaagctcagagaatggaaataaaaagaacaattttttgctttgtgagcaaaccaaacaatatttggctagtcaggaagacaattcagtttcttcaaacccgaatggcatcaacggagaagtagttggctccaaaggagacaggaaaaaattgccagcaggaaactcagtgtcaccaccaagtgctgaaagtaattcaccacccaaagaagtgaatattaagcctggaaataatgtacgtcctgcaaaatcaaaaaaactaaacaagttggtcgagaattccttgtccataagtaatccagggctcttcacctccttaggacctcctcttcggtccacaacttgccatcgctgtggcctatttggatcgctgaggtgctctcagtgcaagcagacctactattgctccacagcatgtcaaagaagagactggtctgcacacagcatcgtgtgcaggcctgttcagccaaatttccacaaacttgaaaataaatcatctattgaaacaaaggatgtggaggtaaacaataagagtgactgtccacttggagttactaaggaaatagccatttgggctgagagaataatgttttctgatttgagaagtctacaactcaagaaaaccatggaaataaagggtacggttaccgaattcaaacacccaggggacttctacgtgcagttatattcttcagaagttttagaatacatgaaccaactctctgccagcttaaaagaaacatatgcaaatgtgcatgaaaaagactatattcctgttaagggggaagtttgtattgccaagtacactgttgatcagacctggaacagagcaatcatacaaaacgttgatgtgcagcaaaagaaggcacatgtcttatatattgattatggaaatgaagaaataattccattaaacagaatttaccacctcaacaggaacattgacttgtttcctccttgtgccataaagtgctttgtagccaatgttatcccagcagaagggaattggagcagtgattgtatcaaagctactaaaccactgttaatggagcagtactgctccataaagattgtcgacatcttggaagaggaagtggttacctttgctgtagaagttgagctgccaaattcaggaaaacttttagaccatgtgcttatagaaatgggatatggcttgaaacccagtggacaagattctaagaaggaaaatgcagatcaaagtgatcctgaagatgttggaaaaatgacaactgaaaacaacattgtcgtagacaaaagtgacctaatcccaaaagtgttaactttgaatgtaggtgatgagttttgtggtgtggttgcccacattcaaacaccagaagacttcttttgtcaacaactgcaaagtggccgaaagcttgctgaacttcaggcatcccttagcaagtactgtgatcagttgcctccacgctctgatttttatccagccattggtgatatatgttgtgctcagttctcagaggatgatcagtggtaccgtgcctctgttttggcttacgcttctgaagaatctgtactggtcggatatgtagattatggaaactttgaaatccttagtttgatgagactttgtcccataatcccaaagttgttggaattgccaatgcaagctataaagtgtgtactagcaggagtaaagccatcattaggaatttggactccagaagctatttgtctcatgaaaaaacttgtacagaacaaaataatcacagtgaaagtggtggacaagttggaaaacagttccctggtggagcttattgataaatccgagacgcctcatgtcagtgttagcaaagttctcctagatgcaggctttgctgtgggagaacagagtatggtgacagataaacccagtgacgtgaaagaaaccagtgttcccttgggtgtggaaggaaaagtaaatccattggagtggacatgggttgaacttggtgttgaccaaacagtagatgttgtggtctgtgtgatatatagtcctggagaattttattgccatgtgcttaaagaggatgctttaaagaaactcaatgatttgaacaagtcattagcagaacactgccagcagaagttacctaatggtttcaaggcagagataggacaaccttgttgtgctttttttgcaggtgatggtagttggtatcgtgctttagtcaaggaaatcttaccaaatggacatgttaaagtacattttgtggattatggaaacatcgaagaagttactgcagatgaactccgaatgatatcatcaacatttttaaaccttccctttcagggaatacggtgccagttagcagatatacagtctagaaacaaacattggtctgaagaagccataacaagattccagatgtgtgttgctgggataaaattgcaagccagagtggttgaagtcactgaaaatgggataggagttgaactcaccgatctctccacttgttatcccagaataattagtgatgttctgattgatgaacatctggttttaaaatctgcttcaccacataaagacttaccaaatgacagacttgttaataaacatgagcttcaagttcatgtacagggacttcaagctacctcttcagctgagcaatggaagacgatagaattgccagtggataaaactatacaagcaaatgtattagaaatcataagcccaaacttgttttatgctctaccaaaagggatgccagaaaatcaggaaaagctgtgcatgttgacagctgaattattagaatactgcaatgctccgaaaagtcgaccaccctatagaccaagaattggagacgcatgctgtgccaaatacacaagtgatgatttttggtatcgtgcagttgttctggggacatcagacactgatgtggaagtgctctatgcagactatggaaacattgaaaccctgcctctttgcagagtgcaaccaatcacctctagccacctggcgcttcctttccaaattattagatgttcacttgaaggattaatggaattgaatggaagctcttctcaattaataataatgctattaaaaaatttcatgttgaatcagaatgtaatgctttctgtgaaaggaattacaaagaatgtccatacagtgtcagttgagaaatgttctgagaatgggactgtcgatgtagctgataagctagtgacatttggtctggcaaaaaacatcacacctcaaaggcagagtgctttaaatacagaaaagatgtataggatgaattgctgctgcacagagttacagaaacaagttgaaaaacatgaacatattcttctcttcctcttaaacaattcaaccaatcaaaataaatttattgaaatgaaaaaactgttaaaaaaaacagcatctcttggaggtaaacccttatgagacaggaaacagcaaaggctagctttaggagagaaagtacagcacctggtgtttttatttatgagaaccttttctttgtccactttctctgtaatgaccttctatccctccgtttttgcctgcctgccattctcctattaggttggtggtttttattttcctctaagttccttccaccaaataaatattacgtaaaaaattcataccaaatcaatgagaatactggcaaggaatacatagggactttctgctatatatgtaactttttattacttaaaggtaccgaaggaaggccaggtgcagtggctcacgcccagcactttgggaggctgaggtgggaggatcccttgaggccaggagttcaaggttacagtgagctatgatagtgccactgcactccagcctgggtgacagattttgtcttaaaaaaaaaaaaaaaaaagttgatatgagttttattttctgtccgtttgaaatattttgtaatattccctgcattctctgtcgtctgcctcttccacataatgtcctttgctttcatgtttgttatcttctttttctgttcactcagaggtcatcaatttctttctctccgtccttaattggattatttttcttttggcctttgggcacagagtctgacctctggaccactctaactggagaaggaactttatgttccctctcctgctgtgtccacaaccttagaaatctgtagctagatttttgttgttatagatagaatttactgtttctgaaacccaaatacagttatcagtttaaggtt

SEQ ID NO: 33155 - DNA, 4062 bp, Homo sapiens
ggtgtgggaggattctctgagtttggaaatagcgcttccaggcatcactccttcaaatgcaaacgttcaccttctctctaagagaaacttgcatgtggattcagtgccttcgtttgactaaaaattacgatacaaacaatattaacatttactagacttttttttccctactttcctcctataggaaaggaagatgtgctagggcatttacttagatgtgggtcagctggcgctagtttgtttaaggagttcctgctgtgtgccagtagcttttccgggccctagggtccttgctataaatacgttagccctgctgggcttctgaactaagggagctaaatgcttccagcttccttagtgaggcagcacggtgctgtatgcttaaatccaaggccgtggagtctgacctgcgtttttatctaaactgtgtaaggtgctggccctgggtggtttggcctcgatgagtgttaaatcgccatttaatgtgatgtcaagaaataatttggaagcacctccttgtaagatgacagagccatttaattttgagaaaaatgaaaacaagcttccaccacatgagtctttaagaagtcctggaacacttcctaaccaccctaatttcaggctgaaaagctcagagaatggaaataaaaagaacaattttttgctttgtgagcaaaccaaacaatatttggctagtcaggaagacaattcagtttcttcaaacccgaatggcatcaacggagaagtagttggctccaaaggagacaggaaaaaattgccagcaggaaactcagtgtcaccaccaagtgctgaaagtaattcaccacccaaagaagtgaatattaagcctggaaataatgtacgtcctgcaaaatcaaaaaaactaaacaagttggtcgagaattccttgtccataagtaatccagggctcttcacctccttaggacctcctcttcggtccacaacttgccatcgctgtggcctatttggatcgctgaggtgctctcagtgcaagcagacctactattgctccacagcatgtcaaagaagagactggtctgcacacagcatcgtgtgcaggcctgttcagccaaatttccacaaacttgaaaataaatcatctattgaaacaaaggatgtggaggtaaacaataagagtgactgtccacttggagttactaaggaaatagccatttgggctgagagaataatgttttctgatttgagaagtctacaactcaagaaaaccatggaaataaagggtacggttaccgaattcaaacacccaggggacttctacgtgcagttatattcttcagaagttttagaatacatgaaccaactctctgccagcttaaaagaaacatatgcaaatgtgcatgaaaaagactatattcctgttaagggggaagtttgtattgccaagtacactgttgatcagacctggaacagagcaatcatacaaaacgttgatgtgcagcaaaagaaggcacatgtcttatatattgattatggaaatgaagaaataattccattaaacagaatttaccacctcaacaggaacattgacttgtttcctccttgtgccataaagtgctttgtagccaatgttatcccagcagaagggaattggagcagtgattgtatcaaagctactaaaccactgttaatggagcagtactgctccataaagattgtcgacatcttggaagaggaagtggttacctttgctgtagaagttgagctgccaaattcaggaaaacttttagaccatgtgcttatagaaatgggatatggcttgaaacccagtggacaagattctaagaaggaaaatgcagatcaaagtgatcctgaagatgttggaaaaatgacaactgaaaacaacattgtcgtagacaaaagtgacctaatcccaaaagtgttaactttgaatgtaggtgatgagttttgtggtgtggttgcccacattcaaacaccagaagacttcttttgtcaacaactgcaaagtggccgaaagcttgctgaacttcaggcatcccttagcaagtactgtgatcagttgcctccacgctctgatttttatccagccattggtgatatatgttgtgctcagttctcagaggatgatcagtggtaccgtgcctctgttttggcttacgcttctgaagaatctgtactggtcggatatgtagattatggaaactttgaaatccttagtttgatgagactttgtcccataatcccaaagttgttggaattgccaatgcaagctataaagtgtgtactagcaggagtaaagccatcattaggaatttggactccagaagctatttgtctcatgaaaaaacttgtacagaacaaaataatcacagtgaaagtggtggacaagttggaaaacagttccctggtggagcttattgataaatccgagacgcctcatgtcagtgttagcaaagttctcctagatgcaggctttgctgtgggagaacagagtatggtgacagataaacccagtgacgtgaaagaaaccagtgttcccttgggtgtggaaggaaaagtaaatccattggagtggacatgggttgaacttggtgttgaccaaacagtagatgttgtggtctgtgtgatatatagtcctggagaattttattgccatgtgcttaaagaggatgctttaaagaaactcaatgatttgaacaagtcattagcagaacactgccagcagaagttacctaatggtttcaaggcagagataggacaaccttgttgtgctttttttgcaggtgatggtagttggtatcgtgctttagtcaaggaaatcttaccaaatggacatgttaaagtacattttgtggattatggaaacatcgaagaagttactgcagatgaactccgaatgatatcatcaacatttttaaaccttccctttcagggaatacggtgccagttagcagatatacagtctagaaacaaacattggtctgaagaagccataacaagattccagatgtgtgttgctgggataaaattgcaagccagagtggttgaagtcactgaaaatgggataggagttgaactcaccgatctctccacttgttatcccagaataattagtgatgttctgattgatgaacatctggttttaaaatctgcttcaccacataaagacttaccaaatgacagacttgttaataaacatgagcttcaagttcatgtacagggacttcaagctacctcttcagctgagcaatggaagacgatagaattgccagtggataaaactatacaagcaaatgtattagaaatcataagcccaaacttgttttatgctctaccaaaagggatgccagaaaatcaggaaaagctgtgcatgttgacagctgaattattagaatactgcaatgctccgaaaagtcgaccaccctatagaccaagaattggagacgcatgctgtgccaaatacacaagtgatgatttttggtatcgtgcagttgttctggggacatcagacactgatgtggaagtgctctatgcagactatggaaacattgaaaccctgcctctttgcagagtgcaaccaatcacctctagccacctggcgcttcctttccaaattattagatgttcacttgaagaaaagatgtataggatgaattgctgctgcacagagttacagaaacaagttgaaaaacatgaacatattcttctcttcctcttaaacaattcaaccaatcaaaataaatttattgaaatgaaaaaactgttaaaaagttaagtaagttaaatcgtatgttttcgcctcttctgtgatcaccaataggacatcttcaggcatattggcaggatagagctaatggagtgaaacctattgtaaggctgtactttcgtgatttaatgacctgaggtttggtcataatgcttctgctgtttttgtaggtttatctgatcgttttcctttgctactgctaatggaactgaacccccaggggtattccagttgtaatagcctttccttactgttgtttggttctgtgaatgcctatgttattgatatgtggaggg

SEQ ID NO: 33156 - DNA, 4168 bp, Homo sapiens
gctgaggccaggagggcgcactggggattggaggcgagggaagtgcagggcgcatcccaggcggcagggctcccagcatcggcagtcgccatcaccgccagaccgcagagacaggttcggatccgcggtcctcttgcctctttccaggcctcgatgagtgttaaatcgccatttaatgtgatgtcaagaaataatttggaagcacctccttgtaagatgacagagccatttaattttgagaaaaatgaaaacaagcttccaccacatgagtctttaagaagtcctggaacacttcctaaccaccctaatttcaggctgaaaagctcagagaatggaaataaaaagaacaattttttgctttgtgagcaaaccaaacaatatttggctagtcaggaagacaattcagtttcttcaaacccgaatggcatcaacggagaagtagttggctccaaaggagacaggaaaaaattgccagcaggaaactcagtgtcaccaccaagtgctgaaagtaattcaccacccaaagaagtgaatattaagcctggaaataatgtacgtcctgcaaaatcaaaaaaactaaacaagttggtcgagaattccttgtccataagtaatccagggctcttcacctccttaggacctcctcttcggtccacaacttgccatcgctgtggcctatttggatcgctgaggtgctctcagtgcaagcagacctactattgctccacagcatgtcaaagaagagactggtctgcacacagcatcgtgtgcaggcctgttcagccaaatttccacaaacttgaaaataaatcatctattgaaacaaaggatgtggaggtaaacaataagagtgactgtccacttggagttactaaggaaatagccatttgggctgagagaataatgttttctgatttgagaagtctacaactcaagaaaaccatggaaataaagggtacggttaccgaattcaaacacccaggggacttctacgtgcagttatattcttcagaagttttagaatacatgaaccaactctctgccagcttaaaagaaacatatgcaaatgtgcatgaaaaagactatattcctgttaagggggaagtttgtattgccaagtacactgttgatcagacctggaacagagcaatcatacaaaacgttgatgtgcagcaaaagaaggcacatgtcttatatattgattatggaaatgaagaaataattccattaaacagaatttaccacctcaacaggaacattgacttgtttcctccttgtgccataaagtgctttgtagccaatgttatcccagcagaagggaattggagcagtgattgtatcaaagctactaaaccactgttaatggagcagtactgctccataaagattgtcgacatcttggaagaggaagtggttacctttgctgtagaagttgagctgccaaattcaggaaaacttttagaccatgtgcttatagaaatgggatatggcttgaaacccagtggacaagattctaagaaggaaaatgcagatcaaagtgatcctgaagatgttggaaaaatgacaactgaaaacaacattgtcgtagacaaaagtgacctaatcccaaaagtgttaactttgaatgtaggtgatgagttttgtggtgtggttgcccacattcaaacaccagaagacttcttttgtcaacaactgcaaagtggccgaaagcttgctgaacttcaggcatcccttagcaagtactgtgatcagttgcctccacgctctgatttttatccagccattggtgatatatgttgtgctcagttctcaggagtaaagccatcattaggaatttggactccagaagctatttgtctcatgaaaaaacttgtacagaacaaaataatcacagtgaaagtggtggacaagttggaaaacagttccctggtggagcttattgataaatccgagacgcctcatgtcagtgttagcaaagttctcctagatgcaggctttgctgtgggagaacagagtatggtgacagataaacccagtgacgtgaaagaaaccagtgttcccttgggtgtggaaggaaaagtaaatccattggagtggacatgggttgaacttggtgttgaccaaacagtagatgttgtggtctgtgtgatatatagtcctggagaattttattgccatgtgcttaaagaggatgctttaaagaaactcaatgatttgaacaagtcattagcagaacactgccagcagaagttacctaatggtttcaaggcagagataggacaaccttgttgtgctttttttgcagatatacagtctagaaacaaacattggtctgaagaagccataacaagattccagatgtgtgttgctgggataaaattgcaagccagagtggttgaagtcactgaaaatgggataggagttgaactcaccgatctctccacttgttatcccagaataattagtgatgttctgattgatgaacatctggttttaaaatctgcttcaccacataaagacttaccaaatgacagacttgttaataaacatgagcttcaagttcatgtacagggacttcaagctacctcttcagctgagcaatggaagacgatagaattgccagtggataaaactatacaagcaaatgtattagaaatcataagcccaaacttgttttatgctctaccaaaagggatgccagaaaatcaggaaaagctgtgcatgttgacagctgaattattagaatactgcaatgctccgaaaagtcgaccaccctatagaccaagaattggagacgcatgctgtgccaaatacacaagtgatgatttttggtatcgtgcagttgttctggggacatcagacactgatgtggaagtgctctatgcagactatggaaacattgaaaccctgcctctttgcagagtgcaaccaatcacctctagccacctggcgcttcctttccaaattattagatgttcacttgaaggattaatggaattgaatggaagctcttctcaattaataataatgctattaaaaaatttcatgttgaatcagaatgtaatgctttctgtgaaaggaattacaaagaatgtccatacagtgtcagttgagaaatgttctgagaatgggactgtcgatgtagctgataagctagtgacatttggtctggcaaaaaacatcacacctcaaaggcagagtgctttaaatacagaaaagatgtataggatgaattgctgctgcacagagttacagaaacaagttgaaaaacatgaacatattcttctcttcctcttaaacaattcaaccaatcaaaataaatttattgaaatgaaaaaactgttaaaaaaaacagcatctcttggaggtaaacccttatgagacaggaaacagcaaaggctagctttaggagagaaagtacagcacctggtgtttttatttatgagaaccttttctttgtccactttctctgtaatgaccttctatccctccgtttttgcctgcctgccattctcctattaggttggtggtttttattttcctctaagttccttccaccaaataaatattacgtaaaaaattcataccaaatcaatgagaatactggcaaggaatacatagggactttctgctatatatgtaactttttattacttaaaggtaccgaaggaaggccaggtgcagtggctcacgcccagcactttgggaggctgaggtgggaggatcccttgaggccaggagttcaaggttacagtgagctatgatagtgccactgcactccagcctgggtgacagattttgtcttaaaaaaaaaaaaaaaaaagttgatatgagttttattttctgtccgtttgaaatattttgtaatattccctgcattctctgtcgtctgcctcttccacataatgtcctttgctttcatgtttgttatcttctttttctgttcactcagaggtcatcaatttctttctctccgtccttaattggattatttttcttttggcctttgggcacagagtctgacctctggaccactctaactggagaaggaactttatgttccctctcctgctgtgtccacaaccttagaaatctgtagctagatttttgttgttatagatagaatttactgtttctgaaacccaaatacagttatcagtttaaggtt

SEQ ID NO: 33157 - DNA, 3705 bp, Homo sapiens
gctgaggccaggagggcgcactggggattggaggcgagggaagtgcagggcgcatcccaggcggcagggctcccagcatcggcagtcgccatcaccgccagaccgcagagacaggttcggatccgcggtcctcttgcctctttccaggcctcgatgagtgttaaatcgccatttaatgtgatgtcaagaaataatttggaagcacctccttgtaagatgacagagccatttaattttgagaaaaatgaaaacaagcttccaccacatgagtctttaagaagtcctggaacacttcctaaccaccctaatttcaggctgaaaagctcagagaatggaaataaaaagaacaattttttgctttgtgagcaaaccaaacaatatttggctagtcaggaagacaattcagtttcttcaaacccgaatggcatcaacggagaagtagttggctccaaaggagacaggaaaaaattgccagcaggaaactcagtgtcaccaccaagtgctgaaagtaattcaccacccaaagaagtgaatattaagcctggaaataatgtacgtcctgcaaaatcaaaaaaactaaacaagttggtcgagaattccttgtccataagtaatccagggctcttcacctccttaggacctcctcttcggtccacaacttgccatcgctgtggcctatttggatcgctgaggtgctctcagtgcaagcagacctactattgctccacagcatgtcaaagaagagactggtctgcacacagcatcgtgtgcaggcctgttcagccaaatttccacaaacttgaaaataaatcatctattgaaacaaaggatgtggaggtaaacaataagagtgactgtccacttggagttactaaggaaatagccatttgggctgagagaataatgttttctgatttgagaagtctacaactcaagaaaaccatggaaataaagggtacggttaccgaattcaaacacccaggggacttctacgtgcagttatattcttcagaagttttagaatacatgaaccaactctctgccagcttaaaagaaacatatgcaaatgtgcatgaaaaagactatattcctgttaagggggaagtttgtattgccaagtacactgttgatcagacctggaacagagcaatcatacaaaacgttgatgtgcagcaaaagaaggcacatgtcttatatattgattatggaaatgaagaaataattccattaaacagaatttaccacctcaacaggaacattgacttgtttcctccttgtgccataaagtgctttgtagccaatgttatcccagcagaagggaattggagcagtgattgtatcaaagctactaaaccactgttaatggagcagtactgctccataaagattgtcgacatcttggaagaggaagtggttacctttgctgtagaagttgagctgccaaattcaggaaaacttttagaccatgtgcttatagaaatgggatatggcttgaaacccagtggacaagattctaagaaggaaaatgcagatcaaagtgatcctgaagatgttggaaaaatgacaactgaaaacaacattgtcgtagacaaaagtgacctaatcccaaaagtgttaactttgaatgtaggtgatgagttttgtggtgtggttgcccacattcaaacaccagaagacttcttttgtcaacaactgcaaagtggccgaaagcttgctgaacttcaggcatcccttagcaagtactgtgatcagttgcctccacgctctgatttttatccagccattggtgatatatgttgtgctcagttctcagaggatgatcagtggtaccgtgcctctgttttggcttacgcttctgaagaatctgtactggtcggatatgtagattatggaaactttgaaatccttagtttgatgagactttgtcccataatcccaaagttgttggaattgccaatgcaagctataaagtgtgtactagcaggagtaaagccatcattaggaatttggactccagaagctatttgtctcatgaaaaaacttgtacagaacaaaataatcacagtgaaagtggtggacaagttggaaaacagttccctggtggagcttattgataaatccgagacgcctcatgtcagtgttagcaaagttctcctagatgcaggctttgctgtgggagaacagagtatggtgacagataaacccagtgacgtgaaagaaaccagtgttcccttgggtgtggaaggaaaagtaaatccattggagtggacatgggttgaacttggtgttgaccaaacagtagatgttgtggtctgtgtgatatatagtcctggagaattttattgccatgtgcttaaagaggatgctttaaagaaactcaatgatttgaacaagtcattagcagaacactgccagcagaagttacctaatggtttcaaggcagagataggacaaccttgttgtgctttttttgcaggtgatggtagttggtatcgtgctttagtcaaggaaatcttaccaaatggacatgttaaagtacattttgtggattatggaaacatcgaagaagttactgcagatgaactccgaatgatatcatcaacatttttaaaccttccctttcagggaatacggtgccagttagcagatatacagtctagaaacaaacattggtctgaagaagccataacaagattccagatgtgtgttgctgggataaaattgcaagccagagtggttgaagtcactgaaaatgggataggagttgaactcaccgatctctccacttgttatcccagaataattagtgatgttctgattgatgaacatctggttttaaaatctgcttcaccacataaagacttaccaaatgacagacttgttaataaacatgagcttcaagttcatgtacagggacttcaagctacctcttcagctgagcaatggaagacgatagaattgccagtggataaaactatacaagcaaatgtattagaaatcataagcccaaacttgttttatgctctaccaaaagggatgccagaaaatcaggaaaagctgtgcatgttgacagctgaattattagaatactgcaatgctccgaaaagtcgaccaccctatagaccaagaattggagacgcatgctgtgccaaatacacaagtgatgatttttggtatcgtgcagttgttctggggacatcagacactgatgtggaagtgctctatgcagactatggaaacattgaaaccctgcctctttgcagagtgcaaccaatcacctctagccacctggcgcttcctttccaaattattagatgttcacttgaagaaaagatgtataggatgaattgctgctgcacagagttacagaaacaagttgaaaaacatgaacatattcttctcttcctcttaaacaattcaaccaatcaaaataaatttattgaaatgaaaaaactgttaaaaaaaacagcatctcttggaggtaaacccttatgagacaggaaacagcaaaggctagctttaggagagaaagtacagcacctggtgtttttatttatgagaaccttttctttgtccactttctctgtaatgaccttctatccctccgtttttgcctgcctgccattctcctattaggttggtggtttttattttcctctaagttccttccaccaaataaatattacgtaaaaaattcataccaaa

SEQ ID NO: 33158 - DNA, 3967 bp, Homo sapiens
gctgaggccaggagggcgcactggggattggaggcgagggaagtgcagggcgcatcccaggcggcagggctcccagcatcggcagtcgccatcaccgccagaccgcagagacaggttcggatccgcggtcctcttgcctctttccaggcctcgatgagtgttaaatcgccatttaatgtgatgtcaagaaataatttggaagcacctccttgtaagatgacagagccatttaattttgagaaaaatgaaaacaagcttccaccacatgagtctttaagaagtcctggaacacttcctaaccaccctaatttcaggctgaaaagctcagagaatggaaataaaaagaacaattttttgctttgtgagcaaaccaaacaatatttggctagtcaggaagacaattcagtttcttcaaacccgaatggcatcaacggagaagtagttggctccaaaggagacaggaaaaaattgccagcaggaaactcagtgtcaccaccaagtgctgaaagtaattcaccacccaaagaagtgaatattaagcctggaaataatgtacgtcctgcaaaatcaaaaaaactaaacaagttggtcgagaattccttgtccataagtaatccagggctcttcacctccttaggacctcctcttcggtccacaacttgccatcgctgtggcctatttggatcgctgaggtgctctcagtgcaagcagacctactattgctccacagcatgtcaaagaagagactggtctgcacacagcatcgtgtgcaggcctgttcagccaaatttccacaaacttgaaaataaatcatctattgaaacaaaggatgtggaggtaaacaataagagtgactgtccacttggagttactaaggaaatagccatttgggctgagagaataatgttttctgatttgagaagtctacaactcaagaaaaccatggaaataaagggtacggttaccgaattcaaacacccaggggacttctacgtgcagttatattcttcagaagttttagaatacatgaaccaactctctgccagcttaaaagaaacatatgcaaatgtgcatgaaaaagactatattcctgttaagggggaagtttgtattgccaagtacactgttgatcaggccataaagtgctttgtagccaatgttatcccagcagaagggaattggagcagtgattgtatcaaagctactaaaccactgttaatggagcagtactgctccataaagattgtcgacatcttggaagaggaagtggttacctttgctgtagaagttgagctgccaaattcaggaaaacttttagaccatgtgcttatagaaatgggatatggcttgaaacccagtggacaagattctaagaaggaaaatgcagatcaaagtgatcctgaagatgttggaaaaatgacaactgaaaacaacattgtcgtagacaaaagtgacctaatcccaaaagtgttaactttgaatgtaggtgatgagttttgtggtgtggttgcccacattcaaacaccagaagacttcttttgtcaacaactgcaaagtggccgaaagcttgctgaacttcaggcatcccttagcaagtactgtgatcagttgcctccacgctctgatttttatccagccattggtgatatatgttgtgctcagttctcaggagtaaagccatcattaggaatttggactccagaagctatttgtctcatgaaaaaacttgtacagaacaaaataatcacagtgaaagtggtggacaagttggaaaacagttccctggtggagcttattgataaatccgagacgcctcatgtcagtgttagcaaagttctcctagatgcaggctttgctgtgggagaacagagtatggtgacagataaacccagtgacgtgaaagaaaccagtgttcccttgggtgtggaaggaaaagtaaatccattggagtggacatgggttgaacttggtgttgaccaaacagtagatgttgtggtctgtgtgatatatagtcctggagaattttattgccatgtgcttaaagaggatgctttaaagaaactcaatgatttgaacaagtcattagcagaacactgccagcagaagttacctaatggtttcaaggcagagataggacaaccttgttgtgctttttttgcaggtgatggtagttggtatcgtgctttagtcaaggaaatcttaccaaatggacatgttaaagtacattttgtggattatggaaacatcgaagaagttactgcagatgaactccgaatgatatcatcaacatttttaaaccttccctttcagggaatacggtgccagttagcagatatacagtctagaaacaaacattggtctgaagaagccataacaagattccagatgtgtgttgctgggataaaattgcaagccagagtggttgaagtcactgaaaatgggataggagttgaactcaccgatctctccacttgttatcccagaataattagtgatgttctgattgatgaacatctggttttaaaatctgcttcaccacataaagacttaccaaatgacagacttgttaataaacatgagcttcaagttcatgtacagggacttcaagctacctcttcagctgagcaatggaagacgatagaattgccagtggataaaactatacaagcaaatgtattagaaatcataagcccaaacttgttttatgctctaccaaaagggatgccagaaaatcaggaaaagctgtgcatgttgacagctgaattattagaatactgcaatgctccgaaaagtcgaccaccctatagaccaagaattggagacgcatgctgtgccaaatacacaagtgatgatttttggtatcgtgcagttgttctggggacatcagacactgatgtggaagtgctctatgcagactatggaaacattgaaaccctgcctctttgcagagtgcaaccaatcacctctagccacctggcgcttcctttccaaattattagatgttcacttgaagaaaagatgtataggatgaattgctgctgcacagagttacagaaacaagttgaaaaacatgaacatattcttctcttcctcttaaacaattcaaccaatcaaaataaatttattgaaatgaaaaaactgttaaaaaaaacagcatctcttggaggtaaacccttatgagacaggaaacagcaaaggctagctttaggagagaaagtacagcacctggtgtttttatttatgagaaccttttctttgtccactttctctgtaatgaccttctatccctccgtttttgcctgcctgccattctcctattaggttggtggtttttattttcctctaagttccttccaccaaataaatattacgtaaaaaattcataccaaatcaatgagaatactggcaaggaatacatagggactttctgctatatatgtaactttttattacttaaaggtaccgaaggaaggccaggtgcagtggctcacgcccagcactttgggaggctgaggtgggaggatcccttgaggccaggagttcaaggttacagtgagctatgatagtgccactgcactccagcctgggtgacagattttgtcttaaaaaaaaaaaaaaaaaagttgatatgagttttattttctgtccgtttgaaatattttgtaatattccctgcattctctgtcgtctgcctcttccacataatgtcctttgctttcatgtttgttatcttctttttctgttcactcagaggtcatcaatttctttctctccgtccttaattggattatttttcttttggcctttgggcacagagtctgacctctggaccactctaactggagaaggaactttatgttccctctcctgctgtgtccacaaccttagaaatctgtagctagatttttgttgttatagatagaatttactgtttctgaaacccaaatacagttatcagtttaaggtt

SEQ ID NO: 33159 - DNA, 3019 bp, Homo sapiens
acccaccctgcgccccagccctctacagcgcgggcgaagggcatcggcggggaagcggctgtggttgccagatctggcagtacagagccaaggtggcagggccgcgctaggacacggatggtcccagggggagggcaacaggaaaaacaagcactgacacaactgccccatttccccatgtcccctaaaagcaggttttcttgggctgaccagggcattttcactgtggtgtccgactggggcaactcgatctgcccgcggggactcaaaaaagcttgagctgcattttttctttgcgtccgggcggaccaaaaggcgaggtgaagggaacgagtgtttataagaaagtaaacttttgtgcagaatgggctggggacacctctgagttttgctgcccgcaacgtgacctttttagcgcggtcctggacgcgttccctcgcagccaacccgtcagtctcctcaggccttatcctgccctctctgaggtggccgcctgtgggcgctgcaaacgccacacttttgctctacgaagaacctcctcgcgactttccaaggtatctttcagatgaaggcattgaagcttgcacaagctctccagacaaagtcaatgtaaatgacatcatcctgattgctctcaatatctgagaacaattggcaagaaattcctccccagtgacatcaatagtggaaaggtagaaaagctcgaaggtccatgtgttttgcaaattcaaaaaattcgcaatgttgctgcaccaaaggataatgaagaatctcaggctgcaccaaggatgctgcgattacagatgactgatggtcatataagttgcacagcagtagaatttagttatatgtcaaaaataagcctgaacacaccacctggaactaaagttaagctctcaggcattgttgacataaaaaatggattcctgctcttgaatgactctaacaccacagttcttggtggtgaagtggaacaccttattgagaaatgggagttacagagaagcttatcaaaacacaatagaagcaatattggaactgaaggtggaccaccgccttttgtgccttttggacagaagtgtgtatctcatgtccaagtggatagcagagaacttgatcgaagaaaaacattgcaagttacaatgcctgtcaaacctacaaatgataatgatgaatttgaaaagcaaaggacggctgctattgctgaagttgcaaagagcaaggaaaccaagacatttggaggaggtggtggtggtgctagaagtaatctcaatatgaatgctgctggtaaccgaaatagggaagttttacagaaagaaaagtcaaccaaatcagagggaaaacatgaaggtgtctatagagaactggttgatgagaaagctctgaagcacataacggaaatgggcttcagtaaggaagcatcgaggcaagctcttatggataatggcaacaacttagaagcagcactgaacgtacttcttacaagcaataaacagaaacctgttatgggtcctcctctgagaggtagaggaaaaggcagggggcgaataagatctgaagatgaagaggacctgggaaatgcaaggccatcagcaccaagcacattatttgatttcttggaatctaaaatgggaactttgaatgtggaagaacctaaatcacagccacagcagcttcatcagggacaatacagatcatcaaatactgagcaaaatggagtaaaagataataatcatctgagacatcctcctcgaaatgataccaggcagccaagaaatgaaaaaccgcctcgttttcaaagagactcccaaaattcaaagtcagttttagaaggcagtggattacctagaaatagaggttctgaaagaccaagtacttcttcagtatctgaagtatgggctgaagacagaatcaaatgtgatagaccgtattctagatatgacagaactaaagatacttcatatcctttaggttctcagcatagtgatggtgcttttaaaaaaagagataactctatgcaaagcagatcaggaaaaggtccctcctttgcagaggcaaaagaaaatccacttcctcaaggatctgtagattataataatcaaaaacgtggaaaaagagaaagccaaacatctattcctgattatttttatgacaggaaatcacaaacaataaataatgaagctttcagtggtataaaaattgaaaaacattttaatgtaaatactgattatcagaatccagttcgaagtaatagtttcattggtgttccaaatggagaagtagaaatgccactgaaaggaagacgaataggacctattaagccagcaggacctgtcacagctgtaccctgtgatgataaaatattttacaatagtgggcccaaacgaagatctgggccaattaagccagaaaaaatactagaatcatctattcctatggagtatgcaaaaatgtggaaacctggagatgaatgttttgcactttattgggaagacaacaagttttaccgggcagaagttgaagccctccattcttcgggtatgacagcagttgttaaattcattgactacggaaactatgaagaggtgctactgagcaatatcaagcccattcaaacagaggcatgggaggaagaaggcacctacgatcaaactctggagttccgtaggggaggtgatggccagccaagacgatccactcggccaacccaacagttttaccaaccaccccgggctcggaactaataggaaaagtagactctttgtgaagaaacgagccagtgactgaaacaccctggtggaaacctgttgacagaccttccactttctcttcagaataagtagctgtggtggatattattatttgaagaaagaaaaaacagattttagggtggaaaaaacagtcaactcacacaaagaatggaaaaaaatactgagttaaattaagcaaataccttttacaagtgaaaggaagaatttttcttctgccgtcaataaaaccattgtgctattattgtttt

SEQ ID NO: 33160 - DNA, 2528 bp, Homo sapiens
gccgcctgtgggcgctgcaaacgccacacttttgctctacgaagaacctcctcgcgactttccaagaggtatctttcagatgaaggcattgaagcttgcacaagctctccagacaaagtcaatgtaaatgacatcatcctgattgctctcaatacagatctgagaacaattggcaagaaattcctccccagtgacatcaatagtggaaaggtagaaaagctcgaaggtccatgtgttttgcaaattcaaaaaattcgcaatgttgctgcaccaaaggataatgaagaatctcaggctgcaccaaggatgctgcgattacagatgactgatggtcatataagttgcacagcagtagaatttagttatatgtcaaaaataagcctgaacacaccacctggaactaaagttaagctctcaggcattgttgacataaaaaatggattcctgctcttgaatgactctaacaccacagttcttggtggtgaagtggaacaccttattgagaaatgggagttacagagaagcttatcaaaacacaatagaagcaatattggaactgaaggtggaccaccgccttttgtgccttttggacagaagtgtgtatctcatgtccaagtggatagcagagaacttgatcgaagaaaaacattgcaagttacaatgcctgtcaaacctacaaatgataatgatgaatttgaaaagcaaaggacggctgctattgctgaagttgcaaagagcaaggaaaccaagacatttggaggaggtggtggtggtgctagaagtaatctcaatatgaatgctgctggtaaccgaaatagggaagttttacagaaagaaaagtcaaccaaatcagagggaaaacatgaaggtgtctatagagaactggttgatgagaaagctctgaagcacataacggaaatgggcttcagtaaggaagcatcgaggcaagctcttatggataatggcaacaacttagaagcagcactgaacgtacttcttacaagcaataaacagaaacctgttatgggtcctcctctgagaggtagaggaaaaggcagggggcgaataagatctgaagatgaagaggacctgggaaatgcaaggccatcagcaccaagcacattatttgatttcttggaatctaaaatgggaactttgaatgtggaagaacctaaatcacagccacagcagcttcatcagggacaatacagatcatcaaatactgagcaaaatggagtaaaagataataatcatctgagacatcctcctcgaaatgataccaggcagccaagaaatgaaaaaccgcctcgttttcaaagagactcccaaaattcaaagtcagttttagaaggcagtggattacctagaaatagaggttctgaaagaccaagtacttcttcagtatctgaagtatgggctgaagacagaatcaaatgtgatagaccgtattctagatatgacagaactaaagatacttcatatcctttaggttctcagcatagtgatggtgcttttaaaaaaagagataactctatgcaaagcagatcaggaaaaggtccctcctttgcagaggcaaaagaaaatccacttcctcaaggatctgtagattataataatcaaaaacgtggaaaaagagaaagccaaacatctattcctgattatttttatgacaggaaatcacaaacaataaataatgaagctttcagtggtataaaaattgaaaaacattttaatgtaaatactgattatcagaatccagttcgaagtaatagtttcattggtgttccaaatggagaagtagaaatgccactgaaaggaagacgaataggacctattaagccagcaggacctgtcacagctgtaccctgtgatgataaaatattttacaatagtgggcccaaacgaagatctgggccaattaagccagaaaaaatactagaatcatctattcctatggagtatgcaaaaatgtggaaacctggagatgaatgttttgcactttattgggaagacaacaagttttaccgggcagaagttgaagccctccattcttcgggtatgacagcagttgttaaattcattgactacggaaactatgaagaggtgctactgagcaatatcaagcccattcaaacagaggcatgggaggaagaaggcacctacgatcaaactctggagttccgtaggggaggtgatggccagccaagacgatccactcggccaacccaacagttttaccaaccaccccgggctcggaactaataggaaaagactctttgtgaagaaacgagccagtgactgaaacaccctggtggaaacctgttgacagaccttccactttctcttcagaataagtagctgtggtggatattattatttgaagaaagaaaaaacagattttagggtggaaaaaacagtcaactcacacaaagaatggaaaaaaatactgagttaaattaagcaaataccttttacaagtgaaaggaagaatttttcttctgccgtcaataaaaccattgtgctattat

SEQ ID NO: 33161 - DNA, 660 bp, Homo sapiens
tatatgccaagtgacttctgaacacgacgtgaagacagtatctttcagatgaaggcattgaagcttgcacaagctctccagacaaagtcaatgtaaatgacatcatcctgattgctctcaatatctgagaacaattggcaagaaattcctccccagtgacatcaatagtggaaaggtagaaaagctcgaaggtccatgtgttttgcaaattcaaaaaattcgcaatgttgctgcaccaaaggataatgaagaatctcaggctgcaccaaggatgctgcgattacagatgactgatggtcatataagttgcacagcagtagaatttagttatatgtcaaaaataagcctgaacacaccacctggaactaaagttaagctctcaggcattgttgacataaaaaatggattcctgctcttgaatgactctaacaccacagttcttggtggtgaagtggaacaccttattgagaaatgggagttacagagaagcttatcaaaacacaatagaagcaatattggaactgaaggtggaccaccgccttttgtgccttttggacagaagtgtgtatctcatgtccaagtggatagcagagaacttgatcgaagaaaaacattgcaagttacaatgcctgtcaaacctacaaatgataatgatgaatt

SEQ ID NO: 33162 - DNA, 2484 bp, Homo sapiens
gaacctcctcgcgactttccaaggtatctttcagatgaaggcattgaagcttgcacaagctctccagacaaagtcaatgtaaatgacatcatcctgattgctctcaatatctgagaacaattggcaagaaattcctccccagtgacatcaatagtggaaaggtagaaaagctcgaaggtccatgtgttttgcaaattcaaaaaattcgcaatgttgctgcaccaaaggataatgaagaatctcaggctgcaccaaggatgctgcgattacagatgactgatggtcatataagttgcacagcagtagaatttagttatatgtcaaaaataagcctgaacacaccacctggaactaaagttaagctctcaggcattgttgacataaaaaatggattcctgctcttgaatgactctaacaccacagttcttggtggtgaagtggaacaccttattgagaaatgggagttacagagaagcttatcaaaacacaatagaagcaatattggaactgaaggtggaccaccgccttttgtgccttttggacagaagtgtgtatctcatgtccaagtggatagcagagaacttgatcgaagaaaaacattgcaagttacaatgcctgtcaaacctacaaatgataatgatgaatttgaaaagcaaaggacggctgctattgctgaagttgcaaagagcaaggaaaccaagacatttggaggaggtggtggtggtgctagaagtaatctcaatatgaatgctgctggtaaccgaaatagggaagttttacagaaagaaaagtcaaccaaatcagagggaaaacatgaaggtgtctatagagaactggttgatgagaaagctctgaagcacataacggaaatgggcttcagtaaggaagcatcgaggcaagctcttatggataatggcaacaacttagaagcagcactgaacgtacttcttacaagcaataaacagaaacctgttatgggtcctcctctgagaggtagaggaaaaggcagggggcgaataagatctgaagatgaagaggacctgggaaatgcaaggccatcagcaccaagcacattatttgatttcttggaatctaaaatgggaactttgaatgtggaagaacctaaatcacagccacagcagcttcatcagggacaatacagatcatcaaatactgagcaaaatggagtaaaagataataatcatctgagacatcctcctcgaaatgataccaggcagccaagaaatgaaaaaccgcctcgttttcaaagagactcccaaaattcaaagtcagttttagaaggcagtggattacctagaaatagaggttctgaaagaccaagtacttcttcagtatctgaagtatgggctgaagacagaatcaaatgtgatagaccgtattctagatatgacagaactaaagatacttcatatcctttaggttctcagcatagtgatggtgcttttaaaaaaagagataactctatgcaaagcagatcaggaaaaggtccctcctttgcagaggcaaaagaaaatccacttcctcaaggatctgtagattataataatcaaaaacgtggaaaaagagaaagccaaacatctattcctgattatttttatgacaggaaatcacaaacaataaataatgaagctttcagtggtataaaaattgaaaaacattttaatgtaaatactgattatcagaatccagttcgaagtaatagtttcattggtgttccaaatggagaagtagaaatgccactgaaaggaagacgaataggacctattaagccagcaggacctgtcacagctgtaccctgtgatgataaaatattttacaatagtgggcccaaacgaagatctgggccaattaagccagaaaaaatactagaatcatctattcctatggagtatgcaaaaatgtggaaacctggagatgaatgttttgcactttattgggaagacaacaagttttaccgggcagaagttgaagccctccattcttcgggtatgacagcagttgttaaattcattgactacggaaactatgaagaggtgctactgagcaatatcaagcccattcaaacagaggcatgggaggaagaaggcacctacgatcaaactctggagttccgtaggggaggtgatggccagccaagacgatccactcggccaacccaacagttttaccaaccaccccgggctcggaactaataggaaaagactctttgtgaagaaacgagccagtgactgaaacaccctggtggaaacctgttgacagaccttccactttctcttcagaataagtagctgtggtggatattattatttgaagaaagaaaaaacagattttagggtggaaaaaacagtcaactcacacaaagaatggaaaaaaatactgagttaaattaagcaaataccttttacaagtgaaaggaagaatttttcttctgccgtcaataaaaccattgtgctattattgttt

SEQ ID NO: 33163 - DNA, 2579 bp, Homo sapiens
ggggtctcaagtaggaggcctccccatcacccccaccccagccccccaccacccccggcctaagcagctaccatggcccaggtggccggcgcggcgttgtcccaggcgggttggtatctttcagatgaaggcattgaagcttgcacaagctctccagacaaagtcaatgtaaatgacatcatcctgattgctctcaatacagatctgagaacaattggcaagaaattcctccccagtgacatcaatagtggaaaggtagaaaagctcgaaggtccatgtgttttgcaaattcaaaaaattcgcaatgttgctgcaccaaaggataatgaagaatctcaggctgcaccaaggatgctgcgattacagatgactgatggtcatataagttgcacagcagtagaatttagttatatgtcaaaaataagcctgaacacaccacctggaactaaagttaagctctcaggcattgttgacataaaaaatggattcctgctcttgaatgactctaacaccacagttcttggtggtgaagtggaacaccttattgagaaatgggagttacagagaagcttatcaaaacacaatagaagcaatattggaactgaaggtggaccaccgccttttgtgccttttggacagaagtgtgtatctcatgtccaagtggatagcagagaacttgatcgaagaaaaacattgcaagttacaatgcctgtcaaacctacaaatgataatgatgaatttgaaaagcaaaggacggctgctattgctgaagttgcaaagagcaaggaaaccaagacatttggaggaggtggtggtggtgctagaagtaatctcaatatgaatgctgctggtaaccgaaatagggaagttttacagaaagaaaagtcaaccaaatcagagggaaaacatgaaggtgtctatagagaactggttgatgagaaagctctgaagcacataacggaaatgggcttcagtaaggaagcatcgaggcaagctcttatggataatggcaacaacttagaagcagcactgaacgtacttcttacaagcaataaacagaaacctgttatgggtcctcctctgagaggtagaggaaaaggcagggggcgaataagatctgaagatgaagaggacctgggaaatgcaaggccatcagcaccaagcacattatttgatttcttggaatctaaaatgggaactttgaatgtggaagaacctaaatcacagccacagcagcttcatcagggacaatacagatcatcaaatactgagcaaaatggagtaaaagataataatcatctgagacatcctcctcgaaatgataccaggcagccaagaaatgaaaaaccgcctcgttttcaaagagactcccaaaattcaaagtcagttttagaaggcagtggattacctagaaatagaggttctgaaagaccaagtacttcttcagtatctgaagtatgggctgaagacagaatcaaatgtgatagaccgtattctagatatgacagaactaaagatacttcatatcctttaggttctcagcatagtgatggtgcttttaaaaaaagagataactctatgcaaagcagatcaggaaaaggtccctcctttgcagaggcaaaagaaaatccacttcctcaaggatctgtagattataataatcaaaaacgtggaaaaagagaaagccaaacatctattcctgattatttttatgacaggaaatcacaaacaataaataatgaagctttcagtggtataaaaattgaaaaacattttaatgtaaatactgattatcagaatccagttcgaagtaatagtttcattggtgttccaaatggagaagtagaaatgccactgaaaggaagacgaataggacctattaagccagcaggacctgtcacagctgtaccctgtgatgataaaatattttacaatagtgggcccaaacgaagatctgggccaattaagccagaaaaaatactagaatcatctattcctatggagtatgcaaaaatgtggaaacctggagatgaatgttttgcactttattgggaagacaacaagttttaccgggcagaagttgaagccctccattcttcgggtatgacagcagttgttaaattcattgactacggaaactatgaagaggtgctactgagcaatatcaagcccattcaaacagaggcatgggaggaagaaggcacctacgatcaaactctggagttccgtaggggaggtgatggccagccaagacgatccactcggccaacccaacagttttaccaaccaccccgggctcggaactaataggaaaagactctttgtgaagaaacgagccagtgactgaaacaccctggtggaaacctgttgacagaccttccactttctcttcagaataagtagctgtggtggatattattatttgaagaaagaaaaaacagattttagggtggaaaaaacagtcaactcacacaaagaatggaaaaaaatactgagttaaattaagcaaataccttttacaagtgaaaggaagaatttttcttctgccgtcaataaaaccattgtgctattattgtttt

SEQ ID NO: 33164 - DNA, 3834 bp, Homo sapiens
ggcgacggtttcccttcccacgcgcggacgccggcgtgggccgacgcggccggagcgcccgcgcgtgcgcagagccgaggccaggctgccctcgaagcggggcggggcgaagcggggcggggccgagcagggcggggcgggggcttgaggtgattcccaagccgcggggcggctccggtggtgcggggaaaccgaaagtgggcggcggccgcggcggggcccctggcggagacggcggcaggagctgggcccagagacgcggggacgggccgtgggcccccggaacgaggcaaagatgctggaaggagatctggtttcaaagatgctacgagctgttctgcagtctcataagaatggagtagcattaccccggctccaaggagagtacagatccttgactggagactggatccccttcaaacagctaggtttccctacactagaagcctatctgagaagtgtgccagcagtggtcaggatagagactagtagatctggagagattacctgctatgccatggcctgcacagaaactgcaagaattgctcagcttgtggctcgtcaaaggagttctaaaaggaaaaccgggcgtcaagttaattgtcagatgagagtgaagaaaaccatgccattttttctagaaggaaaaccaaaagcaaccctcagacaaccaggatttgcttcaaatttttctgttggcaaaaaacctaatccagcaccgttaagagacaaaggaaactctgttggagttaagcctgatgctgaaatgtctccttatatgctacacacaactcttggaaatgaagcattcaaagacattccagtgcaaaggcatgtgaccatgtccaccaacaacaggtttagcccaaaggcgtcccttcaaccacctttgcagatgcatctctcaagaacctctactaaggaaatgagtgataatttaaatcagactgttgaaaaacccaatgtcaagcctcctgcctcttacacttataaaatggatgaggttcaaaatcgcataaaggaaatactaaacaagcataacaatggcatttggatatctaagcttccacatttttacaaagagttatataaagaagaccttaatcaaggaattttacaacagtttgaacactggcctcatatttgcacggtggagaaaccttgcagtggtggccaagatttacttctttatccagctaagagaaagcagcttttgagaagtgaactggatactgagaaagtacctctatccccactacctggtcccaaacaaacaccaccgttgaaagggtgtccaacagttatggcaggagactttaaagaaaaagtggcagacctgctggtgaaatacacaagtggcctttgggccagtgcacttccgaaagcatttgaggaaatgtacaaagtgaaattccctgaggatgccttaaaaaatcttgcctcactttctgatgtatgcagcatagactacatttctggaaatccccagaaggccattctctatgctaaacttccattgcccactgacaaaatccaaaaggatgcagggcaagcacatggtgataatgatatcaaggctatggttgaacaagagtatttgcaggtagaagaaagcattgctgaaagtgctaatacctttatggaggacataacagttcctcctttaatgattccaactgaagcatcaccatctgtattggtggttgaactgagcaacacaaatgaagtggttatcaggtatgtgggcaaagactattctgctgctcaggaattaatggaagatgagatgaaggaatattacagtaagaatcctaagatcacaccagtccaggctgtgaatgttgggcagttgctggccgtaaatgccgaggaggacgcctggttacgggcacaggtcatctcaacagaagagaacaaaataaaggtatgctatgttgactatggttttagtgaaaatgttgaaaaaagcaaagcatacaaattaaacccgaagttttgttcactctcatttcaagctacaaaatgtaagcttgcaggcttggaagtcctaagcgatgaccctgatctagtgaaggtggttgaatctttaacttgtggaaagatctttgcagtggaaatacttgacaaagctgacattccacttgttgttctgtacgatacctcaggagaagatgatatcaatatcaatgccacctgcttgaaggctatatgtgacaagtcactagaggttcacctgcaggttgacgccatgtacacaaatgtcaaagtaactaatatttgctctgatgggacactctactgccaggtgccttgtaagggtctgaacaagctcagtgaccttctacgtaagatagaggactacttccattgcaagcacatgacctctgagtgctttgtttcattacccttctgtgggaaaatctgcctcttccattgcaaaggaaaatggttacgagtagagatcacaaatgttcacagcagccgggctcttgatgttcagttcctggactctggcactgtgacatctgtaaaagtgtcagagctcagggaaattccacctcggtttctacaagaaatgattgcaataccacctcaggccattaagtgctgtttagcagatcttccacaatctattggcatgtggacaccagatgcagtgctgtggttaagagattctgttttgaattgctcggactgtagcattaaggttacaaaagtggatgaaaccagagggatcgcacatgtttatttatttacccctaagaacttccctgaccctcatcgcagtattaatcgccagattacaaatgcagacttgtggaagcatcagaaggatgtgtttttgagtgccatatccagtggagctgactctcccaacagcaaaaatggcaacatgcccatgtcgggcaacactggagagaatttcagaaagaacctcacagatgtcatcaaaaagtccatggtggaccatacgagcgctttctccacagaggaactgccacctcctgtccacttatcaaagccaggggaacacatggatgtgtatgtgcctgtggcctgtcacccaggctacttcgtcatccagccttggcaggagatacataagttggaagttctgatggaagagatgattctatattacagcgtgtctgaagagcgccacatagcagtggagaaagaccaagtgtatgctgcaaaagtggaaaataagtggcacagggtgcttttaaaaggaatcctgaccaatggactggtatctgtgtatgagctggattatggcaaacacgaattagtcaacataagaaaagtacagcccctagtggacatgttccgaaagctgcccttccaagcagtcacagctcaacttgcaggagtgaagtgcaaccagtggtctgaggaggcttctatggtgtttcgaaatcatgtggagaagaaacctctggtggcactggtgcagacagtcattgaaaatgctaacccttgggaccggaaagtagtggtctacttagtggacacatcgttgccagacaccgatacctggattcatgattttatgtcagagtatctgatagagctttcaaaagttaattaatgactgcctctgaaaccttgacaactaattcagattttttagcaataacaaaatgtagtaggcttaaaaaaaatcttaactctgctacatggctctgactgctgtgggggattgaaaagaatatgcttatgtttgatgaaagatatttaacaagttttgttttaacagagttgacttttcaaagaaaattgtacttgaattattactataatattagaataaaaatgtttatcaatataaaa

SEQ ID NO: 33165 - DNA, 3473 bp, Homo sapiens
ttgaggtgattcccaagccgcggggcggctccggtggtgcggggaaaccgaaagtgggcggcggccgcggcggggcccctggcggagacggcggcaggagctgggcccagagacgcggggacgggccgtgggcccccggaacgagattacctgctatgccatggcctgcacagaaactgcaagaattgctcagcttgtggctcgtcaaaggagttctaaaaggaaaaccgggcgtcaagttaattgtcagatgagagtgaagaaaaccatgccattttttctagaaggaaaaccaaaagcaaccctcagacaaccaggatttgcttcaaatttttctgttggcaaaaaacctaatccagcaccgttaagagacaaaggaaactctgttggagttaagcctgatgctgaaatgtctccttatatgctacacacaactcttggaaatgaagcattcaaagacattccagtgcaaaggcatgtgaccatgtccaccaacaacaggtttagcccaaaggcgtcccttcaaccacctttgcagatgcatctctcaagaacctctactaaggaaatgagtgataatttaaatcagactgttgaaaaacccaatgtcaagcctcctgcctcttacacttataaaatggatgaggttcaaaatcgcataaaggaaatactaaacaagcataacaatggcatttggatatctaagcttccacatttttacaaagagttatataaagaagaccttaatcaaggaattttacaacagtttgaacactggcctcatatttgcacggtggagaaaccttgcagtggtggccaagatttacttctttatccagctaagagaaagcagcttttgagaagtgaactggatactgagaaagtacctctatccccactacctggtcccaaacaaacaccaccgttgaaagggtgtccaacagttatggcaggagactttaaagaaaaagtggcagacctgctggtgaaatacacaagtggcctttgggccagtgcacttccgaaagcatttgaggaaatgtacaaagtgaaattccctgaggatgccttaaaaaatcttgcctcactttctgatgtatgcagcatagactacatttctggaaatccccagaaggccattctctatgctaaacttccattgcccactgacaaaatccaaaaggatgcagggcaagcacatggtgataatgatatcaaggctatggttgaacaagagtatttgcaggtagaagaaagcattgctgaaagtgctaatacctttatggaggacataacagttcctcctttaatgattccaactgaagcatcaccatctgtattggtggttgaactgagcaacacaaatgaagtggttatcaggtatgtgggcaaagactattctgctgctcaggaattaatggaagatgagatgaaggaatattacagtaagaatcctaagatcacaccagtccaggctgtgaatgttgggcagttgctggccgtaaatgccgaggaggacgcctggttacgggcacaggtcatctcaacagaagagaacaaaataaaggtatgctatgttgactatggttttagtgaaaatgttgaaaaaagcaaagcatacaaattaaacccgaagttttgttcactctcatttcaagctacaaaatgtaagcttgcaggcttggaagtcctaagcgatgaccctgatctagtgaaggtggttgaatctttaacttgtggaaagatctttgcagtggaaatacttgacaaagctgacattccacttgttgttctgtacgatacctcaggagaagatgatatcaatatcaatgccacctgcttgaaggctatatgtgacaagtcactagaggttcacctgcaggttgacgccatgtacacaaatgtcaaagtaactaatatttgctctgatgggacactctactgccaggtgccttgtaagggtctgaacaagctcagtgaccttctacgtaagatagaggactacttccattgcaagcacatgacctctgagtgctttgtttcattacccttctgtgggaaaatctgcctcttccattgcaaaggaaaatggttacgagtagagatcacaaatgttcacagcagccgggctcttgatgttcagttcctggactctggcactgtgacatctgtaaaagtgtcagagctcagggaaattccacctcggtttctacaagaaatgattgcaataccacctcaggccattaagtgctgtttagcagatcttccacaatctattggcatgtggacaccagatgcagtgctgtggttaagagattctgttttgaattgctcggactgtagcattaaggttacaaaagtggatgaaaccagagggatcgcacatgtttatttatttacccctaagaacttccctgaccctcatcgcagtattaatcgccagattacaaatgcagacttgtggaagcatcagaaggatgtgtttttgagtgccatatccagtggagctgactctcccaacagcaaaaatggcaacatgcccatgtcgggcaacactggagagaatttcagaaagaacctcacagatgtcatcaaaaagtccatggtggaccatacgagcgctttctccacagaggaactgccacctcctgtccacttatcaaagccaggggaacacatggatgtgtatgtgcctgtggcctgtcacccaggctacttcgtcatccagccttggcaggagatacataagttggaagttctgatggaagagatgattctatattacagcgtgtctgaagagcgccacatagcagtggagaaagaccaagtgtatgctgcaaaagtggaaaataagtggcacagggtgcttttaaaaggaatcctgaccaatggactggtatctgtgtatgagctggattatggcaaacacgaattagtcaacataagaaaagtacagcccctagtggacatgttccgaaagctgcccttccaagcagtcacagctcaacttgcaggagtgaagtgcaaccagtggtctgaggaggcttctatggtgtttcgaaatcatgtggagaagaaacctctggtggcactggtgcagacagtcattgaaaatgctaacccttgggaccggaaagtagtggtctacttagtggacacatcgttgccagacaccgatacctggattcatgattttatgtcagagtatctgatagagctttcaaaagttaattaatgactgcctctgaaaccttgacaactaattcagattttttagcaataacaaaatgtagtaggcttaaaaaaaatcttaactctgctacatggctctgactgctgtgggggattgaaaagaatatgcttatgtttgatgaaagatatttaacaagttttgttttaacagagttgacttttcaaagaaaattgtacttgaattattactataatattagaataaaaatgtttatcaatat

SEQ ID NO: 33166 - DNA, 1887 bp, Homo sapiens
attgctgctgagaattatgggctggatgtgaagaataaaaaaggtagctcggtattttgtgcagtagcaagctcttgggacagcggtgattgtagcaatccgggcctgaacttgttccccacatccccttgaagctgacagagatgatttctccctttatttggagaaaccccagctacttagcaccagtcttgcttcgcttgaattgaactttgtctggtggtatgctatgttgactatggttttagtgaaaatgttgaaaaaagcaaagcatacaaattaaacccgaagttttgttcactctcatttcaagctacaaaatgtaagcttgcaggcttggaagtcctaagcgatgaccctgatctagtgaaggtggttgaatctttaacttgtggaaagatctttgcagtggaaatacttgacaaagctgacattccacttgttgttctgtacgatacctcaggagaagatgatatcaatatcaatgccacctgcttgaaggctatatgtgacaagtcactagaggttcacctgcaggttgacgccatgtacacaaatgtcaaagtaactaatatttgctctgatgggacactctactgccaggtgccttgtaagggtctgaacaagctcagtgaccttctacgtaagatagaggactacttccattgcaagatcacaaatgttcacagcagccgggctcttgatgttcagttcctggactctggcactgtgacatctgtaaaagtgtcagagctcagggaaattccacctcggtttctacaagaaatgattgcaataccacctcaggccattaagtgctgtttagcagatcttccacaatctattggcatgtggacaccagatgcagtgctgtggttaagagattctgttttgaattgctcggactgtagcattaaggttacaaaagtggatgaaaccagagggatcgcacatgtttatttatttacccctaagaacttccctgaccctcatcgcagtattaatcgccagattacaaatgcagacttgtggaagcatcagaaggatgtgtttttgagtgccatatccagtggagctgactctcccaacagcaaaaatggcaacatgcccatgtcgggcaacactggagagaatttcagaaagaacctcacagatgtcatcaaaaagtccatggtggaccatacgagcgctttctccacagaggaactgccacctcctgtccacttatcaaagccaggggaacacatggatgtgtatgtgcctgtggcctgtcacccaggctacttcgtcatccagccttggcaggagatacataagttggaagttctgatggaagagatgattctatattacagcgtgtctgaagagcgccacatagcagtggagaaagaccaagtgtatgctgcaaaagtggaaaataagtggcacagggtgcttttaaaaggaatcctgaccaatggactggtatctgtgtatgagctggattatggcaaacacgaattagtcaacataagaaaagtacagcccctagtggacatgttccgaaagctgcccttccaagcagtcacagctcaacttgcaggagtgaagtgcaaccagtggtctgaggaggcttctatggtgtttcgaaatcatgtggagaagaaacctctggtggcactggtgcagacagtcattgaaaatgctaacccttgggaccggaaagtagtggtctacttagtggacacatcgttgccagacaccgatacctggattcatgattttatgtcagagtatctgatagagctttcaaaagttaattaatgactgcctctgaaaccttgacaactaattcagattttttagcaataacaaaatgtagtaggcttaaaaaaaatcttaactctg

SEQ ID NO: 33167 - DNA, 2896 bp, Homo sapiens
gtcatttccggcgcgccggccacggtgcttccgggttctggtgtaggagcggcgtcttctcgcgcggatggtgaagctgaatttggtacgctggaccctcggacagacagcaagagagagacaagcccgaggcctgacttctagcactcctgagtttgagccctatgagcagtggaacctaggttcttcagctttggaacttgactggctctccttgctcctcagcctgcagacagcctattgtgggaccttttgatcgtgaccaccaaggatccagatataattctttcctcagtaatagaaaaaagaatctgggatctaagaagatacctactcattttctaagtgactggccatgtcattgtcccacttataccgggatggggaaggccgcattgatgatgatgatgacgagcgggagaactttgagatcactgactgggatctccagaatgagttcaaccccaaccgacagcgccactggcagaccaaggaagaagccacctacggggtgtgggcagagcgagactcggatgatgagaggcccagctttggaggcaaacgggcccgtgactactctgcgccagtcaacttcatcagcgcagggctcaagaaaggggcagcggaggaggcagagttggaagattctgatgacgaagagaaacctgttaagcaggacgactttcctaaggattttggaccaaggaagctaaaaacgggtggcaattttaagcccagccagaaaggttttgcaggaggaaccaaatctttcatggacttcggcagctgggaaagacacacaaaaggaattggacagaagcttcttcagaagatgggctacgtccctggacggggcctcgggaagaatgcacaaggtatcattaacccaattgaagccaagcagagaaagggaaaaggtgctgtgggggcttatggatccgagcgcaccactcagtccatgcaagacttccctgtggttgactcagaggaagaagctgaagaggagtttcagaaggagctgagccagtggaggaaagacccaagtggaagcaagaagaagcccaaatactcttacaagaccgtggaagagttgaaggccaagggcaggattagcaagaagctcactgctccccagaaggaactttctcaagtcaaggtcatagacatgacaggccgggagcagaaggtctactacagctacagtcagatcagccacaagcacaacgttcccgatgatgggctgccgctacagtcccaacagctgccacagtctggcaaagaggccaaggcccccggcttcgcgctgcccgagctggagcacaacctgcagctgctcatcgacctcacggagcaggagatcatccagaatgaccggcagctacagtatgagcgggacatggtggtcaacctcttccacgagctggagaagatgaccgaggtcctggaccacgaggagcgggtcatctcgaacctcagcaaggtcctggagatggtggaggagtgcgagcggcggatgcagcccgactgcagcaaccccctcaccctggacgagtgtgcccgcatcttcgaaaccctgcaggacaagtactatgaggagtacaggatgtccgaccgtgtggaccttgctgtggccatcgtctatccactcatgaaggagtacttcaaggagtgggatcccctcaaagactgcacttatggcaccgagatcatctctaagtggaaaagcctcctagagaatgaccagctcttgtcccatggcggacaggacctctcagcagatgcctttcacaggttgatatgggaagtctggatgccttttgttcgaaatattgtcacccagtggcagccaaggaactgtgacccgatggtggactttttggatagttgggtgcacattattcctgtgtggatcttagataacatactggaccaactcatcttccccaagctgcaaaaggaggtggaaaactggaacccgctcacagacactgttcccatccactcttggatccacccatggctgccccttatgcaggcacggctggagccactctattcccccatccgtagtaagctgtccagcgccctgcagaagtggcaccccagcgactcctctgccaagctcatcctccagccctggaaggatgtcttcactcctggctcctgggaagcattcatggtcaaaaacatagtgcccaagctggggatgtgtcttggtgagctagtcattaacccccaccagcagcacatggatgcattctattgggtgattgactgggaagggatgatctctgtctctagcctggtgggacttcttgaaaagcacttcttccccaagtggcttcaggtgctgtgctcttggctcagtaacagcccaaattatgaggagatcaccaagtggtacctgggttggaagtcgatgttctcagaccaagtgctggcacatccatctgtcaaggacaaatttaatgaggcacttgatatcatgaaccgggcggtgtcctccaacgttggtgcctacatgcagccaggagcacgggagaacattgcctatctcacccacacggagcggaggaaggacttccagtacgaggccatgcaggagaggcgggaggctgagaacatggctcagaggggcattggcgtggccgctagctctgtgcccatgaactttaaggacctcattgagaccaaggctgaggagcacaacattgtcttcatgcccgtcattgggaagcgacacgaagggaagcagctctacacctttggccgcattgtgatctacatcgaccggggagtggtctttgtccagggcgagaagacgtgggtgcccacctcactgcagagcctgatcgacatggccaagtgaactgtggcaggtccagaaccagtcaga

SEQ ID NO: 33168 - DNA, 2789 bp, Homo sapiens
atttccggcgcgccggccacggtgcttccgggttctggtgtaggagcggcgtcttctcgcgcggatggtgaagctgaatttggtacgctggaccctcggacagacagcaagagagagacaagcccgaggcctgacttctagcactcctgagtttgagccctatgagcagtggaacctaggtgactggccatgtcattgtcccacttataccgggatggggaaggccgcattgatgatgatgatgacgagcgggagaactttgagatcactgactgggatctccagaatgagttcaaccccaaccgacagcgccactggcagaccaaggaagaagccacctacggggtgtgggcagagcgagactcggatgatgagaggcccagctttggaggcaaacgggcccgtgactactctgcgccagtcaacttcatcagcgcagggctcaagaaaggggcagcggaggaggcagagttggaagattctgatgacgaagagaaacctgttaagcaggacgactttcctaaggattttggaccaaggaagctaaaaacgggtggcaattttaagcccagccagaaaggttttgcaggaggaaccaaatctttcatggacttcggcagctgggaaagacacacaaaaggaattggacagaagcttcttcagaagatgggctacgtccctggacggggcctcgggaagaatgcacaaggtatcattaacccaattgaagccaagcagagaaagggaaaaggtgctgtgggggcttatggatccgagcgcaccactcagtccatgcaagacttccctgtggttgactcagaggaagaagctgaagaggagtttcagaaggagctgagccagtggaggaaagacccaagtggaagcaagaagaagcccaaatactcttacaagaccgtggaagagttgaaggccaagggcaggattagcaagaagctcactgctccccagaaggaactttctcaagtcaaggtcatagacatgacaggccgggagcagaaggtctactacagctacagtcagatcagccacaagcacaacgttcccgatgatgggctgccgctacagtcccaacagctgccacagtctggcaaagaggccaaggcccccggcttcgcgctgcccgagctggagcacaacctgcagctgctcatcgacctcacggagcaggagatcatccagaatgaccggcagctacagtatgagcgggacatggtggtcaacctcttccacgagctggagaagatgaccgaggtcctggaccacgaggagcgggtcatctcgaacctcagcaaggtcctggagatggtggaggagtgcgagcggcggatgcagcccgactgcagcaaccccctcaccctggacgagtgtgcccgcatcttcgaaaccctgcaggacaagtactatgaggagtacaggatgtccgaccgtgtggaccttgctgtggccatcgtctatccactcatgaaggagtacttcaaggagtgggatcccctcaaagactgcacttatggcaccgagatcatctctaagtggaaaagcctcctagagaatgaccagctcttgtcccatggcggacaggacctctcagcagatgcctttcacaggttgatatgggaagtctggatgccttttgttcgaaatattgtcacccagtggcagccaaggaactgtgacccgatggtggactttttggatagttgggtgcacattattcctgtgtggatcttagataacatactggaccaactcatcttccccaagctgcaaaaggaggtggaaaactggaacccgctcacagacactgttcccatccactcttggatccacccatggctgccccttatgcaggcacggctggagccactctattcccccatccgtagtaagctgtccagcgccctgcagaagtggcaccccagcgactcctctgccaagctcatcctccagccctggaaggatgtcttcactcctggctcctgggaagcattcatggtcaaaaacatagtgcccaagctggggatgtgtcttggtgagctagtcattaacccccaccagcagcacatggatgcattctattgggtgattgactgggaagggatgatctctgtctctagcctggtgggacttcttgaaaagcacttcttccccaagtggcttcaggtgctgtgctcttggctcagtaacagcccaaattatgaggagatcaccaagtggtacctgggttggaagtcgatgttctcagaccaagtgctggcacatccatctgtcaaggacaaatttaatgaggcacttgatatcatgaaccgggcggtgtcctccaacgttggtgcctacatgcagccaggagcacgggagaacattgcctatctcacccacacggagcggaggaaggacttccagtacgaggccatgcaggagaggcgggaggctgagaacatggctcagaggggcattggcgtggccgctagctctgtgcccatgaactttaaggacctcattgagaccaaggctgaggagcacaacattgtcttcatgcccgtcattgggaagcgacacgaagggaagcagctctacacctttggccgcattgtgatctacatcgaccggggagtggtctttgtccagggcgagaagacgtgggtgcccacctcactgcagagcctgatcgacatggccaagtgaactgtggcaggtccagaaccagtcagagacttgcccctaagagggatgtactgtaaataaacagtatttttagatcaccttcaaaa

SEQ ID NO: 33169 - DNA, 2974 bp, Homo sapiens
acaaggggactcagcgccagtgagagtagggacgaaggctcagggaaggcgagcttcggtccaagccgttggggtgtggggaggggaatccatttcgtagacagctctgccgaggcacggagaggggcggtgctgcttggggtcaactgggatttagggcttggattcatttaagaacctgagcttccttcaccaaacctagacagcaagagagagacaagcccgaggcctgacttctagcactcctgagtttgagccctatgagcagtggaacctagggaccaccaaggatccagatataattctttcctcagtaatagaaaaaagaatctgggatctaagaagatacctactcattttctaagtgactggccatgtcattgtcccacttataccgggatggggaaggccgcattgatgatgatgatgacgagcgggagaactttgagatcactgactgggatctccagaatgagttcaaccccaaccgacagcgccactggcagaccaaggaagaagccacctacggggtgtgggcagagcgagactcggatgatgagaggcccagctttggaggcaaacgggcccgtgactactctgcgccagtcaacttcatcagcgcagggctcaagaaaggggcagcggaggaggcagagttggaagattctgatgacgaagagaaacctgttaagcaggacgactttcctaaggattttggaccaaggaagctaaaaacgggtggcaattttaagcccagccagaaaggttttgcaggaggaaccaaatctttcatggacttcggcagctgggaaagacacacaaaaggaattggacagaagcttcttcagaagatgggctacgtccctggacggggcctcgggaagaatgcacaaggtatcattaacccaattgaagccaagcagagaaagggaaaaggtgctgtgggggcttatggatccgagcgcaccactcagtccatgcaagacttccctgtggttgactcagaggaagaagctgaagaggagtttcagaaggagctgagccagtggaggaaagacccaagtggaagcaagaagaagcccaaatactcttacaagaccgtggaagagttgaaggccaagggcaggattagcaagaagctcactgctccccagaaggaactttctcaagtcaaggtcatagacatgacaggccgggagcagaaggtctactacagctacagtcagatcagccacaagcacaacgttcccgatgatgggctgccgctacagtcccaacagctgccacagtctggcaaagaggccaaggcccccggcttcgcgctgcccgagctggagcacaacctgcagctgctcatcgacctcacggagcaggagatcatccagaatgaccggcagctacagtatgagcgggacatggtggtcaacctcttccacgagctggagaagatgaccgaggtcctggaccacgaggagcgggtcatctcgaacctcagcaaggtcctggagatggtggaggagtgcgagcggcggatgcagcccgactgcagcaaccccctcaccctggacgagtgtgcccgcatcttcgaaaccctgcaggacaagtactatgaggagtacaggatgtccgaccgtgtggaccttgctgtggccatcgtctatccactcatgaaggagtacttcaaggagtgggatcccctcaaagactgcacttatggcaccgagatcatctctaagtggaaaagcctcctagagaatgaccagctcttgtcccatggcggacaggacctctcagcagatgcctttcacaggttgatatgggaagtctggatgccttttgttcgaaatattgtcacccagtggcagccaaggaactgtgacccgatggtggactttttggatagttgggtgcacattattcctgtgtggatcttagataacatactggaccaactcatcttccccaagctgcaaaaggaggtggaaaactggaacccgctcacagacactgttcccatccactcttggatccacccatggctgccccttatgcaggcacggctggagccactctattcccccatccgtagtaagctgtccagcgccctgcagaagtggcaccccagcgactcctctgccaagctcatcctccagccctggaaggatgtcttcactcctggctcctgggaagcattcatggtcaaaaacatagtgcccaagctggggatgtgtcttggtgagctagtcattaacccccaccagcagcacatggatgcattctattgggtgattgactgggaagggatgatctctgtctctagcctggtgggacttcttgaaaagcacttcttccccaagtggcttcaggtgctgtgctcttggctcagtaacagcccaaattatgaggagatcaccaagtggtacctgggttggaagtcgatgttctcagaccaagtgctggcacatccatctgtcaaggacaaatttaatgaggcacttgatatcatgaaccgggcggtgtcctccaacgttggtgcctacatgcagccaggagcacgggagaacattgcctatctcacccacacggagcggaggaaggacttccagtacgaggccatgcaggagaggcgggaggctgagaacatggctcagaggggcattggcgtggccgctagctctgtgcccatgaactttaaggacctcattgagaccaaggctgaggagcacaacattgtcttcatgcccgtcattgggaagcgacacgaagggaagcagctctacacctttggccgcattgtgatctacatcgaccggggagtggtctttgtccagggcgagaagacgtgggtgcccacctcactgcagagcctgatcgacatggccaagtgaactgtggcaggtccagaaccagtcagagacttgcccctaagagggatgtactgtaaataaacagtatttttagatcaccttcaaaa

SEQ ID NO: 33170 - DNA, 3586 bp, Homo sapiens
actaacgtcatttccggcgcgccggccacggtgcttccgggttctggtgtaggagcggcgtcttctcgcgcggatggtgaagctgaatttggtacgctggaccctcggacagacagcaagagagagacaagcccgaggcctgacttctagcactcctgagtttgagccctatgagcagtggaacctagggaccaccaaggatccagatataattctttcctcagtaatagaaaaaagaatctgggatctaagaagatacctactcattttctaagtgactggccatgtcattgtcccacttataccgggatggggaaggccgcattgatgatgatgatgacgagcgggagaactttgagatcactgactgggatctccagaatgagttcaaccccaaccgacagcgccactggcagaccaaggaagaagccacctacggggtgtgggcagagcgagactcggatgatgagaggcccagctttggaggcaaacgggcccgtgactactctgcgccagtcaacttcatcagcgcagggctcaagaaaggggcagcggaggaggcagagttggaagattctgatgacgaagagaaacctgttaagcaggacgactttcctaaggattttggaccaaggaagctaaaaacgggtggcaattttaagcccagccagaaaggttttgcaggaggaaccaaatctttcatggacttcggcagctgggaaagacacacaaaaggaattggacagaagcttcttcagaagatgggctacgtccctggacggggcctcgggaagaatgcacaaggtatcattaacccaattgaagccaagcagagaaagggaaaaggtgctgtgggggcttatggatccgagcgcaccactcagtccatgcaagacttccctgtggttgactcagaggaagaagctgaagaggagtttcagaaggagctgagccagtggaggaaagacccaagtggaagcaagaagaagcccaaatactcttacaagaccgtggaagagttgaaggccaagggcaggattagcaagaagctcactgctccccagaaggaactttctcaagtcaaggtcatagacatgacaggccgggagcagaaggtctactacagctacagtcagatcagccacaagcacaacgttcccgatgatgggctgccgctacagtcccaacagctgccacagtctggcaaagaggccaaggcccccggcttcgcgctgcccgagctggagcacaacctgcagctgctcatcgacctcacggagcaggagatcatccagaatgaccggcagctacagtatgagcgggacatggtggtcaacctcttccacgagctggagaagatgaccgaggtcctggaccacgaggagcgggtcatctcgaacctcagcaaggtcctggagatggtggaggagtgcgagcggcggatgcagcccgactgcagcaaccccctcaccctggacgagtgtgcccgcatcttcgaaaccctgcaggacaagtactatgaggagtacaggatgtccgaccgtgtggaccttgctgtggccatcgtctatccactcatgaaggagtacttcaaggagtgggatcccctcaaagactgcacttatggcaccgagatcatctctaagtggaaaagcctcctagagaatgaccagctcttgtcccatggcggacaggacctctcagcagatgcctttcacaggttgatatgggaagtctggatgccttttgttcgaaatattgtcacccagtggcagccaaggaactgtgacccgatggtggactttttggatagttgggtgcacattattcctgtgtggatcttagataacatactggaccaactcatcttccccaagctgcaaaaggaggtggaaaactggaacccgctcacagacactgttcccatccactcttggatccacccatggctgccccttatgcaggcacggctggagccactctattcccccatccgtagtaagctgtccagcgccctgcagaagtggcaccccagcgactcctctgccaagctcatcctccagccctggaaggatgtcttcactcctggctcctgggaagcattcatggtcaaaaacatagtgcccaagctggggatgtgtcttggtgagctagtcattaacccccaccagcagcacatggatgcattctattgggtgattgactgggaagggatgatctctgtctctagcctggtgggacttcttgaaaagcacttcttccccaagtggcttcaggtgctgtgctcttggctcagtaacagcccaaattatgaggagatcaccaagtggtacctgggttggaagtcgatgttctcagaccaagtgctggcacatccatctgtcaaggacaaatttaatgaggcacttgatatcatgaaccgggcggtgtcctccaacgttggtgcctacatgcagccaggagcacgggagaacattgcctatctcacccacacggagcggaggaaggacttccagtacgaggccatgcaggagaggcgggaggctgagaacatggctcagaggggcattggcgtggccgctagctctgtgcccatgaactttaaggacctcattgagaccaaggctgaggagcacaacattgtcttcatgcccgtcattgggaagcgacacgaagggaagcagctctacacctttggccgcattgtgatctacatcgaccggggagtggtctttgtccagggcgagaagacgtgggtgcccacctcactgcagagcctgatcgacatggccaagtgaactgtggcaggtccagaaccagtcagagacttgcccctaagagggatgtactgtaaataaacagtatttttagatcaccttcaaaagggtaacttctttactcaggagctactccacatcaggccaggtcatgagggaaggatgtaaaatgggacaatgccacgtagggcaggaatctttataccaagtcctcatgtggggtatcgtcctcaaaacaggacagccaagttgatgttctttcctggcaaaggagttctctgtagttcctccatagcagccttccctttagtctctggtggcagcttctacctcagccaacactgagtacctcacaacgagttcagtcagtagcagaaggatcttctctcttgttcctgatgatttcaaggtcctcacagtcctgataatctggttcttcccgaaactcccaaatatctatggagagctgttctagcttttgcacagggaaccagtggacagaggtatcattaaatatgtccatgtattgtgaagtctgaggaaactcaagctcctccagtccttttaaaatctgagcagaaaaattcaagtataaaaacttcagatagtcacagtaatccccactcttctgggataaatttccactttacttgtcatccccactttactttttaaaaaaataacaaatagggtattttgatttaaatgcttttgcacaatgaattgggcgccccaaggacagtggatatcatggactgtgatactaagaataaaggaaataaggaaaaaactaagagatgcattaaaga

SEQ ID NO: 33171 - DNA, 563 bp, Homo sapiens
acggtgcttccgggttctggtgtaggagcggcgtcttctcgcgcggatggtgaagctgaatttggtacgctggaccctcggacagacagcaagagagagacaagcccgaggcctgacttctagcactcctgagtttgagccctatgagcagtggaacctaggttcttcagctttggaacttgactggctctccttgctcctcagcctgcagacagcctattgtgggaccttttgatcgttaatagaaaaaagaatctgggatctaagaagatacctactcattttctaagtgactggccatgtcattgtcccacttataccgggatggggaaggccgcattgatgatgatgatgacgagcgggagaactttgagatcactgactgggatctccagaatgagttcaaccccaaccgacagcgccactggcagaccaaggaagaagccacctacggggtgtgggcagagcgagactcggatgatgagaggcccagctttggaggcaaacgggcccgtgactactctgcgccagtcaacttcatcagcgcagggctcaagaaaggg

SEQ ID NO: 33172 - DNA, 525 bp, Homo sapiens
atttccggcgcgccggccacggtgcttccgggttctggtgtaggagcggcgtcttctcgcgcggatggtgaagctgaatttggtacgctggaccctcggacagacagcaagagagagacaagcccgaggcctgacttctagcactcctgagtttgagccctatgagcagtggaacctagggatccagatataattctttcctcagtaatagaaaaaagaatctgggatctaagaagatacctactcattttctaagtgactggccatgtcattgtcccacttataccgggatggggaaggccgcattgatgatgatgatgacgagcgggagaactttgagatcactgactgggatctccagaatgagttcaaccccaaccgacagcgccactggcagaccaaggaagaagccacctacggggtgtgggcagagcgagactcggatgatgagaggcccagctttggaggcaaacgggcccgtgactactctgcgccagtcaacttcatcagcgcagggctcaagaa

SEQ ID NO: 33173 - DNA, 595 bp, Homo sapiens
gcgcgccggccacggtgcttccgggttctggtgtaggagcggcgtcttctcgcgcggatggtgaagctgaatttggtacgctggaccctcggacagacagcaagagagagacaagcccgaggcctgacttctagcactcctgagtttgagccctatgagcagtggaacctaggctgccagcacggcaagaatataagcaggcagaaaaatgtgaaaagagagactggcctagcctcccagcctatatctttctcctgtgctggatgcttcctgccctcgaacattggacttcaagttcttcagctttggaacttgactggctctccttgctcctcagcctgcagacagcctattgtgggaccttttgatcgtgaccaccaaggatccagatataattctttcctcagtaatagaaaaaagaatctgggatctaagaagatacctactcattttctaagtgactggccatgtcattgtcccacttataccgggatggggaaggccgcattgatgatgatgatgacgagcgggagaactttgagatcactgactgggatctccagaatgagttcaaccccaaccgacagcgccactg

SEQ ID NO: 33174 - DNA, 1650 bp, Homo sapiens
atgtcattgtcccacttataccgggatggggaaggccgcattgatgatgatgatgacgagcgggagaactttgagatcactgactgggatctccagaatgagttcaacctcttccacgagctggagaagatgaccgaggtcctggaccacgaggagcgggtcatctcgaacctcagcaaggtcctggagatggtggaggagtgcgagcggcggatgcagcccgactgcagcaaccccctcaccctggacgagtgtgcccgcatcttcgaaaccctgcaggacaagtactatgaggagtacaggatgtccgaccgtgtggaccttgctgtggccatcgtctatccactcatgaaggagtacttcaaggagtgggatcccctcaaagactgcacttatggcaccgagatcatctctaagtggaaaagcctcctagagaatgaccagctcttgtcccatggcggacaggacctctcagcagatgcctttcacaggttgatatgggaagtctggatgccttttgttcgaaatattgtcacccagtggcagccaaggaactgtgacccgatggtggactttttggatagttgggtgcacattattcctgtgtggatcttagataacatactggaccaactcatcttccccaagctgcaaaaggaggtggaaaactggaacccgctcacagacactgttcccatccactcttggatccacccatggctgccccttatgcaggcacggctggagccactctattcccccatccgtagtaagctgtccagcgccctgcagaagtggcaccccagcgactcctctgccaagctcatcctccagccctggaaggatgtcttcactcctggctcctgggaagcattcatggtcaaaaacatagtgcccaagctggggatgtgtcttggtgagctagtcattaacccccaccagcagcacatggatgcattctattgggtgattgactgggaagggatgatctctgtctctagcctggtgggacttcttgaaaagcacttcttccccaagtggcttcaggtgctgtgctcttggctcagtaacagcccaaattatgaggagatcaccaagtggtacctgggttggaagtcgatgttctcagaccaagtgctggcacatccatctgtcaaggacaaatttaatgaggcacttgatatcatgaaccgggcggtgtcctccaacgttggtgcctacatgcagccaggagcacgggagaacattgcctatctcacccacacggagcggaggaaggacttccagtacgaggccatgcaggagaggcgggaggctgagaacatggctcagaggggcattggcgtggccgctagctctgtgcccatgaactttaaggacctcattgagaccaaggctgaggagcacaacattgtcttcatgcccgtcattgggaagcgacacgaagggaagcagctctacacctttggccgcattgtgatctacatcgaccggggagtggtctttgtccagggcgagaagacgtgggtgcccacctcactgcagagcctgatcgacatggccaagtgaactgtggcaggtccagaaccagtcagagacttgcccctaagagggatgtactgtaaataaacagtatttttagatcacctt

SEQ ID NO: 33175 - DNA, 571 bp, Homo sapiens
ctggacggggcctcgggaagaatgcacaaggtatcattaacccaattgaagccaagcagagaaagggaaaaggtgctgtgggggcttatggatccgagcgcaccactcagtccatgcaagacttccctgtggttgactcagaggaagaagctgaagagtggttgttccttgctgcatctgactgtattcttctggttcaggagtttcagaaggagctgagccagtggaggaaagacccaagtggaagcaagaagaagcccaaatactcttacaagaccgtggaagagttgaaggccaagggcaggattagcaagaagctcactgctccccagaaggaactttctcaagtcaaggtcatagacatgacaggccgggagcagaaggtctactacagctacagtcagatcagccacaagcacaacgttcccgatgatgggctgccgctacagtcccaacagctgccacagtctggcaaagaggccaaggcccccggcttcgcgctgcccgagctggagcacaacctgcagctgctcatcgacctcacggagcaggagatcatccagaatgaccg

SEQ ID NO: 33176 - DNA, 638 bp, Homo sapiens
ggtgtaggagcggcgtcttctcgcgcggatggtgaagctgaatttggtacgctggaccctcggacagacagcaagagagagacaagcccgaggcctgacttctagcactcctgagtttgagccctatgagcagtggaacctaggcctgcagacagcctattgtgggaccttttgatcgtgaccaccaaggatccagatataattctttcctcagtaatagaaaaaagaatctgggatctaagaagatacctactcattttctaagtgactggccatgtcattgtcccacttataccgggatggggaaggccgcattgatgatgatgatgacgagcgggagaactttgagatcactgactgggatctccagaatgagttcaaccccaaccgacagcgccactggcagaccaaggaagaagccacctacggggtgtgggcagagcgagactcggatgatgagaggcccagctttggaggcaaacgggcccgtgactactctgcgccagtcaacttcatcagcgcagggctcaagaaaggggcagcggaggaggcagagttggaagattctgatgacgaagagaaacctgttaagcaggacgactttcctaaggattttggaccaaggaagctaaaaacgg

SEQ ID NO: 33177 - DNA, 1476 bp, Homo sapiens
cgagactccatctcaaaaacaaaacaaataaacgaacaaaaaaacccacaacgtattattttcttgtttacgaggtttcttgtctctctggctccaccagaagaggagcagggacccttcttgctgttgttcattgctgcatcccccacaccgagagcagagcctggcatgggcagaaagtcctcagtcgatatttggtggccccaagcgaatgaagcatccaagaagggaaagctgggggctccccactgcacttgccacctgagtcacattttcagaagcctctggaaagtcgtgcacagcccaggagtgttgagcaatttcggtttcctctgaggttgaaggacccaggcgtgtcagccctgctccagacaccttgggcatggaggagagtgtcgtacggccctcagtgtttgtggtggatggacagaccgacatcccattcacgaggctgggacgaagccaccggagacagtcgtgcagtgtggcccgggtgggtctgggtctcttgctgttgctgatgggggccgggctggccgtccaaggctggttcctcctgcagctgcactggcgtctaggagagatggtcacccgcctgcctgacggacctgcaggctcctgggagcagctgatacaagagcgaaggtctcacgaggtcaacccagcagcgcatctcacaggggccaactccagcttgaccggcagcggggggccgctgttatgggagactcagctgggcctggccttcctgaggggcctcagctaccacgatggggcccttgtggtcaccaaagctggctactactacatctactccaaggtgcagctgggcggtgtgggctgcccgctgggcctggccagcaccatcacccacggcctctacaagcgcacaccccgctaccccgaggagctggagctgttggtcagccagcagtcaccctgcggacgggccaccagcagctcccgggtctggtgggacagcagcttcctgggtggtgtggtacacctggaggctggggagaaggtggtcgtccgtgtgctggatgaacgcctggttcgactgcgtgatggtacccggtcttacttcggggctttcatggtgtgaaggaaggagcgtggtgcattggacatgggtctgacacgtggagaactcagagggtgcctcaggggaaagaaaactcacgaagcagaggctgggcgtggtggctctcgcctgtaatcccagcactttgggaggccaaggcaggcggatcacctgaggtcaggagttcgagaccagcctggctaacatggcaaaaccccatctctactaaaaatacaaaaattagccggacgtggtggtgcctgcctgtaatccagctactcaggaggctgaggcaggataattttgcttaaacccgggaggcggaggttgcagtgagccgagatcacaccactgcactccaacctgggaaacgcagtgagactgtgcctcaa

SEQ ID NO: 33178 - DNA, 2195 bp, Homo sapiens
cccgctcgcccgcgcgccccaggacccaaagccgggctccaagtcggcgccccacgtcgaggctccgccgcagcctccggagttggccgcagacaagaaggggagggagcgggagagggaggagagctccgaagcgagagggccgagcgccatgcgccgcgccagcagagactacaccaagtacctgcgtggctcggaggagatgggcggcggccccggagccccgcacgagggccccctgcacgccccgccgccgcctgcgccgcaccagccccctgccgcctcccgctccatgttcgtggccctcctggggctggggctgggccaggttgtctgcagcgtcgccctgttcttctatttcagagcgcagatggatcctaatagaatatcagaagatggcactcactgcatttatagaattttgagactccatgaaaatgcagattttcaagacacaactctggagagtcaagatacaaaattaatacctgattcatgtaggagaattaaacaggcctttcaaggagctgtgcaaaaggaattacaacatatcgttggatcacagcacatcagagcagagaaagcgatggtggatggctcatggttagatctggccaagaggagcaagcttgaagctcagccttttgctcatctcactattaatgccaccgacatcccatctggttcccataaagtgagtctgtcctcttggtaccatgatcggggttgggccaagatctccaacatgacttttagcaatggaaaactaatagttaatcaggatggcttttattacctgtatgccaacatttgctttcgacatcatgaaacttcaggagacctagctacagagtatcttcaactaatggtgtacgtcactaaaaccagcatcaaaatcccaagttctcataccctgatgaaaggaggaagcaccaagtattggtcagggaattctgaattccatttttattccataaacgttggtggattttttaagttacggtctggagaggaaatcagcatcgaggtctccaacccctccttactggatccggatcaggatgcaacatactttggggcttttaaagttcgagatatagattgagccccagtttttggagtgttatgtatttcctggatgtttggaaacattttttaaaacaagccaagaaagatgtatataggtgtgtgagactactaagaggcatggccccaacggtacacgactcagtatccatgctcttgaccttgtagagaacacgcgtatttacagccagtgggagatgttagactcatggtgtgttacacaatggtttttaaattttgtaatgaattcctagaattaaaccagattggagcaattacggggtgaccttatgagaaactgcatgtgggctatgggaggggttggtccctggtcatgtgccccttcgcagctgaagtggagagggtgtcatctagcgcaattgaaggatcatctgaaggggcaaattcttttgaattgttacatcatgctggaacctgcaaaaaatactttttctaatgaggagagaaaatatatgtatttttatataatatctaaagttatatttcagatgtaatgttttctttgcaaagtattgtaaattatatttgtgctatagtatttgattcaaaatatttaaaaatgtcttgctgttgacatatttaatgttttaaatgtacagacatatttaactggtgcactttgtaaattccctggggaaaacttgcagctaaggaggggaaaaaaatgttgtttcctaatatcaaatgcagtatatttcttcgttctttttaagttaatagattttttcagacttgtcaagcctgtgcaaaaaaattaaaatggatgccttgaataataagcaggatgttggccaccaggtgcctttcaaatttagaaactaattgactttagaaagctgacattgccaaaaaggatacataatgggccactgaaatctgtcaagagtagttatataattgttgaacaggtgtttttccacaagtgccgcaaattgtaccttttttgttttttcaaaatagaaaagttattagtggtttatcagcaaaaaagtccaattttaatttagtaaatgttatcttatactgtacaataaaaacattgcctttgaatgttaattttttggtacaaaaataaatttatatgaaaa

SEQ ID NO: 33179 - DNA, 1520 bp, Homo sapiens
ctgaaagcaaatggtgtggccgaagctgcctctctggtggcatagctaagaccaagctgcacgcagtgaaaacacagtttgttttcactgacaacaaggcagaatgtgtaccagggatgtgacgtggggaaccaggaagaggacagtctgaggatcattattaaagggactccatccaagaaggtttccagccagaggcaagctgtagccagaagaaaagaatgagagatcacctgaataatagaacagaaactgctgaaatattgaacacagatctagatcaaatgaaggaacatattcaggatgaagcataaataaaggccaggcgtggtggctcatgcctggaatctcagctctttgggaggccgaggctattctccatctcctgggctccagtgatcctcacgcctcggccacccaaagtgctgggattatagaagtgaaccactgcgcctggcctattgaaggtttttaatcttcagagtttcgactttatcaacaacacttagaagccaccaaagaattgcagatggatcctaatagaatatcagaagatggcactcactgcatttatagaattttgagactccatgaaaatgcagattttcaagacacaactctggagagtcaagatacaaaattaatacctgattcatgtaggagaattaaacaggcctttcaaggagctgtgcaaaaggaattacaacatatcgttggatcacagcacatcagagcagagaaagcgatggtggatggctcatggttagatctggccaagaggagcaagcttgaagctcagccttttgctcatctcactattaatgccaccgacatcccatctggttcccataaagtgagtctgtcctcttggtaccatgatcggggttgggccaagatctccaacatgacttttagcaatggaaaactaatagttaatcaggatggcttttattacctgtatgccaacatttgctttcgacatcatgaaacttcaggagacctagctacagagtatcttcaactaatggtgtacgtcactaaaaccagcatcaaaatcccaagttctcataccctgatgaaaggaggaagcaccaagtattggtcagggaattctgaattccatttttattccataaacgttggtggattttttaagttacggtctggagaggaaatcagcatcgaggtctccaacccctccttactggatccggatcaggatgcaacatactttggggcttttaaagttcgagatatagattgagccccagtttttggagtgttatgtatttcctggatgtttggaaacattttttaaaacaagccaagaaagatgtatataggtgtgtgagactactaagaggcatggccccaacggtacacgactcagtatccatgctcttgaccttgtagagaacacgcgtatttacagccagtgggagatgttagactcatggtgtgttacacaatggtttttaaattttgtaatgaattcctagaattaaaccagattggagcaa

SEQ ID NO: 33180 - DNA, 2198 bp, Homo sapiens
cgctcgcccgcgcgccccaggacccaaagccgggctccaagtcggcgccccacgtcgaggctccgccgcagcctccggagttggccgcagacaagaaggggagggagcgggagagggaggagagctccgaagcgagagggccgagcgccatgcgccgcgccagcagagactacaccaagtacctgcgtggctcggaggagatgggcggcggccccggagccccgcacgagggccccctgcacgccccgccgccgcctgcgccgcaccagccccctgccgcctcccgctccatgttcgtggccctcctggggctggggctgggccaggttgtctgcagcgtcgccctgttcttctatttcagagcgcagatggatcctaatagaatatcagaagatggcactcactgcatttatagaattttgagactccatgaaaatgcagattttcaagacacaactctggagagtcaagatacaaaattaatacctgattcatgtaggagaattaaacaggcctttcaaggagctgtgcaaaaggaattacaacatatcgttggatcacagcacatcagagcagagaaagcgatggtggatggctcatggttagatctggccaagaggagcaagcttgaagctcagccttttgctcatctcactattaatgccaccgacatcccatctggttcccataaagtgagtctgtcctcttggtaccatgatcggggttgggccaagatctccaacatgacttttagcaatggaaaactaatagttaatcaggatggcttttattacctgtatgccaacatttgctttcgacatcatgaaacttcaggagacctagctacagagtatcttcaactaatggtgtacgtcactaaaaccagcatcaaaatcccaagttctcataccctgatgaaaggaggaagcaccaagtattggtcagggaattctgaattccatttttattccataaacgttggtggattttttaagttacggtctggagaggaaatcagcatcgaggtctccaacccctccttactggatccggatcaggatgcaacatactttggggcttttaaagttcgagatatagattgagccccagtttttggagtgttatgtatttcctggatgtttggaaacattttttaaaacaagccaagaaagatgtatataggtgtgtgagactactaagaggcatggccccaacggtacacgactcagtatccatgctcttgaccttgtagagaacacgcgtatttacagccagtgggagatgttagactcatggtgtgttacacaatggtttttaaattttgtaatgaattcctagaattaaaccagattggagcaattacggggtgaccttatgagaaactgcatgtgggctatgggaggggttggtccctggtcatgtgccccttcgcagctgaagtggagagggtgtcatctagcgcaattgaaggatcatctgaaggggcaaattcttttgaattgttacatcatgctggaacctgcaaaaaatactttttctaatgaggagagaaaatatatgtatttttatataatatctaaagttatatttcagatgtaatgttttctttgcaaagtattgtaaattatatttgtgctatagtatttgattcaaaatatttaaaaatgtcttgctgttgacatatttaatgttttaaatgtacagacatatttaactggtgcactttgtaaattccctggggaaaacttgcagctaaggaggggaaaaaaatgttgtttcctaatatcaaatgcagtatatttcttcgttctttttaagttaatagattttttcagacttgtcaagcctgtgcaaaaaaattaaaatggatgccttgaataataagcaggatgttggccaccaggtgcctttcaaatttagaaactaattgactttagaaagctgacattgccaaaaaggatacataatgggccactgaaatctgtcaagagtagttatataattgttgaacaggtgtttttccacaagtgccgcaaattgtaccttttttgttttttcaaaatagaaaagttattagtggtttatcagcaaaaaagtccaattttaatttagtaaatgttatcttatactgtacaataaaaacattgcctttgaatgttaattttttggtacaaaaataaatttatatgaaaacctgc

SEQ ID NO: 33181 - DNA, 2135 bp, Homo sapiens
acagatcacctgaataatagaacagaaactgctgaaatattgaacacagatctagatcaaatgaaggaacatattcaggatgaagcataaataaaggccaggcgtggtggctcatgcctggaatctcagctctttgggaggccgaggctattctccatctcctgggctccagtgatcctcacgcctcggccacccaaagtgctgggattatagaagtgaaccactgcgcctggcctattgaaggtttttaatcttcagagtttcgactttatcaacaacacttagaagccaccaaagaattgcagatggatcctaatagaatatcagaagatggcactcactgcatttatagaattttgagactccatgaaaatgcagattttcaagacacaactctggagagtcaagatacaaaattaatacctgattcatgtaggagaattaaacaggcctttcaaggagctgtgcaaaaggaattacaacatatcgttggatcacagcacatcagagcagagaaagcgatggtggatggctcatggttagatctggccaagaggagcaagcttgaagctcagccttttgctcatctcactattaatgccaccgacatcccatctggttcccataaagtgagtctgtcctcttggtaccatgatcggggttgggccaagatctccaacatgacttttagcaatggaaaactaatagttaatcaggatggcttttattacctgtatgccaacatttgctttcgacatcatgaaacttcaggagacctagctacagagtatcttcaactaatggtgtacgtcactaaaaccagcatcaaaatcccaagttctcataccctgatgaaaggaggaagcaccaagtattggtcagggaattctgaattccatttttattccataaacgttggtggattttttaagttacggtctggagaggaaatcagcatcgaggtctccaacccctccttactggatccggatcaggatgcaacatactttggggcttttaaagttcgagatatagattgagccccagtttttggagtgttatgtatttcctggatgtttggaaacattttttaaaacaagccaagaaagatgtatataggtgtgtgagactactaagaggcatggccccaacggtacacgactcagtatccatgctcttgaccttgtagagaacacgcgtatttacagccagtgggagatgttagactcatggtgtgttacacaatggtttttaaattttgtaatgaattcctagaattaaaccagattggagcaattacggggtgaccttatgagaaactgcatgtgggctatgggaggggttggtccctggtcatgtgccccttcgcagctgaagtggagagggtgtcatctagcgcaattgaaggatcatctgaaggggcaaattcttttgaattgttacatcatgctggaacctgcaaaaaatactttttctaatgaggagagaaaatatatgtatttttatataatatctaaagttatatttcagatgtaatgttttctttgcaaagtattgtaaattatatttgtgctatagtatttgattcaaaatatttaaaaatgtcttgctgttgacatatttaatgttttaaatgtacagacatatttaactggtgcactttgtaaattccctggggaaaacttgcagctaaggaggggaaaaaaatgttgtttcctaatatcaaatgcagtatatttcttcgttctttttaagttaatagattttttcagacttgtcaagcctgtgcaaaaaaattaaaatggatgccttgaataataagcaggatgttggccaccaggtgcctttcaaatttagaaactaattgactttagaaagctgacattgccaaaaaggatacataatgggccactgaaatctgtcaagagtagttatataattgttgaacaggtgtttttccacaagtgccgcaaattgtaccttttttgttttttcaaaatagaaaagttattagtggtttatcagcaaaaaagtccaattttaatttagtaaatgttatcttatactgtacaataaaaacattgcctttgaatgttaattttttggtacaaaaataaatttatatgaaaacctgc

SEQ ID NO: 33182 - DNA, 818 bp, Homo sapiens
agcctccggagttggccgcagacaagaaggggctgggccaggttgtctgcagcgtcgccctgttcttctatttcagagcgcagatggatcctaatagaatatcagaagatggcactcactgcatttatagaattttgagactccatgaaaatgcagattttcaagacacaactctggagagtcaagatacaaaattaatacctgattcatgtaggagaattaaacaggcctttcaaggagctgtgcaaaaggaattacaacatatcgttggatcacagcacatcagagcagagaaagcgatggtggatggctcatggttagatctggccaagaggagcaagcttgaagctcagccttttgctcatctcactattaatgccaccgacatcccatctggttcccataaagtgagtctgtcctcttggtaccatgatcggggttgggccaagatctccaacatgacttttagcaatggaaaactaatagttaatcaggatggcttttattacctgtatgccaacatttgctttcgacatcatgaaacttcaggagacctagctacagagtatcttcaactaatggtgtacgtcactaaaaccagcatcaaaatcccaagttctcataccctgatgaaaggaggaagcaccaagtattggtcagggaattctgaattccatttttattccataaacgttggtggattttttaagttacggtctggagaggaaatcagcatcgaggtctccaacccctccttactggatccggatcaggatgcaacatactttggggcttttaaagttcgagatatagattga

SEQ ID NO: 33183 - DNA, 1553 bp, Homo sapiens
cctcgccctggtggtgcacgcccgggctgggcgctcagaggtcgggtgggcgcccactccgttcgctgcgcgcacagcgcccggcgagaggctcggagtttgatcacacacagcgtccggcttcctgtccccagcgccccctcccgccccgtttcccttgcccctccctctccccggcccgatccgcccgccggctccccctcccccgatccctcgggtcccgggatgggggggcggtgaggcaggcacagccccccgcccccatggccgcccgtcggagccagaggcggagggggcgccggggggagccgggcaccgccctgctggtcccgctcgcgctgggcctgggcctggcgctggcctgcctcggcctcctgctggccgtggtcagtttggggagccgggcatcgctgtccgcccaggagcctgcccaggaggagctggtggcagaggaggaccaggacccgtcggaactgaatccccagacagaagaaagccaggatcctgcgcctttcctgaaccgactagttcggcctcgcagaagtgcacctaaaggccggaaaacacgggctcgaagagcgatcgcagcccattatgaagttcatccacgacctggacaggacggagcgcaggcaggtgtggacgggacagtgagtggctgggaggaagccagaatcaacagctccagccctctgcgctacaaccgccagatcggggagtttatagtcacccgggctgggctctactacctgtactgtcaggtgcactttgatgaggggaaggctgtctacctgaagctggacttgctggtggatggtgtgctggccctgcgctgcctggaggaattctcagccactgcggcgagttccctcgggccccagctccgcctctgccaggtgtctggtctgttggccctgcggccagggtcctccctgcggatccgcaccctcccctgggcccatctcaaggctgcccccttcctcacctacttcggactcttccaggttcactgaggggccctggtctccccgcagtcgtcccaggctgccggctcccctcgacagctctctgggcacccggtcccctctgccccaccctcagccgctctttgctccagacctgcccctccctctagaggctgcctgggcctgttcacgtgttttccatcccacataaatacagtattcccactcttatcttacaactcccccaccgcccactctccacctcactagctccccaatccctgaccctttgaggcccccagtgatctcgactcccccctggccacagacccccagggcattgtgttcactgtactctgtgggcaaggatgggtccagaagaccccacttcaggcactaagaggggctggacctggcggcaggaagccaaagagactgggcctaggccaggagttcccaaatgtgaggggcgagaaacaagacaagctcctcccttgagaattccctgtggatttttaaaacagatattatttttattattattgtgacaaaatgttgataaatggatattaaatagaataagtcata

SEQ ID NO: 33184 - DNA, 1768 bp, Homo sapiens
atggccgcccgtcggagccagaggcggagggggcgccggggggagccgggcaccgccctgctggtcccgctcgcgctgggcctgggcctggcgctggcctgcctcggcctcctgctggccgtggtcagtttggggagccgggcatcgctgtccgcccaggagcctgcccaggaggagctggtggcagaggaggaccaggacccgtcggaactgaatccccagacagaagaaagccaggatcctgcgcctttcctgaaccgactagttcggcctcgcagaagtgcacctaaaggccggaaaacacgggctcgaagagcgatcgcagcccattatgaagttcatccacgacctggacaggacggagcgcaggcaggtgtggacgggacagtgagtggctgggaggaagccagaatcaacagctccagccctctgcgctacaaccgccagatcggggagtttatagtcacccgggctgggctctactacctgtactgtcagagttccgatgccctggaagcctgggagaatggggagagatcccggaaaaggagagcagtgctcacccaaaaacagaagaagcagcactctgtcctgcacctggttcccattaacgccacctccaaggatgactccgatgtgacagaggtgatgtggcaaccagctcttaggcgtgggagaggcctacaggcccaaggatatggtgtccgaatccaggatgctggagtttatctgctgtatagccaggtcctgtttcaagacgtgactttcaccatgggtcaggtggtgtctcgagaaggccaaggaaggcaggagactctattccgatgtataagaagtatgccctcccacccggaccgggcctacaacagctgctatagcgcaggtgtcttccatttacaccaaggggatattctgagtgtcataattccccgggcaagggcgaaacttaacctctctccacatggaaccttcctggggtttgtgaaactgtgattgtgttataaaaagtggctcccagcttggaagaccagggtgggtacatactggagacagccaagagctgagtatataaaggagagggaatgtgcaggaacagaggcgtcttcctgggtttggctccccgttcctcacttttcccttttcattcccaccccctagactttgattttacggatatcttgcttctgttccccatggagctccgaattcttgcgtgtgtgtagatgaggggcgggggacgggcgccaggcattgtccagacctggtcggggcccactggaagcatccagaacagcaccaccatctagcggccgctcgagggaagcacccgccggttggccgaagtccacgaagccgccctctgctagggaaaacccctggttctccatgccacacctctctccaggtgccctctgcctcttcaccccacaagaagccttatcctacgtccttctctccatctatcggaccccagtttccatcactatctccagagatgtagctattatgcgcccgtctacagggggtgcccgacgatgacggtgccttcgcagtcaaattactcttcgggtcccaaggtttggctttcacgcgctccattgccccggcgtggcaggccattccaagcccttccgggctggaactggtgtcggaggagcctcgggtgtatcgtacgccctggtgttggtgttgcctcactcctctgagctcttctttctgatcaagccctgcttaaagttaaataaaatagaatgaatgataccccggc

SEQ ID NO: 33185 - DNA, 2894 bp, Homo sapiens
cgagactccatctcaaaaacaaaacaaataaacgaacaaaaaaacccacaacgtattattttcttgtttacgaggtttcttgtctctctggctccaccagaagaggagcagggacccttcttgctgttgttcattgctgcatcccccacaccgagagcagagcctggcatgggcagaaagtcctcagtcgatatttggtggccccaagcgaatgaagcatccaagaagggaaagctgggggctccccactgcacttgccacctgagtcacattttcagaagcctctggaaagtcgtgcacagcccaggagtgttgagcaatttcggtttcctctgaggttgaaggacccaggcgtgtcagccctgctccagacaccttgggcatggaggagagtgtcgtacggccctcagtgtttgtggtggatggacagaccgacatcccattcacgaggctgggacgaagccaccggagacagtcgtgcagtgtggcccgggtgggtctgggtctcttgctgttgctgatgggggccgggctggccgtccaaggctggttcctcctgcagctgcactggcgtctaggagagatggtcacccgcctgcctgacggacctgcaggctcctgggagcagctgatacaagagcgaaggtctcacgaggtcaacccagcagcgcatctcacaggggccaactccagcttgaccggcagcggggggccgctgttatgggagactcagctgggcctggccttcctgaggggcctcagctaccacgatggggcccttgtggtcaccaaagctggctactactacatctactccaaggtgcagctgggcggtgtgggctgcccgctgggcctggccagcaccatcacccacggcctctacaagcgcacaccccgctaccccgaggagctggagctgttggtcagccagcagtcaccctgcggacgggccaccagcagctcccgggtctggtgggacagcagcttcctgggtggtgtggtacacctggaggctggggagaaggtggtcgtccgtgtgctggatgaacgcctggttcgactgcgtgatggtacccggtcttacttcggggctttcatggtgtgaaggaaggagcgtggtgcattggacatgggtctgacacgtggagaactcagagggtgcctcaggggaaagaaaactcacgaagcagaggctgggcgtggtggctctcgcctgtaatcccagcactttgggaggccaaggcaggcggatcacctgaggtcaggagttcgagaccagcctggctaacatggcaaaaccccatctctactaaaaatacaaaaattagccggacgtggtggtgcctgcctgtaatccagctactcaggaggctgaggcaggataattttgcttaaacccgggaggcggaggttgcagtgagccgagatcacaccactgcactccaacctgggaaacgcagtgagactgtgcctcaaaaaaaagaaaggaagaaaaaagaaaactcaggaaacagatcttgggggacactccagggaacccaaaactcaaaggcggagagctcagtgggcaccaccaaggcgagatgaagccccagcaggcaccttcagaagacccacgtagactgcagaccctgccacggacaatactaaggacaaaaacccagagacttggggtctgtgggcccccaaacatggggtaaagttgatttgcctgatattcaggaagaaggggtgaggggtgggtatttatgcttttgattcagaagaaagtggggcttgggattccagggacttggctgggggtgggaaacttcatccacttccctactctcatcatgagtacggacagggtgggcgggagactgatcatcgggactcatcatgaagagcccagccccaccccacatactcagatcccacccacagactggtggccacacctcagcctggtcacaaagagttacactcagatacatgagcacggcagcgtgctcataactgtttaacaaccagctgtcctgggagggggacagctttgtaatgtttgccaatttccatggtgtaaatgctaccaccatggctgatttcatcactgccaagcatagacatccctaataggacaccacggatctgtccccggcatccggcccagggcctggcacaaagcatgctctagggaaatgcttgctgattgaaaggaaggaagaatgactctacagtcacacctatggcatcccacaaaatctgtcacatggctgcataatctcagccactctttcacaactatagactcatacacgcgaagtgccagattcatgcacaaccacacaatcacatggaagtcacagacggcatcacagacagtcacagcactgtgtgtatgttataacacaagcacacaaaactcagacagcatcccagctacacagccactcccagaggtgtcaccgtcacacttggtaattaatactcattacattagacacagacagaccaagttatagtcagacctggttacacacatacacacacacaatatcaccatgacaaatacacattacacacacacaacatcacaatgacaaacacacattacacacacaacatcacgatgacaaacacacattacacacacaacatcacgatgacaaacacacattacacacacatcacaatgacaaacacaacattacacacacacaacatcacaatgacacacacatcacacacacatcacaatgacaaacacacaacattacacacatatacacacagcctgagggccctccccagcccagactaacacatctcggggtgaggaccagaccttgttcataaccctgggcctcttaaccactgatctttgaaataaatggcaaatagttgtacctgga

SEQ ID NO: 33186 - DNA, 2786 bp, Homo sapiens
cgagactccatctcaaaaacaaaacaaataaacgaacaaaaaaacccacaacgtattattttcttgtttacgaggtttcttgtctctctggctccaccagaagaggagcagggacccttcttgctgttgttcattgctgcatcccccacaccgagagcagagcctggcatgggcagaaagtcctcagtcgatatttggtggccccaagcgaatgaagcatccaagaagggaaagctgggggctccccactgcacttgccacctgagtcacattttcagaagcctctggaaagtcgtgcacagcccaggagtgttgagcaatttcggtttcctctgaggttgaaggacccaggcgtgtcagccctgctccagacaccttgggcatggaggagagtgtcgtacggccctcagtgtttgtggtggatggacagaccgacatcccattcacgaggctgggacgaagccaccggagacagtcgtgcagtgtggcccgggacggacctgcaggctcctgggagcagctgatacaagagcgaaggtctcacgaggtcaacccagcagcgcatctcacaggggccaactccagcttgaccggcagcggggggccgctgttatgggagactcagctgggcctggccttcctgaggggcctcagctaccacgatggggcccttgtggtcaccaaagctggctactactacatctactccaaggtgcagctgggcggtgtgggctgcccgctgggcctggccagcaccatcacccacggcctctacaagcgcacaccccgctaccccgaggagctggagctgttggtcagccagcagtcaccctgcggacgggccaccagcagctcccgggtctggtgggacagcagcttcctgggtggtgtggtacacctggaggctggggagaaggtggtcgtccgtgtgctggatgaacgcctggttcgactgcgtgatggtacccggtcttacttcggggctttcatggtgtgaaggaaggagcgtggtgcattggacatgggtctgacacgtggagaactcagagggtgcctcaggggaaagaaaactcacgaagcagaggctgggcgtggtggctctcgcctgtaatcccagcactttgggaggccaaggcaggcggatcacctgaggtcaggagttcgagaccagcctggctaacatggcaaaaccccatctctactaaaaatacaaaaattagccggacgtggtggtgcctgcctgtaatccagctactcaggaggctgaggcaggataattttgcttaaacccgggaggcggaggttgcagtgagccgagatcacaccactgcactccaacctgggaaacgcagtgagactgtgcctcaaaaaaaagaaaggaagaaaaaagaaaactcaggaaacagatcttgggggacactccagggaacccaaaactcaaaggcggagagctcagtgggcaccaccaaggcgagatgaagccccagcaggcaccttcagaagacccacgtagactgcagaccctgccacggacaatactaaggacaaaaacccagagacttggggtctgtgggcccccaaacatggggtaaagttgatttgcctgatattcaggaagaaggggtgaggggtgggtatttatgcttttgattcagaagaaagtggggcttgggattccagggacttggctgggggtgggaaacttcatccacttccctactctcatcatgagtacggacagggtgggcgggagactgatcatcgggactcatcatgaagagcccagccccaccccacatactcagatcccacccacagactggtggccacacctcagcctggtcacaaagagttacactcagatacatgagcacggcagcgtgctcataactgtttaacaaccagctgtcctgggagggggacagctttgtaatgtttgccaatttccatggtgtaaatgctaccaccatggctgatttcatcactgccaagcatagacatccctaataggacaccacggatctgtccccggcatccggcccagggcctggcacaaagcatgctctagggaaatgcttgctgattgaaaggaaggaagaatgactctacagtcacacctatggcatcccacaaaatctgtcacatggctgcataatctcagccactctttcacaactatagactcatacacgcgaagtgccagattcatgcacaaccacacaatcacatggaagtcacagacggcatcacagacagtcacagcactgtgtgtatgttataacacaagcacacaaaactcagacagcatcccagctacacagccactcccagaggtgtcaccgtcacacttggtaattaatactcattacattagacacagacagaccaagttatagtcagacctggttacacacatacacacacacaatatcaccatgacaaatacacattacacacacacaacatcacaatgacaaacacacattacacacacaacatcacgatgacaaacacacattacacacacaacatcacgatgacaaacacacattacacacacatcacaatgacaaacacaacattacacacacacaacatcacaatgacacacacatcacacacacatcacaatgacaaacacacaacattacacacatatacacacagcctgagggccctccccagcccagactaacacatctcggggtgaggaccagaccttgttcataaccctgggcctcttaaccactgatctttgaaataaatggcaaatagttgtacctgga

SEQ ID NO: 33187 - DNA, 2789 bp, Homo sapiens
agtgcaggtatctcatggagggttttttggatgtcttcttccctgtgggggggttccaaaggcccatgtctcttgggcattttctttcagattctatcagccctctctctttctctcctgtctctctctttcattcatacactgagtcattcagaaatggcttctctccaactcggagctgcaagtaattctggatctggtcacaaacaaaaagtccccagagttgccaatttatctagttcatctgtgccctgttcaagatgatgtaactaaacatttaccttcagggaggtgtttccaaagaattttcatcgatatatagaaatcaagagaaattccatactatcaccaaatcaagagaaattccatactatcaccagttggccaactttccaagtctagtgcagaaatccaaggcacctcacacctagagttcctatacctctgagactccagaggaaagaacaagacagtgcagaaggatatgttagaacccactgaaaacctagaaggttaaaaaggaagcataccctcctgacctataagaaaattttcagtctgcagggggatatccttgtggcccaagacattggtgttatcatttgactaagaggaaattatttgtggtgagctctgagtgaggattaggaccagggagatgccaagtttctatcacttacctcatgcctgtaagacaagtgttttgttccaattgatgaatggggataaaacagttcagccaatcacttatggggcaaagaatgggaatttgaagggtctggtgcctggccttgtcatacgtaaacaagagaggcatcgatgagttttatctgagtcatttgggaaaggataattcttgcagcaagccattttcctaaacacagaagaatagggggattccttaaccttcattgttctccaggatcataggtctcaggtaaaattaaaaattttcaggtcagaccactcagtctcagaaaggcaaagtaatttgccccaggtcactagtccaagatgttattctctttgaacaaatgtgtatgtccagtcacatattcttcattcattcctccccaaagcagtttttagctgttaggtatattcgatcactttagtctattttgaaaatgatatgagacactttttaagcaaagtctacagtttcccaatgagaaaattaatcctctttcttgtctttccagttgtgagacaaactcccacacagcactttaaaaatcagttcccagctctgcactgggaacatgaactaggcctggccttcaccaagaaccgaatgaactataccaacaaattcctgctgatcccagagtcgggagactacttcatttactcccaggtcacattccgtgggatgacctctgagtgcagtgaaatcagacaagcaggccgaccaaacaagccagactccatcactgtggtcatcaccaaggtaacagacagctaccctgagccaacccagctcctcatggggaccaagtctgtatgcgaagtaggtagcaactggttccagcccatctacctcggagccatgttctccttgcaagaaggggacaagctaatggtgaacgtcagtgacatctctttggtggattacacaaaagaagataaaaccttctttggagccttcttactataggaggagagcaaatatcattatatgaaagtcctctgccaccgagttcctaattttctttgttcaaatgtaattataaccaggggttttcttggggccgggagtagggggcattccacagggacaacggtttagctatgaaatttggggcccaaaatttcacacttcatgtgccttactgatgagagtactaactggaaaaaggctgaagagagcaaatatattattaagatgggttggaggattggcgagtttctaaatattaagacactgatcactaaatgaatggatgatctactcgggtcaggattgaaagagaaatatttcaacaccttcctgctatacaatggtcaccagtggtccagttattgttcaatttgatcataaatttgcttcaattcaggagctttgaaggaagtccaaggaaagctctagaaaacagtataaactttcagaggcaaaatccttcaccaatttttccacatactttcatgccttgcctaaaaaaaatgaaaagagagttggtatgtctcatgaatgttcacacagaaggagttggttttcatgtcatctacagcatatgagaaaagctacctttcttttgattatgtacacagatatctaaataaggaagtatgagtttcacatgtatatcaaaaatacaacagttgcttgtattcagtagagttttcttgcccacctattttgtgctgggttctaccttaacccagaagacactatgaaaaacaagacagactccactcaaaatttatatgaacaccactagatacttcctgatcaaacatcagtcaacatactctaaagaataactccaagtcttggccaggcgcagtggctcacacctgtaatcccaacactttgggaggccaaggtgggtggatcatctaaggccgggagttcaagaccagcctgaccaacgtggagaaaccccatctctactaaaaatacaaaattagccgggcgtggtagcgcatggctgtaatcctggctactcaggaggccgaggcagaagaattgcttgaactggggaggcagaggttgcggtgagcccagatcgcgccattgcactccagcctgggtaacaagagcaaaactctgtccaaaaaaaaaaaaa

SEQ ID NO: 33188 - DNA, 2002 bp, Homo sapiens
aaaagggaaggaggagactgagtgattaagtcacccactgtgagagctggtcttctatttaatgggggctctctctgcccaggagtcagaggtgcctccaggagcagcaggagcatggccgaggatctgggactgagctttggggaaacagccagtgtggaaatgctgccagagcacggcagctgcaggcccaaggccaggagcagcagcgcacgctgggctctcacctgctgcctggtgttgctccccttccttgcaggactcaccacatacctgcttgtcagccagctccgggcccagggagaggcctgtgtgcagttccaggctctaaaaggacaggagtttgcaccttcacatcagcaagtttatgcacctcttagagcagacggagataagccaagggcacacctgacagttgtgagacaaactcccacacagcactttaaaaatcagttcccagctctgcactgggaacatgaactaggcctggccttcaccaagaaccgaatgaactataccaacaaattcctgctgatcccagagtcgggagactacttcatttactcccaggtcacattccgtgggatgacctctgagtgcagtgaaatcagacaagcaggccgaccaaacaagccagactccatcactgtggtcatcaccaaggtaacagacagctaccctgagccaacccagctcctcatggggaccaagtctgtatgcgaagtaggtagcaactggttccagcccatctacctcggagccatgttctccttgcaagaaggggacaagctaatggtgaacgtcagtgacatctctttggtggattacacaaaagaagataaaaccttctttggagccttcttactataggaggagagcaaatatcattatatgaaagtcctctgccaccgagttcctaattttctttgttcaaatgtaattataaccaggggttttcttggggccgggagtagggggcattccacagggacaacggtttagctatgaaatttggggcccaaaatttcacacttcatgtgccttactgatgagagtactaactggaaaaaggctgaagagagcaaatatattattaagatgggttggaggattggcgagtttctaaatattaagacactgatcactaaatgaatggatgatctactcgggtcaggattgaaagagaaatatttcaacaccttcctgctatacaatggtcaccagtggtccagttattgttcaatttgatcataaatttgcttcaattcaggagctttgaaggaagtccaaggaaagctctagaaaacagtataaactttcagaggcaaaatccttcaccaatttttccacatactttcatgccttgcctaaaaaaaatgaaaagagagttggtatgtctcatgaatgttcacacagaaggagttggttttcatgtcatctacagcatatgagaaaagctacctttcttttgattatgtacacagatatctaaataaggaagtatgagtttcacatgtatatcaaaaatacaacagttgcttgtattcagtagagttttcttgcccacctattttgtgctgggttctaccttaacccagaagacactatgaaaaacaagacagactccactcaaaatttatatgaacaccactagatacttcctgatcaaacatcagtcaacatactctaaagaataactccaagtcttggccaggcgcagtggctcacacctgtaatcccaacactttgggaggccaaggtgggtggatcatctaaggccgggagttcaagaccagcctgaccaacgtggagaaaccccatctctactaaaaatacaaaattagccgggcgtggtagcgcatggctgtaatcctggctactcaggaggccgaggcagaagaattgcttgaactggggaggcagaggttgcggtgagcccagatcgcgccattgcactccagcctgggtaacaagagcaaaactctgtccaaaaaaaaaaaaa

SEQ ID NO: 33189 - DNA, 1961 bp, Homo sapiens
cagctctcatttctccaaaaatgtgtttgagccacttggaaaatatgcctttaagccattcaagaactcaaggagctcagagatcatcctggaagctgtggctcttttgctcaatagttatgttgctatttctttgctccttcagttggctaatctttatttttctccaattagagactgctaaggagccctgtatggctaagtttggaccattaccctcaaaatggcaaatggcatcttctgaacctccttgcgtgaataaggtgtctgactggaagctggagatacttcagaatggcttatatttaatttatggccaagtggctcccaatgcaaactacaatgatgtagctccttttgaggtgcggctgtataaaaacaaagacatgatacaaactctaacaaacaaatctaaaatccaaaatgtaggagggacttatgaattgcatgttggggacaccatagacttgatattcaactctgagcatcaggttctaaaaaataatacatactggggtatcattttactagcaaatccccaattcatctcctagagacttgatttgatctcctcattcccttcagcacatgtagaggtgccagtgggtggattggagggagaagatattcaatttctagagtttgtctgtctacaaaaatcaacacaaacagaactcctctgcacgtgaattttcatctatcatgcctatctgaaagagactcaggggaagagccaaagacttttggttggatctgcagagatacttcattaatccatgataaaacaaatatggatgacagaggacatgtgcttttcaaagaatctttatctaattcttgaattcatgagtggaaaaatggagttctattcccatggaagatttacctggtatgcaaaaaggatctggggcagtagcctggctttgttctcatattcttgggctgctgtaattcattcttctcatactcccatcttctgagaccctcccaataaaaagtagactgataggatggccacagatatgcctaccataccctactttagatatggtggtgttagaagataaagaacaatctgagaactattggaatagaggtacaagtggcataaaatggaatgtacgctatctggaaatttctcttggttttatcttcctcaggatgcagggtgctttaaaaagccttatcaaaggagtcattccgaaccctcacgtagagctttgtgagaccttactgttggtgtgtgtgtctaaacattgctaattgtaaagaaagagtaaccattagtaatcattaggtttaaccccagaatggtattatcattactggattatgtcatgtaatgatttagtatttttagctagctttccacagtttgcaaagtgctttcgtaaaacagttagcaattctatgaagttaattgggcaggcatttgggggaaaattttagtgatgagaatgtgatagcatagcatagccaactttcctcaactcataggacaagtgactacaagaggcaatgggtagtcccctgcattgcactgtctcagctttagaattgttatttctgctatcgtgttataagactctaaaacttagcgaattcacttttcaggaagcatattcccctttagcccaaggtgagcagagtgaagctacaacagatctttcctttaccagcacactttttttttttttcctgcctgaatcagggagatccaggatgctgttcaggccttatcccaaccaaattcccctcttcactttgcagggcccatcttagtcaaatgtgctaacttctaaaataataaatagcactaattcaaaatttttggactcttaaattagctacttgcaggttcttgttgaaaggtatataatattacattgtaaacaaatttaaaatatttatggatatttgtgaaaagctgcattatgttaaataatattacatgtaaagct

SEQ ID NO: 33190 - DNA, 2008 bp, Homo sapiens
catgacattgcatccttcacccatcacttgtgaatttttgttttccacagctctcatttctccaaaaatgtgtttgagccacttggaaaatatgcctttaagccattcaagaactcaaggagctcagagatcatcctggaagctgtggctcttttgctcaatagttatgttgctatttctttgctccttcagttggctaatctttatttttctccaattagagactgctaaggagccctgtatggctaagtttggaccattaccctcaaaatggcaaatggcatcttctgaacctccttgcgtgaataaggtgtctgactggaagctggagatacttcagaatggcttatatttaatttatggccaagtggctcccaatgcaaactacaatgatgtagctccttttgaggtgcggctgtataaaaacaaagacatgatacaaactctaacaaacaaatctaaaatccaaaatgtaggagggacttatgaattgcatgttggggacaccatagacttgatattcaactctgagcatcaggttctaaaaaataatacatactggggtatcattttactagcaaatccccaattcatctcctagagacttgatttgatctcctcattcccttcagcacatgtagaggtgccagtgggtggattggagggagaagatattcaatttctagagtttgtctgtctacaaaaatcaacacaaacagaactcctctgcacgtgaattttcatctatcatgcctatctgaaagagactcaggggaagagccaaagacttttggttggatctgcagagatacttcattaatccatgataaaacaaatatggatgacagaggacatgtgcttttcaaagaatctttatctaattcttgaattcatgagtggaaaaatggagttctattcccatggaagatttacctggtatgcaaaaaggatctggggcagtagcctggctttgttctcatattcttgggctgctgtaattcattcttctcatactcccatcttctgagaccctcccaataaaaagtagactgataggatggccacagatatgcctaccataccctactttagatatggtggtgttagaagataaagaacaatctgagaactattggaatagaggtacaagtggcataaaatggaatgtacgctatctggaaatttctcttggttttatcttcctcaggatgcagggtgctttaaaaagccttatcaaaggagtcattccgaaccctcacgtagagctttgtgagaccttactgttggtgtgtgtgtctaaacattgctaattgtaaagaaagagtaaccattagtaatcattaggtttaaccccagaatggtattatcattactggattatgtcatgtaatgatttagtatttttagctagctttccacagtttgcaaagtgctttcgtaaaacagttagcaattctatgaagttaattgggcaggcatttgggggaaaattttagtgatgagaatgtgatagcatagcatagccaactttcctcaactcataggacaagtgactacaagaggcaatgggtagtcccctgcattgcactgtctcagctttagaattgttatttctgctatcgtgttataagactctaaaacttagcgaattcacttttcaggaagcatattcccctttagcccaaggtgagcagagtgaagctacaacagatctttcctttaccagcacactttttttttttttcctgcctgaatcagggagatccaggatgctgttcaggccttatcccaaccaaattcccctcttcactttgcagggcccatcttagtcaaatgtgctaacttctaaaataataaatagcactaattcaaaatttttggactcttaaattagctacttgcaggttcttgttgaaaggtatataatattacattgtaaacaaatttaaaatatttatggatatttgtgaaaagctgcattatgttaaataatattacatgtaaagct

SEQ ID NO: 33191 - DNA, 3470 bp, Homo sapiens
ggccctgggacctttgcctattttctgattgataggctttgttttgtctttacctccttctttctggggaaaacttcagttttatcgcacgttccccttttccatatcttcatcttccctctacccagattgtgaagatggaaagggtccaacccctggaagagaatgtgggaaatgcagccaggccaagattcgagaggaacaagctattgctggtggcctctgtaattcagggactggggctgctcctgtgcttcacctacatctgcctgcacttctctgctcttcaggtatcacatcggtatcctcgaattcaaagtatcaaagtacaatttaccgaatataagaaggagaaaggtttcatcctcacttcccaaaaggaggatgaaatcatgaaggtgcagaacaactcagtcatcatcaactgtgatgggttttatctcatctccctgaagggctacttctcccaggaagtcaacattagccttcattaccagaaggatgaggagcccctcttccaactgaagaaggtcaggtctgtcaactccttgatggtggcctctctgacttacaaagacaaagtctacttgaatgtgaccactgacaatacctccctggatgacttccatgtgaatggcggagaactgattcttatccatcaaaatcctggtgaattctgtgtcctttgaggggctgatggcaatatctaaaaccaggcaccagcatgaacaccaagctgggggtggacagggcatggattcttcattgcaagtgaaggagcctcccagctcagccacgtgggatgtgacaagaagcagatcctggccctcccgcccccacccctcagggatatttaaaacttattttatataccagttaatcttatttatccttatattttctaaattgcctagccgtcacaccccaagattgccttgagcctactaggcacctttgtgagaaagaaaaaatagatgcctcttcttcaagatgcattgtttctattggtcaggcaattgtcataataaacttatgtcattgaaaacggtacctgactaccatttgctggaaatttgacatgtgtgtggcattatcaaaatgaagaggagcaaggagtgaaggagtggggttatgaatctgccaaaggtggtatgaaccaacccctggaagccaaagcggcctctccaaggttaaattgattgcagtttgcatattgcctaaatttaaactttctcatttggtgggggttcaaaagaagaatcagcttgtgaaaaatcaggacttgaagagagccgtctaagaaataccacgtgctttttttctttaccattttgctttcccagcctccaaacatagttaatagaaatttcccttcaaagaactgtctggggatgtgatgctttgaaaaatctaatcagtgacttaagagagattttcttgtatacagggagagtgagataacttattgtgaagggttagctttactgtacaggatagcagggaactggacatctcagggtaaaagtcagtacggattttaatagcctggggaggaaaacacattctttgccacagacaggcaaagcaacacatgctcatcctcctgcctatgctgagatacgcactcagctccatgtcttgtacacacagaaacattgctggtttcaagaaatgaggtgatcctattatcaaattcaatctgatgtcaaatagcactaagaagttattgtgccttatgaaaaataatgatctctgtctagaaataccatagaccatatatagtctcacattgataattgaaactagaagggtctataatcagcctatgccagggcttcaatggaatagtatccccttatgtttagttgaaatgtccccttaacttgatataatgtgttatgcttatggcgctgtggacaatctgatttttcatgtcaactttccagatgatttgtaacttctctgtgccaaaccttttataaacataaatttttgagatatgtattttaaaattgtagcacatgtttccctgacattttcaatagaggatacaacatcacagaatctttctggatgattctgtgttatcaaggaattgtactgtgctacaattatctctagaatctccagaaaggtggagggctgttcgcccttacactaaatggtctcagttggatttttttttcctgttttctatttcctcttaagtacaccttcaactatattcccatccctctattttaatctgttatgaaggaaggtaaataaaaatgctaaatagaagaaattgtaggtaaggtaagaggaatcaagttctgagtggctgccaaggcactcacagaatcataatcatggctaaatatttatggagggcctactgtggaccaggcactgggctaaatacttacatttacaagaatcattctgagacagatattcaatgatatctggcttcactactcagaagattgtgtgtgtgtttgtgtgtgtgtgtgtgtgtgtatttcactttttgttattgaccatgttctgcaaaattgcagttactcagtgagtgatatccgaaaaagtaaacgtttatgactataggtaatatttaagaaaatgcatggttcatttttaagtttggaatttttatctatatttctcacagatgtgcagtgcacatgcaggcctaagtatatgttgtgtgtgttgtttgtctttgatgtcatggtcccctctcttaggtgctcactcgctttgggtgcacctggcctgctcttcccatgttggcctctgcaaccacacagggatatttctgctatgcaccagcctcactccaccttccttccatcaaaaatatgtgtgtgtgtctcagtccctgtaagtcatgtccttcacagggagaattaacccttcgatatacatggcagagttttgtgggaaaagaattgaatgaaaagtcaggagatcagaattttaaatttgacttagccactaactagccatgtaaccttgggaaagtcatttcccatttctgggtcttgcttttctttctgttaaatgagaggaatgttaaatatctaacagtttagaatcttatgcttacagtgttatctgtgaatgcacatattaaatgtctatgttcttgttgctatgagtcaaggagtgtaaccttctcctttactatgttgaatgtatttttttctggacaagcttacatcttcctcagccatctttgtgagtccttcaagagcagttatcaattgttagttagatattttctatttagagaatgcttaagggattccaatcccgatccaaatcataatttgttcttaagtatactgggcaggtcccctattttaagtcataattttgtatttagtgctttcctggctctcagagagtattaatattgatattaataatatagttaatagtaatattgctatttacatggaaacaaataaaagatctcagaattc

SEQ ID NO: 33192 - DNA, 3429 bp, Homo sapiens
aaaacacaggacacatggctccattcaaggctaactgattgcacaacggctctgagcaggagagagcaaaaggtgaaccacagttgtacagcttgctggtggttggggtcacattggactatcaatatccaggagatgttgagaaaaagaggggatcctttccaacaagtcatccagcaactctgggacagaaggaaagctgtgggaagaaaagcagggtgctggtttctaggacactaaacctcatggtatcacatcggtatcctcgaattcaaagtatcaaagtacaatttaccgaatataagaaggagaaaggtttcatcctcacttcccaaaaggaggatgaaatcatgaaggtgcagaacaactcagtcatcatcaactgtgatgggttttatctcatctccctgaagggctacttctcccaggaagtcaacattagccttcattaccagaaggatgaggagcccctcttccaactgaagaaggtcaggtctgtcaactccttgatggtggcctctctgacttacaaagacaaagtctacttgaatgtgaccactgacaatacctccctggatgacttccatgtgaatggcggagaactgattcttatccatcaaaatcctggtgaattctgtgtcctttgaggggctgatggcaatatctaaaaccaggcaccagcatgaacaccaagctgggggtggacagggcatggattcttcattgcaagtgaaggagcctcccagctcagccacgtgggatgtgacaagaagcagatcctggccctcccgcccccacccctcagggatatttaaaacttattttatataccagttaatcttatttatccttatattttctaaattgcctagccgtcacaccccaagattgccttgagcctactaggcacctttgtgagaaagaaaaaatagatgcctcttcttcaagatgcattgtttctattggtcaggcaattgtcataataaacttatgtcattgaaaacggtacctgactaccatttgctggaaatttgacatgtgtgtggcattatcaaaatgaagaggagcaaggagtgaaggagtggggttatgaatctgccaaaggtggtatgaaccaacccctggaagccaaagcggcctctccaaggttaaattgattgcagtttgcatattgcctaaatttaaactttctcatttggtgggggttcaaaagaagaatcagcttgtgaaaaatcaggacttgaagagagccgtctaagaaataccacgtgctttttttctttaccattttgctttcccagcctccaaacatagttaatagaaatttcccttcaaagaactgtctggggatgtgatgctttgaaaaatctaatcagtgacttaagagagattttcttgtatacagggagagtgagataacttattgtgaagggttagctttactgtacaggatagcagggaactggacatctcagggtaaaagtcagtacggattttaatagcctggggaggaaaacacattctttgccacagacaggcaaagcaacacatgctcatcctcctgcctatgctgagatacgcactcagctccatgtcttgtacacacagaaacattgctggtttcaagaaatgaggtgatcctattatcaaattcaatctgatgtcaaatagcactaagaagttattgtgccttatgaaaaataatgatctctgtctagaaataccatagaccatatatagtctcacattgataattgaaactagaagggtctataatcagcctatgccagggcttcaatggaatagtatccccttatgtttagttgaaatgtccccttaacttgatataatgtgttatgcttatggcgctgtggacaatctgatttttcatgtcaactttccagatgatttgtaacttctctgtgccaaaccttttataaacataaatttttgagatatgtattttaaaattgtagcacatgtttccctgacattttcaatagaggatacaacatcacagaatctttctggatgattctgtgttatcaaggaattgtactgtgctacaattatctctagaatctccagaaaggtggagggctgttcgcccttacactaaatggtctcagttggatttttttttcctgttttctatttcctcttaagtacaccttcaactatattcccatccctctattttaatctgttatgaaggaaggtaaataaaaatgctaaatagaagaaattgtaggtaaggtaagaggaatcaagttctgagtggctgccaaggcactcacagaatcataatcatggctaaatatttatggagggcctactgtggaccaggcactgggctaaatacttacatttacaagaatcattctgagacagatattcaatgatatctggcttcactactcagaagattgtgtgtgtgtttgtgtgtgtgtgtgtgtgtgtatttcactttttgttattgaccatgttctgcaaaattgcagttactcagtgagtgatatccgaaaaagtaaacgtttatgactataggtaatatttaagaaaatgcatggttcatttttaagtttggaatttttatctatatttctcacagatgtgcagtgcacatgcaggcctaagtatatgttgtgtgtgttgtttgtctttgatgtcatggtcccctctcttaggtgctcactcgctttgggtgcacctggcctgctcttcccatgttggcctctgcaaccacacagggatatttctgctatgcaccagcctcactccaccttccttccatcaaaaatatgtgtgtgtgtctcagtccctgtaagtcatgtccttcacagggagaattaacccttcgatatacatggcagagttttgtgggaaaagaattgaatgaaaagtcaggagatcagaattttaaatttgacttagccactaactagccatgtaaccttgggaaagtcatttcccatttctgggtcttgcttttctttctgttaaatgagaggaatgttaaatatctaacagtttagaatcttatgcttacagtgttatctgtgaatgcacatattaaatgtctatgttcttgttgctatgagtcaaggagtgtaaccttctcctttactatgttgaatgtatttttttctggacaagcttacatcttcctcagccatctttgtgagtccttcaagagcagttatcaattgttagttagatattttctatttagagaatgcttaagggattccaatcccgatccaaatcataatttgttcttaagtatactgggcaggtcccctattttaagtcataattttgtatttagtgctttcctggctctcagagagtattaatattgatattaataatatagttaatagtaatattgctatttacatggaaacaaataaaagatctcagaattca

SEQ ID NO: 33193 - DNA, 1240 bp, Homo sapiens
gtacagcttgctggtggttggggtcacattggactatcaatatccaggagatgttgagaaaaagaggggatcctttccaacaagtcatccagcaactctgggacagaaggaaagctgtgggaagaaaagcagggtgctggtttctaggacactaaacctcatggtatcacatcggtatcctcgaattcaaagtatcaaagtacaatttaccgaatataagaaggagaaaggtttcatcctcacttcccaaaaggaggatgaaatcatgaaggtgcagaacaactcagtcatcatcaactgtgatgggttttatctcatctccctgaagggctacttctcccaggaagtcaacattagccttcattaccagaaggatgaggagcccctcttccaactgaagaaggtcaggtctgtcaactccttgatggtggcctctctgacttacaaagacaaagtctacttgaatgtgaccactgacaatacctccctggatgacttccatgtgaatggcggagaactgattcttatccatcaaaatcctggtgaattctgtgtcctttgaggggctgatggcaatatctaaaaccaggcaccagcatgaacaccaagctgggggtggacagggcatggattcttcattgcaagtgaaggagcctcccagctcagccacgtgggatgtgacaagaagcagatcctggccctcccgcccccacccctcagggatatttaaaacttattttatataccagttaatcttatttatccttatattttctaaattgcctagccgtcacaccccaagattgccttgagcctactaggcacctttgtgagaaagaaaaaatagatgcctcttcttcaagatgcattgtttctattggtcaggcaattgtcataataaacttatgtcattgaaaacggtacctgactaccatttgctggaaatttgacatgtgtgtggcattatcaaaatgaagaggagcaaggagtgaaggagtggggttatgaatctgccaaaggtggtatgaaccaacccctggaagccaaagcggcctctccaaggttaaattgattgcagtttgcatattgcctaaatttaaactttctcatttggtgggggttcaaaagaagaatcagcttgtgaaaaatcagtgacttaagagagattttcttgtatacagggagagtgagataacttattgtgaagggttagctttactgtacaggatagcagggaact

SEQ ID NO: 33194 - DNA, 1665 bp, Homo sapiens
aaaaagcggcgcgctgtgtcttcccgcagtctctcgtcatggaatacgcctctgacgcttcactggaccccgaagccccgtggcctcccgcgccccgcgctcgcgcctgccgcgtactgccttgggccctggtcgcggggctgctgctgctgctgctgctcgctgccgcctgcgccgtcttcctcgcctgcccctgggccgtgtccggggctcgcgcctcgcccggctccgcggccagcccgagactccgcgagggtcccgagctttcgcccgacgatcccgccggcctcttggacctgcggcagggcatgtttgcgcagctggtggcccaaaatgttctgctgatcgatgggcccctgagctggtacagtgacccaggcctggcaggcgtgtccctgacggggggcctgagctacaaagaggacacgaaggagctggtggtggccaaggctggagtctactatgtcttctttcaactagagctgcggcgcgtggtggccggcgagggctcaggctccgtttcacttgcgctgcacctgcagccactgcgctctgctgctggggccgccgccctggctttgaccgtggacctgccacccgcctcctccgaggctcggaactcggccttcggtttccagggccgcttgctgcacctgagtgccggccagcgcctgggcgtccatcttcacactgaggccagggcacgccatgcctggcagcttacccagggcgccacagtcttgggactcttccgggtgacccccgaaatcccagccggactcccttcaccgaggtcggaataacgtccagcctgggtgcagcccacctggacagagtccgaatcctactccatccttcatggagacccctggtgctgggtccctgctgctttctctacctcaaggggcttggcaggggtccctgctgctgacctccccttgaggaccctcctcacccactccttccccaagttggaccttgatatttattctgagcctgagctcagataatatattatatatattatatatatatatatatttctatttaaagaggatcctgagtttgtgaatggacttttttagaggagttgttttgggggggggggggtcttcgacattgccgaggctggtcttgaactcctggacttagacgatcctcctgcctcagcctcccaagcaactgggattcatcctttctattaattcattgtacttatttgcttatttgtgtgtattgagcatctgtaatgtgccagcattgtgcccaggctagggggctatagaaacatctagaaatagactgaaagaaaatctgagttatggtaatacgtgaggaatttaaagactcatccccagcctccacctcctgtgtgatacttgggggctagcttttttctttctttcttttttttgagatggtcttgttctgtcaaccaggctagaatgcagcggtgcaatcatgagtcaatgcagcctccagcctcgacctcccgaggctcaggtgatcctcccatctcagcctctcgagtagctgggaccacagttgtgtgccaccacacttggctaactttttaatttttttgcggagacggtattgctatgttgccaaggttgtttacatgccagtacaatttataataaacactcatttttcctccctctg

SEQ ID NO: 33195 - DNA, 8138 bp, Homo sapiens
ccgctgaggccgcggcgcccgccagcctgtcccgcgccatggccccgcgcgcccggcggcgccgcccgctgttcgcgctgctgctgctctgcgcgctgctcgcccggctgcaggtggctttgcagatcgctcctccatgtaccagtgagaagcattatgagcatctgggacggtgctgtaacaaatgtgaaccaggaaagtacatgtcttctaaatgcactactacctctgacagtgtatgtctgccctgtggcccggatgaatacttggatagctggaatgaagaagataaatgcttgctgcataaagtttgtgatacaggcaaggccctggtggccgtggtcgccggcaacagcacgaccccccggcgctgcgcgtgcacggctgggtaccactggagccaggactgcgagtgctgccgccgcaacaccgagtgcgcgccgggcctgggcgcccagcacccgttgcagctcaacaaggacacagtgtgcaaaccttgccttgcaggctacttctctgatgccttttcctccacggacaaatgcagaccctggaccaactgtaccttccttggaaagagagtagaacatcatgggacagagaaatccgatgcggtttgcagttcttctctgccagctagaaaaccaccaaatgaaccccatgtttacttgcccggtttaataattctgcttctcttcgcgtctgtggccctggtggctgccatcatctttggcgtttgctataggaaaaaagggaaagcactcacagctaatttgtggcactggatcaatgaggcttgtggccgcctaagtggagataaggagtcctcaggtgacagttgtgtcagtacacacacggcaaactttggtcagcagggagcatgtgaaggtgtcttactgctgactctggaggagaagacatttccagaagatatgtgctacccagatcaaggtggtgtctgtcagggcacatgtgtaggaggtggtccctacgcacaaggcgaagatgccaggatgctctcattggtcagcaagaccgagatagaggaagacagcttcagacagatgcccacagaagatgaatacatggacaggccctcccagcccacagaccagttactgttcctcactgagcctggaagcaaatccacacctcctttctctgaacccctggaggtgggggagaatgacagtttaagccagtgcttcacggggacacagagcacagtgggttcagaaagctgcaactgcactgagcccctgtgcaggactgattggactcccatgtcctctgaaaactacttgcaaaaagaggtggacagtggccattgcccgcactgggcagccagccccagccccaactgggcagatgtctgcacaggctgccggaaccctcctggggaggactgtgaacccctcgtgggttccccaaaacgtggacccttgccccagtgcgcctatggcatgggccttccccctgaagaagaagccagcaggacggaggccagagaccagcccgaggatggggctgatgggaggctcccaagctcagcgagggcaggtgccgggtctggaagctcccctggtggccagtcccctgcatctggaaatgtgactggaaacagtaactccacgttcatctccagcgggcaggtgatgaacttcaagggcgacatcatcgtggtctacgtcagccagacctcgcaggagggcgcggcggcggctgcggagcccatgggccgcccggtgcaggaggagaccctggcgcgccgagactccttcgcggggaacggcccgcgcttcccggacccgtgcggcggccccgaggggctgcgggagccggagaaggcctcgaggccggtgcaggagcaaggcggggccaaggcttgagcgccccccatggctgggagcccgaagctcggagccagggctcgcgagggcagcaccgcagcctctgccccagccccggccacccagggatcgatcggtacagtcgaggaagaccacccggcattctctgcccactttgccttccaggaaatgggcttttcaggaagtgaattgatgaggactgtccccatgcccacggatgctcagcagcccgccgcactggggcagatgtctcccctgccactcctcaaactcgcagcagtaatttgtggcactatgacagctatttttatgactatcctgttctgtgggggggggggtctgttttccccccatatttgtattccttttcataacttttcttgatatctttcctccctcttttttaatgtaaaggttttctcaaaaattctcctaaaggtgagggtctctttcttttctcttttccttttttttttctttttttggcaacctggctctggcccaggctagagtgcagtggtgcgattatagcccggtgcagcctctaactcctgggctcaagcaatccaagtgatcctcccacctcaaccttcggagtagctgggatcacagctgcaggccacgcccagcttcctccccccgactccccccccagagacacggtcccaccatgttacccagcctggtctcaaactccccagctaaagcagtcctccagcctcggcctcccaaagtactgggattacaggcgtgagcccccacgctggcctgctttacgtattttcttttgtgcccctgctcacagtgttttagagatggctttcccagtgtgtgttcattgtaaacacttttgggaaagggctaaacatgtgaggcctggagatagttgctaagttgctaggaacatgtggtgggactttcatattctgaaaaatgttctatattctcatttttctaaaagaaagaaaaaaggaaacccgatttatttctcctgaatctttttaagtttgtgtcgttccttaagcagaactaagctcagtatgtgaccttacccgctaggtggttaatttatccatgctggcagaggcactcaggtacttggtaagcaaatttctaaaactccaagttgctgcagcttggcattcttcttattctagaggtctctctggaaaagatggagaaaatgaacaggacatggggctcctggaaagaaagggcccgggaagttcaaggaagaataaagttgaaattttaatttgcattttttttgtctagataagaatagcgtgaatagatcctcttttattcgtaaataatcgtgcatctgtgggttagccttgtagaagtggaaaacattccattttccaatgcatttaaatgtaaagccaaatctgcatgttgtgaatttaagaaaacttattatcctaaaggtgcctttctcttggcatcatcccgcttgtgagaagcctagaggacgctccaggtggaaggaaatcccctgggtggttttatcttttgttacccagtgagcactggttccccgcaaatactggggaaaagcaaaaatacacaagcaagttaaaattaattttgcacatctgggaggttataaaagaaagcactaatagtagtcactgcccagactttactggccacaaatgcccagctgaagagcatgactgtggatcactggtttttccctcctgctggaaatgctggggtggtagcggtcgattaggattttcagtggagaagcacaggacagttctgtaatttatgggactccttagccaacataaagaactgcaggaaataactgcacagccaggaggatccgttggtgggaatttaccgtcattcctgcccttttatttaacatcatccacagagagatgttatacaaatggaggaaaccattataccttttgatatggaatatattacagagttacagttcacaaagtagaatgctgagctgaaaacccgagtttctgctgtgactgtcatctcactgagcacttcgcttttctttgcttttattttttccttctataaaaaggcaataatgataatttataatagtttccctacccagagatattagaagtatgctacagtgaatgttaaagtaccttgagatccttaaatcaaaggtgctatatacataagtaagactctactttcagaaaaaggtaatattatttcctgcactgatccctactaattctatattgatccaaaggcaactcaatgctaaaaaatgtatagaaaatataagtctgtgtctgtgtactgtagagatgtatgtgacaagtgtaaacaaaatgaactgaagcagtaatgaacagttattagggggaacatgataaagagattatattaagcttatgtttcaccataaaatcctttttatggcttactaaaaccgagctcactgtaaaatcatgatccaacttattgctaatctttatgatatgcttattcctaatctttatggtatggtgtcaaccgttcatttgtatcttattgctcattccctggaccacagactagggacagaaaatacttgctttaataatatatatgctgttgatttcacaaaaatttattaaaatacagcctgggtacccagtgaaagagctgaaatggaaatggagtatcatgtttcctactcacattttactcagctgtcggaaggaagaatgaatttctcaagagcagtttgaatgtgttagatcagaaccttcatgtggtggggaaaatgggattatttcagtgtaacaaaccacccaaagacttagtggcttaaaatagtcaccattggccaggcacagcggttcatgcctcccagtgctttgggaggccaaggcaggaggatcacttgaggacagtagttagagatcaaactgggcaatggagtgagacctcgtctctacaaaaaatacaaaacttatctgggcacggtggtgtgcacctgcagtcctggctactcaggaggctgaggcaggaggatgcttgagtccaggagttcaaggttactgtgagctttgattgggtcagtgcactccagtgtaaaaaaacaaaaataaaaaccaccacttatttagctcccaattctatgggttggatcagcttgggtggttcttcaggcctggtccctcctggcctggtttgcttacccatttacaatgacccggctagttggccgggccaggctgtgtgctctccacctgtctcccatccttccagccacctagctgggcatgctctcatggtggtgtcgagcctgagaacaagcagaaacctgccaggcttcttgaggcctaggctctaactggcatgctgtcacttctgccacattctgtgggccaaagcaggtcacaaaggcagcccagatccaagggatgggggagcagcatatccccccatgggaagagttgcggaatgagagggtagggggtggacacacagaggggaagatggcccccttgccatctgtccaccacagggcactgcgtggagtaaaatgctgcagagaagagtgcattctgggaaaaaaagaggaacatatcccagcccctaaccagtgagtagctccttctctggtgattgaattcccttaatgcacagcactatagattcccacaatgaaagggacacccacgttcatatttaagtgctgtgtcaaaattctttccagagccaaatataggtgatttgggaattgagcctactgtactgcttccacattcctttggcacagaaaactgaaaagtcacaacttctaaaatcaagaaaactggtgagataccttggggtagagaaacctgcatataaacagataaaagatcgagtgttcacccttcacctcagctcaacaaacaaactcttgttacgattatacaagggtgagcttgagcaaaggtgctgtctttggtggaagaaacgtagttttgagttgtttgctctttgacagtctctgatggcatgtgagtctggtgcattgctgtgggctgcgctgggcacaagttgcataacccgcttttggaagaggagacaaagcattcaaagccctaaacactctgttggtgaatcatcatgtttattgagtgtgcttttagtggcagggccctgagcacctgggaaaggagatgaggagcgctggagggttcggagcagagaagacgagacaatgctctgctccaagcgccagaggaggcttctgggaaggggctgtctgtggaatttctgacccccagagccctgctggtgaagtcttgcaaccactaaagctttgccagagaagaggagggacctgacactgggcagtggcggtgccagcagtgagcacaggcggggtctaggtgggatcactgaagccaagccaagtggtgcagggggagccgccctggaccaacacccccatggctgccccactgcggaactgcctactgcggcaaaacaatcctatgtcccccaaggtttcaacaaagaggaggaccgaataaatgtcccagtgggcaggcacacccacaagacttgctgctcctcctgacccacccgcatggctctgcacagctgtgagtccagttttctctcttcctacctccctcttacccagttatcctgaccccagggtgaggttgaaactcatgctaggctaacatctctttccttcatcccattcataaaactggcatacaggaatgttttaaaaaaatctttaagattaccaggagtataaaagttaaaatgacaaaattacaggcctgttaccagatcttcgtactaaccaaggagctggtgacactaccctcttccctgtgtgatagaaaatgcagacgttttgcaggcagacctggttcatgactcagcgctgtgacttgtggacttatcttgtgcagctacatcacttcttagccttgttttcaacatgcgtaagcagaaggtactaatattagtctttagggctggtttgaggatgacgtgagatgagagacaaccaagcactcactggcagttcctagaagattccagtagtagagatctgactgtcctacactactttccctccctgtctctgacacttgttcattcctgggctcaggagccatctcagtcatcatgtcggaccacgtaactataaccaagctctgctgcccacctgggacaccttcccactctttgcaactaggtcggagggacgcaccttctccacagttgacaggactgttatggttgacccaaaagttgtcatcttctgacatgacacactgagggaagtagacttacccaatataacttcacattatactgtcttaaaagactatgattaaaatgggcatcagtgtaggcaacatgtagggcgcaaagaatagccagatgtgaaggttgaaaggctatgtgggctagtttgtcatggtattcctggtgcctctccccgtttgggaagaataacacattgaccaccggctcagaggaggtggcattataggtccaggccccttcaggagggcactggagtcaatgaaagcttttgctctcacccaggctcttggtttctcacgggcaggggtagcccaggaaacaaaggctgtatagactttaagtcgtgagaaaaacgacattcttatggtgaggctcttagagactgtctccatttaagcagcagcagtaaaacatcttaccctaaaatgaagaagcaaatccatttttattggcttttatagcctctctctttcaatgacaaagaaaccattaaaatgaatgtttaaagttcttagaagagctttctctaaatatttactctgtcagtggaaaaataaacattttttacatcgggtctattgagtttgttatatacagtaaaattcaccctttttagatatatagttttatgagttttaacaaaaatacatagttgtgtaaccaccaccatcacaatcaagatatagaatatttcaacatcccaaagttcccatttcccttttcagtcaatcccttccccactacccctagcccctggcaaccattatctgttctctcttcccatagtttcaccttttccaatttgtcgtgtagagttacacagctcatagccatttgagtctggcttctttccacataatgtccttgagatccatcggtgggtacaccagtagttccattttttttctgagtagtagtccattgtatggatgtactgcggtttattcaccaacatatgggttctttcctgtttggggagattacaaataaagctactat

SEQ ID NO: 33196 - DNA, 1718 bp, Homo sapiens
ggagcaggctcaggatgggcctccagtgcctcctctggagctcactacccagactacagcagcgcagtgggcagcgcctcagctccttccccttctgctgcctacagcctggacaggacccggaatcaaaccgcaggccctgggtcaccgctgccggaaagagccagttcctgtccgtccatgcacccaccaccaaaacccaggccttcctggaggtgctaggggaggccatgccccttttctgagtgcttggaagtgactgctgcaagtgacaagtgaccacgccttttcccccgcgggtataaattcagaggcgctgcgctccgattctggcagtgcagctgtgggaacctctccacgcgcacgaactcagccaacgatttctgatagatttttgggagtttgaccagagatgcaaggggtgaaggagcgcttcctaccgttagggaactctggggacagagcgccccggccgcctgatggccgaggcagggtgcgacccaggacccaggacggcgtcgggaaccataccatggcccggatccccaagaccctaaagttcgtcgtcgtcatcgtcgcggtcctgctgccagtcctagcttactctgccaccactgcccggcaggaggaagttccccagcagacagtggccccacagcaacagaggcacagcttcaagggggaggagtgtccagcaggatctcatagatcagaacatactggagcctgtaacccgtgcacagagggtgtggattacaccaacgcttccaacaatgaaccttcttgcttcccatgtacagtttgtaaatcagatcaaaaacataaaagttcctgcaccatgaccagagacacagtgtgtcagtgtaaagaaggcaccttccggaatgaaaactccccagagatgtgccggaagtgtagcaggtgccctagtggggaagtccaagtcagtaattgtacgtcctgggatgatatccagtgtgttgaagaatttggtgccaatgccactgtggaaaccccagctgctgaagagacaatgaacaccagcccggggactcctgccccagctgctgaagagacaatgaacaccagcccggggactcctgccccagctgctgaagagacaatgaccaccagcccggggactcctgccccagctgctgaagagacaatgaccaccagcccggggactcctgccccagctgctgaagagacaatgatcaccagcccggggactcctgcctcttctcattacctctcatgcaccatcgtagggatcatagttctaattgtgcttctgattgtgtttgtttgaaagacttcactgtggaagaaattccttccttacctgaaaggttcaggtaggcgctggctgagggcggggggcgctggacactctctgccctgcctccctctgctgtgttcccacagacagaaacgcctgcccctgccccaagtcctggtgtctccagcctggctctatcttcctccttgtgatcgtcccatccccacatcccgtgcaccccccaggaccctggtctcatcagtccctctcctggagctgggggtccacacatctcccagccaagtccaagagggcagggccagttcctcccatcttcaggcccagccaggcagggggcagtcggctcctcaactgggtgacaagggtgaggatgagaagtggtcacgggatttattcagccttggtcagagcagaa

SEQ ID NO: 33197 - DNA, 894 bp, Homo sapiens
ggcagtgcagctgtgggaacctctccacgcgcacgaactcagccaacgatttctgatagatttttgggagtttgaccagagatgcaaggggtgaaggagcgcttcctaccgttagggaactctggggacagagcgccccggccgcctgatggccgaggcagggtgcgacccaggacccaggacggcgtcgggaaccataccatggcccggatccccaagaccctaaagttcgtcgtcgtcatcgtcgcggtcctgctgccagatctcatagatcagaacatactggagcctgtaacccgtgcacagagggtgtggattacaccaacgcttccaacaatgaaccttcttgcttcccatgtacagtttgtaaatcagatcaaaaacataaaagttcctgcaccatgaccagagacacagtgtgtcagtgtaaagaaggcaccttccggaatgaaaactccccagagatgtgccggaagtgtagcaggtgccctagtggggaagtccaagtcagtaattgtacgtcctgggatgatatccagtgtgttgaagaatttggtgccaatgccactgtggaaaccccagctgctgaagagacaatgaacaccagcccggggactcctgccccagctgctgaagagacaatgaacaccagcccggggactcctgccccagctgctgaagagacaatgaccaccagcccggggactcctgccccagctgctgaagagacaatgaccaccagcccggggactcctgccccagctgctgaagagacaatgatcaccagcccggggactcctgcctcttctcattacctctcatgcaccatcgtagggatcatagttctaattgtgcttctgattgtgtttgtttgaaagacttcactgtggaaga

SEQ ID NO: 33198 - DNA, 1023 bp, Homo sapiens
gctgtgggaacctctccacgcgcacgaactcagccaacgatttctgatagatttttgggagtttgaccagagatgcaaggggtgaaggagcgcttcctaccgttagggaactctggggacagagcgccccggccgcctgatggccgaggcagggtgcgacccaggacccaggacggcgtcgggaaccataccatggcccggatccccaagaccctaaagttcgtcgtcgtcatcgtcgcggtcctgctgccagtcctagcttactctgccaccactgcccggcaggaggaagttccccagcagacagtggccccacagcaacagaggcacagcttcaagggggaggagtgtccagcaggatctcatagatcagaacatactggagcctgtaacccgtgcacagagggtgtggattacaccaacgcttccaacaatgaaccttcttgcttcccatgtacagtttgtaaatcagatcaaaaacataaaagttcctgcaccatgaccagagacacagtgtgtcagtgtaaagaaggcaccttccggaatgaaaactccccagagatgtgccggaagtgtagcaggtgccctagtggggaagtccaagtcagtaattgtacgtcctgggatgatatccagtgtgttgaagaatttggtgccaatgccactgtggaaaccccagctgctgaagagacaatgaacaccagcccggggactcctgccccagctgctgaagagacaatgaacaccagcccggggactcctgccccagctgctgaagagacaatgaccaccagcccggggactcctgccccagctgctgaagagacaatgaccaccagcccggggactcctgccccagctgctgaagagacaatgatcaccagcccggggactcctgcctcttctcattacctctcatgcaccatcgtagggatcatagttctaattgtgcttctgattgtaccctatctcaaaaaaaaaaaaaaaaaaaaactaaagaaaaaacaaaaacgaaagagcaag

SEQ ID NO: 33199 - DNA, 4521 bp, Homo sapiens
ccgctgaggccgcggcgcccgccagcctgtcccgcgccatggccccgcgcgcccggcggcgccgcccgctgttcgcgctgctgctgctctgcgcgctgctcgcccggctgcaggtggctttgcagatcgctcctccatgtaccagtgagaagcattatgagcatctgggacggtgctgtaacaaatgtgaaccaggaaagtacatgtcttctaaatgcactactacctctgacagtgtatgtctgccctgtggcccggatgaatacttggatagctggaatgaagaagataaatgcttgctgcataaagtttgtgatacaggcaaggccctggtggccgtggtcgccggcaacagcacgaccccccggcgctgcgcgtgcacggctgggtaccactggagccaggactgcgagtgctgccgccgcaacaccgagtgcgcgccgggcctgggcgcccagcacccgttgcagctcaacaaggacacagtgtgcaaaccttgccttgcaggctacttctctgatgccttttcctccacggacaaatgcagaccctggaccaactgtaccttccttggaaagagagtagaacatcatgggacagagaaatccgatgcggtttgcagttcttctctgccagctagaaaaccaccaaatgaaccccatgtttacttgcccggtttaataattctgcttctcttcgcgtctgtggccctggtggctgccatcatctttggcgtttgctataggaaaaaagggaaagcactcacagctaatttgtggcactggatcaatgaggcttgtggccgcctaagtggagataaggagtcctcaggtgacagttgtgtcagtacacacacggcaaactttggtcagcagggagcatgtgaaggtgtcttactgctgactctggaggagaagacatttccagaagatatgtgctacccagatcaaggtggtgtctgtcagggcacatgtgtaggaggtggtccctacgcacaaggcgaagatgccaggatgctctcattggtcagcaagaccgagatagaggaagacagcttcagacagatgcccacagaagatgaatacatggacaggccctcccagcccacagaccagttactgttcctcactgagcctggaagcaaatccacacctcctttctctgaacccctggaggtgggggagaatgacagtttaagccagtgcttcacggggacacagagcacagtgggttcagaaagctgcaactgcactgagcccctgtgcaggactgattggactcccatgtcctctgaaaactacttgcaaaaagaggtggacagtggccattgcccgcactgggcagccagccccagccccaactgggcagatgtctgcacaggctgccggaaccctcctggggaggactgtgaacccctcgtgggttccccaaaacgtggacccttgccccagtgcgcctatggcatgggccttccccctgaagaagaagccagcaggacggaggccagagaccagcccgaggatggggctgatgggaggctcccaagctcagcgagggcaggtgccgggtctggaagctcccctggtggccagtcccctgcatctggaaatgtgactggaaacagtaactccacgttcatctccagcgggcaggtgatgaacttcaagggcgacatcatcgtggtctacgtcagccagacctcgcaggagggcgcggcggcggctgcggagcccatgggccgcccggtgcaggaggagaccctggcgcgccgagactccttcgcggggaacggcccgcgcttcccggacccgtgcggcggccccgaggggctgcgggagccggagaaggcctcgaggccggtgcaggagcaaggcggggccaaggcttgagcgccccccatggctgggagcccgaagctcggagccagggctcgcgagggcagcaccgcagcctctgccccagccccggccacccagggatcgatcggtacagtcgaggaagaccacccggcattctctgcccactttgccttccaggaaatgggcttttcaggaagtgaattgatgaggactgtccccatgcccacggatgctcagcagcccgccgcactggggcagatgtctcccctgccactcctcaaactcgcagcagtaatttgtggcactatgacagctatttttatgactatcctgttctgtgggggggggggtctgttttccccccatatttgtattccttttcataacttttcttgatatctttcctccctcttttttaatgtaaaggttttctcaaaaattctcctaaaggtgagggtctctttcttttctcttttccttttttttttctttttttggcaacctggctctggcccaggctagagtgcagtggtgcgattatagcccggtgcagcctctaactcctgggctcaagcaatccaagtgatcctcccacctcaaccttcggagtagctgggatcacagctgcaggccacgcccagcttcctccccccgactccccccccagagacacggtcccaccatgttacccagcctggtctcaaactccccagctaaagcagtcctccagcctcggcctcccaaagtactgggattacaggcgtgagcccccacgctggcctgctttacgtattttcttttgtgcccctgctcacagtgttttagagatggctttcccagtgtgtgttcattgtaaacacttttgggaaagggctaaacatgtgaggcctggagatagttgctaagttgctaggaacatgtggtgggactttcatattctgaaaaatgttctatattctcatttttctaaaagaaagaaaaaaggaaacccgatttatttctcctgaatctttttaagtttgtgtcgttccttaagcagaactaagctcagtatgtgaccttacccgctaggtggttaatttatccatgctggcagaggcactcaggtacttggtaagcaaatttctaaaactccaagttgctgcagcttggcattcttcttattctagaggtctctctggaaaagatggagaaaatgaacaggacatggggctcctggaaagaaagggcccgggaagttcaaggaagaataaagttgaaattttaatttgcattttttttgtctagataagaatagcgtgaatagatcctcttttattcgtaaataatcgtgcatctgtgggttagccttgtagaagtggaaaacattccattttccaatgcatttaaatgtaaagccaaatctgcatgttgtgaatttaagaaaacttattatcctaaaggtgcctttctcttggcatcatcccgcttgtgagaagcctagaggacgctccaggtggaaggaaatcccctgggtggttttatcttttgttacccagtgagcactggttccccgcaaatactggggaaaagcaaaaatacacaagcaagttaaaattaattttgcacatctgggaggttataaaagaaagcactaatagtagtcactgcccagactttactggccacaaatgcccagctgaagagcatgactgtggatcactggtttttccctcctgctggaaatgctggggtggtagcggtcgattaggattttcagtggagaagcacaggacagttctgtaatttatgggactccttagccaacataaagaactgcaggaaataactgcacagccaggaggatccgttggtgggaatttaccgtcattcctgcccttttatttaacatcatccacagagagatgttatacaaatggaggaaaccattataccttttgatatggaatatattacagagttacagttcacaaagtagaatgctgagctgaaaacccgagtttctgctgtgactgtcatctcactgagcacttcgcttttctttgcttttattttttccttctataaaaaggcaataatgataatttataatagtttccctacccagagatattagaagtatgctacagtgaatgttaaagtaccttgagatccttaaatcaaaggtgctatatacataagtaagactctactttcagaaaaaggtaatattatttcctgcactgatccctactaattctatattgatccaaaggcaactcaatgctaaaaaatgtatagaaaatataagtctgtgtctgtgtactgtagagatgtatgtgacaagtgtaaacaaaatgaactgaagcagtaatgaacagttattagggggaacatgataaagagattatattaagcttatgtttcaccataaaatcctttttatggcttactaaaaccgagctcactgtaaaatcatgatccaacttattgctaatctttatgatatgcttattcctaatctttatggtatggtgtcaaccgttcatttgtatcttattgctcattccctggaccacagactagggacagaaaatacttgctttaataatatatatgctgttgatttcacaaaaatttattaaaatacagcctgggtacccagtgaaagagctgaaatgga

SEQ ID NO: 33200 - DNA, 3591 bp, Homo sapiens
ggcagccgcgcccgctgggccacagaggccgctgaggccgcggcgcccgccagcctgtcccgcgccatggccccgcgcgcccggcggcgccgcccgctgttcgcgctgctgctgctctgcgcgctgctcgcccggctgcaggtggctttgcagatcgctcctccatgtaccagtgagaagcattatgagcatctgggacggtgctgtaacaaatgtgaaccaggaaagtacatgtcttctaaatgcactactacctctgacagtgtatgtctgccctgtggcccggatgaatacttggatagctggaatgaagaagataaatgcttgctgcataaagtttgtgatacaggcaaggccctggtggccgtggtcgccggcaacagcacgaccccccggcgctgcgcgtgcacggctgggtaccactggagccaggactgcgagtgctgccgccgcaacaccgagtgcgcgccgggcctgggcgcccagcacccgttgcagctcaacaaggacacagtgtgcaaaccttgccttgcaggctacttctctgatgccttttcctccacggacaaatgcagaccctggaccaactgtaccttccttggaaagagagtagaacatcatgggacagagaaatccgatgcggtttgcagttcttctctgccagctagaaaaccaccaaatggaaatgtgactggaaacagtaactccacgttcatctccagcgggcaggtgatgaacttcaagggcgacatcatcgtggtctacgtcagccagacctcgcaggagggcgcggcggcggctgcggagcccatgggccgcccggtgcaggaggagaccctggcgcgccgagactccttcgcggggaacggcccgcgcttcccggacccgtgcggcggccccgaggggctgcgggagccggagaaggcctcgaggccggtgcaggagcaaggcggggccaaggcttgagcgccccccatggctgggagcccgaagctcggagccagggctcgcgagggcagcaccgcagcctctgccccagccccggccacccagggatcgatcggtacagtcgaggaagaccacccggcattctctgcccactttgccttccaggaaatgggcttttcaggaagtgaattgatgaggactgtccccatgcccacggatgctcagcagcccgccgcactggggcagatgtctcccctgccactcctcaaactcgcagcagtaatttgtggcactatgacagctatttttatgactatcctgttctgtgggggggggggtctgttttccccccatatttgtattccttttcataacttttcttgatatctttcctccctcttttttaatgtaaaggttttctcaaaaattctcctaaaggtgagggtctctttcttttctcttttccttttttttttctttttttggcaacctggctctggcccaggctagagtgcagtggtgcgattatagcccggtgcagcctctaactcctgggctcaagcaatccaagtgatcctcccacctcaaccttcggagtagctgggatcacagctgcaggccacgcccagcttcctccccccgactccccccccagagacacggtcccaccatgttacccagcctggtctcaaactccccagctaaagcagtcctccagcctcggcctcccaaagtactgggattacaggcgtgagcccccacgctggcctgctttacgtattttcttttgtgcccctgctcacagtgttttagagatggctttcccagtgtgtgttcattgtaaacacttttgggaaagggctaaacatgtgaggcctggagatagttgctaagttgctaggaacatgtggtgggactttcatattctgaaaaatgttctatattctcatttttctaaaagaaagaaaaaaggaaacccgatttatttctcctgaatctttttaagtttgtgtcgttccttaagcagaactaagctcagtatgtgaccttacccgctaggtggttaatttatccatgctggcagaggcactcaggtacttggtaagcaaatttctaaaactccaagttgctgcagcttggcattcttcttattctagaggtctctctggaaaagatggagaaaatgaacaggacatggggctcctggaaagaaagggcccgggaagttcaaggaagaataaagttgaaattttaatttgcattttttttgtctagataagaatagcgtgaatagatcctcttttattcgtaaataatcgtgcatctgtgggttagccttgtagaagtggaaaacattccattttccaatgcatttaaatgtaaagccaaatctgcatgttgtgaatttaagaaaacttattatcctaaaggtgcctttctcttggcatcatcccgcttgtgagaagcctagaggacgctccaggtggaaggaaatcccctgggtggttttatcttttgttacccagtgagcactggttccccgcaaatactggggaaaagcaaaaatacacaagcaagttaaaattaattttgcacatctgggaggttataaaagaaagcactaatagtagtcactgcccagactttactggccacaaatgcccagctgaagagcatgactgtggatcactggtttttccctcctgctggaaatgctggggtggtagcggtcgattaggattttcagtggagaagcacaggacagttctgtaatttatgggactccttagccaacataaagaactgcaggaaataactgcacagccaggaggatccgttggtgggaatttaccgtcattcctgcccttttatttaacatcatccacagagagatgttatacaaatggaggaaaccattataccttttgatatggaatatattacagagttacagttcacaaagtagaatgctgagctgaaaacccgagtttctgctgtgactgtcatctcactgagcacttcgcttttctttgcttttattttttccttctataaaaaggcaataatgataatttataatagtttccctacccagagatattagaagtatgctacagtgaatgttaaagtaccttgagatccttaaatcaaaggtgctatatacataagtaagactctactttcagaaaaaggtaatattatttcctgcactgatccctactaattctatattgatccaaaggcaactcaatgctaaaaaatgtatagaaaatataagtctgtgtctgtgtactgtagagatgtatgtgacaagtgtaaacaaaatgaactgaagcagtaatgaacagttattagggggaacatgataaagagattatattaagcttatgtttcaccataaaatcctttttatggcttactaaaaccgagctcactgtaaaatcatgatccaacttattgctaatctttatgatatgcttattcctaatctttatggtatggtgtcaaccgttcatttgtatcttattgctcattccctggaccacagactagggacagaaaatacttgctttaataatatatatgctgttgatttcacaaaaatttattaaaatacagcctgggtacccagtgaaagagctg

SEQ ID NO: 33201 - DNA, 2402 bp, Homo sapiens
ggaaacctcagagccccgcggagacagcagccgccttgttcctcagcccggtggcttttttttcccctgctctcccaggggccagacaccaccgccccacccctcacgccccacctccctgggggatcctttccgccccagccctgaaagcgttaaccctggagctttctgcacaccccccgaccgctcccgcccaagcttcctaaaaaagaaaggtgcaaagtttggtccaggatagaaaaatgactgatcaaaggcaggcgatacttcctgttgccgggacgctatatataacgtgatgagcgcacgggctgcggagacgcaccggagcgctcgcccagccgccgcctccaagcccctgaggtttccggggaccacaatgaacaacttgctgtgctgcgcgctcgtgtttctggacatctccattaagtggaccacccaggaaacgtttcctccaaagtaccttcattatgacgaagaaacctctcatcagctgttgtgtgacaaatgtcctcctggtacctacctaaaacaacactgtacagcaaagtggaagaccgtgtgcgccccttgccctgaccactactacacagacagctggcacaccagtgacgagtgtctatactgcagccccgtgtgcaaggagctgcagtacgtcaagcaggagtgcaatcgcacccacaaccgcgtgtgcgaatgcaaggaagggcgctaccttgagatagagttctgcttgaaacataggagctgccctcctggatttggagtggtgcaagctggaaccccagagcgaaatacagtttgcaaaagatgtccagatgggttcttctcaaatgagacgtcatctaaagcaccctgtagaaaacacacaaattgcagtgtctttggtctcctgctaactcagaaaggaaatgcaacacacgacaacatatgttccggaaacagtgaatcaactcaaaaatgtggaatagatgttaccctgtgtgaggaggcattcttcaggtttgctgttcctacaaagtttacgcctaactggcttagtgtcttggtagacaatttgcctggcaccaaagtaaacgcagagagtgtagagaggataaaacggcaacacagctcacaagaacagactttccagctgctgaagttatggaaacatcaaaacaaagaccaagatatagtcaagaagatcatccaagatattgacctctgtgaaaacagcgtgcagcggcacattggacatgctaacctcaccttcgagcagcttcgtagcttgatggaaagcttaccgggaaagaaagtgggagcagaagacattgaaaaaacaataaaggcatgcaaacccagtgaccagatcctgaagctgctcagtttgtggcgaataaaaaatggcgaccaagacaccttgaagggcctaatgcacgcactaaagcactcaaagacgtaccactttcccaaaactgtcactcagagtctaaagaagaccatcaggttccttcacagcttcacaatgtacaaattgtatcagaagttatttttagaaatgataggtaaccaggtccaatcagtaaaaataagctgcttataactggaaatggccattgagctgtttcctcacaattggcgagatcccatggatgagtaaactgtttctcaggcacttgaggctttcagtgatatctttctcattaccagtgactaattttgccacagggtactaaaagaaactatgatgtggagaaaggactaacatctcctccaataaaccccaaatggttaatccaactgtcagatctggatcgttatctactgactatattttcccttattactgcttgcagtaattcaactggaaattaaaaaaaaaaaactagactccattgtgccttactaaatatgggaatgtctaacttaaatagctttgagatttcagctatgctagaggcttttattagaaagccatatttttttctgtaaaagttactaatatatctgtaacactattacagtattgctatttatattcattcagatataagatttgtacatattatcatcctataaagaaacggtatgacttaattttagaaagaaaattatattctgtttattatgacaaatgaaagagaaaatatatatttttaatggaaagtttgtagcatttttctaataggtactgccatatttttctgtgtggagtatttttataattttatctgtataagctgtaatatcattttatagaaaatgcattatttagtcaattgtttaatgttggaaaacatatgaaatataaattatctgaatattagatgctctgagaaattgaatgtaccttatttaaaagattttatggttttataactatataaatgacattattaaagttttcaaattatttttta

SEQ ID NO: 33202 - DNA, 1033 bp, Homo sapiens
aaggcgggggcgggggcggggcggcggccgtgggtccctgccggccggcggcgggcgcagacagcggcgggcgcaggacgtgcactatggctcggggctcgctgcgccggttgctgcggctcctcgtgctggggctctggctggcgttgctgcgctccgtggccggggagcaagcgccaggcaccgccccctgctcccgcggcagctcctggagcgcggacctggacaagtgcatggactgcgcgtcttgcagggcgcgaccgcacagcgacttctgcctgggctgcgctgcagcacctcctgcccccttccggctgctttggcccatccttgggggcgctctgagcctgaccttcgtgctggggctgctttctggctttttggtctggagacgatgccgcaggagagagaagttcaccacccccatagaggagaccggcggagagggctgcccagctgtggcgctgatccagtgacaatgtgccccctgccagccggggctcgcccactcatcattcattcatccattctagagccagtctctgcctcccagacgcggcgggagccaagctcctccaaccacaaggggggtggggggcggtgaatcacctctgaggcctgggcccagggttcaggggaaccttccaaggtgtctggttgccctgcctctggctccagaacagaaagggagcctcacgctggctcacacaaaacagctgacactgactaaggaactgcagcatttgcacaggggaggggggtgccctccttcctagaggccctgggggccaggctgacttggggggcagacttgacactaggccccactcactcagatgtcctgaaattccaccacgggggtcaccctggggggttagggacctatttttaacactagggggctggcccactaggagggctggccctaagatacagacccccccaactccccaaagcggggaggagatatttattttggggagagtttggaggggagggagaatttattaataaaagaatctttaactttaaa

SEQ ID NO: 33203 - DNA, 839 bp, Homo sapiens
atggctcggggctcgctgcgccggttgctgcggctcctcgtgctggggctctggctggcgttgctgcgctccgtggccggggagcaagcgccaggcgctgcagcacctcctgcccccttccggctgctttggcccatccttgggggcgctctgagcctgaccttcgtgctggggctgctttctggctttttggtctggagacgatgccgcaggagagagaagttcaccacccccatagaggagaccggcggagagggctgcccagctgtggcgctgatccagtgacaatgtgccccctgccagccggggctcgcccactcatcattcattcatccattctagagccagtctctgcctcccagacgcggcgggagccaagctcctccaaccacaaggggggtggggggcggtgaatcacctctgaggcctgggcccagggttcaggggaaccttccaaggtgtctggttgccctgcctctggctccagaacagaaagggagcctcacgctggctcacacaaaacagctgacactgactaaggaactgcagcatttgcacaggggaggggggtgccctccttcctagaggccctgggggccaggctgacttggggggcagacttgacactaggccccactcactcagatgtcctgaaattccaccacgggggtcaccctggggggttagggacctatttttaacactagggggctggcccactaggagggctggccctaagatacagacccccccaactccccaaagcggggaggagatatttattttggggagagtttggaggggagggagaatttattaataaaagaatctttaacttt

SEQ ID NO: 33204 - DNA, 1357 bp, Homo sapiens
agcatcctgagtaatgagtggcctgggccggagcaggcgaggtggccggagccgtgtggaccaggaggagcgctttccacagggcctgtggacgggggtggctatgagatcctgccccgaagagcagtactgggatcctctgctgggtacctgcatgtcctgcaaaaccatttgcaaccatcagagccagcgcacctgtgcagccttctgcaggtcactcagctgccgcaaggagcaaggcaagttctatgaccatctcctgagggactgcatcagctgtgcctccatctgtggacagcaccctaagcaatgtgcatacttctgtgagaacaagctcaggagcccagtgaaccttccaccagagctcaggagacagcggagtggagaagttgaaaacaattcagacaactcgggaaggtaccaaggattggagcacagaggctcagaagcaagtccagctctcccggggctgaagctgagtgcagatcaggtggccctggtctacagcacgctggggctctgcctgtgtgccgtcctctgctgcttcctggtggcggtggcctgcttcctcaagaagaggggggatccctgctcctgccagccccgctcaaggccccgtcaaagtccggccaagtcttcccaggatcacgcgatggaagccggcagccctgtgagcacatcccccgagccagtggagacctgcagcttctgcttccctgagtgcagggcgcccacgcaggagagcgcagtcacgcctgggacccccgaccccacttgtgctggaaggtgggggtgccacaccaggaccacagtcctgcagccttgcccacacatcccagacagtggccttggcattgtgtgtgtgcctgcccaggaggggggcccaggtgcataaatgggggtcagggagggaaaggaggagggagagagatggagaggaggggagagagaaagagaggtggggagaggggagagagatatgaggagagagagacagaggaggcagagagggagagaaacagaggagacagagagggagagagagacagagggagagagagacagaggggaagagaggcagagagggaaagaggcagagaaggaaagagacaggcagagaaggagagaggcagagagggagagaggcagagagggagagaggcagagagacagagagggagagagggacagagagagatagagcaggaggtcggggcactctgagtcccagttcccagtgcagctgtaggtcgtcatcacctaaccacacgtgcaataaagtcctcgtgcctgctgctcacagcccccgagagcccctcctcctggagaataaaacctttggcagctgcccttcctc

SEQ ID NO: 33205 - DNA, 1397 bp, Homo sapiens
tcctgagtaatgagtggcctgggccggagcaggcgaggtggccggagccgtgtggaccaggaggagcgctggtcactcagctgccgcaaggagcaaggcaagttctatgaccatctcctgagggactgcatcagctgtgcctccatctgtggacagcaccctaagcaatgtgcatacttctgtgagaacaagctcaggagcccagtgaaccttccaccagagctcaggagacagcggagtggagaagttgaaaacaattcagacaactcgggaaggtaccaaggattggagcacagaggctcagaagcaagtccagctctcccggggctgaagctgagtgcagatcaggtggccctggtctacagcacgctggggctctgcctgtgtgccgtcctctgctgcttcctggtggcggtggcctgcttcctcaagaagaggggggatccctgctcctgccagccccgctcaaggccccgtcaaagtccggccaagtcttcccaggatcacgcgatggaagccggcagccctgtgagcacatcccccgagccagtggagacctgcagcttctgcttccctgagtgcagggcgcccacgcaggagagcgcagtcacgcctgggacccccgaccccacttgtgctggaaggaaaacgaagccccctcctgtattgacagctgggaattgtggagtccaccgtcctccacctgagacgagcacagggtctccacgaggacagaggctgctttggactcaatagaaaactgggcatcttcatggtcctagaaggatcccaggaggctgatcctatagagacgtctggttcctgaccccaactgcctccaggtgcctggaacagcccatcgtgggccctttaccctcagcaggtggacgccgttggtcctgccagggcaagatggagatggatgagcacccggatatcctgcccacccaggggcaaggcaacatcatcattactaagtatgagcagggacgctgagctggggcagcagtggacacagagcatgagcgtgttgacatctggaaattcaccagtcgtctctgggttgtgtgtgagacagagctgcccgtgtcagtgccctggaggtgaagggaagagcctgtgcctgctgcgtgggagactggtccagggacagggaatcaggagtggttgcaaaggtgtcaggaaataaaatgtactgacaagtggctgaagatgcttggagactggccaaaatataagaacagcaagaagctgggcacggtggcgggcacctgtaatcccagctactcaggaggctgaggcacgagaattgcttgaacccaggcagtggaggttgcagtgagccaagatcgcaccactgaactccagcctgggcgacaagagggagacttcatctc

SEQ ID NO: 33206 - DNA, 926 bp, Homo sapiens
cagctcagcctcagtccccgcagcttgtgcggcggcgtcggcaccatgaggcgagggccccggagcctgcggggcagggacgcgccagcccccacgccctgcgtcccggccgagtgcttcgacctgctggtccgccactgcgtggcctgcgggctcctgcgcacgccgcggccgaaaccggccggggccagcagccctgcgcccaggacggcgctgcagccgcaggagtcggtgggcgcgggggccggcgaggcggcgctgcccctgcccgggctgctctttggcgcccccgcgctgctgggcctggcactggtcctggcgctggtcctggtgggtctggtgagctggaggcggcgacagcggcggcttcgcggcgcgtcctccgcagaggcccccgacggagacaaggacgccccagagcccctggacaaggtcatcattctgtctccgggaatctctgatgccacagctcctgcctggcctcctcctggggaagacccaggaaccaccccacctggccacagtgtccctgtgccagccacagagctgggctccactgaactggtgaccaccaagacggccggccctgagcaacaatagcagggagccggcaggaggtggcccctgccctccctctggacccccagccaggggcttggaaatcaaattcagctcttcactccagcatgcacatgccctctttctgggaccaggctaactctgcagaagcacagacactacagaccacagcattcagcccccatggagtttggtgtgcttgcctttggcttcagacctcaccatctttgacagcccttgaaggtggtagcccagctcctgttcctgtgccttcaaaaggctggggcactatgagtaaaagaccgcttttaaaatggggaaggcaccattaagccaaaatgaatctg

SEQ ID NO: 33207 - DNA, 1707 bp, Homo sapiens
ccttcataccggcccttcccctcggctttgcctggacagctcctgcctcccgcagggcccacctgtgtcccccagcgccgctccacccagcaggcctgagcccctctctgctgccagacaccccctgctgcccactctcctgctgctcgggttctgaggcacagcttgtcacaccgaggcggattctctttctctttctctttctcttctggcccacagccgcagcaatggcgctgagttcctctgctggagttcatcctgctagctgggttcccgagctgccggtctgagcctgaggcatggagcctcctggagactgggggcctcctccctggagatccacccccaaaaccgacgtcttgaggctggtgctgtatctcaccttcctgggagccccctgctacgccccagctctgccgtcctgcaaggaggacgagtacccagtgggctccgagtgctgccccaagtgcagtccaggttatcgtgtgaaggaggcctgcggggagctgacgggcacagtgtgtgaaccctgccctccaggcacctacattgcccacctcaatggcctaagcaagtgtctgcagtgccaaatgtgtgacccagccatgggcctgcgcgcgagccggaactgctccaggacagagaacgccgtgtgtggctgcagcccaggccacttctgcatcgtccaggacggggaccactgcgccgcgtgccgcgcttacgccacctccagcccgggccagagggtgcagaagggaggcaccgagagtcaggacaccctgtgtcagaactgccccccggggaccttctctcccaatgggaccctggaggaatgtcagcaccagaccaagtgcagctggctggtgacgaaggccggagctgggaccagcagctcccactgggtatggtggtttctctcagggagcctcgtcatcgtcattgtttgctccacagttggcctaatcatatgtgtgaaaagaagaaagccaaggggtgatgtagtcaaggtgatcgtctccgtccagcggaaaagacaggaggcagaaggtgaggccacagtcattgaggccctgcaggcccctccggacgtcaccacggtggccgtggaggagacaataccctcattcacggggaggagcccaaaccactgacccacagactctgcaccccgacgccagagatacctggagcgacggctgctgaaagaggctgtccacctggcggaaccaccggagcccggaggcttgggggctccgccctgggctggcttccgtctcctccagtggagggagaggtggggcccctgctggggtagagctggggacgccacgtgccattcccatgggccagtgagggcctggggcctctgttctgctgtggcctgagctccccagagtcctgaggaggagcgccagttgcccctcgctcacagaccacacacccagccctcctgggccagcccagagggcccttcagaccccagctgtctgcgcgtctgactcttgtggcctcagcaggacaggccccgggcactgcctcacagccaaggctggactgggttggctgcagtgtggtgtttagtggataccacatcggaagtgattttctaaattggatttgaattcggctcctgttttctatttgtcatgaaacagtgtatttggggagatgctgtgggaggatgtaaatatcttgtttctcctcaaa

SEQ ID NO: 33208 - DNA, 1027 bp, Homo sapiens
tccttcataccggcccttcccctcggctttgcctggacagctcctgcctcccgcagggcccacctgtgtcccccagcgccgctccacccagcaggcctgagcccctctctgctgccagacaccccctgctgcccactctcctgctgctcgggttctgaggcacagcttgtcacaccgaggcggattctctttctctttctctttctcttctggcccacagccgcagcaatggcgctgagttcctctgctggagttcatcctgctagctgggttcccgagctgccggtctgagcctgaggcatggagcctcctggagactgggggcctcctccctggagatccacccccaaaaccgacgtcttgaggctggtgctgtatctcaccttcctgggagccccctgctacgccccagctctgccgtcctgcaaggaggacgagtacccagtgggctccgagtgctgccccaagtgcagtccaggttatcgtgtgaaggaggcctgcggggagctgacgggcacagtgtgtgaaccctgccctccaggcacctacattgcccacctcaatggcctaagcaagtgtctgcagtgccaaatgtgtgacccagatattggttccccctgtgacctcaggggaagaggtcacctggaggctggtgcccacctgagtccaggcagacagaaaggggaaccagacccagaggtggcctttgagtcactgagcgcagagcctcatgccaggctcagcatggccagtgctccctgcggccaggcaggactgcacctgcgggacagggctgacggcacacctgggggcagggcctgagcctacagggaggcacagggcaggtgggctagccatgaacagaagaggaagctggagtgctttgggggttcatgcatgtaggctgggatttggggctcacacctcaacctgcatgcccagttccatgcccctcccctcttgtgaaagcacctgtctacttgggctgaggatgtgggggcacaggtggcaggtgaggctgccctca

SEQ ID NO: 33209 - DNA, 660 bp, Homo sapiens
ctgggacctgctctgggcaagcacaggcgccgcagcaatggcgctgagttcctctgctggagttcatcctgctagctgggttcccgagctgccggtctgagcctgaggcatggagcctcctggagactgggggcctcctccctggagatccacccccaaaaccgacgtcttgaggctggtgctgtatctcaccttcctgggagccccctgctacgccccagctctgccgtcctgcaaggaggacgagtacccagtgggctccgagtgctgccccaagtgcagtccaggttatcgtgtgaaggaggcctgcggggagctgacgggcacagtgtgtgaaccctgccctccaggcacctacattgcccacctcaatggcctaagcaagtgtctgcagtgccaaatgtgtgacccagccatgggcctgcgcgcgagccggaactgctccaggacagagaacgccgtgtgtggctgcagcccaggccacttctgcatcgtccaggacggggaccactgcgccgcgtgccgcgcttacgccacctccagcccgggccagagggtgcagaagggaggcaccgagagtcaggacaccctgtgtcagaactgccccccggggaccttctctcccaatgggaccctggaggaatgtcagcaccagaccaa

SEQ ID NO: 33210 - DNA, 834 bp, Homo sapiens
cgagggactcactggtgcctgccttggggctccgggactgtgggctgtctccatccggagccgcagcaatggcgctgagttcctctgctggagttcatcctgctagctgggttcccgagctgccggtctgagcctgaggcatggagcctcctggagactgggggcctcctccctggagatccacccccaaaaccgacgtcttgaggctggtgctgtatctcaccttcctgggagccccctgctacgccccagctctgccgtcctgcaaggaggacgagtacccagtgggctccgagtgctgccccaagtgcagtccaggttatcgtgtgaaggaggcctgcggggagctgacgggcacagtgtgtgaaccctgccctccaggcacctacattgcccacctcaatggcctaagcaagtgtctgcagtgccaaatgtgtgacccagccatgggcctgcgcgcgagccggaactgctccaggacagagaacgccgtgtgtggctgcagcccaggccacttctgcatcgtccaggacggggaccactgcgccgcgtgccgcgcttacgccacctccagcccgggccagagggtgcagaagggaggcaccgagagtcaggacaccctgtgtcagaactgccccccggggaccttctctcccaatgggaccctggaggaatgtcagcaccagaccaagtgcagctggctggtgacgaaggccggagctgggaccagcagctcccactgggtatggtggtttctctcagggagcctcgtcatcgtcattgtttgctccacagttggcctaatcatatgtgtgaaaagaagaaagccaaggg

SEQ ID NO: 33211 - DNA, 1225 bp, Homo sapiens
ctggtgcctgccttggggctccgggactgtgggctgtctccatccggaggtctccctaccaccaggctctgtggggcagggaagcccagtggggtgcagggagccaggaagctggggtggggtcagggcagggtccacagggagaccgggcgaggctggcagccttcccagtccgcgcagcgtctctgcagggggagcaagagctgcccttccacccctcccaggggacgggtaggggcactctgggcttttcccaccccctcacgcagggacacaggcctggtgggtctatgactgaaattggccagaccgcattctggtggttttattcggaagggaagtttaccctgttcagcagaagctgagatgggaacaggaaacccacagggcccctttattcggcaaaaatgtcagtcagcgccccggggagcagccgagggtccctgagtgtccgcagcaatggcgctgagttcctctgctggagttcatcctgctagctgggttcccgagctgccggtctgagcctgaggcatggagcctcctggagactgggggcctcctccctggagatccacccccaaaaccgacgtcttgaggctggtgctgtatctcaccttcctgggagccccctgctacgccccagctctgccgtcctgcaaggaggacgagtacccagtgggctccgagtgctgccccaagtgcagtccaggttatcgtgtgaaggaggcctgcggggagctgacgggcacagtgtgtgaaccctgccctccaggcacctacattgcccacctcaatggcctaagcaagtgtctgcagtgccaaatgtgtgacccagccatgggcctgcgcgcgagccggaactgctccaggacagagaacgccgtgtgtggctgcagcccaggccacttctgcatcgtccaggacggggaccactgcgccgcgtgccgcgcttacgccacctccagcccgggccagagggtgcagaagggaggcaccgagagtcaggacaccctgtgtcagaactgccccccggggaccttctctcccaatgggaccctggaggaatgtcagcaccagaccaagtgcagctggctggtgacgaaggccggagctgggaccagcagctcccactgggtatggtggtttctctcagggagcctcgtcatcgtcattgtttgctccacagttggcctaatcatatgtgtgaaaagaagaaagccaaggg

SEQ ID NO: 33212 - DNA, 827 bp, Homo sapiens
agcgtctctgcagggggagcaagagctgcccttccacccctcccaggggacggccgcagcaatggcgctgagttcctctgctggagttcatcctgctagctgggttcccgagctgccggtctgagcctgaggcatggagcctcctggagactgggggcctcctccctggagatccacccccaaaaccgacgtcttgaggctggtgctgtatctcaccttcctgggagccccctgctacgccccagctctgccgtcctgcaaggaggacgagtacccagtgggctccgagtgctgccccaagtgcagtccaggttatcgtgtgaaggaggcctgcggggagctgacgggcacagtgtgtgaaccctgccctccaggcacctacattgcccacctcaatggcctaagcaagtgtctgcagtgccaaatgtgtgacccagccatgggcctgcgcgcgagccggaactgctccaggacagagaacgccgtgtgtggctgcagcccaggccacttctgcatcgtccaggacggggaccactgcgccgcgtgccgcgcttacgccacctccagcccgggccagagggtgcagaagggaggcaccgagagtcaggacaccctgtgtcagaactgccccccggggaccttctctcccaatgggaccctggaggaatgtcagcaccagaccaagtgcagctggctggtgacgaaggccggagctgggaccagcagctcccactgggtatggtggtttctctcagggagcctcgtcatcgtcattgtttgctccacagttggcctaatcatatgtgtgaaaagaagaaagccaaggg

SEQ ID NO: 33213 - DNA, 994 bp, Homo sapiens
aagactcaaacttagaaacttgaattagatgtggtattcaaatccttagctgccgcgaagacacagacagcccccgtaagaacccacgaagcaggcgaagttcattgttctcaacattctagctgctcttgctgcatttgctctggaattcttgtagagatattacttgtccttccaggctgttctttctgtagctcccttgttttctttttgtgatcatgttgcagatggctgggcagtgctcccaaaatgaatattttgacagtttgttgcatgcttgcataccttgtcaacttcgatgttcttctaatactcctcctctaacatgtcagcgttattgtaatgcaagtgtgaccaattcagtgaaaggaacgaatgcgattctctggacctgtttgggactgagcttaataatttctttggcagttttcgtgctaatgtttttgctaaggaagataaactctgaaccattaaaggacgagtttaaaaacacaggatcaggtctcctgggcatggctaacattgacctggaaaagagcaggactggtgatgaaattattcttccgagaggcctcgagtacacggtggaagaatgcacctgtgaagactgcatcaagagcaaaccgaaggtcgactctgaccattgctttccactcccagctatggaggaaggcgcaaccattcttgtcaccacgaaaacgaatgactattgcaagagcctgccagctgctttgagtgctacggagatagagaaatcaatttctgctaggtaattaaccatttcgactcgagcagtgccactttaaaaatcttttgtcagaatagatgatgtgtcagatctctttaggatgactgtatttttcagttgccgatacagctttttgtcctctaactgtggaaactctttatgttagatatatttctctaggttactgttgggagcttaatggtagaaacttccttggtttcatgattaaactcttttttttcctga

SEQ ID NO: 33214 - DNA, 621 bp, Homo sapiens
ttctagctgctcttgctgcatttgctctggaattcttgtagagatattacttgtccttccaggctgttctttctgtagctcccttgttttctttttgtgatcatgttgcagatggctgggcagtgctcccaaaatgaatattttgacagtttgttgcatgcttgcataccttgtcaacttcgatgttcttctaatactcctcctctaacatgtcagcgttattgtaatgcaagatcaggtctcctgggcatggctaacattgacctggaaaagagcaggactggtgatgaaattattcttccgagaggcctcgagtacacggtggaagaatgcacctgtgaagactgcatcaagagcaaaccgaaggtcgactctgaccattgctttccactcccagctatggaggaaggcgcaaccattcttgtcaccacgaaaacgaatgactattgcaagagcctgccagctgctttgagtgctacggagatagagaaatcaatttctgctaggtaattaaccatttcgactcgagcagtgccactttaaaaatcttttgtcagaatagatgatgtgtcagatctctttaggatgactgtatttttcagttgccgatacagctttttg

SEQ ID NO: 33215 - DNA, 1118 bp, Homo sapiens
aagactcaaacttagaaacttgaattagatgtggtattcaaatccttagctgccgcgaagacacagacagcccccgtaagaacccacgaagcaggcgaagttcattgttctcaacattctagctgctcttgctgcatttgctctggaattcttgtagagatattacttgtccttccaggctgttctttctgtagctcccttgttttctttttgtgatcatgttgcagatggctgggcagtgctcccaaaatgaatattttgacagtttgttgcatgcttgcataccttgtcaacttcgatgttcttctaatactcctcctctaacatgtcagcgttattgtaatgcaagtgtgaccaattcagtgaaaggaacgaatgcgattctctggacctgtttgggactgagcttaataatttctttggcagttttcgtgctaatgtttttgctaaggaagataaactctgaaccattaaaggacgagtttaaaaacacagagatggagtctcgctctgtggcccaggctggagtgcagtggcgtgatctcaactcactgcagcctctgcctcttgggttcaaacaattctcccatctcagcctcctgagtaactgggactataggatcaggtctcctgggcatggctaacattgacctggaaaagagcaggactggtgatgaaattattcttccgagaggcctcgagtacacggtggaagaatgcacctgtgaagactgcatcaagagcaaaccgaaggtcgactctgaccattgctttccactcccagctatggaggaaggcgcaaccattcttgtcaccacgaaaacgaatgactattgcaagagcctgccagctgctttgagtgctacggagatagagaaatcaatttctgctaggtaattaaccatttcgactcgagcagtgccactttaaaaatcttttgtcagaatagatgatgtgtcagatctctttaggatgactgtatttttcagttgccgatacagctttttgtcctctaactgtggaaactctttatgttagatatatttctctaggttactgttgggagcttaatggtagaaacttccttggtttcatgattaaactcttttttttcctga

SEQ ID NO: 33216 - DNA, 851 bp, Homo sapiens
atggcacagcacggggcgatgggcgcgtttcgggccctgtgcggcctggcgctgctgtgcgcgctcagcctgggtcagcgccccaccgggggtcccgggtgcggccctgggcgcctcctgcttgggacgggaacggacgcgcgctgctgccgggttcacacgacgcgctgctgccgcgattacccgggcgaggagtgctgttccgagtgggactgcatgtgtgtccagcctgaattccactgcggagacccttgctgcacgacctgccggcaccacccttgtcccccaggccagggggtacagtcccaggggaaattcagttttggcttccagtgtatcgactgtgcctcggggaccttctccgggggccacgaaggccactgcaaaccttggacagactgctgctggaggtgccgccgtcgaccgaagacgccagaagctgccagttccccgaggaagagcggggcgagcgatcggcagaggagaaggggcggctgggagacctgtgggtgtgagcctggccgtcctccggggccaccgaccgcagccagcccctccccaggagctccccaggccgcaggggctctgcgttctgctctgggccgggccctgctcccctggcagcagaagtgggtgcaggaaggtggcagtgaccagcgccctggaccatgcagttcggcggccgcggctgggccctgcaggagggagagagagacacagtcatggcccccttcctcccttgctggccctgatggggtggggtcttaggacgggaggctgtgtccgtgggtgtgcagtgcccagcacgggacccggctgcaggggaccttcaataaacacttgtccagtga

SEQ ID NO: 33217 - DNA, 705 bp, Homo sapiens
atggcacagcacggggcgatgggcgcgtttcgggccctgtgcggcctggcgctgctgtgcgcgctcagcctgggtcagcgccccaccgggggtcccgggtgcggccctgggcgcctcctgcttgggacgggaacggacgcgcgctgctgccgggttcacacgacgcgctgctgccgcgattacccgggcgaggagtgctgttccgagtgggactgcatgtgtgtccagcctgaattccactgcggagacccttgctgcacgacctgccggcaccacccttgtcccccaggccagggggtacagtcccaggggaaattcagttttggcttccagtgtatcgactgtgcctcggggaccttctccgggggccacgaaggccactgcaaaccttggacagactgcacccagttcgggtttctcactgtgttccctgggaacaagacccacaacgctgtgtgcgtcccagggtccccgccggcagagccgcttgggtggctgaccgtcgtcctcctggccgtggccgcctgcgtcctcctcctgacctcggcccagcttggactgcacatctggcagctgaggaagacccagctgctgctggaggtgccgccgtcgaccgaagacgccagaagctgccagttccccgaggaagagcggggcgagcgatcggcagaggagaaggggcggctgggagacctgtgggtgtga

SEQ ID NO: 33218 - DNA, 1179 bp, Homo sapiens
cacgcacttcacctgggtcgggattctcaggtcatgaacggtcccagccacctccgggcagggcgggtgaggacggggacggggcgtgtccaactggctgtgggctcttgaaacccgagcatggcacagcacggggcgatgggcgcgtttcgggccctgtgcggcctggcgctgctgtgcgcgctcagcctgggtcagcgccccaccgggggtcccgggtgcggccctgggcgcctcctgcttgggacgggaacggacgcgcgctgctgccgggttcacacgacgcgctgctgccgcgattacccgggcgaggagtgctgttccgagtgggactgcatgtgtgtccagcctgaattccactgcggagacccttgctgcacgacctgccggcaccacccttgtcccccaggccagggggtacagtcccaggggaaattcagttttggcttccagtgtatcgactgtgcctcggggaccttctccgggggccacgaaggccactgcaaaccttggacagactgcacccagttcgggtttctcactgtgttccctgggaacaagacccacaacgctgtgtgcgtcccagggtccccgccggcagagccgcttgggtggctgaccgtcgtcctcctggccgtggccgcctgcgtcctcctcctgacctcggcccagcttggactgcacatctggcagctgaggagtcagtgcatgtggccccgagagacccagctgctgctggaggtgccgccgtcgaccgaagacgccagaagctgccagttccccgaggaagagcggggcgagcgatcggcagaggagaaggggcggctgggagacctgtgggtgtgagcctggccgtcctccggggccaccgaccgcagccagcccctccccaggagctccccaggccgcaggggctctgcgttctgctctgggccgggccctgctcccctggcagcagaagtgggtgcaggaaggtggcagtgaccagcgccctggaccatgcagttcggcggccgcggctgggccctgcaggagggagagagagacacagtcatggcccccttcctcccttgctggccctgatggggtggggtcttaggacgggaggctgtgtccgtgggtgtgcagtgcccagcacgggacccggctgcaggggaccttcaataaacacttgtccag

SEQ ID NO: 33219 - DNA, 1068 bp, Homo sapiens
cgaggatgtgcgtgggggctcggcggctgggccgcgggccgtgtgcggctctgctcctcctgggcctggggctgagcaccgtgacggggctccactgtgtcggggacacctaccccagcaacgaccggtgctgccacgagtgcaggccaggcaacgggatggtgagccgctgcagccgctcccagaacacggtgtgccgtccgtgcgggccgggcttctacaacgacgtggtcagctccaagccgtgcaagccctgcacgtggtgtaacctcagaagtgggagtgagcggaagcagctgtgcacggccacacaggacacagtctgccgctgccgggcgggcacccagcccctggacagctacaagcctggagttgactgtgccccctgccctccagggcacttctccccaggcgacaaccaggcctgcaagccctggaccaactgcaccttggctgggaagcacaccctgcagccggccagcaatagctcggacgcaatctgtgaggacagggaccccccagccacgcagccccaggagacccagggccccccggccaggcccatcactgtccagcccactgaagcctggcccagaacctcacagggaccctccacccggcccgtggaggtccccgggggccgtgcggttgccgccatcctgggcctgggcctggtgctggggctgctgggccccctggccatcctgctggccctgtacctgctccggagggaccagaggctgccccccgatgcccacaagccccctgggggaggcagtttccggacccccatccaagaggagcaggccgacgcccactccaccctggccaagatctgacctgggcccaccaaggtggacgctgggccccgccaggctggagcccggagggtctgctgggcgagcagggcaggtgcaggccgcctgccccgccacgctcctgggccaactctgcaccgttctaggtgccgatggctgcctccggctctctgcttacgtatgccatgcatacctcctgccccgcgggaccacaataaaaaccttggcagacgggagtctccgaccggca

SEQ ID NO: 33220 - DNA, 393 bp, Homo sapiens
cccaggggcaccccctctccctccgggggcccagactcggcccaggccacgtggagtcggggagaccacgctggccatgtggcctggccttgctggcctgagcagaagtgggagtgagcggaagcagctgtgcacggccacacaggacacagtctgccgctgccgggcgggcacccagcccctggacagctacaagcctggagttgactgtgccccctgccctccagggcacttctccccaggcgacaaccaggcctgcaagccctggaccaactgcaccttggctgggaagcacaccctgcagccggccagcaatagctcggacgcaatctgtgaggacagggaccccccagccacgcagccccaggagacccagggccccccggccaggcc

SEQ ID NO: 33221 - DNA, 420 bp, Homo sapiens
atgagggcgctggaggggccaggcctgtcgctgctgtgcctggtgttggcgctgcctgccctgctgccggtgccggctgtacgcggagtggcagaaacacccacctacccctggcgggacgcagagacaggggagcggctggtgtgcgcccagtgccccccaggcacctttgtgcagcggccgtgccgccgagacagccccacgacgtgtggcccgtgtccaccgcgccactacacgcagttctggaactacctagagcgctgccgctactgcaacgtcctctgcggggagcgtgaggaggaggcacgggcttgccacgccacccacaaccgtgcctgctgcggctgctgcaggcgctgcgcgtggccaggatgcccgggctggagcggagcgtccgtgagcgcttcctccctgtgcact

SEQ ID NO: 33222 - DNA, 1124 bp, Homo sapiens
tccgcaggcggaccgggggcaaaggaggtggcatgtcggtcaggcacagcagggtcctgtgtccgcgctgagccgcgctctccctgctccagcaaggaccatgagggcgctggaggggccaggcctgtcgctgctgtgcctggtgttggcgctgcctgccctgctgccggtgccggctgtacgcggagtggcagaaacacccacctacccctggcgggacgcagagacaggggagcggctggtgtgcgcccagtgccccccaggcacctttgtgcagcggccgtgccgccgagacagccccacgacgtgtggcccgtgtccaccgcgccactacacgcagttctggaactacctagagcgctgccgctactgcaacgtcctctgcggggagcgtgaggaggaggcacgggcttgccacgccacccacaaccgtgcctgccgctgccgcaccggcttcttcgcgcacgctggtttctgcttggagcacgcatcgtgtccacctggtgccggcgtgattgccccgggcacccccagccagaacacgcagtgccagccgtgccccccaggcaccttctcagccagcagctccagctcagagcagtgccagccccaccgcaactgcacggccctgggcctggccctcaatgtgccaggctcttcctcccatgacaccctgtgcaccagctgcactggcttccccctcagcaccagggtaccaggagctgaggagtgtgagcgtgccgtcatcgactttgtggctttccaggacatctccatcaagaggctgcagcggctgctgcaggccctcgaggccccggagggctggggtccgacaccaagggcgggccgcgcggccttgcagctgaagctgcgtcggcggctcacggagctcctgggggcgcaggacggggcgctgctggtgcggctgctgcaggcgctgcgcgtggccaggatgcccgggctggagcggagcgtccgtgagcgcttcctccctgtgcactgatcctggccccctcttatttattctacatccttggcaccccacttgcactgaaagaggcttttttttaaatagaagaaatgaggtttcttaaagcttatttttataaagctttttcataaaa

SEQ ID NO: 33223 - DNA, 4945 bp, Homo sapiens
atgcccaagatagtcctgaatggtgtgaccgtagacttccctttccagccctacaaatgccaacaggagtacatgaccaaggtcctggaatgtctgcagcagaaggtgaatggcatcctggagagccctacgggtacagggaagacgctgtgcctgctgtgcaccacgctggcctggcgagaacacctccgagacggcatctctgcccgcaagattgccgagagggcgcaaggagagcttttcccggatcgggccttgtcatcctggggcaacgctgctgctgctgctggagaccccatagcttgctacacggacatcccaaagattatttacgcctccaggacccactcgcaactcacacaggtcatcaacgagcttcggaacacctcctaccggcctaaggtgtgtgtgctgggctcccgggagcagctgtgcatccatcctgaggtgaagaaacaagagagtaaccatctacagatccacttgtgccgtaagaaggtggcaagtcgctcctgtcatttctacaacaacgtagaagaaaaaagcctggagcaggagctggccagccccatcctggacattgaggacttggtcaagagcggaagcaagcacagggtgtgcccttactacctgtcccggaacctgaagcagcaagccgacatcatattcatgccgtacaattacttgttggatgccaagagccgcagagcacacaacattgacctgaaggggacagtcgtgatctttgacgaagctcacaacgtggagaagatgtgtgaagaatcggcatcctttgacctgactccccatgacctggcttcaggactggacgtcatagaccaggtgctggaggagcagaccaaggcagcgcagcagggtgagccccacccggagttcagcgcggactcccccagcccagggctgaacatggagctggaagacattgcaaagctgaagatgatcctgctgcgcctggagggggccatcgatgctgttgagctgcctggagacgacagcggtgtcaccaagccagggagctacatctttgagctgtttgctgaagcccagatcacgtttcagaccaagggctgcatcctggactcgctggaccagatcatccagcacctggcaggacgtgctggagtgttcaccaacacggccggactgcagaagctggcggacattatccagattgtgttcagtgtggacccctccgagggcagccctggttccccagcagggctgggggccttacagtcctataaggtgcacatccatcctgatgctggtcaccggaggacggctcagcggtctgatgcctggagcaccactgcagccagaaagcgagggaaggtgctgagctactggtgcttcagtcccggccacagcatgcacgagctggtccgccagggcgtccgctccctcatccttaccagcggcacgctggccccggtgtcctcctttgctctggagatgcagatccctttcccagtctgcctggagaacccacacatcatcgacaagcaccagatctgggtgggggtcgtccccagaggccccgatggagcccagttgagctccgcgtttgacagacggttttccgaggagtgcttatcctccctggggaaggctctgggcaacatcgcccgcgtggtgccctatgggctcctgatcttcttcccttcctatcctgtcatggagaagagcctggagttctggcgggcccgcgacttggccaggaagatggaggcgctgaagccgctgtttgtggagcccaggagcaaaggcagcttctccgagaccatcagtgcttactatgcaagggttgccgcccctgggtccaccggcgccaccttcctggcggtctgccggggcaaggccagcgaggggctggacttctcagacacgaatggccgtggtgtgattgtcacgggcctcccgtaccccccacgcatggacccccgggttgtcctcaagatgcagttcctggatgagatgaagggccagggtggggctgggggccagttcctctctgggcaggagtggtaccggcagcaggcgtccagggctgtgaaccaggccatcgggcgagtgatccggcaccgccaggactacggagctgtcttcctctgtgaccacaggttcgcctttgccgacgcaagagcccaactgccctcctgggtgcgtccccacgtcagggtgtatgacaactttggccatgtcatccgagacgtggcccagttcttccgtgttgccgagcgaactatgccagcgccggccccccgggctacagcacccagtgtgcgtggagaagatgctgtcagcgaggccaagtcgcctggccccttcttctccaccaggaaagctaagagtctggacctgcatgtccccagcctgaagcagaggtcctcagggtcaccagctgccggggaccccgagagtagcctgtgtgtggagtatgagcaggagccagttcctgcccggcagaggcccagggggctgctggccgccctggagcacagcgaacagcgggcggggagccctggcgaggagcaggcccacagctgctccaccctgtccctcctgtctgagaagaggccggcagaagaaccgcgaggagggaggaagaagatccggctggtcagccacccggaggagcccgtggctggtgcacagacggacagggccaagctcttcatggtggccgtgaagcaggagttgagccaagccaactttgccaccttcacccaggccctgcaggactacaagggttccgatgacttcgccgccctggccgcctgtctcggccccctctttgctgaggaccccaagaagcacaacctgctccaaggcttctaccagtttgtgcggccccaccataagcagcagtttgaggaggtctgtatccagctgacaggacgaggctgtggctatcggcctgagcacagcattccccgaaggcagcgggcacagccggtcctggaccccactggaagaacggcgccggatcccaagctgaccgtgtccacggctgcagcccagcagctggacccccaagagcacctgaaccagggcaggccccacctgtcgcccaggccacccccaacaggagaccctggcagccaaccacagtgggggtctggagtgcccagagcagggaagcagggccagcacgccgtgagcgcctacctggctgatgcccgcagggccctggggtccgcgggctgtagccaactcttggcagcgctgacagcctataagcaagacgacgacctcgacaaggtgctggctgtgttggccgccctgaccactgcaaagccagaggacttccccctgctgcacaggttcagcatgtttgtgcgtccacaccacaagcagcgcttctcacagacgtgcacagacctgaccggccggccctacccgggcatggagccaccgggaccccaggaggagaggcttgccgtgcctcctgtgcttacccacagggctccccaaccaggcccctcacggtccgagaagaccgggaagacccagagcaagatctcgtccttccttagacagaggccagcagggactgtgggggcgggcggtgaggatgcaggtcccagccagtcctcaggacctccccacgggcctgcagcatctgagtggggtgagcctcatgggagagacatcgctgggcagcaggccacgggagctccgggcgggcccctctcagcaggctgtgtgtgccagggctgtggggcagaggacgtggtgcccttccagtgccctgcctgtgacttccagcgctgccaagcctgctggcaacggcaccttcaggcctctaggatgtgcccagcctgccacaccgcctccaggaagcagagcgtcatgcaggtcttctggccagagccccacaaggaccatgagggcgctggaggggccaggcctgtcgctgctgtgcctggtgttggcgctgcctgccctgctgccggtgccggctgtacgcggagtggcagaaacacccacctacccctggcgggacgcagagacaggggagcggctggtgtgcgcccagtgccccccaggcacctttgtgcagcggccgtgccgccgagacagccccacgacgtgtggcccgtgtccaccgcgccactacacgcagttctggaactacctagagcgctgccgctactgcaacgtcctctgcggggagcgtgaggaggaggcacgggcttgccacgccacccacaaccgtgcctgccgctgccgcaccggcttcttcgcgcacgctggtttctgcttggagcacgcatcgtgtccacctggtgccggcgtgattgccccgggcacccccagccagaacacgcagtgccagccgtgccccccaggcaccttctcagccagcagctccagctcagagcagtgccagccccaccgcaactgcacggccctgggcctggccctcaatgtgccaggctcttcctcccatgacaccctgtgcaccagctgcactggcttccccctcagcaccagggtaccaggagctgaggagtgtgagcgtgccgtcatcgactttgtggctttccaggacatctccatcaagaggctgcagcggctgctgcaggccctcgaggccccggagggctggggtccgacaccaagggcgggccgcgcggccttgcagctgaagctgcgtcggcggctcacggagctcctgggggcgcaggacggggcgctgctggtgcggctgctgcaggcgctgcgcgtggccaggatgcccgggctggagcggagcgtccgtgagcgcttcctccctgtgcactgatcctggccccctcttatttattctacatccttggcaccccacttgcactgaaagaggcttttttttaaatagaagaaatgaggtttcttaaagcttatttttataaagctttttcataaaactggttgtagttgc

SEQ ID NO: 33224 - DNA, 3686 bp, Homo sapiens
atacgggagaactaaggctgaaacctcggaggaacaaccacttttgaagtgacttcgcggcgtgcgttgggtgcggactaggtggccgcggcgggagtgtgctggagcctgaagtccacgcgcgcggctgagaaccgccgggaccgcacgtgggcgccgcgcgcttcccccgcttcccaggtgggcgccggccgccaggccacctcacgtccggccccggggatgcgcgtcctcctcgccgcgctgggactgctgttcctgggggcgctacgagccttcccacaggatcgacccttcgaggacacctgtcatggaaaccccagccactactatgacaaggctgtcaggaggtgctgttaccgctgccccatggggctgttcccgacacagcagtgcccacagaggcctactgactgcaggaagcagtgtgagcctgactactacctggatgaggccgaccgctgtacagcctgcgtgacttgttctcgagacgacctcgtggagaagacgccgtgtgcatggaactcctcccgtgtctgcgaatgtcgacccggcatgttctgttccacgtctgccgtcaactcctgtgcccgctgcttcttccattctgtctgtccggcagggatgattgtcaagttcccaggcacggcgcagaagaacacggtctgtgagccggcttccccaggggtcagccctgcctgtgccagcccagagaactgcaaggaaccctccagtggcaccatcccccaggccaagcccaccccggtgtccccagcaacctccagtgccagcaccatgcctgtaagagggggcacccgcctcgcccaggaagctgcttctaaactgacgagggctcccgactctccctcctctgtgggaaggcctagttcagatccaggtctgtccccaacacagccatgcccagaggggtctggtgattgcagaaagcagtgtgagcccgactactacctggacgaggccggccgctgcacggcctgcgtgagctgttctcgagatgaccttgtggagaagacgccatgtgcatggaactcctcccgcacctgcgaatgtcgacctggcatgatctgtgccacatcagccaccaactcccgtgcccgctgtgtcccctacccaatctgtgcagcagagacggtcaccaagccccaggatatggctgagaaggacaccacctttgaggcgccacccctggggacccagccggactgcaaccccaccccagagaatggcgaggcgcctgccagcaccagccccactcagagcttgctggtggactcccaggccagtaagacgctgcccatcccaaccagcgctcccgtcgctctctcctccacggggaagcccgttctggatgcagggccagtgctcttctgggtgatcctggtgttggttgtggtggtcggctccagcgccttcctcctgtgccaccggagggcctgcaggaagcgaattcggcagaagctccacctgtgctacccggtccagacctcccagcccaagctagagcttgtggattccagacccaggaggagctcaacgcagctgaggagtggtgcgtcggtgacagaacccgtcgcggaagagcgagggttaatgagccagccactgatggagacctgccacagcgtgggggcagcctacctggagagcctgccgctgcaggatgccagcccggccgggggcccctcgtcccccagggaccttcctgagccccgggtgtccacggagcacaccaataacaagattgagaaaatctacatcatgaaggctgacaccgtgatcgtggggaccgtgaaggctgagctgccggagggccggggcctggcggggccagcagagcccgagttggaggaggagctggaggcggaccataccccccactaccccgagcaggagacagaaccgcctctgggcagctgcagcgatgtcatgctctcagtggaagaggaagggaaagaagaccccttgcccacagctgcctctggaaagtgaggcctgggctgggctggggctaggagggcagcagggtggcctctgggaggccaggatggcactgttggcaccgaggttgggggcagaggcccatctggcctgaactgaggctccagcatctagtggtggaccggccggtcactgcaggggtctggtggtctctgcttgcatccccaacttagctgtcccctgacccagagcctaggggatccggggcttgtacagaagagacagtccaaggggactggatcccagcagtgatgttggttgaggcagcaaacagatggcaggatgggcactgccgagaacagcattggtcccagagccctgggcatcagaccttaaccaccaggcccacagcccagcgagggagaggtcgtgaggccagctcccggggcccctgtaaccctactctcctctctccctggacctcagaggtgacacccattgggcccttccggcatgcccccagttactgtaaatgtggcccccagtgggcatggagccagtgcctgtggttgtttctccagagtcaaaagggaagtcgagggatggggcgtcgtcagctggcactgtctctgctgcagcggccacactgtactctgcactggtgtgagggcccctgcctggactgtgggaccctcctggtgctgcccaccttccctgtcctgtagccccctcggtgggcccagggcctagggcccaggatcaagtcactcatctcagaatgtccccaccaatccccgccacagcaggcgcctcgggtcccagatgtctgcagccctcagcagctgcagaccgcccctcaccaacccagagaacctgctttactttgcccagggacttcctccccatgtgaacatggggaacttcgggccctgcctggagtccttgaccgctctctgtgggccccacccactctgtcctgggaaatgaagaagcatcttccttaggtctgccctgcttgcaaatccactagcaccgaccccaccacctggttccggctctgcacgctttggggtgtggatgtcgagaggcaccacggcctcacccaggcatctgctttactctggaccataggaaacaagaccgtttggaggtttcatcaggattttgggtttttcacatttcacgctaaggagtagtggccctgacttccggtcggctggccagctgactccctagggccttcagacgtgtatgcaaatgagtgatggataaggatgagtcttggagttgcgggcagcctggagactcgtggacttaccgcctggaggcaggcccgggaaggctgctgtttactcatcgggcagccacgtgctctctggaggaagtgatagtttctgaaaccgctcagatgttttggggaaagttggagaagccgtggccttgcgagaggtggttacaccagaacctggacattggccagaagaagcttaagtgggcagacactgtttgcccagtgtttgtgcaaggatggagtgggtgtctctgcatcacccacagccgcagctgtaaggcacgctggaaggcacacgcctgccaggcagggcagtctggcgcccatgatgggagggattgacatgtttcaacaaaataatgcacttccttacctagtggcccttcacacaacttttgaatctctaaaaatccataaaatccttaaagaactgtaa

SEQ ID NO: 33225 - DNA, 2363 bp, Homo sapiens
gtcttgtgtggttgcagcaaggcaaagagtgtggggcgtctctgtgttccagggccagtgctcttctgggtgatcctggtgttggttgtggtggtcggctccagcgccttcctcctgtgccaccggagggcctgcaggaagcgaattcggcagaagctccacctgtgctacccggtccagacctcccagcccaagctagagcttgtggattccagacccaggaggagctcaacgcagctgaggagtggtgcgtcggtgacagaacccgtcgcggaagagcgagggttaatgagccagccactgatggagacctgccacagcgtgggggcagcctacctggagagcctgccgctgcaggatgccagcccggccgggggcccctcgtcccccagggaccttcctgagccccgggtgtccacggagcacaccaataacaagattgagaaaatctacatcatgaaggctgacaccgtgatcgtggggaccgtgaaggctgagctgccggagggccggggcctggcggggccagcagagcccgagttggaggaggagctggaggcggaccataccccccactaccccgagcaggagacagaaccgcctctgggcagctgcagcgatgtcatgctctcagtggaagaggaagggaaagaagaccccttgcccacagctgcctctggaaagtgaggcctgggctgggctggggctaggagggcagcagggtggcctctgggaggccaggatggcactgttggcaccgaggttgggggcagaggcccatctggcctgaactgaggctccagcatctagtggtggaccggccggtcactgcaggggtctggtggtctctgcttgcatccccaacttagctgtcccctgacccagagcctaggggatccggggcttgtacagaagagacagtccaaggggactggatcccagcagtgatgttggttgaggcagcaaacagatggcaggatgggcactgccgagaacagcattggtcccagagccctgggcatcagaccttaaccaccaggcccacagcccagcgagggagaggtcgtgaggccagctcccggggcccctgtaaccctactctcctctctccctggacctcagaggtgacacccattgggcccttccggcatgcccccagttactgtaaatgtggcccccagtgggcatggagccagtgcctgtggttgtttctccagagtcaaaagggaagtcgagggatggggcgtcgtcagctggcactgtctctgctgcagcggccacactgtactctgcactggtgtgagggcccctgcctggactgtgggaccctcctggtgctgcccaccttccctgtcctgtagccccctcggtgggcccagggcctagggcccaggatcaagtcactcatctcagaatgtccccaccaatccccgccacagcaggcgcctcgggtcccagatgtctgcagccctcagcagctgcagaccgcccctcaccaacccagagaacctgctttactttgcccagggacttcctccccatgtgaacatggggaacttcgggccctgcctggagtccttgaccgctctctgtgggccccacccactctgtcctgggaaatgaagaagcatcttccttaggtctgccctgcttgcaaatccactagcaccgaccccaccacctggttccggctctgcacgctttggggtgtggatgtcgagaggcaccacggcctcacccaggcatctgctttactctggaccataggaaacaagaccgtttggaggtttcatcaggattttgggtttttcacatttcacgctaaggagtagtggccctgacttccggtcggctggccagctgactccctagggccttcagacgtgtatgcaaatgagtgatggataaggatgagtcttggagttgcgggcagcctggagactcgtggacttaccgcctggaggcaggcccgggaaggctgctgtttactcatcgggcagccacgtgctctctggaggaagtgatagtttctgaaaccgctcagatgttttggggaaagttggagaagccgtggccttgcgagaggtggttacaccagaacctggacattggccagaagaagcttaagtgggcagacactgtttgcccagtgtttgtgcaaggatggagtgggtgtctctgcatcacccacagccgcagctgtaaggcacgctggaaggcacacgcctgccaggcagggcagtctggcgcccatgatgggagggattgacatgtttcaacaaaataatgcacttccttacctagtggcccttcacacaacttttgaatctctaaaaatccataaaatccttaaagaactgtaa

SEQ ID NO: 33226 - DNA, 2412 bp, Homo sapiens
ggagtgtgctggagcctgaagtccacgcgcgcggctgagaaccgccgggaccgcacgtgggcgccgcgcgcttcccccgcttcccaggtgggcgccggccgccaggccacctcacgtccggccccggggatgcgcgtcctcctcgccgcgctgggactgctgttcctgggggcgctacgagccttcccacagggctgttcccgacacagcagtgcccacagaggcctactgactgcaggaagcagtgtgagcctgactactacctggatgaggccgaccgctgtacagcctgcgtgacttgttctcgagacgacctcgtggagaagacgccgtgtgcatggaactcctcccgtgtctgcgaatgtcgacccggcatgttctgttccacgtctgccgtcaactcctgtgcccgctgcttcttccattctgtctgtccggcagggatgattgtcaagttcccaggcacggcgcagaagaacacggtctgtgagccggcttccccaggggtcagccctgcctgtgccagcccagagaactgcaaggaaccctccagtggcaccatcccccaggccaagcccaccccggtgtccccagcaacctccagtgccagcaccatgcctgtaagagggggcacccgcctcgcccaggaagctgcttctaaactgacgagggctcccgactctccctcctctgtgggaaggcctagttcagatccaggtctgtccccaacacagccatgcccagaggggtctggtgattgcagaaagcagtgtgagcccgactactacctggacgaggccggccgctgcacggcctgcgtgagctgttctcgagatgaccttgtggagaagacgccatgtgcatggaactcctcccgcacctgcgaatgtcgacctggcatgatctgtgccacatcagccaccaactcccgtgcccgctgtgtcccctacccaatctgtgcagcagagacggtcaccaagccccaggatatggctgagaaggacaccacctttgaggcgccacccctggggacccagccggactgcaaccccaccccagagaatggcgaggcgcctgccagcaccagccccactcagagcttgctggtggactcccaggccagtaagacgctgcccatcccaaccagcgctcccgtcgctctctcctccacggggaagcccgttctggatgcagggccagtgctcttctgggtgatcctggtgttggttgtggtggtcggctccagcgccttcctcctgtgccaccggagggcctgcaggaagcgaattcggcagaagctccacctgtgctacccggtccagacctcccagcccaagctagagcttgtggattccagacccaggaggagctcaacgctgaggagtggtgcgtcggtgacagaacccgtcgcggaagagcgagggttaatgagccagccactgatggagacctgccacagcgtgggggcagcctacctggagagcctgccgctgcaggatgccagcccggccgggggcccctcgtcccccagggaccttcctgagccccgggtgtccacggagcacaccaataacaagattgagaaaatctacatcatgaaggctgacaccgtgatcgtggggaccgtgaaggctgagctgccggagggccggggcctggcggggccagcagagcccgagttggaggaggagctggaggcggaccataccccccactaccccgagcaggagacagaaccgcctctgggcagctgcagcgatgtcatgctctcagtggaagaggaagggaaagaagaccccttgcccacagctgcctctggaaagtgaggcctgggctgggctggggctaggagggcagcagggtggcctctgggaggccaggatggcactgttggcaccgaggttgggggcagaggcccatctggcctgaactgaggctccagcatctagtggtggaccggccggtcactgcaggggtctggtggtctctgcttgcatccccaacttagctgtcccctgacccagagcctaggggatccggggcttgtacagaagagacagtccaaggggactggatcccagcagtgatgttggttgaggcagcaaacagatggcaggatgggcactgccgagaacagcattggtcccagagccctgggcatcagaccttaaccaccaggcccacagcccagcgagggagaggtcgtgaggccagctcccggggcccctgtaaccctactctcctctctccctggacctcagaggtgacacccattgggcccttccggcatgcccccagttactgtaaatgtggcccccagtgggcatggagccagtgcctgtggttgtttctccagagtcaaaagggaagtcgagggatggggcgtcgtcagctggcactgtctctgctgca

SEQ ID NO: 33227 - DNA, 3627 bp, Homo sapiens
agccggctgggctgggcagcactccgggcggagtcgacgagcgcaggatgtgagctcacagcttgggactgctgaggggcaggcggctgcaggctaggggcggctcggagtccgctggccacccagctgagaggagaggcgcccccggggacgcactgagattatgaggctctggcctccactggccactcactcgtgaccctttccaccacggcggagccttccaagcctacctcctgccgtgtggtgatctacctgcagcgggagatgtcgggggacacctgcctgtgcccagcctcaggggccaagcccaagctcagtggcttcaagggaggagggttgggcaacaagtatgtccagctcaacgtgggcggctctctgtactacaccactgtgcgggccctgacccgccacgacaccatgctcaaggccatgttcagtgggcgcatggaggtgctgaccgacaaagaaggctggatcctcatagaccgttgtggaaagcactttggcaccattttgaattacctccgagatgacaccatcaccctccctcagaaccggcaagaaatcaaggaattgatggctgaagcaaagtattacctcatccaggggctggtgaatatgtgccagagtgccctgcaggacaagaaggactcctaccagcctgtgtgcaacatccccatcatcacatccctaaaggaggaggagcggctcatcgaatcctccaccaagcccgtggtgaagctgctgtacaacagaagcaacaacaagtattcctacaccagcaactctgacgaccacctgctgaaaaacatcgagctgtttgacaagctctccctgcgcttcaacggccgcgtgctcttcatcaaggatgtcattggtgacgagatctgctgctggtccttttatggccagggccgtaagctggcagaggtgtgctgtacctccatcgtgtatgccacggagaagaagcagaccaaggtggaattcccagaggcccgaatctatgaggagacactcaacgtcctactctatgagactccccgcgtccccgacaactccttgttggaggccacaagccgtagccgcagccaggcttcccccagtgaagatgaggagacctttgaactgcgggaccgtgtccgccgcatccacgtcaagcgctacagcacttacgatgaccggcagctcggccaccagtctacccatcgcgactgaccagaccctcagggagtcagggcacgggaggccctatctcccatcctgtggaacccgccccattggccaccccatgctgctgctgcctgggtctctgctctagcacccagaggcatgacaggccctgctcagaggtcagagggtctgggcagaggagggaccacattcccctgccttgcccctgagcacttctggagactgcgtcctgtcctatctgctcaccatcacccttcctgcccgacggagctgcttctgctccctggggcatatggactgacccacctcctgctgagaaccttcccctaggccctgtgcagaaggctactgccccttaggcctcagctgggggaaaggcagttctggtgctgtagaggccctggtgcagaaagtgggacgtcttttttcctaaggtgtttaagcacaggcttgataagtttggtttttaaaaaataatctaggaaatgaataattctaaatctagtaatgaggaaactgagcatttcttttgccctccagggtgccaagaccctacatatgacagaacccttggcccttctccatgcctgtgggatctgtttctttaaagcactttgtactgttattcaggaggttgataatctccttgacccatgtctttctaccctaatccccacttccctgcagaatcaatctgagggaggggataaagaggaagcaataaaaaaaaaacatccgacagagcagctctggctttgcagcctggccagcagctcagagtgcaccgaggagggaaggatggctaagctgggaccggcagtcctcacagggtgcctgtgagaaaggacattttacccccacatcatagtcacatcactgactcctaggtctagcacgactgctctttgtgattctcttgagtacccttggcttccagccatgctgtcctcacatacggtaaagccaaagagctgtcacatgggccagaaacatgagccacggcaggaagaccgtggagcccgtgggcactgcatggtgttggctggcatgcccatcagctgaggacagcaaactcccagcagcccctacagaggtggcacatgcttggccacacatctactccctgcccacaccatctatgctcttggttggtgctggctgggatggcggttctgcccagtggtgtctctgagcgcgggatgacaggagcaaccgaagcaccctgaaggccttcactccttgttgggtaactcagccatggagatgccaagcactagccaggaggtgagttcctctttagggctttggttttcattcctttttgtttggcttggccaaaccagaattcagcttatctgaattattttccaaaggaatgctgtcagggagggactgttctgccagcctaacaaagcaacgtagccacgtatagtacccactttctgctctttggagagaacacaggttatcaagttcatctctcttgactactcttatgatagctgatgccacagagcctatgggcaaatgccagacccagggttagacacaaggacctgaagtgacatgacggcgggacaggggaaatgtgactttctaattaggcattttatgttagtcacagtcttgaatgtataaacagcactaagactctcaggtcaggtaccttggtgatcagctactagttcttccagccctcattgaggtaacaagataaagacaaatccacttctttggccaaattcaggctttggctttatgactttcccacagagactggaatgcgtcagcctgagaccactggcctattttctcagctgccctcttgaggtcctttaacactcaaattcccagctccccactgaggtgttgtgatgcttgccttttgacctccccatcccctttagtccctgcttactactttgacattcacatcctcagtgtctcagtcttttttgccgagaaagcacagtagtctgggactgggcatttatcttctctgactgaaaatctctccttggtcttaaggaaaatactaacattgaactcactgacatgatcttagcttctttaatcagactttgtgacttaaaagtttgggggttttctttgaaagtttccagccctattcagaaagcaactcttggctgtgtgcatttttcaactccaagcagcccaggggtaagtaaacaaagtatggatgaaggtcagattttcttgtcagtttctgagaaacctggcagcctgctgttaacaacacaggccagtattgggttttattgaatttggtatgtgaccaaggtcggcctaaaggatggcgcaggtcctgggcaggaaagaatttttcctttatcacataactgtaatatttggttgctcagcataagtgatggaagcaaacactaatttctaataaaattgtgttaaactcaa

SEQ ID NO: 33228 - DNA, 1497 bp, Homo sapiens
acagcttgggactgctgaggggcaggcggctgcaggctaggggcggctcggagtccgctggccacccagctgagaggagaggcgcccccggggacggctggatcctcatagaccgttgtggaaagcactttggcaccattttgaattacctccgagatgacaccatcaccctccctcagaaccggcaagaaatcaaggaattgatggctgaagcaaagtattacctcatccaggggctggtgaatatgtgccagagtgccctgcaggacaagaaggactcctaccagcctgtgtgcaacatccccatcatcacatccctaaaggaggaggagcggctcatcgaatcctccaccaagcccgtggtgaagctgctgtacaacagaagcaacaacaagtattcctacaccagcaactctgacgaccacctgctgaaaaacatcgagctgtttgacaagctctccctgcgcttcaacggccgcgtgctcttcatcaaggatgtcattggtgacgagatctgctgctggtccttttatggccagggccgtaagctggcagaggtgtgctgtacctccatcgtgtatgccacggagaagaagcagaccaaggtggaattcccagaggcccgaatctatgaggagacactcaacgtcctactctatgagactccccgcgtccccgacaactccttgttggaggccacaagccgtagccgcagccaggcttcccccagtgaagatgaggagacctttgaactgcgggaccgtgtccgccgcatccacgtcaagcgctacagcacttacgatgaccggcagctcggccaccagtctacccatcgcgactgaccagaccctcagggagtcagggcacgggaggccctatctcccatcctgtggaacccgccccattggccaccccatgctgctgctgcctgggtctctgctctagcacccagaggcatgacaggccctgctcagaggtcagagggtctgggcagaggagggaccacattcccctgccttgcccctgagcacttctggagactgcgtcctgtcctatctgctcaccatcacccttcctgcccgacggagctgcttctgctccctggggcatatggactgacccacctcctgctgagaaccttcccctaggccctgtgcagaaggctactgccccttaggcctcagctgggggaaaggcagttctggtgctgtagaggccctggtgcagaaagtgggacgtcttttttcctaaggtgtttaagcacaggcttgataagtttggtttttaaaaaataatctaggaaatgaataattctaaatctagtaatgaggaaactgagcatttcttttgccctccagggtgccaagaccctacatatgacagaacccttggcccttctccatgcctgtgggatctgtttctttaaagcactttgtactgttattcaggaggttgataatctccttgacccatgtctttctaccctaatccccactt

SEQ ID NO: 33229 - DNA, 4175 bp, Homo sapiens
ccagggtgatgctgaagatgatgaccttcttccaaggcctctagagccatcagcctgtgccaggcaccctcgacttgcctagaggcccccaaaagttgcagtccacatcagaggcagagtcagaggcctccatgtcggaggcctcctctgaggacctggtgccacccctggaggctggggcagccccatatagggaggaggaagaggcggcgaagaagaagaaggagaagaagaagaagtccaaaggcctggccaatgtgttctgcgtcttcaccaaagggaagaagaagaagggtcagcccagctcagcggagcccgaggacgcagccgggtccaggcaggggctggatggcccgccccccacagtggaggagctgaaggcggcgctggagcgcgggcagctggaggcggcgcggccgctgctggcgctggagcgggagctggcggcggcggcggcggcgggcggtgtgagcgaggaggagctggtgcggcgccagagcaaggtggaggcgctgtacgagctgctgcgcgaccaggtgctgggcgtgctgcggcggccgctggaggcgccgcccgagcggctgcgccaggcgctggccgtggtggcggagcaggagcgcgaggaccgccaggcggcggcggcggggccggggacctcggggctggcggccacgcgcccgcggcgctggctgcagctgtggcggcgcggcgtggcggaggcggccgaggagcgcatgggccagcggccggccgcgggcgccgaggtccccgagagcgtctttctgcacttgggccgcaccatgaaggaggacctggaggccgtggtggagcggctgaagccgctgttccccgccgagttcggcgtcgtggcggcctacgccgagagctaccaccagcacttcgcggcccacctggccgccgtggcgcagttcgagctgtgcgagcgcgacacctacatgctgctgctctgggtgcagaacctctaccccaatgacatcatcaacagccccaagctggtgggtgagctgcagggtatggggctcgggagcctcctgccccccaggcagatccgactgctggaggccacattcctgtccagtgaggcggccaatgtgagggagttgatggaccgagctctggagctagaggcacggcgctgggctgaggatgtgcctccccagaggctggacggccactgccacagcgagctggccatcgacatcatccagatcacctcccaggcccaggccaaggccgagagcatcacgctggacttgggctcacagataaagcgggtgctgctggtggagctgcctgcgttcctgaggagctaccagcgcgcctttaatgaatttctggagagaggcaagcagctgacgaattacagggccaatgttattgccaacatcaacaactgcctgtccttccggatgtccatggagcagaattggcaggtaccccaggacaccctgagcctcctgctgggccccctgggtgagctcaagagccacggctttgacaccctgctccagaacctgcatgaggacctgaagccactgttcaagaggttcacgcacacccgctgggcggcccctgtggagaccctggaaaacatcatcgccactgtagacacgaggctgcctgagttctcagagctgcagggctgtttccgggaggagctcatggaggccttgcacctgcacctggtgaaggagtacatcatccaactcagcaaggggcgcctggtcctcaagacggccgagcagcagcagcagctggctgggtacatcctggccaatgctgacaccatccagcacttctgcacccagcacggctccccggcgacctggctgcagcctgctctccctacgctggccgagatcattcgcctgcaggaccccagtgccatcaagattgaggtggccacttatgccacctgctaccctgacttcagcaaaggccacctgagcgctatcctggccatcaaggggaacctatccaacagtgaggtcaagcgcatccggagcatcttggacgtcagcatgggggcgcaggagccctcccggcccctattttcccttataaaggttggttagcttttcctgtggcctgacctgcctgtgagtgcccagcaagccttgggcacaccccgctgggagctgttaagagcagcgctggttctcggttcctcccgggtctcctgtgctctgatgctacttctgcctagccctggcggaggtgcaggccctgtcagctggaactggacagaccttggtttgtttacatgtccgatgggggcaggagctcccatcctgggcagccaaccaggcaacaccaaggactctttgtaaacgatagctgatcgtgtgcacgcaaggaaagaaccaggagggagagtgcagccaggctcagggatccccggacacctctgtccagagcccctccacagtcggcctcatgactgtcctcctcgtgggtggggccgagggccctcttcagctctctggagacaggggccgagcctcacccatctgccctctgcagcccagggccgccgtgagcgggattcagcaatggtggaatggaagacagaactggaagagaaagaaggaaaagatgagctctcgtctggcaggggcttttagggtcctgtggcgagctgtgagcaccgccagcattagacgtcacatccaggtggccccacggcccctacaggctggccctgcaatggggccctgagccctccctcttcatcccccaaggcctcaactagagggtggtcccccgagggcttggtgtctactaccgaagggcccaagacctcctgggtcctctcaggctcccccttccccaaggcagggacaggccctgggggtgccaccgtgggccctgccacccagaagtctggctgaggtctgggcaggggcagggcaagcttgacctctcactgttgaccctttggcctctgtatttgtttcctattgccgtgacaggtttccacaaacttcgtggatcaaaacgaggtcttccagttctgcgggtcagaaggctgacccggggctcaaatctgggtgtcggcagtcctgcactccttctggaggctctaggggagaattcatttctggccttttcatttttagaggctgaccgtaattcttgacttcaggctcctccatcttcagagccagctgtgggtagttgaatctttttcccgtcacctcattgaggcctcccctctcctgcctccctccaccacttttttttttttttttttgagacagggtcttgctgtgttgcccaggctggagtgcagtggcctggtcatggcatcaaggctcactgcagcctggacctcctggttcaagtgatcctcttgtctcagtcccctgagacaatcccccacgcccagctacatattttttgtggatacagggtctcattctgttgcctaggcttgtctggaactcctgggctcaagggatcttgtagccttagcctcctaaagtgctgggattataggcatgagtcactgtacccggcctgctctaccgcttttaaggacgcttatgatcacattgcgcctacccagagaacccaggtcgtctttctattttcaggtcagctgattagccaccttagttccatctgcaactttagttcccactggctgtgtaacctaacatagtcacaggctctggggactgtcacgtggacatctttgggaggccgttattctgcccaccgcaccctccgttcatcccctgccctgccgggcacctcgctctaccccaggaaaatgtgagctcgttttcctgctcggcatgtgctccccctaaggctctgctcctccctgggcctgaaagttccttctcagcctgagagggggcccttcggactcaggcatgactcagcccggctgatgcctctgcagtgctgagtcaggatttggggccggctctcttgggtccgtccccttttcccaggtactgccttacaaagctgtggccaggaagtggccggtataaaggatgcccaaggtctttgtacgtgtgtaggagttagcgtgtttgatattgttaatataataataattattttttagagtactgcttttgtatgtatgttgaacaggatccaggtttttatagcttgatataaaacagaattcaaaagtg

SEQ ID NO: 33230 - DNA, 1334 bp, Homo sapiens
gtgcgagcgcgacacctacatgctgctgctctgggtgcagaacctctaccccaagccaatgtgagggagttgatggaccgagctctggagctagaggcacggcgctgggctgaggatgtgcctccccagaggctggacggccactgccacagcgagctggccatcgacatcatccagatcacctcccaggcccaggccaaggccgagagcatcacgctggacttgggctcacagataaagcgggtgctgctggtggagctgcctgcgttcctgaggagctaccagcgcgcctttaatgaatttctggagagaggcaagcagctgacgaattacagggccaatgttattgccaacatcaacaactgcctgtccttccggatgtccatggagcagaattggcaggtaccccaggacaccctgagcctcctgctgggccccctgggtgagctcaagagccacggctttgacaccctgctccagaacctgcatgaggacctgaagccactgttcaagaggttcacgcacacccgctgggcggcccctgtggagaccctggaaaacatcatcgccactgtagacacgaggctgcctgagttctcagagctgcagggctgtttccgggaggagctcatggaggccttgcacctgcacctggtgaaggagtacatcatccaactcagcaaggggcgcctggtcctcaagacggccgagcagcagcagcagctggctgggtacatcctggccaatgctgacaccatccagcacttctgcacccagcacggctccccggcgacctggctgcagcctgctctccctacgctggccgagatcattcgcctgcaggaccccagtgccatcaagattgaggtggccacttatgccacctgctaccctgacttcagcaaaggccacctgagcgctatcctggccatcaaggggaacctatccaacagtgaggtcaagcgcatccggagcatcttggacgtcagcatgggggcgcaggagccctcccggcccctattttcccttataaaggttggttagcttttcctgtggcctgacctgcctgtgagtgcccagcaagccttgggcacaccccgctgggagctgttaagagcagcgctggttctcggttcctcccgggtctcctgtgctctgatgctacttctgcctagccctggcggaggtgcaggccctgtcagctggaactggacagaccttggtttgtttacatgtccgatgggggcaggagctcccatcctgggcagccaaccaggcaacaccaaggactctttgtaaacgatagctgatcgtgtgcacgcaaggaaagaacc

SEQ ID NO: 33231 - DNA, 1002 bp, Homo sapiens
agccactgttcaagaggttcacgcacacccgctgggcggcccctgtggagaccctggaaaacatcatcgccactgtagacacgaggctgcctgagttctcagagctgcagggctgtttccgggaggagctcatggaggccttgcacctgcacctggtgaaggagtacatcatccaactcagcaaggggcgcctggtcctcaagacggccgagcagcagcagcagctggctgggtacatcctggccaatgctgacaccatccagcacttctgcacccagcacggctccccggcgacctggctgcagcctgctctccctacgctggccgagatcattcgcctgcaggaccccagtgccatcaagattgaggtggccacttatgccacctgctaccctgacttcagcaaaggccacctgagcgctatcctggccatcaaggggaacctatccaacagtgaggtcaagcgcatccggagcatcttggacgtcagcatgggggcgcaggagccctcccggcccctattttcccttataaagcccagggccgccgtgagcgggattcagcaatggtggaatggaagacagaactggaagagaaagaaggaaaagatgagctctcgtctggcaggggcttttagggtcctgtggcgagctgtgagcaccgccagcattagacgtcacatccaggtggccccacggcccctacaggctggccctgcaatggggccctgagccctccctcttcatcccccaaggcctcaactagagggtggtcccccgagggcttggtgtctactaccgaagggcccaagacctcctgggtcctctcaggctcccccttccccaaggcagggacaggccctgggggtgccaccgtgggccctgccacccagaagtctggctgaggtctgggcaggggcagggcaagcttgacctctcactgttgaccctttggcctctgtatttgtttcctattgccgtgacaggtttccacaaacttcgt

SEQ ID NO: 33232 - DNA, 421 bp, Homo sapiens
agtggcggccaggccgggacacgctgcctcggagagcggagacctggggcgaggcccagggggctgcagcaggaccttcaggcgctctgggtttcgtgtcacagaggggagaaggcggtgatgctgtgggggtcctgcgggagctgtgcctggaggagcctgcaggcctgaaccagggtgatgctgaagatgatgaccttcttccaaggcctctagagccatcagcctgtgccaggcaccctcgacttgcctagaggcccccaaaagttgcagtccacatcagaggcagagtcagaggcctccatgtcggaggcctcctctgaggacctggtgccacccctggaggctggggcagccccatatagggaggaggaagaggcggcgaagaagaagaaggagaagaagaagaagtccaaaggcc

SEQ ID NO: 33233 - DNA, 4683 bp, Homo sapiens
agtggcggccaggccgggacacggtaagtgacctccgcttccacacgtccattccccgccgctccgcgcggcttctcgcccgcccctaccccgaggccaggccggattccccgaggaaagagcctgtcgccgcggcggggacaggagggggctggacgcttccagggaaactgaggccctggcgcgcccagcgtccgcgcgtccgggcgcagaggggccaaggctggctgagggcccgggcctgccagaggcagggagggcggggctggggcaggcgcaggggtctcccctccattacagcagaaaggccccaggtccggcgtgactccccggccgggcgacacaggccgagtcacttcctcgcccgtgcccgggtgtcctcatcgggggatgggtgcgccttccacatcctgcccaggactgaaggagccgggcccagcgagctcccgggaggtgtgtggacatcagccctgacggggaaggcgagccaggagcctgcaggcctgaaccagggtgatgctgaagatgatgaccttcttccaaggcctctagagccatcagcctgtgccaggcaccctcgacttgcctagaggcccccaaaagttgcagtccacatcagaggcagagtcagaggcctccatgtcggaggcctcctctgaggacctggtgccacccctggaggctggggcagccccatatagggaggaggaagaggcggcgaagaagaagaaggagaagaagaagaagtccaaaggcctggccaatgtgttctgcgtcttcaccaaagggaagaagaagaagggtcagcccagctcagcggagcccgaggacgcagccgggtccaggcaggggctggatggcccgccccccacagtggaggagctgaaggcggcgctggagcgcgggcagctggaggcggcgcggccgctgctggcgctggagcgggagctggcggcggcggcggcggcgggcggtgtgagcgaggaggagctggtgcggcgccagagcaaggtggaggcgctgtacgagctgctgcgcgaccaggtgctgggcgtgctgcggcggccgctggaggcgccgcccgagcggctgcgccaggcgctggccgtggtggcggagcaggagcgcgaggaccgccaggcggcggcggcggggccggggacctcggggctggcggccacgcgcccgcggcgctggctgcagctgtggcggcgcggcgtggcggaggcggccgaggagcgcatgggccagcggccggccgcgggcgccgaggtccccgagagcgtctttctgcacttgggccgcaccatgaaggaggacctggaggccgtggtggagcggctgaagccgctgttccccgccgagttcggcgtcgtggcggcctacgccgagagctaccaccagcacttcgcggcccacctggccgccgtggcgcagttcgagctgtgcgagcgcgacacctacatgctgctgctctgggtgcagaacctctaccccaatgacatcatcaacagccccaagctggtgggtgagctgcagggtatggggctcgggagcctcctgccccccaggcagatccgactgctggaggccacattcctgtccagtgaggcggccaatgtgagggagttgatggaccgagctctggagctagaggcacggcgctgggctgaggatgtgcctccccagaggctggacggccactgccacagcgagctggccatcgacatcatccagatcacctcccaggcccaggccaaggccgagagcatcacgctggacttgggctcacagataaagcgggtgctgctggtggagctgcctgcgttcctgaggagctaccagcgcgcctttaatgaatttctggagagaggcaagcagctgacgaattacagggccaatgttattgccaacatcaacaactgcctgtccttccggatgtccatggagcagaattggcaggtaccccaggacaccctgagcctcctgctgggccccctgggtgagctcaagagccacggctttgacaccctgctccagaacctgcatgaggacctgaagccactgttcaagaggttcacgcacacccgctgggcggcccctgtggagaccctggaaaacatcatcgccactgtagacacgaggctgcctgagttctcagagctgcagggctgtttccgggaggagctcatggaggccttgcacctgcacctggtgaaggagtacatcatccaactcagcaaggggcgcctggtcctcaagacggccgagcagcagcagcagctggctgggtacatcctggccaatgctgacaccatccagcacttctgcacccagcacggctccccggcgacctggctgcagcctgctctccctacgctggccgagatcattcgcctgcaggaccccagtgccatcaagattgaggtggccacttatgccacctgctaccctgacttcagcaaaggccacctgagcgctatcctggccatcaaggggaacctatccaacagtgaggtcaagcgcatccggagcatcttggacgtcagcatgggggcgcaggagccctcccggcccctattttcccttataaaggttggttagcttttcctgtggcctgacctgcctgtgagtgcccagcaagccttgggcacaccccgctgggagctgttaagagcagcgctggttctcggttcctcccgggtctcctgtgctctgatgctacttctgcctagccctggcggaggtgcaggccctgtcagctggaactggacagaccttggtttgtttacatgtccgatgggggcaggagctcccatcctgggcagccaaccaggcaacaccaaggactctttgtaaacgatagctgatcgtgtgcacgcaaggaaagaaccaggagggagagtgcagccaggctcagggatccccggacacctctgtccagagcccctccacagtcggcctcatgactgtcctcctcgtgggtggggccgagggccctcttcagctctctggagacaggggccgagcctcacccatctgccctctgcagcccagggccgccgtgagcgggattcagcaatggtggaatggaagacagaactggaagagaaagaaggaaaagatgagctctcgtctggcaggggcttttagggtcctgtggcgagctgtgagcaccgccagcattagacgtcacatccaggtggccccacggcccctacaggctggccctgcaatggggccctgagccctccctcttcatcccccaaggcctcaactagagggtggtcccccgagggcttggtgtctactaccgaagggcccaagacctcctgggtcctctcaggctcccccttccccaaggcagggacaggccctgggggtgccaccgtgggccctgccacccagaagtctggctgaggtctgggcaggggcagggcaagcttgacctctcactgttgaccctttggcctctgtatttgtttcctattgccgtgacaggtttccacaaacttcgtggatcaaaacgaggtcttccagttctgcgggtcagaaggctgacccggggctcaaatctgggtgtcggcagtcctgcactccttctggaggctctaggggagaattcatttctggccttttcatttttagaggctgaccgtaattcttgacttcaggctcctccatcttcagagccagctgtgggtagttgaatctttttcccgtcacctcattgaggcctcccctctcctgcctccctccaccacttttttttttttttttttgagacagggtcttgctgtgttgcccaggctggagtgcagtggcctggtcatggcatcaaggctcactgcagcctggacctcctggttcaagtgatcctcttgtctcagtcccctgagacaatcccccacgcccagctacatattttttgtggatacagggtctcattctgttgcctaggcttgtctggaactcctgggctcaagggatcttgtagccttagcctcctaaagtgctgggattataggcatgagtcactgtacccggcctgctctaccgcttttaaggacgcttatgatcacattgcgcctacccagagaacccaggtcgtctttctattttcaggtcagctgattagccaccttagttccatctgcaactttagttcccactggctgtgtaacctaacatagtcacaggctctggggactgtcacgtggacatctttgggaggccgttattctgcccaccgcaccctccgttcatcccctgccctgccgggcacctcgctctaccccaggaaaatgtgagctcgttttcctgctcggcatgtgctccccctaaggctctgctcctccctgggcctgaaagttccttctcagcctgagagggggcccttcggactcaggcatgactcagcccggctgatgcctctgcagtgctgagtcaggatttggggccggctctcttgggtccgtccccttttcccaggtactgccttacaaagctgtggccaggaagtggccggtataaaggatgcccaaggtctttgtacgtgtgtaggagttagcgtgtttgatattgttaatataataataattattttttagagtactgcttttgtatgtatgttgaacaggatccaggtttttatagcttgatataaaacagaattcaaaagtg

SEQ ID NO: 33234 - DNA, 4432 bp, Homo sapiens
tgccttgaccaggacttgggactttgcgaaaggatcgcggggcccggagaggtgttggagagcacaatggctgaacaagtccttcctcaggctttgtatttgagcaatatgcggaaagctgtgaagatacgggagagaactccagaagacatttttaaacctactaatgggatcattcatcattttaaaaccatgcaccgatacacactggaaatgttcagaacttgccagttttgtcctcagtttcgggagatcatccacaaagccctcatcgacagaaacatccaggccaccctggaaagccagaagaaactcaactggtgtcgagaagtccggaagcttgtggcgctgaaaacgaacggtgacggcaattgcctcatgcatgccacttctcagtacatgtggggcgttcaggacacagacttggtactgaggaaggcgctgttcagcacgctcaaggaaacagacacacgcaactttaaattccgctggcaactggagtctctcaaatctcaggaatttgttgaaacggggctttgctatgatactcggaactggaatgatgaatgggacaatcttatcaaaatggcttccacagacacacccatggcccgaagtggacttcagtacaactcactggaagaaatacacatatttgtcctttgcaacatcctcagaaggccaatcattgtcatttcagacaaaatgctaagaagtttggaatcaggttccaatttcgcccctttgaaagtgggtggaatttacttgcctctccactggcctgcccaggaatgctacagataccccattgttctcggctatgacagccatcattttgtacccttggtgaccctgaaggacagtgggcctgaaatccgagctgttccacttgttaacagagaccggggaagatttgaagacttaaaagttcactttttgacagatcctgaaaatgagatgaaggagaagctcttaaaagagtacttaatggtgatagaaatccccgtccaaggctgggaccatggcacaactcatctcatcaatgccgcaaagttggatgaagctaacttaccaaaagaaatcaatctggtagatgattactttgaacttgttcagcatgagtacaagaaatggcaggaaaacagcgagcaggggaggagagaggggcacgcccagaatcccatggaaccttccgtgccccagctttctctcatggatgtaaaatgtgaaacgcccaactgccccttcttcatgtctgtgaacacccagcctttatgccatgagtgctcagagaggcggcaaaagaatcaaaacaaactcccaaagctgaactccaagccgggccctgaggggctccctggcatggcgctcggggcctctcggggagaagcctatgagcccttggcgtggaaccctgaggagtccactggggggcctcattcggccccaccgacagcacccagcccttttctgttcagtgagaccactgccatgaagtgcaggagccccggctgccccttcacactgaatgtgcagcacaacggattttgtgaacgttgccacaacgcccggcaacttcacgccagccacgccccagaccacacaaggcacttggatcccgggaagtgccaagcctgcctccaggatgttaccaggacatttaatgggatctgcagtacttgcttcaaaaggactacagcagaggcctcctccagcctcagcaccagcctccctccttcctgtcaccagcgttccaagtcagatccctcgcggctcgtccggagcccctccccgcattcttgccacagagctggaaacgacgcccctgctggctgcctgtctcaagctgcacggactcctggggacaggacggggacgagcaagtgcagaaaagccggctgcgtgtattttgggactccagaaaacaagggcttttgcacactgtgtttcatcgagtacagagaaaacaaacattttgctgctgcctcagggaaagtcagtcccacagcgtccaggttccagaacaccattccgtgcctggggagggaatgcggcacccttggaagcaccatgtttgaaggatactgccagaagtgtttcattgaagctcagaatcagagatttcatgaggccaaaaggacagaagagcaactgagatcgagccagcgcagagatgtgcctcgaaccacacaaagcacctcaaggcccaagtgcgcccgggcctcctgcaagaacatcctggcctgccgcagcgaggagctctgcatggagtgtcagcatcccaaccagaggatgggccctggggcccaccggggtgagcctgcccccgaagacccccccaagcagcgttgccgggcccccgcctgtgatcattttggcaatgccaagtgcaacggctactgcaacgaatgctttcagttcaagcagatgtatggctaaccggaaacaggtgggtcacctcctgcaagaagtggggcctcgagctgtcagtcatcatggtgctatcctctgaacccctcagctgccactgcaacagtgggcttaagggtgtctgagcaggagaggaaagataagctcttcgtggtgcccacgatgctcaggtttggtaacccgggagtgttcccaggtggccttagaaagcaaagcttgtaactggcaagggatgatgtcagattcagcccaaggttcctcctctcctaccaagcaggaggccaggaacttctttggacttggaaggtgtgcggggactggccgaggcccctgcaccctgcgcatcaggactgcttcatcgtcttggctgagaaagggaaaagacacacaagtcgcgtgggttggagaagccagagccattccacctcccctcccccagcatctctcagagatgtgaagccagatcctcatggcagcgaggccctctgcaagaagctcaaggaagctcagggaaaatggacgtattcagagagtgtttgtagttcatggtttttccctacctgcccggttcctttcctgaggacccggcagaaatgcagaaccatccatggactgtgattctgaggctgctgagactgaacatgttcacattgacagaaaaacaagctgctctttataatatgcaccttttaaaaaattagaatattttactgggaagacgtgtaactctttgggttattactgtctttacttctaaagaagttagcttgaactgaggagtaaaagtgtgtacatatataatatacccttacattatgtatgagggatttttttaaattatattgaaatgctgccctagaagtacaataggaaggctaaataataataacctgttttctggttgttgttggggcatgagcttgtgtatacactgcttgcataaactcaaccagctgcctttttaaagggagctctagtcctttttgtgtaattcactttatttattttattacaaacttcaagattatttaagtgaagatatttcttcagctctggggaaaatgccacagtgttctcctgagagaacatccttgctttgagtcaggctgtgggcaagttcctgaccacagggagtaaattggcctctttgatacacttttgcttgcctccccaggaaagaaggaattgcatccaaggtatacatacatattcatcgatgtttcgtgcttctccttatgaaactccagctatgtaataaaaaactatactctgtgttctgttaatgcctctgagtgtcctacctccttggagatgagatagggaaggagcagggatgagactggcaatggtcacagggaaagatgtggccttttgtgatggttttattttctgttaacactgtgtcctgggggggctgggaagtcccctgcatcccatggtaccctggtattgggacagcaaaagccagtaaccatgagtatgaggaaatctctttctgttgctggcttacagtttctctgtgtgctttgtggttgctgtcatatttgctctagaagaaaaaaaaaaaaggaggggaaatgcattttccccagagataaaggctgccattttgggggtctgtacttatggcctgaaaatatttgtgatccataactctacacagcctttactcatactattaggcacactttccccttagagccccctaagtttttcccagacgaatctttataatttctttccaaagataccaaataaacttcagtgttttcatctaattctcttaaagttgatatcttaatattttgtgttgatcattatttccattcttaatgtgaaaaaaagtaattatttatacttattataaaaagtatttgaaatttgcacatttaattgtccctaatagaaagccacctattctttgttggatttcttcaagtttttctaaataaatgtaacttttcacaagagtcaacattaaaaaataaattatttaagaaca

SEQ ID NO: 33235 - DNA, 698 bp, Homo sapiens
gcggccgccaagagagatcacacccccagccgaccctgccagcgagcgagcccgaccccaggcgtccatggagcgtcgcctccgcccggtccctgccccgacccccgcctgcggcgcgctcctgccttgaccaggacttgggactttgcgaaaggatcgcggggcccggagaggtaaccgccgcgcctcccggagaggtgttggagagcacaatggctgaacaagtccttcctcaggctttgtatttgagcaatatgcggaaagctgtgaagatacgggagagaactccagaagacatttttaaacctactaatgggatcattcatcattttaaaaccatgcaccgatacacactggaaatgttcagaacttgccagttttgtcctcagtttcgggagatcatccacaaagccctcatcgacagaaacatccaggccaccctggaaagccagaagaaactcaactggtgtcgagaagtccggaagcttgtggcgctgaaaacgaacggtgacggcaattgcctcatgcatgccacttctcagtacatgtggggcgttcaggacacagacttggtactgaggaaggcgctgttcagcacgctcaaggaaacagacacacgcaactttaaattccgctggcaactggagtctctcaaatctcaggaatttgttgaaacggggctttgctatgatactcgg

SEQ ID NO: 33236 - DNA, 421 bp, Homo sapiens
gggcctacaacccgcatacaactgaaacggggcaaagcagactgcgcagtctgcagtcttcgtggcgggccaagcgagcttggagcccgcgggggcggagcggtgagagcggccgccaagagagatcacacccccagccgaccctgccagcgagcgagcccgaccccaggcgtccatggagcgtcgcctccgcccggtccctgccccgacccccgcctgcggcgcgctcctgccttgaccaggacttgggactttgcgaaaggatcgcggggcccggagaggtaaccgccgcgcctcccggagaggtaaccgccgcgcctcccggagaggtgttggagagcacaatggctgaacaagtccttcctcaggctttgtatttgagcaatatgcggaaagctgtgaagatacgggagagaactcc

SEQ ID NO: 33237 - DNA, 465 bp, Homo sapiens
accgcagtcaagggctgcgggtgcatgttgggcagcgacccccgggctggcaccgtctacctggcgttggttttgcagcgctcctggactgggagtttgttggacgtttctgtctgggttttgaagtgctgggagttgaggtcactgctgcagaggtgttggagagcacaatggctgaacaagtccttcctcaggctttgtatttgagcaatatgcggaaagctgtgaagatacgggagagaactccagaagacatttttaaacctactaatgggatcattcatcattttaaaaccatgcaccgatacacactggaaatgttcagaacttgccagttttgtcctcagtttcgggagatcatccacaaagccctcatcgacagaaacatccaggccaccctggaaagccagaagaaactcaactggtgtcgagaagtccggaagcttgtggcgctgaaaacgaacg

SEQ ID NO: 33238 - DNA, 827 bp, Homo sapiens
aggtgttggagagcacaatggctgaacaagtccttcctcaggctttgtatttgagcaatatgcggaaagctgtgaagatacgggagagaactccagaagacatttttaaacctactaatgggatcattcatcattttaaaaccatgcaccgatacacactggaaatgttcagaacttgccagttttgtcctcagtttcgggagatcatccacaaagccctcatcgacagaaacatccaggccaccctggaaagccagaagaaactcaactggtgtcgagaagtccggaagcttgtggcgctgaaaacgaacggtgacggcaattgcctcatgcatgccacttctcagtacatgtggggcgttcaggacacagacttggtactgaggaaggcgctgttcagcacgctcaaggaaacagacacacgcaactttaaattccgctggcaactggagtctctcaaatctcaggaatttgttgaaacggggctttgctatgatactcggaactggaatgatgaatgggacaatcttatcaaaatggcttccacagacacacccatggcccgaagtggacttcagtacaactcactggaagaaatacacatatttgtcctttgcaacatcctcagaaggccaatcattgtcatttcagacaaaatgctaagaagtttggaatcaggttccaatttcgcccctttgaaagtgggtggaatttacttgcctctccactggcctgcccaggaatgctacagataccccattgttctcggctatgacagccatcattttgtacccttggtgaccctgaaggacagtgggcctgatata

SEQ ID NO: 33239 - DNA, 3817 bp, Homo sapiens
aggtgttggagagcacaatggctgaacaagtccttcctcaggctttgtatttgagcaatatgcggaaagctgtgaagatacgggagagaactccagaagacatttttaaacctactaatgggatcattcatcattttaaaaccatgcaccgatacacactggaaatgttcagaacttgccagttttgtcctcagtttcgggagatcatccacaaagccctcatcgacagaaacatccaggccaccctggaaagccagaagaaactcaactggtgtcgagaagtccggaagcttgtggcgctgaaaacgaacggtgacggcaattgcctcatgcatgccacttctcagtacatgtggggcgttcaggacacagacttggtactgaggaaggcgctgttcagcacgctcaaggaaacagacacacgcaactttaaattccgctggcaactggagtctctcaaatctcaggaatttgttgaaacggggctttgctatgatactcggaactggaatgatgaatgggacaatcttatcaaaatggcttccacagacacacccatggcccgaagtggacttcagtacaactcactggaagaaatacacatatttgtcctttgcaacatcctcagaaggccaatcattgtcatttcagacaaaatgctaagaagtttggaatcaggttccaatttcgcccctttgaaagtgggtggaatttacttgcctctccactggcctgcccaggaatgctacagataccccattgttctcggctatgacagccatcattttgtacccttggtgaccctgaaggacagtgggcctgaaatccgagctgttccacttgttaacagagaccggggaagatttgaagacttaaaagttcactttttgacagatcctgaaaatgagatgaaggagaagctcttaaaagagtacttaatggtgatagaaatccccgtccaaggctgggaccatggcacaactcatctcatcaatgccgcaaagttggatgaagctaacttaccaaaagaaatcaatctggtagatgattactttgaacttgttcagcatgagtacaagaaatggcaggaaaacagcgagcaggggaggagagaggggcacgcccagaatcccatggaaccttccgtgccccagctttctctcatggatgtaaaatgtgaaacgcccaactgccccttcttcatgtctgtgaacacccagcctttatgccatgagtgctcagagaggcggcaaaagaatcaaaacaaactcccaaagctgaactccaagccgggccctgaggggctccctggcatggcgctcggggcctctcggggagaagcctatgagcccttggcgtggaaccctgaggagtccactggggggcctcattcggccccaccgacagcacccagcccttttctgttcagtgagaccactgccatgaagtgcaggagccccggctgccccttcacactgaatgtgcagcacaacggattttgtgaacgttgccacaacgcccggcaacttcacgccagccacgccccagaccacacaaggcacttggatcccgggaagtgccaagcctgcctccaggatgttaccaggacatttaatgggatctgcagtacttgcttcaaaaggactacagcagaggcctcctccagcctcagcaccagcctccctccttcctgtcaccagcgttccaagtcagatccctcgcggctcgtccggagcccctccccgcattcttgccacagagctggaaacgacgcccctgctggctgcctgtctcaagctgcacggactcctggggacaggacggggacgagcaagtgcagaaaagccggctgcgtgtattttgggactccagaaaacaagggcttttgcacactgtgtttcatcgagtacagagaaaacaaacattttgctgctgcctcagggaaagtcagtcccacagcgtccaggttccagaacaccattccgtgcctggggagggaatgcggcacccttggaagcaccatgtttgaaggatactgccagaagtgtttcattgaagctcagaatcagagatttcatgaggccaaaaggacagaagagcaactgagatcgagccagcgcagagatgtgcctcgaaccacacaaagcacctcaaggcccaagtgcgcccgggcctcctgcaagaacatcctggcctgccgcagcgaggagctctgcatggagtgtcagcatcaaccagaggatgggccctggggcccaccggggtgagcctgcccccgaagacccccccaagcagcgttgccgggcccccgcctgtgatcattttggcaatgccaagtgcaacggctactgcaacgaatgctttcagttcaagcagatgtatggctaaccggaaacaggtgggtcacctcctgcaagaagtggggcctcgagctgtcagtcatcatggtgctatcctctgaacccctcagctgccactgcaacagtgggcttaagggtgtctgagcaggagaggaaagataagctcttcgtggtgcccacgatgctcaggtttggtaacccgggagtgttcccaggtggccttagaaagcaaagcttgtaactggcaagggatgatgtcagattcagcccaaggttcctcctctcctaccaagcaggaggccaggaacttctttggacttggaaggtgtgcggggactggccgaggcccctgcaccctgcgcatcaggactgcttcatcgtcttggctgagaaagggaaaagacacacaagtcgcgtgggttggagaagccagagccattccacctcccctcccccagcatctctcagagatgtgaagccagatcctcatggcagcgaggccctctgcaagaagctcaaggaagctcagggaaaatggacgtattcagagagtgtttgtagttcatggtttttccctacctgcccggttcctttcctgaggacccggcagaaatgcagaaccatccatggactgtgattctgaggctgctgagactgaacatgttcacattgacagaaaaacaagctgctctttataatatgcaccttttaaaaaattagaatattttactgggaagacgtgtaactctttgggttattactgtctttacttctaaagaagttagcttgaactgaggagtaaaagtgtgtacatatataatatacccttacattatgtatgagggatttttttaaattatattgaaatgctgccctagaagtacaataggaaggctaaataataataacctgttttctggttgttgttggggcatgagcttgtgtatacactgcttgcataaactcaaccagctgcctttttaaagggagctctagtcctttttgtgtaattcactttatttattttattacaaacttcaagattatttaagtgaagatatttcttcagctctggggaaaatgccacagtgttctcctgagagaacatccttgctttgagtcaggctgtgggcaagttcctgaccacagggagtaaattggcctctttgatacacttttgcttgcctccccaggaaagaaggaattgcatccaaggtatacatacatattcatcgatgtttcgtgcttctccttatgaaactccagctatgtaataaaaaactatactctgtgttctgttaatgcctctgagtgtcctacctccttggagatgagatagggaaggagcagggatgagactggcaatggtcacagggaaagatgtggccttttgtgatggttttattttctgttaacactgtgtcctgggggggctgggaagtcccctgcatcccatg

SEQ ID NO: 33240 - DNA, 459 bp, Homo sapiens
atggctgaacaagtccttcctcaggctttgtatttgagcaatatgcggaaagctgtgaagatacgggagagaactccagaagacatttttaaacctactaatgggatcattcatcattttaaaaccatgcaccgatacacactggaaatgttcagaacttgccagttttgtcctcagtttcgggagatcatccacaaagccctcatcgacagaaacatccaggccaccctggaaagccagaagaaactcaactggtgtcgagaagtccggaagcttgtggcgctgaaaacgaacggtgacggcaattgcctcatgcatgccacttctcagtacatgtggggcgttcaggacacagacttggtactgaggaaggcgctgttcagcacgctcaaggaaacagacacacgcaactttaaattccgctggcaactggagtctcaaatctcaggaatttgttga

SEQ ID NO: 33241 - DNA, 3818 bp, Homo sapiens
aggtgttggagagcacaatggctgaacaagtccttcctcaggctttgtatttgagcaatatgcggaaagctgtgaagatacgggagagaactccagaagacatttttaaacctactaatgggatcattcatcattttaaaaccatgcaccgatacacactggaaatgttcagaacttgccagttttgtcctcagtttcgggagatcatccacaaagccctcatcgacagaaacatccaggccaccctggaaagccagaagaaactcaactggtgtcgagaagtccggaagcttgtggcgctgaaaacgaacggtgacggcaattgcctcatgcatgccacttctcagtacatgtggggcgttcaggacacagacttggtactgaggaaggcgctgttcagcacgctcaaggaaacagacacacgcaactttaaattccgctggcaactggagtctctcaaatctcaggaatttgttgaaacggggctttgctatgatactcggaactggaatgatgaatgggacaatcttatcaaatggcttccacagacacacccatggcccgaagtggacttcagtacaactcactggaagaaatacacatatttgtcctttgcaacatcctcagaaggccaatcattgtcatttcagacaaaatgctaagaagtttggaatcaggttccaatttcgcccctttgaaagtgggtggaatttacttgcctctccactggcctgcccaggaatgctacagataccccattgttctcggctatgacagccatcattttgtacccttggtgaccctgaaggacagtgggcctgaaatccgagctgttccacttgttaacagagaccggggaagatttgaagacttaaaagttcactttttgacagatcctgaaaatgagatgaaggagaagctcttaaaagagtacttaatggtgatagaaatccccgtccaaggctgggaccatggcacaactcatctcatcaatgccgcaaagttggatgaagctaacttaccaaaagaaatcaatctggtagatgattactttgaacttgttcagcatgagtacaagaaatggcaggaaaacagcgagcaggggaggagagaggggcacgcccagaatcccatggaaccttccgtgccccagctttctctcatggatgtaaaatgtgaaacgcccaactgccccttcttcatgtctgtgaacacccagcctttatgccatgagtgctcagagaggcggcaaaagaatcaaaacaaactcccaaagctgaactccaagccgggccctgaggggctccctggcatggcgctcggggcctctcggggagaagcctatgagcccttggcgtggaaccctgaggagtccactggggggcctcattcggccccaccgacagcacccagcccttttctgttcagtgagaccactgccatgaagtgcaggagccccggctgccccttcacactgaatgtgcagcacaacggattttgtgaacgttgccacaacgcccggcaacttcacgccagccacgccccagaccacacaaggcacttggatcccgggaagtgccaagcctgcctccaggatgttaccaggacatttaatgggatctgcagtacttgcttcaaaaggactacagcagaggcctcctccagcctcagcaccagcctccctccttcctgtcaccagcgttccaagtcagatccctcgcggctcgtccggagcccctccccgcattcttgccacagagctggaaacgacgcccctgctggctgcctgtctcaagctgcacggactcctggggacaggacggggacgagcaagtgcagaaaagccggctgcgtgtattttgggactccagaaaacaagggcttttgcacactgtgtttcatcgagtacagagaaaacaaacattttgctgctgcctcagggaaagtcagtcccacagcgtccaggttccagaacaccattccgtgcctggggagggaatgcggcacccttggaagcaccatgtttgaaggatactgccagaagtgtttcattgaagctcagaatcagagatttcatgaggccaaaaggacagaagagcaactgagatcgagccagcgcagagatgtgcctcgaaccacacaaagcacctcaaggcccaagtgcgcccgggcctcctgcaagaacatcctggcctgccgcagcgaggagctctgcatggagtgtcagcatcccaaccagaggatgggccctggggcccaccggggtgagcctgcccccgaagacccccccaagcagcgttgccgggcccccgcctgtgatcattttggcaatgccaagtgcaacggctactgcaacgaatgctttcagttcaagcagatgtatggctaaccggaaacaggtgggtcacctcctgcaagaagtggggcctcgagctgtcagtcatcatggtgctatcctctgaacccctcagctgccactgcaacagtgggcttaagggtgtctgagcaggagaggaaagataagctcttcgtggtgcccacgatgctcaggtttggtaacccgggagtgttcccaggtggccttagaaagcaaagcttgtaactggcaagggatgatgtcagattcagcccaaggttcctcctctcctaccaagcaggaggccaggaacttctttggacttggaaggtgtgcggggactggccgaggcccctgcaccctgcgcatcaggactgcttcatcgtcttggctgagaaagggaaaagacacacaagtcgcgtgggttggagaagccagagccattccacctcccctcccccagcatctctcagagatgtgaagccagatcctcatggcagcgaggccctctgcaagaagctcaaggaagctcagggaaaatggacgtattcagagagtgtttgtagttcatggtttttccctacctgcccggttcctttcctgaggacccggcagaaatgcagaaccatccatggactgtgattctgaggctgctgagactgaacatgttcacattgacagaaaaacaagctgctctttataatatgcaccttttaaaaaattagaatattttactgggaagacgtgtaactctttgggttattactgtctttacttctaaagaagttagcttgaactgaggagtaaaagtgtgtacatatataatatacccttacattatgtatgagggatttttttaaattatattgaaatgctgccctagaagtacaataggaaggctaaataataataacctgttttctggttgttgttggggcatgagcttgtgtatacactgcttgcataaactcaaccagctgcctttttaaagggagctctagtcctttttgtgtaattcactttatttattttattacaaacttcaagattatttaagtgaagatatttcttcagctctggggaaaatgccacagtgttctcctgagagaacatccttgctttgagtcaggctgtgggcaagttcctgaccacagggagtaaattggcctctttgatacacttttgcttgcctccccaggaaagaaggaattgcatccaaggtatacatacatattcatcgatgtttcgtgcttctccttatgaaactccagctatgtaataaaaaactatactctgtgttctgttaatgcctctgagtgtcctacctccttggagatgagatagggaaggagcagggatgagactggcaatggtcacagggaaagatgtggccttttgtgatggttttattttctgttaacactgtgtcctgggggggctgggaagtcccctgcatcccatg

SEQ ID NO: 33242 - DNA, 2010 bp, Homo sapiens
atggctgaacaagtccttcctcaggctttgtatttgagcaatatgcggaaagctgtgaagatacgggagagaactccagaagacatttttaaacctactaatgggatcattcatcattttaaaaccatgcaccgatacacactggaaatgttcagaacttgccagttttgtcctcagtttcgggagatcatccacaaagccctcatcgacagaaacatccaggccaccctggaaagccagaagaaactcaactggtgtcgagaagtccggaagcttgtggcgctgaaaacgaacggtgacggcaattgcctcatgcatgccacttctcagtacatgtggggcgttcaggacacagacttggtactgaggaaggcgctgttcagcacgctcaaggaaacagacacacgcaactttaaattccgctggcaactggagtctctcaaatctcaggaatttgttgaaacggggctttgctatgatactcggaactggaatgatgaatgggacaatcttatcaaaatggcttccacagacacacccatggcccgaagtggacttcagtacaactcactggaagaaatacacatatttgtcctttgcaacatcctcagaaggccaatcattgtcatttcagacaaaatgctaagaagtttggaatcaggttccaatttcgcccctttgaaagtgggtggaatttacttgcctctccactggcctgcccaggaatgctacagataccccattgttctcggctatgacagccatcattttgtacccttggtgaccctgaaggacagtgggcctgaaatccgagctgttccacttgttaacagagaccggggaagatttgaagacttaaaagttcactttttgacagatcctgaaaatgagatgaaggagaagctcttaaaagagtacttaatggtgatagaaatccccgtccaaggctgggaccatggcacaactcatctcatcaatgccgcaaagttggatgaagctaacttaccaaaagaaatcaatctggtagatgattactttgaacttgttcagcatgagtacaagaaatggcaggaaaacagcgagcaggggaggagagaggggcacgcccagaatcccatggaaccttccgtgccccagctttctctcatggatgtaaaatgtgaaacgcccaactgccccttcttcatgtctgtgaacacccagcctttatgccatgagtgctcagagaggcggcaaaagaatcaaaacaaactcccaaagctgaactccaagccgggccctgaggggctccctggcatggcgctcggggcctctcggggagaagcctatgagcccttggcgtggaaccctgaggagtccactggggggcctcattcggccccaccgacagcacccagcccttttctgttcagtgagaccactgccatgaagtgcaggagccccggctgccccttcacactgaatgtgcagcacaacggattttgtgaacgttgccacaacgcccggcaacttcacgccagccacgccccagaccacacaaggcacttggatcccgggaagtgccaagcctgcctccaggatgttaccaggacatttaatgggatctgcagtacttgcttcaaaaggactacagcagaggcctcctccagcctcagcaccagcctccctccttcctgtcaccagcgttccaagtcagatccctcgcggctcgtccggagcccctccccgcattcttgccacagagctggaaacgacgcccctgctggctgcctgtctcaagctgcacggactcctggggacaggacggggacgagcaagtgcagaaaagccggctgcgtgtattttgggactccagaaaacaagggcttttgcacactgtttcatcgagtacagagaaaacaaacattttgctgctgcctcagggaaagtcagtcccacagcgtccaggttccagaacaccattccgtgcctggggagggaatgcggcacccttggaagcaccatgtttga

SEQ ID NO: 33243 - DNA, 1422 bp, Homo sapiens
agtcacatttcagccactgctctgagaatttgtgagcagcccctaacaggctgttacttcactacaactgacgatatgatcatcttaatttacttatttctcttgctatgggaagacactcaaggatggggattcaaggatggaatttttcataactccatatggcttgaacgagcagccggtgtgtaccacagagaagcacggtctggcaaatacaagctcacctacgcagaagctaaggcggtgtgtgaatttgaaggcggccatctcgcaacttacaagcagctagaggcagccagaaaaattggatttcatgtctgtgctgctggatggatggctaagggcagagttggataccccattgtgaagccagggcccaactgtggatttggaaaaactggcattattgattatggaatccgtctcaataggagtgaaagatgggatgcctattgctacaacccacacgcaaaggagtgtggtggcgtctttacagatccaaagcaaatttttaaatctccaggcttcccaaatgagtacgaagataaccaaatctgctactggcacattagactcaagtatggtcagcgtattcacctgagttttttagattttgaccttgaagatgacccaggttgcttggctgattatgttgaaatatatgacagttacgatgatgtccatggctttgtgggaagatactgtggagatgagcttccagatgacatcatcagtacaggaaatgtcatgaccttgaagtttctaagtgatgcttcagtgacagctggaggtttccaaatcaaatatgttgcaatggatcctgtatccaaatccagtcaaggaaaaaatacaagtactacttctactggaaataaaaactttttagctggaagatttagccacttataaaaaaaaaaaaaaggatgatcaaaacacacagtgtttatgttggaatcttttggaactcctttgatctcactgttattattaacatttatttattatttttctaaatgtgaaagcaatacataatttagggaaaattggaaaatataggaaactttaaacgagaaaatgaaacctctcataatcccactgcatagaaataacaagcgttaacattttcatatttttttctttcagtcatttttctatttgtggtatatgtatatatgtacctatatgtatttgcatttgaaattttggaatcctgctctatgtacagttttgtattatactttttaaatcttgaactttataaacattttctgaaatcattgattattctacaaaaacatgattttaaacagctgtaaaatattctatgatatgaatgttttatgcattatttaagcctgtctctattgttggaatttcaggtcattttcataaatattgttgcaataaatatccttgaacaca

SEQ ID NO: 33244 - DNA, 795 bp, Homo sapiens
gacctcccggctcctccccggcctgcccgccacacccttggtccctcctgcaagttccgcccctggcctctgcctccttttctcccgccggctctaacccgcgcttggctaaggtccgcgggaacccgtgagccaccgagagagcagagaactcggcgccgccaaacagcccagctcgcgcttcagcgtcccggcgccgtcgcgccactcctccgatggccacagatgtctttaattccaaaaacctggccgttcaggcacaaaagaagatcttgggtaaaatggtgtccaaatccatcgccaccaccttaatagacgacacaagtagtgaggtgctggatgagctctacagagtgaccagggagtacacccaaaacaagaaggaggcagagaagatcatcaagaacctcatcaagacagtcatcaagctggccattctttataggaataatcagtttaatcaagatgagctagcattgatggagaaatttaagaagaaagttcatcagcttgctatgaccgtggtcagtttccatcaggtggattatacctttgaccggaatgtgttatccaggctgttaaatgaatgcagagagatgctgcaccaaatcattcagcgccacctcactgccaagtcacatggacgggttaataatgtgtttgatcatttttcagattgtgaatttttggctgccttgtataatccttttgggaattttaaaccccacttacaaaaactatgtgatggtatcaacaaaatgttggatgaagagaacatatgagcacatgagttaa

SEQ ID NO: 33245 - DNA, 2502 bp, Homo sapiens
agactccttaaatccatgtcttttgtacgttcttttcactaaatttgccatagtgtttctattggtttttgcctatataaaatcggaaacgaagaaaaagaaacgaactggaaaataaatttgtcaaaagagtatatttttttctcataatttccaagcggatctttcagatatgttatttgaggactttttgcctcagactggcgataaaacaagtgttctacaaaatacctccgtaagacaggcctatcagtggcagctcttgtccccgctttgcagaagggaaaaccaaggctccacagagctaaggggacttcctctcagccaatttgtaggggcctgtgggccagacccgggggcagaattgagatctgttgtgaaggctgtccggcttctttattctatcagcatttcaaatcctgaaaacctcccctttggcattttgaaggaattcatccccagtttttgctggtagccgggagggaaccgtgctctccccctgaggaaggccctttggagtaactgcagcaatgagtgcccgggctgtgcttggagtaccagtgctcgcccggggctatactgaatgagtaagcagccccgtctgcttttgctgtgcaaagagcgaacttgcggctcgtccgagtacatgtgagcggtaatcgcccctgcagctggttatcctgacattatgcactccgaagcagaagaatccaaggaagtggccacagatgtctttaattccaaaaacctggccgttcaggcacaaaagaagatcttgggtaaaatggtgtccaaatccatcgccaccaccttaatagacgacacaagtagtgaggtgctggatgagctctacagagtgaccagggagtacacccaaaacaagaaggaggcagagaagatcatcaagaacctcatcaagacagtcatcaagctggccattctttataggaataatcagtttaatcaagatgagctagcattgatggagaaatttaagaagaaagttcatcagcttgctatgaccgtggtcagtttccatcaggtggattatacctttgaccggaatgtgttatccaggctgttaaatgaatgcagagagatgctgcaccaaatcattcagcgccacctcactgccaagtcacatggacgggttaataatgtgtttgatcatttttcagattgtgaatttttggctgccttgtataatccttttgggaattttaaaccccacttacaaaaactatgtgatggtatcaacaaaatgttggatgaagagaacatatgagcacatgagttaagattgtgactgatcatgatttatttgaagatggagcactgctgatttatgaaggaaaaaagaagaattttctaaagattacacatatttcagaaagactttacccaattcagttgtcagacataatgatttatttgaaggcttgttttatttgaagaaaagcatattgccaaaaattctggttaaaagcttcctaacgggtaacagaccatgggagagatatgtggttgggtaatgcaaatgtagttatacaaagaaaaatacagatgtctccagacctgaggactttttaatagggcagttgttgtgttggtggcacattggatatttctaacatgtacaaagctatgtattttgatttactttcatttcttgctatgtatatgtacttttcttaaaatgccaagaactttctcttgctatcattgctccttttgaaacaattcaattttcatgtctacagctgactgttttgttaagattgagtcatcgacattcaggatttaagtctgaggtagtcaaccctcaggaaaaaaaaaatggcttatctgaaatcagtactgtggaaatgaactatattagctattatgaataatgtccagtataagaatatgcttctggaattgagttctccttttaagtaccaatgatacttaaatttctcagaaatgtaatggtgtgtcattgccttgaaatgcttgcttagggcttcttttatgttatcttaaaaagtgctggtgaattttccattttttacatccatttcacatgtaagagacaaaaaagtctagattggtcttgatattgagataataaaaagtaagtagcattaagaaaggtaacaatcttcattctacagatgaactcattgaaacaatttaggggaatgaggggcaaaaggggagaaatactgctaaagaacatgagcataaaaatgcgtgcgtttcagtgtttaagaaggcttgataaagaatgtcacttttttatttaactgataagatttttgttattttttactttgataagtaaaccaaagaatatttgtatttcaagcagtttgtgtggtgtttctatataattttctgtgtataaataataaagtaggcatttgtttattttgtaaaaaagaaatgaaaatctgctggccagctatgtcctctaggaaatgacagacccaaccaccagcaataaacatttccattgtc

SEQ ID NO: 33246 - DNA, 3591 bp, Homo sapiens
ttctcctcttctcccttctctggctggctatatcttcctcccttcatcctgctctttcagtgaaattgagataacatgttagaatcttaggcaggttagaatctctcagcagtaggatgtgatttaatatctagacctcttacattaatatttataatagccttcactgcttgtgaatagcataagcactcttttctgttcaaagtcaatactgaaataaaacccaagagtatgttttataaaaatttacttttaatggtgcaatggtaataatctatgtagtccttatggttttcaaatccctttgtgcttatattaccttatttaatacagacataaatctgtgaagtaaataatactatttttatcttcattttacaaatgaggaactggaggctcagagaggttaatttgcataaggtcatacaaatgatagatggcagaactggatttaagttcagactccttaaatccatgtcttttgtacgttcttttcactaaatttgccatagtgtttctattggtttttgcctatataaaatcggaaacgaagaaaaagaaacgaactggaaaataaatttgtcaaaagagtatatttttttctcataatttccaagcggatctttcagatatgttatttgaggactttttgcctcagactggcgataaaacaagtgttctacaaaatacctccgtaagacaggcctatcagtggcagctcttgtccccgctttgcagaagggaaaaccaaggctccacagagctaaggggacttcctctcagccaatttgtaggggcctgtgggccagacccgggggcagaattgagatctgttgtgaaggctgtccggcttctttattctatcagcatttcaaatcctgaaaacctcccctttggcattttgaaggaattcatccccagtttttgctggtagccgggagggaaccgtgctctccccctgaggaaggccctttggagtaactgcagcaatgagtgcccgggctgtgcttggagtaccagtgctcgcccggggctatactgaatgagtaagcagccccgtctgcttttgctgtgcaaaggtaagggtggaggccgctccactttcttcaaaaggccccgctctgggacttgtgaaattgtgctctcttaagctggtccttgcaaccccatggacgatatccatgcgactttcctacaaaaataacataccaaagccgctttaaaatccgtaatttttgggttgcaagactccaagacaaagtcaaatgggcatcaaaaaatgtaatccaaaaatacagaggcattggttctaccctatatgcatttgctatttatgtaaaactacagtgtgctctgagatgagactttttttttctttttatacctttttttccgcccgtctggtgcgtttgccgacggttcttctcggccctgtgtctcgggagagtcggctgccgtctgggcctgtgccccacctgcgtgcgcccgggccgagccagccccgccaggtcgcctccgcccggctgccggcccgagcgcgcggctccgggggcggactcccgccgcccagctgacacgcgattcgtcactcttgcagaactttccccctgaaaatccctgcaccagaacccgctctcccgccccggggaggttttgattttagtggctttcttccttttattttccgtcgtgtgcggatttcgctgcagagcgaacttgcggctcgtccgagtacatgtgagcggtaatcgcccctgcagctggttatcctgacattatgcactccgaagcagaagaatccaaggaagtggccacagatgtctttaattccaaaaacctggccgttcaggcacaaaagaagatcttgggtaaaatggtgtccaaatccatcgccaccaccttaatagacgacacaagtagtgaggtgctggatgagctctacagagtgaccagggagtacacccaaaacaagaaggaggcagagaagatcatcaagaacctcatcaagacagtcatcaagctggccattctttataggaataatcagtttaatcaagatgagctagcattgatggagaaatttaagaagaaagttcatcagcttgctatgaccgtggtcagtttccatcaggtggattatacctttgaccggaatgtgttatccaggctgttaaatgaatgcagagagatgctgcaccaaatcattcagcgccacctcactgccaagtcacatggacgggttaataatgtgtttgatcatttttcagattgtgaatttttggctgccttgtataatccttttgggaattttaaaccccacttacaaaaactatgtgatggtatcaacaaaatgttggatgaagagaacatatgagcacatgagttaagattgtgactgatcatgatttatttgaagatggagcactgctgatttatgaaggaaaaaagaagaattttctaaagattacacatatttcagaaagactttacccaattcagttgtcagacataatgatttatttgaaggcttgttttatttgaagaaaagcatattgccaaaaattctggttaaaagcttcctaacgggtaacagaccatgggagagatatgtggttgggtaatgcaaatgtagttatacaaagaaaaatacagatgtctccagacctgaggactttttaatagggcagttgttgtgttggtggcacattggatatttctaacatgtacaaagctatgtattttgatttactttcatttcttgctatgtatatgtacttttcttaaaatgccaagaactttctcttgctatcattgctccttttgaaacaattcaattttcatgtctacagctgactgttttgttaagattgagtcatcgacattcaggatttaagtctgaggtagtcaaccctcaggaaaaaaaaaatggcttatctgaaatcagtactgtggaaatgaactatattagctattatgaataatgtccagtataagaatatgcttctggaattgagttctccttttaagtaccaatgatacttaaatttctcagaaatgtaatggtgtgtcattgccttgaaatgcttgcttagggcttcttttatgttatcttaaaaagtgctggtgaattttccattttttacatccatttcacatgtaagagacaaaaaagtctagattggtcttgatattgagataataaaaagtaagtagcattaagaaaggtaacaatcttcattctacagatgaactcattgaaacaatttaggggaatgaggggcaaaaggggagaaatactgctaaagaacatgagcataaaaatgcgtgcgtttcagtgtttaagaaggcttgataaagaatgtcacttttttatttaactgataagatttttgttattttttactttgataagtaaaccaaagaatatttgtatttcaagcagtttgtgtggtgtttctatataattttctgtgtataaataataaagtaggcatttgtttattttgtaaaaaagaaatgaaaatctgctggccagctatgtcctctaggaaatgacagacccaaccaccagcaataaacatttccattgtc

SEQ ID NO: 33247 - DNA, 1178 bp, Homo sapiens
ggccaagccaaagggctctcacactaagtgaagcttctccattctgtaagctttccgggaacatccaaggcaagactggcacccagcacagcagtgactgaccacataccccactctccaggacccatggagtccttcagctcaaagagcctggcactgcaagcagagaagaagctactgagtaagatggcgggtcgctctgtggctcatctcttcatagatgagacaagcagtgaggtgctagatgagctctaccgtgtgtccaaggagtacacgcacagccggccccaggcccagcgcgtgatcaaggacctgatcaaagtggccatcaaggtggctgtgctgcaccgcaatggctcctttggccccagtgagctggccctggctacccgctttcgccagaagctgcggcagggtgccatgacggcacttagctttggtgaggtagacttcaccttcgaggctgctgttctggctggcctgctgaccgagtgccgggatgtgctgctagagttggtggaacaccacctcacgcccaagtcacatggccgcatccgccacgtgtttgatcacttctctgacccaggtctgctcacggccctctatgggcctgacttcactcagcaccttggcaagatctgtgacggactcaggaagctgctagacgaagggaagctctgagagccctgagcctagcacattccaccttgacaaaatggttgactgagaaaacacagataatgggcttcctaaccctgctcacctggcactaacacttttcaatcttcaggcttcattccttcccaagagtgcttttgactctgagaccagcccacccccaaacagctagtggagaaggagcaatgctgaggggtgaggcctctctcccactccagccccaggacaggaaacagaactgcctgaaaaaggtgaagtgaaacttggatctctatttctcccataagggacttctgaaacagggaagccccctcccatgtgaaccaaggaaaggaggcacagcccagagaacccctttggggatactaaagacagaagaggggaaggtggcccttagagacagagcttggacagatgccagaggctctgttccagagtgcaggaagaaggggctagggcaggggagattctcataggggaaataaaactactaaaatatg

SEQ ID NO: 33248 - DNA, 2362 bp, Homo sapiens
ggcgagcttctcccggcgccgcccgctcggctcccatagcgcccgcgacagcggtccggacgccgcccgaacatggactccgccggccaagatatcaacctgaattctcctaacaaaggtctgctgtctgactccatgacggatgttcctgtcgacacaggtgtggctgcccggactcctgctgttgagggtctgacagaggctgaggaggaggagctcagggctgagcttaccaaggtggaagaggaaattgtcactctgcgccaggtcctggcagccaaggagaggcactgtggagagctcaagaggaggctgggcctctccaccctgggggagctgaaacagaacctgtccaggagctggcatgacgtgcaggtctctagcgcctatgtgaaaacttctgagaaacttggagagtggaatgagaaagtgacccagtcagacctctacaagaagactcaggaaactctttcacaggcaggacagaagacttcagctgccctgtccacagtgggctctgccatcagcaggaagcttggagacatgagggctcatccattttcacactcctttagcagctactccatccgccactcaataagtatgccagccatgaggaactctgcgaccttcaagtcgtttgaggaccgagttgggaccataaagtctaaggttgtgggtgacagagagaacggcagtgacaacctcccttcctcagcggggagtggtgacaagcccctgtcggatcccgcacctttctaagcctgtggttgcttcacccgctgcagagcacacgcaacccagcctcagcatcacagccgcagctctgttcagcggagcagccagccagggcggatgagcagagccggccctgaggacagtcctgcccatccacgcggagatgtggctgccgcgtttgcatgaatttgaagaacacaggcttgtacacagatgttttacactcacgtttgtagatgaaacagatcactgtgctgtccttcctaggggtgcaggaagtggacagggcggagggtttgaaagaatattgagccaaagcccaggctccctttgggaatcatgttagcccatcagaatgttgaaggattgaagagttctaagcataaaataagtggcattttctgacttcttcctcctcctccttccctgactcacagaaggaatgcaatcacccagcaagtcctacctgttacgcaattttttatctcaaaatgccgaacgagaaaactgtccattttctgagacccccagaaaggaaactgaccctcagcagctgcctgattgttacgcgaatctagctttaacggaagcaaattcattattttttaaatgcagtggacttttcaaaaagtttaaattaggcaaagcagctttagcctcatagaatattatttctttggactcaagctgaaatacaagccttacattgccttatgctttatttctttctaatttttatatgtatatagatgagggttccttaatggttgtgagcattgtgtggaattttacacctggcctgcgtggcagcctcttccagttgaggtgttttatgtcacgcacactccatcccagtgtacaaaacctgcttctcttctcaaccgtggcagctcccgctggctcctatgccctgccctaaagggctcttgagcctctgggaatgggaggggccaagagaaggaaaaccctgtctttagcaccctttaaaagaactgtgccccccttctcagtgctgcctttgcatgggcctggcccggctcacattcgtcagtgactccaaccctcctgcttgctgtacttgggatgaaacgaccccacaggtcaggtggagggtggggcgtgggcatcagccaggattgccgttacagtctttttctcaggagctacaaagatctcttcctgttactaaatagtcgcaccccagcagcctctctcgcacaccggggccctgcatgtcagatggcgtggtctgcagggggagctctgtgccttagtggctcttggcaggacactgagggcctgcctgtggtgtgcccggctctgccactcccgggaggggaagggctgctcagctcaaggtgtcctgttcggtagagcaagtgtcctctgacagccgtgtccccggacagttcagacacccttggggatggcactccacacacgacagagatgcaggggccagggaagcccagcgctcggtgcccttcgtccagggttaaaatcggcctgtggggtgtggtgagaaggcaggttgtgcgggtgttgaccgatgtatcttttccttaaagttattataataatgggtaatttgtcaataaagcattcctttgggggaaagtccgcc

SEQ ID NO: 33249 - DNA, 2297 bp, Homo sapiens
acgcggcgagcttctcccggcgccgcccgctcggctcccatagcgcccgcgacagcggtccggacgccgcccgaacatggactccgccggccaagatatcaacctgaattctcctaacaaaggtctgctgtctgactccatgacggatgttcctgtcgacacaggtgtggctgcccggactcctgctgttgagggtctgacagaggctgaggaggaggagctcagggctgagcttaccaaggtggaagaggaaattgtcactctgcgccaggtcctggcagccaaggagaggcactgtggagagctcaagaggaggctgggcctctccaccctgggggagctgaaacagaacctgtccaggagctggcatgacgtgcaggtctctagcgcctatgtgaaaacttctgagaaacttggagagtggaatgagaaagtgacccagtcagacctctacaagaagactcaggaaactctttcacaggcaggacagaagacttcagctgccctgtccacagtgggctctgccatcagcaggaagcttggagacatgaggaactctgcgaccttcaagtcgtttgaggaccgagttgggaccataaagtctaaggttgtgggtgacagagagaacggcagtgacaacctcccttcctcagcggggagtggtgacaagcccctgtcggatcccgcacctttctaagcctgtggttgcttcacccgctgcagagcacacgcaacccagcctcagcatcacagccgcagctctgttcagcggagcagccagccagggcggatgagcagagccggccctgaggacagtcctgcccatccacgcggagatgtggctgccgcgtttgcatgaatttgaagaacacaggcttgtacacagatgttttacactcacgtttgtagatgaaacagatcactgtgctgtccttcctaggggtgcaggaagtggacagggcggagggtttgaaagaatattgagccaaagcccaggctccctttgggaatcatgttagcccatcagaatgttgaaggattgaagagttctaagcataaaataagtggcattttctgacttcttcctcctcctccttccctgactcacagaaggaatgcaatcacccagcaagtcctacctgttacgcaattttttatctcaaaatgccgaacgagaaaactgtccattttctgagacccccagaaaggaaactgaccctcagcagctgcctgattgttacgcgaatctagctttaacggaagcaaattcattattttttaaatgcagtggacttttcaaaaagtttaaattaggcaaagcagctttagcctcatagaatattatttctttggactcaagctgaaatacaagccttacattgccttatgctttatttctttctaatttttatatgtatatagatgagggttccttaatggttgtgagcattgtgtggaattttacacctggcctgcgtggcagcctcttccagttgaggtgttttatgtcacgcacactccatcccagtgtacaaaacctgcttctcttctcaaccgtggcagctcccgctggctcctatgccctgccctaaagggctcttgagcctctgggaatgggaggggccaagagaaggaaaaccctgtctttagcaccctttaaaagaactgtgccccccttctcagtgctgcctttgcatgggcctggcccggctcacattcgtcagtgactccaaccctcctgcttgctgtacttgggatgaaacgaccccacaggtcaggtggagggtggggcgtgggcatcagccaggattgccgttacagtctttttctcaggagctacaaagatctcttcctgttactaaatagtcgcaccccagcagcctctctcgcacaccggggccctgcatgtcagatggcgtggtctgcagggggagctctgtgccttagtggctcttggcaggacactgagggcctgcctgtggtgtgcccggctctgccactcccgggaggggaagggctgctcagctcaaggtgtcctgttcggtagagcaagtgtcctctgacagccgtgtccccggacagttcagacacccttggggatggcactccacacacgacagagatgcaggggccagggaagcccagcgctcggtgcccttcgtccagggttaaaatcggcctgtggggtgtggtgagaaggcaggttgtgcgggtgttgaccgatgtatcttttccttaaagttattataataatgggtaatttgtcaataaagcattcctttgggggaaagtccgcc

SEQ ID NO: 33250 - DNA, 2237 bp, Homo sapiens
acgcggcgagcttctcccggcgccgcccgctcggctcccatagcgcccgcgacagcggtccggacgccgcccgaacatggactccgccggccaagatatcaacctgaattctcctaacaaaggtctgctgtctgactccatgacggatgttcctgtcgacacaggtgtggctgcccggactcctgctgttgagggtctgacagaggctgaggaggaggagctcagggctgagcttaccaaggtggaagaggaaattgtcactctgcgccaggtcctggcagccaaggagaggcactgtggagagctcaagaggaggctgggcctctccaccctgggggagctgaaacagaacctgtccaggagctggcatgacgtgcaggtctctagcgcctacaagaagactcaggaaactctttcacaggcaggacagaagacttcagctgccctgtccacagtgggctctgccatcagcaggaagcttggagacatgaggaactctgcgaccttcaagtcgtttgaggaccgagttgggaccataaagtctaaggttgtgggtgacagagagaacggcagtgacaacctcccttcctcagcggggagtggtgacaagcccctgtcggatcccgcacctttctaagcctgtggttgcttcacccgctgcagagcacacgcaacccagcctcagcatcacagccgcagctctgttcagcggagcagccagccagggcggatgagcagagccggccctgaggacagtcctgcccatccacgcggagatgtggctgccgcgtttgcatgaatttgaagaacacaggcttgtacacagatgttttacactcacgtttgtagatgaaacagatcactgtgctgtccttcctaggggtgcaggaagtggacagggcggagggtttgaaagaatattgagccaaagcccaggctccctttgggaatcatgttagcccatcagaatgttgaaggattgaagagttctaagcataaaataagtggcattttctgacttcttcctcctcctccttccctgactcacagaaggaatgcaatcacccagcaagtcctacctgttacgcaattttttatctcaaaatgccgaacgagaaaactgtccattttctgagacccccagaaaggaaactgaccctcagcagctgcctgattgttacgcgaatctagctttaacggaagcaaattcattattttttaaatgcagtggacttttcaaaaagtttaaattaggcaaagcagctttagcctcatagaatattatttctttggactcaagctgaaatacaagccttacattgccttatgctttatttctttctaatttttatatgtatatagatgagggttccttaatggttgtgagcattgtgtggaattttacacctggcctgcgtggcagcctcttccagttgaggtgttttatgtcacgcacactccatcccagtgtacaaaacctgcttctcttctcaaccgtggcagctcccgctggctcctatgccctgccctaaagggctcttgagcctctgggaatgggaggggccaagagaaggaaaaccctgtctttagcaccctttaaaagaactgtgccccccttctcagtgctgcctttgcatgggcctggcccggctcacattcgtcagtgactccaaccctcctgcttgctgtacttgggatgaaacgaccccacaggtcaggtggagggtggggcgtgggcatcagccaggattgccgttacagtctttttctcaggagctacaaagatctcttcctgttactaaatagtcgcaccccagcagcctctctcgcacaccggggccctgcatgtcagatggcgtggtctgcagggggagctctgtgccttagtggctcttggcaggacactgagggcctgcctgtggtgtgcccggctctgccactcccgggaggggaagggctgctcagctcaaggtgtcctgttcggtagagcaagtgtcctctgacagccgtgtccccggacagttcagacacccttggggatggcactccacacacgacagagatgcaggggccagggaagcccagcgctcggtgcccttcgtccagggttaaaatcggcctgtggggtgtggtgagaaggcaggttgtgcgggtgttgaccgatgtatcttttccttaaagttattataataatgggtaatttgtcaataaagcattcctttgggggaaagtccgcc

SEQ ID NO: 33251 - DNA, 2302 bp, Homo sapiens
ggcgagcttctcccggcgccgcccgctcggctcccatagcgcccgcgacagcggtccggacgccgcccgaacatggactccgccggccaagatatcaacctgaattctcctaacaaaggtctgctgtctgactccatgacggatgttcctgtcgacacaggtgtggctgcccggactcctgctgttgagggtctgacagaggctgaggaggaggagctcagggctgagcttaccaaggtggaagaggaaattgtcactctgcgccaggtcctggcagccaaggagaggcactgtggagagctcaagaggaggctgggcctctccaccctgggggagctgaaacagaacctgtccaggagctggcatgacgtgcaggtctctagcgcctacaagaagactcaggaaactctttcacaggcaggacagaagacttcagctgccctgtccacagtgggctctgccatcagcaggaagcttggagacatgagggctcatccattttcacactcctttagcagctactccatccgccactcaataagtatgccagccatgaggaactctgcgaccttcaagtcgtttgaggaccgagttgggaccataaagtctaaggttgtgggtgacagagagaacggcagtgacaacctcccttcctcagcggggagtggtgacaagcccctgtcggatcccgcacctttctaagcctgtggttgcttcacccgctgcagagcacacgcaacccagcctcagcatcacagccgcagctctgttcagcggagcagccagccagggcggatgagcagagccggccctgaggacagtcctgcccatccacgcggagatgtggctgccgcgtttgcatgaatttgaagaacacaggcttgtacacagatgttttacactcacgtttgtagatgaaacagatcactgtgctgtccttcctaggggtgcaggaagtggacagggcggagggtttgaaagaatattgagccaaagcccaggctccctttgggaatcatgttagcccatcagaatgttgaaggattgaagagttctaagcataaaataagtggcattttctgacttcttcctcctcctccttccctgactcacagaaggaatgcaatcacccagcaagtcctacctgttacgcaattttttatctcaaaatgccgaacgagaaaactgtccattttctgagacccccagaaaggaaactgaccctcagcagctgcctgattgttacgcgaatctagctttaacggaagcaaattcattattttttaaatgcagtggacttttcaaaaagtttaaattaggcaaagcagctttagcctcatagaatattatttctttggactcaagctgaaatacaagccttacattgccttatgctttatttctttctaatttttatatgtatatagatgagggttccttaatggttgtgagcattgtgtggaattttacacctggcctgcgtggcagcctcttccagttgaggtgttttatgtcacgcacactccatcccagtgtacaaaacctgcttctcttctcaaccgtggcagctcccgctggctcctatgccctgccctaaagggctcttgagcctctgggaatgggaggggccaagagaaggaaaaccctgtctttagcaccctttaaaagaactgtgccccccttctcagtgctgcctttgcatgggcctggcccggctcacattcgtcagtgactccaaccctcctgcttgctgtacttgggatgaaacgaccccacaggtcaggtggagggtggggcgtgggcatcagccaggattgccgttacagtctttttctcaggagctacaaagatctcttcctgttactaaatagtcgcaccccagcagcctctctcgcacaccggggccctgcatgtcagatggcgtggtctgcagggggagctctgtgccttagtggctcttggcaggacactgagggcctgcctgtggtgtgcccggctctgccactcccgggaggggaagggctgctcagctcaaggtgtcctgttcggtagagcaagtgtcctctgacagccgtgtccccggacagttcagacacccttggggatggcactccacacacgacagagatgcaggggccagggaagcccagcgctcggtgcccttcgtccagggttaaaatcggcctgtggggtgtggtgagaaggcaggttgtgcgggtgttgaccgatgtatcttttccttaaagttattataataatgggtaatttgtcaataaagcattcctttgggggaaagtccgcc

SEQ ID NO: 33252 - DNA, 2339 bp, Homo sapiens
acgcggcgagcttctcccggcgccgcccgctcggctcccatagcgcccgcgacagcggtccggacgccgcccgaacatggactccgccggccaagatatcaacctgaattctcctaacaaaggtctgctgtctgactccatgacggatgttcctgtcgacacaggtgtggctgcccggactcctgctgttgagggtctgacagaggctgaggaggaggagctcagggctgagcttaccaaggtggaagaggaaattgtcactctgcgccaggtcctggcagccaaggagaggcactgtggagagctcaagaggaggctgggcctctccaccctgggggagctgaaacagaacctgtccaggagctggcatgacgtgcaggtctctagcgcctatgtgaaaacttctgagaaacttggagagtggaatgagaaagtgacccagtcagacctctacaagaagactcaggaaactctttcacaggcaggacagaagacttcagctgccctgtccacagtgggctctgccatcagcaggaagcttggagacatgagcagctactccatccgccactcaataagtatgccagccatgaggaactctgcgaccttcaagtcgtttgaggaccgagttgggaccataaagtctaaggttgtgggtgacagagagaacggcagtgacaacctcccttcctcagcggggagtggtgacaagcccctgtcggatcccgcacctttctaagcctgtggttgcttcacccgctgcagagcacacgcaacccagcctcagcatcacagccgcagctctgttcagcggagcagccagccagggcggatgagcagagccggccctgaggacagtcctgcccatccacgcggagatgtggctgccgcgtttgcatgaatttgaagaacacaggcttgtacacagatgttttacactcacgtttgtagatgaaacagatcactgtgctgtccttcctaggggtgcaggaagtggacagggcggagggtttgaaagaatattgagccaaagcccaggctccctttgggaatcatgttagcccatcagaatgttgaaggattgaagagttctaagcataaaataagtggcattttctgacttcttcctcctcctccttccctgactcacagaaggaatgcaatcacccagcaagtcctacctgttacgcaattttttatctcaaaatgccgaacgagaaaactgtccattttctgagacccccagaaaggaaactgaccctcagcagctgcctgattgttacgcgaatctagctttaacggaagcaaattcattattttttaaatgcagtggacttttcaaaaagtttaaattaggcaaagcagctttagcctcatagaatattatttctttggactcaagctgaaatacaagccttacattgccttatgctttatttctttctaatttttatatgtatatagatgagggttccttaatggttgtgagcattgtgtggaattttacacctggcctgcgtggcagcctcttccagttgaggtgttttatgtcacgcacactccatcccagtgtacaaaacctgcttctcttctcaaccgtggcagctcccgctggctcctatgccctgccctaaagggctcttgagcctctgggaatgggaggggccaagagaaggaaaaccctgtctttagcaccctttaaaagaactgtgccccccttctcagtgctgcctttgcatgggcctggcccggctcacattcgtcagtgactccaaccctcctgcttgctgtacttgggatgaaacgaccccacaggtcaggtggagggtggggcgtgggcatcagccaggattgccgttacagtctttttctcaggagctacaaagatctcttcctgttactaaatagtcgcaccccagcagcctctctcgcacaccggggccctgcatgtcagatggcgtggtctgcagggggagctctgtgccttagtggctcttggcaggacactgagggcctgcctgtggtgtgcccggctctgccactcccgggaggggaagggctgctcagctcaaggtgtcctgttcggtagagcaagtgtcctctgacagccgtgtccccggacagttcagacacccttggggatggcactccacacacgacagagatgcaggggccagggaagcccagcgctcggtgcccttcgtccagggttaaaatcggcctgtggggtgtggtgagaaggcaggttgtgcgggtgttgaccgatgtatcttttccttaaagttattataataatgggtaatttgtcaataaagcattcctttgggggaaagtccgcc

SEQ ID NO: 33253 - DNA, 2275 bp, Homo sapiens
ggcgagcttctcccggcgccgcccgctcggctcccatagcgcccgcgacagcggtccggacgccgcccgaacatggactccgccggccaagatatcaacctgaattctcctaacaaaggtctgctgtctgactccatgacggatgttcctgtcgacacaggtgtggctgcccggactcctgctgttgagggtctgacagaggctgaggaggaggagctcagggctgagcttaccaaggtggaagaggaaattgtcactctgcgccaggtcctggcagccaaggagaggcactgtggagagctcaagaggaggctgggcctctccaccctgggggagctgaaacagaacctgtccaggagctggcatgacgtgcaggtctctagcgcctacaagaagactcaggaaactctttcacaggcaggacagaagacttcagctgccctgtccacagtgggctctgccatcagcaggaagcttggagacatgagcagctactccatccgccactcaataagtatgccagccatgaggaactctgcgaccttcaagtcgtttgaggaccgagttgggaccataaagtctaaggttgtgggtgacagagagaacggcagtgacaacctcccttcctcagcggggagtggtgacaagcccctgtcggatcccgcacctttctaagcctgtggttgcttcacccgctgcagagcacacgcaacccagcctcagcatcacagccgcagctctgttcagcggagcagccagccagggcggatgagcagagccggccctgaggacagtcctgcccatccacgcggagatgtggctgccgcgtttgcatgaatttgaagaacacaggcttgtacacagatgttttacactcacgtttgtagatgaaacagatcactgtgctgtccttcctaggggtgcaggaagtggacagggcggagggtttgaaagaatattgagccaaagcccaggctccctttgggaatcatgttagcccatcagaatgttgaaggattgaagagttctaagcataaaataagtggcattttctgacttcttcctcctcctccttccctgactcacagaaggaatgcaatcacccagcaagtcctacctgttacgcaattttttatctcaaaatgccgaacgagaaaactgtccattttctgagacccccagaaaggaaactgaccctcagcagctgcctgattgttacgcgaatctagctttaacggaagcaaattcattattttttaaatgcagtggacttttcaaaaagtttaaattaggcaaagcagctttagcctcatagaatattatttctttggactcaagctgaaatacaagccttacattgccttatgctttatttctttctaatttttatatgtatatagatgagggttccttaatggttgtgagcattgtgtggaattttacacctggcctgcgtggcagcctcttccagttgaggtgttttatgtcacgcacactccatcccagtgtacaaaacctgcttctcttctcaaccgtggcagctcccgctggctcctatgccctgccctaaagggctcttgagcctctgggaatgggaggggccaagagaaggaaaaccctgtctttagcaccctttaaaagaactgtgccccccttctcagtgctgcctttgcatgggcctggcccggctcacattcgtcagtgactccaaccctcctgcttgctgtacttgggatgaaacgaccccacaggtcaggtggagggtggggcgtgggcatcagccaggattgccgttacagtctttttctcaggagctacaaagatctcttcctgttactaaatagtcgcaccccagcagcctctctcgcacaccggggccctgcatgtcagatggcgtggtctgcagggggagctctgtgccttagtggctcttggcaggacactgagggcctgcctgtggtgtgcccggctctgccactcccgggaggggaagggctgctcagctcaaggtgtcctgttcggtagagcaagtgtcctctgacagccgtgtccccggacagttcagacacccttggggatggcactccacacacgacagagatgcaggggccagggaagcccagcgctcggtgcccttcgtccagggttaaaatcggcctgtggggtgtggtgagaaggcaggttgtgcgggtgttgaccgatgtatcttttccttaaagttattataataatgggtaatttgtcaataaagcattcctttgggggaaagtccgcc

SEQ ID NO: 33254 - DNA, 1063 bp, Homo sapiens
gattacgaaacgccgcggagctgaggcagttccgctggctagtgtgtacgcggcgagcttctcccggcgccgcccgctcggctcccatagcgcccgcgacagcggtccggacgccgcccgaacatggactccgccggccaaggtgtggctgcccggactcctgctgttgagggtctgacagaggctgaggaggaggagctcagggctgagcttaccaaggtggaagaggaaattgtcactctgcgccaggtcctggcagccaaggagaggcactgtggagagctcaagaggaggctgggcctctccaccctgggggagctgaaacagaacctgtccaggagctggcatgacgtgcaggtctctagcgcctacaagaagactcaggaaactctttcacaggcaggacagaagacttcagctgccctgtccacagtgggctctgccatcagcaggaagcttggagacatgaggaactctgcgaccttcaagtcgtttgaggaccgagttgggaccataaagtctaaggttgtgggtgacagagagaacggcagtgacaacctcccttcctcagcggggagtggtgacaagcccctgtcggatcccgcacctttctaagcctgtggttgcttcacccgctgcagagcacacgcaacccagcctcagcatcacagccgcagctctgttcagcggagcagccagccagggcggatgagcagagccggccctgaggacagtcctgcccatgaatttgaagaacacaggcttgtacacagatgttttacactcacgtttgtagatgaaacagatcactgtgctgtccttcctaggggtgcaggaagtggacagggcggagggtttgaaagaatattgagccaaagcccaggctccctttgggaatcatgttagcccatcagaatgttgaaggattgaagagttctaagcataaaataagtggcattttctgacttcttcctcctcctccttccctgactcacagaaggaatgcaatcacccagcaagtcctacctgttacgcaattttttatctcaaaatgccgaacgag

SEQ ID NO: 33255 - DNA, 4651 bp, Homo sapiens
gctggggcccgacccgggattagttggtttcggagcggaggagggagccccgaccgtcacgagcgtcgaagagacaaagccgcgtcagggggcccggccggggcgggggagcccggggcttgttggtgccccagcccgcgcggagggcccttcggacccgcgcgccgccgctgccgccgccgccgcctcgcaacaggtccgggcggcctcgctctccgctcccctcccccgcatccgcgaccctccggggcacctcagctcggccggggccgcagtctggccacccgcttccatgcggttcgggtccaagatgatgccgatgtttcttaccgtgtatctcagtaacaatgagcagcacttcacagaagttccagttactccagaaacaatatgcagagacgtggtggatctgtgcaaagaacccggcgagagtgattgccatttggctgaagtgtggtgtggctctgaacgtccagttgcggataatgagcgaatgtttgatgttcttcaacgatttggaagtcagaggaacgaagttcgcttcttccttcgtcatgaacgcccccctggcagggacattgtgagtggaccaagatctcaggatccaagtttaaaaagaaatggtgtaaaagttcctggtgaatatcgaagaaaggagaacggtgttaatagtcctaggatggatctgactcttgctgaacttcaggaaatggcatctcgccagcagcaacagattgaagcccagcaacaattgctggcaactaaggaacagcgcttaaagtttttgaaacaacaagatcagcgacaacagcaacaagttgctgagcaggagaaacttaaaaggctaaaagaaatagctgagaatcaggaagctaagctaaaaaaagtgagagcacttaaaggccacgtggaacagaagagactaagcaatgggaaacttgtggaggaaattgaacagatgaataatttgttccagcaaaaacagagggagctcgtcctggctgtgtcaaaagtagaagaactgaccaggcagctagagatgctcaagaacggcaggatcgacagccaccatgacaatcagtctgcagtggctgagcttgatcgcctctataaggagctgcagctaagaaacaaattgaatcaagagcagaatgccaagctacaacaacagagggagtgtttgaataagcgtaattcagaagtggcagtcatggataagcgtgttaatgagctgagggaccggctgtggaagaagaaggcagctctacagcaaaaagaaaatctaccagtttcatctgatggaaatcttccccagcaagccgcgtcagccccaagccgtgtggctgcagtaggtccctatatccagtcgtctactatgcctcggatgccctcaaggcctgaattgctggtgaagccagccctgccggatggttccttggtcattcaggcttcagaggggccgatgaaaatacagacactgcccaacatgagatctggggctgcttcacaaactaaaggctctaaaatccatccagttggccctgattggagtccttcaaatgcagatcttttcccaagccaaggctctgcttctgtacctcaaagcactgggaatgctctggatcaagttgatgatggagaggttccgctgagggagaaagagaagaaagtgcgtccgttctcaatgtttgatgcagtagaccagtccaatgccccaccttcctttggtactctgaggaagaaccagagcagtgaagatatcttgcgggatgctcaggttgcaaataaaaatgtggctaaagtaccacctcctgttcctacaaaaccaaaacagattaatttgccttattttggacaaactaatcagccaccttcagacattaagccagacggaagttctcagcagttgtcaacagttgttccgtccatgggaactaaaccaaaaccagcagggcagcagccgagagtgctgctatctcccagcataccttcggttggccaagaccagaccctttctccaggttctaagcaagaaagtccacctgctgctgccgtccggccctttactccccagccttccaaagacaccttacttccacccttcagaaaaccccagaccgtggcagcaagttcaatatattccatgtatacgcaacagcaggcgccaggaaaaaacttccagcaggctgtgcagagcgcgttgaccaagactcataccagagggccacacttttcaagtgtatatggtaagcctgtaattgctgctgcccagaatcaacagcagcacccagagaacatttattccaatagccagggcaagcctggcagtccagaacctgaaacagagcctgtttcttcagttcaggagaaccatgaaaacgaaagaattcctcggccactcagcccaactaaattactgcctttcttatctaatccttaccgaaaccagagtgatgctgacctagaagccttacgaaagaaactgtctaacgcaccaaggcctctaaagaaacgtagttctattacagagccagagggtcctaatgggccaaatattcagaagcttttatatcagaggaccaccatagcggccatggagaccatctctgtcccatcatacccatccaagtcagcttctgtgactgccagctcagaaagcccagtagaaatccagaatccatatttacatgtggagcccgaaaaggaggtggtctctctggttcctgaatcattgtccccagaggatgtggggaatgccagtacagagaacagtgacatgccagctccttctccaggccttgattatgagcctgagggagtcccagacaacagcccaaatctccagaataacccagaagaaccaaatccagaggctccacatgtgcttgatgtgtacctggaggagtaccctccatacccacccccaccatacccatctggggagcctgaagggcccggagaagactcggtgagcatgcgcccgcctgaaatcaccgggcaggtctctctgcctcctggtaaaaggacaaacttgcgtaaaactggctcagagcgtatcgctcatggaatgagggtgaaattcaacccccttgctttactgctagattcgtctttggagggagaatttgaccttgtacagagaattatttatgaggttgatgacccaagcctccccaatgatgaaggcatcacggctcttcacaatgctgtgtgtgcaggccacacagaaatcgttaagttcctggtacagtttggtgtaaatgtaaatgctgctgatagtgatggatggactccattacattgtgctgcctcatgtaacaacgtccaagtgtgtaagtttttggtggagtcaggagccgctgtgtttgccatgacctacagtgacatgcagactgctgcagataagtgcgaggaaatggaggaaggctacactcagtgctcccaatttctttatggagttcaggagaagatgggcataatgaataaaggagtcatttatgcgctttgggattatgaacctcagaatgatgatgagctgcccatgaaagaaggagactgcatgacaatcatccacagggaagacgaagatgaaatcgaatggtggtgggcgcgccttaatgataaggagggatatgttccacgtaacttgctgggactgtacccaagaattaaaccaagacaaaggagcttggcctgaaacttccacacagaattttagtcaatgaagaattaatctctgttaagaagaagtaatacgattatttttggcaaaaatttcacaagacttattttaatgacaatgtagcttgaaagcgatgaagaatgtctctagaagagaatgaaggattgaagaattcaccattagaggacatttagcgtgatgaaataaagcatctacgtcagcaggccatactgtgttggggcaaaggtgtcccgtgtagcactcagataagtatacagcgacaatcctgttttctacaagaatcctgtctagtaaataggatcatttattgggcagttgggaaatcagctctctgtcctgttgagtgttttcagcagctgctcctaaaccagtcctcctgccagaaaggaccagtgccgtcacatcgctgtctctgattgtccccggcaccagcaggcccttggggggctcacctgaaggctcgaaggcactgcacacttgtatattgtcagtgaagaactgttagttggttgtcagtgaacaataactttattatatgagtttttgtagcatcttaagaattatacatatgtttgaaatattgaaactaagctacggtaccagtaattagatgtagaatcttgtttgtaggctgaattttaatctgtatttattgtcttttgtatctcagaaattagaaacttgctacagacttacccgtaatatttgtcaagatcatagctgactttaaaaacagttgtaataaactttttgatgctagctgtttactggtttttgtttttgatgtcataaatagaccttgtttaatagtcacaagccgttgggatatcatacccagctgaaaaagaacaaactgcttaacataagtatatgtatcgtaataagagttttttaccagctaagtgattcaatgtaagtggtttttaaaataaaatactgtagagatca

SEQ ID NO: 33256 - DNA, 4741 bp, Homo sapiens
gggagccccgaccgtcacgagcgtcgaagagacaaagccgcgtcagggggcccggccggggcgggggagcccggggcttgttggtgccccagcccgcgcggagggcccttcggacccgcgcgccgccgctgccgccgccgccgcctcgcaacaggtccgggcggcctcgctctccgctcccctcccccgcatccgcgaccctccggggcacctcagctcggccggggccgcagtctggccacccgcttccatgcggttcgggtccaagatgatgccgatgtttcttaccgtgtatctcagtaacaatgagcagcacttcacagaagttccagttactccagaaacaatatgcagagacgtggtggatctgtgcaaagaacccggcgagagtgattgccatttggctgaagtgtggtgtggctctgtagagatagagtttcatcatgttggccaggatggtctcgatctcctgaccttgtgatccgcctgcctcggcctcccaaagtgctggattacaggtgtgagccaccacgatcagcctctagtgtttaaaaaagaacgtccagttgcggataatgagcgaatgtttgatgttcttcaacgatttggaagtcagaggaacgaagttcgcttcttccttcgtcatgaacgcccccctggcagggacattgtgagtggaccaagatctcaggatccaagtttaaaaagaaatggtgtaaaagttcctggtgaatatcgaagaaaggagaacggtgttaatagtcctaggatggatctgactcttgctgaacttcaggaaatggcatctcgccagcagcaacagattgaagcccagcaacaattgctggcaactaaggaacagcgcttaaagtttttgaaacaacaagatcagcgacaacagcaacaagttgctgagcaggagaaacttaaaaggctaaaagaaatagctgagaatcaggaagctaagctaaaaaaagtgagagcacttaaaggccacgtggaacagaagagactaagcaatgggaaacttgtggaggaaattgaacagatgaataatttgttccagcaaaaacagagggagctcgtcctggctgtgtcaaaagtagaagaactgaccaggcagctagagatgctcaagaacggcaggatcgacagccaccatgacaatcagtctgcagtggctgagcttgatcgcctctataaggagctgcagctaagaaacaaattgaatcaagagcagaatgccaagctacaacaacagagggagtgtttgaataagcgtaattcagaagtggcagtcatggataagcgtgttaatgagctgagggaccggctgtggaagaagaaggcagctctacagcaaaaagaaaatctaccagtttcatctgatggaaatcttccccagcaagccgcgtcagccccaagccgtgtggctgcagtaggtccctatatccagtcgtctactatgcctcggatgccctcaaggcctgaattgctggtgaagccagccctgccggatggttccttggtcattcaggcttcagaggggccgatgaaaatacagacactgcccaacatgagatctggggctgcttcacaaactaaaggctctaaaatccatccagttggccctgattggagtccttcaaatgcagatcttttcccaagccaaggctctgcttctgtacctcaaagcactgggaatgctctggatcaagttgatgatggagaggttccgctgagggagaaagagaagaaagtgcgtccgttctcaatgtttgatgcagtagaccagtccaatgccccaccttcctttggtactctgaggaagaaccagagcagtgaagatatcttgcgggatgctcaggttgcaaataaaaatgtggctaaagtaccacctcctgttcctacaaaaccaaaacagattaatttgccttattttggacaaactaatcagccaccttcagacattaagccagacggaagttctcagcagttgtcaacagttgttccgtccatgggaactaaaccaaaaccagcagggcagcagccgagagtgctgctatctcccagcataccttcggttggccaagaccagaccctttctccaggttctaagcaagaaagtccacctgctgctgccgtccggccctttactccccagccttccaaagacaccttacttccacccttcagaaaaccccagaccgtggcagcaagttcaatatattccatgtatacgcaacagcaggcgccaggaaaaaacttccagcaggctgtgcagagcgcgttgaccaagactcataccagagggccacacttttcaagtgtatatggtaagcctgtaattgctgctgcccagaatcaacagcagcacccagagaacatttattccaatagccagggcaagcctggcagtccagaacctgaaacagagcctgtttcttcagttcaggagaaccatgaaaacgaaagaattcctcggccactcagcccaactaaattactgcctttcttatctaatccttaccgaaaccagagtgatgctgacctagaagccttacgaaagaaactgtctaacgcaccaaggcctctaaagaaacgtagttctattacagagccagagggtcctaatgggccaaatattcagaagcttttatatcagaggaccaccatagcggccatggagaccatctctgtcccatcatacccatccaagtcagcttctgtgactgccagctcagaaagcccagtagaaatccagaatccatatttacatgtggagcccgaaaaggaggtggtctctctggttcctgaatcattgtccccagaggatgtggggaatgccagtacagagaacagtgacatgccagctccttctccaggccttgattatgagcctgagggagtcccagacaacagcccaaatctccagaataacccagaagaaccaaatccagaggctccacatgtgcttgatgtgtacctggaggagtaccctccatacccacccccaccatacccatctggggagcctgaagggcccggagaagactcggtgagcatgcgcccgcctgaaatcaccgggcaggtctctctgcctcctggtaaaaggacaaacttgcgtaaaactggctcagagcgtatcgctcatggaatgagggtgaaattcaacccccttgctttactgctagattcgtctttggagggagaatttgaccttgtacagagaattatttatgaggttgatgacccaagcctccccaatgatgaaggcatcacggctcttcacaatgctgtgtgtgcaggccacacagaaatcgttaagttcctggtacagtttggtgtaaatgtaaatgctgctgatagtgatggatggactccattacattgtgctgcctcatgtaacaacgtccaagtgtgtaagtttttggtggagtcaggagccgctgtgtttgccatgacctacagtgacatgcagactgctgcagataagtgcgaggaaatggaggaaggctacactcagtgctcccaatttctttatggagttcaggagaagatgggcataatgaataaaggagtcatttatgcgctttgggattatgaacctcagaatgatgatgagctgcccatgaaagaaggagactgcatgacaatcatccacagggaagacgaagatgaaatcgaatggtggtgggcgcgccttaatgataaggagggatatgttccacgtaacttgctgggactgtacccaagaattaaaccaagacaaaggagcttggcctgaaacttccacacagaattttagtcaatgaagaattaatctctgttaagaagaagtaatacgattatttttggcaaaaatttcacaagacttattttaatgacaatgtagcttgaaagcgatgaagaatgtctctagaagagaatgaaggattgaagaattcaccattagaggacatttagcgtgatgaaataaagcatctacgtcagcaggccatactgtgttggggcaaaggtgtcccgtgtagcactcagataagtatacagcgacaatcctgttttctacaagaatcctgtctagtaaataggatcatttattgggcagttgggaaatcagctctctgtcctgttgagtgttttcagcagctgctcctaaaccagtcctcctgccagaaaggaccagtgccgtcacatcgctgtctctgattgtccccggcaccagcaggcccttggggggctcacctgaaggctcgaaggcactgcacacttgtatattgtcagtgaagaactgttagttggttgtcagtgaacaataactttattatatgagtttttgtagcatcttaagaattatacatatgtttgaaatattgaaactaagctacggtaccagtaattagatgtagaatcttgtttgtaggctgaattttaatctgtatttattgtcttttgtatctcagaaattagaaacttgctacagacttacccgtaatatttgtcaagatcatagctgactttaaaaacagttgtaataaactttttgatgctagctgtttactggtttttgtttttgatgtcataaatagaccttgtttaatagtcacaagccgttgggatatcatacccagctgaaaaagaacaaactgcttaacataagtatatgtatcgtaataagagttttttaccagctaagtgattcaatgtaagtggtttttaaaataaaatactgtagagatca

SEQ ID NO: 33257 - DNA, 1841 bp, Homo sapiens
aaagcactgggaatgctctggatcaagttgatgatggagaggttccgctgagggagaaagagaagaaagtgcgtccgttctcaatgtttgatgcagtagaccagtccaatgccccaccttcctttggtactctgaggaagaaccagagcagtgaagatatcttgcgggatgctcagtatatggtaagcctgtaattgctgctgcccagaatcaacagcagcacccagagaacatttattccaatagccagggcaagcctggcagtccagaacctgaaacagagcctgtttcttcagttcaggagaaccatgaaaacgaaagaattcctcggccactcagcccaactaaattactgcctttcttatctaatccttaccgaaaccagagtgatgctgacctagaagccttacgaaagaaactgtctaacgcaccaaggcctctaaagaaacgtagttctattacagagccagagggtcctaatgggccaaatattcagaagcttttatatcagaggaccaccatagcggccatggagaccatctctgtcccatcatacccatccaagtcagcttctgtgactgccagctcagaaagcccagtagaaatccagaatccatatttacatgtggagcccgaaaaggaggtggtctctctggttcctgaatcattgtccccagaggatgtggggaatgccagtacagagaacagtgacatgccagctccttctccaggccttgattatgagcctgagggagtcccagacaacagcccaaatctccagaataacccagaagaaccaaatccagaggctccacatgtgcttgatgtgtacctggaggagtaccctccatacccacccccaccatacccatctggggagcctgaagggcccggagaagactcggtgagcatgcgcccgcctgaaatcaccgggcaggtctctctgcctcctggtaaaaggacaaacttgcgtaaaactggctcagagcgtatcgctcatggaatgagggtgaaattcaacccccttgctttactgctagattcgtctttggagggagaatttgaccttgtacagagaattatttatgaggttgatgacccaagcctccccaatgatgaaggcatcacggctcttcacaatgctgtgtgtgcaggccacacagaaatcgttaagttcctggtacagtttggtgtaaatgtaaatgctgctgatagtgatggatggactccattacattgtgctgcctcatgtaacaacgtccaagtgtgtaagtttttggtggagtcaggagccgctgtgtttgccatgacctacagtgacatgcagactgctgcagataagtgcgaggaaatggaggaaggctacactcagtgctcccaatttctttatggagttcaggagaagatgggcataatgaataaaggagtcatttatgcgctttgggattatgaacctcagaatgatgatgagctgcccatgaaagaaggagactgcatgacaatcatccacagggaagacgaagatgaaatcgaatggtggtgggcgcgccttaatgataaggagggatatgttccacgtaacttgctgggactgtacccaagaattaaaccaagacaaaggagcttggcctgaaacttccacacagaattttagtcaatgaagaattaatctctgttaagaagaagtaatacgattatttttggcaaaaatttcacaagacttattttaatgacaatgtagcttgaaagcgatgaagaatgtctctagaagagaatgaaggattgaagaattcaccattagaggacatttagcgtgatgaaataaagcatctacgtcagca

SEQ ID NO: 33258 - DNA, 4909 bp, Homo sapiens
cccggctttatatctatatatacacaggtatatgtgtatattttatataattgttctccgttcgttgatatcaaagacagttgaaggaaatgaattttgaaacttcacggtgtgccaccctacagtactgccctgacccttacatccagcgtttcgtagaaaccccagctcatttctcttggaaagaaagttattaccgatccaccatgtcccagagcacacagacaaatgaattcctcagtccagaggttttccagcatatctgggattttctggaacagcctatatgttcagttcagcccattgacttgaactttgtggatgaaccatcagaagatggtgcgacaaacaagattgagattagcatggactgtatccgcatgcaggactcggacctgagtgaccccatgtggccacagtacacgaacctggggctcctgaacagcatggaccagcagattcagaacggctcctcgtccaccagtccctataacacagaccacgcgcagaacagcgtcacggcgccctcgccctacgcacagcccagctccaccttcgatgctctctctccatcacccgccatcccctccaacaccgactacccaggcccgcacagtttcgacgtgtccttccagcagtcgagcaccgccaagtcggccacctggacgtattccactgaactgaagaaactctactgccaaattgcaaagacatgccccatccagatcaaggtgatgaccccacctcctcagggagctgttatccgcgccatgcctgtctacaaaaaagctgagcacgtcacggaggtggtgaagcggtgccccaaccatgagctgagccgtgaattcaacgagggacagattgcccctcctagtcatttgattcgagtagaggggaacagccatgcccagtatgtagaagatcccatcacaggaagacagagtgtgctggtaccttatgagccaccccaggttggcactgaattcacgacagtcttgtacaatttcatgtgtaacagcagttgtgttggagggatgaaccgccgtccaattttaatcattgttactctggaaaccagagatgggcaagtcctgggccgacgctgctttgaggcccggatctgtgcttgcccaggaagagacaggaaggcggatgaagatagcatcagaaagcagcaagtttcggacagtacaaagaacggtgatggtacgaagcgcccgtttcgtcagaacacacatggtatccagatgacatccatcaagaaacgaagatccccagatgatgaactgttatacttaccagtgaggggccgtgagacttatgaaatgctgttgaagatcaaagagtccctggaactcatgcagtaccttcctcagcacacaattgaaacgtacaggcaacagcaacagcagcagcaccagcacttacttcagaaacagacctcaatacagtctccatcttcatatggtaacagctccccacctctgaacaaaatgaacagcatgaacaagctgccttctgtgagccagcttatcaaccctcagcagcgcaacgccctcactcctacaaccattcctgatggcatgggagccaacattcccatgatgggcacccacatgccaatggctggagacatgaatggactcagccccacccaggcactccctcccccactctccatgccatccacctcccactgcacacccccacctccgtatcccacagattgcagcattgtcagtttcttagcgaggttgggctgttcatcatgtctggactatttcacgacccaggggctgaccaccatctatcagattgagcattactccatggatgatctggcaagtctgaaaatccctgagcaatttcgacatgcgatctggaagggcatcctggaccaccggcagctccacgaattctcctccccttctcatctcctgcggaccccaagcagtgcctctacagtcagtgtgggctccagtgagacccggggtgagcgtgttattgatgctgtgcgattcaccctccgccagaccatctctttcccaccccgagatgagtggaatgacttcaactttgacatggatgctcgccgcaataagcaacagcgcatcaaagaggagggggagtgagcctcaccatgtgagctcttcctatccctctcctaactgccagccccctaaaagcactcctgcttaatcttcaaagccttctccctagctcctccccttcctcttgtctgatttcttaggggaaggagaagtaagaggctacctcttacctaacatctgacctggcatctaattctgattctggctttaagccttcaaaactatagcttgcagaactgtagctgccatggctaggtagaagtgagcaaaaaagagttgggtgtctccttaagctgcagagatttctcattgacttttataaagcatgttcacccttatagtctaagactatatatataaatgtataaatatacagtatagatttttgggtggggggcattgagtattgtttaaaatgtaatttaaatgaaagaaaattgagttgcacttattgaccattttttaatttacttgttttggatggcttgtctatactccttcccttaaggggtatcatgtatggtgataggtatctagagcttaatgctacatgtgagtgacgatgatgtacagattctttcagttctttggattctaaatacatgccacatcaaacctttgagtagatccatttccattgcttattatgtaggtaagactgtagatatgtattcttttctcagtgttggtatattttatattactgacatttcttctagtgatgatggttcacgttggggtgatttaatccagttataagaagaagttcatgtccaaacgtcctctttagtttttggttgggaatgaggaaaattcttaaaaggcccatagcagccagttcaaaaacacccgacgtcatgtatttgagcatatcagtaacccccttaaatttaataccagataccttatcttacaatattgattgggaaaacatttgctgccattacagaggtattaaaactaaatttcactactagattgactaactcaaatacacatttgctactgttgtaagaattctgattgatttgattgggatgaatgccatctatctagttctaacagtgaagttttactgtctattaatattcagggtaaataggaatcattcagaaatgttgagtctgtactaaacagtaagatatctcaatgaaccataaattcaactttgtaaaaatcttttgaagcatagataatattgtttggtaaatgtttcttttgtttggtaaatgtttcttttaaagaccctcctattctataaaactctgcatgtagaggcttgtttacctttctctctctaaggtttacaataggagtggtgatttgaaaaatataaaattatgagattggttttcctgtggcataaattgcatcactgtatcattttcttttttaaccggtaagagtttcagtttgttggaaagtaactgtgagaacccagtttcccgtccatctcccttagggactacccatagacatgaaaggtccccacagagcaagagataagtctttcatggctgctgttgcttaaaccacttaaacgaagagttcccttgaaactttgggaaaacatgttaatgacaatattccagatctttcagaaatataacacatttttttgcatgcatgcaaatgagctctgaaatcttcccatgcattctggtcaagggctgtcattgcacataagcttccattttaattttaaagtgcaaaagggccagcgtggctctaaaaggtaatgtgtggattgcctctgaaaagtgtgtatatattttgtgtgaaattgcatactttgtattttgattattttttttttcttcttgggatagtgggatttccagaaccacacttgaaacctttttttatcgtttttgtattttcatgaaaataccatttagtaagaataccacatcaaataagaaataatgctacaattttaagaggggagggaagggaaagtttttttttattatttttttaaaattttgtatgttaaagagaatgagtccttgatttcaaagttttgttgtacttaaatggtaataagcactgtaaacttctgcaacaagcatgcagctttgcaaacccattaaggggaagaatgaaagctgttccttggtcctagtaagaagacaaactgcttcccttactttgctgagggtttgaataaacctaggacttccgagctatgtcagtactattcaggtaacactagggccttggaaattcctgtactgtgtctcatggatttggcactagccaaagcgaggcacccttactggcttacctcctcatggcagcctactctccttgagtgtatgagtagccagggtaaggggtaaaaggatagtaagcatagaaaccactagaaagtgggcttaatggagttcttgtggcctcagctcaatgcagttagctgaagaattgaaaagtttttgtttggagacgtttataaacagaaatggaaagcagagttttcattaaatccttttaccttttttttttcttggtaatcccctaaaataacagtatgtgggatattgaatgttaaagggatatttttttctattatttttataattgtacaaaattaagcaaatgttaaaagttttatatgctttattaatgttttcaaaaggtattatacatgtgatacattttttaagcttcagttgcttgtcttctggtactttctgttatgggcttttggggagccagaagccaatctacaatctctttttgtttgccaggacatgcaataaaatttaaaaaataaataaaaactaattaagaaattg

SEQ ID NO: 33259 - DNA, 2032 bp, Homo sapiens
tcgttgatatcaaagacagttgaaggaaatgaattttgaaacttcacggtgtgccaccctacagtactgccctgacccttacatccagcgtttcgtagaaaccccagctcatttctcttggaaagaaagttattaccgatccaccatgtcccagagcacacagacaaatgaattcctcagtccagaggttttccagcatatctgggattttctggaacagcctatatgttcagttcagcccattgacttgaactttgtggatgaaccatcagaagatggtgcgacaaacaagattgagattagcatggactgtatccgcatgcaggactcggacctgagtgaccccatgtggccacagtacacgaacctggggctcctgaacagcatggaccagcagattcagaacggctcctcgtccaccagtccctataacacagaccacgcgcagaacagcgtcacggcgccctcgccctacgcacagcccagctccaccttcgatgctctctctccatcacccgccatcccctccaacaccgactacccaggcccgcacagtttcgacgtgtccttccagcagtcgagcaccgccaagtcggccacctggacgtattccactgaactgaagaaactctactgccaaattgcaaagacatgccccatccagatcaaggtgatgaccccacctcctcagggagctgttatccgcgccatgcctgtctacaaaaaagctgagcacgtcacggaggtggtgaagcggtgccccaaccatgagctgagccgtgaattcaacgagggacagattgcccctcctagtcatttgattcgagtagaggggaacagccatgcccagtatgtagaagatcccatcacaggaagacagagtgtgctggtaccttatgagccaccccaggttggcactgaattcacgacagtcttgtacaatttcatgtgtaacagcagttgtgttggagggatgaaccgccgtccaattttaatcattgttactctggaaaccagagatgggcaagtcctgggccgacgctgctttgaggcccggatctgtgcttgcccaggaagagacaggaaggcggatgaagatagcatcagaaagcagcaagtttcggacagtacaaagaacggtgatggtacgaagcgcccgtttcgtcagaacacacatggtatccagatgacatccatcaagaaacgaagatccccagatgatgaactgttatacttaccagtgaggggccgtgagacttatgaaatgctgttgaagatcaaagagtccctggaactcatgcagtaccttcctcagcacacaattgaaacgtacaggcaacagcaacagcagcagcaccagcacttacttcagaaacagacctcaatacagtctccatcttcatatggtaacagctccccacctctgaacaaaatgaacagcatgaacaagctgccttctgtgagccagcttatcaaccctcagcagcgcaacgccctcactcctacaaccattcctgatggcatgggagccaacagatctggcaagtctgaaaatccctgagcaatttcgacatgcgatctggaagggcatcctggaccaccggcagctccacgaattctcctccccttctcatctcctgcggaccccaagcagtgcctctacagtcagtgtgggctccagtgagacccggggtgagcgtgttattgatgctgtgcgattcaccctccgccagaccatctctttcccaccccgagatgagtggaatgacttcaactttgacatggatgctcgccgcaataagcaacagcgcatcaaagaggagggggagtgagcctcaccatgtgagctcttcctatccctctcctaactgccagccccctaaaagcactcctgcttaatcttcaaagccttctccctagctcctccccttcctcttgtctgatttcttaggggaaggagaagtaagaggctacctcttacctaacatctgacctggcatctaattctgattctggctttaagccttcaaaa

SEQ ID NO: 33260 - DNA, 4668 bp, Homo sapiens
agagagagaaagagagagagggacttgagttctgttatcttcttaagtagattcatattgtaagggtctcggggtgggggggttggcaaaatcctggagccagaagaaaggacagcagcattgatcaatcttacagctaacatgttgtacctggaaaacaatgcccagactcaatttagtgagccacagtacacgaacctggggctcctgaacagcatggaccagcagattcagaacggctcctcgtccaccagtccctataacacagaccacgcgcagaacagcgtcacggcgccctcgccctacgcacagcccagctccaccttcgatgctctctctccatcacccgccatcccctccaacaccgactacccaggcccgcacagtttcgacgtgtccttccagcagtcgagcaccgccaagtcggccacctggacgtattccactgaactgaagaaactctactgccaaattgcaaagacatgccccatccagatcaaggtgatgaccccacctcctcagggagctgttatccgcgccatgcctgtctacaaaaaagctgagcacgtcacggaggtggtgaagcggtgccccaaccatgagctgagccgtgaattcaacgagggacagattgcccctcctagtcatttgattcgagtagaggggaacagccatgcccagtatgtagaagatcccatcacaggaagacagagtgtgctggtaccttatgagccaccccaggttggcactgaattcacgacagtcttgtacaatttcatgtgtaacagcagttgtgttggagggatgaaccgccgtccaattttaatcattgttactctggaaaccagagatgggcaagtcctgggccgacgctgctttgaggcccggatctgtgcttgcccaggaagagacaggaaggcggatgaagatagcatcagaaagcagcaagtttcggacagtacaaagaacggtgatggtacgaagcgcccgtttcgtcagaacacacatggtatccagatgacatccatcaagaaacgaagatccccagatgatgaactgttatacttaccagtgaggggccgtgagacttatgaaatgctgttgaagatcaaagagtccctggaactcatgcagtaccttcctcagcacacaattgaaacgtacaggcaacagcaacagcagcagcaccagcacttacttcagaaacagacctcaatacagtctccatcttcatatggtaacagctccccacctctgaacaaaatgaacagcatgaacaagctgccttctgtgagccagcttatcaaccctcagcagcgcaacgccctcactcctacaaccattcctgatggcatgggagccaacattcccatgatgggcacccacatgccaatggctggagacatgaatggactcagccccacccaggcactccctcccccactctccatgccatccacctcccactgcacacccccacctccgtatcccacagattgcagcattgtcagtttcttagcgaggttgggctgttcatcatgtctggactatttcacgacccaggggctgaccaccatctatcagattgagcattactccatggatgatctggcaagtctgaaaatccctgagcaatttcgacatgcgatctggaagggcatcctggaccaccggcagctccacgaattctcctccccttctcatctcctgcggaccccaagcagtgcctctacagtcagtgtgggctccagtgagacccggggtgagcgtgttattgatgctgtgcgattcaccctccgccagaccatctctttcccaccccgagatgagtggaatgacttcaactttgacatggatgctcgccgcaataagcaacagcgcatcaaagaggagggggagtgagcctcaccatgtgagctcttcctatccctctcctaactgccagccccctaaaagcactcctgcttaatcttcaaagccttctccctagctcctccccttcctcttgtctgatttcttaggggaaggagaagtaagaggctacctcttacctaacatctgacctggcatctaattctgattctggctttaagccttcaaaactatagcttgcagaactgtagctgccatggctaggtagaagtgagcaaaaaagagttgggtgtctccttaagctgcagagatttctcattgacttttataaagcatgttcacccttatagtctaagactatatatataaatgtataaatatacagtatagatttttgggtggggggcattgagtattgtttaaaatgtaatttaaatgaaagaaaattgagttgcacttattgaccattttttaatttacttgttttggatggcttgtctatactccttcccttaaggggtatcatgtatggtgataggtatctagagcttaatgctacatgtgagtgacgatgatgtacagattctttcagttctttggattctaaatacatgccacatcaaacctttgagtagatccatttccattgcttattatgtaggtaagactgtagatatgtattcttttctcagtgttggtatattttatattactgacatttcttctagtgatgatggttcacgttggggtgatttaatccagttataagaagaagttcatgtccaaacgtcctctttagtttttggttgggaatgaggaaaattcttaaaaggcccatagcagccagttcaaaaacacccgacgtcatgtatttgagcatatcagtaacccccttaaatttaataccagataccttatcttacaatattgattgggaaaacatttgctgccattacagaggtattaaaactaaatttcactactagattgactaactcaaatacacatttgctactgttgtaagaattctgattgatttgattgggatgaatgccatctatctagttctaacagtgaagttttactgtctattaatattcagggtaaataggaatcattcagaaatgttgagtctgtactaaacagtaagatatctcaatgaaccataaattcaactttgtaaaaatcttttgaagcatagataatattgtttggtaaatgtttcttttgtttggtaaatgtttcttttaaagaccctcctattctataaaactctgcatgtagaggcttgtttacctttctctctctaaggtttacaataggagtggtgatttgaaaaatataaaattatgagattggttttcctgtggcataaattgcatcactgtatcattttcttttttaaccggtaagagtttcagtttgttggaaagtaactgtgagaacccagtttcccgtccatctcccttagggactacccatagacatgaaaggtccccacagagcaagagataagtctttcatggctgctgttgcttaaaccacttaaacgaagagttcccttgaaactttgggaaaacatgttaatgacaatattccagatctttcagaaatataacacatttttttgcatgcatgcaaatgagctctgaaatcttcccatgcattctggtcaagggctgtcattgcacataagcttccattttaattttaaagtgcaaaagggccagcgtggctctaaaaggtaatgtgtggattgcctctgaaaagtgtgtatatattttgtgtgaaattgcatactttgtattttgattattttttttttcttcttgggatagtgggatttccagaaccacacttgaaacctttttttatcgtttttgtattttcatgaaaataccatttagtaagaataccacatcaaataagaaataatgctacaattttaagaggggagggaagggaaagtttttttttattatttttttaaaattttgtatgttaaagagaatgagtccttgatttcaaagttttgttgtacttaaatggtaataagcactgtaaacttctgcaacaagcatgcagctttgcaaacccattaaggggaagaatgaaagctgttccttggtcctagtaagaagacaaactgcttcccttactttgctgagggtttgaataaacctaggacttccgagctatgtcagtactattcaggtaacactagggccttggaaattcctgtactgtgtctcatggatttggcactagccaaagcgaggcacccttactggcttacctcctcatggcagcctactctccttgagtgtatgagtagccagggtaaggggtaaaaggatagtaagcatagaaaccactagaaagtgggcttaatggagttcttgtggcctcagctcaatgcagttagctgaagaattgaaaagtttttgtttggagacgtttataaacagaaatggaaagcagagttttcattaaatccttttaccttttttttttcttggtaatcccctaaaataacagtatgtgggatattgaatgttaaagggatatttttttctattatttttataattgtacaaaattaagcaaatgttaaaagttttatatgctttattaatgttttcaaaaggtattatacatgtgatacattttttaagcttcagttgcttgtcttctggtactttctgttatgggcttttggggagccagaagccaatctacaatctctttttgtttgccaggacatgcaataaaatttaaaaaataaataaaaactaa

SEQ ID NO: 33261 - DNA, 1788 bp, Homo sapiens
atgaattttgaaacttcacggtgtgccaccctacagtactgccctgacccttacatccagcgtttcgtagaaaccccagctcatttctcttggaaagaaagttattaccgatccaccatgtcccagagcacacagacaaatgaattcctcagtccagaggttttccagcatatctgggattttctggaacagcctatatgttcagttcagcccattgacttgaactttgtggatgaaccatcagaagatggtgcgacaaacaagattgagattagcatggactgtatccgcatgcaggactcggacctgagtgaccccatgtggtattccactgaactgaagaaactctactgccaaattgcaaagacatgccccatccagatcaaggtgatgaccccacctcctcagggagctgttatccgcgccatgcctgtctacaaaaaagctgagcacgtcacggaggtggtgaagcggtgccccaaccatgagctgagccgtgaattcaacgagggacagattgcccctcctagtcatttgattcgagtagaggggaacagccatgcccagtatgtagaagatcccatcacaggaagacagagtgtgctggtaccttatgagccaccccaggttggcactgaattcacgacagtcttgtacaatttcatgtgtaacagcagttgtgttggagggatgaaccgccgtccaattttaatcattgttactctggaaaccagagatgggcaagtcctgggccgacgctgctttgaggcccggatctgtgcttgcccaggaagagacaggaaggcggatgaagatagcatcagaaagcagcaagtttcggacagtacaaagaacggtgatggtacgaagcgcccgtttcgtcagaacacacatggtatccagatgacatccatcaagaaacgaagatccccagatgatgaactgttatacttaccagtgaggggccgtgagacttatgaaatgctgttgaagatcaaagagtccctggaactcatgcagtaccttcctcagcacacaattgaaacgtacaggcaacagcaacagcagcagcaccagcacttacttcagaaacagacctcaatacagtctccatcttcatatggtaacagctccccacctctgaacaaaatgaacagcatgaacaagctgccttctgtgagccagcttatcaaccctcagcagcgcaacgccctcactcctacaaccattcctgatggcatgggagccaacattcccatgatgggcacccacatgccaatggctggagacatgaatggactcagccccacccaggcactccctcccccactctccatgccatccacctcccactgcacacccccacctccgtatcccacagattgcagcattgtcagtttcttagcgaggttgggctgttcatcatgtctggactatttcacgacccaggggctgaccaccatctatcagattgagcattactccatggatgatctggcaagtctgaaaatccctgagcaatttcgacatgcgatctggaagggcatcctggaccaccggcagctccacgaattctcctccccttctcatctcctgcggaccccaagcagtgcctctacagtcagtgtgggctccagtgagacccggggtgagcgtgttattgatgctgtgcgattcaccctccgccagaccatctctttcccaccccgagatgagtggaatgacttcaactttgacatggatgctcgccgcaataagcaacagcgcatcaaagaggagggggagtga

SEQ ID NO: 33262 - DNA, 1668 bp, Homo sapiens
atgaattttgaaacttcacggtgtgccaccctacagtactgccctgacccttacatccagcgtttcgtagaaaccccagctcatttctcttggaaagaaagttattaccgatccaccatgtcccagagcacacagacaaatgaattcctcagtccagaggttttccagcatatctgggattttctggaacagcctatatgttcagttcagcccattgacttgaactttgtggatgaaccatcagaagatggtgcgacaaacaagattgagattagcatggactgtatccgcatgcaggactcggacctgagtgaccccatgtggccacagtacacgaacctggggctcctgaacagcatggaccagcagattcagaacggctcctcgtccaccagtccctataacacagaccacgcgcagaacagcgtcacggcgccctcgccctacgcacagcccagctccaccttcgatgctctctctccatcacccgccatcccctccaacaccgactacccaggcccgcacagtttcgacgtgtccttccagcagtcgagcaccgccaagtcggccacctggacgtattccactgaactgaagaaactctactgccaaattgcaaagacatgccccatccagatcaaggtgatgaccccacctcctcagggagctgttatccgcgccatgcctgtctacaaaaaagctgagcacgtcacggaggtggtgaagcggtgccccaaccatgagctgagccgtgaattcaacgagggacagattgcccctcctagtcatttgattcgagtagaggggaacagccatgcccagtatgtagaagatcccatcacaggaagacagagtgtgctggtaccttatgagccaccccaggttggcactgaattcacgacagtcttgtacaatttcatgtgtaacagcagttgtgttggagggatgaaccgccgtccaattttaatcattgttactctggaaaccagagatgggcaagtcctgggccgacgctgctttgaggcccggatctgtgcttgcccaggaagagacaggaaggcggatgaagatagcatcagaaagcagcaagtttcggacagtacaaagaacggtgatggtacgaagcgcccgtttcgtcagaacacacatggtatccagatgacatccatcaagaaacgaagatccccagatgatgaactgttatacttaccagtgaggggccgtgagacttatgaaatgctgttgaagatcaaagagtccctggaactcatgcagtaccttcctcagcacacaattgaaacgtacaggcaacagcaacagcagcagcaccagcacttacttcagaaacagacctcaatacagtctccatcttcatatggtaacagctccccacctctgaacaaaatgaacagcatgaacaagctgccttctgtgagccagcttatcaaccctcagcagcgcaacgccctcactcctacaaccattcctgatggcatgggagccaacattcccatgatgggcacccacatgccaatggctggagacatgaatggactcagccccacccaggcactccctcccccactctccatgccatccacctcccactgcacacccccacctccgtatcccacagattgcagcattgtcaggatctggcaagtctga

SEQ ID NO: 33263 - DNA, 1251 bp, Homo sapiens
atgttgtacctggaaaacaatgcccagactcaatttagtgagccacagtacacgaacctggggctcctgaacagcatggaccagcagattcagaacggctcctcgtccaccagtccctataacacagaccacgcgcagaacagcgtcacggcgccctcgccctacgcacagcccagctccaccttcgatgctctctctccatcacccgccatcccctccaacaccgactacccaggcccgcacagtttcgacgtgtccttccagcagtcgagcaccgccaagtcggccacctggacgtattccactgaactgaagaaactctactgccaaattgcaaagacatgccccatccagatcaaggtgatgaccccacctcctcagggagctgttatccgcgccatgcctgtctacaaaaaagctgagcacgtcacggaggtggtgaagcggtgccccaaccatgagctgagccgtgaattcaacgagggacagattgcccctcctagtcatttgattcgagtagaggggaacagccatgcccagtatgtagaagatcccatcacaggaagacagagtgtgctggtaccttatgagccaccccaggttggcactgaattcacgacagtcttgtacaatttcatgtgtaacagcagttgtgttggagggatgaaccgccgtccaattttaatcattgttactctggaaaccagagatgggcaagtcctgggccgacgctgctttgaggcccggatctgtgcttgcccaggaagagacaggaaggcggatgaagatagcatcagaaagcagcaagtttcggacagtacaaagaacggtgatggtacgaagcgcccgtttcgtcagaacacacatggtatccagatgacatccatcaagaaacgaagatccccagatgatgaactgttatacttaccagtgaggggccgtgagacttatgaaatgctgttgaagatcaaagagtccctggaactcatgcagtaccttcctcagcacacaattgaaacgtacaggcaacagcaacagcagcagcaccagcacttacttcagaaacagacctcaatacagtctccatcttcatatggtaacagctccccacctctgaacaaaatgaacagcatgaacaagctgccttctgtgagccagcttatcaaccctcagcagcgcaacgccctcactcctacaaccattcctgatggcatgggagccaacagatctggcaagtctgaaaatccctga

SEQ ID NO: 33264 - DNA, 1386 bp, Homo sapiens
atgttgtacctggaaaacaatgcccagactcaatttagtgagccacagtacacgaacctggggctcctgaacagcatggaccagcagattcagaacggctcctcgtccaccagtccctataacacagaccacgcgcagaacagcgtcacggcgccctcgccctacgcacagcccagctccaccttcgatgctctctctccatcacccgccatcccctccaacaccgactacccaggcccgcacagtttcgacgtgtccttccagcagtcgagcaccgccaagtcggccacctggacgtattccactgaactgaagaaactctactgccaaattgcaaagacatgccccatccagatcaaggtgatgaccccacctcctcagggagctgttatccgcgccatgcctgtctacaaaaaagctgagcacgtcacggaggtggtgaagcggtgccccaaccatgagctgagccgtgaattcaacgagggacagattgcccctcctagtcatttgattcgagtagaggggaacagccatgcccagtatgtagaagatcccatcacaggaagacagagtgtgctggtaccttatgagccaccccaggttggcactgaattcacgacagtcttgtacaatttcatgtgtaacagcagttgtgttggagggatgaaccgccgtccaattttaatcattgttactctggaaaccagagatgggcaagtcctgggccgacgctgctttgaggcccggatctgtgcttgcccaggaagagacaggaaggcggatgaagatagcatcagaaagcagcaagtttcggacagtacaaagaacggtgatggtacgaagcgcccgtttcgtcagaacacacatggtatccagatgacatccatcaagaaacgaagatccccagatgatgaactgttatacttaccagtgaggggccgtgagacttatgaaatgctgttgaagatcaaagagtccctggaactcatgcagtaccttcctcagcacacaattgaaacgtacaggcaacagcaacagcagcagcaccagcacttacttcagaaacagacctcaatacagtctccatcttcatatggtaacagctccccacctctgaacaaaatgaacagcatgaacaagctgccttctgtgagccagcttatcaaccctcagcagcgcaacgccctcactcctacaaccattcctgatggcatgggagccaacattcccatgatgggcacccacatgccaatggctggagacatgaatggactcagccccacccaggcactccctcccccactctccatgccatccacctcccactgcacacccccacctccgtatcccacagattgcagcattgtcaggatctggcaagtctga

SEQ ID NO: 33265 - DNA, 2810 bp, Homo sapiens
tcgttgatatcaaagacagttgaaggaaatgaattttgaaacttcacggtgtgccaccctacagtactgccctgacccttacatccagcgtttcgtagaaaccccagctcatttctcttggaaagaaagttattaccgatccaccatgtcccagagcacacagacaaatgaattcctcagtccagaggttttccagcatatctgggattttctggaacagcctatatgttcagttcagcccattgacttgaactttgtggatgaaccatcagaagatggtgcgacaaacaagattgagattagcatggactgtatccgcatgcaggactcggacctgagtgaccccatgtggccacagtacacgaacctggggctcctgaacagcatggaccagcagattcagaacggctcctcgtccaccagtccctataacacagaccacgcgcagaacagcgtcacggcgccctcgccctacgcacagcccagctccaccttcgatgctctctctccatcacccgccatcccctccaacaccgactacccaggcccgcacagtttcgacgtgtccttccagcagtcgagcaccgccaagtcggccacctggacgtattccactgaactgaagaaactctactgccaaattgcaaagacatgccccatccagatcaaggtgatgaccccacctcctcagggagctgttatccgcgccatgcctgtctacaaaaaagctgagcacgtcacggaggtggtgaagcggtgccccaaccatgagctgagccgtgaattcaacgagggacagattgcccctcctagtcatttgattcgagtagaggggaacagccatgcccagtatgtagaagatcccatcacaggaagacagagtgtgctggtaccttatgagccaccccaggttggcactgaattcacgacagtcttgtacaatttcatgtgtaacagcagttgtgttggagggatgaaccgccgtccaattttaatcattgttactctggaaaccagagatgggcaagtcctgggccgacgctgctttgaggcccggatctgtgcttgcccaggaagagacaggaaggcggatgaagatagcatcagaaagcagcaagtttcggacagtacaaagaacggtgatggtacgaagcgcccgtttcgtcagaacacacatggtatccagatgacatccatcaagaaacgaagatccccagatgatgaactgttatacttaccagtgaggggccgtgagacttatgaaatgctgttgaagatcaaagagtccctggaactcatgcagtaccttcctcagcacacaattgaaacgtacaggcaacagcaacagcagcagcaccagcacttacttcagaaacatctcctttcagcctgcttcaggaatgagcttgtggagccccggagagaaactccaaaacaatctgacgtcttctttagacattccaagcccccaaaccgatcagtgtacccatagagccctatctctatattttaagtgtgtgtgttgtatttccatgtgtatatgtgagtgtgtgtgtgtgtatgtgtgtgcgtgtgtatctagccctcataaacaggacttgaagacactttggctcagagacccaactgctcaaaggcacaaagccactagtgagagaatcttttgaagggactcaaacctttacaagaaaggatgttttctgcagattttgtatccttagaccggccattggtgggtgaggaaccactgtgtttgtctgtgagctttctgttgtttcctgggagggaggggtcaggtggggaaaggggcattaagatgtttattggaacccttttctgtcttcttctgttgtttttctaaaattcacagggaagcttttgagcaggtctcaaacttaagatgtctttttaagaaaaggagaaaaaagttgttattgtctgtgcataagtaagttgtaggtgactgagagactcagtcagacccttttaatgctggtcatgtaataatattgcaagtagtaagaaacgaaggtgtcaagtgtactgctgggcagcgaggtgatcattaccaaaagtaatcaactttgtgggtggagagttctttgtgagaacttgcattatttgtgtcctcccctcatgtgtaggtagaacatttcttaatgctgtgtacctgcctctgccactgtatgttggcatctgttatgctaaagtttttcttgtacatgaaaccctggaagacctactacaaaaaaactgttgtttggcccccatagcaggtgaactcattttgtgcttttaatagaaagacaaatccaccccagtaatattgcccttacgtagttgtttaccattattcaaagctcaaaatagaatttgaagccctctcacaaaatctgtgattaatttgcttaattagagcttctatccctcaagcctacctaccataaaaccagccatattactgatactgttcagtgcatttagccaggagacttacgttttgagtaagtgagatccaagcagacgtgttaaaatcagcactcctggactggaaattaaagattgaaagggtagactacttttcttttttttactcaaaagtttagagaatctctgtttctttccattttaaaaacatattttaagataatagcataaagactttaaaaatgttcctcccctccatcttcccacacccagtcaccagcactgtattttctgtcaccaagacaatgatttcttgttattgaggctgttgcttttgtggatgtgtgattttaattttcaataaacttttgcatcttggttta

SEQ ID NO: 33266 - DNA, 2500 bp, Homo sapiens
atgttgtacctggaaaacaatgcccagactcaatttagtgagccacagtacacgaacctggggctcctgaacagcatggaccagcagattcagaacggctcctcgtccaccagtccctataacacagaccacgcgcagaacagcgtcacggcgccctcgccctacgcacagcccagctccaccttcgatgctctctctccatcacccgccatcccctccaacaccgactacccaggcccgcacagtttcgacgtgtccttccagcagtcgagcaccgccaagtcggccacctggacgtattccactgaactgaagaaactctactgccaaattgcaaagacatgccccatccagatcaaggtgatgaccccacctcctcagggagctgttatccgcgccatgcctgtctacaaaaaagctgagcacgtcacggaggtggtgaagcggtgccccaaccatgagctgagccgtgaattcaacgagggacagattgcccctcctagtcatttgattcgagtagaggggaacagccatgcccagtatgtagaagatcccatcacaggaagacagagtgtgctggtaccttatgagccaccccaggttggcactgaattcacgacagtcttgtacaatttcatgtgtaacagcagttgtgttggagggatgaaccgccgtccaattttaatcattgttactctggaaaccagagatgggcaagtcctgggccgacgctgctttgaggcccggatctgtgcttgcccaggaagagacaggaaggcggatgaagatagcatcagaaagcagcaagtttcggacagtacaaagaacggtgatggtacgaagcgcccgtttcgtcagaacacacatggtatccagatgacatccatcaagaaacgaagatccccagatgatgaactgttatacttaccagtgaggggccgtgagacttatgaaatgctgttgaagatcaaagagtccctggaactcatgcagtaccttcctcagcacacaattgaaacgtacaggcaacagcaacagcagcagcaccagcacttacttcagaaacatctcctttcagcctgcttcaggaatgagcttgtggagccccggagagaaactccaaaacaatctgacgtcttctttagacattccaagcccccaaaccgatcagtgtacccatagagccctatctctatattttaagtgtgtgtgttgtatttccatgtgtatatgtgagtgtgtgtgtgtgtatgtgtgtgcgtgtgtatctagccctcataaacaggacttgaagacactttggctcagagacccaactgctcaaaggcacaaagccactagtgagagaatcttttgaagggactcaaacctttacaagaaaggatgttttctgcagattttgtatccttagaccggccattggtgggtgaggaaccactgtgtttgtctgtgagctttctgttgtttcctgggagggaggggtcaggtggggaaaggggcattaagatgtttattggaacccttttctgtcttcttctgttgtttttctaaaattcacagggaagcttttgagcaggtctcaaacttaagatgtctttttaagaaaaggagaaaaaagttgttattgtctgtgcataagtaagttgtaggtgactgagagactcagtcagacccttttaatgctggtcatgtaataatattgcaagtagtaagaaacgaaggtgtcaagtgtactgctgggcagcgaggtgatcattaccaaaagtaatcaactttgtgggtggagagttctttgtgagaacttgcattatttgtgtcctcccctcatgtgtaggtagaacatttcttaatgctgtgtacctgcctctgccactgtatgttggcatctgttatgctaaagtttttcttgtacatgaaaccctggaagacctactacaaaaaaactgttgtttggcccccatagcaggtgaactcattttgtgcttttaatagaaagacaaatccaccccagtaatattgcccttacgtagttgtttaccattattcaaagctcaaaatagaatttgaagccctctcacaaaatctgtgattaatttgcttaattagagcttctatccctcaagcctacctaccataaaaccagccatattactgatactgttcagtgcatttagccaggagacttacgttttgagtaagtgagatccaagcagacgtgttaaaatcagcactcctggactggaaattaaagattgaaagggtagactacttttcttttttttactcaaaagtttagagaatctctgtttctttccattttaaaaacatattttaagataatagcataaagactttaaaaatgttcctcccctccatcttcccacacccagtcaccagcactgtattttctgtcaccaagacaatgatttcttgttattgaggctgttgcttttgtggatgtgtgattttaattttcaataaacttttgcatcttggttta

SEQ ID NO: 33267 - DNA, 2031 bp, Homo sapiens
atgaattttgaaacttcacggtgtgccaccctacagtactgccctgacccttacatccagcgtttcgtagaaaccccagctcatttctcttggaaagaaagttattaccgatccaccatgtcccagagcacacagacaaatgaattcctcagtccagaggttttccagcatatctgggattttctggaacagcctatatgttcagttcagcccattgacttgaactttgtggatgaaccatcagaagatggtgcgacaaacaagattgagattagcatggactgtatccgcatgcaggactcggacctgagtgaccccatgtggccacagtacacgaacctggggctcctgaacagcatggaccagcagattcagaacggctcctcgtccaccagtccctataacacagaccacgcgcagaacagcgtcacggcgccctcgccctacgcacagcccagctccaccttcgatgctctctctccatcacccgccatcccctccaacaccgactacccaggcccgcacagtttcgacgtgtccttccagcagtcgagcaccgccaagtcggccacctggacgtattccactgaactgaagaaactctactgccaaattgcaaagacatgccccatccagatcaaggtgatgaccccacctcctcagggagctgttatccgcgccatgcctgtctacaaaaaagctgagcacgtcacggaggtggtgaagcggtgccccaaccatgagctgagccgtgaattcaacgagggacagattgcccctcctagtcatttgattcgagtagaggggaacagccatgcccagtatgtagaagatcccatcacaggaagacagagtgtgctggtaccttatgagccaccccaggttggcactgaattcacgacagtcttgtacaatttcatgtgtaacagcagttgtgttggagggatgaaccgccgtccaattttaatcattgttactctggaaaccagagatgggcaagtcctgggccgacgctgctttgaggcccggatctgtgcttgcccaggaagagacaggaaggcggatgaagatagcatcagaaagcagcaagtttcggacagtacaaagaacggtgatgcgtttcgtcagaacacacatggtatccagatgacatccatcaagaaacgaagatccccagatgatgaactgttatacttaccagtgaggggccgtgagacttatgaaatgctgttgaagatcaaagagtccctggaactcatgcagtaccttcctcagcacacaattgaaacgtacaggcaacagcaacagcagcagcaccagcacttacttcagaaacagacctcaatacagtctccatcttcatatggtaacagctccccacctctgaacaaaatgaacagcatgaacaagctgccttctgtgagccagcttatcaaccctcagcagcgcaacgccctcactcctacaaccattcctgatggcatgggagccaacattcccatgatgggcacccacatgccaatggctggagacatgaatggactcagccccacccaggcactccctcccccactctccatgccatccacctcccactgcacacccccacctccgtatcccacagattgcagcattgtcagtttcttagcgaggttgggctgttcatcatgtctggactatttcacgacccaggggctgaccaccatctatcagattgagcattactccatggatgatctggcaagtctgaaaatccctgagcaatttcgacatgcgatctggaagggcatcctggaccaccggcagctccacgaattctcctccccttctcatctcctgcggaccccaagcagtgcctctacagtcagtgtgggctccagtgagacccggggtgagcgtgttattgatgctgtgcgattcaccctccgccagaccatctctttcccaccccgagatgagtggaatgacttcaactttgacatggatgctcgccgcaataagcaacagcgcatcaaagaggagggggagtga

SEQ ID NO: 33268 - DNA, 1506 bp, Homo sapiens
atgttgtacctggaaaacaatgcccagactcaatttagtgagtattccactgaactgaagaaactctactgccaaattgcaaagacatgccccatccagatcaaggtgatgaccccacctcctcagggagctgttatccgcgccatgcctgtctacaaaaaagctgagcacgtcacggaggtggtgaagcggtgccccaaccatgagctgagccgtgaattcaacgagggacagattgcccctcctagtcatttgattcgagtagaggggaacagccatgcccagtatgtagaagatcccatcacaggaagacagagtgtgctggtaccttatgagccaccccaggttggcactgaattcacgacagtcttgtacaatttcatgtgtaacagcagttgtgttggagggatgaaccgccgtccaattttaatcattgttactctggaaaccagagatgggcaagtcctgggccgacgctgctttgaggcccggatctgtgcttgcccaggaagagacaggaaggcggatgaagatagcatcagaaagcagcaagtttcggacagtacaaagaacggtgatggtacgaagcgcccgtttcgtcagaacacacatggtatccagatgacatccatcaagaaacgaagatccccagatgatgaactgttatacttaccagtgaggggccgtgagacttatgaaatgctgttgaagatcaaagagtccctggaactcatgcagtaccttcctcagcacacaattgaaacgtacaggcaacagcaacagcagcagcaccagcacttacttcagaaacagacctcaatacagtctccatcttcatatggtaacagctccccacctctgaacaaaatgaacagcatgaacaagctgccttctgtgagccagcttatcaaccctcagcagcgcaacgccctcactcctacaaccattcctgatggcatgggagccaacattcccatgatgggcacccacatgccaatggctggagacatgaatggactcagccccacccaggcactccctcccccactctccatgccatccacctcccactgcacacccccacctccgtatcccacagattgcagcattgtcagtttcttagcgaggttgggctgttcatcatgtctggactatttcacgacccaggggctgaccaccatctatcagattgagcattactccatggatgatctggcaagtctgaaaatccctgagcaatttcgacatgcgatctggaagggcatcctggaccaccggcagctccacgaattctcctccccttctcatctcctgcggaccccaagcagtgcctctacagtcagtgtgggctccagtgagacccggggtgagcgtgttattgatgctgtgcgattcaccctccgccagaccatctctttcccaccccgagatgagtggaatgacttcaactttgacatggatgctcgccgcaataagcaacagcgcatcaaagaggagggggagtga

SEQ ID NO: 33269 - DNA, 1749 bp, Homo sapiens
atgttgtacctggaaaacaatgcccagactcaatttagtgagccacagtacacgaacctggggctcctgaacagcatggaccagcagattcagaacggctcctcgtccaccagtccctataacacagaccacgcgcagaacagcgtcacggcgccctcgccctacgcacagcccagctccaccttcgatgctctctctccatcacccgccatcccctccaacaccgactacccaggcccgcacagtttcgacgtgtccttccagcagtcgagcaccgccaagtcggccacctggacgtattccactgaactgaagaaactctactgccaaattgcaaagacatgccccatccagatcaaggtgatgaccccacctcctcagggagctgttatccgcgccatgcctgtctacaaaaaagctgagcacgtcacggaggtggtgaagcggtgccccaaccatgagctgagccgtgaattcaacgagggacagattgcccctcctagtcatttgattcgagtagaggggaacagccatgcccagtatgtagaagatcccatcacaggaagacagagtgtgctggtaccttatgagccaccccaggttggcactgaattcacgacagtcttgtacaatttcatgtgtaacagcagttgtgttggagggatgaaccgccgtccaattttaatcattgttactctggaaaccagagatgggcaagtcctgggccgacgctgctttgaggcccggatctgtgcttgcccaggaagagacaggaaggcggatgaagatagcatcagaaagcagcaagtttcggacagtacaaagaacggtgatgcgtttcgtcagaacacacatggtatccagatgacatccatcaagaaacgaagatccccagatgatgaactgttatacttaccagtgaggggccgtgagacttatgaaatgctgttgaagatcaaagagtccctggaactcatgcagtaccttcctcagcacacaattgaaacgtacaggcaacagcaacagcagcagcaccagcacttacttcagaaacagacctcaatacagtctccatcttcatatggtaacagctccccacctctgaacaaaatgaacagcatgaacaagctgccttctgtgagccagcttatcaaccctcagcagcgcaacgccctcactcctacaaccattcctgatggcatgggagccaacattcccatgatgggcacccacatgccaatggctggagacatgaatggactcagccccacccaggcactccctcccccactctccatgccatccacctcccactgcacacccccacctccgtatcccacagattgcagcattgtcagtttcttagcgaggttgggctgttcatcatgtctggactatttcacgacccaggggctgaccaccatctatcagattgagcattactccatggatgatctggcaagtctgaaaatccctgagcaatttcgacatgcgatctggaagggcatcctggaccaccggcagctccacgaattctcctccccttctcatctcctgcggaccccaagcagtgcctctacagtcagtgtgggctccagtgagacccggggtgagcgtgttattgatgctgtgcgattcaccctccgccagaccatctctttcccaccccgagatgagtggaatgacttcaactttgacatggatgctcgccgcaataagcaacagcgcatcaaagaggagggggagtga

SEQ ID NO: 33270 - DNA, 1008 bp, Homo sapiens
tcccttcagtcgccatcatgattatctaccgggacctcatcagccacgatgagatgttctccgacatctacaagatccgggagatcgcggacgggttgtgcctggaggtggaggggaagatggtcagtaggacagaaggtaacattgatgactcgctcattggtggaaatgcctccgctgaaggccccgagggcgaaggtaccgaaagcacagtaatcactggtgtcgatattgtcatgaaccatcacctgcaggaaacaagtttcacaaaagaagcctacaagaagtacatcaaagattacatgaaatcaatcaaagggaaacttgaagaacagagaccagaaagagtaaaaccttttatgacaggggctgcagaacaaatcaagcacatccttgctaatttcaaaaactaccagttctttattggtgaaaacatgaatccagatggcatggttgctctattggactaccgtgaggatggtgtgaccccatatatgattttctttaaggatggtttagaaatggaaaaatgtgtaagtacaaggaagtgggttaaaataaataatgtaaaaaagacattttagatgtgatttgcaattgttttgtgacactgagaatgagttttacagcgttctgaaacatggttttagttttctctttggggatcaagagaattgtgtttcatatgtaaaaaattcttagggtataaaaaggcttagaatcttatttgtggaaaacgttgagtgcagatggggcataataaagtacagtttaggctgggtgtggtggctcacacctgtaatttcagcacttgggacgccgaggtgggtgcatcacctgaggttgggagttcgagaccagcctggccaacatggcgaaaccctatctctgctaaaaatacaaaaattagccaggcatggcagcgggcacctgtaatcccagctaatcgagagcctgaggcaggaaaatcacttaaacctgggaggggggttgcagtgagcagagatc

SEQ ID NO: 33271 - DNA, 948 bp, Homo sapiens
ccgagcgccgctccggctgcaccgcgctcgctccgagtttcaggctcgtgctaagctagcgccgtcgtcgtctcccttcagtcgccatcatgattatctaccgggacctcatcagccgtgagtcctcactgcactatccttactgccgcacacgggggtctggggtgcgggtgggggcggggaaggcgcagccgtcgcgggcctaggggacgccggcggtcttagccgagcgcggaggggtcggtgcccggggctcgcgcccagctctggtgtgctacggaggggcagatcccgcgtgcggccgccggcgcgggaaatgcgggaaatggcggcgccaggcgcacggtgatgggcggctctgtgtatccggcagacgatgagatgttctccgacatctacaagatccgggagatcgcggacgggttgtgcctggaggtggaggggaagatggtcagtaggacagaaggtaacattgatgactcgctcattggtggaaatgcctccgctgaaggccccgagggcgaaggtaccgaaagcacagtaatcactggtgtcgatattgtcatgaaccatcacctgcaggaaacaagtttcacaaaagaagcctacaagaagtacatcaaagattacatgaaatcaatcaaagggaaacttgaagaacagagaccagaaagagtaaaaccttttatgacaggggctgcagaacaaatcaagcacatccttgctaatttcaaaaactaccagttctttattggtgaaaacatgaatccagatggcatggttgctctattggactaccgtgaggatggtgtgaccccatatatgattttctttaaggatggtttagaaatggaaaaatgttaacaaatgtggcaattattttggatctatcacctgtcatcataactggcttctgcttgtcatccacacaacaccaggacttaagac

SEQ ID NO: 33272 - DNA, 1101 bp, Homo sapiens
atatgaggttggggagcggctgagtcggccttttccgcccgctcccccctccccccgagcgccgctccggctgcaccgcgctcgctccgagtttcaggctcgtgctaagctagcgccgtcgtcgtctcccttcagtcgccatcatgattatctaccgggacctcatcagccatggtcagtaggacagaaggtaacattgatgactcgctcattggtggaaatgcctccgctgaaggccccgagggcgaaggtaccgaaagcacagtaatcactggtgtcgatattgtcatgaaccatcacctgcaggaaacaagtttcacaaaagaagcctacaagaagtacatcaaagattacatgaaatcaatcaaagggaaacttgaagaacagagaccagaaagagtaaaaccttttatgacaggggctgcagaacaaatcaagcacatccttgctaatttcaaaaactaccagttctttattggtgaaaacatgaatccagatggcatggttgctctattggactaccgtgaggatggtgtgaccccatatatgattttctttaaggatggtttagaaatggaaaaatgttaacaaatgtggcaattattttggatctatcacctgtcatcataactggcttctgcttgtcatccacacaacaccaggacttaagacaaatgggactgatgtcatcttgagctcttcatttattttgactgtgatttatttggagtggaggcattgtttttaagaaaaacatgtcatgtaggttgtctaaaaataaaatgcatttaaactcatttgagagaatgccttttagtttaatgcatatttaaactaaattgatcctgtagtgttcctggagaagctagagcctgattgtaggctactactcatcaattaacttctacagtggagactacttctgggactggaatataaaaaagaatcaaaggttctgattttgagttgcaataaagggaaagaccatgctcatagcagtgccaacatctgaagtgtggagccttacccatttcatcacctacaacggaagtagttaactggaagagattaccaagagaataaaaagagactcattcagtg

SEQ ID NO: 33273 - DNA, 764 bp, Homo sapiens
gtttcaggctcgtgctaagctagcgccgtcgtcgtctcccttcagtcgccatcatgattatctaccgggacctcatcagccgtgaacgatgagatgttctccgacatctacaagatccgggagatcgcggacgggttgtgcctggaggtggaggggaagatggtcagtaggacagaaggtaacattgatgactcgctcattggtggaaatgcctccgctgaaggccccgagggcgaaggtaccgaaagcacagtaatcactggtgtcgatattgtcatgaaccatcacctgcaggaaacaagtttcacaaaagaagcctacaagaagtacatcaaagattacatgaaatcaatcaaagggaaacttgaagaacagagaccagaaagagtaaaaccttttatgacaggggctgcagaacaaatcaagcacatccttgctaatttcaaaaactaccagttctttattggtgaaaacatgaatccagatggcatggttgctctattggactaccgtgaggatggtgtgaccccatatatgattttctttaaggatggtttagaaatggaaaaatgttaacaaatgtggcaattattttggatctatcacctgtcatcataactggcttctgcttgtcatccacacaacaccaggacttaagacaaatgggactgatgtcatcttgagctcttcatttattttgactgtgatttatttggagtggaggcattgtttttaagaaaaacatgtcatgtaggttgtctaaa

SEQ ID NO: 33274 - DNA, 1028 bp, Homo sapiens
ggaacggagccttgtgtctccgcctcaagtccccggatgctcacctccccgactcgcccccgctgtggccccgcccccgcgcggctcttcgtgccacgtcaccgcctgcgtcgcttccggaggcgcagcgggcgatgacgtagagggacgtgccctctatatgaggttggggagcggctgagtcggccttttccgcccgctcccccctccccccgagcgccgctccggctgcaccgcgctcgctccgagtttcaggctcgtgctaagctagcgccgtcgtcgtctcccttcagtcgccatcatgattatctaccgggacctcatcagccacgatgagatgttctccgacatctacaagatccgggagatcgcggacgggttgtgcctggaggtggaggggaagatggtcagtaggacagaaggtaacattgatgactcgctcattggtggaaatgcctccgctgaaggccccgagggcgaaggtaccgaaagcacagtaatcactggtgtcgatattgtcatgaaccatcacctgcaggaaacaagtttcacaaaagaagcctacaagaagtacatcaaagattacatgaaatcaatcaaagggaaacttgaagaacagagaccagaaagagtaaaaccttttatgacaggggctgcagaacaaatcaagcacatccttgctaatttcaaaaactaccagttctttattggtgaaaacatgaatccagatggcatggttgctctattggactaccgtgaggatggtgtgaccccatatatgattttctttaaggatggtttagaaatggaaaaatgttaacaaatgtggcaattattttggatctatcacctgtcatcataactggcttctgcttgtcatccacacaacaccaggacttaagacaaatgggactgatgtcatcttgagctcttcatttattttgactgtgatttatttggagtggaggcattgtttttaagaaaaacatgtcatgtaggttgtctaaaaataaaatgcatttaaactc

SEQ ID NO: 33275 - DNA, 1766 bp, Homo sapiens
gatgacacatccgaaaaataggaagtggccactacggaagctgttctgggccagaaagacttccagtttggagtcgtttgctgcggggagggaatgaatgggcgctgggaacacgcccgcgaggtggggacgcgccggccgtagcgaggtccttagcgtgtgagtggccggggtcgggtcgcttccccgcagcatggaggacgatgcaccagtgatctacgggctggagttccaggcacgtgccttaacacctcaaactgcagaaacagatgccattcggtttttggttgggacgcagtctcttaaatatgataatcagatccatatcatagattttgacgatgaaaacaacattataaataaaaatgtcctcctccatcaagcgggtgaaatctggcatattagcgctagccctgcagacagaggtgtgctgacgacctgctacaacagaacttcagacagcaaagtcctgacatgtgcagccgtgtggaggatgccgaaggaattggaatcaggcagccacgagtcccctgatgattcatccagcactgcacagaccctggagctgctctgtcaccttgacaacacagcccatggcaacatggcctgtgtcgtgtgggagccaatgggagatgggaagaaaatcatttccttggctgataaccatatcctgctgtgggatttacaggaaagctcgagccaggctgtgctggccagctcagcgtccctggaagggaagggacaactgaagttcacctcaggacggtggagcccacatcataactgcacccaggtggccacagcgaacgacaccaccctccgtggctgggacacccggagcatgagccagatctactgcatagagaatgcccacggacagctggtgcgggaccttgactttaatcccaataagcagtactacttggccagctgcggagacgactgtaaggtgaagttctgggacacccgaaatgtcaccgaacccgtgaagaccctggaggagcactcccactgggtgtggaacgtccgctacaaccactctcatgaccagctggtcctcacgggcagcagtgacagcagagtcatcctttccaacatggtgtccatctcgtcggagcccttcggccacttggtagacgacgatgacatcagtgaccaggaggaccaccgttctgaagagaagagcaaggagcccctgcaggacaacgtgatcgccacctacgaggagcacgaggacagcgtctatgccgtggactggtcctcggctgacccgtggctgtttgcctccctgagctatgacgggaggctcgtgatcaacagggtgcccagggccctgaagtaccacatcctgctatgactcccgggcctgggttatccaggtcccattgagtggttttcctcttggcagattctcaaacagtcgcagctctttggaggtgactcgtgttccaggtggatccctctctgggagagccgctgttcccttcctgtagcagcagcatttatgaatggggtgaatggggctattgtcgacggcacagctaatgcccgaacccagcccctgtcggcagagacagagccccacattattatgtgaataacaatgttttctgttttaagggtgtcaggagtttcgctttttaaaaaaatgtctgttcctgcaatagtaactcttctttctcttgagagtaaaaaatgaaataaaataaatccacgctgcacaggtgctcggctcattctttcaggagctctgccctgtgacccca

SEQ ID NO: 33276 - DNA, 1686 bp, Homo sapiens
atgccgtcgtttccggggctgcttccgagccggacccaagggccggggcgtggaggagtagaggggcgagcgcatgcgcacaggactacacgtcccgacaggcgtcgggagcggcggcccagttccttgtgggagctgtagttctgcaggcgcggaagccgtggtgctcggccggcagagcactcggtttcccagagggctgagcgcgccgcacggaggtgcggcgccgaccaagatggagactgccgagcagccttgagccgttgagcagctgaacagaggccatgccggggcactccgaggcctgagacgaccacgcctgtgccgctgaggaccttcatcagggctccgtccacttggcccgcttggctgtccaatcacactccagtgtcaaccactggcacccagcagccaagagaggtgtggcgtggccctggggacgcatggctgaggcaggaacaggtgagccgtcccccagcgtggagggcgaacacgggacggagtatgacacgctgccttccgacacagtctccctcagtgactcggactctgacctcagcttgcccggtggtgctgaagtggaagcactgtccccgatggggctgcctggggaggaggattcaggtcctgatgagccgccctcacccccgtcaggcctcctcccagccacggtgcagccattccatctgagaggcatgagctccaccttctcccagcgcagccgtgacatctttgactgcctggagggggcggccagacgggctccatcctctgtggcccacaccagcatgagtgacaacggaggcttcaagcggcccctagcgccctcaggccggtctccagtggaaggcctgggcagggcccatcggagccctgcctcaccaagggtgcctccggtccccgactacgtggcacaccccgagcgctggaccaagtacagcctggaagatgtgaccgaggtcagcgagcagagcaatcaggccaccgccctggccttcctgggctcccagagcctggctgcccccactgactgcgtgtcctccttcaaccaggatccctccagctgtggggaggggagggtcatcttcaccaaaccagtccgaggggtcgaagccagacacgagaggaagagggtcctggggaaggtgggagagccaggcaggggcggccttgggaatcctgccacagacaggggcgagggccctgtggagctggcccatctggccgggcccgggagcccagaggctgaggagtggggcagccaccatggaggcctgcaggaggtggaggcactgtcagggtctgtccacagtgggtctgtgccaggtctcccgccggtggaaactgttggcttccatggcagcaggaagcggagtcgagaccacttccggaacaagagcagcagccccgaggacccaggtgctgaggtctgagagggagatggcccagcctgaccccactggccactgccatcctgctgccttcccagtggggctggtcagggggcagcctggccactgcctagctggaatgggaggaagcctgcaggtggcaccggtggccctggctgcagttctgggcagcatcctcccaagcagagaccttgctgaagctcctggggtgtggggtgtgggctggaagcactggctccctggtagggacaataaaggttttgggtctttctga

SEQ ID NO: 33277 - DNA, 1542 bp, Homo sapiens
ccctcctcttcctgttcttggtcaattccggtcttgtttccccaacaaatgccgtcgtttccggggctgcttccgagccggacccaagggccggggcgtggaggagtagaggggcgagcgcatgcgcacaggactacacgtcccgacaggcgtcgggagcggcggcccagttccttgtgggagctgtagttctgcaggcgcggaagccgtggtgctcggccggcagagcactcggtttcccagagggctgagcgcgccgcacggaggtgcggcgccgaccaagatggagactgccgagcagccttgagccgttgagcagctgaacagaggccatgccggggcactccgaggcctgagacgaccacgcctgtgccgctgaggaccttcatcagggctccgtccacttggcccgcttggctgtccaatcacactccagtgtcaaccactggcacccagcagccaagagaggtgtggcgtggccctggggacgcatggctgaggcaggaacaggcctcctcccagccacggtgcagccattccatctgagaggcatgagctccaccttctcccagcgcagccgtgacatctttgactgcctggagggggcggccagacgggctccatcctctgtggcccacaccagcatgagtgacaacggaggcttcaagcggcccctagcgccctcaggccggtctccagtggaaggcctgggcagggcccatcggagccctgcctcaccaagggtgcctccggtccccgactacgtggcacaccccgagcgctggaccaagtacagcctggaagatgtgaccgaggtcagcgagcagagcaatcaggccaccgccctggccttcctgggctcccagagcctggctgcccccactgactgcgtgtcctccttcaaccaggatccctccagctgtggggaggggagggtcatcttcaccaaaccagtccgaggggtcgaagccagacacgagaggaagagggtcctggggaaggtgggagagccaggcaggggcggccttgggaatcctgccacagacaggggcgagggccctgtggagctggcccatctggccgggcccgggagcccagaggctgaggagtggggcagccaccatggaggcctgcaggaggtggaggcactgtcagggtctgtccacagtgggtctgtgccaggtctcccgccggtggaaactgttggcttccatggcagcaggaagcggagtcgagaccacttccggaacaagagcagcagccccgaggacccaggtgctgaggtctgagagggagatggcccagcctgaccccactggccactgccatcctgctgccttcccagtggggctggtcagggggcagcctggccactgcctagctggaatgggaggaagcctgcaggtggcaccggtggccctggctgcagttctgggcagcatcctcccaagcagagaccttgctgaagctcctggggtgtggggtgtgggctggaagcactggctccctggtagggacaataaaggttttgggtctttctga

SEQ ID NO: 33278 - DNA, 863 bp, Homo sapiens
cgaccaagatggagactgccgagcagccttgagccgggctgctcaaggtgatggtcgacaccccactttcctgagagcttgaccctcagatgccagggccttggctgcagattccttgggagctcccggggatcttccagcaaataggagcaaatcttttccccgtggatcaggaaggtgcacgctctttgtggaatacgactgctcaccccgcacagcaagcagcttataagtggccctcctgcctgatttcagccctgggttcaagccctgggtggctgcttactaccaaaatcgctcagtagctccaagcctgcctgcagagggttggcaccattaaatgagttgagcagctgaacagaggccatgccggggcactccgaggcctgagacgaccacgcctgtgccgctgaggaccttcatcagggctccgtccacttggcccgcttggctgtccaatcacactccagtgtcaaccactggcacccagcagccaagagaggtgtggcgtggccctggggacgcatggctgaggcaggaacaggtgagccgtcccccagcgtggagggcgaacacgggacggagtatgacacgctgccttccgacacagtctccctcagtgactcggactctgacctcagcttgcccggtggtgctgaagtggaagcactgtccccgatggggctgcctggggaggaggattcaggtcctgatgagccgccctcacccccgtcaggcctcctcccagccacggtgcagccattccatctgagaggcatgagctccaccttctcccagcgcagccgtgacatctttgactgcctggagggggcggccagacgggctccatcctctgtggccca

SEQ ID NO: 33279 - DNA, 974 bp, Homo sapiens
gcggcgccgaccaagatggagactgccgagcagccttgagccgggctgctcaaggtgatggtcgacaccccactttcctgagagcttgaccctcagatgccagggccttggctgcagattccttgggagctcccggggatcttccagcaaataggagcaaatcttttccccgtggatcaggaagttgagcagctgaacagaggccatgccggggcactccgaggcctgagacgaccacgcctgtgccgctgaggaccttcatcagggctccgtccacttggcccgcttggctgtccaatcacactccagtgtcaaccactggcacccagcagccaagagaggtgtggcgtggccctggggacgcatggctgaggcaggaacaggtgagccgtcccccagcgtggagggcgaacacgggacggagtatgacacgctgccttccgacacagtctccctcagtgactcggactctgacctcagcttgcccggtggtgctgaagtggaagcactgtccccgatggggctgcctggggaggaggattcaggtcctgatgagccgccctcacccccgtcaggcctcctcccagccacggtgcagccattccatctgagaggcatgagctccaccttctcccagcgcagccgtgacatctttgactgcctggagggggcggccagacgggctccatcctctgtggcccacaccagcatgagtgacaacggaggcttcaagcggcccctagcgccctcaggccggtctccagtggaaggcctgggcagggcccatcggagccctgcctcaccaagggtgcctccggtccccgactacgtggcacaccccgagcgctggaccaagtacagcctggaagatgtgaccgaggtcagcgagcagagcaatcaggccaccgccctggccttcctgggctcccagagcctggctgcccccactgactgcgtgtcctccttcaaccagg

SEQ ID NO: 33280 - DNA, 851 bp, Homo sapiens
ctcagtagctccaagcctgcctgcagagggttggcaccattaaatgagttgagcagctgaacagaggccatgccggggcactccgaggcctgagacgaccacgcctgtgccgctgaggaccttcatcagggctccgtccacttggcccgcttggctgtccaatcacactccagtgtcaaccactggcacccagcagccaagagaggtgtggcgtggccctggggacgcatggctgaggcaggaacaggcctcctcccagccacggtgcagccattccatctgagaggcatgagctccaccttctcccagcgcagccgtgacatctttgactgcctggagggggcggccagacgggctccatcctctgtggcccacaccagcatgagtgacaacggaggcttcaagcggcccctagcgccctcaggccggtctccagtggaaggcctgggcagggcccatcggagccctgcctcaccaagggtgcctccggtccccgactacgtggcacaccccgagcgctggaccaagtacagcctggaagatgtgaccgaggtcagcgagcagagcaatcaggccaccgccctggccttcctgggctcccagagcctggctgcccccactgactgcgtgtcctccttcaaccaggatccctccagctgtggggaggggagggtcatcttcaccaaaccagtccgaggggtcgaagccagacacgagaggaagagggtcctggggaaggtgggagagccaggcaggggcggccttgggaatcctgccacagacaggggcgagggccctgtggagctggcccatctggccgggcccgggagcccagaggctgaggagtgggg

SEQ ID NO: 33281 - DNA, 1423 bp, Homo sapiens
gttgagcagctgaacagaggccatgccggggcactccgaggcctgagacgaccacgcctgtgccgctgaggaccttcatcagggctccgtccacttggcccgcttggctgtccaatcacactccagtgtcaaccactggcacccagcagccaagagaggtgtggcgtggccctggggacgcatggctgaggcaggaacaggtgagccgtcccccagcgtggagggcgaacacgggacggagtatgacacgctgccttccgacacagtctccctcagtgactcggactctgacctcagcttgcccggtggtgctgaagtggaagcactgtccccgatggggctgcctggggaggaggattcaggtcctgatgagccgccctcacccccgtcaggcctcctcccagccacggtgcagccattccatctgagaggcatgagctccaccttctcccagcgcagccgtgacatctttgactgcctggagggggcggccagacgggctccatcctctgtggcccacaccagcatgagtgacaacggaggcttcaagcggcccctagcgccctcaggccggtctccagtggaaggcctgggcagggcccatcggagccctgcctcaccaagggtgcctccggtccccgactacgtggcacaccccgagcgctggaccaagtacagcctggaagatgtgaccgaggtcagcgagcagagcaatcaggccaccgccctggccttcctgggctcccagagcctggctgcccccactgactgcgtgtcctccttcaaccaggatccctccagctgtggggaggggagggtcatcttcaccaaaccagtccgaggggtcgaagccagacacgagaggaagagggtcctggggaaggtgggagagccaggcaggggcggccttgggaatcctgccacagacaggggcgagggccctgtggagctggcccatctggccgggcccgggagcccagaggctgaggagtggggcagccaccatggaggcctgcaggaggtggaggcactgtcagggtctgtccacagtgggtctgtgccaggtctcccgccggtggaaactgttggcttccatggcagcaggaagcggagtcgagaccacttccggaacaagagcagcagccccgaggacccaggtgctgaggtctgagagggagatggcccagcctgaccccactggccactgccatcctgctgccttcccagtggggctggtcagggggcagcctggccactgcctagctggaatgggaggaagcctgcaggtggcaccggtggccctggctgcagttctgggcagcatcctcccaagcagagaccttgctgaagctcctggggtgtggggtgtgggctggaagcactggctccctggtagggacaataaaggttttgggtctttctg

SEQ ID NO: 33282 - DNA, 979 bp, Homo sapiens
cgagagttcgtttgttctctggcggggaggtcttgctggcacatatagtggagaaaggccgggctctgcgttcatgtggagaaagagacggcttccttcagcctacggacatgaaggagtcaactctaccttccactcgttgccggctttcgccgagaaccccgagaaacggactaccggagtccctatcttgcagcccgatccccgctacccgtcggagtgccccgctgaccaggctgcttctggccgcggcggcgttccgctgcagaggacgggagtgcgaatctgggaagcagggttctggttgaactccagcttcgtctgcaacatactgtgtgacttgggcaaattatttcccccgccccgttcctgccagctttaaaacggtcatcagtggggggtgctgcgtatcccctttcactggggtggcttcttcactgaggagagtcgcgcctcagaggaactgagttgagcagctgaacagaggccatgccggggcactccgaggcctgagacgaccacgcctgtgccgctgaggaccttcatcagggctccgtccacttggcccgcttggctgtccaatcacactccagtgtcaaccactggcacccagcagccaagagaggtgtggcgtggccctggggacgcatggctgaggcaggaacaggtgagccgtcccccagcgtggagggcgaacacgggacggagtatgacacgctgccttccgacacagtctccctcagtgactcggactctgacctcagcttgcccggtggtgctgaagtggaagcactgtccccgatggggctgcctggggaggaggattcaggtcctgatgagccgccctcacccccgtcaggcctcctcccagccacggtgcagccattccatctgagaggcatgagctccaccttctcccagcgcagccgtgacatctttgactgcctggagggggcggccagacgggctccatcctctg

SEQ ID NO: 33283 - DNA, 912 bp, Homo sapiens
ccattaaatgaggtaacgagtcaaaagtccctaccctgggtcctagcctgtcaggggctccgaaaacccaggctcaggtcggtcctgcccggcacctgtttcacacatgtacactccggtctgaggttggtcctctcccccaccccacccacctgcagttgagcagctgaacagaggccatgccggggcactccgaggcctgagacgaccacgcctgtgccgctgaggaccttcatcagggctccgtccacttggcccgcttggctgtccaatcacactccagtgtcaaccactggcacccagcagccaagagaggtgtggcgtggccctggggacgcatggctgaggcaggaacaggtgagccgtcccccagcgtggagggcgaacacgggacggagtatgacacgctgccttccgacacagtctccctcagtgactcggactctgacctcagcttgcccggtggtgctgaagtggaagcactgtccccgatggggctgcctggggaggaggattcaggtcctgatgagccgccctcacccccgtcaggcctcctcccagccacggtgcagccattccatctgagaggcatgagctccaccttctcccagcgcagccgtgacatctttgactgcctggagggggcggccagacgggctccatcctctgtggcccacaccagcatgagtgacaacggaggcttcaagcggcccctagcgccctcaggccggtctccagtggaaggcctgggcagggcccatcggagccctgcctcaccaagggtgcctccggtccccgactacgtggcacaccccgagcgctggaccaagtacagcctggaagatgtgaccgaggtcagcgagcagagcaatcaggccaccgccctggccttcctgggctcccagagcctgg

SEQ ID NO: 33284 - DNA, 2461 bp, Homo sapiens
ttctgtttaatgttttattaaacataggggtgggttaaaccactgggttttaaatgaagcacttagagcttttcaacttgccccatagctttgtctcagaaccgatcattctattatcattagttttgagaatgccgtgtaaagagcaaagtaaccactggtggttgcactccggagcgggcgaggacggctagttcctgcagtgcccaggcctgcacggaagcgccctggcacaactcagctgaggatacacgctttttcccgcgcagccggagggctgaacagcaaagcactccccgggggaactgtgtgtcagcgcagcctggagagagcaggcccagggggcagctccaccacaggagacaggacacgcctcagtctgggcaaattcccggcctcctttggctctaagccagcagccgccgcccgcgacctcctctcctcctccgtcgtcaccccggccgccctgccagccccgaacttgcccgcgcctggccgcgcggcccctcagcccacggggctggcggcgcggttgggatgggaccgatgtggcgcatgcgtggtggcgccactaggcgcgggagttgctgcggcggggacggtgctgcggacggccgagggccaggccgctccggccgggctcgtggtgggggcagccccagcggcggcggcggcggcgtgggctggcgaggccgcgcggacggcgcccgacagcagctggaggagcggtttgccgacctggcggcgagccacttggaggccatccgtgcgcgggacgagtgggaccggcagaacgcgcggctgcgtcaggagaacgcccggctgcggctcgagaaccggcggctgaagcgcgagaaccgcagcctcttccgtcaggctttgcggctccccggcgaaggcggcaacgggacgcccgcggaggcacgccgggtccctgaagaggccagcacgaaccggagggctagagacagcggccgagaggacgagccgggcagccccagggccctgagggcccgacttgagaagctggaagccatgtaccgccgggccctgctgcagctgcacctcgagcagcggggaccacgtccgagcggggacaaggaggagcagcctctacaggaacccgactccggcctccgctcccgggactcggagccctctgggccctggctgtagccgaggccgcagccggtgagaggcggagcctcgagcgggcccctcctcctccgttcccagctacccccgacctcgcgcacgccctggcccgctccctgcccgcggataccttggactacggtgccttcccgcccccaccagtggacacttccgggtggcgcttggccatccgcttggtggaggtcgagtgggtgcaagggccctcaggacctcccacatgtacagttcccctgcctcttgccccggctagtttccctggagagaggcctagccaacaacgaagggacggattttaaaacagcgagaactgggtgccaagaaacacttcatattccctgaacttttctggatgttgtgcgaacctgttgtatttttttttttcctgtattttggttctgagggatgagtaatgtgtttttagttggttgagtttatccattcttcaatcccctaaagccttcagctattctttcatatgtggccaacattttaagtacagtgtttgcttttataagtcggtgttacttggatgtcctataaaatacccactttttataaagatgatatttataacctaggaactcatgcctgtcttggctgcagtccctgtacatctaatatatactgatttgtttgcccccagagaatttttaaggtatctgcctatatcgtgatcttttgaaatggtaaataaatctggtgcattaaaaattatctgaaaggttgcggcgagtattatttgaagtgtgttacatttttatatttttaaaaagatacctttatgaatatactaatttaaatctggttttagttgtccttagtaaactatcatgttcttttagcttcatgtaacagtgatcttttaaaataatctaaagattaggtagtctaaaagttattttaatctttaatgttcaattagcttaattagtacgtagataatttgccttattttgactaaggacttttaagaaattataaattacttgtatatcaaaagttcccctaacaaagtaatttaagtctcagttgttatttcaatggcacaaaaaagtgactagtttagcaataaatgtcctaaaattacttttattgcgcttcgttaataacacttttgccaactaagtaatgaagaggataccattgtgcctgataaaaaaatcataggtccaagagtgtttcaatgatggaaaacatttcaggggaaaaaatcatgaatagaattgtcaagggaataaaatatactagttatggcatagtccaaaagtattaaatattatatatt

SEQ ID NO: 33285 - DNA, 1545 bp, Homo sapiens
tcctcctctgcgtcctcggccgcggcccgggtccctcgcaaagccgctgccatcccggagggcccagccagcgggctcccggaggctggccgggcaggcgtggtgcgcggtaggagctgggcgcgcacggctaccgcgcgtggaggagacactgccctgccgcgatgggggcccggggcgctccttcacgccgtaggcaagcggggcggcggctgcggtacctgcccaccgggagctttcccttccttctcctgctgctgctgctctgcatccagctcgggggaggacagaagaaaaaggagaatcttttagctgaaaaagtagagcagctgatggaatggagttccagacgctcaatcttccgaatgaatggtgataaattccgaaaatttataaaggcaccacctcgaaactattccatgattgttatgttcactgctcttcagcctcagcggcagtgttctgtgtgcaggcaagctaatgaagaatatcaaatactggcgaactcctggcgctattcatctgctttttgtaacaagctcttcttcagtatggtggactatgatgaggggacagacgtttttcagcagctcaacatgaactctgctcctacattcatgcattttcctccaaaaggcagacctaagagagctgatacttttgacctccaaagaattggatttgcagctgagcaactagcaaagtggattgctgacagaacggatgttcatattcgggttttcagaccacccaactactctggtaccattgctttggccctgttagtgtcgcttgttggaggtttgctttatttgagaaggaacaacttggagttcatctataacaagactggttgggccatggtgtctctgtgtatagtctttgctatgacttctggccagatgtggaaccatatccgtggacctccatatgctcataagaacccacacaatggacaagtgagctacattcatgggagcagccaggctcagtttgtggcagaatcacacattattctggtactgaatgccgctatcaccatggggatggttcttctaaatgaagcagcaacttcgaaaggcgatgttggaaaaagacggataatttgcctagtgggattgggcctggtggtcttcttcttcagttttctactttcaatatttcgttccaagtaccacggctatccttatagtgatctggactttgagtgagaagatgtgatttggaccatggcacttaaaaactctataacctcaggcaactttttaattaaatgaagccaagtgggatttgcataaagtgaatgtttaccatgaagataaactgttcctgactttatactattttgaattcattcatttcattgtgatcagctagcttattcttgtgtactttttttaaactgtgggttttcctagtaaatttaatttacagaaatcaatggtagcatttagtaatctacaaaggaaatatcaaagtgtttttcaagcctgttatattcagtgtgtgccacaggattgaaataaatgacaatgtaattatgaa

SEQ ID NO: 33286 - DNA, 3683 bp, Homo sapiens
gcctttccaggtcttctcccggtgaaccggatgctctgtcagtctcctcctctgcgtcctcggccgcggcccgggtccctcgcaaagccgctgccatcccggagggcccagccagcgggctcccggaggctggccgggcaggcgtggtgcgcggtaggagctgggcgcgcacggctaccgcgcgtggaggagacactgccctgccgcgatgggggcccggggcgctccttcacgccgtaggcaagcggggcggcggctgcggtacctgcccaccgggagctttcccttccttctcctgctgctgctgctctgcatccagctcgggggaggacagaagaaaaaggagaatcttttagctgaaaaagtagagcagctgatggaatggagttccagacgctcaatcttccgaatgaatggtgataaattccgaaaatttataaaggcaccacctcgaaactattccatgattgttatgttcactgctcttcagcctcagcggcagtgttctgtgtgcaggcaagctaatgaagaatatcaaatactggcgaactcctggcgctattcatctgctttttgtaacaagctcttcttcagtatggtggactatgatgaggggacagacgtttttcagcagctcaacatgaactctgctcctacattcatgcattttcctccaaaaggcagacctaagagagctgatacttttgacctccaaagaattggatttgcagctgagcaactagcaaagtggattgctgacagaacggatgttcatattcgggttttcagaccacccaactactctggtaccattgctttggccctgttagtgtcgcttgttggaggtttgctttatttgagaaggaacaacttggagttcatctataacaagactggttgggccatggtgtctctgtgtatagtctttgctatgacttctggccagatgtggaaccatatccgtggacctccatatgctcataagaacccacacaatggacaagtgagctacattcatgggagcagccaggctcagtttgtggcagaatcacacattattctggtactgaatgccgctatcaccatggggatggttcttctaaatgaagcagcaacttcgaaaggcgatgttggaaaaagacggataatttgcctagtgggattgggcctggtggtcttcttcttcagttttctactttcaatatttcgttccaagtaccacggctatccttatagctttttaattaaatgaagccaagtgggatttgcataaagtgaatgtttaccatgaagataaactgttcctgactttatactattttgaattcattcatttcattgtgatcagctagcttattcttgtgtactttttttaaactgtgggttttcctagtaaatttaatttacagaaatcaatggtagcatttagtaatctacaaaggaaatatcaaagtgtttttcaagcctgttatattcagtgtgtgccacaggattgaaataaatgacaatgtaattatgaattcatgttttagagctgtttactcattagtaaaggaccgcaatgttagtaaagaaaacctatgaaatgtatgttaaagattcttagtattgtacagggataaagcaaatgcatgaaaatatgtcatgtactgaaaattaaacttacttcagtttcagttataaaggacgtgcactgttacgaatagtgttttgttattaattataactagataaaggtatataggacagggaactggatgaatggtacctacaatttggatgcctaaccaaggactagagctccttcttgagatctaaatctaaagtaaatgtgcattaaagcagtgtgcttcaaaggcatcagacgatgaaagcaacataccacaactaggagttatttctcaaacttaaatgtcctctgggaatccagacttaaaaataagagcaaacttaacacactatccattttcgagcaaacctaacccactatatccattttgctcatgtgttttatgcaaccagctttccatcaaatcctcaatctttgaatccaggtaaaaggttaattatcctaggattagtgaatgattcaatgaagctttcttgaaaacaaacataggagtgtaatgtactattatgtttgtatcctgttttagtttataaagcactttcacatacattatggtatttcttcctcacaataaccttgtaaattagtcaggaaatgtaaattttatctgactcatagaactaatggaagctgaaagccaaaaataaagtttataaccaggccttcaaactctcaaacatggatttttatattctgtggagttatccaaattaattagggtttaggaaagcagttcttcttgagtcagttcaataagtgtttgctttttgtttttaaggtttgttatctaattttcattaagatttgagtaacagaccatggagaattgttttcattgggagttccagctatatagcctcaaacaagaaacgggtgtacaaccattgagtttacttacttaaatctgtgaatttcaatgaagaatgggaatataaaggcctactggggcatgtttatcaagttatatcccagggcaatgtgtatgctagcaggatgaatgctatcttttcaaaacataatattcagtgaaaattacgtaataattgtaagtttataatcatactcccaaatctgttactaaaaataacataaattctcctagttcatgtacttagatgaataaatttagttttggaatgacgtttatggaaaagcaatagatgaacttaatcatttgatcactgcctatcactaggcagaacttgacctgtaattcttaatccattgtagattttttacattttactcaaaacttcatacatagagactctcaggtcaaattttacaagtattaaacatttgttaattataatcacttttgtttgtatccttaaatctcagaattatcttgcagttaatatgcagctgattaaatgatattacaaattatctctaatctcactgtaaatcttttaatcatatcaaagtcaggtcatcctcagacactataactaagatagataaggagtactttactataccatattagtaaaggttttctagctcttattttctaatttcctctgagcatttaaaattacatccagtgataaaaacaatatttttttttcagaatttcatgctttaaaaagctgtggcttctctatagacaactgttacattagggaagtgattctagagcaaaatatactgcctcaacataagtcgttactgactggaaaatgctataggcagaattgcaaagagtggctcaaacatatagtttgcttgcagaatgtaacgtgcaaaatcacatacatgcgatgtatttacctttgctagacaatgagaattgaataattgatttgtacctggtatgttatatcctccagtgtcactttttaaccagattcactgtgcgttccaaactgtcataaaaattgattatatgtttaacaattgtttttctactacagtggagagaaaaatcccaattataaaattccacctaaaggagtttcattttgtaataacatctgattaataacttgttgcattttgcttaacatactgttcctggcattagatattcacatgagtaagcccagtagca

SEQ ID NO: 33287 - DNA, 1498 bp, Homo sapiens
cggccgcggcccgggtccctcgcaaagccgctgccatcccggagggcccagccagcgggctcccggaggctggccgggcaggcgtggtgcgcggtaggagctgggcgcgcacggctaccgcgcgtggaggagacactgccctgccgcgatgggggcccggggcgctccttcacgccgtaggcaagcggggcggcggctgcggtacctgcccaccgggagctttcccttccttctcctgctgctgctgctctgcatccagctcgggggaggacagaagaaaaaggagaatcttttagctgaaaaagtagagcagctgatggaatggagttccagacgctcaatcttccgaatgaatggtgataaattccgaaaatttataaaggcaccacctcgaaactattccatgattgttatgttcactgctcttcagcctcagcggcagtgttctgtgtgcaggcaagctaatgaagaatatcaaatactggcgaactcctggcgctattcatctgctttttgtaacaagctcttcttcagtatggtggactatgatgaggggacagacgtttttcagcagctcaacatgaactctgctcctacattcatgcattttcctccaaaaggcagacctaagagagctgatacttttgacctccaaagaattggatttgcagctgagcaactagcaaagtggattgctgacagaacggatgttcatattcgggttttcagaccacccaactactctggtaccattgctttggccctgttagtgtcgcttgttggaggtttgctttatttgagaaggaacaacttggagttcatctataacaagactggttgggccatggtgtctctgtgtatagtctttgctatgacttctggccagatgtggaaccatatccgtggacctccatatgctcataagaacccacacaatggacaagtgagctacattcatgggagcagccaggctcagtttgtggcagaatcacacattattctggtactgaatgccgctatcaccatggggatggttcttctaaatgaagcagcaacttcgaaaggcgatgttggaaaaagacggataatttgcctagtgggattgggcctggtggtcttcttcttcagttttctactttcaatatttcgttccaagtaccacggctatccttatagtgatctggactttgagtgagaagatgtgatttggaccatggcacttaaaaactctataacctcagctttttaattaaatgaagccaagtgggatttgcataaagtgaatgtttaccatgaagataaactgttcctgactttatactattttgaattcattcatttcattgtgatcagctagcttattcttgtgtactttttttaaactgtgggttttcctagtaaatttaatttacagaaatcaatggtagcatttagtaatctacaaaggaaatatcaaagtgtttttcaagcctgttatattcagtgtgtgccacaggat

SEQ ID NO: 33288 - DNA, 1449 bp, Homo sapiens
ggagggcccagccagcgggctcccggaggctggccgggcaggcgtggtgcgcggtaggagctgggcgcgcacggctaccgcgcgtggaggagacactgccctgccgcgatgggggcccggggcgctccttcacgccgtaggcaagcggggcggcggctgcggtacctgcccaccgggagctttcccttccttctcctgctgctgctgctctgcatccagctcgggggaggacagaagaaaaaggagaatcttttagctgaaaaagtagagcagctgatggaatggagttccagacgctcaatcttccgaatgaatggtgataaattccgaaaatttataaaggcaccacctcgaaactattccatgattgttatgttcactgctcttcagcctcagcggcagtgttctgtgtgcaggcaagctaatgaagaatatcaaatactggcgaactcctggcgctattcatctgctttttgtaacaagctcttcttcagtatggtggactatgatgaggggacagacgtttttcagcagctcaacatgaactctgctcctacattcatgcattttcctccaaaaggcagacctaagagagctgatacttttgacctccaaagaattggatttgcagctgagcaactagcaaagtggattgctgacagaacggatgttcatattcgggttttcagaccacccaactactctggtaccattgctttggccctgttagtgtcgcttgttggaggtttgctttatttgagaaggaacaacttggagttcatctataacaagactggttgggccatggtgtctctgtgtatagtctttgctatgacttctggccagatgtggaaccatatccgtggacctccatatgctcataagaacccacacaatggacaagtgagctacattcatgggagcagccaggctcagtttgtggcagaatcacacattattctggtactgaatgccgctatcaccatggggatggttcttctaaatgaagcagcaacttcgaaaggcgatgttggaaaaagacggataatttgcctagtgggattgggcctggtggtcttcttcttcagttttctactttcaatatttcgttccaagtaccacggctatccttatagtgatctggactttgagtgagaagatgtgatttggaccatggcacttaaaaactctataacctcaggcaaaagtcctcagataaaaatgtctaccaaaagactgacacgtggagttaatcatttgacagatgcaatgcttccacccccaacaaatatactttcttaacttctgtttgttatcacttagggaaaaaaggcagtcaacaaatatatttcattctatctaggaaaaatgtagccaaatcttttttcccattaacaaataatgtaagccttaatattcaagggtaataaaaaatacaagtcttccaaa

SEQ ID NO: 33289 - DNA, 3596 bp, Homo sapiens
cattcttctctctgctctctgagctttccgttgcttccctgcccatctgtgctctcagcagcaccagcaaagttggcctcaaacttgaacaaagctgcaggctccagcgtctttctgggagctccgcgggggcagcaggcaggccccagcctctgaactcagctggcttgagaagctcagcccaacccttccagcacccagccggccctccgtctcctgagggacgcccctgcccccgacctggaggccctcagtctgggctggggaatggcgcgctgaggtccctccagagccccttgtcccagcctggagctgcagccgcgcaaggcccaggcccccatggcccacccggtgcagtccgagtttccttcagcacaggagccaggctccgccgcattcctggacctgccggagatggagatactcctcaccaaggcagagaacaaggatgacaagaccctgaatctgtccaagaccctctcggggcctctggatctggagcagaacagccagggcctacccttcaaggccatctccgaggggcacctggaggccccactgcctcggtccccctcccgggccagctcaaggagggcgtcctccatcgccaccacctcctatgcccaagaccaagaagcccccagagattacctcatcctggccgtcgtcgcctgcttctgccccgtctggcccctcaacctcatccccctcatcatttccatcatgtctcgaagcagcatgcaacagggcaacgtggacggcgcccggaggctgggccgcctggctcggctgctcagcattaccctcatcatcatgggcatcgtcattatcatggtggccgtgaccgtcaacttcacagttcagaagaaataaacttaagcagggagctgggctagcagaggccggccctggccatcgggagagctctgacctgcacaccgcgggaggccagggtgctgactgtcaagcatcccctgtccccaagttccaaaagcacagactcaaagggaaaccccccagtcacccactgtcagcccccatctgacaagaaagcctggagcgaggaaggaaagcacagcgaacccaatgggtaacgtggtttactctcccggacgcgtcctgggatctcaaccccagcagtctggcttgtttctcattcccacaatttcctgggttccaccaagcagcgaaaactgccaggatgaatgaggaaaaaacccagccccacaaacgagacacacgctggcggggagagacgcagcagagctccttcctgtctgtggactcggagcaaagacgtggggccccatcttttgtgttttcctcaagcggggaaagaatggactgtttgcatgcttcgtgccacacgcccgcggtgatcccagccagggccccgagcgcagaggcggagctgtgctcagcacaggcctgggacctcccccggcaggcacctgtggggggtgcagctcccgggaaggaggcaactgcctcacttaacatcctccgctgcaaggtggtggcgccgagaggcgtgtctgtgaagacaggtaccaggatggcaggacccgcacgcctcttcccacacctgtcagcttcggaagcatctctcgaggactctggtcccaggatgtctcccaggacaagccagtctgcctcttcctcctacttctgctgtagcctgggaccagacctggccaaggtcagccagcggggagggccgaggtctgagctctcgtcctgccgtggcccccgcgatggcctggggtgcaagcttggggctccgtctggtgctgcttaggtagtttcaggcttccagcccagccctatgctctgtgcttggccctgggcccctggccatccacaaacagcagaggccttccctggaggaggctttgggaccacccctggggggacttcccaaagggtcccaggctgtcaggggcgtttgcgccacctgcaagggcgtgggtcagagagtttttatgggggtctgttgtttgaccgtcctgagaccgagggaagggctcagctgaaggaccccgtctgcaggagagtcgggggaccaggtttgggaatacacttgcatgtacagagcctggggcctggacgccacggcctctcatcttaggacctaatgggacccccgaaaggagccaagtggggccctcggcctcttccttcgttccaggcccatgattttccctacacttctccctggcccaggctccagccacaggcacctctcctgcccccgcccaccctcctgaccgcagctcccaggccctggagacctccaggctttcctgccctgggcagccccacctcacagccagagtcaatgccttcatgggaagggctcccagccacacccagagtggcccaaagctgttgaagtcagcatcctttgtcccatcaggaccctcctgcctcctctccaggcccttgttcgcctccccaccctcctcagaggcccggggaagggaagagcaggtcagtacagaggttctgtctacagggaggggccctgggtctatgcacagctggagctctgagccttccacagcccgtgtgactgctagagggcaggggtgcagggctcagggggcccgggctggtcctttggggctggtgttcctacgtcagtccccacctggggaataaactccagcctctcctgctcatacagaagggactggttgggtttgctttatgggatctttgagaccaaaacagatgctcctgtttgctgggggagggtgtgagcacggagtatttctgtccctcgtgaagtcacgtcacacaggggagaggcgaggtcgatggaactggccacgcacaggctctggctctggaaggagggatgatgagtgggcgttttcccggcaggcccccggggtcctcagcctcagcaacccagggagaggacagaaacgaaccgatggttgagggattgtcacgggaggaacatgacacccgaagggactctaggtgccctcggagtgccacacatgcccagaccttctcacacccacacaaataggctctgccgtgcactcctacacacacacacacacacacacacgcttgttcacactcagaacccaggacagccacagccaccgcttaggggaagccactgcagatgcccctggaatgggcacagcacagccagggcgctcttccaggcaggcgaggataacttgagagtttcctagggcaccagggacagagctcagaggcccccgaggtgtgtgtaggaggcggaggcccgcagagcacagagcaggagaagggcttgggccctggaggagaaagccattctggacaccaggggacctggacggagggtccccacagcccgtgccccacgccgcctggaggccagaggggtcagtggccctgctgtcccggctccatcttggttctagccgccacctgcatgaacacagtggcccggcttaacgcactaacccagcctctccctgtgtcccacagggagtagcaagacccaccccacactgccttcaccatctacaccagtgacgccgctgtgtgtcttagcatggaaataaataaacctgaatgtacgtgctcgc

SEQ ID NO: 33290 - DNA, 1824 bp, Homo sapiens
aatcagtcattaaggctcactggcaagcccttcgtacttcttccctctccggcactagcttccttaagtcgactctgtgaaatacctgctaatcttatcctgaaccagagtttcgaccctcggaacagtcttgcccacatctttgggacccgattcgtcctgctgattccggcactcgaggggcgggttggttggaacccaccccaccaggcccctctcaatcccacacggtgtccacccttgcccgcaggacggcggcccggaagtgacgtagtggaagcggaagtggtgtagtggtgccgacttcctgttgtttgaggccgggttgggggtgtgcgattgtgtgggacggtctggggcagcccagcagcggctgaccctctgcctgcggggaagggagtcgccaggcggccgtcatggcggtgtcggagagccagctcaagaaaatggtgtccaagtacaaatacagagacctaactgtacgtgaaactgtcaatgttattactctatacaaagatctcaaacctgttttggattcatatgtttttaacgatggcagttccagggaactaatgaacctcactggaacaatccctgtgccttatagaggtaatacatacaatattccaatatgcctatggctactggacacatacccatataatccccctatctgttttgttaagcctactagttcaatgactattaaaacaggaaagcatgttgatgcaaatgggaagatatatcttccttatctacatgaatggaaacacccacagtcagacttgttggggcttattcaggtcatgattgtggtatttggagatgaacctccagtcttctctcgtcctatttcggcatcctatccgccataccaggcaacggggccaccaaatacttcctacatgccaggcatgccaggtggaatctctccatacccatccggataccctcccaatcccagtggttacccaggctgtccttacccacctggtggtccatatcctgccacaacaagttctcagtacccttctcagcctcctgtgaccactgttggtcccagtagggatggcacaatcagcgaggacaccatccgagcctctctcatctctgcggtcagtgacaaactgagatggcggatgaaggaggaaatggatcgtgcccaggcagagctcaatgccttgaaacgaacagaagaagacctgaaaaagggtcaccagaaactggaagagatggttacccgtttagatcaagaagtagccgaggttgataaaaacatagaacttttgaaaaagaaggatgaagaactcagttctgctctggaaaaaatggaaaatcagtctgaaaacaatgatatcgatgaagttatcattcccacagctcccttatacaaacagatcctgaatctgtatgcagaagaaaacgctattgaagacactatcttttacttgggagaagccttgagaaggggcgtgatagacctggatgtcttcctgaagcatgtacgtcttctgtcccgtaaacagttccagctgagggcactaatgcaaaaagcaagaaagactgccggtctcagtgacctctactgacttctctgataccagctggaggttgagctcttcttaaagtattcttctcttccttttatcagtaggtgcccagaataagttattgcagtttatcattcaagtgtaaaatattttgaatcaataatatattttctgttttcttttggtaaagactggcttttattaatgcactttctatcctctgtaaactttttgtgctgaatgttgggactgctaaataaaatttgttgcataa

SEQ ID NO: 33291 - DNA, 1200 bp, Homo sapiens
ctgttgtttgaggccgggttgggggtgtgcgattgtgtgggacggtctggggcagcccagcagcggctgaccctctgcctgcggggaagggagtcgccaggcggccgtcatggcggtgtcggagagccagctcaagaaaatggtgtccaagccacagtcagacttgttggggcttattcaggtcatgattgtggtatttggagatgaacctccagtcttctctcgtcctatttcggcatcctatccgccataccaggcaacggggccaccaaatacttcctacatgccaggcatgccaggtggaatctctccatacccatccggataccctcccaatcccagtggttacccaggctgtccttacccacctggtggtccatatcctgccacaacaagttctcagtacccttctcagcctcctgtgaccactgttggtcccagtagggatggcacaatcagcgaggacaccatccgagcctctctcatctctgcggtcagtgacaaactgagatggcggatgaaggaggaaatggatcgtgcccaggcagagctcaatgccttgaaacgaacagaagaagacctgaaaaagggtcaccagaaactggaagagatggttacccgtttagatcaagaagtagccgaggttgataaaaacatagaacttttgaaaaagaaggatgaagaactcagttctgctctggaaaaaatggaaaatcagtctgaaaacaatgatatcgatgaagttatcattcccacagctcccttatacaaacagatcctgaatctgtatgcagaagaaaacgctattgaagacactatcttttacttgggagaagccttgagaaggggcgtgatagacctggatgtcttcctgaagcatgtacgtcttctgtcccgtaaacagttccagctgagggcactaatgcaaaaagcaagaaagactgccggtctcagtgacctctactgacttctctgataccagctggaggttgagctcttcttaaagtattcttctcttccttttatcagtaggtgcccagaataagttattgcagtttatcattcaagtgtaaaatattttgaatcaataatatattttctgttttcttttggtaaagactggcttttattaatgcactttctatcctctgtaaactttttgtgctgaatgttgggactgctaaataaaatttgttgcat

SEQ ID NO: 33292 - DNA, 2068 bp, Homo sapiens
gcgggtccccagaagcctacaggtgagtatcggttctccccttcccggctttcggtccggaggaggcgggagcagcttccctgttctgatcctatcgcgggcggcgcagggccggcttggccttccgtgggacggggaggggggcgggatgtgtcacccaaataccagtggggacggtcggtggtggaaccagccgggcaggtcgggtagagtataagagccggagggagcggccgggcggcagacgcctgcagaccatcccagacgccggagcccgagccccgacgagtccccgcgcctcatccgcccgcgtccggtccgcgttcctccgccccaccatggctcggggccccggcctcgcgccgccaccgctgcggctgccgctgctgctgctggtgctggcggcggtgaccggccacacggccgcgcaggacaactgcacgtgtcccaccaacaagatgaccgtgtgcagccccgacggccccggcggccgctgccagtgccgcgcgctgggctcgggcatggcggtcgactgctccacgctgacctccaagtgtctgctgctcaaggcgcgcatgagcgcccccaagaacgcccgcacgctggtgcggccgagtgagcacgcgctcgtggacaacgatggcctctacgaccccgactgcgaccccgagggccgcttcaaggcgcgccagtgcaaccagacgtcggtgtgctggtgcgtgaactcggtgggcgtgcgccgcacggacaagggcgacctgagcctacgctgcgatgagctggtgcgcacccaccacatcctcattgacctgcgccaccgccccaccgccggcgccttcaaccactcagacctggacgccgagctgaggcggctcttccgcgagcgctatcggctgcaccccaagttcgtggcggccgtgcactacgagcagcccaccatccagatcgagctgcggcagaacacgtctcagaaggccgccggtgacgtggatatcggcgatgccgcctactacttcgagagggacatcaagggcgagtctctattccagggccgcggcggcctggacttgcgcgtgcgcggagaacccctgcaggtggagcgcacgctcatctattacctggacgagattcccccgaagttctccatgaagcgcctcaccgccggcctcatcgccgtcatcgtggtggtcgtggtggccctcgtcgccggcatggccgtcctggtgatcaccaaccggagaaagtcggggaagtacaagaaggtggagatcaaggaactgggggagttgagaaaggaaccgagcttgtaggtacccggcggggcaggggatggggtggggtaccggatttcggtatcgtcccagacccaagtgagtcacgcttcctgattcctcggcgcaaaggagacgtttatcctttcaaattcctgccttccccctcccttttgcgcacacaccaggtttaatagatcctggcctcagggtctcctttctttctcacttctgtcttgaaggaagcatttctaaaatgtatcccctttcggtccaacaacaggaaacctgactggggcagtgaaggaagggatggcatagcgttatgtgtaaaaaacaagtatctgtatgacaacccgggatcgtttgcaagtaactgaatccattgcgacattgtgaaggcttaaatgagtttagatgggaaatagcgttgttatcgccttgggtttaaattatttgatgagttccacttgtatcatggcctacccgaggagaagaggagtttgttaactgggcctatgtagtagcctcatttaccatcgtttgtattactgaccacatatgcttgtcactgggaaagaagcctgtttcagctgcctgaacgcagtttggatgtctttgaggacagacattgcccggaaactcagtctatttattcttcagcttgcccttactgccactgatattggtaatgttcttttttgtaaaatgtttgtacatatgttgtctttgataatgttgctgtaattttttaaaataaaacacgaatttaataaaatatgggaaaggcacaaacc

SEQ ID NO: 33293 - DNA, 1885 bp, Homo sapiens
gctcccctgagcccagccagaccccgcgccgcccgcgccccgctcgactccggaggctcccgcagccccggcgtccgccccgctgccccctcccccgggggccatgggggcgcccccgggctaccggccctcagcttgggtgcatctcctccaccagctgccccgcgccgacttccagctccgcccggtgcccagcgttttcgcgccccaagagcaggaataccagcaggccttgttgctggtggcggccttggcgggcctgggcttgggcctgagcctcattttcatcgctgtctacctcatccgcttctgctgctgccggccccccgagccccccgggtccaagatcccctcgcccgggggaggctgcgtcacctggagctgcattgtcgcccttctcgccggctgcactggcattggcatcggtttctatggcaacagtgagaccagtgatggggtgtcccagctcagctctgcgctgctgcacgccaaccacacactcagcaccattgaccacctggtgttggagacggtggagaggctgggcgaggcggtgaggacagagctgaccaccctggaggaggtgctcgagccgcgcacggagctggtggctgccgcccgaggggctcgacggcaggcggaggctgcggcccagcagctgcaggggctggccttctggcagggagtgcccctgagccccctgcaggtggctgaaaatgtgtcctttgtggaggagtacaggtggctggcctacgtcctcctgctgctcctggagctgctggtctgcctcttcaccctcctgggcctggcgaagcagagcaagtggctggtgatcgtgatgacagtcatgagtctcctggttctcgtcctgagctggggctccatgggcctggaggcagccacggccgtgggcctcagtgacttctgctccaatccagacccttatgttctgaacctgacccaggaggagacagggctcagctcagacatcctgagctattatctcctctgcaaccgggccgtctccaaccccttccaacagaggctgactctgtcccagcgagctctggccaacatccactcccagctgctgggcctggagcgagaagctgtgcctcagttcccttcagcgcagaagcctctgctgtccttggaggagactctgaatgtgacagaaggaaatttccaccagttggtggcactgctacactgccgcagcctgcacaaggactatggtgcagccctgcggggcctgtgcgaagacgccctggaaggcctgctcttcctgctactcttctccctgctgtctgcaggagcgctggccactgccctctgcagcctgccccgagcctgggccctcttcccacccagtgacgactacgatgacacagacgatgacgaccctttcaaccctcaggaatccaagcgctttgtgcagtggcagtcgtctatctgagcccctcctcccggctggactggagcctggctcccctcttcgttccttccctggctgccggaggagaccccactaacccagcctgcctgggctctgaccactaacactcttggccatggacagcctgcacaggaccgcctccctgctcttggccactgtgctcccatttctgtccttggccttgggagtagctgagggggcagactagggagtagggctggcaggggagggggcagacagcctcgcctcgcacccttcatccctggctgccggtcccatccttggagggactaagctgggggtgggggacatgagtccccctgctgcccctgccacatcccagtgggctctgaccccctgatctcaactcgtggcactaacttggaaaagggttgatttaaaataaaagggaagactattttacaagca

SEQ ID NO: 33294 - DNA, 1763 bp, Homo sapiens
gccccgctgccccctcccccgggggccatgggggcgcccccgggctaccggccctcagcttgggtgcatctcctccaccagctgccccgcgccgacttccagctccgcccggtgcccagcgttttcgcgccccaagagcaggaataccagcaggccttgttgctggtggcggccttggcgggcctgggcttgggcctgagcctcattttcatcgctgtctacctcatccgcttctgctgctgccggccccccgagccccccgggtccaagatcccctcgcccgggggaggctgcgtcacctggagctgcattgtcgcccttctcgccggctgcactggcattggcatcggtttctatggcaacagtgagaccagtgatggggtgtcccagctcagctctgcgctgctgcacgccaaccacacactcagcaccattgaccacctggtgttggagacggtggagaggctgggcgaggcggtgaggacagagctgaccaccctggaggaggtgctcgagccgcgcacggagctggtggctgccgcccgaggggctcgacggcaggcggaggctgcggcccagcagctgcaggggctggccttctggcagggagtgcccctgagccccctgcaggtggctgaaaatgtgtcctttgtggaggagtacaggtggctggcctacgtcctcctgctgctcctggagctgctggtctgcctcttcaccctcctgggcctggcgaagcagagcaagtggctggtgatcgtgatgacagtcatgagtctcctggttctcgtcctgagctggggctccatgggcctggaggcagccacggccgtgggcctcagtgacttctgctccaatccagacccttatgttctgaacctgacccaggaggagacagggctcagctcagacatcctgagctattatctcctctgcaaccgggccgtctccaaccccttccaacagaggctgactctgtcccagcgagctctggccaacatccactcccagctgctgggcctggagcgagaagctgtgcctcagttcccttcagcgcagaagcctctgctgtccttggaggagactctgaatgtgacagaaggaaatttccaccagttggtggcactgctacactgccgcagcctgcacaaggactatggtgcagccctgcggggcctgtgcgaagacgccctggaaggcctgctcttcctgctactcttctccctgctgtctgcaggagcgctggccactgccctctgcagcctgccccgagcctgggccctcttcccacccaggaatccaagcgctttgtgcagtggcagtcgtctatctgagcccctcctcccggctggactggagcctggctcccctcttcgttccttccctggctgccggaggagaccccactaacccagcctgcctgggctctgaccactaacactcttggccatggacagcctgcacaggaccgcctccctgctcttggccactgtgctcccatttctgtccttggccttgggagtagctgagggggcagactagggagtagggctggcaggggagggggcagacagcctcgcctcgcacccttcatccctggctgccggtcccatccttggagggactaagctgggggtgggggacatgagtccccctgctgcccctgccacatcccagtgggctctgaccccctgatctcaactcgtggcactaacttggaaaagggttgatttaaaataaaagggaagactattttacaagca

SEQ ID NO: 33295 - DNA, 1538 bp, Homo sapiens
gctcgactccggaggctcccgcagccccggcgtccgccccgctgccccctcccccgggggccatgggggcgcccccgggctaccggccctcagcttgggtgcatctcctccaccagctgccccgcgccgacttccagctccgcccggtgcccagcgttttcgcgccccaagagcaggaataccagcaggatcagagcagcctcgcggttacacaacggccacctccaacaacgccgctccaccggctccggcctcggcccagactcacgcccgctctggcccggagacctcccgaagccgcacgcggggatccgcggccccagtcaccgccagaggccttgttgctggtggcggccttggcgggcctgggcttgggcctgagcctcattttcatcgctgtctacctcatccgcttctgctgctgccggccccccgagccccccgggtccaagatcccctcgcccgggggaggctgcgtcacctggagctgcattgtcgcccttctcgccggctgcactggcattggcatcggtttctatggcaacagtgagaccagtgatggggtgtcccagctcagctctgcgctgctgcacgccaaccacacactcagcaccattgaccacctggtgttggagacggtggagaggctgggcgaggcggtgaggacagagctgaccaccctggaggaggtgctcgagccgcgcacggagctggtggctgccgcccgaggggctcgacggcaggcggaggctgcggcccagcagctgcaggggctggccttctggcagggagtgcccctgagccccctgcaggtggctgaaaatgtgtcctttgtggaggagtacaggtggctggcctacgtcctcctgctgctcctggagctgctggtctgcctcttcaccctcctgggcctggcgaagcagagcaagtggctggtgatcgtgatgacagtcatgagtctcctggttctcgtcctgagctggggctccatgggcctggaggcagccacggccgtgggcctcagtgacttctgctccaatccagacccttatgttctgaacctgacccaggaggagacagggctcagctcagaggctgactctgtcccagcgagctctggccaacatccactcccagctgctgggcctggagcgagaagctgtgcctcagttcccttcagcgcagaagcctctgctgtccttggaggagactctgaatgtgacagaaggaaatttccaccagttggtggcactgctacactgccgcagcctgcacaaggactatggtgcagccctgcggggcctgtgcgaagacgccctggaaggcctgctcttcctgctactcttctccctgctgtctgcaggagcgctggccactgccctctgcagcctgccccgagcctgggccctcttcccacccagtgacgactacgatgacacagacgatgacgaccctttcaaccctcagcaggaatccaagcgctttgtgcagtggcagtcgtctatctgagcccctcctcccggctggactggagcctg

SEQ ID NO: 33296 - DNA, 2088 bp, Homo sapiens
ctgcctcccccccgctcccgctcccctgagcccagccagaccccgcgccgcccgcgccccgctcgactccggaggctcccgcagccccggcgtccgccccgctgccccctcccccgggggccatgggggcgcccccgggctaccggccctcagcttgggtgcatctcctccaccagctgccccgcgccgacttccagctccgcccggtgcccagcgttttcgcgccccaagagcaggaataccagcaggccttgttgctggtggcggccttggcgggcctgggcttgggcctgagcctcattttcatcgctgtctacctcatccgcttctgctgctgccggccccccgagccccccgggtccaagatcccctcgcccgggggaggctgcgtcacctggagctgcattgtcgcccttctcgccggctgcactggcattggcatcggtttctatggcaacagtgagaccagtgatggggtgtcccagctcagctctgcgctgctgcacgccaaccacacactcagcaccattgaccacctggtgttggagacggtggagaggctgggcgaggcggtgaggacagagctgaccaccctggaggaggtgctcgagccgcgcacggagctggtggctgccgcccgaggggctcgacggcaggcggaggctgcggcccagcagctgcaggggctggccttctggcagggagtgcccctgagccccctgcaggtggctgaaaatgtgtcctttgtggaggagtacaggtggctggcctacgtcctcctgctgctcctggagctgctggtctgcctcttcaccctcctgggcctggcgaagcagagcaagtggctggtgatcgtgatgacagtcatgagtctcctggttctcgtcctgagctggggctccatgggcctggaggcagccacggccgtgggcctcagtgacttctgctccaatccagacccttatgttctgaacctgacccaggaggagacagggctcagctcagacatcctgagctattatctcctctgcaaccgggccgtctccaaccccttccaacagaggctgactctgtcccagcgagctctggccaacatccactcccagctgctgggcctggagcgagaagctgtgcctcagttcccttcagcgcagaagcctctgctgtccttggaggagactctgaatgtgacagaaggaaatttccaccagttggtggcactgctacactgccgcagcctgcacaaggactatggtgcagccctgcggggcctgtgcgaagacgccctggaaggcctgctcttcctgctactcttctccctgctgtctgcaggagcgctggccactgccctctgcagcctgccccgagcctgggccctcttcccacccagtgacgactacgatgacacagacgatgacgaccctttcaaccctcagcaggaatccaagcgctttgtgcagtggcagtcgtctatctgagcccctcctcccggctggactggagcctggctcccctcttcgttccttccctggctgccggaggagaccccactaacccagcctgcctgggctctgaccactaacactcttggccatggacagcctgcacaggaccgcctccctgctcttggccactgtgctcccatttctgtccttggccttgggagtagctgagggggcagactagggagtagggctggcaggggagggggcagacagcctcgcctcgcacccttcatccctggctgccggtcccatccttggagggactaagctgggggtgggggacatgagtccccctgctgcccctgccacatcccagtgggctctgaccccctgatctcaactcgtggcactaacttggaaaagggttgatttaaaataaaagggaagactattttacaagcagctgggtcctccttatttctcctctcccttgattcggcctcctggccagggctgggacatcctccctgctgtcctctctcccccggcctcccagctgccaggaatttctgcgcctgtccaggctcagcaaggggtccaaagacattgttctttaaaaaaaaaaaaaaaaaaatcaaaaaac

SEQ ID NO: 33297 - DNA, 3043 bp, Homo sapiens
gggcggggcggccgcgggtcgcgggcggatgacgcgccggggccggcggaggagcagccacttcctggggccgccggccggggccgctggctgcactcagcgccggagccgggagctagcggccgccgccatgtcccaccagaccggcatccaagcaagtgaagatgttaaagagatctttgccagagccagaaatggaaagtacagacttctgaaaatatctattgaaaatgagcaacttgtgattggatcatatagtcagccttcagattcctgggataaggattatgattcctttgttttacccctgttggaggacaaacaaccatgctatatattattcaggttagattctcagaatgcccagggatatgaatggatattcattgcatggtctccagatcattctcatgttcgtcaaaaaatgttgtatgcagcaacaagagcaactctgaagaaggaatttggaggtggccacattaaagatgaagtatttggaacagtaaaggaagatgtatcattacatggatataaaaaatacttgctgtcacaatcttcccctgccccactgactgcagctgaggaagaactacgacagattaaaatcaatgaggtacagactgacgtgggtgtggacactaagcatcaaacactacaaggagtagcatttcccatttctcgagaagcctttcaggctttggaaaaattgaataatagacagctcaactatgtgcagttggaaatagatataaaaaatgaaattataattttggccaacacaacaaatacagaactgaaagatttgccaaagaggattcccaaggattcagctcgttaccatttctttctgtataaacattcccatgaaggagactatttagagtccatagtttttatttattcaatgcctggatacacatgcagtataagagagcggatgctgtattctagctgcaagagccgtctgctagaaattgtagaaagacaactacaaatggatgtaattagaaagatcgagatagacaatggggatgagttgactgcagacttcctttatgaagaagtacatcccaagcagcatgcacacaagcaaagttttgcaaaaccaaaaggtcctgcaggaaaaagaggaattcgaagactaattaggggcccagcggaaactgaagctactactgattaaagtcatcacattaaacattgtaatactagttttttaaaagtccagcttttagtacaggagaactgaaatcattccatgttgatataaagtagggaaaaaaattgtactttttggaaaatagcacttttcacttctgtgtgtttttaaaattaatgttatagaagactcatgatttctatttttgagttaaagctagaaaagggttcaacataatgtttaattttgtcacactgttttcatagcgttgattccacacttcaaatacttcttaaaattttatacagttgggccagttctagaaagtctgatgtctcaaagggtaaacttactactttcttgtgggacagaaagaccttaaaatattcatattacttaatgaatatgttaaggaccaggctagagtattttctaagctggaaacttagtgtgccttggaaaaggccgcaagttgcttactccgagtagctgtgctagctctgtcagactgtaggatcatgtctgcaacttttagaaatagtgctttatattgcagcagtcttttatatttgacttttttttaatagcattaaaattgcagatcagctcactctgaaactttaagggtaccagatattttctatactgcaggatttctgatgacattgaaagactttaaacagccttagtaaattatctttctaatgctctgtgaggccaaacatttatgttcagattgaaatttaaattaatatcattcaaaaggaaacaaaaaatgttgagttttaaaaatcaggattgacttttttctccaaaaccatacatttatgggcaaattgtgttctttatcacttccgagcaaatactcagatttaaaattactttaaagtcctggtacttaacaggctaacgtagataaacaccttaataatctcagttaatactgtatttcaaaacacatttaactgttttctaatgctttgcattatcagttacaacctagagagattttgagcctcatatttctttgatacttgaaatagagggagctagaacacttaatgtttaatctgttaaacctgctgcaagagccataactttgaggcattttctaaatgaactgtggggatccaggatttgtaatttcttgatctaaactttatgctgcataaatcacttatcggaaatgcacatttcatagtgtgaagcactcatttctaaaccttattatctaaggtaatatatgcacctttcagaaatttgtgttcgagtaagtaaagcatattagaataattgtgggttgacagatttttaaaatagaatttagagtatttggggttttgtttgtttacaaataatcagactataatatttaaacatgcaaaataactgacaataatgttgcacttgtttactaaagatataagttgttccatgggtgtacacgtagacagacacacatacacccaaattattgcattaagaatcctggagcagaccatagctgaagctgttattttcagtcaggaagactacctgtcatgaaggtataaaataatttagaagtgaatgtttttctgtaccatctatgtgcaattatactctaaattccactacactacattaaagtaaatggacattccagaatatagatgtgattatagtcttaaactaattattattaaaccaatgattgctgaaaatcagtgatgcatttgttatagagtataactcatcgtttacagtatgttttagttggcagtatcatacctagatggtgaataacatattcccagtaaatttatatagcagtgaagaattacatgccttctggtggacattttataagtgcattttatatcacaataaaaattttttctcttt

SEQ ID NO: 33298 - DNA, 3045 bp, Homo sapiens
gggcggggcggccgcgggtcgcgggcggatgacgcgccggggccggcggaggagcagccacttcctggggccgccggccggggccgctggctgcactcagcgccggagccgggagctagcggccgccgccatgtcccaccagaccggcatccaagcaagtgaagatgttaaagagatctttgccagagccagaaatggaaagtacagacttctgaaaatatctattgaaaatgagcaacttgtgattggatcatatagtcagccttcagattcctgggataaggattatgattcctttgttttacccctgttggaggacaaacaaccatgctatatattattcaggttagattctcagaatgcccagggatatgaatggatattcattgcatggtctccagatcattctcatgttcgtcaaaaaatgttgtatgcagcaacaagagcaactctgaagaaggaatttggaggtggccacattaaagatgaagtatttggaacagtaaaggaagatgtatcattacatggatataaaaaatacttgctgtcacaatcttcccctgccccactgactgcagctgaggaagaactacgacagattaaaatcaatgaggtacagactgacgtgggtgtggacactaagcatcaaacactacaaggagtagcatttcccatttctcgagaagcctttcaggctttggaaaaattgaataatagacagctcaactatgtgcagttggaaatagatataaaaaatgaaattataattttggccaacacaacaaatacagaactgaaagatttgccaaagaggattcccaaggattcagctcgttaccatttctttctgtataaacattcccatgaaggagactatttagagtccatagtttttatttattcaatgcctggatacacatgcagtataagagagcggatgctgtattctagctgcaagagccgtctgctagaaattgtagaaagacaactacaaatggatgtaattagaaagatcgagatagacaatggggatgagttgactgcagacttcctttatgaagaagtacatcccaagcagcatgcacacaagcaaagttttgcaaaaccaaaaggtcctgcaggaaaaagaggaattcgaagactaattaggggcccagcggaaactgaagctactactgattaaagtcatcacattaaacattgtaatactagttttttaaaagtccagcttttagtacaggagaactgaaatcattccatgttgatataaagtagggaaaaaaattgtactttttggaaaatagcacttttcacttctgtgtgtttttaaaattaatgttatagaagactcatgatttctatttttgagttaaagctagaaaagggttcaacataatgtttaattttgtcacactgttttcatagcgttgattccacacttcaaatacttcttaaaattttatacagttgggccagttctagaaagtctgatgtctcaaagggtaaacttactactttcttgtgggacagaaagaccttaaaatattcatattacttaatgaatatgttaaggaccaggctagagtattttctaagctggaaacttagtgtgccttggaaaaggccgcaagttgcttactccgagtagctgtgctagctctgtcagactgtaggatcatgtctgcaacttttagaaatagtgctttatattgcagcagtcttttatatttgacttttttttaatagcattaaaattgcagatcagctcactctgaaactttaagggtaccagatattttctatactgcaggatttctgatgacattgaaagactttaaacagccttagtaaattatctttctaatgctctgtgaggccaaacatttatgttcagattgaaatttaaattaatatcattcaaaaggaaacaaaaaatgttgagttttaaaaatcaggattgacttttttctccaaaaccatacatttatgggcaaattgtgttctttatcacttccgagcaaatactcagatttaaaattactttaaagtcctggtacttaacaggctaacgtagataaacaccttaataatctcagttaatactgtatttcaaaacacatttaactgttttctaatgctttgcattatcagttacaacctagagagattttgagcctcatatttctttgatacttgaaatagagggagctagaacacttaatgtttaatctgttaaacctgctgcaagagccataactttgaggcattttctaaatgaactgtggggatccaggatttgtaatttcttgatctaaactttatgctgcataaatcacttatcggaaatgcacatttcatagtgtgaagcactcatttctaaaccttattatctaaggtaatatatgcacctttcagaaatttgtgttcgagtaagtaaagcatattagaataattgtgggttgacagatttttaaaatagaatttagagtatttggggttttgtttgtttacaaataatcagactataatatttaaacatgcaaaataactgacaataatgttgcacttgtttactaaagatataagttgttccatgggtgtacacgtagacagacacacatacacccaaattattgcattaagaatcctggagcagaccatagctgaagctgttattttcagtcaggaagactacctgtcatgaaggtataaaataatttagaagtgaatgtttttctgtaccatctatgtgcaattatactctaaattccactacactacattaaagtaaatggacattccagaatatagatgtgattatagtcttaaactaattattattaaaccaatgattgctgaaaatcagtgatgcatttgttatagagtataactcatcgtttacagtatgttttagttggcagtatcatacctagatggtgaataacatattcccagtaaatttatatagcagtgaagaattacatgccttctggtggacattttataagtgcattttatatcacaataaaaattttttctctttaa

SEQ ID NO: 33299 - DNA, 1170 bp, Homo sapiens
cgccatgtcccaccagaccggcatccaagcaagtgaagatgttaaagagatctttgccagagccagaaatggaaagtacagacttctgaaaatatctattgaaaatgagcaacttgtgattggatcatatagtcagccttcagattcctgggataaggattatgattcctttgttttacccctgttggaggacaaacaaccatgctatatattattcaggttagattctcagaatgcccagggatatgaatggatattcattgcatggtctccagatcattctcatgttcgtcaaaaaatgttgtatgcagcaacaagagcaactctgaagaaggaatttggaggtggccacattaaagatgaagtatttggaacagtaaaggaagatgtatcattacatggatataaaaaatacttgctgtcacaatcttcccctgccccactgactgcagctgaggaagaactacgacagattaaaatcaatgagagcccagaggatcatattggggtacagactgacgtgggtgtggacactaagcatcaaacactacaaggagtagcatttcccatttctcgagaagcctttcaggctttggaaaaattgaataatagacagctcaactatgtgcagttggaaatagatataaaaaatgaaattataattttggccaacacaacaaatacagaactgaaagatttgccaaagaggattcccaaggattcagctcgttaccatttctttctgtataaacattcccatgaaggagactatttagagtccatagtttttatttattcaatgcctggatacacatgcagtataagagagcggatgctgtattctagctgcaagagccgtctgctagaaattgtagaaagacaactacaaatggatgtaattagaaagatcgagatagacaatggggatgagttgactgcagacttcctttatgaagaagtacatcccaagcagcatgcacacaagcaaagttttgcaaaaccaaaaggtcctgcaggaaaaagaggaattcgaagactaattaggggcccagcggaaactgaagctactactgattaaagtcatcacattaaacattgtaatactagttttttaaaagtccagcttttagtacaggagaactgaaatcattccatgttgatataaagtag

SEQ ID NO: 33300 - DNA, 1619 bp, Homo sapiens
ggcgggtcctgcggcaccgcccgggaagctgcgcgagggtcgacagcctccgccacatcctccacctctcttggtccagcgagcgttgccgggccagggtcaagcggagggctccgacggcgcggacggagcgaagcgccgagccatggcgcaccaaacgggcatccacgccacggaagagctgaaggaattctttgccaaggcacgggctggctctgtgcggctcatcaaggttgtgattgaggacgagcagctcgtgctgggtgcctcgcaggagccagtaggccgctgggatcaggactatgacagggccgtgctgccactgctggacgcccagcagccctgctacctgctctaccgcctcgactcacagaatgctcagggcttcgaatggctcttcctcgcctggtcgcctgataactcccccgtgcggctgaagatgctgtacgcggccacgcgggccacagtgaaaaaggagtttggaggtggccacatcaaggatgagctcttcgggactgtgaaggatgacctctcttttgctgggtaccagaaacacctgtcgtcctgtgcggcacctgccccgctgacctcggctgagagagagctccagcagatccgcattaacgaggtgaagacagagatcagtgtggaaagcaagcaccagaccctgcagggcctcgccttccccctgcagcctgaggcccagcgggcactccagcagctcaagcagaaaatggtcaactacatccagatgaagctggacctagagcgggaaaccattgagctggtgcacacagagcccacggatgtggcccagctgccctcccgggtgccccgagatgctgcccgctaccacttcttcctctacaagcacacccatgagggcgacccccttgagtctgtagtgttcatctactccatgccggggtacaagtgcagcatcaaggagcgaatgctctactccagctgcaagagccgcctcctcgactccgtggagcaggacttccatctggagatcgccaagaaaattgagattggcgatggggcagagctgacggcagagttcctctacgacgaggtgcaccccaagcaacacgccttcaagcaggccttcgccaagcccaagggcccagggggcaagcggggccataagcgcctcatccgcggcccgggtgaaaatggggatgacagctaggaggctggagcagggccggccacgtgtggactgtggggctgcccaccttccgctccctgccaccatcctccttcctgggctccaggaaagtgtttctgggaggtcaggagggctggcagctgaacgcacttgcagcgtccgagggccaccgggctggcattttgtgacccttccctgttgctgtccctgcatctcgtctgtgtgcccagggtgtccggggaccctgcctggctggcttaagggggctgggtcaggggcctggcatgaacctggcctcccggggagctgagactagggtcccagcacagcccagaaacctttggccacaagaagtggggtcagtcagggctggggcaggggtcactgcagtttgggatggttgaatgctgtattttctaaagaataaaatatttttaaatcaaga

SEQ ID NO: 33301 - DNA, 1176 bp, Homo sapiens
ctagagtttccaaaaaagttagaataacttcctctcccggagacctcggttttgcacaagccggccttgaaatcagagcctttccagcaactccgagagcgtgtgctcggcgaccgcgggcttggccagcggcgcgcgctcggcgccccggcgcccccagccccacgcgcgccgggcgggcgccatggaggagggctccagctcgcccgtgtcccccgtggacagcctgggcaccagcgaggaggagctcgagaggcagcccaagcgcttcggccggaagcggcgctacagcaagaagtcgagcgaagatggcagcccgaccccgggcaagcgcggcaagaagggcagccccagcgcgcagtccttcgaggagctgcagagccagcgcatcctggccaacgtgcgcgagcgccagcgcacccagtcgctcaacgaggccttcgcggcgctgcgcaagatcatccccacgctgccctctgacaagctgagcaagatccagacgctcaagctggccgccaggtacatagacttcctctaccaggtcctgcagagcgacgagatggacaataagatgaccagctgcagctacgtggcccacgagcgcctcagctacgccttctccgtgtggcgcatggagggcgcgtggtccatgtccgcctcccactagcgccgcgccacccacctccggaccggcgcgccaggaggagattctgaatgatgctgccattgccagaccttctgctaccaaacagagcgaagaggaagagggggcagtgtttggtcaagacagcccacgaaacgttggcgggagtgagcacattagcaatggctaagaacatgcttgaatcatttgtaacaacccaggacagagatgccacaagaggactttggggaaaggcgaatccactcatacatcttggagttgttttttcaagttcagaaaatgaaccttcaccaaggtcttggaacatgaagcagagactctggtgctgactctatcatttgagctcctaagggtactcatgcccagtggagcatgcacaccagcaacactgccaacaccatctcggtgtcccaccccttagaggaggaagaggacacagaggggcgcccggtaataaccctcatttcctctcttccaccccaccacatcatcttaataaaacatgaaggtaa

SEQ ID NO: 33302 - DNA, 3942 bp, Homo sapiens
aaaacgagcgccggggacatgggattgtgcttgcgtcaacggcgcgcgccgtgggaaccttgacaagcagcatggctgcaggttgctcagaggcgccgcggccagcggcggcttctgatgggtctctggtagggcaggctggcgtcctgccttgcctagagttgccgacttatgccgctgcttgtgcgctggtgaacagtcgctactcatgcctggtggccgggccgcaccaaaggcacatcgcgctgtcgccccgctaccttaacaggaaacgcaccggcattcgagaacagcttgatgcggagctccttcgctattctgagagccttttaggtgtccctattgcatatgataacatcaaagttgtgggagagcttggagatatttatgatgatcaaggacacattcatcttaacattgaagccgattttgttattttctgccctgaaccagggcagaagcttatgggtatagttaataaagtgtcttctagccacattggctgtttagtacatgggtgtttcaatgcctccattcctaaacctgagcagttgtcagctgagcagtggcaaaccatggagataaacatgggtgatgaactagaatttgaagtatttcgtttagactcagatgctgctggagtattctgcattcggggaaaactaaatatcacaagtttacaattcaagcgctctgaagtttctgaagaagttacagaaaatggcactgaggaagctgctaaaaaacctaaaaagaagaaaaagaagaaagacccagagacatatgaagtggacagtggtaccacaaagctagcagatgatgcagatgacactccaatggaagagtcagccctgcagaatactaataatgcgaatggcatctgggaggaggagccaaagaaaaagaagaagaagaaaaagcaccaggaagttcaggaccaggaccctgttttccaaggcagtgactccagtggttaccaaagtgaccataaaaagaaaaaaaagaaaagaaaacacagtgaagaggccgaatttaccccacctttgaaatgctcaccaaaaagaaaagggaaaagtaattttctttagtgtattttaaacacgattcagtttttaaaagatcgatctacatacaatagatgaataaatgttttcagtgatatgaaaaggttaagtatgccagtagtttacaaaacagaaaatacttaactaggagtaggaggctttatatgctaaaaatgataaaactgactgtaaattaatttggggaaagccagtattgttaaaataccattttatacaaaataaaaagctgctctcactgtcagctctcatattcttccaggttttgcactctacataaaattatttctacaatgtcaagactagccaaaggactttataatacaatattatattactaaagaatgagttaagtttgagattttgatgatttgattttgtgtgtgtttaataggcttcaccttattacatgctattttattttgcttttttaaaaactcaggacattaactaattttaggttttcctttatcatggctttctacagtatttctattgtttaacataaaatagtttgccaaagaagtttctgaagtcttcacagctcttaaaagccaggccagtactgactgtgtggtggtaaatgctattcattattttcttttctttcttccaagtgcatgtgtgtccttgtcttcttaagtctgagaggttgctggaaaggactgttttcttgtacttgttcatttgtgcctcagccattctagttttgttgtgtgttggaggacagtctaatgaagacaggataaatgtgattctgactagtgggaaatttcagattactttttaatgattggaatgggctataagatattgtgctgaagagaaaacagttgttctgttcactgctttcattgagaaaatgtggaatgtctcttgactaattgacaaagtgtaatgaaatgacaagctggttgaagctggtaatcaatgcatggccatatttattcattttccacacacttgaccatctactttgtataacacattctgctaaggcccagggatacaatggcaaacaagatagatgtagttccttcccttgtggcatgtcataagagaaacagatgtgcatatacacacaataaataagaaaattaataattgtattaagtggtatgaaaaaaagggggaggattgttcactcactgttacctgtgttagtatctgcaaatgcatgaatggttgaactcccatgtcagcatttttgttgccatttatttagtaccagacatagtgctggtctcacagcttaatatttggtaatgaataaattctgctagtggtatatgttgatctgaacttacaatgatgggatatagaattggcagagtggcagatgttcacaattgtctacaagtagatgtgctagacaatggaaggatgcaggccaacctctttgattacaattgagattcatgtgactattgagccctggaaatgtagcttgtccaaattgagatgtgctgtcagtataaaatacataccagattttaaagatgtaccaaaaaatgtaaactatctcaatttttatattggtgaaatcaatatgtcttggtatagtggcttaaataaaacaattttagcctttctcagtttatttttctgcaaaaagattaaaaattgtacatgaagctcatgttaactttcttttggtcagtgctattttaaaggaagtatgagttgaaaaaaaattgaaataaactatatcatattactaggacttaatatagtggcatacccaggaaatgcttagtaagtgttcccttcacattttaaaatttgagtatacaatcatgtttgacaatatagaaatttaatttttagtgaaacaattctaaaccccttttccatagacacaagaaagatggcaaatttatgctattcctggaaaaatacattgtggcttagcaaataagcaagttcccacgttacttttgttttgcttcaagtaatacttctgccagttgtgttttatgaattaaacagggaacggcatgctgaacttgaaactagatttgttcctgcttttttcacaatgtgagtagttttgaaaagtcagatctggccatttgtctttcctagaatagcataactttgttcattgttttttttgtttgtctttctgacacagaaagactgatgatggtgtccactatgtattcttcaaaacatttggcacatgctgcactaacctagtctatcttttctatcttggaatttgctcatacaaaccctatagcctagactagatcccttaccctctctccagttcctatcattcacccatttcactgtgcaagacacctcactagtcaccagtgatacagaaatgacttttaagcagtttctgctcttaagggcttaccgttttgtctataagatacacaagtataaatgacaagtacaaataacaatgaatgtttaatgctttacgtttagtgtttaagcttgttgttggaagagcagcattttgacccttggagaagaaaaactagctgtggcattccaggtggagaacctgacagaggactaagaagttatctaatgtaaaagacctcaggcaccaccttcgcataaactttttccagacaaggctaaatgtgcatgcttcataaccataattcttatttttctttaataaatatttttctacttgtaacactgtgcattatttcaaactgtttacctgtttgtaaagcttgtctcttaatcaaatttgtcttgaccaaataagtttcctgagggctggaattatgccttaactatatctatagtatttaacagtgaatcctttgtataatgaaagcatcaacagataattttaaattgataaataaaaagcacagtttcaaatggt

SEQ ID NO: 33303 - DNA, 3756 bp, Homo sapiens
ctctttaaggtgcccgaggctcgcgggcgctgcgctgaggggacggcgggaggcgcggcctggcctcgcactcaaagccgccgcagcgcgccccgggctcggccgacccggcggggatctaggggtgggcgacttcgcgggaccgtggcgcatgtttcctgggagttactgatcatcttctttgaagaaacatgaagttacactatgttgctgtgcttactctagccatcctgatgttcctgacatggcttccagaatcactgagctgtaacaaagcactctgtgctagtgatgtgagcaaatgcctcattcaggagctctgccagtgccggccgggagaaggcaattgctcctgctgtaaggagtgcatgctgtgtcttggggccctttgggacgagtgctgtgactgtgttggtatgtgtaatcctcgaaattatagtgacacacctccaacttcaaagagcacagtggaggagctgcatgaaccgatcccttctctcttccgggcactcacagaaggagatactcagttgaattggaacatcgtttctttccctgttgcagaagaactttcacatcatgagaatctggtttcatttttagaaactgtgaaccagccacaccaccagaatgtgtctgtccccagcaataatgttcacgcgccttattccagtgacaaagaacacatgtgtactgtggtttattttgatgactgcatgtccatacatcagtgtaaaatatcctgtgagtccatgggagcatccaaatatcgctggtttcataatgcctgctgcgagtgcattggtccagaatgtattgactatggtagtaaaactgtcaaatgtatgaactgcatgttttaaagaagacaaatgcaaaccaaagcaacttagtaaaataataggtataaaaagttattctgtaagtctgttggttgtatcttgtatcagaatcccagtaagttaagttgtaaagactttggaataagtttcttttaaaaatatgacatagccagtgatgtgtttaattatataactgttcttactgattttattgccccctagcaataagccctttcctttgaatacatgtacaactttggtcatatgagaagcaggtgcgcagagaattccttgaaagatctgaggtttttaacatgaagtctgacgtggttttcctctagcattccaaaaggtttttgctttgaaagtgttagcagaagcatgttgatgtgaattatgatttcttcatgtgctactgttagcacactgagtttttatagttgcacatcattcctcattgtgccttgttttatccattttataaatagagtagatatttgatataccactctgataactcatataaaaatatcatcataaaaagcttaatttcatcccttttatgttggttttaaaaggtaaatgcttaccatattttataattgagaactcttacatagtagaatccattctataatacatgtgttgacaaagctttagagaaagtttcctattctcttccatttcccctgcccaaagtgctgacataggcagtgatgaagaatctttaccaagattttcagggtgtacctatgaaattgctttaaatgcactgctggtgtaaataattagcaagcaaagcgtttctgtgacttcaggtaccagcttaaagagcactagggatggggaacgaatgccaaatcagactccacctagagcaccaggaaacagcttgtaccctggtagggaaatggtgttgctgaaaggggaggctgagccagtgcgagactgaacttgtgcagccttagccaagacaaagcagtgtttttcagcagacggctgatgggacaggaattgaagaagagaattgactcgtatgaacaggacagggtgaaaatgctgggaattattatgggaaacaaaactatctatgttcatattttgtaatatttcatttgttaagtttatatctggatataatgttctttttaaacaagtataatcatatcgtcggaggttaagattatgaaattttagaatctctattcaagatgatgttcactccaaatacactacagaatttagtcaacattttatataatgtttcaataaatgtttctttcaataaagatactatgtgcccttcatagtaataaaatctcaatcttaaagcatgaatctaaaacataaatatttatattacagactcaattttacaaaattactaattgctctagtgcatatttgaactacaagcaactttttaggaatacctctttatacgtctacatattttagtatataaaaatagataatgctcttggacacattttgtattattcatgatctgaatagtagttagttaaaagatcatttgtaatattatgatcaactgttataaattaaggtcttaataccttttctgctctttcaaataactctaatgaatattcaagatattttagccttttaaaaagttgagatttagctcatggatatattttttggtagggaaacattagggtctccttttcttccttttacctagaatgcctcatttaaaagtgccttgaaaacatttagctccccttcttcatgagcatctgtagagctgaaagtattctggaactttagacagaaagctgaaaggaatctgcagtctcctgctgcagttcaactctgctgtttttcagtcatttcctactgtgagtggagtgatgtttgtgtgtgtgttggcaacatgcctaatgttttcttaatgatgacaacaaatattttaaaactgcatttatcattttttaggtcttcattaaattttaaaatgtaatatctgtttcccaccccctacattaggaggataatttcttaaaccacattgttttaattgatttttcttatcttgatttctttcattagaaactatccctaaatgtaaagatcttttgccttcaaatttggcttattttttctgatttatgagggtttgaaagaaagaattcacctaaaagattccatttccagttttataatgtatttcaggttctgaataacaatatttttccaaattgaaagtaaatattccagaagttgatagcctggttaaaagttagatcctctattaccattctaagcacattcacttctatattgaagttttggtaaaaattcttttttcttttttaataaaaaattaggttattactttttttataaccagatttttaaagcactaggttttaaatcagtgggtatcataaaagccatatataaaagatcctttcttatagtaagacttgtgcttgttagcaggtttttctgttagtttttcccccataacatttaattattactaaaattgtatttacaatagtggtgccaaatcaaatggtaatttaaataaaatctattctgtgtttatgtagggtggtataaaaaagaggtcttcatttagacatgtgatttctaaaattccagaaagcaaaattgataagatgttagaaatttggaccattatttataatcagggtagcattaaaatggagaaaagaaagttttctgaaaaaatgcagtaaatataagccacatttctaaagtttatttttatgaaagcttcttttaagattttgaaatctattctgcattcccaagagtttatgtttattgtattttatatgatctacaacatataaaattgtgtatttttctttggttgtccctattaacaaaaaagtattttaataaaaaattgaaatga

SEQ ID NO: 33304 - DNA, 5274 bp, Homo sapiens
gagaggacggtaggcggtggataggagagctggcgcagctgccctggtggcagtggctgaagtggcggcggcttcggcggctgcggcggctgcaacagcttcgggctcggggttttggcggcggcgccggcgggctaggctgcgcggtgcggaccccggcgcgcggtccgggttgctggggcggcgcgtaagatgcctctaatggaggagtttctgagcagcacccctggcccagtggctttgaaagggagctcaaaccagagactatttcaagccctggatatcatatcctgagggccacaggagaagagaacatggctgtgagtttggatgacgacgtgccgctcatcctgaccttggatgagggtggcagtgccccactggctccctccaacggcctgggccaagaagagctacctagcaaaaatggcggcagctatgccatccacgactcccaggcccccagtctcagctctgggggtgagagttccccctccagccccgcacacaactgggagatgaattaccaagaggcagcaatctacctccaggaaggcgagaacaacgacaagttcttcacccaccccaaggatgccaaggcgctggcggcctacctctttgcacacaatcacctcttctacctgatggagctggccacggccctgctgctgctgctgctctccctgtgcgaggcccccgccgtccccgcactccggcttggcatctatgtccacgccaccctggagctgtttgccctgatggtggtagtgtttgaactctgcatgaagttacgctggctgggcctccacaccttcatccggcacaagcggaccatggtcaagacctcggtgctggtggtgcagtttgtcgaggccatcgtggtgttggtacggcagatgtcccatgtgcgggtgacccgagcactgcgctgcattttcctggtggactgtcggtattgcggtggcgtccggcgcaacctgcggcagatcttccagtccctgccgcccttcatggacatcctcctgctgctgctgttcttcatgatcatctttgccatcctcggtttctacttgttctcccctaacccttcagacccctacttcagcaccctggagaacagcatcgtcagtctgtttgtccttctgaccacagccaatttcccagatgtgatgatgccctcctactcccggaacccctggtcctgcgtcttcttcatcgtgtacctctccatcgagctgtatttcatcatgaacctgcttctggctgtggtgttcgacaccttcaatgacattgagaaacgcaagttcaagtctttgctactgcacaagcgaaccgctatccagcatgcctaccgcctgctcatcagccagaggaggcctgccggcatctcctacaggcagtttgaaggcctcatgcgcttctacaagccccggatgagtgccagggagcgctatcttaccttcaaggccctgaatcagaacaacacacccctgctcagcctaaaggacttttacgatatctacgaagttgctgctttgaagtggaaggccaagaaaaacagagagcactggtttgatgagcttcccaggacggcgctcctcatcttcaaaggtattaatatccttgtgaagtccaaggccttccagtatttcatgtacttggtggtggcagtcaacggggtctggatcctcgtggagacatttatgctgaaaggtgggaacttcttctccaagcacgtgccctggagttacctcgtctttctaactatctatggggtggagctgttcctgaaggttgccggcctgggccctgtggagtacttgtcttccggatggaacttgtttgacttctccgtgacagtgttcgccttcctgggactgctggcgctggccctcaacatggagcccttctatttcatcgtggtcctgcgccccctccagctgctgaggttgtttaagttgaaggagcgctaccgcaacgtgctggacaccatgttcgagctgctgccccggatggccagcctgggcctcaccctgctcatcttttactactccttcgccatcgtgggcatggagttcttctgcgggatcgtcttccccaactgctgcaacacgagtacagtggcagatgcctaccgctggcgcaaccacaccgtgggcaacaggaccgtggtggaggaaggctactattatctcaataattttgacaacatcctcaacagctttgtgaccctgtttgagctcacagttgtcaacaactggtacatcatcatggaaggcgtcacctctcagacctcccactggagccgcctctacttcatgaccttttacattgtgaccatggtggtgatgacgatcattgtcgcctttatcctcgaggccttcgtcttccgaatgaactacagccgcaagaaccaggactcggaagttgatggtggcatcacccttgagaaggaaatctccaaagaagagctggttgccgtcctggagctctaccgggaggcacggggggcctcctcggatgtcaccaggctgctggagaccctctcccagatggagagataccagcaacattccatggtgtttctgggacggcgatcaaggaccaagagcgacctgagcctgaagatgtaccaggaggagatccaggagtggtatgaggagcatgccagggagcaagagcagcagcgacaactcagcagcagtgcagcccccgccgcccagcagcccccaggcagccgccagcgctcccagaccgttacctagcccagcgcccgaaagccgtctcttctatgcaataacacaatagtattactctactgcgatgtacggaactgcggtgtgtgtacacatactcacgtatatgcacatatttatatacaggaagaaaaaagacagacaagatggggcttggtttataaccaccttgccctgtcttccttaactccagaagccagtttggtgaggggtgggggtgcggccaccaggtctgagctcttcctactgtggaaggctccagaaggcccttcacaaggagacccctcacctggatccagtcgactgcggggcttgcccctcatgtgggctggcctccatcggccacgtccaaagctgtcactgctactgcttcaggctcacatccccccgacctgatggcgtgcccgccccctctccctgcggcccatgccacaggtttctgtgttttgctttagggacagaaccacttaggaaggaaagaactcccggtctccagggtggtatttcagtgtctgtgataatgtcacgcaacacctcttcggggaccagtgcccaggatctaatggaagcggaattggggcaactgggcccatgtggccagagctcagttagccagtgccgggcggccacagattacactgaccaatctcctcccttggctctgcaagcctcccacccagccttctctggcttaacccttgttggcgaaaactcttccacagtggcctccttggggacccagaacccggaggaaggggcatgaggcaggaagtggggccgatgtctgcaacccagaccacttcgtggaatgggctcttgaccaaatccctttttttgcgatttacccgttcaagcaaaacaacgttttggttaactaaggattgtgctaaagccgataccaggtccttcacacgtgtgcactaggaacaggagcgaacagcacagagagacgctccctgtgggacgcagcagccccgtggccccggcccagttcccagccaccctccctggctctgctcacaccagagatttccatagcaggagcggttggtgcagaagtaggttcagatgaacctcagttaacgtcgccacccctcctcccaccatggtaccctgtaggagccctgtatgacatctgagcgtggtggaggtaggagggttgccagctgcagtgaccctgccacagaggcagggtcagtgcagaggtcgctttggttccgcttccctgggccacagaacggaacacagcataggttctgcagcaggagccgcagtggcaggatggagggtgcgaagggcaaggagtgcactgctgggcattcctggccagccccggccctctggtgcctgcttcctgtgacttcagaaggcaggtggacagagcctccctctggccttgtcctcttcccagccacagaacgggcagggtggcacccgaccccaggggagcagtacctggtcccccaccccctcctcccaaccacctccaaggccaagctgggtcccatagccagcacggcatggttctccccttccccccttcccaggtcaggggagttggacaagtagcaggtgtttgtttttaaagcacagccctttgggaaagcaacacattattgagactcactgtgattcccccgggagtcagactggctttgtcctcttcctctctggagggccatgggccatcagcaggagctccacatcgagccccaggccagaaccccctccctttcacagagagggaactttattgcacaattgggtgccttttagcttttgtgtgttgaaatgggcgttttggaagcaagggtcaggggacagcttctaaaggtgtgagtctctgacctgagcatctgggcctcgcctgggcccttcttcctccccaggggtggaaacgtggaggggccagcagcaccccggggtctgcccaggggagtcaaggccccgaggtgggggggcctattccaggaggagtgggatctcggccctgtccagagcgagttaatgtgtccatctgcccaaccctgtcctgagaaaggacctggttttggccaggacctgacaaatacccaatggcagcagtgtcaacagacgggagtccagccagggtgggtgcccttgtcattgaggttagggacagctatccccaggttatgcctggccccacccagcagggagttggggtccccccacaggctgtgagctctgtgggccctgggatgtgatctagctcagatgccctctcatccttgatgtcatagttgagtgcacccaagtggcacccactggcggccaggggcacagcctggtggtggtggcaatagaactgtgcccctcctcagctcctcgcttcccctcccacagccccagccttactccaccatgcggacaatcattttgtacggatcacgggagcaatgctgtacggttttgtacactggtggtttgtttcctagaaaacccattgtgtctctggatttctagcacattactaaaagagcctctgctttgtaaa

SEQ ID NO: 33305 - DNA, 2558 bp, Homo sapiens
ccctttcctcctttggcttaagcctttggcaggacagattttgggctggaggccagcaattcaactgggagggctctgtgccagttcttgcctttctgaagatggcggcagctatgccatccacgactcccaggcccccagtctcagctctgggggtgagagttccccctccagccccgcacacaactgggagatgaattaccaagaggcagcaatctacctccaggaaggcgagaacaacgacaagttcttcacccaccccaaggatgccaaggcgctggcggcctacctctttgcacacaatcacctcttctacctgatggagctggccacggccctgctgctgctgctgctctccctgtgcgaggcccccgccgtccccgcactccggcttggcatctatgtccacgccaccctggagctgtttgccctgatggtggtagtgtttgaactctgcatgaagttacgctggctgggcctccacaccttcatccggcacaagcggaccatggtcaagacctcggtgctggtggtgcagtttgtcgaggccatcgtggtgttggtacggcagatgtcccatgtgcgggtgacccgagcactgcgctgcattttcctggtggactgtcggtattgcggtggcgtccggcgcaacctgcggcagatcttccagtccctgccgcccttcatggacatcctcctgctgctgctgttcttcatgatcatctttgccatcctcggtttctacttgttctcccctaacccttcagacccctacttcagcaccctggagaacagcatcgtcagtctgtttgtccttctgaccacagccaatttcccagatgtgatgatgccctcctactcccggaacccctggtcctgcgtcttcttcatcgtgtacctctccatcgagctgtatttcatcatgaacctgcttctggctgtggtgttcgacaccttcaatgacattgagaaacgcaagttcaagtctttgctactgcacaagcgaaccgctatccagcatgcctaccgcctgctcatcagccagaggaggcctgccggcatctcctacaggcagtttgaaggcctcatgcgcttctacaagccccggatgagtgccagggagcgctatcttaccttcaaggccctgaatcagaacaacacacccctgctcagcctaaaggacttttacgatatctacgaagttgctgctttgaagtggaaggccaagaaaaacagagagcactggtttgatgagcttcccaggacggcgctcctcatcttcaaaggtattaatatccttgtgaagtccaaggccttccagtatttcatgtacttggtggtggcagtcaacggggtctggatcctcgtggagacatttatgctgaaaggtgggaacttcttctccaagcacgtgccctggagttacctcgtctttctaactatctatggggtggagctgttcctgaaggttgccggcctgggccctgtggagtacttgtcttccggatggaacttgtttgacttctccgtgacagtgttcgccttcctgggactgctggcgctggccctcaacatggagcccttctatttcatcgtggtcctgcgccccctccagctgctgaggttgtttaagttgaaggagcgctaccgcaacgtgctggacaccatgttcgagctgctgccccggatggccagcctgggcctcaccctgctcatcttttactactccttcgccatcgtgggcatggagttcttctgcgggatcgtcttccccaactgctgcaacacgagtacagtggcagatgcctaccgctggcgcaaccacaccgtgggcaacaggaccgtggtggaggaaggctactattatctcaataattttgacaacatcctcaacagctttgtgaccctgtttgagctcacagttgtcaacaactggtacatcatcatggaaggcgtcacctctcagacctcccactggagccgcctctacttcatgaccttttacattgtgaccatggtggtgatgacgatcattgtcgcctttatcctcgaggccttcgtcttccgaatgaactacagccgcaagaaccaggactcggaagttgatggtggcatcacccttgagaaggaaatctccaaagaagagctggttgccgtcctggagctctaccgggaggcacggggggcctcctcggatgtcaccaggctgctggagaccctctcccagatggagagataccagcaacattccatggtgtttctgggacggcgatcaaggaccaagagcgacctgagcctgaagatgtaccaggaggagatccaggagtggtatgaggagcatgccagggagcaagagcagcagcgacaactcagcagcagtgcagcccccgccgcccagcagcccccaggcagccgccagcgctcccagaccgttacctagcccagcgcccgaaagccgtctcttctatgcaataacacaatagtattactctactgcgatgtacggaactgcggtgtgtgtacacatactcacgtatatgcacatatttatatacagg

SEQ ID NO: 33306 - DNA, 5175 bp, Homo sapiens
agatggagtcttgctacattgcccaggctggtcttgaactgctaggctcaagcagttctcccaccttgacctcccaaagcgctgagattacagaagatgcctctaatggaggagtttctgagcagcacccctggcccagtggctttgaaagggagctcaaaccagagactatttcaagccctggatatcatatcctgagggccacaggagaagagaacatggctgtgagtttggatgacgacgtgccgctcatcctgaccttggatgagggtggcagtgccccactggctccctccaacggcctgggccaagaagagctacctagcaaaaatggcggcagctatgccatccacgactcccaggcccccagtctcagctctgggggtgagagttccccctccagccccgcacacaactgggagatgaattaccaagaggcagcaatctacctccaggaaggcgagaacaacgacaagttcttcacccaccccaaggatgccaaggcgctggcggcctacctctttgcacacaatcacctcttctacctgatggagctggccacggccctgctgctgctgctgctctccctgtgcgaggcccccgccgtccccgcactccggcttggcatctatgtccacgccaccctggagctgtttgccctgatggtggtagtgtttgaactctgcatgaagttacgctggctgggcctccacaccttcatccggcacaagcggaccatggtcaagacctcggtgctggtggtgcagtttgtcgaggccatcgtggtgttggtacggcagatgtcccatgtgcgggtgacccgagcactgcgctgcattttcctggtggactgtcggtattgcggtggcgtccggcgcaacctgcggcagatcttccagtccctgccgcccttcatggacatcctcctgctgctgctgttcttcatgatcatctttgccatcctcggtttctacttgttctcccctaacccttcagacccctacttcagcaccctggagaacagcatcgtcagtctgtttgtccttctgaccacagccaatttcccagatgtgatgatgccctcctactcccggaacccctggtcctgcgtcttcttcatcgtgtacctctccatcgagctgtatttcatcatgaacctgcttctggctgtggtgttcgacaccttcaatgacattgagaaacgcaagttcaagtctttgctactgcacaagcgaaccgctatccagcatgcctaccgcctgctcatcagccagaggaggcctgccggcatctcctacaggcagtttgaaggcctcatgcgcttctacaagccccggatgagtgccagggagcgctatcttaccttcaaggccctgaatcagaacaacacacccctgctcagcctaaaggacttttacgatatctacgaagttgctgctttgaagtggaaggccaagaaaaacagagagcactggtttgatgagcttcccaggacggcgctcctcatcttcaaaggtattaatatccttgtgaagtccaaggccttccagtatttcatgtacttggtggtggcagtcaacggggtctggatcctcgtggagacatttatgctgaaaggtgggaacttcttctccaagcacgtgccctggagttacctcgtctttctaactatctatggggtggagctgttcctgaaggttgccggcctgggccctgtggagtacttgtcttccggatggaacttgtttgacttctccgtgacagtgttcgccttcctgggactgctggcgctggccctcaacatggagcccttctatttcatcgtggtcctgcgccccctccagctgctgaggttgtttaagttgaaggagcgctaccgcaacgtgctggacaccatgttcgagctgctgccccggatggccagcctgggcctcaccctgctcatcttttactactccttcgccatcgtgggcatggagttcttctgcgggatcgtcttccccaactgctgcaacacgagtacagtggcagatgcctaccgctggcgcaaccacaccgtgggcaacaggaccgtggtggaggaaggctactattatctcaataattttgacaacatcctcaacagctttgtgaccctgtttgagctcacagttgtcaacaactggtacatcatcatggaaggcgtcacctctcagacctcccactggagccgcctctacttcatgaccttttacattgtgaccatggtggtgatgacgatcattgtcgcctttatcctcgaggccttcgtcttccgaatgaactacagccgcaagaaccaggactcggaagttgatggtggcatcacccttgagaaggaaatctccaaagaagagctggttgccgtcctggagctctaccgggaggcacggggggcctcctcggatgtcaccaggctgctggagaccctctcccagatggagagataccagcaacattccatggtgtttctgggacggcgatcaaggaccaagagcgacctgagcctgaagatgtaccaggaggagatccaggagtggtatgaggagcatgccagggagcaagagcagcagcgacaactcagcagcagtgcagcccccgccgcccagcagcccccaggcagccgccagcgctcccagaccgttacctagcccagcgcccgaaagccgtctcttctatgcaataacacaatagtattactctactgcgatgtacggaactgcggtgtgtgtacacatactcacgtatatgcacatatttatatacaggaagaaaaaagacagacaagatggggcttggtttataaccaccttgccctgtcttccttaactccagaagccagtttggtgaggggtgggggtgcggccaccaggtctgagctcttcctactgtggaaggctccagaaggcccttcacaaggagacccctcacctggatccagtcgactgcggggcttgcccctcatgtgggctggcctccatcggccacgtccaaagctgtcactgctactgcttcaggctcacatccccccgacctgatggcgtgcccgccccctctccctgcggcccatgccacaggtttctgtgttttgctttagggacagaaccacttaggaaggaaagaactcccggtctccagggtggtatttcagtgtctgtgataatgtcacgcaacacctcttcggggaccagtgcccaggatctaatggaagcggaattggggcaactgggcccatgtggccagagctcagttagccagtgccgggcggccacagattacactgaccaatctcctcccttggctctgcaagcctcccacccagccttctctggcttaacccttgttggcgaaaactcttccacagtggcctccttggggacccagaacccggaggaaggggcatgaggcaggaagtggggccgatgtctgcaacccagaccacttcgtggaatgggctcttgaccaaatccctttttttgcgatttacccgttcaagcaaaacaacgttttggttaactaaggattgtgctaaagccgataccaggtccttcacacgtgtgcactaggaacaggagcgaacagcacagagagacgctccctgtgggacgcagcagccccgtggccccggcccagttcccagccaccctccctggctctgctcacaccagagatttccatagcaggagcggttggtgcagaagtaggttcagatgaacctcagttaacgtcgccacccctcctcccaccatggtaccctgtaggagccctgtatgacatctgagcgtggtggaggtaggagggttgccagctgcagtgaccctgccacagaggcagggtcagtgcagaggtcgctttggttccgcttccctgggccacagaacggaacacagcataggttctgcagcaggagccgcagtggcaggatggagggtgcgaagggcaaggagtgcactgctgggcattcctggccagccccggccctctggtgcctgcttcctgtgacttcagaaggcaggtggacagagcctccctctggccttgtcctcttcccagccacagaacgggcagggtggcacccgaccccaggggagcagtacctggtcccccaccccctcctcccaaccacctccaaggccaagctgggtcccatagccagcacggcatggttctccccttccccccttcccaggtcaggggagttggacaagtagcaggtgtttgtttttaaagcacagccctttgggaaagcaacacattattgagactcactgtgattcccccgggagtcagactggctttgtcctcttcctctctggagggccatgggccatcagcaggagctccacatcgagccccaggccagaaccccctccctttcacagagagggaactttattgcacaattgggtgccttttagcttttgtgtgttgaaatgggcgttttggaagcaagggtcaggggacagcttctaaaggtgtgagtctctgacctgagcatctgggcctcgcctgggcccttcttcctccccaggggtggaaacgtggaggggccagcagcaccccggggtctgcccaggggagtcaaggccccgaggtgggggggcctattccaggaggagtgggatctcggccctgtccagagcgagttaatgtgtccatctgcccaaccctgtcctgagaaaggacctggttttggccaggacctgacaaatacccaatggcagcagtgtcaacagacgggagtccagccagggtgggtgcccttgtcattgaggttagggacagctatccccaggttatgcctggccccacccagcagggagttggggtccccccacaggctgtgagctctgtgggccctgggatgtgatctagctcagatgccctctcatccttgatgtcatagttgagtgcacccaagtggcacccactggcggccaggggcacagcctggtggtggtggcaatagaactgtgcccctcctcagctcctcgcttcccctcccacagccccagccttactccaccatgcggacaatcattttgtacggatcacgggagcaatgctgtacggttttgtacactggtggtttgtttcctagaaaacccattgtgtctctggatttctagcacattactaaaagagcctctgctttgt

SEQ ID NO: 33307 - DNA, 5345 bp, Homo sapiens
aggagagctggcgcagctgccctggtggcagtggctgaagtggcggcggcttcggcggctgcggcggctgcaacagcttcgggctcggggttttggcggcggcgccggcgggctaggctgcgcggtgcggaccccggcgcgcggtccgggttgctggggcggcgcgtagatggagtcttgctacattgcccaggctggtcttgaactgctaggctcaagcagttctcccaccttgacctcccaaagcgctgagattacagaagatgcctctaatggaggagtttctgagcagcacccctggcccagtggctttgaaagggagctcaaaccagagactatttcaagccctggatatcatatcctgagggccacaggagaagagaacatggctgtgagtttggatgacgacgtgccgctcatcctgaccttggatgagggtggcagtgccccactggctccctccaacggcctgggccaagaagagctacctagcaaaaatggcggcagctatgccatccacgactcccaggcccccagtctcagctctgggggtgagagttccccctccagccccgcacacaactgggagatgaattaccaagaggcagcaatctacctccaggaaggcgagaacaacgacaagttcttcacccaccccaaggatgccaaggcgctggcggcctacctctttgcacacaatcacctcttctacctgatggagctggccacggccctgctgctgctgctgctctccctgtgcgaggcccccgccgtccccgcactccggcttggcatctatgtccacgccaccctggagctgtttgccctgatggtggtagtgtttgaactctgcatgaagttacgctggctgggcctccacaccttcatccggcacaagcggaccatggtcaagacctcggtgctggtggtgcagtttgtcgaggccatcgtggtgttggtacggcagatgtcccatgtgcgggtgacccgagcactgcgctgcattttcctggtggactgtcggtattgcggtggcgtccggcgcaacctgcggcagatcttccagtccctgccgcccttcatggacatcctcctgctgctgctgttcttcatgatcatctttgccatcctcggtttctacttgttctcccctaacccttcagacccctacttcagcaccctggagaacagcatcgtcagtctgtttgtccttctgaccacagccaatttcccagatgtgatgatgccctcctactcccggaacccctggtcctgcgtcttcttcatcgtgtacctctccatcgagctgtatttcatcatgaacctgcttctggctgtggtgttcgacaccttcaatgacattgagaaacgcaagttcaagtctttgctactgcacaagcgaaccgctatccagcatgcctaccgcctgctcatcagccagaggaggcctgccggcatctcctacaggcagtttgaaggcctcatgcgcttctacaagccccggatgagtgccagggagcgctatcttaccttcaaggccctgaatcagaacaacacacccctgctcagcctaaaggacttttacgatatctacgaagttgctgctttgaagtggaaggccaagaaaaacagagagcactggtttgatgagcttcccaggacggcgctcctcatcttcaaaggtattaatatccttgtgaagtccaaggccttccagtatttcatgtacttggtggtggcagtcaacggggtctggatcctcgtggagacatttatgctgaaaggtgggaacttcttctccaagcacgtgccctggagttacctcgtctttctaactatctatggggtggagctgttcctgaaggttgccggcctgggccctgtggagtacttgtcttccggatggaacttgtttgacttctccgtgacagtgttcgccttcctgggactgctggcgctggccctcaacatggagcccttctatttcatcgtggtcctgcgccccctccagctgctgaggttgtttaagttgaaggagcgctaccgcaacgtgctggacaccatgttcgagctgctgccccggatggccagcctgggcctcaccctgctcatcttttactactccttcgccatcgtgggcatggagttcttctgcgggatcgtcttccccaactgctgcaacacgagtacagtggcagatgcctaccgctggcgcaaccacaccgtgggcaacaggaccgtggtggaggaaggctactattatctcaataattttgacaacatcctcaacagctttgtgaccctgtttgagctcacagttgtcaacaactggtacatcatcatggaaggcgtcacctctcagacctcccactggagccgcctctacttcatgaccttttacattgtgaccatggtggtgatgacgatcattgtcgcctttatcctcgaggccttcgtcttccgaatgaactacagccgcaagaaccaggactcggaagttgatggtggcatcacccttgagaaggaaatctccaaagaagagctggttgccgtcctggagctctaccgggaggcacggggggcctcctcggatgtcaccaggctgctggagaccctctcccagatggagagataccagcaacattccatggtgtttctgggacggcgatcaaggaccaagagcgacctgagcctgaagatgtaccaggaggagatccaggagtggtatgaggagcatgccagggagcaagagcagcagcgacaactcagcagcagtgcagcccccgccgcccagcagcccccaggcagccgccagcgctcccagaccgttacctagcccagcgcccgaaagccgtctcttctatgcaataacacaatagtattactctactgcgatgtacggaactgcggtgtgtgtacacatactcacgtatatgcacatatttatatacaggaagaaaaaagacagacaagatggggcttggtttataaccaccttgccctgtcttccttaactccagaagccagtttggtgaggggtgggggtgcggccaccaggtctgagctcttcctactgtggaaggctccagaaggcccttcacaaggagacccctcacctggatccagtcgactgcggggcttgcccctcatgtgggctggcctccatcggccacgtccaaagctgtcactgctactgcttcaggctcacatccccccgacctgatggcgtgcccgccccctctccctgcggcccatgccacaggtttctgtgttttgctttagggacagaaccacttaggaaggaaagaactcccggtctccagggtggtatttcagtgtctgtgataatgtcacgcaacacctcttcggggaccagtgcccaggatctaatggaagcggaattggggcaactgggcccatgtggccagagctcagttagccagtgccgggcggccacagattacactgaccaatctcctcccttggctctgcaagcctcccacccagccttctctggcttaacccttgttggcgaaaactcttccacagtggcctccttggggacccagaacccggaggaaggggcatgaggcaggaagtggggccgatgtctgcaacccagaccacttcgtggaatgggctcttgaccaaatccctttttttgcgatttacccgttcaagcaaaacaacgttttggttaactaaggattgtgctaaagccgataccaggtccttcacacgtgtgcactaggaacaggagcgaacagcacagagagacgctccctgtgggacgcagcagccccgtggccccggcccagttcccagccaccctccctggctctgctcacaccagagatttccatagcaggagcggttggtgcagaagtaggttcagatgaacctcagttaacgtcgccacccctcctcccaccatggtaccctgtaggagccctgtatgacatctgagcgtggtggaggtaggagggttgccagctgcagtgaccctgccacagaggcagggtcagtgcagaggtcgctttggttccgcttccctgggccacagaacggaacacagcataggttctgcagcaggagccgcagtggcaggatggagggtgcgaagggcaaggagtgcactgctgggcattcctggccagccccggccctctggtgcctgcttcctgtgacttcagaaggcaggtggacagagcctccctctggccttgtcctcttcccagccacagaacgggcagggtggcacccgaccccaggggagcagtacctggtcccccaccccctcctcccaaccacctccaaggccaagctgggtcccatagccagcacggcatggttctccccttccccccttcccaggtcaggggagttggacaagtagcaggtgtttgtttttaaagcacagccctttgggaaagcaacacattattgagactcactgtgattcccccgggagtcagactggctttgtcctcttcctctctggagggccatgggccatcagcaggagctccacatcgagccccaggccagaaccccctccctttcacagagagggaactttattgcacaattgggtgccttttagcttttgtgtgttgaaatgggcgttttggaagcaagggtcaggggacagcttctaaaggtgtgagtctctgacctgagcatctgggcctcgcctgggcccttcttcctccccaggggtggaaacgtggaggggccagcagcaccccggggtctgcccaggggagtcaaggccccgaggtgggggggcctattccaggaggagtgggatctcggccctgtccagagcgagttaatgtgtccatctgcccaaccctgtcctgagaaaggacctggttttggccaggacctgacaaatacccaatggcagcagtgtcaacagacgggagtccagccagggtgggtgcccttgtcattgaggttagggacagctatccccaggttatgcctggccccacccagcagggagttggggtccccccacaggctgtgagctctgtgggccctgggatgtgatctagctcagatgccctctcatccttgatgtcatagttgagtgcacccaagtggcacccactggcggccaggggcacagcctggtggtggtggcaatagaactgtgcccctcctcagctcctcgcttcccctcccacagccccagccttactccaccatgcggacaatcattttgtacggatcacgggagcaatgctgtacggttttgtacactggtggtttgtttcctagaaaacccattgtgtctctggatttctagcacattactaaaagagcctctgctttgtaaa

SEQ ID NO: 33308 - DNA, 527 bp, Homo sapiens
aacgagtaaggcggggaacaagggaggagtaaggggcgtggattcttcgtcccgccccttcttaaggaggcgggcagggagtaccgcatcggcggcgggcgagacctgcggaaggacgtgatagttggccaatcagagttcatcacgaagatgcctctaatggaggagtttctgagcagcacccctggcccagtggctttgaaagggagctcaaaccagagactatttcaagccctggatatcatatcctgagggccacaggagaagagaacatggctgtgagtttggatgacgacgtgccgctcatcctgaccttggatgagggtggcagtgccccactggctccctccaacggcctgggccaagaagagctacctagcaaaaatggcggcagctatgccatccacgactcccaggcccccagtctcagctctgggggtgagagttccccctccagccccgcacacaactgggagatgaattaccaagaggcagcaatctacctccaggaaggcgagaacaacgac

SEQ ID NO: 33309 - DNA, 570 bp, Homo sapiens
gagaggacggtaggcggtggataggagagctggcgcagctgccctggtggcagtggctgaagtggcggcggcttcggcggctgcggcggctgcaacagcttcgggctcggggttttggcggcggcgccggcgggctaggctgcgcgaagatgcctctaatggaggagtttctgagcagcacccctggcccagtggctttgaaagggagctcaaaccagagactatttcaagccctggatatcatatcctgagggccacaggagaagagaacatggctgtgagtttggatgacgacgtgccgctcatcctgaccttggatgagggtggcagtgccccactggctccctccaacggcctgggccaagaagagctacctagcaaaagacgctgctgcatgctgtgctccagcaaacagaaaccttggattccctgcagggtcatttccgatgtggcgtgcaaagcagccagctgtttcgagggagcgtctgggccctgtgacatcagcatgtgggagtgttaccgtgtgtgcaaacagatggcggcagctatgccatccacgactcccaggcc

SEQ ID NO: 33310 - DNA, 2931 bp, Homo sapiens
agcaaaaacgccagggacggggtctccgcgcctgcgcagtgaagctgggcgccttcggggcttgagcttctgagggtcgggtccagcgcgtgggctgctggatggcggaaccccaggcggagtcggagcccctgctgggcggggcccgcggcggtggcggcgactggccggcggggctgaccacttaccgcagcatccaagtcggccctggtgccgcggccaggtgggacctctgcattgatcaggctgtggtcttcatcgaagatgctattcagtaccgctccatcaaccaccgggtggatgccagctcgatgtggctttaccgacggtattactcgaacgtatgccaacggactttgagcttcaccatcttcttgatcctgtttttggcttttatcgagaccccatcctcactcaccagcacggcggacgtgcgctaccgcgctgctccctgggagccgccctgcggcctgaccgagagtgtcgaggtgctctgcctgctggtctttgcggccgacctctctgtgaagggttacctgttcgggtgggcccatttccagaaaaacctttggctgctgggctacctcgtggtgctggtggtgtctctggtggactggaccgtgtccctgagtctcgtgtgtcatgagcccctgcggatccgccggcttctccgtcccttcttcctgctgcagaactcctctatgatgaagaagaccttgaaatgcatccgctggtcgctgccggaaatggccagcgtcgggctgctgctggccatccacctgtgcctcttcaccatgttcggaatgctgctgttcgctggtgggaagcaggatgatgggcaggacagggagaggctgacctacttccagaacctgcctgagtctctgacttccctcctggtgctgctgaccacggccaacaaccccgatgtgatgattcctgcgtattccaagaaccgggcctatgccatcttcttcatagtcttcactgtgataggaagcctgtttctgatgaacctgctgacagccatcatctacagtcagttccggggctacctgatgaaatctctccagacctcgctgtttcggaggcggctgggaacccgggctgcctttgaagtcctatcctccatggtgggggagggaggagccttccctcaggcagttggggtgaagccccagaacttgctgcaggtgcttcagaaggtccagctggacagctcccacaaacaggccatgatggagaaggtgcgttcctatggcagtgttctgctctcagctgaggagtttcagaagctcttcaacgagcttgacagaagtgtggttaaagagcacccgccgaggcccgagtaccagtctccgtttctgcagagcgcccagttcctcttcggccactactactttgactacctggggaacctcatcgccctggcaaacctggtgtccatttgcgtgttcctggtgctggatgcagatgtgctgcctgctgagcgtgatgacttcatcctggggattctcaactgcgtcttcattgtgtactacctgttggagatgctgctcaaggtctttgccctgggcctgcgagggtacctgtcctaccccagcaacgtgtttgacgggctcctcaccgttgtcctgctggttttggagatctcaactctggctgtgtaccgattgccacacccaggctggaggccggagatggtgggcctgctgtcgctgtgggacatgacccgcatgctgaacatgctcatcgtgttccgcttcctgcgtatcatccccagcatgaagctgatggccgtggtggccagtaccgtcctgggcctggtgcagaacatgcgtgcgtttggcgggatcctggtggtggtctactacgtatttgccatcattgggatcaacttgtttagaggcgtcattgtggctcttcctggaaacagcagcctggcccctgccaatggctcggcgccctgtgggagcttcgagcagctggagtactgggccaacaacttcgatgactttgcggctgccctggtcactctgtggaacttgatggtggtgaacaactggcaggtgtttctggatgcatatcggcgctactcaggcccgtggtccaagatctattttgtattgtggtggctggtgtcgtctgtcatctgggtcaacctgtttctggccctgattctggagaacttccttcacaagtgggacccccgcagccacctgcagccccttgctgggaccccagaggccacctaccagatgactgtggagctcctgttcagggatattctggaggagcccggggaggatgagctcacagagaggctgagccagcacccgcacctgtggctgtgcaggtgacgtccgggctgccgtcccagcaggggcggcaggagagagaggctggcctacacaggtgcccgtcatggaagaggcggccatgctgtggccagccaggcaggaagagacctttcctctgacggaccactaagctggggacaggaaccaagtcctttgcgtgtggcccaacaaccatctacagaacagctgctggtgcttcagggaggcgccgtgccctccgctttcttttatagctgcttcagtgagaattccctcgtcgactccacagggacctttcagacaaaaatgcaagaagcagcggcctcccctgtcccctgcagcttccgtggtgcctttgctgccggcagcccttggggaccacaggcctgaccagggcctgcacaggttaaccgtcagacttccggggcattcaggtggggatgctggtggtttgacatggagagaaccttgactgtgttttattatttcatggcttgtatgagtgtgactgggtgtgtttctttagggttctgattgccagttattttcatcaataagtcttgcaaagaatgggattgtcattcttcacttc

SEQ ID NO: 33311 - DNA, 4730 bp, Homo sapiens
tgccgtgcgcgcgtcagcaaaaacgccagggacggggtctccgcgcctgcgcagtgaagctgggcgccttcggggcttgagcttctgagggtcgggtccagcgcgtgggctgctggatggcggaaccccaggcggagtcggagcccctgctgggcggggcccgcggcggtggcggcgactggccggcggggctgaccacttaccgcagcatccaagtcggccctggtgccgcggccaggtgggacctctgcattgatcaggctgtggtcttcatcgaagatgctattcagtaccgctccatcaaccaccgggtggatgccagctcgatgtggctttaccgacggtattactcgaacgtatgccaacggactttgagcttcaccatcttcttgatcctgtttttggcttttatcgagaccccatcctcactcaccagcacggcggacgtgcgctaccgcgctgctccctgggagccgccctgcggcctgaccgagagtgtcgaggtgctctgcctgctggtctttgcggccgacctctctgtgaagggttacctgttcgggtgggcccatttccagaaaaacctttggctgctgggctacctcgtggtgctggtggtgtctctggtggactggaccgtgtccctgagtctcgtgtgtcatgagcccctgcggatccgccggcttctccgtcccttcttcctgctgcagaactcctctatgatgaagaagaccttgaaatgcatccgctggtcgctgccggaaatggccagcgtcgggctgctgctggccatccacctgtgcctcttcaccatgttcggaatgctgctgttcgctggtgggaagcaggatgatgggcaggacagggagaggctgacctacttccagaacctgcctgagtctctgacttccctcctggtgctgctgaccacggccaacaaccccgatgtgatgattcctgcgtattccaagaaccgggcctatgccatcttcttcatagtcttcactgtgataggaagcctgtttctgatgaacctgctgacagccatcatctacagtcagttccggggctacctgatgaaatctctccagacctcgctgtttcggaggcggctgggaacccgggctgcctttgaagtcctatcctccatggtgggggagggaggagccttccctcaggccacccgccgaggcccgagtaccagtctccgtttctgcagagcgcccagttcctcttcggccactactactttgactacctggggaacctcatcgccctggcaaacctggtgtccatttgcgtgttcctggtgctggatgcagatgtgctgcctgctgagcgtgatgacttcatcctggggattctcaactgcgtcttcattgtgtactacctgttggagatgctgctcaaggtctttgccctgggcctgcgagggtacctgtcctaccccagcaacgtgtttgacgggctcctcaccgttgtcctgctggaggccggagatggtgggcctgctgtcgctgtgggacatgacccgcatgctgaacatgctcatcgtgttccgcttcctgcgtatcatccccagcatgaagctgatggccgtggtggccagtaccgtcctgggcctggtgcagaacatgcgtgcgtttggcgggatcctggtgcctggcccctgccaatggctcggcgccctgtgggagcttcgagcagctggagtactgggccaacaacttcgatgactttgcggctgccctggtcactctgtggaacttgatggtggtgaacaactggcaggtgtttctggatgcatatcggcgctactcaggcccgtggtccaagatctattttgtattgtggtggctggtgtcgtctgtcatctgggtcaacctgtttctggccctgattctggagaacttccttcacaagtgggacccccgcagccacctgcagccccttgctgggaccccagaggccacctaccagatgactgtggagctcctgttcagggatattctggaggagcccggggaggatgagctcacagagaggctgagccagcacccgcacctgtggctgtgcaggtgacgtccgggctgccgtcccagcaggggcggcaggagagagaggctggcctacacaggtgcccgtcatggaagaggcggccatgctgtggccagccaggcaggaagagacctttcctctgacggaccactaagctggggacaggaaccaagtcctttgcgtgtggcccaacaaccatctacagaacagctgctggtgcttcagggaggcgccgtgccctccgctttcttttatagctgcttcagtgagaattccctcgtcgactccacagggacctttcagacaaaaatgcaagaagcagcggcctcccctgtcccctgcagcttccgtggtgcctttgctgccggcagcccttggggaccacaggcctgaccagggcctgcacaggttaaccgtcagacttccggggcattcaggtggggatgctggtggtttgacatggagagaaccttgactgtgttttattatttcatggcttgtatgagtgtgactgggtgtgtttctttagggttctgattgccagttattttcatcaataagtcttgcaaagaatgggattgtcattcttcacttcagcacagttctagtcctgcttctctggagtagggttgttgagtaaggttgcttgggttgtgcattgcacaagggcacatggctgtgaggtgtatcctggcggggggctgtctacctgcagtgaggggcaccttttctgttttgctcaaaggcatgtataagccaatgggtgaccttatttcctgtgtcttcaggtgtgtggcagggggcctggggtggggaggtggggcgagcgagcagtgtgtggaaagccttgttgtcacctgaagcacgccaggtccagattgaccaatggttttctcacttcaggggccaacccacgccccctttctgctgaggtttgggtgccatctagtggtgggatgggacttggttgactacatttaaggtaaggtggacccagcaactcccagaaacaactccggggacaccactccccatcacactccacaccgagcctggtgcccggtctgtgcccgagctcagcgggaccaggaagggatgggccctgccagggttgcccctgcactgtgcattctcgcctgggaggcacaagttctttcatctgcttttccttcagaggtgctgagcccacgccatagcccctgtgggatggtgggggagggggcgacccgaacaacagtgcagtcggtatcgagattggggagaggagcgagtccaaggagaaggtcatgagtttctttttactcgtgttgaataataacaataacaataacaataacaatatggaaaccaccgcaaacttggagaaaagttgtaagcacagtaaagagaagcttccttctgagtcacttgagtggttgccgttctggccctgcaccctctgtgctttgggacggcgtccaacccgcattcatgtcaggagtgagtcgcacgtggctttgtggtcatggcgacttaatccgcctggacggtggctccgtctccctgggcttagacgaccttggcacttctggagataagcccatggctcccaggttgtgttcatgtgacgtttccttgtggtaggttctgggtctgcgtttcgtctaggagtgtcacaggatggacactgcctcctggcaggggctgcccaatgcagttagcctcctgctggtgttctctcttgttgcttggtgaaggtggccctggtcagcttctccactgcccagtgaacgacccctttgtaatgaatgagtggggaggtagtgtgaagcgatgccaatatcccatccctgtcaaactgcctttactttttccttccttccttgctcccacctgtgtggatcctggtcccttcttgtattcagggctgtggtctgttatgacatttactctcaggctcaggtcctgcttgtttggcccgtgggagccccttcttctgccttttgtgttttttttgttatgtacctacagttctttagctgtttctttactttctggtgcaaaaagatgttcaagccttattttatacttgcctgcccctttctctttcatttattggagtgagctgcagctctaagaagacctgttcttttgaatggagagtagcatcaggaaccaggatgtgggtgcgaggcgtgctcctggctgttgcagattgctgcacccgggagctcttagtggacagagctagaggatatgtgcacgtacttccatctctctctctgtctcatctattcacagctgggaatgatactaatacctccgattttagcccagcaccacagggtacgttccagtttttctctctttccatagctgtaaggccctttctgggaatggttctcattctccttaatctattattgggtcagttttcctgcatgtccccagcctcccatcactgccacccactccccacagagatgccctgctcatccgactggggctttgactcccacactgtgtacccctcttgtgtggacgccctgctgccaaaaccttcagcaaacagctttccaaatggaagttgtcactgtcagggcctttacaatcagcaacagcaaaatctacatgctgctgagggtcctgcctcattaagatgcaataaatatgtaagtacataaaaacagcaatag

SEQ ID NO: 33312 - DNA, 2914 bp, Homo sapiens
gatttcagttgaaagatgtgtttttgtgagtagagcaccgcagaagaactgaagactgttgtgtgctccccgcagaaggggctaccatgatcctttcctcctataacaccatccagtcggttttctgttgctgctgttgctgttcagtgcagaagcgacaaatgagaacacagataagcctgagcacagatgaagagcttccagaaaaatacacccagcgtcgcaggccgtggctcagccaattgtcaaataagaagcaatccaacacgggccgtgtgcagccgtcaaaacgaaagccactgcctcccctcccaccctctgaggttgctgaagagaagatccaagtcaaggcactttatgattttctgcccagagaaccctgtaatttagccttaaggagagcagaagaatacctgatactggagaaatacaatcctcactggtggaaggcaagagaccgtttggggaatgaaggcttaatcccaagcaactatgtgactgaaaacaaaataactaatttagaaatatatgagtggtaccatagaaacattaccagaaatcaggcagaacatctattgagacaagagtctaaagaaggtgcatttattgtcagagattcaagacatttaggatcctacacaatttccgtatttatgggagctagaagaagtacggaggctgccataaaacattatcagataaaaaagaatgactcaggacagtggtatgtggctgaaagacacgcctttcaatcaatccctgagttaatctggtatcaccagcacaatgcagccggtctcatgactcgtctccgatatccagttgggctgatgggcagttgtttaccagccacagctgggtttagctacgaaaagtgggagatagatccatctgagttggcttttataaaggagattggaagcggtcagtttggagtggtccatttaggtgaatggcggtcacatatccaggtagctatcaaggccatcaatgaaggctccatgtctgaagaggatttcattgaagaggccaaagtgatgatgaaattatctcattcaaagctagtgcaactttatggagtctgtatacagcggaagcccctttacattgtgacagagttcatggaaaatggctgcctgcttaactatctcagggagaataaaggaaagcttaggaaggaaatgctactgagtgtatgccaggatatatgtgaaggaatggaatatctggagaggaatggctatattcatagggatttggcggcaaggaattgtttggtcagttcaacatgcatagtaaaaatttcagactttggaatgacaaggtacgttttggatgatgagtatgtcagttcttttggagccaagttcccaatcaagtggtcccctcctgaagtttttcttttcaataagtacagcagtaaatctgatgtctggtcatttggagttttaatgtgggaagtttttacagaaggaaaaatgccttttgaaaataagtcaaatttgcaagtcgtggaagctatttctgaaggcttcaggctatatcgccctcacctggcaccaatgtccatatatgaagtcatgtacagctgctggcatgagaaacctgaaggccgccctacatttgccgagctgctgcgggctgtcacagagattgcggaaacctggtgaccggaaacagaatgccaacccaaagagtcatcttgcaaaactgtcatttattgtgaatatcttcaccatatggggtcacttatggtgaatatctttcttcagagttgctgactcttgaaaacagtgcaaagatcacagtttttaaaagttttaaaaatttaagaatattcacacaatcgtttttctatgtgtgagagggatttgcacactcttatttttctgtaaaatatttcacatcccaaatgtgaagaagtgaaaaagacttcgcagcagtcttcattgtggtgctcttcatgatcatagccccaggaacccttgaggttcttcttcacaaggctgagagtgcttccttcttgaagacgagtgacattcatcacttcagtgatccatgcatagaatatgaaaataaattcttccaactcatgggataaaggggactcccttgaagaatttcatgtttttgggctgtatagctctttacagaaaatgcacctttataaatcacatgaatgttagtattctggaaatgtcttttgttaatataatcttcccatgttatttaacaaattgtttttgcacatatctgattatattgaaagcagttttttgcattcgagttttaaacactgttataaaatgtagccaaagctcacctttgaacagatcccggtgacattctatttccaggaaaatccggaacctgattttagttctgtgattttacactttttacatgtgagattggacagtttcagaggccttattttgtcatactaagtgtctcctgtaattttcaggaagatgatttgttctttccagaagaggagacaaaagcaagatagccaaatgtgacatcaagctccattgtttcggaaatccaggattttgaattcgagatgaaacaaccagcaatcacagttaaatcttaactttgcctgcactctttgtaggaatgatcagaaatttatctttatcattctgagtgcttcaggagtacaataggaagaaagatactggagaaagcactaatgtaatcaccatgaagtctgacaacaggagcccattatttgcgtactgtcccaccctgtatcatggttctctgggaacaagctttatgattctcattagagtttatttgttgattgtcagtagttgcgacttttaaattatatttcccccactcaaagaatggtatctttatatatcaatgacattcaataaatgtgtattatttctaatgagaa

SEQ ID NO: 33313 - DNA, 582 bp, Homo sapiens
agacttcctccttcacttgcctggacgctgcgccacatcccaccggcccttacactgtggtgtccagcagcatccggcttcatggggggacttgaaccctgcagcaggctcctgctcctgcctctcctgctggctgtaagtggtctccgtcctgtccaggcccaggcccagagcgattgcagttgctctacggtgagcccgggcgtgctggcagggatcgtgatgggagacctggtgctgacagtgctcattgccctggccgtgtacttcctgggccggctggtccctcgggggcgaggggctgcggaggcagcgacccggaaacagcgtatcactgagaccgagtcgccttatcaggagctccagggtcagaggtcggatgtctacagcgacctcaacacacagaggccgtattacaaatgagcccgaatcatgacagtcagcaacatgatacctggatccagccattcctgaagcccaccctgcacctcattccaactcctaccgcgatacagacccacagagtgccatccctgagagaccagaccgctccccaatactctcctaaaataaacatgaagc

SEQ ID NO: 33314 - DNA, 579 bp, Homo sapiens
agacttcctccttcacttgcctggacgctgcgccacatcccaccggcccttacactgtggtgtccagcagcatccggcttcatggggggacttgaaccctgcagcaggctcctgctcctgcctctcctgctggctgtaagtggtctccgtcctgtccaggcccaggcccagagcgattgcagttgctctacggtgagcccgggcgtgctggcagggatcgtgatgggagacctggtgctgacagtgctcattgccctggccgtgtacttcctgggccggctggtccctcgggggcgaggggctgcggaggcgacccggaaacagcgtatcactgagaccgagtcgccttatcaggagctccagggtcagaggtcggatgtctacagcgacctcaacacacagaggccgtattacaaatgagcccgaatcatgacagtcagcaacatgatacctggatccagccattcctgaagcccaccctgcacctcattccaactcctaccgcgatacagacccacagagtgccatccctgagagaccagaccgctccccaatactctcctaaaataaacatgaagc

SEQ ID NO: 33315 - DNA, 549 bp, Homo sapiens
agacttcctccttcacttgcctggacgctgcgccacatcccaccggcccttacactgtggtgtccagcagcatccggcttcatggggggacttgaaccctgcagcaggctcctgctcctgcctctcctgctggctgtaagtgattgcagttgctctacggtgagcccgggcgtgctggcagggatcgtgatgggagacctggtgctgacagtgctcattgccctggccgtgtacttcctgggccggctggtccctcgggggcgaggggctgcggaggcagcgacccggaaacagcgtatcactgagaccgagtcgccttatcaggagctccagggtcagaggtcggatgtctacagcgacctcaacacacagaggccgtattacaaatgagcccgaatcatgacagtcagcaacatgatacctggatccagccattcctgaagcccaccctgcacctcattccaactcctaccgcgatacagacccacagagtgccatccctgagagaccagaccgctccccaatactctcctaaaataaacatgaagc

SEQ ID NO: 33316 - DNA, 415 bp, Homo sapiens
acttgcctggacgctgcgccacatcccaccggcccttacactgtggtgtccagcagcatccggcttcatggggggacttgaaccctgcagcaggctcctgctcctgcctctcctgctggctgtaagtggtctccgtcctgtccaggcccaggcccagagcgattgcagttgctctacggtgagcccgggcgtgctggcagggatcgtgatgggagacctggtgctgacagtgctcattgccctggccgtgtacttcctgggccggctggtccctcgggggcgaggggctgcggaggcgacccggaaacagcgtatcactgagaccgagtcgccttatcaggagctccagggtcagaggtcggatgtctacagcgacctcaacacacagaggccgtattacaaatgagcccgaatc

SEQ ID NO: 33317 - DNA, 3959 bp, Homo sapiens
gcggtggcgcgggagcggccccggggaccccgcgctgctgacggcggcgaccgcggccggaggcgggcgcgggtctcggaggcggtcgcctcagcaccgccccacgggcggccccagcccctcccgcagccctcctccctcccgctcccttcccgccgcctcctccccgccctcctccctcctcgctcgcgggccgggcccggcatggtgcggcgtcgccgccgatggcgctgaggcggagcatggggcggccggggctcccgccgctgccgctgccgccgccaccgcggctcgggctgctgctggcggctctggcttctctgctgctcccggagtccgccgccgcaggtctgaagctcatgggagccccggtgaagctgacagtgtctcaggggcagccggtgaagctcaactgcagtgtggaggggatggaggagcctgacatccagtgggtgaaggatggggctgtggtccagaacttggaccagttgtacatcccagtcagcgagcagcactggatcggcttcctcagcctgaagtcagtggagcgctctgacgccggccggtactggtgccaggtggaggatgggggtgaaaccgagatctcccagccagtgtggctcacggtagaaggtgtgccatttttcacagtggagccaaaagatctggcagtgccacccaatgcccctttccaactgtcttgtgaggctgtgggtccccctgaacctgttaccattgtctggtggagaggaactacgaagatcgggggacccgctccctctccatctgttttaaatgtaacaggggtgacccagagcaccatgttttcctgtgaagctcacaacctaaaaggcctggcctcttctcgcacagccactgttcaccttcaagcactgcctgcagcccccttcaacatcaccgtgacaaagctttccagcagcaacgctagtgtggcctggatgccaggtgctgatggccgagctctgctacagtcctgtacagttcaggtgacacaggccccaggaggctgggaagtcctggctgttgtggtccctgtgcccccctttacctgcctgctccgggacctggtgcctgccaccaactacagcctcagggtgcgctgtgccaatgccttggggccctctccctatgctgactgggtgccctttcagaccaagggtctagccccagccagcgctccccaaaacctccatgccatccgcacagattcaggcctcatcttggagtgggaagaagtgatccccgaggcccctttggaaggccccctgggaccctacaaactgtcctgggttcaagacaatggaacccaggatgagctgacagtggaggggaccagggccaatttgacaggctgggatccccaaaaggacctgatcgtacgtgtgtgcgtctccaatgcagttggctgtggaccctggagtcagccactggtggtctcttctcatgaccgtgcaggccagcagggccctcctcacagccgcacatcctgggtacctgtggtccttggtgtgctaacggccctggtgacggctgctgccctggccctcatcctgcttcgaaagagacggaaagagacgcggtttgggcaagcctttgacagtgtcatggcccggggagagccagccgttcacttccgggcagcccggtccttcaatcgagaaaggcccgagcgcatcgaggccacattggacagcttgggcatcagcgatgaactaaaggaaaaactggaggatgtgctcatcccagagcagcagttcaccctgggccggatgttgggcaaaggagagtttggttcagtgcgggaggcccagctgaagcaagaggatggctcctttgtgaaagtggctgtgaagatgctgaaagctgacatcattgcctcaagcgacattgaagagttcctcagggaagcagcttgcatgaaggagtttgaccatccacacgtggccaaacttgttggggtaagcctccggagcagggctaaaggccgtctccccatccccatggtcatcttgcccttcatgaagcatggggacctgcatgccttcctgctcgcctcccggattggggagaacccctttaacctacccctccagaccctgatccggttcatggtggacattgcctgcggcatggagtacctgagctctcggaacttcatccaccgagacctggctgctcggaattgcatgctggcagaggacatgacagtgtgtgtggctgacttcggactctcccggaagatctacagtggggactactatcgtcaaggctgtgcctccaaactgcctgtcaagtggctggccctggagagcctggccgacaacctgtatactgtgcagagtgacgtgtgggcgttcggggtgaccatgtgggagatcatgacacgtgggcagacgccatatgctggcatcgaaaacgctgagatttacaactacctcattggcgggaaccgcctgaaacagcctccggagtgtatggaggacgtgtatgatctcatgtaccagtgctggagtgctgaccccaagcagcgcccgagctttacttgtctgcgaatggaactggagaacatcttgggccagctgtctgtgctatctgccagccaggaccccttatacatcaacatcgagagagctgaggagcccactgcgggaggcagcctggagctacctggcagggatcagccctacagtggggctggggatggcagtggcatgggggcagtgggtggcactcccagtgactgtcggtacatactcacccccggagggctggctgagcagccagggcaggcagagcaccagccagagagtcccctcaatgagacacagaggcttttgctgctgcagcaagggctactgccacacagtagctgttagcccacaggcagagggcatcggggccatttggccggctctggtggccactgagctggctgactaagccccgtctgaccccagcccagacagcaaggtgtggaggctcctgtggtagtcctcccaagctgtgctgggaagcccggactgaccaaatcacccaatcccagttcttcctgcaaccactctgtggccagcctggcatcagtttaggccttggcttgatggaagtgggccagtcctggttgtctgaacccaggcagctggcaggagtggggtggttatgtttccatggttaccatgggtgtggatggcagtgtggggagggcaggtccagctctgtgggccctaccctcctgctgagctgcccctgctgcttaagtgcatgcattgagctgcctccagcctggtggcccagctattaccacacttggggtttaaatatccaggtgtgcccctccaagtcacaaagagatgtccttgtaatattcccttttaggtgagggttggtaaggggttggtatctcaggtctgaatcttcaccatctttctgattccgcaccctgcctacgccaggagaagttgaggggagcatgcttccctgcagctgaccgggtcacacaaaggcatgctggagtacccagcctatcaggtgcccctcttccaaaggcagcgtgccgagccagcaagaggaaggggtgctgtgaggcttgcccaggagcaagtgaggccggagaggagttcaggaacccttctccatacccacaatctgagcacgctaccaaatctcaaaatatcctaagactaacaaaggcagctgtgtctgagcccaacccttctaaacggtgacctttagtgccaacttcccctctaactggacagcctcttctgtcccaagtctccagagagaaatcaggcctgatgagggggaattcctggaacctggaccccagccttggtgggggagcctctggaatgcatggggcgggtcctagctgttagggacatttccaagctgttagttgctgtttaaaatagaaataaaattgaagactaaagacctaa

SEQ ID NO: 33318 - DNA, 3965 bp, Homo sapiens
agtggaaggagcgcggtggcgcgggagcggccccggggaccccgcgctgctgacggcggcgaccgcggccggaggcgggcgcgggtctcggaggcggtcgcctcagcaccgccccacgggcggccccagcccctcccgcagccctcctccctcccgctcccttcccgccgcctcctccccgccctcctccctcctcgctcgcgggccgggcccggcatggtgcggcgtcgccgccgatggcgctgaggcggagcatggggcggccggggctcccgccgctgccgctgccgccgccaccgcggctcgggctgctgctggcggctctggcttctctgctgctcccggagtccgccgccgcaggtctgaagctcatgggagccccggtgaagctgacagtgtctcaggggcagccggtgaagctcaactgcagtgtggaggggatggaggagcctgacatccagtgggtgaaggatggggctgtggtccagaacttggaccagttgtacatcccagtcagcgagcagcactggatcggcttcctcagcctgaagtcagtggagcgctctgacgccggccggtactggtgccaggtggaggatgggggtgaaaccgagatctcccagccagtgtggctcacggtagaaggtgtgccatttttcacagtggagccaaaagatctggcagtgccacccaatgcccctttccaactgtcttgtgaggctgtgggtccccctgaacctgttaccattgtctggtggagaggaactacgaagatcgggggacccgctccctctccatctgttttaaatgtaacaggggtgacccagagcaccatgttttcctgtgaagctcacaacctaaaaggcctggcctcttctcgcacagccactgttcaccttcaagcactgcctgcagcccccttcaacatcaccgtgacaaagctttccagcagcaacgctagtgtggcctggatgccaggtgctgatggccgagctctgctacagtcctgtacagttcaggtgacacaggccccaggaggctgggaagtcctggctgttgtggtccctgtgcccccctttacctgcctgctccgggacctggtgcctgccaccaactacagcctcagggtgcgctgtgccaatgccttggggccctctccctatgctgactgggtgccctttcagaccaagggtctagccccagccagcgctccccaaaacctccatgccatccgcacagattcaggcctcatcttggagtgggaagaagtgatccccgaggcccctttggaaggccccctgggaccctacaaactgtcctgggttcaagacaatggaacccaggatgagctgacagtggaggggaccagggccaatttgacaggctgggatccccaaaaggacctgatcgtacgtgtgtgcgtctccaatgcagttggctgtggaccctggagtcagccactggtggtctcttctcatgaccgtgcaggccagcagggccctcctcacagccgcacatcctgggtacctgtggtccttggtgtgctaacggccctggtgacggctgctgccctggccctcatcctgcttcgaaagagacggaaagagacgcggtttgggcaagcctttgacagtgtcatggcccggggagagccagccgttcacttccgggcagcccggtccttcaatcgagaaaggcccgagcgcatcgaggccacattggacagcttgggcatcagcgatgaactaaaggaaaaactggaggatgtgctcatcccagagcagcagttcaccctgggccggatgttgggcaaaggagagtttggttcagtgcgggaggcccagctgaagcaagaggatggctcctttgtgaaagtggctgtgaagatgctgaaagctgacatcattgcctcaagcgacattgaagagttcctcagggaagcagcttgcatgaaggagtttgaccatccacacgtggccaaacttgttggggtaagcctccggagcagggctaaaggccgtctccccatccccatggtcatcttgcccttcatgaagcatggggacctgcatgccttcctgctcgcctcccggattggggagaacccctttaacctacccctccagaccctgatccggttcatggtggacattgcctgcggcatggagtacctgagctctcggaacttcatccaccgagacctggctgctcggaattgcatgctggcagaggacatgacagtgtgtgtggctgacttcggactctcccggaagatctacagtggggactactatcgtcaaggctgtgcctccaaactgcctgtcaagtggctggccctggagagcctggccgacaacctgtatactgtgcagagtgacgtgtgggcgttcggggtgaccatgtgggagatcatgacacgtgggcagacgccatatgctggcatcgaaaacgctgagatttacaactacctcattggcgggaaccgcctgaaacagcctccggagtgtatggaggacgtgtatgatctcatgtaccagtgctggagtgctgaccccaagcagcgcccgagctttacttgtctgcgaatggaactggagaacatcttgggccagctgtctgtgctatctgccagccaggaccccttatacatcaacatcgagagagctgaggagcccactgcgggaggcagcctggagctacctggcagggatcagccctacagtggggctggggatggcagtggcatgggggcagtgggtggcactcccagtgactgtcggtacatactcacccccggagggctggctgagcagccagggcaggcagagcaccagccagagagtcccctcaatgagacacagaggcttttgctgctgcagcaagggctacacacagtagctgttagcccacaggcagagggcatcggggccatttggccggctctggtggccactgagctggctgactaagccccgtctgaccccagcccagacagcaaggtgtggaggctcctgtggtagtcctcccaagctgtgctgggaagcccggactgaccaaatcacccaatcccagttcttcctgcaaccactctgtggccagcctggcatcagtttaggccttggcttgatggaagtgggccagtcctggttgtctgaacccaggcagctggcaggagtggggtggttatgtttccatggttaccatgggtgtggatggcagtgtggggagggcaggtccagctctgtgggccctaccctcctgctgagctgcccctgctgcttaagtgcatgcattgagctgcctccagcctggtggcccagctattaccacacttggggtttaaatatccaggtgtgcccctccaagtcacaaagagatgtccttgtaatattcccttttaggtgagggttggtaaggggttggtatctcaggtctgaatcttcaccatctttctgattccgcaccctgcctacgccaggagaagttgaggggagcatgcttccctgcagctgaccgggtcacacaaaggcatgctggagtacccagcctatcaggtgcccctcttccaaaggcagcgtgccgagccagcaagaggaaggggtgctgtgaggcttgcccaggagcaagtgaggccggagaggagttcaggaacccttctccatacccacaatctgagcacgctaccaaatctcaaaatatcctaagactaacaaaggcagctgtgtctgagcccaacccttctaaacggtgacctttagtgccaacttcccctctaactggacagcctcttctgtcccaagtctccagagagaaatcaggcctgatgagggggaattcctggaacctggaccccagccttggtgggggagcctctggaatgcatggggcgggtcctagctgttagggacatttccaagctgttagttgctgtttaaaatagaaataaaattgaagactaaagacct

SEQ ID NO: 33319 - DNA, 3049 bp, Homo sapiens
aggaccggagcggaagtggcgatcggagcggaagtggagctaccgccaccgccgccgccgattccggagccggggtagtcgccgccgccgccgccgctgcagccactgcaggcaccgctgccgccgcctgagtagtgggcttaggaaggaagaggtcatctcgctcggagcttcgctcggaagggtctttgttccctgcagccctcccacgggaatgacaatggataaaagtgagctggtacagaaagccaaactcgctgagcaggctgagcgatatgatgatatggctgcagccatgaaggcagtcacagaacaggggcatgaactctccaacgaagagagaaatctgctctctgttgcctacaagaatgtggtaggcgcccgccgctcttcctggcgtgtcatctccagcattgagcagaaaacagagaggaatgagaagaagcagcagatgggcaaagagtaccgtgagaagatagaggcagaactgcaggacatctgcaatgatgttctggagctgttggacaaatatcttattcccaatgctacacaaccagaaagtaaggtgttctacttgaaaatgaaaggagattattttaggtatctttctgaagtggcatctggagacaacaaacaaaccactgtgtcgaactcccagcaggcttaccaggaagcatttgaaattagtaagaaagaaatgcagcctacacacccaattcgtcttggtctggcactaaatttctcagtcttttactatgagattctaaactctcctgaaaaggcctgtagcctggcaaaaacggcatttgatgaagcaattgctgaattggatacgctgaatgaagagtcttataaagacagcactctgatcatgcagttacttagggacaatctcactctgtggacatcggaaaaccagggagacgaaggagacgctggggagggagagaactaatgtttctcgtgctttgtgatctgttcagtgtcactctgtaccctcaacatatatcccttgtgcgataaaaaaaaaaaaaaaaaaaaaaagagaatcgtacgtcgactttcgatttttcacagcctcagcctaggaaaaatggttcatgggataaacagctggtatttgtatctaaaactcagattggtcacataaatgccacggcattccgaagttttgattttgattaacattgacaggattactgtgtgtttaattttttaaaaactgaacactgtgattatggggttttgtaatttagcagaactcttactggtagaaaaaatagacctgaattatgtgtaactttttggaaggtttaatctgatatcaaaataatcattgaaatacaattccattgtaaagttgtacagaaagttatagagattatattgtgatgctggaacttggagtgagacacacatcatttggcatttgagttgaatggtaattcacagtaatgctgccgttgttcgggacttaaagacacttgacctgtttgggctgttgccacttaaaagttcatgaccacaaatgtccacagtgtcttcctctgaggaaactcgaatcctgaaatggaaattctttgtggcagataactggcttatgacaccttgaaaagttcaagtgctcatataacacaccacactgaaccccctttcctacagcaatatgttcactatgttaccaatttgcaacttgtgcttcaatagtggaatctactttcattgttaacactgagctaaagaaaaaaagccgtgtgttttatgaatgaccttatctgtttcctggataatacctttaagaataatgtcctgagtcaggcgtggtggtgcgtgcatctagtcccaactatttgggaggctgaggcaggaggatcgcttgagcccaggagtttaaagctgcagtgccctgtggttgcacctgtgaataactgcactccagcctgggcaacatagcgagacctcatctccaaaaaagaaaacaaaaaacaaaaaaaggaatgatgttctgtagagatggcctttcacttgaggagtactcagttttcaggttcttcctagctcggggcttttaaattttgaaatctaaacattctttcccaccatcctttttgactgttgaccttggttttctcttctaagtttctgtccctctgcttccttactttttttcctttttgaattctatctttatctgtcttttgttcactttttaatgctatatatgggcaggggtgagagacattactgagcaccttggtgagcaagcctggctttaaagattggagaagagcttctggcaccagaaccctgtcttcctccagttctcaacacggtgttgctcttcagtcataccggaatctgaatcaaaaaagtatttttaaatatccatgatttctccctgtattgaggctagccctgatcatgctttttgtgcctgtcaccaggtctcccaagtgcactcatccaggtcagtgctcagatgtgtttaaggagaccctatattcagggaagttgcgtgaacactgcagtggggagaattgagaatagtcaggcctatcagtctcacagaatcacccctctacctttgatattccacttagctgtagagtccatctgtttgtccatctgctgaaatgagaaaagaaaaatttatgcactgatttaaaacaaaccaaaaaaaaagaaaaaaacaaaaaaaaaaatccctcctttctagctgaacaaaaatgtgcagttaatacttggcgcttgaaaatgcagtagtgaatgtggaaccaagcctgtctgtatatctggtagctcttttcttgctttgttttttcttaccagtattctgcctaacgtttgcttctgtgatggttatattgcctagcaagcacacccgtggttgtgaaaatagtatagcaaaaaagaaaaatccccggttattgatgtactagatttgtgtatgtcttttaaacagttctagtttcaccttacacagaataatcaggaaaagtgtaaaaattcaaaagtgaaataaaaattttatcagttagttgcctgtgaa

SEQ ID NO: 33320 - DNA, 3109 bp, Homo sapiens
ggagctaccgccaccgccgccgccgattccggagccggggtagtcgccgccgccgccgccgctgcagccactgcaggcaccgctgccgccgcctgagtagtgggcttaggaaggaagaggtcatctcgctcggagcttcgctcggaagggtctttgttccctgcagccctcccacggcagagtctccagagatttgggccgctacaaaaagtgcattttgcccattcggctgtggatagagaagcaggaagagcactggacttggagtcagggaatgacaatggataaaagtgagctggtacagaaagccaaactcgctgagcaggctgagcgatatgatgatatggctgcagccatgaaggcagtcacagaacaggggcatgaactctccaacgaagagagaaatctgctctctgttgcctacaagaatgtggtaggcgcccgccgctcttcctggcgtgtcatctccagcattgagcagaaaacagagaggaatgagaagaagcagcagatgggcaaagagtaccgtgagaagatagaggcagaactgcaggacatctgcaatgatgttctggagctgttggacaaatatcttattcccaatgctacacaaccagaaagtaaggtgttctacttgaaaatgaaaggagattattttaggtatctttctgaagtggcatctggagacaacaaacaaaccactgtgtcgaactcccagcaggcttaccaggaagcatttgaaattagtaagaaagaaatgcagcctacacacccaattcgtcttggtctggcactaaatttctcagtcttttactatgagattctaaactctcctgaaaaggcctgtagcctggcaaaaacggcatttgatgaagcaattgctgaattggatacgctgaatgaagagtcttataaagacagcactctgatcatgcagttacttagggacaatctcactctgtggacatcggaaaaccagggagacgaaggagacgctggggagggagagaactaatgtttctcgtgctttgtgatctgttcagtgtcactctgtaccctcaacatatatcccttgtgcgataaaaaaaaaaaaaaaaaaaaaaagagaatcgtacgtcgactttcgatttttcacagcctcagcctaggaaaaatggttcatgggataaacagctggtatttgtatctaaaactcagattggtcacataaatgccacggcattccgaagttttgattttgattaacattgacaggattactgtgtgtttaattttttaaaaactgaacactgtgattatggggttttgtaatttagcagaactcttactggtagaaaaaatagacctgaattatgtgtaactttttggaaggtttaatctgatatcaaaataatcattgaaatacaattccattgtaaagttgtacagaaagttatagagattatattgtgatgctggaacttggagtgagacacacatcatttggcatttgagttgaatggtaattcacagtaatgctgccgttgttcgggacttaaagacacttgacctgtttgggctgttgccacttaaaagttcatgaccacaaatgtccacagtgtcttcctctgaggaaactcgaatcctgaaatggaaattctttgtggcagataactggcttatgacaccttgaaaagttcaagtgctcatataacacaccacactgaaccccctttcctacagcaatatgttcactatgttaccaatttgcaacttgtgcttcaatagtggaatctactttcattgttaacactgagctaaagaaaaaaagccgtgtgttttatgaatgaccttatctgtttcctggataatacctttaagaataatgtcctgagtcaggcgtggtggtgcgtgcatctagtcccaactatttgggaggctgaggcaggaggatcgcttgagcccaggagtttaaagctgcagtgccctgtggttgcacctgtgaataactgcactccagcctgggcaacatagcgagacctcatctccaaaaaagaaaacaaaaaacaaaaaaaggaatgatgttctgtagagatggcctttcacttgaggagtactcagttttcaggttcttcctagctcggggcttttaaattttgaaatctaaacattctttcccaccatcctttttgactgttgaccttggttttctcttctaagtttctgtccctctgcttccttactttttttcctttttgaattctatctttatctgtcttttgttcactttttaatgctatatatgggcaggggtgagagacattactgagcaccttggtgagcaagcctggctttaaagattggagaagagcttctggcaccagaaccctgtcttcctccagttctcaacacggtgttgctcttcagtcataccggaatctgaatcaaaaaagtatttttaaatatccatgatttctccctgtattgaggctagccctgatcatgctttttgtgcctgtcaccaggtctcccaagtgcactcatccaggtcagtgctcagatgtgtttaaggagaccctatattcagggaagttgcgtgaacactgcagtggggagaattgagaatagtcaggcctatcagtctcacagaatcacccctctacctttgatattccacttagctgtagagtccatctgtttgtccatctgctgaaatgagaaaagaaaaatttatgcactgatttaaaacaaaccaaaaaaaaagaaaaaaacaaaaaaaaaaatccctcctttctagctgaacaaaaatgtgcagttaatacttggcgcttgaaaatgcagtagtgaatgtggaaccaagcctgtctgtatatctggtagctcttttcttgctttgttttttcttaccagtattctgcctaacgtttgcttctgtgatggttatattgcctagcaagcacacccgtggttgtgaaaatagtatagcaaaaaagaaaaatccccggttattgatgtactagatttgtgtatgtcttttaaacagttctagtttcaccttacacagaataatcaggaaaagtgtaaaaattcaaaagtgaaataaaaattttatcagttagttgcctgtgaa

SEQ ID NO: 33321 - DNA, 648 bp, Homo sapiens
cggagccggggtagtcgccgccgccgccgccgctgcagccactgcaggcaccgctgccgccgcctgagtagtgggcttaggaaggaagaggtcatctcgctcggagcttcgctcggaagggtctttgttccctgcagccctcccacgtgcttgttatattgaagccattttagaattggagcgctatagatcagggaggcagcctctataaaaccaggctgagcaaattcccatgatgctggttctctaggcagagtctccagagatttgggccgctacaaaaagtgcattttgcccattcggctgtggatagagaagcaggaagagcactggacttggagtcagggaatgacaatggataaaagtgagctggtacagaaagccaaactcgctgagcaggctgagcgatatgatgatatggctgcagccatgaaggcagtcacagaacaggggcatgaactctccaacgaagagagaaatctgctctctgttgcctacaagaatgtggtaggcgcccgccgctcttcctggcgtgtcatctccagcattgagcagaaaacagagaggaatgagaagaagcagcagatgggcaaagagtaccgtgagaagatagaggcagaactgcaggacatctgcaatgatgttctg

SEQ ID NO: 33322 - DNA, 556 bp, Homo sapiens
agtcgccgccgccgccgccgctgcagccactgcaggcaccgctgccgccgcctgagtagtgggcttaggaaggaagaggtcatctcgctcggagcttcgctcggaagggtctttgttccctgcagccctcccacgatagcatcaggtcctgattttgcttgccctgtgtgggagatggaatttggcaagatgatgctatgaacataaaatcagcctcgggaaccaaaagagaaaggcagagtctccagagatttgggccgctacaaaaagtgcattttgcccattcggctgtggatagagaagcaggaagagcactggacttggagtcagggaatgacaatggataaaagtgagctggtacagaaagccaaactcgctgagcaggctgagcgatatgatgatatggctgcagccatgaaggcagtcacagaacaggggcatgaactctccaacgaagagagaaatctgctctctgttgcctacaagaatgtggtaggcgcccgccgctcttcctggcgtgtcatctccagcattgagcagaaaacagagaggaatg

SEQ ID NO: 33323 - DNA, 2044 bp, Homo sapiens
ccgccatttttgctgcccggacgcggagcgagaggctgagagagtcggagacactatccgcttccatccgtcgcgcagaccctgccggagccgctgccgctatggatgatcgagaggatctggtgtaccaggcgaagctggccgagcaggctgagcgatacgacgaaatggtggagtcaatgaagaaagtagcagggatggatgtggagctgacagttgaagaaagaaacctcctatctgttgcatataagaatgtgattggagctagaagagcctcctggagaataatcagcagcattgaacagaaagaagaaaacaagggaggagaagacaagctaaaaatgattcgggaatatcggcaaatggttgagactgagctaaagttaatctgttgtgacattctggatgtactggacaaacacctcattccagcagctaacactggcgagtccaaggttttctattataaaatgaaaggggactaccacaggtatctggcagaatttgccacaggaaacgacaggaaggaggctgcggagaacagcctagtggcttataaagctgctagtgatattgcaatgacagaacttccaccaacgcatcctattcgcttaggtcttgctctcaatttttccgtattctactacgaaattcttaattcccctgaccgtgcctgcaggttggcaaaagcagcttttgatgatgcaattgcagaactggatacgctgagtgaagaaagctataaggactctacacttatcatgcagttgttacgtgataatctgacactatggacttcagacatgcagggtgacggtgaagagcagaataaagaagcgctgcaggacgtggaagacgaaaatcagtgagacataagccaacaagagaaaccatctctgaccaccccctcctccccatcccaccctttggaaactccccattgtcactgagaaccaccaaatctgacttttacatttggtctcagaatttaggttcctgccctgttggttttttttttttttttttaaacagttttcaaaagttcttaaaggcaagagtgaatttctgtggattttactggtcccagcttttaggttctttaagacactaacaggactacatagaggctttttcagcattactgtgtcgtctccgtgccagatgtggcaagatcaccattagcaaatggaaattacatttgaaagccattagacttataggtgatgcaagcatctaagagagaggttaatcacactatagaggcataagtggtatcagttttcatttttctaattgtttaaactgtgttttataccagtgtttgcaagtaattgggtgttagcttgagatggttaaaggtggtttggggagggacttcgttgtaatggttttgctgtaaaaaatgtttccaactccgctgaaatgttgctgaaaagcatggtgctggtaacagttcaacaatccgtggctgctcattcttgcctactttactctcccactgaagcaggttagcgttgaaggtggtatggaaaagcctgcatgcctgttcaattcttttgtttcttctccttccccctccccctacctccttcccctcactcctcccctccttcgctcgctcaacctcttttgttcagtatgtgtaacttgaagctaatttgtactactggatatctgactggagccacagatacagaatctgtattgttcttactgaaacacagcatggaattaacattaaacttaaataaaacaaacctaaattaaaaatgccaaatatcgcgcctccatcctttatacttctaaaataaaatctctagtccaaacacactgacagtattatgtttgcctgaatgtgaaacattcctccttttttcttccataaataatttgtttgcttcccaaagatgtatgttttggaaaaaaattgcctgtagtctggttgtgaagaacactgagtcagttgatggtgtgtcttgtcctccagaccaggcagcaacatggtatttattttaatcattaaagtacaacatgagtagtacaa

SEQ ID NO: 33324 - DNA, 1295 bp, Homo sapiens
gctgcccggacgcggagcgagaggctgagagagtcggagacactatccgcttccatccgtcgcgcaggctgagcgatacgacgaaatggtggagtcaatgaagaaagtagcagggatggatgtggagctgacagttgaagaaagaaacctcctatctgttgcatataagaatgtgattggagctagaagagcctcctggagaataatcagcagcattgaacagaaagaagaaaacaagggaggagaagacaagctaaaaatgattcgggaatatcggcaaatggttgagactgagctaaagttaatctgttgtgacattctggatgtactggacaaacacctcattccagcagctaacactggcgagtccaaggttttctattataaaatgaaaggggactaccacaggtatctggcagaatttgccacaggaaacgacaggaaggaggctgcggagaacagcctagtggcttataaagctgctagtgatattgcaatgacagaacttccaccaacgcatcctattcgcttaggtcttgctctcaatttttccgtattctactacgaaattcttaattcccctgaccgtgcctgcaggttggcaaaagcagcttttgatgatgcaattgcagaactggatacgctgagtgaagaaagctataaggactctacacttatcatgcagttgttacgtgataatctgacactatggacttcagacatgcagggtgacggtgaagagcagaataaagaagcgctgcaggacgtggaagacgaaaatcagtgagacataagccaacaagagaaaccatctctgaccaccccctcctccccatcccaccctttggaaactccccattgtcactgagaaccaccaaatctgacttttacatttggtctcagaatttaggttcctgccctgttggttttttttttttttttttaaacagttttcaaaagttcttaaaggcaagagtgaatttctgtggattttactggtcccagcttttaggttctttaagacactaacaggactacatagaggctttttcagcattactgtgtcgtctccgtgccagatgtggcaagatcaccattagcaaatggaaattacatttgaaagccattagacttataggtgatgcaagcatctaagagagaggttaatcacactatagaggcataagtggtatcagttttcatttttctaattgtttaaactgtgttttataccagtgtttgcaagtaattgggtgttagcttgagatggttaaaggtggtttggggagggactt

SEQ ID NO: 33325 - DNA, 3745 bp, Homo sapiens
ggccgcagggggttgtccgtcagtggcacgcacagcagccgcagccgcctcgcgcccggtcccgcggtcgcagctccagccgcctcctccgcgcagccgccgcctcagctgctcgctctgtgggtcggtcctctccggcacttgggctccagtcgcgccctccaagcccttcaggccgccccagtgtcctcctccttctccggccagacccagccccgcgaagatggtggaccgcgagcaactggtgcagaaagcccggctggccgagcaggcggagcgctacgacgacatggccgcggccatgaagaacgtgacagagctgaatgagccactgtcgaatgaggaacgaaaccttctgtctgtggcctacaagaacgttgtgggggcacgccgctcttcctggagggtcatcagtagcattgagcagaagacatctgcagacggcaatgagaagaagattgagatggtccgtgcgtaccgggagaagatagagaaggagttggaggctgtgtgccaggatgtgctgagcctgctggataactacctgatcaagaattgcagcgagacccagtacgagagcaaagtgttctacctgaagatgaaaggggactactaccgctacctggctgaagtggccaccggagagaaaagggcgacggtggtggagtcctccgagaaggcctacagcgaagcccacgagatcagcaaagagcacatgcagcccacccaccccatccgattaggcctggctcttaactactccgtcttctactatgagatccagaacgccccagagcaagcgtgccacttggccaagaccgcgttcgacgacgccatcgccgagcttgacaccctcaacgaggactcctacaaggactccacgctcatcatgcagctcctccgcgacaacctcacgctctggacgagcgaccagcaggacgacgatggcggcgaaggcaacaattaaggccccaggggaactggcagcgcacgcggatgctactactgcagtctttatttttttcccatgagttgggggtcgggtgggggagggaaagggagggatgaccttcccagggagaaacccacgacctgtcctgtctttgatcgcctctttgacatttttgccaaaataccactagtggaaagtcaggctagctgtgctggtattggaatagcagcctcacactggcgtctggactgttctgtagattcatgcaagtggagctgtctgtctctaatttaacttattgctagataatagggttttcagatgaaaagaaaacttaaagaggaatggccctcattcagtaagttctgtggttccagtaaggatttttatgtacatacgctctcgtctctcgttttgggtactttctatctcatctgtctcggctctgcatgttttccagggtgtagcctacagacatggaacagtgtaaatcccagactgacagacttagaacctgaggtctcattcatccttatggtttaggccttgccagttttccgaagtctctgattagttgacagtattaacactaaattgcagtttacagtatttctacattacagccatatgtaacatcaagccatcgattgtgtacttttcctttgctagttgtttgggctttaacatccttattcagccttatccaggttggttttgctgttgatcggtctcctaggctaaatgagaatgaaagcgacttcaggtcaggtggctgtgggattttttttttttggtccttctttcctcttaacgtaaatccaccaccaaaattattaatcctcttgagagaaacgtgaaacgccacaaaaatagagaaaattcaggtctgtatgtcatggatcgtgttggtattttcagagaacatcccgcttctgaagctgctgcagctccctcctcagggatcacactgccgtcacccactctgcactggggcgtttcctactgcgcctcgtgctggcggacgcagctgggtgcagaagctgtggggtcggagaggcgtttggagaaggtctgtggtgcagtgtgtgaaaattcaggtgctagaagcctactggtagaaaaacccaaaaggaagagctatatccttaaccattctgtccaatttcgggagccttgtcagtgtgtcagtttttcctccccgaagacactccttccccaagtaattgtaggaagataaaaaaactgttaccagataacaaacactgaactcctatttgaccagaactttttcctctcgagatagttttttctttttaatgaaaaaagcataggaattggagattggcttgtctcacgcagccagtgcacatttggaattgacggaaacaacgttgctatttccacccatttgttttcggcagccttaaggccctcattctcatttcgggtgaatctgtctatctgtgaacgtggcccgcatgtgcattcttttttttatatatataaagtcagtgacgaggaactcccgagacgtgtaatgacaccacacttgttttctttgtttctttgttttatttaggcaagaagaggtgtgagtaattgaggaaaaactgacagatgcttttgctaataccaaaattgagcttacaattaggaactgagtatgtgtaacaggatacaggtgacagtgaagatagaagaaccacgatgaccacagactcaatgtgctctgtaacatcgcacagtttacccagcatgactttccttaggaggccccctcctcacgctagagtaaaagtcccagttaagtgaagcctaccagaagaactagtagaagaagctttgccgcttttgtgcctctcacaggcgcctaaagtcattgccatgggaggaagacgatttggggggggaggggggggggggcagggtaggtggggctttccctaatttatcttcatgtccagtgagcagtgttgcgtttttccttgtagcatttggaaatgatttactggaattacaaaacctatttttcctttaaatttcagctttggctctggctgctttttagaataatgcaagataaaaatcacacctgagggctgaaaacggagagggaatgggagacttgatatttaagcagcttgaatggtttttcttttctttatttttaaagaaatgcacttgcctatgatactgtctctccagtgaaatgattactcctccattactctattgatacaatattgtgcatgctagtgttgtatttctatacagtagcttgaaattgattaacttatactgtaggtgttatgtattcctatgacaaaaaaaattaagtcttcaaattttttaaaggttttttttttttaatttaatttttccttttgggggtaaagtttgctctaccaaatagtgattgtaacaaattgatctgttttggatgttgctatagtgacatgcagttatatattttgtttttaaaagggggggagcaaaagaaacaccagtgttagcttaatcttaatgtctggtgtttgtcatggtgaaattataactattacagtgttggagaacaacaaatatgttctctgaatgagcctttgtgctttttgtcatgttatgcagtgaactatttttaaggtctaatcagtgattatttttccagctccgtgtttctctaaggaattatttcacacacggaccatctttagcagtttcctcagtgatggaatatcatgaatgtgagtcattatgtagctgtcgtacattgagcaaataaacttacagatctga

SEQ ID NO: 33326 - DNA, 884 bp, Homo sapiens
agccgcctcgcgcccggtcccgcggtcgcagctccagccgcctcctccgcgcagccgccgcctcagctgctcgctctgtgggtcggtcctctccggcacttgggctccagtcgcgccctccaagcccttcaggccgccccagtgtcctcctccttctccggccagacccagccccgcgaagatggtggaccgcgagcaactggtgcagaaagcccggctggccgagcaggcggagcgctacgacgacatggccgcggccatgaagaacgtgacagagctgaatgagccactgtcgaatgaggaacgaaaccttctgtctgtggcctacaagaacgttgtgggggcacgccgctcttcctggagggtcatcagtagcattgagcagaagacatctgcagacggcaatgagaagaagattgagatggtccgtgcgtaccgggagaagatagagaaggagttggaggctgaagtggccaccggagagaaaagggcgacggtggtggagtcctccgagaaggcctacagcgaagcccacgagatcagcaaagagcacatgcagcccacccaccccatccgattaggcctggctcttaactactccgtcttctactatgagatccagaacgccccagagcaagcgtgccacttggccaagaccgcgttcgacgacgccatcgccgagcttgacaccctcaacgaggactcctacaaggactccacgctcatcatgcagctcctccgcgacaacctcacgctctggacgagcgaccagcaggacgacgatggcggcgaaggcaacaattaaggccccaggggaactggcagcgcacgcggatgctactactgcagtctttatttttttcccatgagttgggggtcgggtg

SEQ ID NO: 33327 - DNA, 1362 bp, Homo sapiens
agctccagccgcctcctccgcgcagccgccgcctcagctgctcgctctgtgggtcggtcctctccggcacttgggctccagtcgcgccctccaagcccttcaggccgccccagtgtcctcctccttctccggctggccgagcaggcggagcgctacgacgacatggccgcggccatgaagaacgtgacagagctgaatgagccactgtcgaatgaggaacgaaaccttctgtctgtggcctacaagaacgttgtgggggcacgccgctcttcctggagggtcatcagtagcattgagcagaagacatctgcagacggcaatgagaagaagattgagatggtccgtgcgtaccgggagaagatagagaaggagttggaggctgtgtgccaggatgtgctgagcctgctggataactacctgatcaagaattgcagcgagacccagtacgagagcaaagtgttctacctgaagatgaaaggggactactaccgctacctggctgaagtggccaccggagagaaaagggcgacggtggtggagtcctccgagaaggcctacagcgaagcccacgagatcagcaaagagcacatgcagcccacccaccccatccgattaggcctggctcttaactactccgtcttctactatgagatccagaacgccccagagcaagcgtgccacttggccaagaccgcgttcgacgacgccatcgccgagcttgacaccctcaacgaggactcctacaaggactccacgctcatcatgcagctcctccgcgacaacctcacgctctggacgagcgaccagcaggacgacgatggcggcgaaggcaacaattaaggccccaggggaactggcagcgcacgcggatgctactactgcagtctttatttttttcccatgagttgggggtcgggtgggggagggaaagggagggatgaccttcccagggagaaacccacgacctgtcctgtctttgatcgcctctttgacatttttgccaaaataccactagtggaaagtcaggctagctgtgctggtattggaatagcagcctcacactggcgtctggactgttctgtagattcatgcaagtggagctgtctgtctctaatttaacttattgctagataatagggttttcagatgaaaagaaaacttaaagaggaatggccctcattcagtaagttctgtggttccagtaaggatttttatgtacatacgctctcgtctctcgttttgggtactttctatctcatctgtctcggctctgcatgttttccagggtgtagcctacagacatggaacagtgtaaatcccagactgacagacttagaacctgaggtctcattcatccttatg

SEQ ID NO: 33328 - DNA, 2829 bp, Homo sapiens
gcccactcccaccgccagctggaaccctggggactacgacgtccctcaaaccttgcttctaggagataaaaagaacatccagtcatggataaaaatgagctggttcagaaggccaaactggccgagcaggctgagcgatatgatgacatggcagcctgcatgaagtctgtaactgagcaaggagctgaattatccaatgaggagaggaatcttctctcagttgcttataaaaatgttgtaggagcccgtaggtcatcttggagggtcgtctcaagtattgaacaaaagacggaaggtgctgagaaaaaacagcagatggctcgagaatacagagagaaaattgagacggagctaagagatatctgcaatgatgtactgtctcttttggaaaagttcttgatccccaatgcttcacaagcagagagcaaagtcttctatttgaaaatgaaaggagattactaccgttacttggctgaggttgccgctggtgatgacaagaaagggattgtcgatcagtcacaacaagcataccaagaagcttttgaaatcagcaaaaaggaaatgcaaccaacacatcctatcagactgggtctggcccttaacttctctgtgttctattatgagattctgaactccccagagaaagcctgctctcttgcaaagacagcttttgatgaagccattgctgaacttgatacattaagtgaagagtcatacaaagacagcacgctaataatgcaattactgagagacaacttgacattgtggacatcggatacccaaggagacgaagctgaagcaggagaaggaggggaaaattaaccggccttccaacttttgtctgcctcattctaaaatttacacagtagaccatttgtcatccatgctgtcccacaaatagttttttgtttacgatttatgacaggtttatgttacttctatttgaatttctatatttcccatgtggtttttatgtttaatattaggggagtagagccagttaacatttagggagttatctgttttcatcttgaggtggccaatatggggatgtggaatttttatacaagttataagtgtttggcatagtacttttggtacattgtggcttcaaaagggccagtgtaaaactgcttccatgtctaagcaaagaaaactgcctacatactggtttgtcctggcggggaataaaagggatcattggttccagtcacaggtgtagtaattgtgggtactttaaggtttggagcacttacaaggctgtggtagaatcataccccatggataccacatattaaaccatgtatatctgtggaatactcaatgtgtacacctttgactacagctgcagaagtgttcctttagacaaagttgtgacccattttactctggataagggcagaaacggttcacattccattatttgtaaagttacctgctgttagctttcattatttttgctacactcattttatttgtatttaaatgttttaggcaacctaagaacaaatgtaaaagtaaagatgcaggaaaaatgaattgcttggtattcattacttcatgtatatcaagcacagcagtaaaacaaaaacccatgtatttaacttttttttaggatttttgcttttgtgatttttttttttttgatacttgcctaacatgcatgtgctgtaaaaatagttaacagggaaataacttgagatgatggctagctttgtttaatgtcttatgaaattttcatgaacaatccaagcataattgttaagaacacgtgtattaaattcatgtaagtggaataaaagttttatgaatggacttttcaactactttctctacagcttttcatgtaaattagtcttggttctgaaacttctctaaaggaaattgtacattttttgaaatttattccttattccctcttggcagctaatgggctcttaccaagtttaaacacaaaatttatcataacaaaaatactactaatataactactgtttccatgtcccatgatcccctctcttcctccccaccctgaaaaaaatgagttcctattttttctgggagagggggggattgattagaaaaaaatgtagtgtgttccatttaaaattttggcatatggcattttctaacttaggaagccacaatgttcttggcccatcatgacattgggtagcattaactgtaagttttgtgcttccaaatcactttttggtttttaagaatttcttgatactcttatagcctgccttcaattttgatcctttattctttctatttgtcaggtgcacaagattaccttcctgttttagccttctgtcttgtcaccaaccattcttacttggtggccatgtacttggaaaaaggccgcatgatctttctggctccactcagtgtctaaggcaccctgcttcctttgcttgcatcccacagactatttccctcatcctatttactgcagcaaatctctccttagttgatgagactgtgtttatctccctttaaaaccctacctatcctgaatggtctgtcattgtctgcctttaaaatccttcctctttcttcctcctctattctctaaataatgatggggctaagttatacccaaagctcactttacaaaatatttcctcagtactttgcagaaaacaccaaacaaaaatgccattttaaaaaaggtgtattttttcttttagaatgtaagctcctcaagagcagggacaatgttttctgtatgttctattgtgcctagtacactgtaaatgctcaataaatattgatgatgggaggcagtgagtcttgatgataagggtgagaaactgaaatccc

SEQ ID NO: 33329 - DNA, 812 bp, Homo sapiens
cccctcgcgcagtcaccgagcgcagatcccgcgctctcgattggaacgcctccccatcactcagccacactcaggggctggacgcctcactcccgtttccgagccataaaaggtctaggaccgcttcccccgagccagcaggagcccgtaggtcatcttggagggtcgtctcaagtattgaacaaaagacggaaggtgctgagaaaaaacagcagatggctcgagaatacagagagaaaattgagacggagctaagagatatctgcaatgatgtactgtctcttttggaaaagttcttgatccccaatgcttcacaagcagagagcaaagtcttctatttgaaaatgaaaggagattactaccgttacttggctgaggttgccgctggtgatgacaagaaagggattgtcgatcagtcacaacaagcataccaagaagcttttgaaatcagcaaaaaggaaatgcaaccaacacatcctatcagactgggtctggcccttaacttctctgtgttctattatgagattctgaactccccagagaaagcctgctctcttgcaaagacagcttttgatgaagccattgctgaacttgatacattaagtgaagagtcatacaaagacagcacgctaataatgcaattactgagagacaacttgacattgtggacatcggatacccaaggagacgaagctgaagcaggagaaggaggggaaaattaaccggccttccaacttttgtctgcctcattctaaaatttacacagtagaccatttgtcatccatgctgtcccacaaatagttttttgttta

SEQ ID NO: 33330 - DNA, 964 bp, Homo sapiens
atgacaaaggaggagagtcggggacttgagccgtggctccgacttgggcggagcctggaggggggtggttgcgatacgcggaccggagaatttgcactttaaagtccgggtctgcccgttttcgtttcacagtaaccgacgtctcaagtcagaacatccagtcatggataaaaatgagctggttcagaaggccaaactggccgagcaggctgagcgatatgatgacatggcagcctgcatgaagtctgtaactgagcaaggagctgaattatccaatgaggagaggaatcttctctcagttgcttataaaaatgttgtaggagcccgtaggtcatcttggagggtcgtctcaagtattgaacaaaagacggaaggtgctgagaaaaaacagcagatggctcgagaatacagagagaaaattgagacggagctaagagatatctgcaatgatgtactgtctcttttggaaaagttcttgatccccaatgcttcacaagcagagagcaaagtcttctatttgaaaatgaaaggagattactaccgttacttggctgaggttgccgctggtgatgacaagaaagggattgtcgatcagtcacaacaagcataccaagaagcttttgaaatcagcaaaaaggaaatgcaaccaacacatcctatcagactgggtctggcccttaacttctctgtgttctattatgagattctgaactccccagagaaagcctgctctcttgcaaagacagcttttgatgaagccattgctgaacttgatacattaagtgaagagtcatacaaagacagcacgctaataatgcaattactgagagacaacttgacattgtggacatcggatacccaaggagacgaagctgaagcaggagaaggaggggaaaattaaccggccttccaacttttgtctgcctcattctaaaatttacacagtagaccatttgtcatccat

SEQ ID NO: 33331 - DNA, 994 bp, Homo sapiens
gcatggccggggcgccgccggccgcgatccatccccacccttgtctctgcgggcttccaccccctccctcgccgcccttctcgcttccgcccgagataatgactcggcggcggcggcggcgggcatcgcagtggcgcagaacatccagtcatggataaaaatgagctggttcagaaggccaaactggccgagcaggctgagcgatatgatgacatggcagcctgcatgaagtctgtaactgagcaaggagctgaattatccaatgaggagaggaatcttctctcagttgcttataaaaatgttgtaggagcccgtaggtcatcttggagggtcgtctcaagtattgaacaaaagacggaaggtgctgagaaaaaacagcagatggctcgagaatacagagagaaaattgagacggagctaagagatatctgcaatgatgtactgtctcttttggaaaagttcttgatccccaatgcttcacaagcagagagcaaagtcttctatttgaaaatgaaaggagattactaccgttacttggctgaggttgccgctggtgatgacaagaaagggattgtcgatcagtcacaacaagcataccaagaagcttttgaaatcagcaaaaaggaaatgcaaccaacacatcctatcagactgggtctggcccttaacttctctgtgttctattatgagattctgaactccccagagaaagcctgctctcttgcaaagacagcttttgatgaagccattgctgaacttgatacattaagtgaagagtcatacaaagacagcacgctaataatgcaattactgagagacaacttgacattgtggacatcggatacccaaggagacgaagctgaagcaggagaaggaggggaaaattaaccggccttccaacttttgtctgcctcattctaaaatttacacagtagaccatttgtcatccatgctgtcccacaaatagttttttgtttacgatttatgacaggtt

SEQ ID NO: 33332 - DNA, 2974 bp, Homo sapiens
ccgccccctcccctctccctcggccgccccctcctttccctccccctcgcgcagcctccgcgctgggcgctgcggcggcgggacccggccctcccccaccccgggaggcggtggcgcggcggggaggggccgggggcctcggggacccaagcgcgagggaaaggcctggccgagagcgggccggagcccaggcctggcgcggcggcgcccgccagaacatccagtcatggataaaaatgagctggttcagaaggccaaactggccgagcaggctgagcgatatgatgacatggcagcctgcatgaagtctgtaactgagcaaggagctgaattatccaatgaggagaggaatcttctctcagttgcttataaaaatgttgtaggagcccgtaggtcatcttggagggtcgtctcaagtattgaacaaaagacggaaggtgctgagaaaaaacagcagatggctcgagaatacagagagaaaattgagacggagctaagagatatctgcaatgatgtactgtctcttttggaaaagttcttgatccccaatgcttcacaagcagagagcaaagtcttctatttgaaaatgaaaggagattactaccgttacttggctgaggttgccgctggtgatgacaagaaagggattgtcgatcagtcacaacaagcataccaagaagcttttgaaatcagcaaaaaggaaatgcaaccaacacatcctatcagactgggtctggcccttaacttctctgtgttctattatgagattctgaactccccagagaaagcctgctctcttgcaaagacagcttttgatgaagccattgctgaacttgatacattaagtgaagagtcatacaaagacagcacgctaataatgcaattactgagagacaacttgacattgtggacatcggatacccaaggagacgaagctgaagcaggagaaggaggggaaaattaaccggccttccaacttttgtctgcctcattctaaaatttacacagtagaccatttgtcatccatgctgtcccacaaatagttttttgtttacgatttatgacaggtttatgttacttctatttgaatttctatatttcccatgtggtttttatgtttaatattaggggagtagagccagttaacatttagggagttatctgttttcatcttgaggtggccaatatggggatgtggaatttttatacaagttataagtgtttggcatagtacttttggtacattgtggcttcaaaagggccagtgtaaaactgcttccatgtctaagcaaagaaaactgcctacatactggtttgtcctggcggggaataaaagggatcattggttccagtcacaggtgtagtaattgtgggtactttaaggtttggagcacttacaaggctgtggtagaatcataccccatggataccacatattaaaccatgtatatctgtggaatactcaatgtgtacacctttgactacagctgcagaagtgttcctttagacaaagttgtgacccattttactctggataagggcagaaacggttcacattccattatttgtaaagttacctgctgttagctttcattatttttgctacactcattttatttgtatttaaatgttttaggcaacctaagaacaaatgtaaaagtaaagatgcaggaaaaatgaattgcttggtattcattacttcatgtatatcaagcacagcagtaaaacaaaaacccatgtatttaacttttttttaggatttttgcttttgtgatttttttttttttgatacttgcctaacatgcatgtgctgtaaaaatagttaacagggaaataacttgagatgatggctagctttgtttaatgtcttatgaaattttcatgaacaatccaagcataattgttaagaacacgtgtattaaattcatgtaagtggaataaaagttttatgaatggacttttcaactactttctctacagcttttcatgtaaattagtcttggttctgaaacttctctaaaggaaattgtacattttttgaaatttattccttattccctcttggcagctaatgggctcttaccaagtttaaacacaaaatttatcataacaaaaatactactaatataactactgtttccatgtcccatgatcccctctcttcctccccaccctgaaaaaaatgagttcctattttttctgggagagggggggattgattagaaaaaaatgtagtgtgttccatttaaaattttggcatatggcattttctaacttaggaagccacaatgttcttggcccatcatgacattgggtagcattaactgtaagttttgtgcttccaaatcactttttggtttttaagaatttcttgatactcttatagcctgccttcaattttgatcctttattctttctatttgtcaggtgcacaagattaccttcctgttttagccttctgtcttgtcaccaaccattcttacttggtggccatgtacttggaaaaaggccgcatgatctttctggctccactcagtgtctaaggcaccctgcttcctttgcttgcatcccacagactatttccctcatcctatttactgcagcaaatctctccttagttgatgagactgtgtttatctccctttaaaaccctacctatcctgaatggtctgtcattgtctgcctttaaaatccttcctctttcttcctcctctattctctaaataatgatggggctaagttatacccaaagctcactttacaaaatatttcctcagtactttgcagaaaacaccaaacaaaaatgccattttaaaaaaggtgtattttttcttttagaatgtaagctcctcaagagcagggacaatgttttctgtatgttctattgtgcctagtacactgtaaatgctcaataaatattgatgatgggaggcagtgagtcttgatgataagggtgagaaactgaaatcccaaa

SEQ ID NO: 33333 - DNA, 3197 bp, Homo sapiens
cgcagtcaccgagcgcagatcccgcgctctcgattggaacgcctccccatcactcagccacactcaggggctggacgcctcactcccgtttccgagccataaaaggtctaggaccgcttcccccgagccagcagcgtttgacgtcatcgtgcgtgtggtgcccctgctgccggggctggtgattggaggaaaccccgtgtctgcggagcggctgtagcctgtgagcagcgagatccagggacagagtctcagcctcgccgctgctgccgccgccgccgcccagagactgctgagcccgtccgtccgccgccaccacccactccggacacagaacatccagtcatggataaaaatgagctggttcagaaggccaaactggccgagcaggctgagcgatatgatgacatggcagcctgcatgaagtctgtaactgagcaaggagctgaattatccaatgaggagaggaatcttctctcagttgcttataaaaatgttgtaggagcccgtaggtcatcttggagggtcgtctcaagtattgaacaaaagacggaaggtgctgagaaaaaacagcagatggctcgagaatacagagagaaaattgagacggagctaagagatatctgcaatgatgtactgtctcttttggaaaagttcttgatccccaatgcttcacaagcagagagcaaagtcttctatttgaaaatgaaaggagattactaccgttacttggctgaggttgccgctggtgatgacaagaaagggattgtcgatcagtcacaacaagcataccaagaagcttttgaaatcagcaaaaaggaaatgcaaccaacacatcctatcagactgggtctggcccttaacttctctgtgttctattatgagattctgaactccccagagaaagcctgctctcttgcaaagacagcttttgatgaagccattgctgaacttgatacattaagtgaagagtcatacaaagacagcacgctaataatgcaattactgagagacaacttgacattgtggacatcggatacccaaggagacgaagctgaagcaggagaaggaggggaaaattaaccggccttccaacttttgtctgcctcattctaaaatttacacagtagaccatttgtcatccatgctgtcccacaaatagttttttgtttacgatttatgacaggtttatgttacttctatttgaatttctatatttcccatgtggtttttatgtttaatattaggggagtagagccagttaacatttagggagttatctgttttcatcttgaggtggccaatatggggatgtggaatttttatacaagttataagtgtttggcatagtacttttggtacattgtggcttcaaaagggccagtgtaaaactgcttccatgtctaagcaaagaaaactgcctacatactggtttgtcctggcggggaataaaagggatcattggttccagtcacaggtgtagtaattgtgggtactttaaggtttggagcacttacaaggctgtggtagaatcataccccatggataccacatattaaaccatgtatatctgtggaatactcaatgtgtacacctttgactacagctgcagaagtgttcctttagacaaagttgtgacccattttactctggataagggcagaaacggttcacattccattatttgtaaagttacctgctgttagctttcattatttttgctacactcattttatttgtatttaaatgttttaggcaacctaagaacaaatgtaaaagtaaagatgcaggaaaaatgaattgcttggtattcattacttcatgtatatcaagcacagcagtaaaacaaaaacccatgtatttaacttttttttaggatttttgcttttgtgatttttttttttttgatacttgcctaacatgcatgtgctgtaaaaatagttaacagggaaataacttgagatgatggctagctttgtttaatgtcttatgaaattttcatgaacaatccaagcataattgttaagaacacgtgtattaaattcatgtaagtggaataaaagttttatgaatggacttttcaactactttctctacagcttttcatgtaaattagtcttggttctgaaacttctctaaaggaaattgtacattttttgaaatttattccttattccctcttggcagctaatgggctcttaccaagtttaaacacaaaatttatcataacaaaaatactactaatataactactgtttccatgtcccatgatcccctctcttcctccccaccctgaaaaaaatgagttcctattttttctgggagagggggggattgattagaaaaaaatgtagtgtgttccatttaaaattttggcatatggcattttctaacttaggaagccacaatgttcttggcccatcatgacattgggtagcattaactgtaagttttgtgcttccaaatcactttttggtttttaagaatttcttgatactcttatagcctgccttcaattttgatcctttattctttctatttgtcaggtgcacaagattaccttcctgttttagccttctgtcttgtcaccaaccattcttacttggtggccatgtacttggaaaaaggccgcatgatctttctggctccactcagtgtctaaggcaccctgcttcctttgcttgcatcccacagactatttccctcatcctatttactgcagcaaatctctccttagttgatgagactgtgtttatctccctttaaaaccctacctatcctgaatggtctgtcattgtctgcctttaaaatccttcctctttcttcctcctctattctctaaataatgatggggctaagttatacccaaagctcactttacaaaatatttcctcagtactttgcagaaaacaccaaacaaaaatgccattttaaaaaaggtgtattttttcttttagaatgtaagctcctcaagagcagggacaatgttttctgtatgttctattgtgcctagtacactgtaaatgctcaataaatattgatgatgggaggcagtgagtcttgatgataagggtgagaaactgaaatcccaaacactgttttgttgcttgttttattatgacctcagattaaattgggaaatattggcccttttgaataattgtcccaaatattacattcaaataaaagtgcaatggaga

SEQ ID NO: 33334 - DNA, 3064 bp, Homo sapiens
gcagcgtttgacgtcatcgtgcgtgtggtgcccctgctgccggggctggtgattggaggaaaccccgtgtctgcggagcggctgtagcctgtgagcagcgagatccagggacagagtctcagcctcgccgctgctgccgccgccgccgcccagagactgctgagcccgtccgtccgccgccaccacccactccggacacagaacatccagtcatggataaaaatgagctggttcagaaggccaaactggccgagcaggctgagcgatatgatgacatggcagcctgcatgaagtctgtaactgagcaaggagctgaattatccaatgaggagaggaatcttctctcagttgcttataaaaatgttgtaggagcccgtaggtcatcttggagggtcgtctcaagtattgaacaaaagacggaaggtgctgagaaaaaacagcagatggctcgagaatacagagagaaaattgagacggagctaagagatatctgcaatgatgtactgtctcttttggaaaagttcttgatccccaatgcttcacaagcagagagcaaagtcttctatttgaaaatgaaaggagattactaccgttacttggctgaggttgccgctggtgatgacaagaaagggattgtcgatcagtcacaacaagcataccaagaagcttttgaaatcagcaaaaaggaaatgcaaccaacacatcctatcagactgggtctggcccttaacttctctgtgttctattatgagattctgaactccccagagaaagcctgctctcttgcaaagacagcttttgatgaagccattgctgaacttgatacattaagtgaagagtcatacaaagacagcacgctaataatgcaattactgagagacaacttgacattgtggacatcggatacccaaggagacgaagctgaagcaggagaaggaggggaaaattaaccggccttccaacttttgtctgcctcattctaaaatttacacagtagaccatttgtcatccatgctgtcccacaaatagttttttgtttacgatttatgacaggtttatgttacttctatttgaatttctatatttcccatgtggtttttatgtttaatattaggggagtagagccagttaacatttagggagttatctgttttcatcttgaggtggccaatatggggatgtggaatttttatacaagttataagtgtttggcatagtacttttggtacattgtggcttcaaaagggccagtgtaaaactgcttccatgtctaagcaaagaaaactgcctacatactggtttgtcctggcggggaataaaagggatcattggttccagtcacaggtgtagtaattgtgggtactttaaggtttggagcacttacaaggctgtggtagaatcataccccatggataccacatattaaaccatgtatatctgtggaatactcaatgtgtacacctttgactacagctgcagaagtgttcctttagacaaagttgtgacccattttactctggataagggcagaaacggttcacattccattatttgtaaagttacctgctgttagctttcattatttttgctacactcattttatttgtatttaaatgttttaggcaacctaagaacaaatgtaaaagtaaagatgcaggaaaaatgaattgcttggtattcattacttcatgtatatcaagcacagcagtaaaacaaaaacccatgtatttaacttttttttaggatttttgcttttgtgatttttttttttttgatacttgcctaacatgcatgtgctgtaaaaatagttaacagggaaataacttgagatgatggctagctttgtttaatgtcttatgaaattttcatgaacaatccaagcataattgttaagaacacgtgtattaaattcatgtaagtggaataaaagttttatgaatggacttttcaactactttctctacagcttttcatgtaaattagtcttggttctgaaacttctctaaaggaaattgtacattttttgaaatttattccttattccctcttggcagctaatgggctcttaccaagtttaaacacaaaatttatcataacaaaaatactactaatataactactgtttccatgtcccatgatcccctctcttcctccccaccctgaaaaaaatgagttcctattttttctgggagagggggggattgattagaaaaaaatgtagtgtgttccatttaaaattttggcatatggcattttctaacttaggaagccacaatgttcttggcccatcatgacattgggtagcattaactgtaagttttgtgcttccaaatcactttttggtttttaagaatttcttgatactcttatagcctgccttcaattttgatcctttattctttctatttgtcaggtgcacaagattaccttcctgttttagccttctgtcttgtcaccaaccattcttacttggtggccatgtacttggaaaaaggccgcatgatctttctggctccactcagtgtctaaggcaccctgcttcctttgcttgcatcccacagactatttccctcatcctatttactgcagcaaatctctccttagttgatgagactgtgtttatctccctttaaaaccctacctatcctgaatggtctgtcattgtctgcctttaaaatccttcctctttcttcctcctctattctctaaataatgatggggctaagttatacccaaagctcactttacaaaatatttcctcagtactttgcagaaaacaccaaacaaaaatgccattttaaaaaaggtgtattttttcttttagaatgtaagctcctcaagagcagggacaatgttttctgtatgttctattgtgcctagtacactgtaaatgctcaataaatattgatgatgggaggcagtgagtcttgatgataagggtgagaaactgaaatcccaaacactgttttgttgcttgttttattatgacctcagattaaattgggaaatattggcccttttgaataattgtcccaaatattacattcaaataaaagtgcaatgg

SEQ ID NO: 33335 - DNA, 996 bp, Homo sapiens
agttactaccgcgaagcacggagggtggggcgggccgggcctcggggaggggtggggggatgtgaaaggtcccggatgttgctgaacgggagccccttccagagggagtgactggggcaagcgcagacgggctgagcgaaagctaaggtgggggtagggagagaacgccttcccgccggctgagaggaagagtgggccggcagaggctgcaggggagagggagagagagggcgttggggacccaaagggaaggcgaggagtgggggatttgcgttggggaggaaaaggaaaaaagcagcctcctgccctaggtgcactcgggacaagcgtagaggagctggaagccgagcggggtgggaggagtggcggctgcgggcgaggacgcgcgcgcctccgctcgccctccagcgcgggcgggcaggacgagcgccggggagcggcggttacgcggggccccgatcgctgtgggcaccaatcaacggttgccatagcagcgtttgacgtcatcgtgcgtgtggtgcccctgctgccggggctggtgattggaggaaaccccgtgtctgcggagcggctgtagcctgtgagcagcgagatccagggacagagtctcagcctcgccgctgctgccgccgccgccgcccagagactgctgagcccgtccgtccgccgccaccacccactccggacacagaacatccagtcatggataaaaatgagctggttcagaaggccaaactggccgagcaggctgagcgatatgatgacatggcagcctgcatgaagtctgtaactgagcaaggagctgaattatccaatgaggagaggaatcttctctcagttgcttataaaaatgttgtaggagcccgtaggtcatcttggagggtcgtctcaagtattgaacaaaagacggaaggtgctgagaaaaaacagcagatggctcgagaatacagagagaaaattgagacggagctaagagatatctgcaatgatgtactg

SEQ ID NO: 33336 - DNA, 891 bp, Homo sapiens
gagcgggccggagcccaggcctggcgcggcggcgcccgccaggtagaccggggcgaggctgcgcgccggcgggaggggagtccactgcgggaacatccagtcatggataaaaatgagctggttcagaaggccaaactggccgagcaggctgagcgatatgatgacatggcagcctgcatgaagtctgtaactgagcaaggagctgaattatccaatgaggagaggaatcttctctcagttgcttataaaaatgttgtaggagcccgtaggtcatcttggagggtcgtctcaagtattgaacaaaagacggaaggtgctgagaaaaaacagcagatggctcgagaatacagagagaaaattgagacggagctaagagatatctgcaatgatgtactgtctcttttggaaaagttcttgatccccaatgcttcacaagcagagagcaaagtcttctatttgaaaatgaaaggagattactaccgttacttggctgaggttgccgctggtgatgacaagaaagggattgtcgatcagtcacaacaagcataccaagaagcttttgaaatcagcaaaaaggaaatgcaaccaacacatcctatcagactgggtctggcccttaacttctctgtgttctattatgagattctgaactccccagagaaagcctgctctcttgcaaagacagcttttgatgaagccattgctgaacttgatacattaagtgaagagtcatacaaagacagcacgctaataatgcaattactgagagacaacttgacattgtggacatcggatacccaaggagacgaagctgaagcaggagaaggaggggaaaattaaccggccttccaacttttgtctgcctcattctaaaatttacacagtagacca

SEQ ID NO: 33337 - DNA, 701 bp, Homo sapiens
aaaaggtctaggaccgcttcccccgagccagcaggtgcactcgggacaagcgtagaggagctggaagccgagcggggtgggaggagtggcggctgcgggcgaggacgcgcgcgcctccgctcgccctccagcgcgggcgggcaggacgagcgccggggagcggcggttacgcggggccccgatcgctgtgggcaccaatcaacggttgccatagcagcgtttgacgtcatcgtgcgtgtggtgcccctgctgccggggctggtgattggaggaaaccccgtgtctgcggagcggctgtagcctgtgagcagcgagatccagggacagagtctcagcctcgccgctgctgccgccgccgccgcccagagactgctgagcccgtccgtccgccgccaccacccactccggacacagaacatccagtcatggataaaaatgagctggttcagaaggccaaactggccgagcaggctgagcgatatgatgacatggcagcctgcatgaagtctgtaactgagcaaggagctgaattatccaatgaggagaggaatcttctctcagttgcttataaaaatgttgtaggagcccgtaggtcatcttggagggtcgtctcaagtattgaacaaaagacggaaggtgctgagaaaaaacagcagatggctcgagaatacagagagaaaattgagacggagctaagagat

SEQ ID NO: 33338 - DNA, 3007 bp, Homo sapiens
tgtcccctcgcgcagtcaccgagcgcagatcccgcgctctcgattggaacgcctccccatcactcagccacactcaggggctggacgcctcactcccgtttccgagccataaaaggtctaggaccgcttcccccgagccagcagaacatccagtcatggataaaaatgagctggttcagaaggccaaactggccgagcaggctgagcgatatgatgacatggcagcctgcatgaagtctgtaactgagcaaggagctgaattatccaatgaggagaggaatcttctctcagttgcttataaaaatgttgtaggagcccgtaggtcatcttggagggtcgtctcaagtattgaacaaaagacggaaggtgctgagaaaaaacagcagatggctcgagaatacagagagaaaattgagacggagctaagagatatctgcaatgatgtactgtctcttttggaaaagttcttgatccccaatgcttcacaagcagagagcaaagtcttctatttgaaaatgaaaggagattactaccgttacttggctgaggttgccgctggtgatgacaagaaagggattgtcgatcagtcacaacaagcataccaagaagcttttgaaatcagcaaaaaggaaatgcaaccaacacatcctatcagactgggtctggcccttaacttctctgtgttctattatgagattctgaactccccagagaaagcctgctctcttgcaaagacagcttttgatgaagccattgctgaacttgatacattaagtgaagagtcatacaaagacagcacgctaataatgcaattactgagagacaacttgacattgtggacatcggatacccaaggagacgaagctgaagcaggagaaggaggggaaaattaaccggccttccaacttttgtctgcctcattctaaaatttacacagtagaccatttgtcatccatgctgtcccacaaatagttttttgtttacgatttatgacaggtttatgttacttctatttgaatttctatatttcccatgtggtttttatgtttaatattaggggagtagagccagttaacatttagggagttatctgttttcatcttgaggtggccaatatggggatgtggaatttttatacaagttataagtgtttggcatagtacttttggtacattgtggcttcaaaagggccagtgtaaaactgcttccatgtctaagcaaagaaaactgcctacatactggtttgtcctggcggggaataaaagggatcattggttccagtcacaggtgtagtaattgtgggtactttaaggtttggagcacttacaaggctgtggtagaatcataccccatggataccacatattaaaccatgtatatctgtggaatactcaatgtgtacacctttgactacagctgcagaagtgttcctttagacaaagttgtgacccattttactctggataagggcagaaacggttcacattccattatttgtaaagttacctgctgttagctttcattatttttgctacactcattttatttgtatttaaatgttttaggcaacctaagaacaaatgtaaaagtaaagatgcaggaaaaatgaattgcttggtattcattacttcatgtatatcaagcacagcagtaaaacaaaaacccatgtatttaacttttttttaggatttttgcttttgtgatttttttttttttgatacttgcctaacatgcatgtgctgtaaaaatagttaacagggaaataacttgagatgatggctagctttgtttaatgtcttatgaaattttcatgaacaatccaagcataattgttaagaacacgtgtattaaattcatgtaagtggaataaaagttttatgaatggacttttcaactactttctctacagcttttcatgtaaattagtcttggttctgaaacttctctaaaggaaattgtacattttttgaaatttattccttattccctcttggcagctaatgggctcttaccaagtttaaacacaaaatttatcataacaaaaatactactaatataactactgtttccatgtcccatgatcccctctcttcctccccaccctgaaaaaaatgagttcctattttttctgggagagggggggattgattagaaaaaaatgtagtgtgttccatttaaaattttggcatatggcattttctaacttaggaagccacaatgttcttggcccatcatgacattgggtagcattaactgtaagttttgtgcttccaaatcactttttggtttttaagaatttcttgatactcttatagcctgccttcaattttgatcctttattctttctatttgtcaggtgcacaagattaccttcctgttttagccttctgtcttgtcaccaaccattcttacttggtggccatgtacttggaaaaaggccgcatgatctttctggctccactcagtgtctaaggcaccctgcttcctttgcttgcatcccacagactatttccctcatcctatttactgcagcaaatctctccttagttgatgagactgtgtttatctccctttaaaaccctacctatcctgaatggtctgtcattgtctgcctttaaaatccttcctctttcttcctcctctattctctaaataatgatggggctaagttatacccaaagctcactttacaaaatatttcctcagtactttgcagaaaacaccaaacaaaaatgccattttaaaaaaggtgtattttttcttttagaatgtaagctcctcaagagcagggacaatgttttctgtatgttctattgtgcctagtacactgtaaatgctcaataaatattgatgatgggaggcagtgagtcttgatgataagggtgagaaactgaaatcccaaacactgttttgttgcttgttttattatgacctcagattaaattgggaaatattggcccttttgaataattgtcccaaatattacattcaaataaaagtgcaatgg

SEQ ID NO: 33339 - DNA, 1012 bp, Homo sapiens
agagtctcagcctcgccgctgctgccgccgccgccgcccagagactgctgagcccgtccgtccgccgccaccacccactccggacacagaacatccagtcatggataaaaatgagctgaattatccaatgaggagaggaatcttctctcagttgcttataaaaatgttgtaggagcccgtaggtcatcttggagggtcgtctcaagtattgaacaaaagacggaaggtgctgagaaaaaacagcagatggctcgagaatacagagagaaaattgagacggagctaagagatatctgcaatgatgtactgtctcttttggaaaagttcttgatccccaatgcttcacaagcagagagcaaagtcttctatttgaaaatgaaaggagattactaccgttacttggctgaggttgccgctggtgatgacaagaaagggattgtcgatcagtcacaacaagcataccaagaagcttttgaaatcagcaaaaaggaaatgcaaccaacacatcctatcagactgggtctggcccttaacttctctgtgttctattatgagattctgaactccccagagaaagcctgctctcttgcaaagacagcttttgatgaagccattgctgaacttgatacattaagtgaagagtcatacaaagacagcacgctaataatgcaattactgagagacaacttgacattgtggacatcggatacccaaggagacgaagctgaagcaggagaaggaggggaaaattaaccggccttccaacttttgtctgcctcattctaaaatttacacagtagaccatttgtcatccatgctgtcccacaaatagttttttgtttacgatttatgacaggtttatgttacttctatttgaatttctatatttcccatgtggtttttatgtttaatattaggggagtagagccagttaacatttagggagttatctgttttcatcttgaggtggccaatatggggatgtggaatttttatacaagttataagtgtt

SEQ ID NO: 33340 - DNA, 1399 bp, Homo sapiens
acagagtctcagcctcgccgctgctgccgccgccgccgcccagagactgctgagcccgtccgtccgccgccaccacccactccggacacagtctcttttggaaaagttcttgatccccaatgcttcacaagcagagagcaaagtcttctatttgaaaatgaaaggagattactaccgttacttggctgaggttgccgctggtgatgacaagaaagggattgtcgatcagtcacaacaagcataccaagaagcttttgaaatcagcaaaaaggaaatgcaaccaacacatcctatcagactgggtctggcccttaacttctctgtgttctattatgagattctgaactccccagagaaagcctgctctcttgcaaagacagcttttgatgaagccattgctgaacttgatacattaagtgaagagtcatacaaagacagcacgctaataatgcaattactgagagacaacttgacattgtggacatcggatacccaaggagacgaagctgaagcaggagaaggaggggaaaattaaccggccttccaacttttgtctgcctcattctaaaatttacacagtagaccatttgtcatccatgctgtcccacaaatagttttttgtttacgatttatgacaggtttatgttacttctatttgaatttctatatttcccatgtggtttttatgtttaatattaggggagtagagccagttaacatttagggagttatctgttttcatcttgaggtggccaatatggggatgtggaatttttatacaagttataagtgtttggcatagtacttttggtacattgtggcttcaaaagggccagtgtaaaactgcttccatgtctaagcaaagaaaactgcctacatactggtttgtcctggcggggaataaaagggatcattggttccagtcacaggtgtagtaattgtgggtactttaaggtttggagcacttacaaggctgtggtagaatcataccccatggataccacatattaaaccatgtatatctgtggaatactcaatgtgtacacctttgactacagctgcagaagtgttcctttagacaaagttgtgacccattttactctggataagggcagaaacggttcacattccattatttgtaaagttacctgctgttagctttcattatttttgctacactcattttatttgtatttaaatgttttaggcaacctaagaacaaatgtaaaagtaaagatgcaggaaaaatgaattgcttggtattcattacttcatgtatatcaagcacagcagtaaaacaaaaacccatgtatttaacttttttttaggatttttgcttttgtgatttttttttttttgatacttgcctaacatgcatgtgctgtaaaaatagttaaca

SEQ ID NO: 33341 - DNA, 511 bp, Homo sapiens
agcccgcagtcggctcccgtgcttgatggactagaactggagggtccctgcgctcggtttggggacgcatatcctgctttgggggcggaacatccagtcatggataaaaatgagctggttcagaaggccaaactggccgagcaggctgagcgatatgatgacatggcagcctgcatgaagtctgtaactgagcaaggagctgaattatccaatgaggagaggaatcttctctcagttgcttataaaaatgttgtaggagcccgtaggtcatcttggagggtcgtctcaagtattgaacaaaagacggaaggtgctgagaaaaaacagcagatggctcgagaatacagagagaaaattgagacggagctaagagatatctgcaatgatgtactgtctcttttggaaaagttcttgatccccaatgcttcacaagcagagagcaaagtcttctatttgaaaatgaaaggagattactaccgttacttggctgaggttgccgctggtgatgaca

SEQ ID NO: 33342 - DNA, 750 bp, Homo sapiens
aacatccagtcatggataaaaatgagctggttcagaaggccaaactggccgagcaggctgagcgatatgatgacatggcagcctgcatgaagtctgtaactgagcaaggagctgaattatccaatgaggagaggaatcttctctcagttgcttataaaaatgttgtaggagcccgtaggtcatcttggagggtcgtctcaagtattgaacaaaagacggaaggtgctgagaaaaaacagcagatggctcgagaatacagagagaaaattgagacggagctaagagatatctgcaatgatgtactgtctcttttggaaaagttcttgatccccaatgcttcacaagcagagagcaaagtcttctatttgaaaatgaaaggagattactaccgttacttggctgaggttgccgctggtgatgacaagaaagtacgttttggtgtgtcttatccagggattgtcgatcagtcacaacaagcataccaagaagcttttgaaatcagcaaaaaggaaatgcaaccaacacatcctatcagactgggtctggcccttaacttctctgtgttctattatgagattctgaactccccagagaaagcctgctctcttgcaaagacagcttttgatgaagccattgctgaacttgatacattaagtgaagagtcatacaaagacagcacgctaataatgcaattactgagagacaacttgacattgtggacatcggatacccaaggagacgaagctgaag

SEQ ID NO: 33343 - DNA, 1394 bp, Homo sapiens
gctataatgttaatgtaatgagtcaaccatgcagaaaactctggcgtcacaactatgaaacctcttcctgcattgaattcttgaagtctcttttggaaaagttcttgatccccaatgcttcacaagcagagagcaaagtcttctatttgaaaatgaaaggagattactaccgttacttggctgaggttgccgctggtgatgacaagaaagggattgtcgatcagtcacaacaagcataccaagaagcttttgaaatcagcaaaaaggaaatgcaaccaacacatcctatcagactgggtctggcccttaacttctctgtgttctattatgagattctgaactccccagagaaagcctgctctcttgcaaagacagcttttgatgaagccattgctgaacttgatacattaagtgaagagtcatacaaagacagcacgctaataatgcaattactgagagacaacttgacattgtggacatcggatacccaaggagacgaagctgaagcaggagaaggaggggaaaattaaccggccttccaacttttgtctgcctcattctaaaatttacacagtagaccatttgtcatccatgctgtcccacaaatagttttttgtttacgatttatgacaggtttatgttacttctatttgaatttctatatttcccatgtggtttttatgtttaatattaggggagtagagccagttaacatttagggagttatctgttttcatcttgaggtggccaatatggggatgtggaatttttatacaagttataagtgtttggcatagtacttttggtacattgtggcttcaaaagggccagtgtaaaactgcttccatgtctaagcaaagaaaactgcctacatactggtttgtcctggcggggaataaaagggatcattggttccagtcacaggtgtagtaattgtgggtactttaaggtttggagcacttacaaggctgtggtagaatcataccccatggataccacatattaaaccatgtatatctgtggaatactcaatgtgtacacctttgactacagctgcagaagtgttcctttagacaaagttgtgacccattttactctggataagggcagaaacggttcacattccattatttgtaaagttacctgctgttagctttcattatttttgctacactcattttatttgtatttaaatgttttaggcaacctaagaacaaatgtaaaagtaaagatgcaggaaaaatgaattgcttggtattcattacttcatgtatatcaagcacagcagtaaaacaaaaacccatgtatttaacttttttttaggatttttgcttttgtgatttttttttttttgatacttgcctaacatgcatgtgctgtaaaaatagttaaca

SEQ ID NO: 33344 - DNA, 875 bp, Homo sapiens
tcagcctcccgagtagctgggattacagtcgtgtgccaccacatccaatttttttttttttcccagtagagacggggtgtcacccaggctggtaatctttattttaaattgtacttgctcctaagaatttaggtgttaagagcatagcatgtagaaggaaaaaataaagctgctgtaacctcatcctgccttcttggagatgagaatctgagacccaggaagatttcagagttttgtcaaggtgacagagtttgaatttaggcatctcttttggaaaagttcttgatccccaatgcttcacaagcagagagcaaagtcttctatttgaaaatgaaaggagattactaccgttacttggctgaggttgccgctggtgatgacaagaaagggattgtcgatcagtcacaacaagcataccaagaagcttttgaaatcagcaaaaaggaaatgcaaccaacacatcctatcagactgggtctggcccttaacttctctgtgttctattatgagattctgaactccccagagaaagcctgctctcttgcaaagacagcttttgatgaagccattgctgaacttgatacattaagtgaagagtcatacaaagacagcacgctaataatgcaattactgagagacaacttgacattgtggacatcggatacccaaggagacgaagctgaagcaggagaaggaggggaaaattaaccggccttccaacttttgtctgcctcattctaaaatttacacagtagaccatttgtcatccatgctgtcccacaaatagttttttgtttacgatttatgacaggtttatgttacttctatttgaatttctatatttcccatgtggtttttatgtttaatattagggg

SEQ ID NO: 33345 - DNA, 567 bp, Homo sapiens
gcacggagggtggggcgggccgggcctcggggaggggtggggggatgtgaaaggtcccggatgttgctgaacgggagccccttccagagggagtgactggggcaagcgcagacgggctgagcgaaagctaagcgtttgacgtcatcgtgcgtgtggtgcccctgctgccggggctggtgattggaggaaaccccgtgtctgcggagcggctgtagcctgtgagcagcgagatccagggacagagtctcagcctcgccgctgctgccgccgccgccgcccagagactgctgagcccgtccgtccgccgccaccacccactccggacacagaacatccagtcatggataaaaatgagctggttcagaaggccaaactggccgagcaggctgagcgatatgatgacatggcagcctgcatgaagtctgtaactgagcaaggagctgaattatccaatgaggagaggaatcttctctcagttgcttataaaaatgttgtaggagcccgtaggtcatcttggagggtcgtctcaagtattgaacaaaagacggaaggtgctgagaaaaaaca

SEQ ID NO: 33346 - DNA, 664 bp, Homo sapiens
gtcttctatttgaaaatgaaaggagattactaccgttacttggctgaggttgccgctggtgatgacaagaaagggattgtcgatcagtcacaacaagcataccaagaagcttttgaaatcagcaaaaaggaaatgcaaccaacacatcctatcagactgggtctggcccttaacttctctgtgttctattatgagattctgaactccccagagaaagcctgctctcttgcaaagacagcttttgatgaagccattgctgaacttgatacattaagtgaagagtcatacaaagacagcacgctaataatgcaattactgagagacaacttgacattgtggacatcggatacccaaggagacgaagctgaagcaggagaaggaggggaaaattaaccggccttccaacttttgtctgcctcattctaaaatttacacagtagaccatttgtcatccatgctgtcccacaaatagttttttgtttacgatttatgacaggtgcacaagattaccttcctgttttagccttctgtcttgtcaccaaccattcttacttggtggccatgtacttggaaaaaggccgcatgatctttctggctccactcagtgtctaaggcaccctgcttcctttgcttgcatcccacagactatttccctcatcctatt

SEQ ID NO: 33347 - DNA, 626 bp, Homo sapiens
ggtcccggatgttgctgaacgggagccccttccagagggagtgactggggcaagcgcagacgggctgagcgaaagctaaggtgcactcgggacaagcgtagaggagctggaagccgagcggggtgggaggagtggcggctgcgggcgaggacgcgcgcgcctccgctcgccctccagcgcgggcgggcaggacgagcgccggggagcggcggttacgcggggccccgatcgctgtgggcaccaatcaacggttgccatagcagcgtttgacgtcatcgtgcgtgtggtgcccctgctgccggggctggtgattggaggaaaccccgtgtctgcggagcggctgtagcctgtgagcagcgagatccagggacagagtctcagcctcgccgctgctgccgccgccgccgcccagagactgctgagcccgtccgtccgccgccaccacccactccggacacagaacatccagtcatggataaaaatgagctggttcagaaggccaaactggccgagcaggctgagcgatatgatgacatggcagcctgcatgaagtctgtaactgagcaaggagctgaattatccaatgaggagaggaatcttctctcagttgcttataaaaatgttgt

SEQ ID NO: 33348 - DNA, 1536 bp, Homo sapiens
cactgagccatgcccacccccgacgccaccacgccacaggccaagggcttccgcagggccgtgtctgagctggacgccaagcaggcagaggccatcatggtaagagggcagtccccgcggttcattgggcgcaggcagagcctcatcgaggacgcccgcaaggagcgggaggcggcggtggcagcagcggccgctgcagtcccctcggagcccggggaccccctggaggctgtggcctttgaggagaaggaggggaaggccgtgctaaacctgctcttctccccgagggccaccaagccctcggcgctgtcccgagctgtgaaggtgtttgagacgtttgaagccaaaatccaccatctagagacccggcccgcccagaggccgcgagctgggggcccccacctggagtacttcgtgcgcctcgaggtgcgccgaggggacctggccgccctgctcagtggtgtgcgccaggtgtcagaggacgtgcgcagccccgcggggcccaaggtcccctggttcccaagaaaagtgtcagagctggacaagtgtcatcacctggtcaccaagttcgaccctgacctggacttggaccacccgggcttctcggaccaggtgtaccgccagcgcaggaagctgattgctgagatcgccttccagtacaggcacggcgacccgattccccgtgtggagtacaccgccgaggagattgccacctgggactgctgccacgagctgctggggcacgtgcccatgctggccgaccgcaccttcgcgcagttctcgcaggacattggcctggcgtccctgggggcctcggatgaggaaattgagaagctgtccacgctgtactggttcacggtggagttcgggctgtgtaagcagaacggggaggtgaaggcctatggtgccgggctgctgtcctcctacggggagctcctgcactgcctgtctgaggagcctgagattcgggccttcgaccctgaggctgcggccgtgcagccctaccaagaccagacgtaccagtcagtctacttcgtgtctgagagcttcagtgacgccaaggacaagctcaggagctatgcctcacgcatccagcgccccttctccgtgaagttcgacccgtacacgctggccatcgacgtgctggacagcccccaggccgtgcggcgctccctggagggtgtccaggatgagctggacacccttgcccatgcgctgagtgccattggctaggtgcacggcgtccctgagggcccttcccaacctcccctggtcctgcactgtcccggagctcaggccctggtgaggggctgggtcccgggtgccccccatgccctccctgctgccaggctcccactgcccctgcacctgcttctcagcgcaacagctgtgtgtgcccgtggtgaggttgtgctgcctgtggtgaggtcctgtcctggctcccagggtcctgggggctgctgcactgccctccgcccttccctgacactgtctgctgccccaatcaccgtcacaataaaagaaactgtggtctct

SEQ ID NO: 33349 - DNA, 1889 bp, Homo sapiens
ggacccagagggggctttgacgtcagctcagcttataagaggctgctgggccagggctgtggagacggagcccggacctccacactgagccatgcccacccccgacgccaccacgccacaggccaagggcttccgcagggccgtgtctgagctggacgccaagcaggcagaggccatcatgtccccgcggttcattgggcgcaggcagagcctcatcgaggacgcccgcaaggagcgggaggcggcggtggcagcagcggccgctgcagtcccctcggagcccggggaccccctggaggctgtggcctttgaggagaaggaggggaaggccgtgctaaacctgctcttctccccgagggccaccaagccctcggcgctgtcccgagctgtgaaggtgtttgagacgtttgaagccaaaatccaccatctagagacccggcccgcccagaggccgcgagctgggggcccccacctggagtacttcgtgcgcctcgaggtgcgccgaggggacctggccgccctgctcagtggtgtgcgccaggtgtcagaggacgtgcgcagccccgcggggcccaaggtcccctggttcccaagaaaagtgtcagagctggacaagtgtcatcacctggtcaccaagttcgaccctgacctggacttggaccacccgggcttctcggaccaggtgtaccgccagcgcaggaagctgattgctgagatcgccttccagtacaggcacggcgacccgattccccgtgtggagtacaccgccgaggagattgccacctggaaggaggtctacaccacgctgaagggcctctacgccacgcacgcctgcggggagcacctggaggcctttgctttgctggagcgcttcagcggctaccgggaagacaatatcccccagctggaggacgtctcccgcttcctgaaggagcgcacgggcttccagctgcggcctgtggccggcctgctgtccgcccgggacttcctggccagcctggccttccgcgtgttccagtgcacccagtatatccgccacgcgtcctcgcccatgcactcccctgagccggactgctgccacgagctgctggggcacgtgcccatgctggccgaccgcaccttcgcgcagttctcgcaggacattggcctggcgtccctgggggcctcggatgaggaaattgagaagctgtccacgctgtactggttcacggtggagttcgggctgtgtaagcagaacggggaggtgaaggcctatggtgccgggctgctgtcctcctacggggagctcctgcactgcctgtctgaggagcctgagattcgggccttcgaccctgaggctgcggccgtgcagccctaccaagaccagacgtaccagtcagtctacttcgtgtctgagagcttcagtgacgccaaggacaagctcaggagctatgcctcacgcatccagcgccccttctccgtgaagttcgacccgtacacgctggccatcgacgtgctggacagcccccaggccgtgcggcgctccctggagggtgtccaggatgagctggacacccttgcccatgcgctgagtgccattggctaggtgcacggcgtccctgagggcccttcccaacctcccctggtcctgcactgtcccggagctcaggccctggtgaggggctgggtcccgggtgccccccatgccctccctgctgccaggctcccactgcccctgcacctgcttctcagcgcaacagctgtgtgtgcccgtggtgaggttgtgctgcctgtggtgaggtcctgtcctggctcccagggtcctgggggctgctgcactgccctccgcccttccctgacactgtctgctgccccaatcaccgtcacaataaaagaaactgtggtctcta

SEQ ID NO: 33350 - DNA, 1898 bp, Homo sapiens
cggacctccacactgagccatgcccacccccgacgccaccacgccacaggccaagggcttccgcagggccgtgtctgagctggacgccaagcaggcagaggccatcatgggcgccccggggcccagcctcacaggctctccgtggcctggaactgcagccccagctgcatcctacacccccaccccaaggtccccgcggttcattgggcgcaggcagagcctcatcgaggacgcccgcaaggagcgggaggcggcggtggcagcagcggccgctgcagtcccctcggagcccggggaccccctggaggctgtggcctttgaggagaaggaggggaaggccgtgctaaacctgctcttctccccgagggccaccaagccctcggcgctgtcccgagctgtgaaggtgtttgagacgtttgaagccaaaatccaccatctagagacccggcccgcccagaggccgcgagctgggggcccccacctggagtacttcgtgcgcctcgaggtgcgccgaggggacctggccgccctgctcagtggtgtgcgccaggtgtcagaggacgtgcgcagccccgcggggcccaaggtcccctggttcccaagaaaagtgtcagagctggacaagtgtcatcacctggtcaccaagttcgaccctgacctggacttggaccacccgggcttctcggaccaggtgtaccgccagcgcaggaagctgattgctgagatcgccttccagtacaggcacggcgacccgattccccgtgtggagtacaccgccgaggagattgccacctggaaggaggtctacaccacgctgaagggcctctacgccacgcacgcctgcggggagcacctggaggcctttgctttgctggagcgcttcagcggctaccgggaagacaatatcccccagctggaggacgtctcccgcttcctgaaggagcgcacgggcttccagctgcggcctgtggccggcctgctgtccgcccgggacttcctggccagcctggccttccgcgtgttccagtgcacccagtatatccgccacgcgtcctcgcccatgcactcccctgagccggactgctgccacgagctgctggggcacgtgcccatgctggccgaccgcaccttcgcgcagttctcgcaggacattggcctggcgtccctgggggcctcggatgaggaaattgagaagctgtccacgctgtactggttcacggtggagttcgggctgtgtaagcagaacggggaggtgaaggcctatggtgccgggctgctgtcctcctacggggagctcctgcactgcctgtctgaggagcctgagattcgggccttcgaccctgaggctgcggccgtgcagccctaccaagaccagacgtaccagtcagtctacttcgtgtctgagagcttcagtgacgccaaggacaagctcaggagctatgcctcacgcatccagcgccccttctccgtgaagttcgacccgtacacgctggccatcgacgtgctggacagcccccaggccgtgcggcgctccctggagggtgtccaggatgagctggacacccttgcccatgcgctgagtgccattggctaggtgcacggcgtccctgagggcccttcccaacctcccctggtcctgcactgtcccggagctcaggccctggtgaggggctgggtcccgggtgccccccatgccctccctgctgccaggctcccactgcccctgcacctgcttctcagcgcaacagctgtgtgtgcccgtggtgaggttgtgctgcctgtggtgaggtcctgtcctggctcccagggtcctgggggctgctgcactgccctccgcccttccctgacactgtctgctgccccaatcaccgtcacaataaaagaaactgtggtctcta

SEQ ID NO: 33351 - DNA, 1910 bp, Homo sapiens
cggacctccacactgagccatgcccacccccgacgccaccacgccacaggccaagggcttccgcagggccgtgtctgagctggacgccaagcaggcagaggccatcatggtaagagggcagggcgccccggggcccagcctcacaggctctccgtggcctggaactgcagccccagctgcatcctacacccccaccccaaggtccccgcggttcattgggcgcaggcagagcctcatcgaggacgcccgcaaggagcgggaggcggcggtggcagcagcggccgctgcagtcccctcggagcccggggaccccctggaggctgtggcctttgaggagaaggaggggaaggccgtgctaaacctgctcttctccccgagggccaccaagccctcggcgctgtcccgagctgtgaaggtgtttgagacgtttgaagccaaaatccaccatctagagacccggcccgcccagaggccgcgagctgggggcccccacctggagtacttcgtgcgcctcgaggtgcgccgaggggacctggccgccctgctcagtggtgtgcgccaggtgtcagaggacgtgcgcagccccgcggggcccaaggtcccctggttcccaagaaaagtgtcagagctggacaagtgtcatcacctggtcaccaagttcgaccctgacctggacttggaccacccgggcttctcggaccaggtgtaccgccagcgcaggaagctgattgctgagatcgccttccagtacaggcacggcgacccgattccccgtgtggagtacaccgccgaggagattgccacctggaaggaggtctacaccacgctgaagggcctctacgccacgcacgcctgcggggagcacctggaggcctttgctttgctggagcgcttcagcggctaccgggaagacaatatcccccagctggaggacgtctcccgcttcctgaaggagcgcacgggcttccagctgcggcctgtggccggcctgctgtccgcccgggacttcctggccagcctggccttccgcgtgttccagtgcacccagtatatccgccacgcgtcctcgcccatgcactcccctgagccggactgctgccacgagctgctggggcacgtgcccatgctggccgaccgcaccttcgcgcagttctcgcaggacattggcctggcgtccctgggggcctcggatgaggaaattgagaagctgtccacgctgtactggttcacggtggagttcgggctgtgtaagcagaacggggaggtgaaggcctatggtgccgggctgctgtcctcctacggggagctcctgcactgcctgtctgaggagcctgagattcgggccttcgaccctgaggctgcggccgtgcagccctaccaagaccagacgtaccagtcagtctacttcgtgtctgagagcttcagtgacgccaaggacaagctcaggagctatgcctcacgcatccagcgccccttctccgtgaagttcgacccgtacacgctggccatcgacgtgctggacagcccccaggccgtgcggcgctccctggagggtgtccaggatgagctggacacccttgcccatgcgctgagtgccattggctaggtgcacggcgtccctgagggcccttcccaacctcccctggtcctgcactgtcccggagctcaggccctggtgaggggctgggtcccgggtgccccccatgccctccctgctgccaggctcccactgcccctgcacctgcttctcagcgcaacagctgtgtgtgcccgtggtgaggttgtgctgcctgtggtgaggtcctgtcctggctcccagggtcctgggggctgctgcactgccctccgcccttccctgacactgtctgctgccccaatcaccgtcacaataaaagaaactgtggtctcta

SEQ ID NO: 33352 - DNA, 3865 bp, Homo sapiens
atgcctctgcgccactgggggatggccaggggcagtaagcccgttggggatggagcccagcccatggctgccatgggaggcctgaaggtgcttctgcactgggctggtccaggcggcggggagccctgggtcactttcagtgagtcatcgctgacagctgaggaagtctgcatccacattgcacataaagttggtatcactcctccttgcttcaatctctttgccctcttcgatgctcaggcccaagtctggttgcccccaaaccacatcctagagatccccagagatgcaagcctgatgctatatttccgcataaggttttatttccggaactggcatggcatgaatcctcgggaaccggctgtgtaccgttgtgggcccccaggaaccgaggcatcctcagatcagacagcacaggggatgcaactcctggacccagcctcatttgagtacctctttgagcagggcaagcatgagtttgtgaatgacgtggcatcactgtgggagctgtcgaccgaggaggagatccaccactttaagaatgagagcctgggcatggcctttctgcacctctgtcacctcgctctccgccatggcatccccctggaggaggtggccaagaagaccagcttcaaggactgcatcccgcgctccttccgccggcatatccggcagcacagcgccctgacccggctgcgccttcggaacgtcttccgcaggttcctgcgggacttccagccgggccgactctcccagcagatggtcatggtcaaatacctagccacactcgagcggctggcaccccgcttcggcacagagcgtgtgcccgtgtgccacctgaggctgctggcccaggccgagggggagccctgctacatccgggacagtggggtggcccctacagaccctggccctgagtctgctgctgggcccccaacccacgaggtgctggtgacaggcactggtggcatccagtggtggccagtagaggaggaggtgaacaaggaggagggttctagtggcagcagtggcaggaacccccaagccagcctgtttgggaagaaggccaaggctcacaaggcagtcggccagccggcagacaggccgcgggagccactgtgggcctacttctgtgacttccgggacatcacccacgtggtgctgaaagagcactgtgtcagcatccaccggcaggacaacaagtgcctggagctgagcttgccttcccgggctgcggcgctgtccttcgtgtcgctggtggacggctatttccgcctgacggccgactccagccactacctgtgccacgaggtggctcccccacggctggtgatgagcatccgggatgggatccacggacccctgctggagccatttgtgcaggccaagctgcggcccgaggacggcctgtacctcattcactggagcaccagccacccctaccgcctgatcctcacagtggcccagcgtagccaggcaccagacggcatgcagagcttgcggctccgaaagttccccattgagcagcaggacggggccttcgtgctggagggctggggccggtccttccccagcgttcgggaacttggggctgccttgcagggctgcttgctgagggccggggatgactgcttctctctgcgtcgctgttgcctgccccaaccaggagaaacctccaatctcatcatcatgcggggggctcgggccagccccaggacactcaacctcagccagctcagcttccaccgggttgaccagaaggagatcacccagctgtcccacttgggccagggcacaaggaccaacgtgtatgagggccgcctgcgagtggagggcagcggggaccctgaggagggcaagatggatgacgaggaccccctcgtgcctggcagggaccgtgggcaggagctacgagtggtgctcaaagtgctggaccctagtcaccatgacatcgccctggccttctacgagacagccagcctcatgagccaggtctcccacacgcacctggccttcgtgcatggcgtctgtgtgcgcggccctgaaaatatcatggtgacagagtacgtggagcacggacccctggatgtgtggctgcggagggagcggggccatgtgcccatggcttggaagatggtggtggcccagcagctggccagcgccctcagctacctggagaacaagaacctggttcatggtaatgtgtgtggccggaacatcctgctggcccggctggggttggcagagggcaccagccccttcatcaagctgagtgatcctggcgtgggcctgggcgccctctccagggaggagcgggtggagaggatcccctggctggcccccgaatgcctaccaggtggggccaacagcctaagcaccgccatggacaagtgggggtttggcgccaccctcctggagatctgctttgacggagaggcccctctgcagagccgcagtccctccgagaaggagcatttctaccagaggcagcaccggctgcccgagccctcctgcccacagctggccacactcaccagccagtgtctgacctatgagccaacccagaggccatcattccgcaccatcctgcgtgacctcacccggctgcagccccacaatcttgctgacgtcttgactgtgaacccggactcaccggcgtcggaccctacggttttccacaagcgctatttgaaaaagatccgagatctgggcgagggtcacttcggcaaggtcagcttgtactgctacgatccgaccaacgacggcactggcgagatggtggcggtgaaagccctcaaggcagactgcggcccccagcaccgctcgggctggaagcaggagattgacattctgcgcacgctctaccacgagcacatcatcaagtacaagggctgctgcgaggaccaaggcgagaagtcgctgcagctggtcatggagtacgtgcccctgggcagcctccgagactacctgccccggcacagcatcgggctggcccagctgctgctcttcgcccagcagatctgcgagggcatggcctatctgcacgcgcagcactacatccaccgagacctagccgcgcgcaacgtgctgctggacaacgacaggctggtcaagatcggggactttggcctagccaaggccgtgcccgaaggccacgagtactaccgcgtgcgcgaggatggggacagccccgtgttctggtatgccccagagtgcctgaaggagtataagttctactatgcgtcagatgtctggtccttcggggtgaccctgtatgagctgctgacgcactgtgactccagccagagcccccccacgaaattccttgagctcataggcattgctcagggtcagatgacagttctgagactcactgagttgctggaacgaggggagaggctgccacggcccgacaaatgtccctgtgaggtctatcatctcatgaagaactgctgggagacagaggcgtcctttcgcccaaccttcgagaacctcatacccattctgaagacagtccatgagaagtaccaaggccaggccccttcagtgttcagcgtgtgctgaggcacaatggcagccctgcctgggaggactggaccaggcagtggctgcagagggagcctcctgctccctgctccaggatgaaaccaagagggggatgtcagcctcacccacaccgtgtgccttactcctgtctagagaccccacctctgtgaacttatttttctttcttggccgtgagcctaaccatgatcttgagggacccaacatttgtaggggcactaatccagcccttaaatcccccagcttccaaacttgaggcccaccatctccaccatctggtaataaactcatgttttctctg

SEQ ID NO: 33353 - DNA, 4347 bp, Homo sapiens
aaaaaaaaaaaaatccaatggtgacgagcagggagaacagagcagctgccaatgggcgtgtgcgtttcaggcggccaatgggaggaggcgtctcggcgggggacaagcagtagctacccgcgggagcggggaggggtccgggttcgagcttgtgttcccccggaagggtgagtctggacgcgggcgcggaaggagcgcggccggaggtcctcaggaagaagccgcggggactggctgcgcttgacaggctgcacttggatgggagcacctggtgcctcgggactgctccgatgcccgggtctgtgctgaatgtgtaatatgcggaactatattgaaacattacaaccatcttttgatggcaacaccctgaggacctcccttttccagatggggaaactgaggcccagaattgctaagtggcttgcttgagttgacacagggagctccaggactcaccctcagctgagccacctgccgggagcatgcctctgcgccactgggggatggccaggggcagtaagcccgttggggatggagcccagcccatggctgccatgggaggcctgaaggtgcttctgcactgggctggtccaggcggcggggagccctgggtcactttcagtgagtcatcgctgacagctgaggaagtctgcatccacattgcacataaagttggtatcactcctccttgcttcaatctctttgccctcttcgatgctcaggcccaagtctggttgcccccaaaccacatcctagagatccccagagatgcaagcctgatgctatatttccgcataaggttttatttccggaactggcatggcatgaatcctcgggaaccggctgtgtaccgttgtgggcccccaggaaccgaggcatcctcagatcagacagcacaggggatgcaactcctggacccagcctcatttgagtacctctttgagcagggcaagcatgagtttgtgaatgacgtggcatcactgtgggagctgtcgaccgaggaggagatccaccactttaagaatgagagcctgggcatggcctttctgcacctctgtcacctcgctctccgccatggcatccccctggaggaggtggccaagaagaccagcttcaaggactgcatcccgcgctccttccgccggcatatccggcagcacagcgccctgacccggctgcgccttcggaacgtcttccgcaggttcctgcgggacttccagccgggccgactctcccagcagatggtcatggtcaaatacctagccacactcgagcggctggcaccccgcttcggcacagagcgtgtgcccgtgtgccacctgaggctgctggcccaggccgagggggagccctgctacatccgggacagtggggtggcccctacagaccctggccctgagtctgctgctgggcccccaacccacgaggtgctggtgacaggcactggtggcatccagtggtggccagtagaggaggaggtgaacaaggaggagggttctagtggcagcagtggcaggaacccccaagccagcctgtttgggaagaaggccaaggctcacaaggcagtcggccagccggcagacaggccgcgggagccactgtgggcctacttctgtgacttccgggacatcacccacgtggtgctgaaagagcactgtgtcagcatccaccggcaggacaacaagtgcctggagctgagcttgccttcccgggctgcggcgctgtccttcgtgtcgctggtggacggctatttccgcctgacggccgactccagccactacctgtgccacgaggtggctcccccacggctggtgatgagcatccgggatgggatccacggacccctgctggagccatttgtgcaggccaagctgcggcccgaggacggcctgtacctcattcactggagcaccagccacccctaccgcctgatcctcacagtggcccagcgtagccaggcaccagacggcatgcagagcttgcggctccgaaagttccccattgagcagcaggacggggccttcgtgctggagggctggggccggtccttccccagcgttcgggaacttggggctgccttgcagggctgcttgctgagggccggggatgactgcttctctctgcgtcgctgttgcctgccccaaccaggagaaacctccaatctcatcatcatgcggggggctcgggccagccccaggacactcaacctcagccagctcagcttccaccgggttgaccagaaggagatcacccagctgtcccacttgggccagggcacaaggaccaacgtgtatgagggccgcctgcgagtggagggcagcggggaccctgaggagggcaagatggatgacgaggaccccctcgtgcctggcagggaccgtgggcaggagctacgagtggtgctcaaagtgctggaccctagtcaccatgacatcgccctggccttctacgagacagccagcctcatgagccaggtctcccacacgcacctggccttcgtgcatggcgtctgtgtgcgcggccctgaaaatatcatggtgacagagtacgtggagcacggacccctggatgtgtggctgcggagggagcggggccatgtgcccatggcttggaagatggtggtggcccagcagctggccagcgccctcagctacctggagaacaagaacctggttcatggtaatgtgtgtggccggaacatcctgctggcccggctggggttggcagagggcaccagccccttcatcaagctgagtgatcctggcgtgggcctgggcgccctctccagggaggagcgggtggagaggatcccctggctggcccccgaatgcctaccaggtggggccaacagcctaagcaccgccatggacaagtgggggtttggcgccaccctcctggagatctgctttgacggagaggcccctctgcagagccgcagtccctccgagaaggagcatttctaccagaggcagcaccggctgcccgagccctcctgcccacagctggccacactcaccagccagtgtctgacctatgagccaacccagaggccatcattccgcaccatcctgcgtgacctcacccggctgcagccccacaatcttgctgacgtcttgactgtgaacccggactcaccggcgtcggaccctacggttttccacaagcgctatttgaaaaagatccgagatctgggcgagggtcacttcggcaaggtcagcttgtactgctacgatccgaccaacgacggcactggcgagatggtggcggtgaaagccctcaaggcagactgcggcccccagcaccgctcgggctggaagcaggagattgacattctgcgcacgctctaccacgagcacatcatcaagtacaagggctgctgcgaggaccaaggcgagaagtcgctgcagctggtcatggagtacgtgcccctgggcagcctccgagactacctgccccggcacagcatcgggctggcccagctgctgctcttcgcccagcagatctgcgagggcatggcctatctgcacgcgcagcactacatccaccgagacctagccgcgcgcaacgtgctgctggacaacgacaggctggtcaagatcggggactttggcctagccaaggccgtgcccgaaggccacgagtactaccgcgtgcgcgaggatggggacagccccgtgttctggtatgccccagagtgcctgaaggagtataagttctactatgcgtcagatgtctggtccttcggggtgaccctgtatgagctgctgacgcactgtgactccagccagagcccccccacgaaattccttgagctcataggcattgctcagggtcagatgacagttctgagactcactgagttgctggaacgaggggagaggctgccacggcccgacaaatgtccctgtgaggtctatcatctcatgaagaactgctgggagacagaggcgtcctttcgcccaaccttcgagaacctcatacccattctgaagacagtccatgagaagtaccaaggccaggccccttcagtgttcagcgtgtgctgaggcacaatggcagccctgcctgggaggactggaccaggcagtggctgcagagggagcctcctgctccctgctccaggatgaaaccaagagggggatgtcagcctcacccacaccgtgtgccttactcctgtctagagaccccacctctgtgaacttatttttctttcttggccgtgagcctaaccatgatcttgagggacccaacatttgtaggggcactaatccagcccttaaatcccccagcttccaaacttgaggcccaccatctccaccatctggtaataaactcatgttttctctg

SEQ ID NO: 33354 - DNA, 644 bp, Homo sapiens
aagcagtagctacccgcgggagcggggaggggtccgggttcgagcttgtgttcccccggaagggtgagtctggacgcgggcgcggaaggagcgcggccggaggtcctcaggaagaagccgcggggactggctgcgcttgacaggctgcacttggatgggagcacctggtgcctcgggactgctccgatgcccgatggggaaactgaggcccagaattgctaagtggcttgcttgagttgacacagggagctccaggactcaccctcagctgagccacctgccgggagcatgcctctgcgccactgggggatggccaggggcagtaagcccgttggggatggagcccagcccatggctgccatgggaggcctgaaggtgcttctgcactgggctggtccaggcggcggggagccctgggtcactttcagtgagtcatcgctgacagctgaggaagtctgcatccacattgcacataaagttggtatcactcctccttgcttcaatctctttgccctcttcgatgctcaggcccaagtctggttgcccccaaaccacatcctagagatccccagagatgcaagcctgatgctatatttccgcataaggttttatttccggaactggcatggcatgaatcctcggga

SEQ ID NO: 33355 - DNA, 3312 bp, Homo sapiens
gccaatgggaggaggcgtctcggcgggggacaagcagtagctacccgcgggagcggggaggggtccgggttcgagcttgtgttcccccggaagggtgactccttccgccggcatatccggcagcacagcgccctgacccggctgcgccttcggaacgtcttccgcaggttcctgcgggacttccagccgggccgactctcccagcagatggtcatggtcaaatacctagccacactcgagcggctggcaccccgcttcggcacagagcgtgtgcccgtgtgccacctgaggctgctggcccaggccgagggggagccctgctacatccgggacagtggggtggcccctacagaccctggccctgagtctgctgctgggcccccaacccacgaggtgctggtgacaggcactggtggcatccagtggtggccagtagaggaggaggtgaacaaggaggagggttctagtggcagcagtggcaggaacccccaagccagcctgtttgggaagaaggccaaggctcacaaggcagtcggccagccggcagacaggccgcgggagccactgtgggcctacttctgtgacttccgggacatcacccacgtggtgctgaaagagcactgtgtcagcatccaccggcaggacaacaagtgcctggagctgagcttgccttcccgggctgcggcgctgtccttcgtgtcgctggtggacggctatttccgcctgacggccgactccagccactacctgtgccacgaggtggctcccccacggctggtgatgagcatccgggatgggatccacggacccctgctggagccatttgtgcaggccaagctgcggcccgaggacggcctgtacctcattcactggagcaccagccacccctaccgcctgatcctcacagtggcccagcgtagccaggcaccagacggcatgcagagcttgcggctccgaaagttccccattgagcagcaggacggggccttcgtgctggagggctggggccggtccttccccagcgttcgggaacttggggctgccttgcagggctgcttgctgagggccggggatgactgcttctctctgcgtcgctgttgcctgccccaaccaggagaaacctccaatctcatcatcatgcggggggctcgggccagccccaggacactcaacctcagccagctcagcttccaccgggttgaccagaaggagatcacccagctgtcccacttgggccagggcacaaggaccaacgtgtatgagggccgcctgcgagtggagggcagcggggaccctgaggagggcaagatggatgacgaggaccccctcgtgcctggcagggaccgtgggcaggagctacgagtggtgctcaaagtgctggaccctagtcaccatgacatcgccctggccttctacgagacagccagcctcatgagccaggtctcccacacgcacctggccttcgtgcatggcgtctgtgtgcgcggccctgaaaatatcatggtgacagagtacgtggagcacggacccctggatgtgtggctgcggagggagcggggccatgtgcccatggcttggaagatggtggtggcccagcagctggccagcgccctcagctacctggagaacaagaacctggttcatggtaatgtgtgtggccggaacatcctgctggcccggctggggttggcagagggcaccagccccttcatcaagctgagtgatcctggcgtgggcctgggcgccctctccagggaggagcgggtggagaggatcccctggctggcccccgaatgcctaccaggtggggccaacagcctaagcaccgccatggacaagtgggggtttggcgccaccctcctggagatctgctttgacggagaggcccctctgcagagccgcagtccctccgagaaggagcatttctaccagaggcagcaccggctgcccgagccctcctgcccacagctggccacactcaccagccagtgtctgacctatgagccaacccagaggccatcattccgcaccatcctgcgtgacctcacccggctgcagccccacaatcttgctgacgtcttgactgtgaacccggactcaccggcgtcggaccctacggttttccacaagcgctatttgaaaaagatccgagatctgggcgagggtcacttcggcaaggtcagcttgtactgctacgatccgaccaacgacggcactggcgagatggtggcggtgaaagccctcaaggcagactgcggcccccagcaccgctcgggctggaagcaggagattgacattctgcgcacgctctaccacgagcacatcatcaagtacaagggctgctgcgaggaccaaggcgagaagtcgctgcagctggtcatggagtacgtgcccctgggcagcctccgagactacctgccccggcacagcatcgggctggcccagctgctgctcttcgcccagcagatctgcgagggcatggcctatctgcacgcgcagcactacatccaccgagacctagccgcgcgcaacgtgctgctggacaacgacaggctggtcaagatcggggactttggcctagccaaggccgtgcccgaaggccacgagtactaccgcgtgcgcgaggatggggacagccccgtgttctggtatgccccagagtgcctgaaggagtataagttctactatgcgtcagatgtctggtccttcggggtgaccctgtatgagctgctgacgcactgtgactccagccagagcccccccacgaaattccttgagctcataggcattgctcagggtcagatgacagttctgagactcactgagttgctggaacgaggggagaggctgccacggcccgacaaatgtccctgtgaggtctatcatctcatgaagaactgctgggagacagaggcgtcctttcgcccaaccttcgagaacctcatacccattctgaagacagtccatgagaagtaccaaggccaggccccttcagtgttcagcgtgtgctgaggcacaatggcagccctgcctgggaggactggaccaggcagtggctgcagagggagcctcctgctccctgctccaggatgaaaccaagagggggatgtcagcctcacccacaccgtgtgccttactcctgtctagagaccccacctctgtgaacttatttttctttcttggccgtgagcctaaccatgatcttgagggacccaacatttgtaggggcactaatccagcccttaaatcccccagcttccaaacttgaggcccaccatctccaccatctggtaataaactcatgttttctct

SEQ ID NO: 33356 - DNA, 3122 bp, Homo sapiens
aacagcttcaactgtagactctgtctaggccagggccaactctccgtaccagcatcaacatctctctgccctggccccattccagggttcattaagtaaagcctgctaggaagctctgaaccccctgccatggggcaggaactgtgtcctatttagccttatattccctgtgcgtggacaggatagctctatcgggcgcttattcatgtaagagggaactcggggtgcggccctcgccggccccgggccagcggccaggtccccgccctccgcgggatttactcctgtcccgcctcctcggatttagcccaggcagcctgggaggttccgcagtcgccgcttccgccttgaccaggtggagctggagacctggtctctctagggcctaccctgagctcaccatctgaaggagagtgccatcatccttaggaactccttctccagacatgcttcctgaggctggctccctgtggctactgaagctgctccgggacatccagttggcccagttttactggcccatccttgaggagcttaatgtcactcggccagagcacttcgactttgtaaagcctgaggacctggacggcattggcatgggccggcctgcccagcgcagactgtccgaagctctgaaaaggctacgttctgggcctaagtctaagaactgggtctacaagatccttggaggttttgcccctgagcacaaggagcccaccctgccctcggacagcccacggcacctccctgagccagaggggggcctcaagtgtctgatcccagagggtgctgtttgcagaggggagctgctgggttcaggctgcttcggtgtggtgcaccgagggctgtggacgctgcccagtggcaagagtgtcccagtggctgtcaagtccctccgggtaggtcccgaaggcccgatgggcacagaactgggggacttcctgcgagaggtatcggtcatgatgaacttggagcacccacacgtgctgcgtctgcacggccttgtactgggccagcctctgcagatggtgatggagctggcgccactgggctccctgcacgcgcgcctaacggccccggccccgacacccccgctgctcgtggccctgctctgcctcttcctgcggcagctggcgggagccatggcgtacctgggggcccgcgggctggtgcaccgagacctcgctacgcgcaacctactgctggcgtcgccgcgcaccatcaaggtggctgacttcgggctggtgcggcctctgggcggtgcccggggccgctacgtcatgggcgggccccgccctatcccctacgcctggtgtgccccagagagcctgcgccacggagccttctcgtctgcctcggacgtgtggatgtttggggtgacgctgtgggagatgttctccgggggcgaggaaccctgggccggggtcccaccgtacctcatcctgcagcggctggaggacagagcccggctgcctaggcctcccctctgctccagggccctctactccctcgccttgcgctgctgggccccccaccctgccgaccggcctagcttttcccacctggaggggctgctgcaagaggccgggccttcggaagcatgttgtgtgagggatgtcacagaaccaggcgccctgaggatggagactggtgaccccatcacagtcatcgagggcagccccgactccacaatctggaagggccagaatggtcgcaccttcaaagtgggcagcttcccagcctcggcagtgacgctggcagatgcggggggcttgccagccacccgtccagtccacagaggcacccctgcccggggagatcaacacccaggaagcatagatggagacagaaagaaggcaaatctttgggatgcgcccccagcacggggccagaggaggaacatgcccctggagaggatgaaaggcatttccaggagtctggagtcagttctgtccctcggtcctcgtcccacagggggtggttcaagcccccctgaaattcgacaagccagagctgtgccccagggacctccaggcctgcctccacgcccacctttatcctctagctctcctcagcccagccagccctctagggagaggcttccctggcccaaaagaaaacccccacacaatcaccccatgggaatgcctggagcccgtaaagccgctgccctctctggaggcctcttgtccgatcctgagttgcagaggaagattatggaggtggagctgagtgtgcatggggtcacccaccaggagtgccagacagcactaggagccactgggggagatgtggtttctgccatccggaacctcaaggtagatcagctcttccacctgagtagccggtccagagctgactgctggcgcatcctggagcattaccagtgggacctctcagctgccagccgctatgtcctggccaggccctgagctcagcttctgcgggcacagacaccagcatgaaaagcctaggcccctgagggcctggccacatgggaccaagcggaaccagaacaaggtcccgacaggggtagacgttccacctggggagatcccacctgccgtaggcacatggaggaggagcccagagttgggcactggcaaatgtctcctccctcccatgctccttggcttctgaaggctgaagctcctttggctgggccaagaaggatctagtctgcccactacattctcaaacaagaggacttggaagaaaagagctgctatacatcatatgcagaggaagcttctacgcgctagagaggatcaaggggccacactggaccatgtgaacagccatcctgaactgccatcagctaccacactggactctgcagggcagccatcctggatgatggaagccaccatattgacttggggtataggcccaaactgccttcgtttggtccagggccatcgtgggtgatgacgattgctctcttgcactcaaggacatttgatgctggtagtatggattatgagatggactagcccctgccccagcccagctctcacattcccctttgttttttcccataccaactgcttctaccctcccctattacatacatctttcaatgtccaaaaagttacaaagtttatatgaatgtaacatataaa

SEQ ID NO: 33357 - DNA, 2835 bp, Homo sapiens
gtcccgcctcctcggatttagcccaggcagcctgggaggttccgcagtcgccgcttccgccttgaccaggtggagctggagacctggtctctctagggcctaccctgagctcaccatctgaaggagagtgccatcatccttaggaactccttctccagacatgcttcctgaggctggctccctgtggctactgaagctgctccgggacatccagttggcccagttttactggcccatccttgaggagcttaatgtcactcggccagagcacttcgactttgtaaagcctgaggacctggacggcattggcatgggccggcctgcccagcgcagactgtccgaagctctgaaaaggctacgttctgggcctaagtctaagaactgggtctacaagatccttggaggttttgcccctgagcacaaggagcccaccctgccctcggacagcccacggcacctccctgagccagaggggggcctcaagtgtctgatcccagagggtgctgtttgcagaggggagctgctgggttcaggctgcttcggtgtggtgcaccgagggctgtggacgctgcccagtggcaagagtgtcccagtggctgtcaagtccctccgggtaggtcccgaaggcccgatgggcacagaactgggggacttcctgcgagaggtatcggtcatgatgaacttggagcacccacacgtgctgcgtctgcacggccttgtactgggccagcctctgcagatggtgatggagctggcgccactgggctccctgcacgcgcgcctaacggccccggccccgacacccccgctgctcgtggccctgctctgcctcttcctgcggcagctggcgggagccatggcgtacctgggggcccgcgggctggtgcaccgagacctcgctacgcgcaacctactgctggcgtcgccgcgcaccatcaaggtggctgacttcgggctggtgcggcctctgggcggtgcccggggccgctacgtcatgggcgggccccgccctatcccctacgcctggtgtgccccagagagcctgcgccacggagccttctcgtctgcctcggacgtgtggatgtttggggtgacgctgtgggagatgttctccgggggcgaggaaccctgggccggggtcccaccgtacctcatcctgcagcggctggaggacagagcccggctgcctaggcctcccctctgctccagggccctctactccctcgccttgcgctgctgggccccccaccctgccgaccggcctagcttttcccacctggaggggctgctgcaagaggccgggccttcggaagcatgttgtgtgagggatgtcacagaaccaggcgccctgaggatggagactggtgaccccatcacagtcatcgagggcagccccgactccacaatctggaagggccagaatggtcgcaccttcaaagtgggcagcttcccagcctcggcagtgacgctggcagatgcggggggcttgccagccacccgtccagtccacagaggcacccctgcccggggagatcaacacccaggaagcatagatggagacagaaagaaggcaaatctttgggatgcgcccccagcacggggccagaggaggaacatgcccctggagaggatgaaaggcatttccaggagtctggagtcagttctgtccctcggtcctcgtcccacagggggtggttcaagcccccctgaaattcgacaagccagagctgtgccccagggacctccaggcctgcctccacgcccacctttatcctctagctctcctcagcccagccagccctctagggagaggcttccctggcccaaaagaaaacccccacacaatcaccccatgggaatgcctggagcccgtaaagccgctgccctctctggaggcctcttgtccgatcctgagttgcagaggaagattatggaggtggagctgagtgtgcatggggtcacccaccaggagtgccagacagcactaggagccactgggggagatgtggtttctgccatccggaacctcaaggtagatcagctcttccacctgagtagccggtccagagctgactgctggcgcatcctggagcattaccagtgggacctctcagctgccagccgctatgtcctggccaggccctgagctcagcttctgcgggcacagacaccagcatgaaaagcctaggcccctgagggcctggccacatgggaccaagcggaaccagaacaaggtcccgacaggggtagacgttccacctggggagatcccacctgccgtaggcacatggaggaggagcccagagttgggcactggcaaatgtctcctccctcccatgctccttggcttctgaaggctgaagctcctttggctgggccaagaaggatctagtctgcccactacattctcaaacaagaggacttggaagaaaagagctgctatacatcatatgcagaggaagcttctacgcgctagagaggatcaaggggccacactggaccatgtgaacagccatcctgaactgccatcagctaccacactggactctgcagggcagccatcctggatgatggaagccaccatattgacttggggtataggcccaaactgccttcgtttggtccagggccatcgtgggtgatgacgattgctctcttgcactcaaggacatttgatgctggtagtatggattatgagatggactagcccctgccccagcccagctctcacattcccctttgttttttcccataccaactgcttctaccctcccctattacatacatctttcaatgtccaaaaagttacaaagtttatatgaatgtaacatataa

SEQ ID NO: 33358 - DNA, 1921 bp, Homo sapiens
ggagaggaggaacggagctgggacgggctgcaggagggaatggccgcaggccggcaggaggaggggcgcgaccacccggccgccggccgatggcggatgaggctatgggggctgagacgcagtagcggccctgcacttctggaggatgctcgaggcccggccccccaggacgcagggcagtgacgctgccggtgccgctgcggggcgggggctgcgggcgctgcttctctccctgaccgcagccgctgggatttggggctccatgggggagagatctgcttaccagcgcctggctgggggcgaggagggaccgcagaggctgggaggcggcagaatgcagccagaggagggcacaggctggctgctggagctgctgtccgaggtgcagctgcaacagtacttcctgcggctccgagatgacctcaacgtcacccgcctgtcccactttgagtacgtcaagaatgaggacctggagaagatcggcatgggtcggcctggccagcggcggctgtgggaggctgtgaagaggaggaaggccttgtgcaaacgcaagtcgtggatgagtaaggtgttcagtggaaagcgactggaggctgagttcccacctcatcactctcagagcaccttccggaagacctcgcccgcccctgggggcccagcaggggaggggcccctgcagagcctcacctgcctcattggggagaaggacctgcgcctcctggagaagctgggtgatggttcctttggcgtggtgcgcaggggcgagtgggacgcgccctcagggaagacggtgagtgtggctgtgaagtgcctgaagcccgatgtcctgagccagccagaagccatggacgacttcatccgggaggtcaatgccatgcactcgctcgaccaccgaaacctcatccgcctctacggggtggtgctcacgccgcccatgaagatggtgacagagctggcacctctgggatcgttgttggaccggctacgtaagcaccagggccacttcctcctggggactctgagccgctacgctgtgcaggtggctgagggcatgggctacctggagtccaagcgctttattcaccgtgacctggctgcccgcaatctgctgttggctacccgcgacctggtcaagatcggggactttgggctgatgcgagcactacctcagaatgacgaccattacgtcatgcaggaacatcgcaaggtgcccttcgcctggtgtgcccccgagagcctgaagacacgcaccttctcccatgccagcgacacctggatgttcggggtgacactgtgggaaatgttcacctacggccaggagccctggatcggcctcaacggcagtcagatcctgcataagatcgacaaggagggggagcggctgccccggcccgaggactgtccccaggacatctacaacgtcatggtccagtgctgggctcacaagccagaggacagacccacgtttgtggccctgcgggacttcctgctggaggcccagcccacagacatgcgggcccttcaggactttgaggaaccggacaagctgcacatccagatgaatgatgtcatcaccgtcatcgagggaagggccgagaactactggtggcgtggccagaacacacggacgctgtgtgtggggcccttccctcgcaacgtggtgacctccgtggccggcctgtcggcccaggacatcagccagcccctgcagaacagcttcatccacacagggcatggcgacagtgacccccgccactgctggggcttcccggacaggattgacgagtgtcctttctctgccttctctccaggacaccccccagctgagacgtgcggtcaggttctgtggactgggaggcgggaggcctgtgcttcagacccaagactacacccggtttcctccaggacgaaggggctctga

SEQ ID NO: 33359 - DNA, 4552 bp, Homo sapiens
gggagcccgcggaggctgctgcagcagcccgaaccggcgtccgagtccggggaaggcccccgcgagcgcagggaggggccggaaagttccggcgaactgggggagcggcagtgggagagcgtcgggcgggaggcggtggtcctgggagcggccccggcgccccgaagccgccccgagctggtggggagggcccggccggtggggccccgggggcctgcgggggaggggcgcctgggggtgcaagaggcgaattggctgcccggggtgcaggagggacaggtggtgcgggctgtccaggaaacctacctgaacgggaaggagccccaggagggagagggacccggcgaggggctcaggacccggaggcgccggcggaggaggaggtggtgactggcaggcccgggccccacggtacctccggggctgaaggggacgcaggatgtaggggcatggggagtcgggcgcagaagagtgcggggaaccgctgagctctgggagccactgcctgagggcaggccgcggccggcgggaacctcttctgccgtctcagcctgggcgtcgctgaagctgtgtctgcggggaggcagcggaaggcggcagaggctgggaggcggcagaatgcagccagaggagggcacaggctggctgctggagctgctgtccgaggtgcagctgcaacagtacttcctgcggctccgagatgacctcaacgtcacccgcctgtcccactttgagtacgtcaagaatgaggacctggagaagatcggcatgggtcggcctggccagcggcggctgtgggaggctgtgaagaggaggaaggccttgtgcaaacgcaagtcgtggatgagtaaggtgttcagtggaaagcgactggaggctgagttcccacctcatcactctcagagcaccttccggaagacctcgcccgcccctgggggcccagcaggggaggggcccctgcagagcctcacctgcctcattggggagaaggacctgcgcctcctggagaagctgggtgatggttcctttggcgtggtgcgcaggggcgagtgggacgcgccctcagggaagacggtgagtgtggctgtgaagtgcctgaagcccgatgtcctgagccagccagaagccatggacgacttcatccgggaggtcaatgccatgcactcgctcgaccaccgaaacctcatccgcctctacggggtggtgctcacgccgcccatgaagatggtgacagagctggcacctctgggatcgttgttggaccggctacgtaagcaccagggccacttcctcctggggactctgagccgctacgctgtgcaggtggctgagggcatgggctacctggagtccaagcgctttattcaccgtgacctggctgcccgcaatctgctgttggctacccgcgacctggtcaagatcggggactttgggctgatgcgagcactacctcagaatgacgaccattacgtcatgcaggaacatcgcaaggtgcccttcgcctggtgtgcccccgagagcctgaagacacgcaccttctcccatgccagcgacacctggatgttcggggtgacactgtgggaaatgttcacctacggccaggagccctggatcggcctcaacggcagtcagatcctgcataagatcgacaaggagggggagcggctgccccggcccgaggactgtccccaggacatctacaacgtcatggtccagtgctgggctcacaagccagaggacagacccacgtttgtggccctgcgggacttcctgctggaggcccagcccacagacatgcgggcccttcaggactttgaggaaccggacaagctgcacatccagatgaatgatgtcatcaccgtcatcgagggaagggccgagaactactggtggcgtggccagaacacacggacgctgtgtgtggggcccttccctcgcaacgtggtgacctccgtggccggcctgtcggcccaggacatcagccagcccctgcagaacagcttcatccacacagggcatggcgacagtgacccccgccactgctggggcttcccggacaggattgacgaactgtatctgggaaaccccatggacccccccgacctcctgagcgtggaactgagcacctcccggcccccccagcatctaggaggggtgaaaaaaccaacctatgaccctgtgagcgaggaccaagaccccttgtccagcgacttcaagaggctgggcctgcggaagccaggcctgccccgagggctgtggctggcgaagccctcggcgcgggtgccgggcaccaaggccagccgaggcagcggggctgaggtcacgctcatcgacttcggtgaggagcccgtggtcccggccctacggccctgcgcgccctccctggcgcagctggccatggacgcctgctccctgctggacgagaccccgcctcagagccccacgcgggcactgccccggcccctgcaccccacgcctgtggtggactgggacgcacgcccgctgccccccccgcccgcctatgacgacgtggcccaggatgaggatgactttgagatctgctccatcaacagcaccctcgtgggcgcgggggtccctgccgggcccagccagggccagaccaactacgcctttgtgcctgagcaggcgcggccgccccctcccctggaggacaacctgttcctcccgccccagggtgggggcaagccgcccagctccgcacagaccgcagagatcttccaggcgctacagcaggagtgcatgaggcaactgcaggctccggccggctccccggccccctctcccagcccggggggtgacgacaagccccaggtgcctcctcgggtacccatcccccctcggcccacgcgcccacacgtccagctgtctccagcccccccgggcgaggaggagaccagccagtggcctggacctgcttcccctccccgggtgcctccgcgggagcccctgtcccctcaaggctcgaggacacccagccccctggtaccacctggcagctccccgctgccaccccggctctcaagctcacctgggaagaccatgcccaccacccagagctttgcctcagaccccaagtacgccaccccccaggtgatccaggcccctggcccgcgggctggtccctgcatcctgcccatcgtccgggatggcaagaaggtcagcagcacccactattacttgctgcccgagcgaccatcctacctggagcgctaccagcgcttcctgcgtgaggcccagagccccgaggagcctacccccctgcctgtgcctctgctgctgcccccacccagcaccccagcccccgccgcccccacggccaccgtgcggccgatgccccaggctgccttggaccccaaggccaacttctccaccaacaacagcaacccaggggcccggccaccacccccgagggccactgctcggctgccacagaggggctgccctggcgatgggccagaggcgggccggccagcagacaagatccagatggccatggtgcatggggtgaccacagaggagtgccaggcggccctgcagtgccacggctggagcgtgcagagggctgcccagtatctgaaggtggagcagctcttcgggctgggtctgcggcccagaggggagtgccacaaagtgctggagatgttcgactggaacctggagcaggccggctgccaccttctgggctcctggggccctgcccaccacaagcgctgagatgcgtctggagagccagagggcctgcctgaaggaatcacctgagcctgtccgtccaccaggagtggggagatgcccccatccagtcctggaggacccgctgctcctgctgctcccggggatggagcaaggccaaggctgcgggaggctgggagccctgccctgcccatccctcctgcaccagcgctgtccctgcacactttggttcagtcccggtgcccctgccaagatgtggaaggggccgggtgaagacaggcttgagggctgccccagcaggctctgggtatgacctgcctctggccctggtcctgggcggggcctgtgggtggagtagtacccccaggccctgccctgggtgacagactgggaggaaaccaggctggacctgggcaggcgggatgtgttggccacagggagaggcggaccggcacccggtgggacctcctaggactgggccttcttccagggggcccctggcagcagctggggtgtcgggcagaatgtgacttgtggccttaccatggacttgaatgggacttggctggcctcaggatcttgtgcctggaaatagcctgaggtggctcaggaagcggagaaagggtgccagaccattctctggcggggaccagggcccaaggccccagggctggaaggagaccaaggggcagccgccctggagggacatcagtgcttcctcttccacccaattcccccacgcggttccatgttttcccaccagcctgttggcgaagttgctgctccggcattcagtacctgcttcttccagagaaataaagttagtttctattttatgtta

SEQ ID NO: 33360 - DNA, 4223 bp, Homo sapiens
ggagaggaggaacggagctgggacgggctgcaggagggaatggccgcaggccggcaggaggaggggcgcgaccacccggccgccggccgatggcggatgaggctatgggggctgagacgcagtagcggccctgcacttctggaggatgctcgaggcccggccccccaggacgcagggcagtgacgctgccggtgccgctgcggggcgggggctgcgggcgctgcttctctccctgaccgcagccgctgggatttggggctccatgggggagagatctgcttaccagcgcctggctgggggcgaggagggaccgcagaggctgggaggcggcagaatgcagccagaggagggcacaggctggctgctggagctgctgtccgaggtgcagctgcaacagtacttcctgcggctccgagatgacctcaacgtcacccgcctgtcccactttgagtacgtcaagaatgaggacctggagaagatcggcatgggtcggcctggccagcggcggctgtgggaggctgtgaagaggaggaaggccttgtgcaaacgcaagtcgtggatgagtaaggtgttcagtggaaagcgactggaggctgagttcccacctcatcactctcagagcaccttccggaagacctcgcccgcccctgggggcccagcaggggaggggcccctgcagagcctcacctgcctcattggggagaaggacctgcgcctcctggagaagctgggtgatggttcctttggcgtggtgcgcaggggcgagtgggacgcgccctcagggaagacggtgagtgtggctgtgaagtgcctgaagcccgatgtcctgagccagccagaagccatggacgacttcatccgggaggtcaatgccatgcactcgctcgaccaccgaaacctcatccgcctctacggggtggtgctcacgccgcccatgaagatggtgacagagctggcacctctgggatcgttgttggaccggctacgtaagcaccagggccacttcctcctggggactctgagccgctacgctgtgcaggtggctgagggcatgggctacctggagtccaagcgctttattcaccgtgacctggctgcccgcaatctgctgttggctacccgcgacctggtcaagatcggggactttgggctgatgcgagcactacctcagaatgacgaccattacgtcatgcaggaacatcgcaaggtgcccttcgcctggtgtgcccccgagagcctgaagacacgcaccttctcccatgccagcgacacctggatgttcggggtgacactgtgggaaatgttcacctacggccaggagccctggatcggcctcaacggcagtcagatcctgcataagatcgacaaggagggggagcggctgccccggcccgaggactgtccccaggacatctacaacgtcatggtccagtgctgggctcacaagccagaggacagacccacgtttgtggccctgcgggacttcctgctggaggcccagcccacagacatgcgggcccttcaggactttgaggaaccggacaagctgcacatccagatgaatgatgtcatcaccgtcatcgagggaagggccgagaactactggtggcgtggccagaacacacggacgctgtgtgtggggcccttccctcgcaacgtggtgacctccgtggccggcctgtcggcccaggacatcagccagcccctgcagaacagcttcatccacacagggcatggcgacagtgacccccgccactgctggggcttcccggacaggattgacgaactgtatctgggaaaccccatggacccccccgacctcctgagcgtggaactgagcacctcccggcccccccagcatctaggaggggtgaaaagggagcctccacctcgcccacctcagcctgccttcttcactcagaaaccaacctatgaccctgtgagcgaggaccaagaccccttgtccagcgacttcaagaggctgggcctgcggaagccaggcctgccccgagggctgtggctggcgaagccctcggcgcgggtgccgggcaccaaggccagccgaggcagcggggctgaggtcacgctcatcgacttcggtgaggagcccgtggtcccggccctacggccctgcgcgccctccctggcgcagctggccatggacgcctgctccctgctggacgagaccccgcctcagagccccacgcgggcactgccccggcccctgcaccccacgcctgtggtggactgggacgcacgcccgctgccccccccgcccgcctatgacgacgtggcccaggatgaggatgactttgagatctgctccatcaacagcaccctcgtgggcgcgggggtccctgccgggcccagccagggccagaccaactacgcctttgtgcctgagcaggcgcggccgccccctcccctggaggacaacctgttcctcccgccccagggtgggggcaagccgcccagctccgcacagaccgcagagatcttccaggcgctacagcaggagtgcatgaggcaactgcaggctccggccggctccccggccccctctcccagcccggggggtgacgacaagccccaggtgcctcctcgggtacccatcccccctcggcccacgcgcccacacgtccagctgtctccagcccccccgggcgaggaggagaccagccagtggcctggacctgcttcccctccccgggtgcctccgcgggagcccctgtcccctcaaggctcgaggacacccagccccctggtaccacctggcagctccccgctgccaccccggctctcaagctcacctgggaagaccatgcccaccacccagagctttgcctcagaccccaagtacgccaccccccaggtgatccaggcccctggcccgcgggctggtccctgcatcctgcccatcgtccgggatggcaagaaggtcagcagcacccactattacttgctgcccgagcgaccatcctacctggagcgctaccagcgcttcctgcgtgaggcccagagccccgaggagcctacccccctgcctgtgcctctgctgctgcccccacccagcaccccagcccccgccgcccccacggccaccgtgcggccgatgccccaggctgccttggaccccaaggccaacttctccaccaacaacagcaacccaggggcccggccaccacccccgagggccactgctcggctgccacagaggggctgccctggcgatgggccagaggcgggccggccagcagacaagatccagatggtggagcagctcttcgggctgggtctgcggcccagaggggagtgccacaaagtgctggagatgttcgactggaacctggagcaggccggctgccaccttctgggctcctggggccctgcccaccacaagcgctgagatgcgtctggagagccagagggcctgcctgaaggaatcacctgagcctgtccgtccaccaggagtggggagatgcccccatccagtcctggaggacccgctgctcctgctgctcccggggatggagcaaggccaaggctgcgggaggctgggagccctgccctgcccatccctcctgcaccagcgctgtccctgcacactttggttcagtcccggtgcccctgccaagatgtggaaggggccgggtgaagacaggcttgagggctgccccagcaggctctgggtatgacctgcctctggccctggtcctgggcggggcctgtgggtggagtagtacccccaggccctgccctgggtgacagactgggaggaaaccaggctggacctgggcaggcgggatgtgttggccacagggagaggcggaccggcacccggtgggacctcctaggactgggccttcttccagggggcccctggcagcagctggggtgtcgggcagaatgtgacttgtggccttaccatggacttgaatgggacttggctggcctcaggatcttgtgcctggaaatagcctgaggtggctcaggaagcggagaaagggtgccagaccattctctggcggggaccagggcccaaggccccagggctggaaggagaccaaggggcagccgccctggagggacatcagtgcttcctcttccacccaattcccccacgcggttccatgttttcccaccagcctgttggcgaagttgctgctccggcattcagtacctgcttcttccagagaaataaagttagtttctattttatgtta

SEQ ID NO: 33361 - DNA, 4267 bp, Homo sapiens
ggagaggaggaacggagctgggacgggctgcaggagggaatggccgcaggccggcaggaggaggggcgcgaccacccggccgccggccgatggcggatgaggctatgggggctgagacgcagtagcggccctgcacttctggaggatgctcgaggcccggccccccaggacgcagggcagtgacgctgccggtgccgctgcggggcgggggctgcgggcgctgcttctctccctgaccgcagccgctgggatttggggctccatgggggagagatctgcttaccagcgcctggctgggggcgaggagggaccgcagaggctgggaggcggcagaatgcagccagaggagggcacaggctggctgctggagctgctgtccgaggtgcagctgcaacagtacttcctgcggctccgagatgacctcaacgtcacccgcctgtcccactttgagtacgtcaagaatgaggacctggagaagatcggcatgggtcggcctggccagcggcggctgtgggaggctgtgaagaggaggaaggccttgtgcaaacgcaagtcgtggatgagtaaggtgttcagtggaaagcgactggaggctgagttcccacctcatcactctcagagcaccttccggaagacctcgcccgcccctgggggcccagcaggggaggggcccctgcagagcctcacctgcctcattggggagaaggacctgcgcctcctggagaagctgggtgatggttcctttggcgtggtgcgcaggggcgagtgggacgcgccctcagggaagacggtgagtgtggctgtgaagtgcctgaagcccgatgtcctgagccagccagaagccatggacgacttcatccgggaggtcaatgccatgcactcgctcgaccaccgaaacctcatccgcctctacggggtggtgctcacgccgcccatgaagatggtgacagagctggcacctctgggatcgttgttggaccggctacgtaagcaccagggccacttcctcctggggactctgagccgctacgctgtgcaggtggctgagggcatgggctacctggagtccaagcgctttattcaccgtgacctggctgcccgcaatctgctgttggctacccgcgacctggtcaagatcggggactttgggctgatgcgagcactacctcagaatgacgaccattacgtcatgcaggaacatcgcaaggtgcccttcgcctggtgtgcccccgagagcctgaagacacgcaccttctcccatgccagcgacacctggatgttcggggtgacactgtgggaaatgttcacctacggccaggagccctggatcggcctcaacggcagtcagatcctgcataagatcgacaaggagggggagcggctgccccggcccgaggactgtccccaggacatctacaacgtcatggtccagtgctgggctcacaagccagaggacagacccacgtttgtggccctgcgggacttcctgctggaggcccagcccacagacatgcgggcccttcaggactttgaggaaccggacaagctgcacatccagatgaatgatgtcatcaccgtcatcgagggaagggccgagaactactggtggcgtggccagaacacacggacgctgtgtgtggggcccttccctcgcaacgtggtgacctccgtggccggcctgtcggcccaggacatcagccagcccctgcagaacagcttcatccacacagggcatggcgacagtgacccccgccactgctggggcttcccggacaggattgacgaactgtatctgggaaaccccatggacccccccgacctcctgagcgtggaactgagcacctcccggcccccccagcatctaggaggggtgaaaaaaccaacctatgaccctgtgagcgaggaccaagaccccttgtccagcgacttcaagaggctgggcctgcggaagccaggcctgccccgagggctgtggctggcgaagccctcggcgcgggtgccgggcaccaaggccagccgaggcagcggggctgaggtcacgctcatcgacttcggtgaggagcccgtggtcccggccctacggccctgcgcgccctccctggcgcagctggccatggacgcctgctccctgctggacgagaccccgcctcagagccccacgcgggcactgccccggcccctgcaccccacgcctgtggtggactgggacgcacgcccgctgccccccccgcccgcctatgacgacgtggcccaggatgaggatgactttgagatctgctccatcaacagcaccctcgtgggcgcgggggtccctgccgggcccagccagggccagaccaactacgcctttgtgcctgagcaggcgcggccgccccctcccctggaggacaacctgttcctcccgccccagggtgggggcaagccgcccagctccgcacagaccgcagagatcttccaggcgctacagcaggagtgcatgaggcaactgcaggctccggccggctccccggccccctctcccagcccggggggtgacgacaagccccaggtgcctcctcgggtacccatcccccctcggcccacgcgcccacacgtccagctgtctccagcccccccgggcgaggaggagaccagccagtggcctggacctgcttcccctccccgggtgcctccgcgggagcccctgtcccctcaaggctcgaggacacccagccccctggtaccacctggcagctccccgctgccaccccggctctcaagctcacctgggaagaccatgcccaccacccagagctttgcctcagaccccaagtacgccaccccccaggtgatccaggcccctggcccgcgggctggtccctgcatcctgcccatcgtccgggatggcaagaaggtcagcagcacccactattacttgctgcccgagcgaccatcctacctggagcgctaccagcgcttcctgcgtgaggcccagagccccgaggagcctacccccctgcctgtgcctctgctgctgcccccacccagcaccccagcccccgccgcccccacggccaccgtgcggccgatgccccaggctgccttggaccccaaggccaacttctccaccaacaacagcaacccaggggcccggccaccacccccgagggccactgctcggctgccacagaggggctgccctggcgatgggccagaggcgggccggccagcagacaagatccagatggccatggtgcatggggtgaccacagaggagtgccaggcggccctgcagtgccacggctggagcgtgcagagggctgcccagtatctgaaggtggagcagctcttcgggctgggtctgcggcccagaggggagtgccacaaagtgctggagatgttcgactggaacctggagcaggccggctgccaccttctgggctcctggggccctgcccaccacaagcgctgagatgcgtctggagagccagagggcctgcctgaaggaatcacctgagcctgtccgtccaccaggagtggggagatgcccccatccagtcctggaggacccgctgctcctgctgctcccggggatggagcaaggccaaggctgcgggaggctgggagccctgccctgcccatccctcctgcaccagcgctgtccctgcacactttggttcagtcccggtgcccctgccaagatgtggaaggggccgggtgaagacaggcttgagggctgccccagcaggctctgggtatgacctgcctctggccctggtcctgggcggggcctgtgggtggagtagtacccccaggccctgccctgggtgacagactgggaggaaaccaggctggacctgggcaggcgggatgtgttggccacagggagaggcggaccggcacccggtgggacctcctaggactgggccttcttccagggggcccctggcagcagctggggtgtcgggcagaatgtgacttgtggccttaccatggacttgaatgggacttggctggcctcaggatcttgtgcctggaaatagcctgaggtggctcaggaagcggagaaagggtgccagaccattctctggcggggaccagggcccaaggccccagggctggaaggagaccaaggggcagccgccctggagggacatcagtgcttcctcttccacccaattcccccacgcggttccatgttttcccaccagcctgttggcgaagttgctgctccggcattcagtacctgcttcttccagagaaataaagttagtttctattttatgtt

SEQ ID NO: 33362 - DNA, 580 bp, Homo sapiens
gtcgggctgttttcctgggcgaggagaaagggggccgggccgggccgggcgcggtggctcacgcctgtcatctcagcactttgggaggccgaggcgggcagatcacctgagacgaggacgctgagctggattactgggccagttacaggtcttgttcttactggacatccaagcatcccggagttccttcccgtcctcccacatgcatcccctgtgcagagctgcgctgttgctgggtcagggagcatggagtgcacagctgaacagagaggctgggaggcggcagaatgcagccagaggagggcacaggctggctgctggagctgctgtccgaggtgcagctgcaacagtacttcctgcggctccgagatgacctcaacgtcacccgcctgtcccactttgagtacgtcaagaatgaggacctggagaagatcggcatgggtcggcctggccagcggcggctgtgggaggctgtgaagaggaggaaggccttgtgcaaacgcaagtcgtggatgagtaaggtgttcagtggaaagcgactggaggctgagttcccacctcatcactctcagagcacctt

SEQ ID NO: 33363 - DNA, 3696 bp, Homo sapiens
gttggttctgtgcgcctcagagttggagcacacagctgtattaaaaaggcaaatcgaaggccgggcgcggtgactcacgcctgtcatcctagcactttgggaggccgaggcggctgaatcacttgaggttaggagtttgagatcagcccgggcaacatggtgaaaccccgtctctacaaaaatagaaaaattagccgagcgtgatggtggatgcctgtaatcctagctcctcgggaggctaaggagtataatgtctcaggaaggcgattatgggaggtggaccatatctagtagtgatgaaagtgaggaagaaaagccaaaaccagacaagccatctacctcttctcttctctgtgccaggcaaggagcagcaaatgagcccaggtacacctgttccgaggcccagaaagctgcacacaagaggaaaatatcacctgtgaaattcagcaatacagattcagttttacctcccaaaaggcagaaaagcggttcccaggaggacctcggctggtgtctgtccagcagtgatgatgagctgcaaccagaaatgccgcagaagcaggctgagaaagtggtgatcaaaaaggagaaagacatctctgctcccaatgacggcactgcccaaagaactgaaaatcatggcgctcccgcctgccacaggctcaaagaggaggaagacgagtatgagacatcaggggagggccaggacatttgggacatgctggataaagggaaccccttccagttttacctcactagagtctctggagttaagccaaagtataactctggagccctccacatcaaggatattttatctcctttatttgggacgcttgtttcttcagctcagtttaactactgctttgacgtggactggctcgtaaaacagtatccaccagagttcaggaagaagccaatcctgcttgtgcatggtgataagcgagaggctaaggctcacctccatgcccaggccaagccttacgagaacatctctctctgccaggcaaagttggatattgcgtttggaacacaccacacgaaaatgatgctgctgctctatgaagaaggcctccgggttgtcatacacacctccaacctcatccatgctgactggcaccagaaaactcaaggaatatggttgagccccttatacccacgaattgctgatggaacccacaaatctggagagtcgccaacacattttaaagctgatctcatcagttacttgatggcttataatgccccttctctcaaggagtggatagatgtcattcacaagcacgatctctctgaaacaaatgtttatcttattggttcaaccccaggacgctttcaaggaagtcaaaaagataattggggacattttagacttaagaagcttctgaaagaccatgcctcatccatgcctaacgcagagtcctggcctgtcgtaggtcagttttcaagcgttggctccttgggagccgatgaatcaaagtggttatgttctgagtttaaagagagcatgctgacactggggaaggaaagcaagactccaggaaaaagctctgttcctctttacttgatctatccttctgtggaaaatgtgcggaccagtttagaaggatatcctgctgggggctctcttccctatagcatccagacagctgaaaaacagaattggctgcattcctattttcacaaatggtcagctgagacttctggccgcagcaatgccatgccacatattaagacatatatgaggccttctccagacttcagtaaaattgcttggttccttgtcacaagcgcaaatctgtccaaggctgcctggggagcattggagaagaatggcacccagctgatgatccgctcctacgagctcggggtccttttcctcccttcagcatttggtctagacagtttcaaagtgaaacagaagttcttcgctggcagccaggagccaatggccacctttcctgtgccatatgatttgcctccagaactgtatggaagtaaagatcggccatggatatggaacattccttatgtcaaagcaccggatacgcatgggaacatgtgggtgccctcctgagaatcttgaggcactgtgaaatttaagtgtaagacattgagccacaaacatggaatctcttctttgtactggatgtccacttcccttaaagtcttatttgcacccttacaaaatctttccaaaggtcactcttatgaatggatgttggttatacttttaatggacattaacattcctaataaagtattagtttcttaattcacttttatatgttttggaaagaaaattagtgaacttctctatgttaaaaatacgtactgcttgagtatcccctgtctgaaatgcttgggaccagaagtgtttcagcttttggatttttttgaattttggaatatttgcatagcataatgagatatcttgggaatgggacccaaatctaaacacaaaattcatttatgtttcatatacaccttatatacaataacctaaaggtgattttatatgatattttgagtaattttatgcatgaaacaaagttttgacaggcttttgaccgtgattcatcacatgagttcaggcatggaaattttcatttggagcatcatgtcagcactcaaaaagttctggatcttggagcagttcagattttcagattagggatgctcaaatctatatagatataaaattatcctcacagtaacatagaatctcttggtgctgtcagctgttgggaattgaagattgactttgtgcttccaccctccatccagaaaggcacccttcattccaccagaactttacccaggaagaacacgatcatttcctttttcaccgatgccctctctcagctttctgagtacgtctcttggggtcgctggaggtgatcctaggatctgtctctgagaccaatgtgctgtttcagccccctgcagctaagaattgtattgactgtcctcacagcggcttttcatagctttcagcttcagctttacgaggcttctcctctctccctggcaccctgctggctgcctcactgcttacagacaggtcccaccaaacccaaacacctgcctagggtaaatgggtctctcttctatccccagaaactttcagaggaagcagctcatagaaacatacaaaagcacacaagtattttgggaaaaaatcctaaaaggtgacttaatttgatgccttaaattcacaagtgaggaagctaaggcctagaaggttaaggatgtccccagggtcacacagtgagcggggctcagagcttgagtgtctttgtgctttgtgtacattgtgttctccctagggtgctttagaccctgtttgttttcttctgcatgaggctgatttccagtttgtcatcaacctctttatcttataatttaggatagagttgaacgttagtcttgaaagattttctaaagtagtctttcaaactgttcctcagaggcctaggattttccaaaagtaccttaggaaccttgtaggctgcagtgggggtgtggcgatagagcaggaggcagggagacagggctgcagggcctcccaccttccaacagacaggctctgctgtatctgttgtacatactgggattctgtaaaggacattatctggggtgttgtatgtatttttgtgtgttctgctttttttaaataaacttgaaaagctactg

SEQ ID NO: 33364 - DNA, 2210 bp, Homo sapiens
gttctgtgcgcctcagagttggagcacacagctgtattaaaaaggcaaatcgaaggccgggcgcggtgactcacgcctgtcatcctagcactttgggaggccgaggcggctgaatcacttgaggttaggagtttgagatcagcccgggcaacatggtgaaaccccgtctctacaaaaatagaaaaattagccgagcgtgatggtggatgcctgtaatcctagctcctcgggaggctaaggagtataatgtctcaggaaggcgattatgggaggtggaccatatctagtagtgatgaaagtgaggaagaaaagccaaaaccagacaagccatctacctcttctcttctctgtgccaggcaaggagcagcaaatgagcccaggtacacctgttccgaggcccagaaagctgcacacaagaggaaaatatcacctgtgaaattcagcaatacagattcagttttacctcccaaaaggcagaaaagcggttcccaggaggacctcggctggtgtctgtccagcagtgatgatgagctgcaaccagaaatgccgcagaagcaggctgagaaagtggtgatcaaaaaggagaaagacatctctgctcccaatgacggcactgcccaaagaactgaaaatcatggcgctcccgcctgccacaggctcaaagaggaggaagacgagtatgagacatcaggggagggccaggacatttgggacatgctggataaagggaaccccttccagttttacctcactagagtctctggagttaagccaaagtataactctggagccctccacatcaaggatattttatctcctttatttgggacgcttgtttcttcagctcagtttaactactgctttgacgtggactggctcgtaaaacagtatccaccagagttcaggaagaagccaatcctgcttgtgcatggtgataagcgagaggctaaggctcacctccatgcccaggccaagccttacgagaacatctctctctgccaggaaaatgatgctgctgctctatgaagaaggcctccgggttgtcatacacacctccaacctcatccatgctgactggcaccagaaaactcaaggaatatggttgagccccttatacccacgaattgctgatggaacccacaaatctggagagtcgccaacacattttaaagctgatctcatcagttacttgatggcttataatgccccttctctcaaggagtggatagatgtcattcacaagcacgatctctctgaaacaaatgtttatcttattggttcaaccccaggacgctttcaaggaagtcaaaaagataattggggacattttagacttaagaagcttctgaaagaccatgcctcatccatgcctaacgcagagtcctggcctgtcgtaggtcagttttcaagcgttggctccttgggagccgatgaatcaaagtggttatgttctgagtttaaagagagcatgctgacactggggaaggaaagcaagactccaggaaaaagctctgttcctctttacttgatctatccttctgtggaaaatgtgcggaccagtttagaaggatatcctgctgggggctctcttccctatagcatccagacagctgaaaaacagaattggctgcattcctattttcacaaatggtcagctgagacttctggccgcagcaatgccatgccacatattaagacatatatgaggccttctccagacttcagtaaaattgcttggttccttgtcacaagcgcaaatctgtccaaggctgcctggggagcattggagaagaatggcacccagctgatgatccgctcctacgagctcggggtccttttcctcccttcagcatttggtctagacagtttcaaagtgaaacagaagttcttcgctggcagccaggagccaatggccacctttcctgtgccatatgatttgcctccagaactgtatggaagtaaagatcggccatggatatggaacattccttatgtcaaagcaccggatacgcatgggaacatgtgggtgccctcctgagaatcttgaggcactgtgaaatttaagtgtaagacattgagccacaaacatggaatctcttctttgtactggatgtccacttcccttaaagtcttatttgcacccttacaaaatctttccaaaggtcactcttatgaatggatgttggttatacttttaatggacattaaca

SEQ ID NO: 33365 - DNA, 2068 bp, Homo sapiens
atccgaggcaagcgttggttctgtgcgcctcaggagtataatgtctcaggaaggcgattatgggaggtggaccatatctagtagtgatgaaagtgaggaagaaaagccaaaaccagacaagccatctacctcttctcttctctgtgccaggcaaggagcagcaaatgagcccaggtacacctgttccgaggcccagaaagctgcacacaagaggaaaatatcacctgtgaaattcagcaatacagattcagttttacctcccaaaaggcagaaaagcggttcccaggaggacctcggctggtgtctgtccagcagtgatgatgagctgcaaccagaaatgccgcagaagcaggctgagaaagtggtgatcaaaaaggagaaagacatctctgctcccaatgacggcactgcccaaagaactgaaaatcatggcgctcccgcctgccacaggctcaaagaggaggaagacgagtatgagacatcaggggagggccaggacatttgggacatgctggataaagggaaccccttccagttttacctcactagagtctctggagttaagccaaagtataactctggagccctccacatcaaggatattttatctcctttatttgggacgcttgtttcttcagctcagtttaactactgctttgacgtggactggctcgtaaaacagtatccaccagagttcaggaagaagccaatcctgcttgtgcatggtgataagcgagaggctaaggctcacctccatgcccaggccaagccttacgagaacatctctctctgccaggcaaagttggatattgcgtttggaacacaccacacgaaaatgatgctgctgctctatgaagaaggcctccgggttgtcatacacacctccaacctcatccatgctgactggcaccagaaaactcaaggaatatggttgagccccttatacccacgaattgctgatggaacccacaaatctggagagtcgccaacacattttaaagctgatctcatcagttacttgatggcttataatgccccttctctcaaggagtggatagatgtcattcacaagcacgatctctctgaaacaaatgtttatcttattggttcaaccccaggacgctttcaaggaagtcaaaaagataattggggacattttagacttaagaagcttctgaaagaccatgcctcatccatgcctaacgcagagtcctggcctgtcgtaggtcagttttcaagcgttggctccttgggagccgatgaatcaaagtggttatgttctgagtttaaagagagcatgctgacactggggaaggaaagcaagactccaggaaaaagctctgttcctctttacttgatctatccttctgtggaaaatgtgcggaccagtttagaaggatatcctgctgggggctctcttccctatagcatccagacagctgaaaaacagaattggctgcattcctattttcacaaatggtcagctgagacttctggccgcagcaatgccatgccacatattaagacatatatgaggccttctccagacttcagtaaaattgcttggttccttgtcacaagcgcaaatctgtccaaggctgcctggggagcattggagaagaatggcacccagctgatgatccgctcctacgagctcggggtccttttcctcccttcagcatttggtctagacagtttcaaagtgaaacagaagttcttcgctggcagccaggagccaatggccacctttcctgtgccatatgatttgcctccagaactgtatggaagtaaagatcggccatggatatggaacattccttatgtcaaagcaccggatacgcatgggaacatgtgggtgccctcctgagaatcttgaggcactgtgaaatttaagtgtaagacattgagccacaaacatggaatctcttctttgtactggatgtccacttcccttaaagtcttatttgcacccttacaaaatctttccaaaggtcactcttatgaatggatgttggttatacttttaatggacattaacattcctaataaagtattagtttcttaattc

SEQ ID NO: 33366 - DNA, 2488 bp, Homo sapiens
ccattctccgcagagttggagcacacagctgtattaaaaaggcaaatcgaaggccgggcgcggtgactcacgcctgtcatcctagcactttgggaggccgaggcggctgaatcacttgaggttaggagtttgagatcagcccgggcaacatggtgaaaccccgtctctacaaaaatagaaaaattagccgagcgtgatggtggatgcctgtaatcctagctcctcgggaggctaaggagtataatgtctcaggaaggcgattatgggaggtggaccatatctagtagtgatgaaagtgaggaagaaaagccaaaaccagacaagccatctacctcttctcttctctgtgccaggcaaggagcagcaaatgagcccaggtacacctgttccgaggcccagaaagctgcacacaagaggaaaatatcacctgtgaaattcagcaatacagattcagttttacctcccaaaaggcagaaaagcggttcccaggaggacctcggctggtgtctgtccagcagtgatgatgagctgcaaccagaaatgccgcagaagcaggctgagaaagtggtgatcaaaaaggagaaagacatctctgctcccaatgacggcactgcccaaagaactgaaaatcatggcgctcccgcctgccacaggctcaaagaggaggaagacgagtatgagacatcaggggagggccaggacatttgggacatgctggataaagggaaccccttccagttttacctcactagagtctctggagttaagccaaagtataactctggagccctccacatcaaggatattttatctcctttatttgggacgcttgtttcttcagctcagtttaactactgctttgacgtggactggctcgtaaaacagtatccaccagagttcaggaagaagccaatcctgcttgtgcatggtgataagcgagaggctaaggctcacctccatgcccaggccaagccttacgagaacatctctctctgccaggcaaagttggatattgcgtttggaacacaccacacgaaaatgatgctgctgctctatgaagaaggcctccgggttgtcatacacacctccaacctcatccatgctgactggcaccagaaaactcaaggaactcacctgtgagtgaatctctgatccaggaggagcctcactcagcctgggaactttgaggtgctattgcaaggggaggtcctccacgtctgtccagcccaacctggtcattttacacacggaggcaaaggcccagagagatcacagagcttacccaaaatgaatatggttgagccccttatacccacgaattgctgatggaacccacaaatctggagagtcgccaacacattttaaagctgatctcatcagttacttgatggcttataatgccccttctctcaaggagtggatagatgtcattcacaagcacgatctctctgaaacaaatgtttatcttattggttcaaccccaggacgctttcaaggaagtcaaaaagataattggggacattttagacttaagaagctttgcataattatcaaagcaggaaatgcagatcagtcttctgcagtgttttagctgcttctgaaagaccatgcctcatccatgcctaacgcagagtcctggcctgtcgtaggtcagttttcaagcgttggctccttgggagccgatgaatcaaagtggttatgttctgagtttaaagagagcatgctgacactggggaaggaaagcaagactccaggaaaaagctctgttcctctttacttgatctatccttctgtggaaaatgtgcggaccagtttagaaggatatcctgctgggggctctcttccctatagcatccagacagctgaaaaacagaattggctgcattcctattttcacaaatggtcagctgagacttctggccgcagcaatgccatgccacatattaagacatatatgaggccttctccagacttcagtaaaattgcttggttccttgtcacaagcgcaaatctgtccaaggctgcctggggagcattggagaagaatggcacccagctgatgatccgctcctacgagctcggggtccttttcctcccttcagcatttggtctagacagtttcaaagtgaaacagaagttcttcgctggcagccaggagccaatggccacctttcctgtgccatatgatttgcctccagaactgtatggaagtaaagatcggccatggatatggaacattccttatgtcaaagcaccggatacgcatgggaacatgtgggtgccctcctgagaatcttgaggcactgtgaaatttaagtgtaagacattgagccacaaacatggaatctcttctttgtactggatgtccacttcccttaaagtcttatttgcacccttacaaaatctttccaaaggtcactcttatgaatggatgttggttatacttttaatggacattaacattcctaataaagtattagtttcttaa

SEQ ID NO: 33367 - DNA, 910 bp, Homo sapiens
atcctgctcctggccgagtcgcggtgcgcgggctgctggggtccggcagggctggaggcggaccgcgaggaagcggcgcggccgggaagatggggcagggtcgcctcggccccggggcctcggtttcctccgatcacagcgcctcagggggcgcgcacgggcgctgcggagacctgtgtcctgccggggcgcggcgctaggggcccctgctcgggtttttattcccagacctaagcttacagagttggagcacacagctgtattaaaaaggcaaatcgaaggccgggcgcggtgactcacgcctgtcatcctagcactttgggaggccgaggcggctgaatcacttgaggttaggagtttgagatcagcccgggcaacatggtgaaaccccgtctctacaaaaatagaaaaattagccgagcgtgatggtggatgcctgtaatcctagctcctcgggaggctaaggagtataatgtctcaggaaggcgattatgggaggtggaccatatctagtagtgatgaaagtgaggaagaaaagccaaaaccagacaagccatctacctcttctcttctctgtgccaggcaaggagcagcaaatgagcccaggtacacctgttccgaggcccagaaagctgcacacaagaggaaaatatcacctgtgaaattcagcaatacagattcagttttacctcccaaaaggcagaaaagcggttcccaggaggacctcggctggtgtctgtccagcagtgatgatgagctgcaaccagaaatgccgcagaagcaggctgagaaagtggtgatcaaaaaggagaaagacatctctgctcccaatgacggcactgcccaaagaactgaaaatcatggcgctcccgcctgccacaggctcaaagaggaggaagacgagtatgag

SEQ ID NO: 33368 - DNA, 728 bp, Homo sapiens
aacgccttcagcaagagccctctcacttcctttgtcttcaacccattctccgcagagttggagcacacagctgtattaaaaaggcaaatcgaaggccgggcgcggtgactcacgcctgtcatcctagcactttgggaggccgaggcggctgaatcacttgaggttaggagtttgagatcagcccgggcaacatggtgaaaccccgtctctacaaaaatagaaaaattagccgagcgtgatggtggatgcctgtaatcctagctcctcgggaggctaaggagtataatgtctcaggaaggcgattatgggaggtggaccatatctagtagtgatgaaagtgaggaagaaaagccaaaaccagacaagccatctacctcttctcttctctgtgccaggcaaggagcagcaaatgagcccaggtacacctgttccgaggcccagaaagctgcacacaagaggaaaatatcacctgtgaaattcagcaatacagattcagttttacctcccaaaaggcagaaaagcggttcccaggaggacctcggctggtgtctgtccagcagtgatgatgagctgcaaccagaaatgccgcagaagcaggctgagaaagtggtgatcaaaaaggagaaagacatctctgctcccaatgacggcactgcccaaagaactgaaaatcatggcgctcccgcctgccacaggctcaaagaggaggaagacgagtatgagacatc

SEQ ID NO: 33369 - DNA, 910 bp, Homo sapiens
gcgcatgcgcggcggccgccgaaggggcgggatccgaggcaagcgttggttctgtgcgcctcaggagtataatgtctcaggaaggcgattatgggaggtggaccatatctagtagtgatgaaagtgaggaagaaaagccaaaaccagacaagccatctacctcttctcttctctgtgccaggcaaggagcagcaaatgagcccaggtacacctgttccgaggcccagaaagctgcacacaagaggaaaatatcacctgtgaaattcagcaatacagattcagttttacctcccaaaaggcagaaaagcggttcccaggaggacctcggctggtgtctgtccagcagtgatgatgagctgcaaccagaaatgccgcagaagcaggctgagaaagtggtgatcaaaaaggagaaagacatctctgctcccaatgacggcactgcccaaagaactgaaaatcatggcgctcccgcctgccacaggctcaaagaggaggaagacgagtatgagacatcaggggagggccaggacatttgggacatgctggataaagggaaccccttccagttttacctcactagagtctctggagttaagccaaagtataactctggagccctccacatcaaggatattttatctcctttatttgggacgcttgtttcttcagctcagtttaactactgctttgacgtggactggctcgtaaaacagtatccaccagagttcaggaagaagccaatcctgcttgtgcatggtgataagcgagaggctaaggctcacctccatgcccaggccaagccttacgagaacatctctctctgccaggcaaagttggatattgcgtttggaacacaccacacgaaaatgatgctgctgctctatgaagaaggcctccgggttgtcataca

SEQ ID NO: 33370 - DNA, 597 bp, Homo sapiens
gggttatagctctatttgcactcgctgtttagctggtccgaatttcttgtcctgcgtccaagaataatgaggttaggctgacaaccgaaggggaaaagggcggaggagtataatgtctcaggaaggcgattatgggaggtggaccatatctagtagtgatgaaagtgaggaagaaaagccaaaaccagacaagccatctacctcttctcttctctgtgccaggcaaggagcagcaaatgagcccaggtacacctgttccgaggcccagaaagctgcacacaagaggaaaatatcacctgtgaaattcagcaatacagattcagttttacctcccaaaaggcagaaaagcggttcccaggaggacctcggctggtgtctgtccagcagtgatgatgagctgcaaccagaaatgccgcagaagcaggctgagaaagtggtgatcaaaaaggagaaagacatctctgctcccaatgacggcactgcccaaagaactgaaaatcatggcgctcccgcctgccacaggctcaaagaggaggaagacgagtatgagacatcaggggagggccaggacatttgggacatgctggataaagggaa

SEQ ID NO: 33371 - DNA, 748 bp, Homo sapiens
cgcggactcggtgcggtctctcgcgggctgcggtcgggcccgggatcctgctcctggccgagtcgcggtgcgcgggctgctggggtccggcagggctggaggcggaccgcgaggaagcggcgcggccgggaagatggggcagggtcgcctcggccccggggcctcggtttcctccgatcacagcgcctcagggggcgcgcacgggcgctgcggagacctgtgtcctgccggggcgcggcgctaggggcccctgctcgggtttttattcccagacctaagcttacaggagtataatgtctcaggaaggcgattatgggaggtggaccatatctagtagtgatgaaagtgaggaagaaaagccaaaaccagacaagccatctacctcttctcttctctgtgccaggcaaggagcagcaaatgagcccaggtacacctgttccgaggcccagaaagctgcacacaagaggaaaatatcacctgtgaaattcagcaatacagattcagttttacctcccaaaaggcagaaaagcggttcccaggaggacctcggctggtgtctgtccagcagtgatgatgagctgcaaccagaaatgccgcagaagcaggctgagaaagtggtgatcaaaaaggagaaagacatctctgctcccaatgacggcactgcccaaagaactgaaaatcatggcgctcccgcctgccacaggctcaaagaggaggaagacgagtatgagacatcaggggagggcca

SEQ ID NO: 33372 - DNA, 2116 bp, Homo sapiens
tccttcggtgggcagccggccggaactcacgaatcagagcagccgacacatcgtccgctcagccaatcgtagcagatgtgtgatcccgccacctccccggaccctggcggttgtcgctgagttggcgaccgcgggagacgctgctgaggcggcttcggttgcgggtcggaacggcgctgctctgcggggccggtccaggctggcagctgccggcgcttggcggtgagggcgggctcccgagtggccccccaccgaaggcggtgggaccagcggctgaggccaggatgccgtccaggcggcgcggcggctcctcactcatcccagatgttggttatctttctgaagtagactgtccatggcctgaacattttccgaaaatcattttgagcaaaatatctgtttaataacaagataaccacatcaagatggttggaaagctgaagcagaacttactattggcatgtctggtgattagttctgtgactgtgttttacctgggccagcatgccatggaatgccatcaccggatagaggaacgtagccagccagtcaaattggagagcacaaggaccactgtgagaactggcctggacctcaaagccaacaaaacctttgcctatcacaaagatatgcctttaatatttattggaggtgtgcctcggagtggaaccacactcatgagggccatgctggacgcacatcctgacattcgctgtggagaggaaaccagggtcattccccgaatcctggccctgaagcagatgtggtcacggtcaagtaaagagaagatccgcctggatgaggctggtgttactgatgaagtgctggattctgccatgcaagccttcttactagaaattatcgttaagcatggggagccagccccttatttatgtaataaagatccttttgccctgaaatctttaacttacctttctaggttattccccaatgccaaatttctcctgatggtccgagatggccgggcatcagtacattcaatgatttctcgaaaagttactatagctggatttgatctgaacagctatagggactgtttgacaaagtggaatcgtgctatagagaccatgtataaccagtgtatggaggttggttataaaaagtgcatgttggttcactatgaacaacttgtcttacatcctgaacggtggatgagaacactcttaaagttcctccagattccatggaaccactcagtattgcaccatgaagagatgattgggaaagctgggggagtgtctctgtcaaaagtggagagatctacagaccaagtaatcaagccagtcaatgtaggagctctatcaaaatgggttgggaagataccgccagatgttttacaagacatggcagtgattgctcctatgcttgccaagcttggatatgacccatatgccaacccacctaactacggaaaacctgatcccaaaattattgaaaacactcgaagggtctataagggagaattccaactacctgactttcttaaagaaaaaccacagactgagcaagtggagtagcagaaccaggagcctcttccatacatgaggaaagattgctgccttttcagcagaagggaaattcctaggattggctgtcccctgccaagcttggtggagcgtctgcaccttggctgcgccgcctgtgcatttgccagtttcctcccactgagaggatggaggtgtccgcacagctttgggcctcgtgagggatctgcctcctgagcaaagagctcttgatcccgatttcatgcacagccctgcagtaaggagcccagaaggaacatgtgtttcctgttaaaactcctcttgttctcttttcttacattatgacgtttgttttcaaggagagggtttaaaaatgggatcctgtaagcagacttgggcagtctccttttgaaataggttgtctgtacatgttctaatgttttgtagaacacgtgtgcctgtttaagtgtattgatgtgaataatattaaatatcctaattatttaattcattgtattgtttctgagaagttgggaaattaccattatacatttacaacctaatgacttttgtattttatttttcaaaataaaagctttcaatgtgaagca

SEQ ID NO: 33373 - DNA, 560 bp, Homo sapiens
gagttggcgaccgcgggagacgctgctgaggcggcttcggttgcgggtcggaacggcgctgctctgcggggccggtccaggctggcagctgccggcgcttggcggtgagggcgggctcccgagtggccccccaccgaaggcggtgggaccagcggctgaggccaggatgccgtccaggcggcgcggcggctcctcactcatcccagccctgggaccacgtcctagccccgcagtcccctgggatgagaccctcgtctcgccgggatcggacatttgcccccacgtctaccccggctgcgcttcttgagctcatcgccccatcatcctacccgttatgttggttatctttctgaagtagactgtccatggcctgaacattttccgaaaatcattttgagcaaaatatctgtttaataacaagataaccacatcaagatggttggaaagctgaagcagaacttactattggcatgtctggtgattagttctgtgactgtgttttacctgggccagcatgccatggaatgccatcaccggatagaggaacgtagccagccagt

SEQ ID NO: 33374 - DNA, 562 bp, Homo sapiens
attacagtgtaagtgagagctggctgcagatgaagcaggatgttggttatctttctgaagtagactgtccatggcctgaacattttccgaaaatcattttgagcaaaatatctgtttaataacaagataaccacatcaagatggttggaaagctgaagcagaacttactattggcatgtctggtgattagttctgtgactgtgttttacctgggccagcatgccatggaatgccatcaccggatagaggaacgtagccagccagtcaaattggagagcacaaggaccactgtgagaactggcctggacctcaaagccaacaaaacctttgcctatcacaaagatatgcctttaatatttattggaggtgtgcctcggagtggaaccacactcatgagggccatgctggacgcacatcctgacattcgctgtggagaggaaaccagggtcattccccgaatcctggccctgaagcagatgtggtcacggtcaagtaaagagaagatccgcctggatgaggctggtgttactgatgaagtgctggattctgccatgcaagcctt

SEQ ID NO: 33375 - DNA, 1832 bp, Homo sapiens
ttcggttgcgggtcggaacggcgctgctctgcggggccggtccaggctggcagctgccggcgcttggcggtgagggcgggctcccgagtggccccccaccgaaggcggtgggaccagcggctgaggccaggatgccgtccaggcggcgcggcggctcctcactcatcccagatgttggttatctttctgaagtagactgtccatggcctgaacattttccgaaaatcattttgagcaaaatatctgtttaataacaagataaccacatcaagatggttggaaagctgaagcagaacttactattggcatgtctggtgattagttctgtgactgtgttttacctgggccagcatgccatggaatgccatcaccggatagaggaacgtagccagccagtcaaattggagagcacaaggaccactgtgagaactggcctggacctcaaagccaacaaaacctttgcctatcacaaagatatgcctttaatatttattggaggtgtgcctcggagtggaaccacactcatgagggccatgctggacgcacatcctgacattcgctgtggagaggaaaccagggtcattccccgaatcctggccctgaagcagatgtggtcacggtcaagtaaagagaagatccgcctggatgaggctggtgttactgatgaagtgctggattctgccatgcaagccttcttactagaaattatcgttaagcatggggagccagccccttatttatgtaataaagatccttttgccctgaaatctttaacttacctttctaggttattccccaatgccaaatttctcctgatggtccgagatggccgggcatcagtacattcaatgatttctcgaaaagttactatagctggatttgatctgaacagctatagggactgtttgacaaagtggaatcgtgctatagagaccatgtataaccagtgtatggaggttggttataaaaagtgcatgttggttcactatgaacaacttgtcttacatcctgaacggtggatgagaacactcttaaagttcctccagattccatggaaccactcagtattgcaccatgaagagatgattgggaaagctgggggagtgtctctgtcaaaagtggagagatctacagaccaagtaatcaagccagtcaatgtaggagctctatcaaaatgggttgggaagataccgccagatgttttacaagacatggcagtgattgctcctatgcttgccaagcttggatatgacccatatgccaacccacctaactacggaaaacctgatcccaaaattattgaaaacactcgaagggaaagattgctgccttttcagcagaagggaaattcctaggattggctgtcccctgccaagcttggtggagcgtctgcaccttggctgcgccgcctgtgcatttgccagtttcctcccactgagaggatggaggtgtccgcacagctttgggcctcgtgagggatctgcctcctgagcaaagagctcttgatcccgatttcatgcacagccctgcagtaaggagcccagaaggaacatgtgtttcctgttaaaactcctcttgttctcttttcttacattatgacgtttgttttcaaggagagggtttaaaaatgggatcctgtaagcagacttgggcagtctccttttgaaataggttgtctgtacatgttctaatgttttgtagaacacgtgtgcctgtttaagtgtattgatgtgaataatattaaatatcctaattatttaattcattgtattgtttctgagaagttgggaaattaccattatacatttacaacctaatgacttttgtatttt

SEQ ID NO: 33376 - DNA, 2188 bp, Homo sapiens
acgtcgccgcggccccgcccccgcgcgggcacctcccccttccccggctggggcggctggagagccgggagtcgctgggtgcgtggggctgcctcgccgcgtctcgccacgggctctgccagcagacagccttggcacacaggcacaagggctggagcccagagatgagagtgcccaagggagatgtgagcctggcgggctgcccgctaacctgtcgctgaagccccagaagcgggccctcaggccaggcctaccctgcctccggcccagcatgcgcctgtcggtgcggagggtgctgctggcagccggctgcgccctggtcctggtgctggcggttcagctgggacagcaggtgctagagtgccgggcggtgctggcgggcctgcggagcccccggggggccatgcggcctgagcaggaggagctggtgatggtgggcaccaaccacgtggaataccgctatggcaaggccatgccgctcatcttcgtgggtggcgtgcctcgcagtggcaccacgttgatgcgcgccatgctggacgcgcaccccgaggtgcgctgcggcgaggagacccgcatcatcccgcgcgtgctggccatgcgccaggcctggtccaagtctggccgtgagaagctgcggctggatgaggcgggggtgacggatgaggtgctggacgccgccatgcaggccttcatcctggaggtgattgccaagcacggagagccggcccgcgtgctctgcaacaaggacccatttacgctcaagtcctcggtctacctgtcgcgcctgttccccaactccaagttcctgctgatggtgcgggacggccgggcctccgtgcactccatgatcacgcgcaaagtcaccattgcgggctttgacctcagcagctaccgtgactgcctcaccaagtggaacaaggccatcgaggtgatgtacgcccagtgcatggaggtaggcaaggagaagtgcctgcctgtgtactacgagcagctggtgctgcaccccaggcgctcactcaagctcatcctcgacttcctcggcatcgcctggagcgacgctgtcctccaccatgaagacctcattggcaagcccggtggtgtctccctgtccaagatcgagcggtccacggaccaggtcatcaagcctgttaacctggaagcgctctccaagtggactggccacatccctggggatgtggtgcgggacatggcccagatcgcccccatgctggctcagctcggctatgacccttatgcaaacccccccaactatggcaaccctgaccccttcgtcatcaacaacacacagcgggtcttgaaaggggactataaaacaccagccaatctgaaaggatattttcaggtgaaccagaacagcacctcctcccacttaggaagctcgtgatttccagatctccgcaaatgacttcattgccaagaagagaagaaaatgcatttaagtggaaatcggacctctaatccaagcatattgcttgctattaatcgccaaaacaggactgctgatgaggaatgtatttgcatatgtttgcaaaagctgaatcattgaaaacgtaccttgaaactctctatctctggacactccagggtagagaatgaagggtatggaagtagtccggcttttgaaacttaggtattttatatttttcccctcaagaacttttttttaagagacagatttgccatcctccttaatttgcaggactgccttggtggctttgtttgctgggacaaggcccacaacctgtgcctctcctattgacccttactttgaattcaaagaatctatttaagagtttaatatatgaggctttctttgattcctcctcagttctacctagtttcacagaggaaaaaaatactctttgaataaagtgaacagaggctcatttgtttgtgccttactttactgaatgaatagggttttttttttctttccatactggattttgtcaggtagatttgtgatgagcaaaaagctggagaatataggtgcatgtaaggcacagctgaattcctgtgtcagggtccccagggccacccccaggatcgatgattggctagaagaactcagaattcagaagagctattatccttatggttatggtttattacagcaaaaggataaacattaaaatcagcaaaagaggccgggtggagtggctcacgc

SEQ ID NO: 33377 - DNA, 1968 bp, Homo sapiens
aaaggagcctcccagctaaaagccagcaggagagagaccttggccaccaagggtctgccagctcctggtggtccccactccagccacctgccagctcgagcctgaccctcgcctccaccctggctgctgcctgtaccgctctcagggctctgccagcagacagccttggcacacaggcacaagggctggagcccagagatgagagtgcccaagggagatgtgagcctggcgggctgcccgctaacctgtcgctgaagccccagaagcgggccctcaggccaggcctaccctgcctccggcccagcatgcgcctgtcggtgcggagggtgctgctggcagccggctgcgccctggtcctggtgctggcggttcagctgggacagcaggtgctagagtgccgggcggtgctggcgggcctgcggagcccccggggggccatgcggcctgagcaggaggagctggtgatggtgggcaccaaccacgtggaataccgctatggcaaggccatgccgctcatcttcgtgggtggcgtgcctcgcagtggcaccacgttgatgcgcgccatgctggacgcgcaccccgaggtgcgctgcggcgaggagacccgcatcatcccgcgcgtgctggccatgcgccaggcctggtccaagtctggccgtgagaagctgcggctggatgaggcgggggtgacggatgaggtgctggacgccgccatgcaggccttcatcctggaggtgattgccaagcacggagagccggcccgcgtgctctgcaacaaggacccatttacgctcaagtcctcggtctacctgtcgcgcctgttccccaactccaagttcctgctgatggtgcgggacggccgggcctccgtgcactccatgatcacgcgcaaagtcaccattgcgggctttgacctcagcagctaccgtgactgcctcaccaagtggaacaaggccatcgaggtgatgtacgcccagtgcatggaggtaggcaaggagaagtgcctgcctgtgtactacgagcagctggtgctgcaccccaggcgctcactcaagctcatcctcgacttcctcggcatcgcctggagcgacgctgtcctccaccatgaagacctcattggcaagcccggtggtgtctccctgtccaagatcgagcggtccacggaccaggtcatcaagcctgttaacctggaagcgctctccaagtggactggccacatccctggggatgtggtgcgggacatggcccagatcgcccccatgctggctcagctcggctatgacccttatgcaaacccccccaactatggcaaccctgaccccttcgtcatcaacaacacacagcgggtcttgaaaggggactataaaacaccagccaatctgaaaggatattttcaggtgaaccagaacagcacctcctcccacttaggaagctcgtgatttccagatctccgcaaatgacttcattgccaagaagagaagaaaatgcatttaagtggaaatcggacctctaatccaagcatattgcttgctattaatcgccaaaacaggactgctgatgaggaatgtatttgcatatgtttgcaaaagctgaatcattgaaaacgtaccttgaaactctctatctctggacactccagggtagagaatgaagggtatggaagtagtccggcttttgaaacttaggtattttatatttttcccctcaagaacttttttttaagagacagatttgccatcctccttaatttgcaggactgccttggtggctttgtttgctgggacaaggcccacaacctgtgcctctcctattgacccttactttgaattcaaagaatctatttaagagtttaatatatgaggctttctttgattcctcctcagttctacctagtttcacagaggaaaaaaatactctttgaataaagtgaacagaggctcatttgtttgtgccttactttactgaatg

SEQ ID NO: 33378 - DNA, 2084 bp, Homo sapiens
aaattctactgcagtggagtccatcttcacagtcatatgagccccctgaaattgacttccatagttctttaccttcaaggtcttattgttgggctctgccagcagacagccttggcacacaggcacaagggctggagcccagagatgagagtgcccaagggagaccctgaatcgagggtacaaatgaagccccaacctcttcagcagaacttcatcagcacgtttttctgaagagagggaaattatccaatgcacagagaggccggtgaccccagcctgagatccatctctggtttgtcagctgcttctcatattttcacagcagcctctgagatgtgagcctggcgggctgcccgctaacctgtcgctgaagccccagaagcgggccctcaggccaggcctaccctgcctccggcccagcatgcgcctgtcggtgcggagggtgctgctggcagccggctgcgccctggtcctggtgctggcggttcagctgggacagcaggtgctagagtgccgggcggtgctggcgggcctgcggagcccccggggggccatgcggcctgagcaggaggagctggtgatggtgggcaccaaccacgtggaataccgctatggcaaggccatgccgctcatcttcgtgggtggcgtgcctcgcagtggcaccacgttgatgcgcgccatgctggacgcgcaccccgaggtgcgctgcggcgaggagacccgcatcatcccgcgcgtgctggccatgcgccaggcctggtccaagtctggccgtgagaagctgcggctggatgaggcgggggtgacggatgaggtgctggacgccgccatgcaggccttcatcctggaggtgattgccaagcacggagagccggcccgcgtgctctgcaacaaggacccatttacgctcaagtcctcggtctacctgtcgcgcctgttccccaactccaagttcctgctgatggtgcgggacggccgggcctccgtgcactccatgatcacgcgcaaagtcaccattgcgggctttgacctcagcagctaccgtgactgcctcaccaagtggaacaaggccatcgaggtgatgtacgcccagtgcatggaggtaggcaaggagaagtgcctgcctgtgtactacgagcagctggtgctgcaccccaggcgctcactcaagctcatcctcgacttcctcggcatcgcctggagcgacgctgtcctccaccatgaagacctcattggcaagcccggtggtgtctccctgtccaagatcgagcggtccacggaccaggtcatcaagcctgttaacctggaagcgctctccaagtggactggccacatccctggggatgtggtgcgggacatggcccagatcgcccccatgctggctcagctcggctatgacccttatgcaaacccccccaactatggcaaccctgaccccttcgtcatcaacaacacacagcgggtcttgaaaggggactataaaacaccagccaatctgaaaggatattttcaggtgaaccagaacagcacctcctcccacttaggaagctcgtgatttccagatctccgcaaatgacttcattgccaagaagagaagaaaatgcatttaagtggaaatcggacctctaatccaagcatattgcttgctattaatcgccaaaacaggactgctgatgaggaatgtatttgcatatgtttgcaaaagctgaatcattgaaaacgtaccttgaaactctctatctctggacactccagggtagagaatgaagggtatggaagtagtccggcttttgaaacttaggtattttatatttttcccctcaagaacttttttttaagagacagatttgccatcctccttaatttgcaggactgccttggtggctttgtttgctgggacaaggcccacaacctgtgcctctcctattgacccttactttgaattcaaagaatctatttaagagtttaatatatgaggctttctttgattcctcctcagttctacctagtttcacagaggaaaaaaatactctttgaataaagtgaacagaggctcatttgtttgtgccttactttactgaatg

SEQ ID NO: 33379 - DNA, 544 bp, Homo sapiens
cttccccggctggggcggctggagagccgggagtcgctgggtgcgtggggctgcctcgccgcgtctcgccacgtgtggtttctatttgttggcgattttgctgtgtggtagagtcgtgctcaccctgcacccacgtgggcctttcttagcttaaaatggagaacatgccaccacctgcctgactgggctgatggctctgccagcagacagccttggcacacaggcacaagggctggagcccagagatgagagtgcccaagggagatgtgagcctggcgggctgcccgctaacctgtcgctgaagccccagaagcgggccctcaggccaggcctaccctgcctccggcccagcatgcgcctgtcggtgcggagggtgctgctggcagccggctgcgccctggtcctggtgctggcggttcagctgggacagcaggtgctagagtgccgggcggtgctggcgggcctgcggagcccccggggggccatgcggcctgagcaggaggagctggtgatggtgggcaccaaccacgtggaataccgctat

SEQ ID NO: 33380 - DNA, 586 bp, Homo sapiens
cttccccggctggggcggctggagagccgggagtcgctgggtgcgtggggctgcctcgccgcgtctcgccacgatgtgagcctggcgggctgcccgctaacctgtcgctgaagccccagaagcgggccctcaggccaggcctaccctgcctccggcccagcatgcgcctgtcggtgcggagggtgctgctggcagccggctgcgccctggtcctggtgctggcggttcagctgggacagcaggtgctagagtgccgggcggtgctggcgggcctgcggagcccccggggggccatgcggcctgagcaggaggagctggtgatggtgggcaccaaccacgtggaataccgctatggcaaggccatgccgctcatcttcgtgggtggcgtgcctcgcagtggcaccacgttgatgcgcgccatgctggacgcgcaccccgaggtgcgctgcggcgaggagacccgcatcatcccgcgcgtgctggccatgcgccaggcctggtccaagtctggccgtgagaagctgcggctggatgaggcgggggtgacggatgaggtgctggacgccgccatgcaggccttcatcct

SEQ ID NO: 33381 - DNA, 544 bp, Homo sapiens
cttccccggctggggcggctggagagccgggagtcgctgggtgcgtggggctgcctcgccgcgtctcgccacgggctctgccagcagacagccttggcacacaggcacaagggctggagcccagagatgagagtgcccaagggagaccctgaatcgagggtacaaatgaagccccaacctcttcagcagaacttcatcagcacgtttttctgaagagagggaaattatccaatgcacagagaggccggtgaccccagcctgagatccatctctggtttgtcagctgcttctcatattttcacagcagcctctgagatgtgagcctggcgggctgcccgctaacctgtcgctgaagccccagaagcgggccctcaggccaggcctaccctgcctccggcccagcatgcgcctgtcggtgcggagggtgctgctggcagccggctgcgccctggtcctggtgctggcggttcagctgggacagcaggtgctagagtgccgggcggtgctggcgggcctgcggagcccccggggggccatgcggcct

SEQ ID NO: 33382 - DNA, 514 bp, Homo sapiens
ttacttctgtaacatagctactggaaaactgagaatttgaagtgtgtctcacactgcatttctattgggtggcgctgttacaaactacaggaaggagctagaattctgtggaaggttttaggcaggggctgacatcctctggccaaaatgacaagagggaattccagagaccagggcaagtctggccacagggagactgcatggcctaggagacctgagccacagccgccaagagaagccctgattccccagagaggaggtgcccgctgccagtccacagatgtgagcctggcgggctgcccgctaacctgtcgctgaagccccagaagcgggccctcaggccaggcctaccctgcctccggcccagcatgcgcctgtcggtgcggagggtgctgctggcagccggctgcgccctggtcctggtgctggcggttcagctgggacagcaggtgctagagtgccgggcggtgctggcgggcctgcggagcccccggggggccatgcggcctgagca

SEQ ID NO: 33383 - DNA, 582 bp, Homo sapiens
attgcagggctgatggctgagcctgagcacgtgggcactgggccctgctccagggccactctggctctgccagcagacagccttggcacacaggcacaagggctggagcccagagatgagagtgcccaagggagatgtgagcctggcgggctgcccgctaacctgtcgctgaagccccagaagcgggccctcaggccaggcctaccctgcctccggcccagcatgcgcctgtcggtgcggagggtgctgctggcagccggctgcgccctggtcctggtgctggcggttcagctgggacagcaggtgctagagtgccgggcggtgctggcgggcctgcggagcccccggggggccatgcggcctgagcaggaggagctggtgatggtgggcaccaaccacgtggaataccgctatggcaaggccatgccgctcatcttcgtgggtggcgtgcctcgcagtggcaccacgttgatgcgcgccatgctggacgcgcaccccgaggtgcgctgcggcgaggagacccgcatcatcccgcgcgtgctggccatgcgccaggcctggtccaagtctggccgtgagaag

SEQ ID NO: 33384 - DNA, 1905 bp, Homo sapiens
agagccgggagtcgctgggtgcgtggggctgcctcgccgcgtctcgccacgggctctgccagcagacagccttggcacacaggcacaagggctggagcccagagatgagagtgcccaagggagaccctgaatcgagggtacaaatgaagccccaacctcttcagcagaacttcatcagcacgtttttctgaagagagggaaattatccaatgcacagagaggccggtgaccccagcctgagatccatctctggtttgtcagctgcttctcatattttcacagcagcctctgagatgtgagcctggcgggctgcccgctaacctgtcgctgaagccccagaagcgggccctcaggccaggcctaccctgcctccggcccagcatgcgcctgtcggtgcggagggtgctgctggcagccggctgcgccctggtcctggtgctggcggttcagctgggacagcaggtgctagagtgccgggcggtgctggcgggcctgcggagcccccggggggcaaggccatgccgctcatcttcgtgggtggcgtgcctcgcagtggcaccacgttgatgcgcgccatgctggacgcgcaccccgaggtgcgctgcggcgaggagacccgcatcatcccgcgcgtgctggccatgcgccaggcctggtccaagtctggccgtgagaagctgcggctggatgaggcgggggtgacggatgaggtgctggacgccgccatgcaggccttcatcctggaggtgattgccaagcacggagagccggcccgcgtgctctgcaacaaggacccatttacgctcaagtcctcggtctacctgtcgcgcctgttccccaactccaagttcctgctgatggtgcgggacggccgggcctccgtgcactccatgatcacgcgcaaagtcaccattgcgggctttgacctcagcagctaccgtgactgcctcaccaagtggaacaaggccatcgaggtgatgtacgcccagtgcatggaggtaggcaaggagaagtgcctgcctgtgtactacgagcagctggtgctgcaccccaggcgctcactcaagctcatcctcgacttcctcggcatcgcctggagcgacgctgtcctccaccatgaagacctcattggcaagcccggtggtgtctccctgtccaagatcgagcggtccacggaccaggtcatcaagcctgttaacctggaagcgctctccaagtggactggccacatccctggggatgtggtgcgggacatggcccagatcgcccccatgctggctcagctcggctatgacccttatgcaaacccccccaactatggcaaccctgaccccttcgtcatcaacaacacacagcgggtcttgaaaggggactataaaacaccagccaatctgaaaggatattttcaggtgaaccagaacagcacctcctcccacttaggaagctcgtgatttccagatctccgcaaatgacttcattgccaagaagagaagaaaatgcatttaagtggaaatcggacctctaatccaagcatattgcttgctattaatcgccaaaacaggactgctgatgaggaatgtatttgcatatgtttgcaaaagctgaatcattgaaaacgtaccttgaaactctctatctctggacactccagggtagagaatgaagggtatggaagtagtccggcttttgaaacttaggtattttatatttttcccctcaagaacttttttttaagagacagatttgccatcctccttaatttgcaggactgccttggtggctttgtttgctgggacaaggcccacaacctgtgcctctcctattgacccttactttgaattcaaagaatctatttaagagtttaatatatgaggctttctttgattcctcctcagttctacctag

SEQ ID NO: 33385 - DNA, 3238 bp, Homo sapiens
ctgtgctgtgcgctcctctcccggggaccaccgtcctcagatctccccagggaatgggtcgtcctcttcctgcccccacccgcgagacgcggcagaaaagcccgcggctatcttcccgccagcaacagcctcccgccgagccggccgggacagaggcggcccccacccccactgggcaggggactgcagacggcgctccccgactctcaagacgaccagggagcttcccttttcctcagcggggtgaggggcatctgtcgcccgccgacttggaggtggaggggcagggacattccctcgccatcacctcaggagctagaacgcgcccttctcgcagcagggcgtgggcctcccaatccctccaaggggcggacggcgtgcgcaaccccctggagaagcaacaggcgcccccatccccctccaagccgggtaacgccgaccccctcgtccctcccgctcttcacctccggaagccgggccaaagcctgggcgaacgactgcgcctcactccgccccctgcgccattttatcgccccctccccgacctcccctaccccgagtcagccgggccaacaccagggggagggcaaaccagcagtgattggcaggaaaccgtcccgcctctaggagggttgtgccccgctcaggcgcctcagccccgccctccgcaccgcccaccgtgcccactggctccaccttttcccgtctcatcgacctgctcgactctctgctgctcctcactttttccggccgctgccggaggggtccaggccgagtaagcggagcgccgagcccagctgatgcaacctggctggactcgcgtgacagttcccggcacgcggcggcgacggtgacccaggaaggggctctggtgccgggctgagcgggggaagcaggggtagcggagccatgggggacgctcccagccctgaagagaaactgcaccttatcacccggaacctgcaggaggttctgggggaagagaagctgaaggagatactgaaggagcgggaacttaaaatttactggggaacggcaaccacgggcaaaccacatgtggcttactttgtgcccatgtcaaagattgcagacttcttaaaggcagggtgtgaggtaacaattctgtttgcggacctccacgcatacctggataacatgaaagccccatgggaacttctagaactccgagtcagttactatgagaatgtgatcaaagcaatgctggagagcattggtgtgcccttggagaagctcaagttcatcaaaggcactgattaccagctcagcaaagagtacacactagatgtgtacagactctcctccgtggtcacacagcacgattccaagaaggctggagctgaggtggtaaagcaggtggagcaccctttgctgagtggcctcttataccccggactgcaggctttggatgaagagtatttaaaagtagatgcccaatttggaggcattgatcagagaaagattttcacctttgcagagaagtacctccctgcacttggctattcaaaacgggtccatctgatgaatcctatggttccaggattaacaggcagcaaaatgagctcttcagaagaggagtccaagattgatctccttgatcggaaggaggatgtgaagaaaaaactgaagaaggccttctgtgagccaggaaatgtggagaacaatggggttctgtccttcatcaagcatgtcctttttccccttaagtccgagtttgtgatcctacgagatgagaaatggggtggaaacaaaacctacacagcttacgtggacctggaaaaggactttgctgctgaggttgtacatcctggagacctgaagaattctgttgaagtcgcactgaacaagttgctggatccaatccgggaaaagtttaatacccctgccctgaaaaaactggccagcgctgcctacccagatccctcaaagcagaagccaatggccaaaggccctgccaagaattcagaaccagaggaggtcatcccatcccggctggatatccgtgtggggaaaatcatcactgtggagaagcacccagatgcagacagcctgtatgtagagaagattgacgtgggggaagctgaaccacggactgtggtgagcggcctggtacagttcgtgcccaaggaggaactgcaggacaggctggtagtggtgctgtgcaacctgaaaccccagaagatgagaggagtcgagtcccaaggcatgcttctgtgtgcttctatagaagggataaaccgccaggttgaacctctggaccctccggcaggctctgctcctggtgagcacgtgtttgtgaagggctatgaaaagggccaaccagatgaggagctcaagcccaagaagaaagtcttcgagaagttgcaggctgacttcaaaatttctgaggagtgcatcgcacagtggaagcaaaccaacttcatgaccaagctgggctccatttcctgtaaatcgctgaaaggggggaacattagctagccagcccagcatcttccccccttcttccaccactgagtcatctgctgtctcttcagtctgctccatccatcacccatttacccatctctcaggacacggaagcagcgggtttggactctttattcggtgcagaactcggcaaggggcagcttaccctccccagaacccaggatcatcctgtctggctgcagtgagagaccaacccctaacaagggctgggccacagcagggagtccagccctaccttcttcccttggcagctggagaaatctggtttcaatataactcatttaaaaatttatgccacagtccttataattggaaaaatactggtgcccaggttttcttggagttatccaagcagctgcgcccctagctgggatctggtacctggactaggctaattacagcttctccccaacaggaaactgtgggatttgaaaaggaaagggaagggaaaacagagaacctagtggtctaccaagtggttggcaactttcccaatgtctgcttactctgaggcttggcactgggggccagggcctgccccagggctcctggaatttcccttgatccagctaggctgggacactccctaaatcagctgcgtgttgttagcatcaggcagaatgaatggcagagagtgattctgtcttcatagagggtggggtacttctccataaggcatctcagtcaaatccccatcactgtcataaattcaaataaaatgtctgaacaaggg

SEQ ID NO: 33386 - DNA, 2122 bp, Homo sapiens
ccagcattcccttcgtgccgctaccaagatggcggcgcccatcttgcggtccttttcctggggccggtggtctggtaccctaaatctctcagtattgttgcccttggggctgcgtaaggcccactcgggcgctcaggggttactggcagcgcagaaggctcgaggtctgttcaaggacttcttcccggagacggggacgaaaatagagctcccagagctcttcgaccgtggcacggcgagttttccccaaaccatttactgtggcttcgaccccacggcagactcgcttcatgtgggtcatctacttgcgctgctgggcctgtttcatttgcagcgagcgggccacaacgtgatcgcgctggtgggaggcgccacggcgcgcctgggagacccgagcggccgtaccaaggaacgcgaggcgctggagacagagcgcgtgcgagccaacgcgcgagctctgcgcctagggcttgaggccctggcggctaatcaccagcagcttttcactgatgggcgctcctggggcagcttcactgtgctggacaactcggcctggtaccagaagcagcacctggtggacttcctggcggcagtggggggtcacttccgcatggggacgctgctgagccggcagagcgtgcagctgcggctcaagagccccgagggcatgagcttggccgagttcttttaccaggtgctccaggcctatgacttctattacctcttccagcgttatggatgcagggtccagctgggcggatctgatcaactaggcaacatcatgtccggatatgagttcatcaacaagttgactggagaagatgtatttggaatcaccgttcctctaattacaagtacaactggagcaaagctgggaaagtctgctggcaacgctgtttggctaaacagagataagacatctccatttgaattgtatcaattctttgtcaggcaaccggacgattcagtggaaaggtacctgaagctgttcactttcctgccccttccagagattgatcatatcatgcagctgcatgtcaaagagccagaaaggcggggtcctcagaaacgactggcagcagaagtaacaaagcttgttcatggacgagaaggattggattctgctaaaaggtgtacacaagccctttatcacagtagcatagatgcactggaggtcatgtctgatcaggagttaaaagagttgtttaaagaagctccattttctgaattttttctcgatcctggaacaagtgtcctagatacttgccgcaaagcaaatgccattccagatggtccccgagggtatcgaatgataacagaaggcggagtcagcataaatcaccaacaagtaacaaatcctgagagtgttttaattgttggacaacatattctcaagaatggactttccttacttaaaataggaaaaagaaatttctacattataaaatggcttcagttgtgatgaaaagtccttctggttgtccaaataaacttacccatcattcattctcaagacctctgaagggttggctccagaacttagacctttgcttatgcaaatcagaaaaacagaatggactaggactcagtgtgagtaacttcattatttttatgggccggttaataaatatttgtttaataatgggatgttttattttctgatgtacaaagcttgattaccatagaaaaccatgattttcagggttaatctctttttaaaattatacttcagaagagaaagaaatgctgctttcctatcttacccttcctgctctcctttttgtagtgatgaggaacaatgaaaaagaggtagtgtaaggaattgtgaggctgggcatggtggctcacacctgtaatcccagcacttcgggaggccaaggtgggcaaatcgcttgaggccaggagtttgagaccagcctggccaacagggcgaaaccccgtctctactgaaaatataaaaattagccagatgtggttgcaggcacctgtaaccccagctactcaagaggctgagctgcgagaatcacttgaacccaggagatggaggttgcagtgagctgagatcacgccactgcactccagcctgggagacagcatgagtagtgagtgaaactctgtctca

SEQ ID NO: 33387 - DNA, 962 bp, Homo sapiens
cgtcgtcgcgtccgggtgacgtctcccgagggcgtcggcagggtcggcggcgtcggcagcagtgtcgacggcagcggcggcggcgggtgggaaatggcggagtatctggcctccatcttcggcaccgagaaagacaaagtcaactgttcattttatttcaaaattggagcatgtcgtcatggagacaggtgctctcggttgcacaataaaccgacgtttagccagaccattgccctcttgaacatttaccgtaaccctcaaaactcttcccagtctgctgacggtttgcgctgtgccgtgagcgatgtggagatgcaggaacactatgatgagttttttgaggaggtttttacagaaatggaggagaagtatggggaagtagaggagatgaacgtctgtgacaacctgggagaccacctggtggggaacgtgtacgtcaagtttcgccgtgaggaagatgcggaaaaggctgtgattgacttgaataaccgttggtttaatggacagccgatccacgccgagctgtcacccgtgacggacttcagagaagcctgctgccgtcagtatgagatgggagaatgcacacgaggcggcttctgcaacttcatgcatttgaagcccatttccagagagctgcggcgggagctgtatggccgccgtcgcaagaagcatagatcaagatcccgatcccgggagcgtcgttctcggtctagagaccgtggtcgtggcggtggcggtggcggtggtggaggtggcggcggacgggagcgtgacaggaggcggtcgagagatcgtgaaagatctgggcgattctgagccatgccatttttaccttatgtctgctagaaagtgttgtagttgattgaccaaaccagttcataaggggaattttttttaaaaaacaacaaaaaaaaaaacatacaaagatgggtttctgaataaaatttgtagtgataacagta

SEQ ID NO: 33388 - DNA, 940 bp, Homo sapiens
ctcccgagggcgtcggcagggtcggcggcgtcggcagcagtgtcgacggcagcggcggcggcgggtgggaaatggcggagtatctggcctccatcttcggcaccgagaaagacaaagtcaactgttcattttatttcaaaattggagcatgtcgtcatggagacaggtgctctcggttgcacaataaaccgacgtttagccagaccatcttgattcaaaacatctatcgtaatccccaaaacagtgcacagacggctgacggctcacactgtgccgtgagcgatgtggagatgcaggaacactatgatgagttttttgaggaggtttttacagaaatggaggagaagtatggggaagtagaggagatgaacgtctgtgacaacctgggagaccacctggtggggaacgtgtacgtcaagtttcgccgtgaggaagatgcggaaaaggctgtgattgacttgaataaccgttggtttaatggacagccgatccacgccgagctgtcacccgtgacggacttcagagaagcctgctgccgtcagtatgagatgggagaatgcacacgaggcggcttctgcaacttcatgcatttgaagcccatttccagagagctgcggcgggagctgtatggccgccgtcgcaagaagcatagatcaagatcccgatcccgggagcgtcgttctcggtctagagaccgtggtcgtggcggtggcggtggcggtggtggaggtggcggcggacgggagcgtgacaggaggcggtcgagagatcgtgaaagatctgggcgattctgagccatgccatttttaccttatgtctgctagaaagtgttgtagttgattgaccaaaccagttcataaggggaattttttttaaaaaacaacaaaaaaaaaaacatacaaagatgggtttctgaataaaatttgtagtgataacagta

SEQ ID NO: 33389 - DNA, 1019 bp, Homo sapiens
gtccgggtgacgtctcccgagggcgtcggcagggtcggcggcgtcggcagcagtgtcgacggcagcggcggcggcgggtgggaaatggcggagtatctggcctccatcttcggcaccgagaaagacaaagtcaactgttcattttatttcaaaattggagcatgtcgtcatggagacaggtgctctcggttgcacaataaaccgacgtttagccagaccatcttgattcaaaacatctatcgtaatccccaaaacagtgcacagacggctgacggctcacactaccattgccctcttgaacatttaccgtaaccctcaaaactcttcccagtctgctgacggtttgcgctgtgccgtgagcgatgtggagatgcaggaacactatgatgagttttttgaggaggtttttacagaaatggaggagaagtatggggaagtagaggagatgaacgtctgtgacaacctgggagaccacctggtggggaacgtgtacgtcaagtttcgccgtgaggaagatgcggaaaaggctgtgattgacttgaataaccgttggtttaatggacagccgatccacgccgagctgtcacccgtgacggacttcagagaagcctgctgccgtcagtatgagatgggagaatgcacacgaggcggcttctgcaacttcatgcatttgaagcccatttccagagagctgcggcgggagctgtatggccgccgtcgcaagaagcatagatcaagatcccgatcccgggagcgtcgttctcggtctagagaccgtggtcgtggcggtggcggtggcggtggtggaggtggcggcggacgggagcgtgacaggaggcggtcgagagatcgtgaaagatctgggcgattctgagccatgccatttttaccttatgtctgctagaaagtgttgtagttgattgaccaaaccagttcataaggggaattttttttaaaaaacaacaaaaaaaaaaacatacaaagatgggtttctgaataaaatttgtagtgataacagt

SEQ ID NO: 33390 - DNA, 1675 bp, Homo sapiens
ccctccctgacattgctggcacacaggcatgattgctggttccattggatatggatctggattgtcagcgtatttgaacagtattaagggagggttttgcagtagagacagaaggtgacgtaaggtggttcctaaggtgggttcggtcagtcccctaatagtttgttttcagtgtattgagaccaggagaattgatttacttcagacctattttttgaaactccctgttggtctggtgtcatgcgtttagagagactctgaacttcgttttctgttttccttagataatgatagcacttcatgagcaccatatgtgaagcacacatacgttctgtctgactctcagaacagtgccacattggcattgtcatcatttacagatgacatctgagagctagggtgacttgcccaagcccaagcagctggtagcagagttgggatcttaaccctcaccacaccggtgttttcaagagagaacttggtcgtggagaactggagaacagatactgcctaagttacatttagttttagactaatttaatactccatttaagaaacaaacagaacagctgtgcagttaggaaagtggaggggatttgaatgaggaggaggcgggttagagttagaaccgtctttgctgaacaagtagtgtgtttgcagaaagggaagttgaagttacgttgtcctaaaatacagcaaggaagaggaggtgcttaataccacggaaaaaagtctgtgtcatgtttctgtgaggttaaaagtaatttgatagtgtatgtcatgctgctgacatattccatgtgtttgatatcttcccagcaaaataatcagctctcattttcccttacagagtcaactgttcattttatttcaaaattggagcatgtcgtcatggagacaggtgctctcggttgcacaataaaccgacgtttagccagaccattgccctcttgaacatttaccgtaaccctcaaaactcttcccagtctgctgacggtttgcgctgtgccgtgagcgatgtggagatgcaggaacactatgatgagttttttgaggaggtttttacagaaatggaggagaagtatggggaagtagaggagatgaacgtctgtgacaacctgggagaccacctggtggggaacgtgtacgtcaagtttcgccgtgaggaagatgcggaaaaggctgtgattgacttgaataaccgttggtttaatggacagccgatccacgccgagctgtcacccgtgacggacttcagagaagcctgctgccgtcagtatgagatgggagaatgcacacgaggcggcttctgcaacttcatgcatttgaagcccatttccagagagctgcggcgggagctgtatggccgccgtcgcaagaagcatagatcaagatcccgatcccgggagcgtcgttctcggtctagagaccgtggtcgtggcggtggcggtggcggtggtggaggtggcggcggacgggagcgtgacaggaggcggtcgagagatcgtgaaagatctgggcgattctgagccatgccatttttaccttatgtctgctagaaagtgttgtagttgattgaccaaaccagttcataaggggaattttttttaaaaaacaacaaaaaaaaaaacatacaaagatgggtttctgaataaaatttgtagtgataacagta

SEQ ID NO: 33391 - DNA, 1867 bp, Homo sapiens
ccgcgacggcgcgcccccggcggctgctgcggcggcgggagcgaggcgaccgctgaggccgcggagagtgacggcggcccggccgacgggagccggggcggggcggcggcccagcgaaggagcgcgcgggcggtctggccccgccccctccccgcccgccttcccggtgaccttcaggggcccgggtggcgggcgcaggcccctgcggcggcggcgggatgttcgtgcaggaggagaagatcttcgcgggcaaggtgctgcggctgcacatctgcgcgtccgacggcgccgagtggctggaggaggccaccgaggacacctcggtggagaagctcaaggagcgctgcctcaagcactgtgctcatgggagcttagaagatcccaaaagtataacccatcataaattaatccacgctgcctcagagagggtgctgagtgatgccaggaccatcctggaagagaacatccaggaccaagatgtcctattattgataaaaaagcgtgctccatcaccacttcccaagatggctgatgtctcagcagaagaaaagaaaaaacaagaccagaaagctccagataaagaggccatactgcgggccaccgccaacctgccctcctacaacatggaccgggccgcggtccagaccaacatgagagacttccagacagaactccggaagatactggtgtctctcatcgaggtggcgcagaagctgttagcgctgaacccagatgcagtggaattgtttaagaaggcgaatgcaatgctggacgaggacgaggatgagcgtgtggacgaggctgccctgcggcagctcacggagatgggctttccggagaacagagccaccaaggcccttcagctgaaccacatgtcggtgcctcaggccatggagtggctaattgaacacgcagaagacccgaccatagacacgcctcttcctggccaagctcccccagaggccgagggggccacagcagctgcctccgaggctgccgcgggagccagcgccaccgatgaggaggccagagatgagctgacggaaatcttcaagaagatccggaggaaaagggagtttcgggctgatgctcgggccgtcatttccctgatggagatggggttcgacgagaaagaggtgatagatgccctcagagtgaacaacaaccagcagaatgccgcgtgcgagtggctgctgggggaccggaagccctctccggaggagctggacaagggcatcgaccccgacagtcctctctttcaggccatcctggataacccggtggtgcagctgggcctgaccaacccgaaaacattgctagcatttgaagacatgctggagaacccactgaacagcacccagtggatgaatgatccagaaacggggcctgtcatgctgcagatctctagaatcttccagacactaaatcgcacgtaggtggcgttgttccactcggctatcaggccacagcagccccctggtgcggcccgagaccgggcagagtggacctcacctggaaactcaccttcagcgcctcagccctggactgttagaggtgctgcagctgctcctgctctctgatcttattgcttataaactttggtgacggtagtgtgtaaggccgtatttttagcatctgacaggtgtttacaaaaaagtggttgtcgcactgggaagtggagtgatggcctcgtctccagtgctcctctgggctcttgagttgctgcttgaattgccgtgtagacatttgcttggagagtccacttgttatttgacggaggtaggtttcaacccagagttaatgtcaagcatgctaatttaactagtcactcacagatgacttttctttaataaagtcccttttccta

SEQ ID NO: 33392 - DNA, 716 bp, Homo sapiens
ttccatggcggcctctcaggtcctgggggagaagattaacatcctgtcgggagagactgtcaaagctggggacagggacccgctggggaacgactgtcccgagcaagataggctcccccagcgctcctggaggcagaagtgtgcctcctacgtgttggccctgaggccctggagcttcagtgcctcactcacaccggtggccctgggcagtgcccttgcctacagatcccacggtgtcctggatcccaggctcttggtgggttgtgccgtggctgtcctggctgtgcacggggccggtaatttggtcaacacttactatgacttttccaagggcattgaccacaaaaagagtgatgacaggacacttgtggaccgaatcttggagccgcaggatgtcgtccggttcggagtcttcctctacacgttgggctgcgtctgtgccgcttgcctctactacctgtcccctctgaaactggagcacttggctcttatctactttggaggcctgtctggctcctttctctacacaggagtcctcatctagccactgaagcagagtgcccacatcaggagcagccagtgctcaagctcccagaaactgcctagtgacctgccttctagacctgcctcctgagaatggggctggccaccttcgaggagagggaagtgagccccttcctgcctcggggtgggcagcatctggagctgacaattgt

SEQ ID NO: 33393 - DNA, 3646 bp, Homo sapiens
gcgggcctccagaggccggcgcacaagatggcggctctggcggcctaaagaaggcggccgcggctcagccgtgggctctaacgcggggctgggggccggagacagacttcgcccaggtgacgggtagtaggggcggcgccgcttggcctcgtggggtgtaagacccacttgctgttgcccccggaccttgccgccacaccagccctgtcctggggcggaaccgaaggaaggtcgggccctgctgccccgccccgtccttcctccttcccgggcggtcactgtgcgtggctcacttttagagtttacttcaaccacgtggagcttccatggcggcctctcaggtcctgggggagaagattaacatcctgtcgggagagactgtcaaagctggggacagggacccgctggggaacgactgtcccgagcaagataggctcccccagcgctcctggaggcagaagtgtgcctcctacgtgttggccctgaggccctggagcttcagtgcctcactcacaccggtggccctgggcagtgcccttgcctacagatcccacggtgtcctggatcccaggctcttggtgggttgtgccgtggctgtcctggctgtgcacggggccggtaatttggtcaacacttactatgacttttccaagggcattgaccacaaaaagagtgatgacaggacacttgtggaccgaatcttggagccgcaggatgtcgtccggttcggagtcttcctctacacgttgggctgcgtctgtgccgcttgcctctactacctgtcccctctgaaactggagcacttggctcttatctactttggaggcctgtctggctcctttctctacacaggaggaattggattcaagtacgtggctctgggagacctcatcatcctcatcacttttggcccgctggctgtgatgttcgcctacgccatccaggtggggtccctggccatcttcccactggtctatgccatccccctcgccctcagcaccgaggccattctccattccaacaacaccagggacatggagtccgaccgggaggctggtatcgtcacgctggccatcctcatcggccccacgttctcctacattctctacaacacactgctcttcctgccctacctggtcttcagcatcctggccacacactgcaccatcagcctggcactccccctgcttaccattcccatggccttctcccttgagagacagtttcgaagccaggccttcaacaaactgccccagaggactgccaagctcaacctcctgctgggacttttctatgtctttggcatcattctggcaccagcaggcagtctgcccaaaatttaaggggacaagtagctccccccacgacatgtctccctttcttagaatatattaaagtcagagtctctgaggaaggaatgtgatttggcagtcagggtactaagcatgggtgggaactcctgccttataaaaattgtttttgtgttcttaaagataatatgttgtttttctgttttttgttttttccattttatggggaatttaaaaaccattcttgtatcagaaggtgaattaggcgcatggtctttgttttattaataatttccactagagggtgttctcaggtcactttgcagtgaagtggacttagttcctccttgttctgtacaaaatgtctccagactttgtaaaggagctgcccagtttggcctcctgtcccgaaaagaccctaataactaggcagagtgttgtcctgctttcttcgtctcgtaggatgtgctatgattggtgccaggcctcactaacacaggggctacctgtctcttattctcagcacctgtgtcctgagatacgctgcctgagacagagagagtccctcattaacagcctgtgtggctgtcagctttttgcctaaattgtgattcagatgcttttgttctctctcctttcacttattgccacagttgaggaaaagtgtcagattaccctgcagcaagacaagccaaggactgggagggaaaaaaaaaccactctggaggcaactgagaaaatcactgcttttggataggaatcagtagggtggctgttttccctttgttgaatctactagagtgacaggaaggactcccagccctttcagtaactatcaggagccctgaaacggtagaggcactgccatccttgtgggatactcaaagcccacagggcttttccctccctattgcatcttctgatgctccccacacctaccctccacctctccacctctgtggtgttcccatttgtgtgtttcccatctgtggagccagactgagcaatagcttagcagcgagtcagggacagctgccactttccacagagccacaggatgggcagagcagggacccagggaatgaatagccagtggacaaacagtcttgagctctgttcagccagagtgatgggccctgccagttaaggggctgtgtcttcatccttgaagacagatgtgcaatattgaccctgcctctccccagggctttgtggaaagatagttgagggctttagtgagatcacactcagagtggggcaattccagcatttatcctggctgcgtttcattgcattgtctgtgaagtataatttctgggccagaattgctcagttgcatttgatccaggactatagattggaaatgggtcatcattgttttctgttgtgattatagccattctagtaggcgtttaaggtcatggcctgcagaaaatgatgtaagaactagttcttaatctttcagatcaagctaatgatgatatggaaccttgagttcgaattgattggtttacttggaaaaaaacatgtttgaaaattgcaaaagttccgccgggcgcggtggctcatgcctgtaatcccagcactttgggaggccgagacgggcggatcacgaggtcaggagatcgagaccatcttggctaacacggtgaaaccccgtttctactaaaaatacaaaaaattagccaggcgtgttggcgggcgcctgtagtcccagctacctgggcggctgaggcaggagcatggcgtgaacccaggaggcggagcttgcagtgagctgagatcatgccactgcactccaacctgggggacacagcaagactccgtctcaaaaaaaaaaaaagaaaaagaaaattgcaaaagttcctctaaagttaaatcaaaggtggtttgtctagcagagagccagaatcttctaatagtgggcagagcccagagacaaggggaagaaagatgaccttctccccagtccttcccagcaccatttttgtttcacaccaggcttgtggcattttggtgctcacaggggttttgccttctgacctctccttggagtaggccattctcatgcagggctcaccctgaggcaggaggaccaagggctccctgcgtccacggaccacgtatgccttggtggtcactcccatcggggctatcagttctgcactgtgccctggtgcggattttaatgcatatttttatatataaatgttcccaaaggccaaatttgttgccaggttttatacgcaggtcaccataatttgtattatgttccctgagtcaatgaaggttttctttagacttcttaattaaaaagagaagaaagaaaatgttca

SEQ ID NO: 33394 - DNA, 5972 bp, Homo sapiens
gtcccgcgccgcaagttctcctggggcgaccggaggctgctcccccgaccccctggtgtccccggagtggctgcgcggacgtcgagttggcatttcttcgcttcctcctgggccggcgcgcggcgcggcacaccaggctcccctgggctcggggacccggccatgggccgaggcgcgggccgcccgcccgctgggagccacggcttagcagccgaccgctagctgcgccgccgcccggggaccggcatgaggaccgccgcggggggacgtctgcggcccgcgtcggcgctggggacaaagaagccatgcagtgacacccgctaagacttgttggtagccatgtcggagccccacagggtccagttcacctctctcccaggttccctgaatcctgcgtttttgaagaagtcccggaaggaggaggctggggcaggagaacagcatcaggactgtgagccggctgcagcagctgttcggattacactcaccctctttgaaccagatcacaaacgctgcccagagttcttctacccagagctggtgaagaatatccgagggaaggtaaaaggccttcagcctggagataagaagaaagatctgtcagatcctttcaatgacgaagaaaaggaaaggcataaagtagaggcccttgcccgaaaatttgaagaaaaatacggtggaaagaaacgtagaaaagaccgaatacaggacttgatcgatatggggtatggttatgatgaatccgactccttcatcgataactctgaggcgtatgatgagcttgttcctgcttctttgactacgaagtatggaggattttacattaactcgggaaccctgcagtttagacaagcatcagagtctgaagatgacttcattaaagaaaagaagaaaaaatctccaaagaagcggaagttgaaggaaggtggtgagaagataaagaagaagaaaaaagatgacacttatgacaaggagaagaaatcgaaaaagtccaagttttccaaagccggcttcacagccctcaatgccagtaaggagaagaagaagaagaaatattctggggctttaagcgttaaagagatgctaaagaaatttcagaaagagaaagaggctcagaaaaaaagggaggaggagcataagcctgttgcggtcccatcagcggaagctcagggcctgcgggaactggagggtgcctctgaccccttgctctcactctttggctctacttctgacaacgacttgctccaggcggccactgccatggactcgctgacggatttggacttggagcatctgctcagtgagtctccagaaggaagtcccttccgagatatggatgatggaagtgattcccttggggtgggattggaccaggaattcaggcagccctcttctctccccgaaggcctgccagcacccctggagaagcgcgttaaggagctggctcaggctgccagagctgctgagggggagagcagacagaagttcttcacccaggatattaatggaatcctattagacatagaggcgcagactcgggagctgagcagtcaggtccgctctggggtgtatgcctatcttgcgtcattcctgccctgcagcaaggatgccctgctcaagcgtgctcggaaacttcacctctatgaacaggggggccgtctgaaggagcctctccagaagctcaaggaagccattggcagggcgatgccagagcagatggccaagtaccaggacgaatgccaggcacacacgcaggcaaaggttgccaagatgctggaagaggagaaagacaaggagcagagggaccggatttgttcggatgaggaagaagatgaagaaaaagggggcaggaggataatgggacctcggaagaagttccaatggaatgatgagatcagggagctactgtgccaggtggtgaagatcaaactggagagccaggacctggagaggaacaacaaagcccaggcttgggaggactgtgtgaagggctttctggatgcggaagtcaagcccctctggcccaaaggctggatgcaggccagaactctgtttaaggagagcagacgaggccatgggcacctgacttcaatcctggccaagaagaaagttatggccccttctaaaatcaaggtgaaggaatcgtctacgaagcctgataaaaaggtttctgtcccatcaggacagattggtggccccattgctttgccctcagatcaccaaacaggaggcctgagtattggggcctcgagcagggagctcccatcccaggcatcgggcggccttgctaaccctcctcctgtcaacctggaggactcattggatgaagacttgatccgcaatccagcctcctcggtggaagccgtgtccaaggaattggctgcattgaatagcagagcagctgggaactctgaattcacactgcctgcaccctcaaaagcacctgcagaaaaagttggaggcgttttatgtacagaagaaaaaaggaactttgcgaagcctagtccttctgctccaccaccagctagctctctgcagtcacccctcaattttctggcagaacaggctctggcactggggcagtcctctcaggagaaaaaaccagagagttctggctacaaagagctgtcctgccaggctcccctcaataagggcctgccagaagtacatcagtccaaagctaagcaccacagcttgccacggacgtctcacgggccccaagtggcagttcctgtgcctggcccccaggtcaaagtctttcatgccggcactcagcagcagaaaaacttcacgcccccatctccatttgccaataagctccaaggcccaaaggcttctcccacacagtgtcatcgttccctcctgcagttagtgaagacagcggccaaaggccagggcttccatccctctgcaccagccacctcaggaggcctgtcagcctccagcagcagctctcacaagaccccagcctcgtcctcttctgccctgagccatccagcaaagccacattcagtcagctctgcaggctcatcttacaagaataatccctttgccagctcaatctccaaacatggggtttcttctggcagctcttcctcgggaggaacaccagtccagagttctgtttctgggagcctggtccctggcatacagcctccctccgtgggacaggccaccagccgacccgtcccaagttcagcagggaaaaaaatgcctgtttcccagaagttgactctggtagcccctccaggcggtccaaacggagattccagtggtgggacccagggagtggcaaagttgctgacctcgccgtccctaaagccctctgcagttagtagtgtgacatcgtctacctccttgtcaaaaggagcgagtgggactgtgctgctggccggctcctctttgatggcttcaccctacaaatccagcagcccaaagctgtctggggccatgagctcgaactccttgggaattataacccctgtccctattcctgtccatgtgctctccttcagcgctgactcctctgccaaagcaggggtctccaaggatgccatcgtcacaggccctgcccccgggtccttccaccatggccttggccacagtcttctggctggcttgcactccagcccgccccatgcagcgcctctcccacacgctgcggtgcccacccatatcccgcagagtctgccaggtgcttctcagcttcacgggaaagggcctgctgtaccacggaaattgtgaccgcttcagaggcaaggcttgccacttgggtctgggtggaatcagaacgtgcaggtctcccaggatgtacactcactgcgccctttctgctgcttggtgttcttctggaggagcgtgagttctcagcggagcgcttctcggcacttctgatgtgcctcccatggagggagccgggcccttgctgctcaggaggtgcagactgccccgtgctctgggccttgcagctctgtcgctagacggttgttagaggggcagctctaggctggggcttgcgctgggccgtggtgggaggcacagtgtttacaggctctggtggcagagcagttggcacacctgtgggtgaatctgcctgatcccctggcatttggtcagagtacctcagagcaccccactgctcaggggctccttctggctgcagtaagctccctggatggtcacagtgccgccccatccccaggctgtgtgctcaaagcggacaaaactcaggccagagccacagctgggagacctgcactgtccctgcgaaatactaagaacacctagggtgtgctcactgtgggggccagtttctcctcggaacatgacaatgaagctcttttagagaaaagacctttgtagattcaacaattatgataggatttttacagacacctattttgggctcagttttcatcattaccattaaatgcattggatagaaggggactgttcttcacacatcatattataggaagacataattccagtgcctttatggtggagcagaattcgacaacacatgtccattcagccctctgaatggatctgagacgaagacctttttaaagatatgtctgtattgaagagaaagccagttttgagttttttacacttgcacatcattatctgtgccgtcctgactagaaggttgtctgggcccccaaattccaagtcccagtatagccagggctcccattttgtttttccagagttcgtggaggtggactgcagagcccagagcccttcatctctctgagggtcaaggataccaggggtcccaagtcacagatagacattccagtttgtattcttaggaatcattcttaggcagtgcggcagaagcaggcctctgtgaagtgtctgccgggtagaaataggccttgaagtcctggggctctccaggcagtggggttatgtgtcgactgaagggtgatgtgcagaagagcttggagagtggatcagagagactaggacagttactgcagagctcctaagtcaccactcaaccagtggctgtttcacaaggatttgagggcacttgcctgtcttgtgaggtctgtgccacaaggtgagtctgaactgactgctccagctaagtgatcaggcacgttgagagtatacggtgtcctcagcacatacacctgtgggaaaacggaccgctcttggctcctgactcccagggtacagcgcccagtaactcatccttcattcagaggtttgctggccttcccggtttcccaaggagcaagacctctgtccgccctttggcccggcctctgctctgtctcctttttttacataagaaccaatccgtgtttcacattgggctaagtggattccttatccctttgttatatatattttttgcaacttggatttccagtttgtttacagagtagtcttaggtagtagcaaaagagccaaagaagagatttgtattgctgagctcaaagccaagcagaggccggcagtggaggctgagcagggactctccaggcttctctgcccataaacacccgggtcccaggccctccttcctttccctttggtgctccctcctccccacgtaccattgcgcgtgcagctggagcagaataccctcatttttaggaatctagtgatgcctcttgcctcagggaaacgtttctttgatggggagtttgagatttcttttccttgtttatgctttatttgtggtaatgaaagagcgaatgactgaacagccatggcaaggcagacctacaggcgaggccgcagcagagggtggggcagagcagcctcggggtctgggggctgcaggggtttccctggcgcagcgaaagtctctgagcacttaccgggcgtgaccgtttcttaggtgtgagaggggctgtggcttttgtgcagcgactatgttggtgttaggggtggtgtggagattgttaatcttgtataaagcaattcaataaattgtttcaaggtttccaaaa

SEQ ID NO: 33395 - DNA, 6336 bp, Homo sapiens
ttctgtgaacatttggaattctgtattcaaaatctattttgaccattcccaagtgattttgaaggtctttggcatgtcataatttgttattttgtcaaggccagtgtttgggtgtgagagtggtgcacagggcaggagtgtgtaactttgttaggaagtgagcctagccacaccctcctgagtcactggttctttactatcctggggtaggcaatatcttttgttcagctgataaaagctttgtcattgtgaagattggctcccaatgataggaaactgctggtgatgaaaataaaggggtcttaaagattattctcagccagaaaaaataagtgttagacaaattaaatggaaaataattaatattttagtagtctttacaatttggaggtctaaggctctgtcagcatgggttctttaaggtcaaggatctaggatacacatgcacaggaaaaaagactggaagtatgctaagcagtgactatctctgaatgattgtgaaaaaattttaggatgaataagcagaaaaaaacaataaatgacaaaatataacaatggagttttcttgacaatgaaattctcttaaacttaaatctctttaattaggcaggtaaactattttatcatcttcgtttgacctggcccttcttttcaatgttaacagaagccatgcagtgacacccgctaagacttgttggtagccatgtcggagccccacagggtccagttcacctctctcccaggttccctgaatcctgcgtttttgaagaagtcccggaaggaggaggctggggcaggagaacagcatcaggactgtgagccggctgcagcagctgttcggattacactcaccctctttgaaccagatcacaaacgctgcccagagttcttctacccagagctggtgaagaatatccgagggaaggtaaaaggccttcagcctggagataagaagaaagatctgtcagatcctttcaatgacgaagaaaaggaaaggcataaagtagaggcccttgcccgaaaatttgaagaaaaatacggtggaaagaaacgtagaaaagaccgaatacaggacttgatcgatatggggtatggttatgatgaatccgactccttcatcgataactctgaggcgtatgatgagcttgttcctgcttctttgactacgaagtatggaggattttacattaactcgggaaccctgcagtttagacaagcatcagagtctgaagatgacttcattaaagaaaagaagaaaaaatctccaaagaagcggaagttgaaggaaggtggtgagaagataaagaagaagaaaaaagatgacacttatgacaaggagaagaaatcgaaaaagtccaagttttccaaagccggcttcacagccctcaatgccagtaaggagaagaagaagaagaaatattctggggctttaagcgttaaagagatgctaaagaaatttcagaaagagaaagaggctcagaaaaaaagggaggaggagcataagcctgttgcggtcccatcagcggaagctcagggcctgcgggaactggagggtgcctctgaccccttgctctcactctttggctctacttctgacaacgacttgctccaggcggccactgccatggactcgctgacggatttggacttggagcatctgctcagtgagtctccagaaggaagtcccttccgagatatggatgatggaagtgattcccttggggtgggattggaccaggaattcaggcagccctcttctctccccgaaggcctgccagcacccctggagaagcgcgttaaggagctggctcaggctgccagagctgctgagggggagagcagacagaagttcttcacccaggatattaatggaatcctattagacatagaggcgcagactcgggagctgagcagtcaggtccgctctggggtgtatgcctatcttgcgtcattcctgccctgcagcaaggatgccctgctcaagcgtgctcggaaacttcacctctatgaacaggggggccgtctgaaggagcctctccagaagctcaaggaagccattggcagggcgatgccagagcagatggccaagtaccaggacgaatgccaggcacacacgcaggcaaaggttgccaagatgctggaagaggagaaagacaaggagcagagggaccggatttgttcggatgaggaagaagatgaagaaaaagggggcaggaggataatgggacctcggaagaagttccaatggaatgatgagatcagggagctactgtgccaggtggtgaagatcaaactggagagccaggacctggagaggaacaacaaagcccaggcttgggaggactgtgtgaagggctttctggatgcggaagtcaagcccctctggcccaaaggctggatgcaggccagaactctgtttaaggagagcagacgaggccatgggcacctgacttcaatcctggccaagaagaaagttatggccccttctaaaatcaaggtgaaggaatcgtctacgaagcctgataaaaaggtttctgtcccatcaggacagattggtggccccattgctttgccctcagatcaccaaacaggaggcctgagtattggggcctcgagcagggagctcccatcccaggcatcgggcggccttgctaaccctcctcctgtcaacctggaggactcattggatgaagacttgatccgcaatccagcctcctcggtggaagccgtgtccaaggaattggctgcattgaatagcagagcagctgggaactctgaattcacactgcctgcaccctcaaaagcacctgcagaaaaagttggaggcgttttatgtacagaagaaaaaaggaactttgcgaagcctagtccttctgctccaccaccagctagctctctgcagtcacccctcaattttctggcagaacaggctctggcactggggcagtcctctcaggagaaaaaaccagagagttctggctacaaagagctgtcctgccaggctcccctcaataagggcctgccagaagtacatcagtccaaagctaagcaccacagcttgccacggacgtctcacgggccccaagtggcagttcctgtgcctggcccccaggtcaaagtctttcatgccggcactcagcagcagaaaaacttcacgcccccatctccatttgccaataagctccaaggcccaaaggcttctcccacacagtgtcatcgttccctcctgcagttagtgaagacagcggccaaaggccagggcttccatccctctgcaccagccacctcaggaggcctgtcagcctccagcagcagctctcacaagaccccagcctcgtcctcttctgccctgagccatccagcaaagccacattcagtcagctctgcaggctcatcttacaagaataatccctttgccagctcaatctccaaacatggggtttcttctggcagctcttcctcgggaggaacaccagtccagagttctgtttctgggagcctggtccctggcatacagcctccctccgtgggacaggccaccagccgacccgtcccaagttcagcagggaaaaaaatgcctgtttcccagaagttgactctggtagcccctccaggcggtccaaacggagattccagtggtgggacccagggagtggcaaagttgctgacctcgccgtccctaaagccctctgcagttagtagtgtgacatcgtctacctccttgtcaaaaggagcgagtgggactgtgctgctggccggctcctctttgatggcttcaccctacaaatccagcagcccaaagctgtctggggccatgagctcgaactccttgggaattataacccctgtccctattcctgtccatgtgctctccttcagcgctgactcctctgccaaagcaggggtctccaaggatgccatcgtcacaggccctgcccccgggtccttccaccatggccttggccacagtcttctggctggcttgcactccagcccgccccatgcagcgcctctcccacacgctgcggtgcccacccatatcccgcagagtctgccaggtgcttctcagcttcacgggaaagggcctgctgtaccacggaaattgtgaccgcttcagaggcaaggcttgccacttgggtctgggtggaatcagaacgtgcaggtctcccaggatgtacactcactgcgccctttctgctgcttggtgttcttctggaggagcgtgagttctcagcggagcgcttctcggcacttctgatgtgcctcccatggagggagccgggcccttgctgctcaggaggtgcagactgccccgtgctctgggccttgcagctctgtcgctagacggttgttagaggggcagctctaggctggggcttgcgctgggccgtggtgggaggcacagtgtttacaggctctggtggcagagcagttggcacacctgtgggtgaatctgcctgatcccctggcatttggtcagagtacctcagagcaccccactgctcaggggctccttctggctgcagtaagctccctggatggtcacagtgccgccccatccccaggctgtgtgctcaaagcggacaaaactcaggccagagccacagctgggagacctgcactgtccctgcgaaatactaagaacacctagggtgtgctcactgtgggggccagtttctcctcggaacatgacaatgaagctcttttagagaaaagacctttgtagattcaacaattatgataggatttttacagacacctattttgggctcagttttcatcattaccattaaatgcattggatagaaggggactgttcttcacacatcatattataggaagacataattccagtgcctttatggtggagcagaattcgacaacacatgtccattcagccctctgaatggatctgagacgaagacctttttaaagatatgtctgtattgaagagaaagccagttttgagttttttacacttgcacatcattatctgtgccgtcctgactagaaggttgtctgggcccccaaattccaagtcccagtatagccagggctcccattttgtttttccagagttcgtggaggtggactgcagagcccagagcccttcatctctctgagggtcaaggataccaggggtcccaagtcacagatagacattccagtttgtattcttaggaatcattcttaggcagtgcggcagaagcaggcctctgtgaagtgtctgccgggtagaaataggccttgaagtcctggggctctccaggcagtggggttatgtgtcgactgaagggtgatgtgcagaagagcttggagagtggatcagagagactaggacagttactgcagagctcctaagtcaccactcaaccagtggctgtttcacaaggatttgagggcacttgcctgtcttgtgaggtctgtgccacaaggtgagtctgaactgactgctccagctaagtgatcaggcacgttgagagtatacggtgtcctcagcacatacacctgtgggaaaacggaccgctcttggctcctgactcccagggtacagcgcccagtaactcatccttcattcagaggtttgctggccttcccggtttcccaaggagcaagacctctgtccgccctttggcccggcctctgctctgtctcctttttttacataagaaccaatccgtgtttcacattgggctaagtggattccttatccctttgttatatatattttttgcaacttggatttccagtttgtttacagagtagtcttaggtagtagcaaaagagccaaagaagagatttgtattgctgagctcaaagccaagcagaggccggcagtggaggctgagcagggactctccaggcttctctgcccataaacacccgggtcccaggccctccttcctttccctttggtgctccctcctccccacgtaccattgcgcgtgcagctggagcagaataccctcatttttaggaatctagtgatgcctcttgcctcagggaaacgtttctttgatggggagtttgagatttcttttccttgtttatgctttatttgtggtaatgaaagagcgaatgactgaacagccatggcaaggcagacctacaggcgaggccgcagcagagggtggggcagagcagcctcggggtctgggggctgcaggggtttccctggcgcagcgaaagtctctgagcacttaccgggcgtgaccgtttcttaggtgtgagaggggctgtggcttttgtgcagcgactatgttggtgttaggggtggtgtggagattgttaatcttgtataaagcaattcaataaattgtttcaaggtttccaaaa

SEQ ID NO: 33396 - DNA, 5878 bp, Homo sapiens
gtcccgcgccgcaagttctcctggggcgaccggaggctgctcccccgaccccctggtgtccccggagtggctgcgcggacgtcgagttggcatttcttcgcttcctcctgggccggcgcgcggcgcggcacaccaggctcccctgggctcggggacccggccatgggccgaggcgcgggccgcccgcccgctgggagccacggcttagcagccgaccgctagctgcgccgccgcccggggaccggcatgaggaccgccgcggggggacgtctgcggcccgcgtcggcgctggggacaaagaagccatgcagtgacacccgctaagacttgttggtagccatgtcggagccccacagggtccagttcacctctctcccaggttccctgaatcctgcgtttttgaagaagtcccggaaggaggaggctggggcaggagaacagcatcaggactgtgagccggctgcagcagctgttcggattacactcaccctctttgaaccagatcacaaacgctgcccagagttcttctacccagagctggtgaagaatatccgagggaaggtaaaaggccttcagcctggagataagaagaaagatctgtcagatcctttcaatgacgaagaaaaggaaaggcataaagtagaggcccttgcccgaaaatttgaagaaaaatacggtggaaagaaacgtagaaaagaccgaatacaggacttgatcgatatggggtatggttatgatgaatccgactccttcatcgataactctgaggcgtatgatgagcttgttcctgcttctttgactacgaagtatggaggattttacattaactcgggaaccctgcagtttagacaagcatcagagtctgaagatgacttcattaaagaaaagaagaaaaaatctccaaagaagcggaagttgaaggaaggtggtgagaagataaagaagaagaaaaaagatgacacttatgacaaggagaagaaatcgaaaaagtccaagttttccaaagccggcttcacagccctcaatgccagtaaggagaagaagaagaagaaatattctggggctttaagcgttaaagagatgctaaagaaatttcagaaagagaaagaggctcagaaaaaaagggaggaggagcataagcctgttgcggtcccatcagcggaagctcagggcctgcgggaactggagggtgcctctgaccccttgctctcactctttggctctacttctgacaacgacttgctccaggcggccactgccatggactcgctgacggatttggacttggagcatctgctcagtgagtctccagaaggaagtcccttccgagatatggatgatggaagtgattcccttggggtgggattggaccaggaattcaggcagccctcttctctccccgaaggcctgccagcacccctggagaagcgcgttaaggagctggctcaggctgccagagctgctgagggggagagcagacagaagttcttcacccaggatattaatggaatcctattagacatagaggcgcagactcgggagctgagcagtcaggtccgctctggggtgtatgcctatcttgcgtcattcctgccctgcagcaaggatgccctgctcaagcgtgctcggaaacttcacctctatgaacaggggggccgtctgaaggagcctctccagaagctcaaggaagccattggcagggcgatgccagagcagatggccaagtaccaggacgaatgccaggcacacacgcaggcaaaggttgccaagatgctggaagaggagaaagacaaggagcagagggaccggatttgttcggatgaggaagaagatgaagaaaaagggggcaggaggataatgggacctcggaagaagttccaatggaatgatgagatcagggagctactgtgccaggtggtgaagatcaaactggagagccaggacctggagaggaacaacaaagcccaggcttgggaggactgtgtgaagggctttctggatgcggaagtcaagcccctctggcccaaaggctggatgcaggccagaactctgtttaaggagagcagacgaggccatgggcacctgacttcaatcctggccaagaagaaagttatggccccttctaaaatcaaggtgaaggaatcgtctacgaagcctgataaaaaggtttctgtcccatcaggacagattggtggccccattgctttgccctcagatcaccaaacaggaggcctgagtattggggcctcgagcagggagctcccatcccaggcatcgggcggccttgctaaccctcctcctgtcaacctggaggactcattggatgaagacttgatccgcaatccagcctcctcggtggaagccgtgtccaaggaattggctgcattgaatagcagagcagctgggaactctgaattcacactgcctgcaccctcaaaagcacctgcagaaaaagttggaggcgttttatgtacagaagaaaaaaggaactttgcgaagcctagtccttctgctccaccaccagctagctctctgcagtcacccctcaattttctggcagaacaggctctggcactggggcagtcctctcaggagaaaaaaccagagagttctggctacaaagagctgtcctgccaggctcccctcaataagggcctgccagaagtacatcagtccaaagctaagcaccacagcttgccacggacgtctcacgggccccaagtggcagttcctgtgcctggcccccaggtcaaagtctttcatgccggcactcagcagcagaaaaacttcacgcccccatctccatttgccaataagctccaaggcccaaaggcttctcccacacagtgtcatcgttccctcctgcagttagtgaagacagcggccaaaggccagggcttccatccctctgcaccagccacctcaggaggcctgtcagcctccagcagcagctctcacaagaccccagcctcgtcctcttctgccctgagccatccagcaaagccacattcagtcagctctgcaggctcatcttacaagaataatccctttgccagctcaatctccaaacatggggtttcttctggcagctcttcctcgggaggaacaccagtccagagttctgtttctgggagcctggtccctggcatacagcctccctccgtgggacaggccaccagccgacccgtcccaagttcagcagggaaaaaaatgcctgtttcccagaagttgactctggtagcccctccaggcggtccaaacggagattccagtggtgggacccagggagtggcaaagttgctgacctcgccgtccctaaagccctctgcagttagtagtgtgacatcgtctacctccttgtcaaaaggagcgagtgggactgtgctgctggccggctcctctttgatggcttcaccctacaaatccagcagcccaaagctgtctggggccatgagctcgaactccttgggaattataacccctgtccctattcctgtccatgtgctctccttcagcgctgactcctctgccaaagcaggggtctccaaggatgccatcgtcacaggccctgcccccgggtccttccaccatggccttggccacagtgcttctcagcttcacgggaaagggcctgctgtaccacggaaattgtgaccgcttcagaggcaaggcttgccacttgggtctgggtggaatcagaacgtgcaggtctcccaggatgtacactcactgcgccctttctgctgcttggtgttcttctggaggagcgtgagttctcagcggagcgcttctcggcacttctgatgtgcctcccatggagggagccgggcccttgctgctcaggaggtgcagactgccccgtgctctgggccttgcagctctgtcgctagacggttgttagaggggcagctctaggctggggcttgcgctgggccgtggtgggaggcacagtgtttacaggctctggtggcagagcagttggcacacctgtgggtgaatctgcctgatcccctggcatttggtcagagtacctcagagcaccccactgctcaggggctccttctggctgcagtaagctccctggatggtcacagtgccgccccatccccaggctgtgtgctcaaagcggacaaaactcaggccagagccacagctgggagacctgcactgtccctgcgaaatactaagaacacctagggtgtgctcactgtgggggccagtttctcctcggaacatgacaatgaagctcttttagagaaaagacctttgtagattcaacaattatgataggatttttacagacacctattttgggctcagttttcatcattaccattaaatgcattggatagaaggggactgttcttcacacatcatattataggaagacataattccagtgcctttatggtggagcagaattcgacaacacatgtccattcagccctctgaatggatctgagacgaagacctttttaaagatatgtctgtattgaagagaaagccagttttgagttttttacacttgcacatcattatctgtgccgtcctgactagaaggttgtctgggcccccaaattccaagtcccagtatagccagggctcccattttgtttttccagagttcgtggaggtggactgcagagcccagagcccttcatctctctgagggtcaaggataccaggggtcccaagtcacagatagacattccagtttgtattcttaggaatcattcttaggcagtgcggcagaagcaggcctctgtgaagtgtctgccgggtagaaataggccttgaagtcctggggctctccaggcagtggggttatgtgtcgactgaagggtgatgtgcagaagagcttggagagtggatcagagagactaggacagttactgcagagctcctaagtcaccactcaaccagtggctgtttcacaaggatttgagggcacttgcctgtcttgtgaggtctgtgccacaaggtgagtctgaactgactgctccagctaagtgatcaggcacgttgagagtatacggtgtcctcagcacatacacctgtgggaaaacggaccgctcttggctcctgactcccagggtacagcgcccagtaactcatccttcattcagaggtttgctggccttcccggtttcccaaggagcaagacctctgtccgccctttggcccggcctctgctctgtctcctttttttacataagaaccaatccgtgtttcacattgggctaagtggattccttatccctttgttatatatattttttgcaacttggatttccagtttgtttacagagtagtcttaggtagtagcaaaagagccaaagaagagatttgtattgctgagctcaaagccaagcagaggccggcagtggaggctgagcagggactctccaggcttctctgcccataaacacccgggtcccaggccctccttcctttccctttggtgctccctcctccccacgtaccattgcgcgtgcagctggagcagaataccctcatttttaggaatctagtgatgcctcttgcctcagggaaacgtttctttgatggggagtttgagatttcttttccttgtttatgctttatttgtggtaatgaaagagcgaatgactgaacagccatggcaaggcagacctacaggcgaggccgcagcagagggtggggcagagcagcctcggggtctgggggctgcaggggtttccctggcgcagcgaaagtctctgagcacttaccgggcgtgaccgtttcttaggtgtgagaggggctgtggcttttgtgcagcgactatgttggtgttaggggtggtgtggagattgttaatcttgtataaagcaattcaataaattgtttcaaggtttcc

SEQ ID NO: 33397 - DNA, 14443 bp, Homo sapiens
atggcggagccgcgcagagtagcgttcattagcttgtcaccggtgcggcggcgcgaggccgagtacccggggcccgagcgtgagcccgagtacccccgcgagcccccccggctggagccgcagccgtaccgcgagccggcccgggcggagccgccggccccgcgggagcctgccccccgctcggacgcgcagcccccgtcgcgggagaagccgctcccccagcgcgaggtcagccgcgccgagccgcccatgtcgctgcagcgggagcccccgcggcccgagccgccgccgccgttcccgccgctgcccttgcagccgcccccgccgcgggagtcggcttcccgggctgagcagccgccgcggccgccgagggagacggtgcgcctggagctggtgcttaaggaccccaccgacgagagctgcgtggagttcagttacccggagctgctgctgtgcggagaacaacggaagaagctcattcacacagaagacccatttaatgatgaacatcaggagaggcaagaggtggaaatgttggctaagaagtttgaaatgaaatatggtgggaaaccccgtaaacaccggaaggatcggctacaagatttaattgatataggctttggctatgatgagacagatccatttattgataactcagaggcttatgatgaattagttcccgcttctctaacaacaaaatatggaggcttttatatcaacactggcactctacagtttcgccaagcttcagatactgaagaagatgatattacagacaaccaaaagcacaagccacccaaggtccccaaaataaaagaagatgatattgagatgaagaagcggaagcggaaagaggaaggggaaaaggagaagaagccaaggaaaaaagttcccaaacaactgggagttgtggctctaaattcacacaagtctgaaaaaaagaagaaacgttataaagattctctttctctagctgccatgattagaaaattccagaaagagaaggatgcattaaagaaggagtctaaccccaaagtcccagtgaccttgtcaaccccttctctgaataaacccccatgtgctgctgcagcactggggaatgacgtcccggacttaaatctgagcagcggtgatccagaccttcccatttttgttagcacaaatgaacatgagctgtttcaggaagctgaaaatgccctagagatgctagatgattttgacttcgacagattactggatgctgcttctgatggtagccccctatctgagtcggggggtgaaaatggaaccaccacccagccaacctacacttctcaggttatgcccaaagtggtacctacactcccagagggtctacctgtacttcttgaaaaacgtatcgaagaccttcgtgtagctgccaaactttttgatgaagaaggaaggaaaaaattctttacacaggatatgaataatattcttctggacattgagttacagctacaagaactaggccctgtcattcgcagtggtgtctactcccaccttgaagcttttgtgccatgcaataaagaaacactagtaaaacgtctgaagaagttacatctcaatgtccaggatgatcgtttaagagaacctctgcaaaaactgaaactggctgttagcaatgtcatgcctgaacagctatttaaataccaggaggactgccaggctcgtagtcaagctaagtgtgccaaattgcagacagatgaagaacgagaaaaaaatggatctgaagaggatgatgatgagaaaccaggaaaacgtgtcataggaccaagaaagaaattccactgggatgacactatcagaactttgttatgtaaccttgttgagatcaaattgggatgctatgagttagaaccaaataaaagccagtctgctgaagattatcttaagtcttttatggagacagaagtgaagcccctgtggcctaagggctggatgcaggcaagaatgctttttaaggaaagccggagtgttcataatcatcttacttctgctccggcaaagaaaaaggtgattcctgcacctaaacccaaagtaaaggaggtgatggtaaagacccttcctctccattctttccccactatgcttaaggagtgtagtccaaaaaaggaccagaaaactccaacatccctggtggcttcggttagcggtcctccaacgagctccagcacagctgccattgctgcagctagctctagctctgcaccagcccaagaaaccatctgcctcgacgactcactagatgaagacctttctttccattcaccttcactggatcttgtttctgaagctttagcggttatcaacaatgggaacaagggccctccagttggctcaaggataagcatgccaaccacaaagcctcgtccaggactgagagaagaaaaattagcaagtatcatgagtaagctgccactagctactcccaaaaaactagattctactcagactacacattcttcaagtcttattgctggtcacacagggccagtaccaaagaaaccccaggatttagctcatactggcatctcttcaggccttattgctggttcttccattcagaaccctaaagtttctttagaacctttgccagccaggctacttcaacaaggacttcagaggtcaagccagattcacacttcttcctcttcacagacccatgtctcctcttcttcccaagcccaaattgctgcctcttctcatgctctgggaacatccgaggcccaagatgcttcttcgttaacacaagtaacaaaggtgcaccagcattcagctgtccagcagaactatgtgtctccattacaggccaccatcagtaaatcccagaccaaccccgtcgtgaagttaagtaataatccccaactctcctgttcctcctcacttattaagacttcagataagccacttatgtaccgccttcccttatctaccccctcacctggaaatggttctcaagggtcccaccccctggtttctaggacagtacctagcaccactacctccagtaactatttagccaaggctatggtgtcacagatctccacgcagggtttcaaatctcccttctcgatggctgcctccccaaaacttgccgcatctcccaagcctgccacatctcctaaacccctgccctcgcctaagccttctgcctcacccaagccctctctgtcagctaagccttcagtatcaactaaacttatttctaaatccaacccaactcccaagcctactgtatccccaagtagttccagtccaaatgcactagttgcccagggtagccactccagcactaacagcccagtccataaacagcccagtggaatgaacatcagcagacagtctcccaccttgaatttattgccctctagtcgcacttcaggccttccacctacaaaaaatcttcaggccccctcaaagctaacaaactcatcatccactggaactgttgggaagaacagcttgagtggaattgcaatgaatgtacctgccagcagaggtagcaaccttaactcaagcggagctaataggactagtctgtctgggggaacaggaagtggaacacagggtgctaccaaaccattgtctactccacatagaccatccactgcctcagggtcttcagtggtaacagccagtgtgcagtccacagcaggagcatcattattggctaatgcctcacctctgactctcatgacatcacctttgtctgtaacaaatcaaaatgtgactccttttgggatgctgggtggccttgttccagtgaccatgcccttccagtttcccttggagatatttggctttggaacggacacagctggagtgacaaccacctcgggatctacctcagccgctttccaccatagcctaactcagaatttactaaagggtttacagccaggaggagctcagcatgcagcaacgctttcccactcacctctgcctgcacacttacagcaagcatttcacgatggaggccaaagtaaaggggacactaaattaccacggaaatctcagtgactgcccagcaagcaaaggagacgaaatgtttagttgactgatggaatctacctgatgggaaagtacttatgtggtcatagggctgctgtttctgtcgatgtttacattctctcgtcccaagcactgtggtgaggaggaaaaagaaaagaaaacattacttgagcaaagccaggtgcaggaggaagaaatgcttttgtgcaaagttagtgacctttggtctcttctaaagaatgacagagttaccgtattaacagacttgaaagagactcagttgtcaaacccacagaaatacaaatttgatttttcccgggggaggaagaaggaagtgaagagaatttgggtaaactccatccatcctgggggttggatctgaacacttacagacataattggtaataaaaggcattaaaaactggaattaggccagtttgtcaggaataatgatcatgtctatttgaatggactgtgtagcagatttgccacaaaaagaaataataatgattctatctccgatagacagtagctgcatagcacaccctcgaaaatcctgaacaaacttgaatctcctccagtgtgtagcaacttccctcaatcagtggactaaagatccttcaggaaagttattttagcacagtgatatatattattaaatcatctagatttttaaaaatcaggaagttgagcctgttgctcttaagagatgaaacctagatgtcccctttttgtaaaagggtcaatttcatcttccgttcagaagcaggtacttaactcttttcttcaggtgatttgtgcatctagtattgactggttaattcttatttccattcttgatgttaaaatgtgactgtgttcacatttttctcctgagaaatggggatctttacagggttattgctttgctgcttttagcccttgcagcaacataaactctaagtttccccagttcatctaacttcacaacttctccttctgttcttttagctagtggtccttcaggtgattattagctattggtataaacaggtagaagtgtacactatgtttcttcattggtcattcaaatggcatgaatatagtttttgaatttttaagatggtattttaaagggaggaatcacattaggatcacaatcacgacatatttttactccctgtatccagtgtagtgaaattgtttggagcatttgagatcctaaagcttcactatttactcagtgtattggtatgtgagtaaatctgcagaaaataagactccttagttattatagcttccttatgcaaatagcatattcaacaaaggatgttaagggaaaaatttatggttctccttggatacatttgatttgatgggtttttttgccgcattattctagttttttaagcttctgaatattttcatactatatcagagaatggtgtaaactctaaatggtataagcttcatccatttataatgacactaacctaaaaaaaatagactggtagtgacaagatttattgcatatgtgtttattatacattaccctataccattagatttactcaattaagagtattaaccaggcccttttttcttttatacacaaaagtcccagataccctacaggactgtgaataaataaccacagatcggttcagatctgtatgcctatattttgacttcaaagtcacattggcttgcttcatagcgaaaaagttaataaataactgaaaactttagttccaagaacttgttacagtaaagggaaaggattatttcaaaggaatcactgatataatttcttgactctaagaatttagtttatcaataaaacaaatatggatgtagtatgaaccccagtagatattttggaaggatactgggaggatgttgcagagaggtttgacttgaattcagtatgtttgatgaagatttgcttggtttcaattaaggaagcttgcccaatttttttaattttttcaaatgtagtggacctcttgcttttacgaaatatgaataaaaaggtctttgcttcatactaggggaagtgatgggattttcctttgggaaggtagcctttgttttacttctcataccacaagagaagtcgaagtgcgtattaatttctcttcctgaatacttgtatatatgtttgtctgtatgtatatatacatacacacatacattcatataaatgactagtttgagtcaaaaaatcatttgaatttcttaaaaccatcaattctgaatcatgccatatgaagatccctggtgactgtcatcattagaaaagaacaagataatcagttcttttccctgtaacattttatactaaccagtaaaaatatctgaaggcccttggctccaagaatacaatgtggagattcttctgtgttctctttagtcttgattccttgaggactactgtcagatccctaccttaaacccccacctgcactgacgacttacattcatttcagtcaggaccccccttttatgttgtatgaatcagtcaaacatcgttgtatttctgtatagataaagtatgatcagagagtttctacatgtaaatagtaatctatttctttcctagatcataacattgaaaaaggtgcccatactttatggtcacctgtctttaccgtttttattactaaaaacaaacatataaattggttattttttagcacagagacttgtgactcatactgtatttttgcacttaaaaatcaaattatgttattttttaaaatggtgagtcattggaaaggatatctatagagcaacgtgtatttctgaagagcattagcaacatccaaatgcaaaaataatcagcacacatgattatatcccactccttgggattcttgattcaggaagattaagctgtttgttttcaactgttttatattttaaattgccttcactgatatataagctgttactgtacatacaagttaatcctcagtattcacaagcaataacagtcagcagggttgtcctcggagatagctgtgctgagcctcagttggagactgggagcaaagtgtcaagctcattcagagcatccagaataaatgcaagcaataatttccattataattcaattataattcttgtatgcttttgaggtcagagggtaaatgaaatcgtgattttaaaacagcctgaagaaaaaggttttgggaaaggaaatgaggctaatctgtagtcataaaattctgatactttgcggaaattagaagatggtgatagtgcattcttttgtgcccaccccccctctgatggatgttgttagcccaaattacatttttcatatcatggacattgaatagggtttattgaatcaggaaggtaaggggaagaaccgggcacatatgtgttggaatactgtgggtttgacacctggttgaaaacaacttattggacatgatttttaacccaggatatttttttcccaaagcagatctaaattgtttactacccagggttggaaagggcaggcacctctaatctagtctttgtcctctggttgccctctcccacacccctttccacctatacttggttcaagacattttctgaaacgaaaattctgctgttgttcaaactgccattggttatgagaactctgcgtcctttgggatcatctcttagaactccagtgatctatcatatttgctgctacatttgtaaaatgaactttgcctgtattggttgactttaatttacagttctttatttctaggatgttttgtcctctagtttgactcatgtatagaattaggatactttattttaggagtgtaccgtaaaagcacactggtccctttgttgtttttattatttaggtttggaatttgtttgctttttttttgtttgttttttgttttgtttctgtttttgtttttttttaaagttggaaatagaagaatgagaaaaatctataatcaggccaaacttgagaactttcctgtgcttcagcactgtaattctgctgacctaatgttctcaaaagaggcacttttactttctattgtgcatgtatgattgttgttttttgcttttgagggggcttttgtgtttgtaataatgaagcagaagaaaagtgcagtagtagataaatgatcacaacatgttatgcaattttattttataaaattttaaggggaaaagtttaactctttgtaaatcatttcttagctctggtaaaatgcttatattactcctctaaaacatgctcaattcaggcctttgtctttgttaagtgccttttttctttcttttttcctctcttttgaaactgttgtcacattatcttaaagtacagactgataagtcaggggattcaggaggaagaatctcacacttgtcaacatcatgtcatgctgtgtaaccctcttcctttgctttctatgtatatggatatatgtgtaagatacatacattacatatatataaaactaggagctgctgtaccattgcatcctttccaaacactcccctttccatgtttgcaaaacttctgccttgtttattccattgcttttagttgattaaagtgggtggattagaaaagtatcttttcggccgggtgcggtggctcacgcctgtaatcccagctctttgggaggctgaggcaggtggatcacgaggtcaggagatcgagaccatcctggctaatatggtgaaaccccgtctctactaaaaatacaaaaaattagccaggcgtggtggcaggcgcctgtagtcccagctacttgggaggctgaggcaggagaatgacataaacccgggaggcggaagttgcagtgagctgagatcgcgccactgcactccagcctgggcgacagagcaagactccgtctcaaaaaaagaaaataaaagtatagaaaagtatcttttcacaagaggccaccttcgccctttgaatatctgcttgtagaagttaacaataacaacacacacacacacacacacacacacgtcagttactacaagtaaaataaacttagtgaatcattgactattcttggatataacccacttttctgtgctctttaaacttggcataagtaatataggagacagcattggaataacaagagtaccttgcaagtcacattggtaaggtgcgctagactaaacatgtgacaaggctagcgttagaaccgcagtttggtgtctaagtttagaagcaggttagcaactgtcaacatgaaaaatgtatcatattttcttctggaaaatgatttttgaagaaatcatatagctgcatatctatctgttaaaaggttaataaactcagaagtagaaagacttcagatgctgaggaaaacatataatctatagcattcttgagagattttccatttgctttttatttgctagataattacatttggcttaatctgattttatggttatttagatttctcccttgagcaaaataacataattttcagtatctaagattcatcgattttttgttgaaaacaaatagatgtgacatgttaagggagaccaagttgaaccatccctcagacccagtacaaatatacctagtaagtgcccccctttcaatacattctaattgggaagaagaagagactagtggcttaaaaggagaaagcagaagctcctggtagtgttacctgatagcagaacttaccaggcagttggaattcacgagtgttattcttgaatgactatgtctagggggaatattgtttaaccttcgtgcctcagattacccattagacaattgggtataatcatattcacctacctcccagggatatcagagactttactatttcaaaaatattttgagtttttgtaaaatgtcctatataattaaaaatagtattatcatcttcctgcagaggctaaaaaatgttttccttataatgagtataaaaagcaccctatggtttttaaatttaaaaaaatcactggaattttaatttagatacatatttgttatttaaacattatctttgaggtgggataaaatgtttagtttcaggttaacaagggagagaaataacactaagtttaagtagttttttttagccttttacggtgttactgtgatttttcgtcaaggttgtggagctaaagttagataaagttatgatgcttggttattggagttgataaatgatcctggaagttttaactgtctcacttttccatcttctcagtctaatttccttttattgcttgtttgaggacggatagctaagctttttaactttctaagaatgagtatgatgtctcattcttgcaaatcagagattgtgtactaattccattaactgtaggtgtatccagctctgcactgaaggggtgagcactacacacagtcagctggatactcttgtagccattgcacctttgtaattcatgcttcttcaacccatgaaagaggtggagccatcagctgctcaggttgtaagaaaatgggagacggaaggcaggattcactttctaactgggtcggggtggggaaggtcagggtagaaggaaacatgttttccccagctcccaggaggagacgaagatcattttatcccaccttccatccctgtatattaagtagtactactacatagaattttcccgttatcgtttaaaataatagcaacaggaaaagaaaaatggatgctgcagttttagttggggctaaatgctgagcaacgattgttggagtgtgtgtgtaaatttaaattgtagcacatattcagggtcaggaaagcaaaatgttggggatgaggaaccagtgttaccaggttcaagtgagttagtagaaagcaccaggtccaagcagacaaagcatctggttaatttccagaattggctaaggtccactgaatctctaatgatagggtgtgtgtgtgtgtgtgtgtgtgtgtgtgtgtgtctgtaagtcactttttggatttttgttgctttttccagataaggccttagtagcctctaaatatcaactatgcagataaacatactccttttttttttcacatgtccctgtcttttccattctcagataacaaatgttaagacccaaagaaataaggcataagggtttttgttgaatgtgtgtttgttcttctagggaaaattaacagaagcataaaatagagatactttgtgtgttcatctatcgtaaaatgtgaactctgtattcaaaaactatctacagatgctttcactggtgcaaagctgtagttagtatcatggaatgtctttgggttgttaatgataaaatcatcccagtgttcaattctgagagttttagattatatgacacaatgttcaggtttatagagctgaatgggtgatcaaactctaattaaaaatagctttgaatattaatgttgaattcttctttcttggtttcctttagtcttcattctttattcagagctcttaatcatattgctacactagaatatgaattgtatattaggagtctggggaggaaaggttaaattgtcttttacatcctcttctcactcactctggcaacctatcctgtgtccccatagaactgagaagtaaagccctgtgcaggcctgctttagaagactttacatcccagcagaggattcaggcagggactctcaggattttaatcagactgcctttgaataatgtgatattaaattttatttttctcatagactctcaaagtaccacttgcttgaaagtagctacttgtgatctttaatttccttatattgtgatagttctacttttcagtctttcctgtgtatctccatttcatagtgcgttagtacttaaacttcggacacttttccaaactgttaaacaagtcaggaatgcttttcagaatcgcagtagtattattagggtctctgtgtctaggacttacagtcatcagtggtcatcactgggactagaggtgttcttttttttcctcttctcctttgtattaaaaaatagattttgctactgtataatgcggcatttcatgacttcctcttgttacttttcaaggttattctaaagagatggagatcttcattagaggctatttctcataatagtctgccttgcttattttcatactccccctgaaataagcctacttttgcaaacaggccatatgaatcaaattttatgtttgttcctcacaaaattttctacacattatttgttcccactttgctaataataatataatgattttattgtaaatctgtgttttaaatattttataacagagcactaatggaaacctaataaatacaaacaagataactattacccaagataacatggaaatacttctgtttttgaagttaacaacaccgtctgccctcaaagcacatttaggagtatcaaccaagaccagccagttgacatgtttttctgtgtggcaacctgcccttaaattgtcagatcttaactatcttgtgtttgctgtgcttgcagccataagctttcctccttttttgcttatccctgctgtttgtagggttagtgtgccctctgtcagaaaattgggttttctttactatacctgcaaaattaccaagggttaccccaatattgtctagaggaattaaaaagaacttattctcagttgacaaaagtattactgttatacatagttaattggaaagttggccaactttggtcacctatttttgagtcttggctatgcctttgtaattagttacatataccttctgagaccttcagataatcaatgggcctttccccattagaggtaggttcccagcctacaagtatttcctgtgatccatggcaagcctccagagaaaagattcaagctttgcactgcccttttgttgattgtcattgaaaacttactttatttcagaaagtatcaaaaataccaaattggtctttcagagagtatgtaaatctggggcttgcccttggatttcacttgttaaacaccctcaaacttaaaagaagaaaatagatctccagctggtgaaaattttgtgccccaaataatatattaatccaagtctaccaaggtaactaagtaatggatgttttctctcttttattacaagcaagaaagttcatttgcagttgtaaaaatgattaccgaactccagacctatttgctataactgattggaaataatgattctgatttttagtctgggtaaacacatacttcggtgtgaattttgataagggaaagacttgtttggtagcccaaggaaaaacaggatgtatttatacagtgaatgttcactctgcagaggaacttccctccagttacatcttcctcatacattagccacctccacacttgacatagatgccaacatgtttcaaaaccaatcttgaaggagcctaaagagttgatggtcctctaggtgaaagacaagaattactgtattgcatttgcttatagggaggtgtgtttttgctaacttgaagggatatactgtatttcaaataagtgtgtgacttaatattttgggatttttttttcctcctttaaaaactggacctgaacacaagctttgagttgatgtttgtaataatctcaggacctgaaagattgtagcatttagtgtgtcttaaaaattatgtactgtaccagccatggatttttgtaaatatacctgtctcccttttttgtattttagtaaaaaaaaaaaaaaataaatttaaataaaagggggtggtgatgacatgtgaatgggtgcgggtatgtgtgcgtgtgtgtttgtataaggctcttttgagatgaactggtgcttgtttaatttccagctcaaatcggagcaggaatatggacaaactgctgctactgaaccctgcactgagccgaggtatttccatttggttaactaaacgctagctaccaggaaatgacgcagaagtcacgttcttcttcccactgccatcttgcctttgcattctcagttctacgtgccctttgaactttaatggtaaaacatttcacactttggatggtttgcttgtctctagtttttagaaagctcttatcactccttcctaagaaaaaagaagggcaggtaaatttttttaaccaaaaaaaaatcacacatttcataaaaccctgatgaattttggatatgtgagagggcataaacattcctaaatatggacctgtgaatttagtaaattacccccatgaatatactccttcagtgcagggatttttgtgttttttttttttttttaatttttttgcaacagccttgctcatattccaggtgtagctagcaaacccctgtttttgaagcaagagccttatttgattcagtgtagatgtttcctgtctatcctttgtgacagggccttttaatgagtgttttttctttttgtatatgttacgtgtttgttgttgtattaaataaagaggaatgtacatact

SEQ ID NO: 33398 - DNA, 6064 bp, Homo sapiens
atggcggagccgcgcagagtagcgttcattagcttgtcaccggtgcggcggcgcgaggccgagtacccggggcccgagcgtgagcccgagtacccccgcgagcccccccggctggagccgcagccgtaccgcgagccggcccgggcggagccgccggccccgcgggagcctgccccccgctcggacgcgcagcccccgtcgcgggagaagccgctcccccagcgcgaggtcagccgcgccgagccgcccatgtcgctgcagcgggagcccccgcggcccgagccgccgccgccgttcccgccgctgcccttgcagccgcccccgccgcgggagtcggcttcccgggctgagcagccgccgcggccgccgagggagacggtgcgcctggagctggtgcttaaggaccccaccgacgagagctgcgtggagttcagttacccggagctgctgctgtgcggagaacaacggaagaagctcattcacacagaagacccatttaatgatgaacatcaggagaggcaagaggtggaaatgttggctaagaagtttgaaatgaaatatggtgggaaaccccgtaaacaccggaaggatcggctacaagatttaattgatataggctttggctatgatgagacagatccatttattgataactcagaggcttatgatgaattagttcccgcttctctaacaacaaaatatggaggcttttatatcaacactggcactctacagtttcgccaagcttcagatactgaagaagatgatattacagacaaccaaaagcacaagccacccaaggtccccaaaataaaagaagatgatattgagatgaagaagcggaagcggaaagaggaaggggaaaaggagaagaagccaaggaaaaaagttcccaaacaactgggagttgtggctctaaattcacacaagtctgaaaaaaagaagaaacgttataaagattctctttctctagctgccatgattagaaaattccagaaagagaaggatgcattaaagaaggagtctaaccccaaagtcccagtgaccttgtcaaccccttctctgaataaacccccatgtgctgctgcagcactggggaatgacgtcccggacttaaatctgagcagcggtgatccagaccttcccatttttgttagcacaaatgaacatgagctgtttcaggaagctgaaaatgccctagagatgctagatgattttgacttcgacagattactggatgctgcttctgatggtagccccctatctgagtcggggggtgaaaatggaaccaccacccagccaacctacacttctcaggttatgcccaaagtggtacctacactcccagagggtctacctgtacttcttgaaaaacgtatcgaagaccttcgtgtagctgccaaactttttgatgaagaaggaaggaaaaaattctttacacaggatatgaataatattcttctggacattgagttacagctacaagaactaggccctgtcattcgcagtggtgtctactcccaccttgaagcttttgtgccatgcaataaagaaacactagtaaaacgtctgaagaagttacatctcaatgtccaggatgatcgtttaagagaacctctgcaaaaactgaaactggctgttagcaatgtcatgcctgaacagctatttaaataccaggaggactgccaggctcgtagtcaagctaagtgtgccaaattgcagacagatgaagaacgagaaaaaaatggatctgaagaggatgatgatgagaaaccaggaaaacgtgtcataggaccaagaaagaaattccactgggatgacactatcagaactttgttatgtaaccttgttgagatcaaattgggatgctatgagttagaaccaaataaaagccagtctgctgaagattatcttaagtcttttatggagacagaagtgaagcccctgtggcctaagggctggatgcaggcaagaatgctttttaaggaaagccggagtgttcataatcatcttacttctgctccggcaaagaaaaaggtgattcctgcacctaaacccaaagtaaaggaggtgatggtaaagacccttcctctccattctttccccactatgcttaaggagtgtagtccaaaaaaggaccagaaaactccaacatccctggtggcttcggttagcggtcctccaacgagctccagcacagctgccattgctgcagctagctctagctctgcaccagcccaagaaaccatctgcctcgacgactcactagatgaagacctttctttccattcaccttcactggatcttgtttctgaagctttagcggttatcaacaatgggaacaagggccctccagttggctcaaggataagcatgccaaccacaaagcctcgtccaggactgagagaagaaaaattagcaagtatcatgagtaagctgccactagctactcccaaaaaactagattctactcagactacacattcttcaagtcttattgctggtcacacagggccagtaccaaagaaaccccaggatttagctcatactggcatctcttcaggccttattgctggttcttccattcagaaccctaaagtttctttagaacctttgccagccaggctacttcaacaaggacttcagaggtcaagccagattcacacttcttcctcttcacagacccatgtctcctcttcttcccaagcccaaattgctgcctcttctcatgctctgggaacatccgaggcccaagatgcttcttcgttaacacaagtaacaaaggtgcaccagcattcagctgtccagcagaactatgtgtctccattacaggccaccatcagtaaatcccagaccaaccccgtcgtgaagttaagtaataatccccaactctcctgttcctcctcacttattaagacttcagataagccacttatgtaccgccttcccttatctaccccctcacctggaaatggttctcaagggtcccaccccctggtttctaggacagtacctagcaccactacctccagtaactatttagccaaggctatggtgtcacagatctccacgcagggtttcaaatctcccttctcgatggctgcctccccaaaacttgccgcatctcccaagcctgccacatctcctaaacccctgccctcgcctaagccttctgcctcacccaagccctctctgtcagctaagccttcagtatcaactaaacttatttctaaatccaacccaactcccaagcctactgtatccccaagtagttccagtccaaatgcactagttgcccagggtagccactccagcactaacagcccagtccataaacagcccagtggaatgaacatcagcagacagtctcccaccttgaatttattgccctctagtcgcacttcaggccttccacctacaaaaaatcttcaggccccctcaaagctaacaaactcatcatccactggaactgttgggaagaacagcttgagtggaattgcaatgaatgtacctgccagcagaggtagcaaccttaactcaagcggagctaataggactagtctgtctgggggaacaggaagtggaacacagggtgctaccaaaccattgtctactccacatagaccatccactgcctcagggtcttcagtggtaacagccagtgtgcagtccacagcaggagcatcattattggctaatgcctcacctctgactctcatgacatcacctttgtctgtaacaaatcaaaatgtgactccttttgggatgctgggtggccttgttccagtgaccatgcccttccagtttcccttggagatatttggctttggaacggacacagctggagtgacaaccacctcgggatctacctcagccgctttccaccatagcctaactcagaatttactaaagggtttacagccaggaggagctcagcatgcagcaacgctttcccactcacctctgcctgcacacttacagcaagcatttcacgatggaggccaaagtaaaggggacactaaattaccacggaaatctcagtgactgcccagcaagcaaaggagacgaaatgtttagttgactgatggaatctacctgatgggaaagtacttatgtggtcatagggctgctgtttctgtcgatgtttacattctctcgtcccaagcactgtggtgaggaggaaaaagaaaagaaaacattacttgagcaaagccaggtgcaggaggaagaaatgcttttgtgcaaagttagtgacctttggtctcttctaaagaatgacagagttaccgtattaacagacttgaaagagactcagttgtcaaacccacagaaatacaaatttgatttttcccgggggaggaagaaggaagtgaagagaatttgggtaaactccatccatcctgggggttggatctgaacacttacagacataattggtaataaaaggcattaaaaactggaattaggccagtttgtcaggaataatgatcatgtctatttgaatggactgtgtagcagatttgccacaaaaagaaataataatgattctatctccgatagacagtagctgcatagcacaccctcgaaaatcctgaacaaacttgaatctcctccagtgtgtagcaacttccctcaatcagtggactaaagatccttcaggaaagttattttagcacagtgatatatattattaaatcatctagatttttaaaaatcaggaagttgagcctgttgctcttaagagatgaaacctagatgtcccctttttgtaaaagggtcaatttcatcttccgttcagaagcaggtacttaactcttttcttcaggtgatttgtgcatctagtattgactggttaattcttatttccattcttgatgttaaaatgtgactgtgttcacatttttctcctgagaaatggggatctttacagggttattgctttgctgcttttagcccttgcagcaacataaactctaagtttccccagttcatctaacttcacaacttctccttctgttcttttagctagtggtccttcaggtgattattagctattggtataaacaggtagaagtgtacactatgtttcttcattggtcattcaaatggcatgaatatagtttttgaatttttaagatggtattttaaagggaggaatcacattaggatcacaatcacgacatatttttactccctgtatccagtgtagtgaaattgtttggagcatttgagatcctaaagcttcactatttactcagtgtattggtatgtgagtaaatctgcagaaaataagactccttagttattatagcttccttatgcaaatagcatattcaacaaaggatgttaagggaaaaatttatggttctccttggatacatttgatttgatgggtttttttgccgcattattctagttttttaagcttctgaatattttcatactatatcagagaatggtgtaaactctaaatggtataagcttcatccatttataatgacactaacctaaaaaaaatagactggtagtgacaagatttattgcatatgtgtttattatacattaccctataccattagatttactcaattaagagtattaaccaggcccttttttcttttatacacaaaagtcccagataccctacaggactgtgaataaataaccacagatcggttcagatctgtatgcctatattttgacttcaaagtcacattggcttgcttcatagcgaaaaagttaataaataactgaaaactttagttccaagaacttgttacagtaaagggaaaggattatttcaaaggaatcactgatataatttcttgactctaagaatttagtttatcaataaaacaaatatggatgtagtatgaaccccagtagatattttggaaggatactgggaggatgttgcagagaggtttgacttgaattcagtatgtttgatgaagatttgcttggtttcaattaaggaagcttgcccaatttttttaattttttcaaatgtagtggacctcttgcttttacgaaatatgaataaaaaggtctttgcttcatacta

SEQ ID NO: 33399 - DNA, 2299 bp, Homo sapiens
gcggatgtcggtgtgagcgagcggcgcctgaacacacggcggctgccgagcgcctgacccgggcctgcgccagagcctgcaccgagctccggggccccacacccgctacggtggccctgcgcccgttgctactgaggcggcgtgctctgcattcttcgctgtccaggcctgccggctctggtgtctgctggctcctccttgctcgcctgctccctcctgcttgcctgagtcaccgccgccgccgccgccacagccatggccgagagtggtgaaagcggcggtcctccgggctcccaggatagcgccgccggagccgaaggtgctggcgcccccgcggccgctgcctccgcggagcccaaaatcatgaaagtcaccgtgaagaccccgaaggaaaaggaggaattcgccgtgcccgagaatagctccgtccagcagtttaaggaagaaatctctaaacgttttaaatcacatactgaccaacttgtgttgatatttgctggaaaaattttgaaagatcaagataccttgagtcagcatggaattcatgatggacttactgttcaccttgtcattaaaacacaaaacaggcctcaggatcattcagctcagcaaacaaatacagctggaagcaatgttactacatcatcaactcctaatagtaactctacatctggttctgctactagcaacccttttggtttaggtggccttgggggacttgcaggtctgagtagcttgggtttgaatactaccaacttctctgaactacagagtcagatgcagcgacaacttttgtctaaccctgaaatgatggtccagatcatggaaaatccctttgttcagagcatgctctcaaatcctgacctgatgagacagttaattatggccaatccacaaatgcagcagttgatacagagaaatccagaaattagtcatatgttgaataatccagatataatgagacaaacgttggaacttgccaggaatccagcaatgatgcaggagatgatgaggaaccaggaccgagctttgagcaacctagaaagcatcccagggggatataatgctttaaggcgcatgtacacagatattcaggaaccaatgctgagtgctgcacaagagcagtttggtggtaatccatttgcttccttggtgagcaatacatcctctggtgaaggtagtcaaccttcccgtacagaaaatagagatccactacccaatccatgggctccacagacttcccagagttcatcagcttccagcggcactgccagcactgtgggtggcactactggtagtactgccagtggcacttctgggcagagtactactgcgccaaatttggtgcctggagtaggagctagtatgttcaacacaccaggaatgcagagcttgttgcaacaaataactgaaaacccacaactgatgcaaaacatgttgtctgccccctacatgagaagcatgatgcagtcactaagccagaatcctgaccttgctgcacagatgcagaatcctgatacactatcagcaatgtcaaaccctagagcaatgcaggccttgttacagattcagcagggtttacagacattagcaacggaagccccgggcctcatcccagggtttactcctggcttgggggcattaggaagcactggaggctcttcgggaactaatggatctaacgccacacctagtgaaaacacaagtcccacagcaggaaccactgaacctggacatcagcagtttattcagcagatgctgcaggctcttgctggagtaaatcctcagctacagaatccagaagtcagatttcagcaacaactggaacaactcagtgcaatgggatttttgaaccgtgaagcaaacttgcaagctctaatagcaacaggaggtgatatcaatgcagctattgaaaggttactgggctcccagccatcatagcagcatttctgtatcttgaaaaaatgtaatttatttttgataacggctcttaaactttaaaatacctgctttatttcattttgactcttggaattctgtgctgttataaacaaacccaatatgatgcattttaaggtggagtacagtaagatgtgtgggtttttctgtatttttcttttctggaacagtgggaattaaggctactgcatgcatcacttctgcatttattgtaattttttaaaaacatcaccttttatagttgggtgaccagattttgtcctgcatctgtccagtttatttgctttttaaacattagcctatggtagtaatttatgtagaataaaagcattaaaaagaa

SEQ ID NO: 33400 - DNA, 4118 bp, Homo sapiens
ggaaactgcgatttagtttttggtgaaaggagtggaaaaaaaccatgaactgacctaccccgccccattttgcttttagtccttcacactggcttcgcctgcactttgggcaatggagcgggaaaggaaaaggcacgcaggctgagctcaaagtcgcgccagccggggatgactcggcgacgccgccaggcgcgttacccggcgtgctccgcgcggcgccggcgaagggacgtgggggaaggggcagggaggaggaagcggtggctgctgcggatgtcggtgtgagcgagcggcgcctgaacacacggcggctgccgagcgcctgacccgggcctgcgccagagcctgcaccgagctccggggccccacacccgctacggtggccctgcgcccgttgctactgaggcggcgtgctctgcattcttcgctgtccaggcctgccggctctggtgtctgctggctcctccttgctcgcctgctccctcctgcttgcctgagtcaccgccgccgccgccgccacagccatggccgagagtggtgaaagcggcggtcctccgggctcccaggatagcgccgccggagccgaaggtgctggcgcccccgcggccgctgcctccgcggagcccaaaatcatgaaagtcaccgtgaagaccccgaaggaaaaggaggaattcgccgtgcccgagaatagctccgtccagcagtttaaggaagaaatctctaaacgttttaaatcacatactgaccaacttgtgttgatatttgctggaaaaattttgaaagatcaagataccttgagtcagcatggaattcatgatggacttactgttcaccttgtcattaaaacacaaaacaggcctcaggatcattcagctcagcaaacaaatacagctggaagcaatgttactacatcatcaactcctaatagtaactctacatctggttctgctactagcaacccttttggtttaggtggccttgggggacttgcaggtctgagtagcttgggtttgaatactaccaacttctctgaactacagagtcagatgcagcgacaacttttgtctaaccctgaaatgatggtccagatcatggaaaatccctttgttcagagcatgctctcaaatcctgacctgatgagacagttaattatggccaatccacaaatgcagcagttgatacagagaaatccagaaattagtcatatgttgaataatccagatataatgagacaaacgttggaacttgccaggaatccagcaatgatgcaggagatgatgaggaaccaggaccgagctttgagcaacctagaaagcatcccagggggatataatgctttaaggcgcatgtacacagatattcaggaaccaatgctgagtgctgcacaagagcagtttggtggtaatccatttgcttccttggtgagcaatacatcctctggtgaaggtagtcaaccttcccgtacagaaaatagagatccactacccaatccatgggctccacagacttcccagagttcatcagcttccagcggcactgccagcactgtgggtggcactactggtagtactgccagtggcacttctgggcagagtactactgcgccaaatttggtgcctggagtaggagctagtatgttcaacacaccaggaatgcagagcttgttgcaacaaataactgaaaacccacaactgatgcaaaacatgttgtctgccccctacatgagaagcatgatgcagtcactaagccagaatcctgaccttgctgcacagatgatgctgaataatcccctatttgctggaaatcctcagcttcaagaacaaatgagacaacagctcccaactttcctccaacaaatgcagaatcctgatacactatcagcaatgtcaaaccctagagcaatgcaggccttgttacagattcagcagggtttacagacattagcaacggaagccccgggcctcatcccagggtttactcctggcttgggggcattaggaagcactggaggctcttcgggaactaatggatctaacgccacacctagtgaaaacacaagtcccacagcaggaaccactgaacctggacatcagcagtttattcagcagatgctgcaggctcttgctggagtaaatcctcagctacagaatccagaagtcagatttcagcaacaactggaacaactcagtgcaatgggatttttgaaccgtgaagcaaacttgcaagctctaatagcaacaggaggtgatatcaatgcagctattgaaaggttactgggctcccagccatcatagcagcatttctgtatcttgaaaaaatgtaatttatttttgataacggctcttaaactttaaaatacctgctttatttcattttgactcttggaattctgtgctgttataaacaaacccaatatgatgcattttaaggtggagtacagtaagatgtgtgggtttttctgtatttttcttttctggaacagtgggaattaaggctactgcatgcatcacttctgcatttattgtaattttttaaaaacatcaccttttatagttgggtgaccagattttgtcctgcatctgtccagtttatttgctttttaaacattagcctatggtagtaatttatgtagaataaaagcattaaaaagaagcaaatcatttgcactctataatttgtggtacagtattgcttattgtgactttggcatgcatttttgcaaacaatgctgtaagatttatactactgataattttgttttatttgtatacaatatagagtatgcacatttgggactgcatttctggaaacatactgcaataggctctctgagcaaaacacctgtaactaaaaaagtgaagataagaaaatactcttaaagctgagtatttcctaattgtatagaatcttacagcatctttgacaaacatctcccagcaaaagtgccggttagtcaggtttgttgaaaatacagtagaaaagctgattctggttatctctttaaggacaattaattgtacagacacataatgtaacattgtctcaacattcattcacagattgactgtaaattaccttaatctttgtgcagactgaaggaacactgtagtataccccaaagtgcatttgcctaggacttctcagcttctcccataggtagtttaacaggcattaaaatttgtaattgaaatgttgctttcactgaaaaagtgtcttgatgtttcagttatttttaatcgccataaaaaaatagaactatcttttgggtttatctgttttctcatgcacaggcaatacacaaatttaaaatgagttgtgagccaattgtttctgaagtgttttggtagttctattaagaaatagttaaatattgtgcttttcagagcctcagagaaagggggacggggtgggggggtggggcagcggaatctgtcctggatggggccagcttaaataatactggcaaccaagattctgttaggatttctgtgcatatagtgtagtaaagaagtatcattcaggggtgaaaaacaaagagccgttttaatgatgttgagtacatttggctgttttatagcctttttcttccctcccccaaagaattctgtttgcctaactcccaaactgttggggtggtacattcctttaggaccaattaaaacataattgagggtcagtgatacatttggctgactctggttcagtattctcttaggtgattatattctctcatgtacagttacaggaaattaaaatgttaaagtaacctaaaatgaattcagaccaataaaatcaagggaaatacaagttgattgcattacttctgtatgttgcttgctattaaaaaggttaagaggccaggttacccaccagtccttgcactgttctgacactttccccaggaggaaaacaagtacaaaggttacggtggaggcataagtagaagagattgttaagaagggtattcatgtgtctttgctctttctgctttatgcctcagtttggtttaaaaacttctgtactggcaaatggtggtattcagtgtgggatagtgtcataactaatttgacaatttattaatcataaaataacaataaatctctagcttttacacttga

SEQ ID NO: 33401 - DNA, 3418 bp, Homo sapiens
tgccagagttgctgggagtgcgcgcggtcggatcacaaggcggcggcggaggaggcccagagaccggagcgcggagacctcagccagcggcctacgcccaggcctttctccaccggaggaccagggaaccgcagtcttcatcacagaggtaccgtgctccgcgctccccgcctgacccggcccagcccgctgcggcggtgcctccttccttcctccttccctcgcgctctctctttcgcccgcccgcgccttccctgcccgcctgcgtcaccgcggccgccatggctgagaatggcgagagcagcggccccccgcgcccctcccgcggccctgctgcggcccaaggctcggctgctgccccggctgagcctaaaatcatcaaagtcacggtgaagactcccaaagagaaagaggagttcgcggtgcccgagaacagctcggttcagcagtttaaggaagcgatttcgaaacgcttcaaatcccaaaccgatcagctagtgctgatttttgccggaaaaatcttaaaagatcaagataccttgatccagcatggcatccatgatgggctgactgttcaccttgtcatcaaaagccagaaccgacctcagggccagtccacgcagcctagcaatgccgcgggaactaacactacctcggcgtcgactcccaggagtaactccacacctatttccacaaatagcaacccgtttgggttggggagcctgggaggacttgcaggccttagcagcctgggcttgagctcgaccaacttctctgagctccagagccagatgcagcagcagcttatggccagccctgagatgatgatccaaataatggaaaatccctttgttcagagcatgctttcgaatcccgatctgatgaggcagctcattatggctaatccacagatgcagcaattgattcagagaaacccagaaatcagtcacctgctcaacaacccagacataatgaggcagacactcgaaattgccaggaatccagccatgatgcaagagatgatgagaaatcaagacctggctcttagcaatctagaaagcatcccaggtggctataatgctttacggcgcatgtacactgacattcaagagccgatgctgaatgccgcacaagagcagtttgggggtaatccatttgcctccgtggggagtagttcctcctctggggaaggtacgcagccttcccgcacagaaaatcgcgatccactacccaatccatgggcaccaccgccagctacccagagttctgcaactaccagcacgaccacaagcactggtagtgggtctggcaatagttccagcaatgctactgggaacaccgttgctgccgctaattatgtcgccagcatctttagtaccccaggcatgcagagcctgctgcaacagataactgaaaacccccagctgattcagaatatgctgtcggcgccctacatgagaagcatgatgcagtcgctgagccagaatccagatttggctgcacagatgatgctgaatagcccgctgtttactgcaaatcctcagctgcaggagcagatgcggccacagctcccagccttcctgcagcagatgcagaatccagacacactatcagccatgtcaaacccaagagcaatgcaggctttaatgcagatccagcaggggctacagacattagccactgaagcacctggcctgattccgagcttcactccaggtgtgggggtgggggtgctgggaaccgctataggccctgtaggcccagtcacccccataggccccataggccctatagtcccttttacccccataggccccattgggcccataggacccactggccctgcagccccccctggctccaccggctctggtggccccacggggcctactgtgtccagcgctgcacctagtgaaaccacgagtcctacatcagaatctggacccaaccagcagttcattcagcaaatggtgcaggccctggctggagcaaatgctccacagctgccgaatccagaagtcagatttcagcaacaactggaacagctcaacgcaatggggttcttaaaccgtgaagcaaacttgcaggccctaatagcaacaggaggcgacatcaatgcagccattgaaaggctgctgggctcccagccatcgtaatcacatttctgtacctggaaaaaaaatgtatcttatttttgataatggctcttaaatctttaaacacacacacaaaatcgttctttactttcattttgattcttttaaatctgtctagttgtaagtctaatatgatgcattttaagatggagtccctccctcctacttccctcactccctttctcctttgcttatttttcctaccttcccttcctcttgtctccccactccctccctctttgtttccttccttccttatttcctttagtttccttccttagccgttttgagtggtgggaatcaatgctgtttcactcaaaagtgttgcatgcaaacacttctctttattctgcatttattgtgatttttggaaacaggtatcaaccttcacagttgggtgaacaagtgttgtcctacagatgtccaatttatttgcatttttaaacattagcctatgatagtaatttaatgtagaatgaagatattaaaaacagaagcaaattatttgaagctctctaatttgtggtacgatattgcttattgtgactttggcatgtatttttgctagcaaaatgctgtaagatttataccattgatcttttttgctatatttgtatacagtacagtaagcacaattggcactgtacatctaaaaatattacagtagaatctgagtgtaatatgtgtaaccaaaatgagaaagaatacaagaaatgtttctggagctagttatgtctcacaattttgtagaatcttacagcatctttgataaacttctcagtgaaaatgttggctaggcaagttcagttaaaatatagtagaaatgtttatcctggtatctctaagtatacatttaattgtacagaaaatttacagtgtaacattgtgtcaacatttgcagattgactgtatatgaccttaatctttgtgcagcctgaaggatcagtgtagtaatgccaggaaagtgctttttacctaagacttccttctcagcttctcccataaagagaccctaatatgcattttgatttgtaattggaaatgtaactttcactgaaagtgtcatgtgatgtttgcattacttttaactgctatgtataaaggaaagtgtgtcttttgacttcatcagttatttctcttgtgcacagagaaaaatgcattaaaaatgactaaaaaaaataaaaaattaaaaaatggataaatcttttctttttgccttttggccctaggatcgtgtttaggaggattatcccaccccgaga

SEQ ID NO: 33402 - DNA, 2167 bp, Homo sapiens
acaaggcggcggcggaggaggcccagagaccggagcgcggagacctcagccagcggcctacgcccaggcctttctccaccggaggaccagggaaccgcagtcttcatcacagaggtaccgtgctccgcgctccccgcctgacccggcccagcccgctgcggcggtgcctccttccttcctccttccctcgcgctctctctttcgcccgcccgcgccttccctgcccgcctgcgtcaccgcggccgccatggctgagaatggcgagagcagcggccccccgcgcccctcccgcggccctgctgcggcccaaggctcggctgctgccccggctgagcctaaaatcatcaaagtcacggtgaagactcccaaagagaaagaggagttcgcggtgcccgagaacagctcggttcagcagtttaaggaagcgatttcgaaacgcttcaaatcccaaaccgatcagctagtgctgatttttgccggaaaaatcttaaaagatcaagataccttgatccagcatggcatccatgatgggctgactgttcaccttgtcatcaaaagccagaaccgacctcagggccagtccacgcagcctagcaatgccgcgggaactaacactacctcggcgtcgactcccaggagtaactccacacctatttccacaaatagcaacccgtttgggttggggagcctgggaggacttgcaggccttagcagcctgggcttgagctcgaccaacttctctgagctccagagccagatgcagcagcagcttatggccagccctgagatgatgatccaaataatggaaaatccctttgttcagagcatgctttcgaatcccgatctgatgaggcagctcattatggctaatccacagatgcagcaattgattcagagaaacccagaaatcagtcacctgctcaacaacccagacataatgaggcagacactcgaaattgccaggaatccagccatgatgcaagagatgatgagaaatcaagacctggctcttagcaatctagaaagcatcccaggtggctataatgctttacggcgcatgtacactgacattcaagagccgatgctgaatgccgcacaagagcagtttgggggtaatccatttgcctccgtggggagtagttcctcctctggggaaggtacgcagccttcccgcacagaaaatcgcgatccactacccaatccatgggcaccaccgccagctacccagagttctgcaactaccagcacgaccacaagcactggtagtgggtctggcaatagttccagcaatgctactgggaacaccgttgctgccgctaattatgtcgccagcatctttagtaccccaggcatgcagagcctgctgcaacagataactgaaaacccccagctgattcagaatatgctgtcggcgccctacatgagaagcatgatgcagtcgctgagccagaatccagatttggctgcacagatgatgctgaatagcccgctgtttactgcaaatcctcagctgcaggagcagatgcggccacagctcccagccttcctgcagcagatgcagaatccagacacactatcagccatgtcaaacccaaccagcagttcattcagcaaatggtgcaggccctggctggagcaaatgctccacagctgccgaatccagaagtcagatttcagcaacaactggaacagctcaacgcaatggggttcttaaaccgtgaagcaaacttgcaggccctaatagcaacaggaggcgacatcaatgcagccattgaaaggctgctgggctcccagccatcgtaatcacatttctgtacctggaaaaaaaatgtatcttatttttgataatggctcttaaatctttaaacacacacacaaaatcgttctttactttcattttgattcttttaaatctgtctagttgtaagtctaatatgatgcattttaagatggagtccctccctcctacttccctcactccctttctcctttgcttatttttcctaccttcccttcctcttgtctccccactccctccctctttgtttccttccttccttatttcctttagtttccttccttagccgttttgagtggtgggaatcaatgctgtttcactcaaaagtgttgcatgcaaacacttctctttattctgcatttattgtga

SEQ ID NO: 33403 - DNA, 2407 bp, Homo sapiens
agggacctgatagtgcgggttctggcccagaaggcctcaggggtggctgtgtagcaagatgagggaggtttggagccctgcataaagagaaggacgggaccacagctgactgctgtgtccccacagatctgggcctcctgctgccaccatggccaaaggtggagaagccctgccacagggcagcccagcaccagtccaggatccccacctcatcaaggtgacagtgaagacgcccaaagacaaggaggatttctcagttacagacacatgcactatccagcagctgaaggaagagatatctcagcgctttaaggcccaccccgatcagcttgttctaatctttgctggcaaaatcctcaaggatcctgactcactggcacagtgtggagtgcgagatggcctcactgtccacctggtcatcaagaggcagcaccgtgccatgggcaatgagtgcccagctgcctctgtccctacccagggcccaagtcctggatcactccctcagccaagctccatttacccagcagatgggccccctgcctttagcttaggtctcctcacaggcctcagtaggctgggcttggcctatcgtggcttccctgaccagccaagctccctgatgcggcagcatgtgtctgtgcctgagtttgtgactcagctcattgatgaccccttcatcccgggtctgctgtccaacacaggcctagtacgccagctggttcttgacaacccccatatgcagcagctgatccagcacaaccctgagattgggcatattcttaacaacccggaaattatgcggcagacactggagtttttacgtaaccctgccatgatgcaggagatgatacgtagccaggaccgggtgctcagtaacttggagagcattcctggtggctacaatgtgctttgcactatgtacacagatattatggacccaatgcttaacgcagtccaggagcagtttggcggcaatccctttgccactgccactactgataatgccaccaccaccaccagccaaccttcaaggatggagaattgtgaccctctccccaacccctggacttccacacatggaggctcaggtagcaggcaaggaaggcaggatggggatcaggatgcacctgacattagaaataggtttccaaactttctgggtattataaggctctatgactatctccagcaattacacgagaacccccagtccctaggaacttatctacaggggactgcatctgccctcagccaaagccaggaaccaccaccatcagtaaacagagttcccccatcgtcaccctcatctcaggagcctgggtcaggccagcctctccccgaggagtcagtagcaatcaagggaaggtcctcctgcccagctttcctgagataccccacagagaacagtactggacaaggtggagaccaagatggtgcagggaaaagctctactggacatagcacaaacttgcctgatcttgtctcggggctgggagattctgccaacagggttccatttgctcccttatctttttcccccacggcagccattcctggaatccctgagcctccctggctgccatccccggcttatccaagatctctgaggccagatggcatgaatccagctccacagttacaggatgagatacaaccacagctgccactgctgatgcaccttcaggcagccatggcaaacccccgtgccctgcaagccctgcggcagattgagcagggtctacaggtcctagctactgaagcacctcgcctcctactctggttcatgccttgcctagcagggacgggtagtgtggcaggaggtatagagtctagagaagatccccttatgtctgaggatcctctcccaaatccacctcctgaggtgttcccagcactggactctgcagagctgggcttcctttcccctccctttctccatatgctgcaagatttagttagtacaaatccccagcagctgcagcctgaggctcactttcaggtgcagctggagcaactgcggtccatgggctttctgaatcgtgaagccaatcttcaggccctcattgctacggggggcgacgtggatgctgctgtggagaagctgagacagtcgtaggagccttattcattcaaaccatacgttttcctctgtgcctttttcccatatcctagttccctagctctcccatttttgaatacagctgcattataaaccaaatttactatgaagtcctttgctgtggaggcaatgttgttccagagtcaacgaggaagactaatggccaaaacatagtggaggtgctgtgtgtgagtcaaccacttgtaccactataccactggggggccccagtctaagctctgcttatgcctatcttgagatgcaattacacccaatttccaatgtgaa

SEQ ID NO: 33404 - DNA, 817 bp, Homo sapiens
cagaaggcctcaggggtggctgtgtagcaagatgagggaggtttggagccctgcataaagagaaggacgggaccacagctgactggatgatcttggtctccaatccccatgcccctagctgtgtccccacagatctgggcctcctgctgccaccatggccaaaggtggagaagccctgccacagggcagcccagcaccagtccaggatccccacctcatcaaggtgacagtgaagacgcccaaagacaaggaggatttctcagttacagacacatgcactatccagcagctgaaggaagagatatctcagcgctttaaggcccaccccgatcagcttgttctaatctttgctggcaaaatcctcaaggatcctgactcactggcacagtgtggagtgcgagatggcctcactgtccacctggtcatcaagaggcagcaccgtgccatgggcaatgagtgcccagctgcctctgtccctacccagggcccaagtcctggatcactccctcagccaagctccatttacccagcagatgggccccctgcctttagcttaggtctcctcacaggcctcagtaggctgggcttggcctatcgtggcttccctgaccagccaagctccctgatgcggcagcatgtgtctgtgcctgagtttgtgactcagctcattgatgaccccttcatcccgggtctgctgtccaacacaggcctagtacgccagctggttcttgacaacccccatatgcagcagctgatccagcacaaccctgagattgggcatattcttaacaacccggaaattatgcggcagacactg

SEQ ID NO: 33405 - DNA, 2451 bp, Homo sapiens
ggcggcggcggcatggcggagccgagcggggccgagacgaggccccccattcgggtcaccgtcaagacccccaaggacaaggaggaaattgtgatctgcgatcgagcctcggtcaaggagttcaaagaggaaatctcccggaggtttaaggctcagcaggatcagctggtcctgatcttcgcaggcaagatcctcaaggatggggacacactgaaccagcacggaatcaaggacgggctcactgtccatctggtcatcaagacccctcagaaggctcaagatccagctccgcctgcagctcccagtcttcctgcagcagatgcagaacccagagtcactctccatccttaccaatccccgagccatgcaggcattgctgcagatccagcagggactacagaccttgcagaccgaggcccctgggctggtacccagccttggctcctttgggatatcccggaccccagcaccctcagcaggcagcaacgcagggtctacgcccgaggcccccacttcctcaccagccacgccagccacatcttctccaacaggggcttccagcgcccagcagcaactcatgcagcagatgatccagcttttggctggaagtggaaactcacaggtgcagacgccagaagtgagatttcagcagcagctggagcagctcaactccatgggcttcatcaatcgtgaggctaacctgcaggccctgattgccacaggaggggacatcaacgcagctatcgagagactgctgggctcccagctctcctaatccctcggcccatgcctcctgcctctcccctccctcgatgtcagcattcggttcttctgtcaatccttaccctctgcagcttgtcctcccttccgtcttctccctcatcctttccaaacagcagggtgactttagaggcatgggctccaaccccttagctctgtctgagaattatggttttactgctacgtctctaacagactcttctctcctggtctccttgagcagtgctacttaaacagttttcacagtttcattgattgactctacctccttgccccacaccacttttgcaatctttaaactttcagtggctgtgcagagtcgagggaggaaccagctctctggtttactggaacatagtcttccatctataccactagggttttgtcttatgtttacttttggtaactctcttccttctttttctccctaccccccaacccctagcccaaccaatgctagaatttcttgctctgaaggaggagcaggtgaaacaggtggtaattttccttctcggcccctattctggttcattcagcactttttggtgggaactgttggaaattccagggtaaggaggaagatgcctgttctccctgtctgaagagggagatgagacagctctctggacaggaattaacaaacgctggagcagcccagaggaaattcgtgtgaaagaggagggaatgagattattcggaggaagggaatgggggagacagcctgagtaaaaggcttggaagttggaattaacagtggggagcagaagcactcatagctcttttaggcagaagaatccaggcccgagctggcagaagagacttagagatgctaatggaatttaaactgaaaaaaggagcccaatgaagctaagcgccacgccccacaaggggtcatattggctttagttcctcaagcatatgtgcttatatgcacacacacacacatttccatggacccaggtcttgcttgtgtccccaggcaccagtagtttgagcccccctcaaaagacatgaagggggttggggtctgtgtgagtagtggggaggtgcatgtgtatccacatgtgtgcatacactcttaagttgggtgggaagtggattccttgttggtttctggttcagagtgctctcccaccaccagagacaagtgggtaaaaaggtcagtccattgcaggaatatatatccgggagagctaggtcccttggggctctggatgctgggtaacccagaggtaatgtgggtaccctttctgaagctgtcagggctgtgactagcacccttatcacccctcactgccttgtgggaatagtagagggtttttttcctccagagcccctggcctttcagttcttaactatttccctccaggccagaaagttttctttgaggaaggagaggagagggtggcaatgatgcctttgatctggaattggacatttctctgtcagagcacagaggaggctcatatcacctcttccctctcctacttggcccagctgcttggaggaccgaccccatggctgagaatatgacggcaagaggaacagagtttgctccaagtgggaaagggtcccaagcagtccagagaagatgtctgtgtggctttccctccctgcctcccccagctcccacactggcctttgtaaataaatggcgtggtctttgttgtg

SEQ ID NO: 33406 - DNA, 3576 bp, Homo sapiens
gttggaggcgcagaagccgagccgggccggccgggcgggcggggaggaggaggagccgggcgggctggcgggcggccgggtggcggcggcggcatggcggagccgagcggggccgagacgaggccccccattcgggtcaccgtcaagacccccaaggacaaggaggaaattgtgatctgcgatcgagcctcggtcaaggagttcaaagaggaaatctcccggaggtttaaggctcagcaggatcagctggtcctgatcttcgcaggcaagatcctcaaggatggggacacactgaaccagcacggaatcaaggacgggctcactgtccatctggtcatcaagacccctcagaaggctcaagatccagctgctgccactgcttcttccccctccacacctgaccctgcctcagcaccctccaccacgcctgcttcacccgccacccctgcccagccctccacctctggcagtgcctcttcagatgctggcagtggaagccggaggagcagtggtggggggccctctccgggggctggggagggatcccccagtgctactgcgtccatactctctggctttgggggcatcctggggctgggcagcctaggcctgggctctgccaacttcatggagctgcagcagcagatgcagcggcagctgatgtccaatcctgagatgctgtcacagatcatggagaaccccctggtccaggatatgatgtctaaccctgatctgatgcgtcacatgattatggccaacccccagatgcagcagttgatggagcggaaccctgagatcagccacatgctcaataaccctgaactcatgaggcagacaatggagcttgctcggaatccagccatgatgcaagagatgatgcggaaccaggaccgggccctgagcaaccttgagagcatccctggagggtataatgccctccgccgcatgtacacggacatccaggagcccatgttcagtgctgcccgggaacagtttggcaacaatcccttctcttccctggccgggaactccgacagctcatcctcccagcctctgcggactgagaatcgagagcccctccctaacccctggagcccctcgccccccacctcccaggcccccgggtccggtggggagggcaccggaggatcggggaccagccaggtgcacccgacagtctcgaacccctttgggatcaatgcggctagcctggggtcagggatgttcaatagcccagaaatgcaagccctcctccagcagatctctgagaacccccagctgatgcagaatgtgatctcagcaccctacatgcgcagcatgatgcagacgcttgcccagaaccccgactttgctgctcagatgatggtgaatgtgccgctcttcgcggggaacccccaactgcaggagcagctccgcctgcagctcccagtcttcctgcagcagatgcagaacccagagtcactctccatccttaccaatccccgagccatgcaggcattgctgcagatccagcagggactacagaccttgcagaccgaggcccctgggctggtacccagccttggctcctttgggatatcccggaccccagcaccctcagcaggcagcaacgcagggtctacgcccgaggcccccacttcctcaccagccacgccagccacatcttctccaacaggggcttccagcgcccagcagcaactcatgcagcagatgatccagcttttggctggaagtggaaactcacaggtgcagacgccagaagtgagatttcagcagcagctggagcagctcaactccatgggcttcatcaatcgtgaggctaacctgcaggccctgattgccacaggaggggacatcaacgcagctatcgagagactgctgggctcccagctctcctaatccctcggcccatgcctcctgcctctcccctccctcgatgtcagcattcggttcttctgtcaatccttaccctctgcagcttgtcctcccttccgtcttctccctcatcctttccaaacagcagggtgactttagaggcatgggctccaaccccttagctctgtctgagaattatggttttactgctacgtctctaacagactcttctctcctggtctccttgagcagtgctacttaaacagttttcacagtttcattgattgactctacctccttgccccacaccacttttgcaatctttaaactttcagtggctgtgcagagtcgagggaggaaccagctctctggtttactggaacatagtcttccatctataccactagggttttgtcttatgtttacttttggtaactctcttccttctttttctccctaccccccaacccctagcccaaccaatgctagaatttcttgctctgaaggaggagcaggtgaaacaggtggtaattttccttctcggcccctattctggttcattcagcactttttggtgggaactgttggaaattccagggtaaggaggaagatgcctgttctccctgtctgaagagggagatgagacagctctctggacaggaattaacaaacgctggagcagcccagaggaaattcgtgtgaaagaggagggaatgagattattcggaggaagggaatgggggagacagcctgagtaaaaggcttggaagttggaattaacagtggggagcagaagcactcatagctcttttaggcagaagaatccaggcccgagctggcagaagagacttagagatgctaatggaatttaaactgaaaaaaggagcccaatgaagctaagcgccacgccccacaaggggtcatattggctttagttcctcaagcatatgtgcttatatgcacacacacacacatttccatggacccaggtcttgcttgtgtccccaggcaccagtagtttgagcccccctcaaaagacatgaagggggttggggtctgtgtgagtagtggggaggtgcatgtgtatccacatgtgtgcatacactcttaagttgggtgggaagtggattccttgttggtttctggttcagagtgctctcccaccaccagagacaagtgggtaaaaaggtcagtccattgcaggaatatatatccgggagagctaggtcccttggggctctggatgctgggtaacccagaggtaatgtgggtaccctttctgaagctgtcagggctgtgactagcacccttatcacccctcactgccttgtgggaatagtagagggtttttttcctccagagcccctggcctttcagttcttaactatttccctccaggccagaaagttttctttgaggaaggagaggagagggtggcaatgatgcctttgatctggaattggacatttctctgtcagagcacagaggaggctcatatcacctcttccctctcctacttggcccagctgcttggaggaccgaccccatggctgagaatatgacggcaagaggaacagagtttgctccaagtgggaaagggtcccaagcagtccagagaagatgtctgtgtggctttccctccctgcctcccccagctcccacactggcctttgtaaataaatggcgtggtctttgttgtga

SEQ ID NO: 33407 - DNA, 5575 bp, Homo sapiens
agcggcctttctctgttcgcgatgtgacgtaacgcgcctgcggactgggcccagcttgtcctctatgacttacccagaaggcaacgcttctctttctggtcaaaatggctggtaagcaggccgtttcagcatcaggcaagtggctggatggtattcgaaaatggtattacaatgctgcaggattcaataaactggggttaatgcgagatgatacaatatacgaggatgaagatgtaaaagaagccataagaagacttcctgagaacctttataatgacaggatgtttcgcattaagagggcactggacctgaacttgaagcatcagatcttgcctaaagagcagtggaccaaatatgaagaggaaaatttctaccttgaaccgtatctgaaagaggttattcgggaaagaaaagaaagagaagaatgggcaaagaagtaatcatgtagttgaagtctgtggatgcagctgttatgaagatggttaaacttgaaacaaacaattttaagaattatttggtctgaagatgttttactttaaataaatgtctattgtaatggctggagtttttgaattccaaaccttatactgaataactactgaatccctttactgttaaatttttttccaaactttcaagatatatttagttgtgtttaactgctacttggagctcagaagccactttatcagttttcctcactggttggatagcctatcagtttatggaaggatataacttccgtaagttacatccttatggaagctactgaataaaagaagggggtatgcaccccctagtttgccaagattgagaaatagcctcttcactggtatgcaaacagatttgattttgcatcctatcatttaaaaagaaattatgtctgcaccccaacataggcatacttaagtaatatacatactcctgtgctaacatgtatactagaaaacaaaaagatgttagaaaaataaaagtataaagacaaatcatactgtccccatatcccagtgacttttccactttggaaatgattgttatgaagtttaagggttggatactagtcagttaaaagttttaagattatagggtaatttttaaaaatataaattagaatcattggcaaggcatggtggctcatgcctgtaatcccagcactttgggaggccgaggcgggcgggtcacctgaagtcaggaatttgagaccagcctggccaacatggtgaaaccctgtctctactaaaaatacaaaaaattagctaggcgtgatggtaggcacctgtaatcccagctactcgggaggctgagggaggagaattgcttgaccccaggaggtggaggttgcagtgagcctagatcacaccactgcacttcagcctgagcgacattgactgtctcaaaaaaaaaattaggattattcaatgttgtcatcatttccactcctaaattctgaaatgctttctttggtagaggtgagagtgtggagccacagctagtagagaaggaacagtaggacctgcagcctccctggttttccaggacaagtcattgctgtgtgtggcaggaatgccttacctcaaataacaaaacagtgtgaaaaacgaatttgtgttacatttaaagtttgtaaagcaatgagaaatgtgtgtatcataaagagcatctttaaatttttgctaaaatattagcctcttaaattctctaggaaccccctcccccgcttttttttttcctttcgctggtcgttatttttctaaacctatcctgaaatcatgtcaattttcttttgtatggttgaagacaactagatcacttgataatggttttgctcaggtcacattgtgacaaggttttaatgtagtcctactttgcagaaggaggccaagaagatgggctgtctagaaccccctttaaaagcatttgtctattcagaaaattttcctgagtagatctctgcaaaggctcttttaatagtgatttcaagatcacgtttgcaggactctggtctattcgttcagacgtctactgtgcacaattacaaggagactacaactgaggcatctcaaagagcactgtcaaggtgtgtagggagccgggtgggtggagggaggctgggctctgaccctagaaaccatgcttatgaatgctgttaatgtttaaagcaagcctaagggcactgctgaaggacaggggaacaaatagaactgaccaagactgaggtataacaggaacccccaggctatccacctgctcaaggtaaagtgtggtattacataaggcaacctctgattttgtaagagttcttcctaaagccaaagtgtatgcctattctatgtttccagattacttcattcttctaaatgagaacaagtgtgcaaaagttctttgaacactagatcaatgttttgtgttcattataaattatggttatcgtcctgcttgttatgaagactaagaaagtagatctagtatttggctcacacaggtgaatgggtgagaatttgttaatccatcagtgaagtcctttcatttgaaagagagggcctttctattatcaaaagccgtcctgtgtggaaaatcaccatgagagtgcctgaaacacaggcactctgcattgtcctgtagaccaaatctacattgtcctgtagtctggtctacattgtcctgtagaccgaatggtagagtgattcagagctaattctgggttagactgcacaggtctgaatctatttgctcactgtgtagtgctttaggaatacaatttaacctctccgtgcttcagtttgtttgtccctaagatagagctaatgatagaaacctacttcacccagttgtgaaaattaactgactgcatgtcaagcactaacagtttctggcatatagtatgcataatgtaaattatgtgctgagaagcgagaaagaataacttgggaaaacgctgaatatcatcaatgtcgaatagctaaccagtagctaaggtccaaggtctcctctcttccttctatgtggcactcttgtttctggttcatctactccccttgggtgtcacctccttgagtgaagtacctgctggagatgagaagagtggaactggatctgcatgacagctttgattaggatggagctaagacttggctatctccctgttttgtgttttggatgggtgacattttaaaactgccaatattcaaatcctgctaatttgctttgtacagtttaaaatgtttgatatcttttgttgtttaaagtttgagattggttttgaatatacagttttcctacatcttgaagaaagttatgtttgtttactctgaagtggtctatgttctgtttgtttgttttactatactttgcaaaaaaacagatggctggcttatgttcactgttgtagtgcactacctagtatcacttggccttcctgttgtcaagatgtaggaagcagcgtaagggatgtcgggccttcagacccccaattgccagctgtggtcctagttccagattgcatggaaatatttgataacattcctgcactgagttatcatggtctgaatatttatgtgacgctctacgagtggtaccaaaatgttagtgatggagtttttactaatggcaccttttcctgtttttaaattctagaatcttaataaatccaaagtgtacattttggtagtgatttcatttagttatttactttaaggactcccttttcaagcattaactctgcactaattttgacttatgaaaagattcagcagtaagaataaaaactgggccaaagcccaaagtaataatccttcacaaataggatggagttttaaaaatatgggcatcctgtgtgtagctttgaaaataaccaaactacttggaattaaaaagttaggtgaacatgaagattgtcataaccaaatccttgacagcttgatggatgaagagcagatgggtttatggtgtatgggaggaagcatggattttaggagggacagtatcagagagggatggttagaaagtgagtaagacaggttgctctttggaaaacaaggaaaatccctttattagaacaaggcatgaaattctgccactaggtggcgatgccctataactttacaacttagtgtacatcacacgagcactatggaagatttctccattctgcgccccaccaactccctcccctccttcatttttcaggatgacaacaccttagaggtttatggccatcaggagaatttactactaagctatatactgatgtaatgaaatctaatatatgttgtgcaatgaattatgagatgttatttagtttcaggattttattacttcaatcagttatgaccatatttccttttatatgattgctcactctttaaacataccagatgactgtataaggaacacctaataaagtctatagatgttaaaatattttaaatgttttaatttatatgccataatttgtttacattctggttatactggcgttcatattaaaagccataacatgttagaatctgagatctcaggtcggatagtgcctctaagttatattttgctaagaaattttattgtattagcaattgagcaagaaagaagaactgaatcattatacggtggttaatttttagcatagatgtcagaaagcctgttaatattccagaggcttatgataaactatttaaattgtcattctggattctgattatatctcctacaaagaaagagtgtattatttattgaactttttgtttgaatacatgtgcctatttttgcataaatgtaaaaatgtaattttaaaataaacccctgaaaacttctggtaacattatccagttgaataattgttctgttagtattctaaatattttaagaaaattgtatacatatctgtgacaattgtattcacaagccaaaccaaaaaaagataattatttgttttacaaaggagtcagcttacaatttttctcttatgcatgcatttaaaatgtggtttgccattaaactggaaacactgatctgaggccaatgatttaggcaagtcattagtctaaagattggcttcctcagctagaaaatgaagggctttgactaaaaagtctttttcatttcagtaccaaaacattctgggtctgtgatttaacttacgctctttattgttgggatgaactaatactgatggaatactagctttgtactaggcactgttcgtatgttgtctcttttaatcctccctgcaaccttctggcatggctattataatgcccattgtatggaagaagaaattaggcttcgaaagtccattttatgcttgttcattacataattttctggattttttaaattgatgtatgtgtttatgttccaggctaggcagaagctaggaagaatatagcagcctcgtcactgttgaaatctggggctagataattctttgttgtgggggcctcctctgtgtgttacaggatatttagcagcatcctggcttctacacgataggtaccagtagcgcctcctgcctccaactgtaacaaccaaaaatgttttgagacattgtctggaaatgttcccctgggggagcagaatt

SEQ ID NO: 33408 - DNA, 1985 bp, Homo sapiens
tactgactttcagcaccaacttgtggtcccaggtaagtttccacgctggtactttagccctgggctcgaacctgcggacacgctgtggctgcaactccccgcccgccagacctcagtacgcagcgcggctggtgagaaacataatgcactctgacttccacgcgtggaatggggagatggactgcacggcgggcggacctgctcgggctgatggacggcaggtggactgatgtgcgcagggactggcggcagcgcggtcagagccagtcagccaaagccaggccagcacaatagactgtcccggttcccgccaggaggcggccgagcaccaactgtacggtactgcgcctgcgccgcgaccgccaacgcgcccagtctacgcttgcgcggcgcaacagggccgactgcagctggaagatggcggcgtccgtggtctgtcgggccgctaccgccggggcacaagtgctattgcgcgcccgccgctcgccggccctgctgcggacgccagccttgcggagtacggcaaccttcgctcaggcgctccagttcgtgccggagacgcaggttagcctgctggacaacggcctgcgtgtggcctccgagcagtcctctcagcccacttgcacggtgggagtgtggattgatgttggcagccgttttgagactgagaagaataatggggcaggctactttttggagcatctggctttcaagggaacaaagaatcggcctggcagtgccctggagaaggaggtggagagcatgggggcccatcttaatgcctacagcacccgggagcacacagcttactacatcaaggcgctgtccaaggatctgccgaaagctgtggagctcctgggtgacattgtgcagaactgtagtctggaagactcacagattgagaaggaacgtgatgtgatcctgcgggagatgcaggagaatgatgcatctatgcgagatgtggtctttaactacctgcatgccacagcattccagggcacacctctagcccaggctgtggaggggcccagtgagaatgtcaggaagctgtctcgtgcagacttgaccgagtacctcagcacacattacaaggcccctcgaatggtgctggcagcagctggaggagtggagcaccagcaactgttagacctcgcccagaagcacctcggtggcatcccatggacatatgcagaggacgctgtgcccactcttactccatgccgcttcactggcagtgagatccgccaccgtgatgatgctctaccttttgcccacgtggccattgcagtagagggtcctggctgggccagcccggacaatgtggccttgcaagtggccaatgccatcatcggccactatgactgcacttatggtggtggcgtgcacctgtccagcccactggcttcaggtgctgtggccaacaagctatgccagagtttccagaccttcagcatctgctatgcagagacgggcttgctgggtgcacactttgtctgtgaccgaatgaaaatcgatgacatgatgttcgtcctgcaagggcagtggatgcgcctgtgtaccagtgccacggagagtgaggtggcccggggcaaaaacatcctcagaaatgccctggtatctcatctagatggcactactcctgtgtgtgaggacatcggacgcagcctcctgacctatggccgccgcatccccctggctgaatgggaaagccggattgcggaggtggatgccagtgtggtacgtgagatctgctccaagtacatctatgaccagtgcccagcagtggctggatatggccccattgagcagctcccagactacaaccggatccgtagcggcatgttctggctgcgcttctaggcgggaagcctatgtaagcaagagggcagggccggggtttgtggtcccccccccaccacaaacacagcacttcggctcctctaacctgtgccacaggtgaccaccaataaaatcctctgctgaga

SEQ ID NO: 33409 - DNA, 2615 bp, Homo sapiens
actatccaaaacatttctattttcctaacacaaaaactatagctaagtttttatattctatgtagccccagcctaggacgtaaattccacgagaccaaaagccttgtgatgattccccgaggttgctgaccctcccggtgtgtcccgggcctgctctgggggacacagcggcgaatacgttgaacgaggcccctgtttcacggagctaaagatccagtaaggacttcacccagcgagaggcaactacgccgggcttcgatacccaatacctctgcagaaaggtggagtggcaggaatctcctgaagcctccaacgtccaggaacgcggaaacccagggcctccagtgcaggtgtcatcccggagggcgcatgcggagtcccaagagaggcgcgtcccattggacaatgctgagcggaagagcccaagatagcggggggagttgtgacaggctgctgcagacgtacttagaaaaggggtgcatactggatattcaggctaggagaagaacgcaaaaagcagtgacgtacattattctctgcatatatttacttgggaaattgtgcgtctccctattctgagtcttggaggaattggactggtccaaccttataaagagagcagtagagcgcggcagtatagagagtacctcacgaaggggacgtgggaaagtgttagcggggaacgctgggaaactcccggcctccgccaccatcttgctttcctttaatccggcagtgaccgtgtgtcagaacaatcttgaatcatgaagctactaaccagagccggctctttctcgagattttattccctcaaagttgcccccaaagttaaagccacagctgcgcctgcaggagcaccgccacaacctcaggaccttgagtttaccaagttaccaaatggcttggtgattgcttctttggaaaactattctcctgtatcaagaattggtttgttcattaaagcaggcagtagatatgaggacttcagcaatttaggaaccacccatttgctgcgtcttacatccagtctgacgacaaaaggagcttcatctttcaagataacccgtggaattgaagcagttggtggcaaattaagtgtgaccgcaacaagggaaaacatggcttatactgtggaatgcctgcggggtgatgttgatattctaatggagttcctgctcaatgtcaccacagcaccagaatttcgtcgttgggaagtagctgaccttcagcctcagctaaagattgacaaagctgtggcctttcagaatccgcagactcatgtcattgaaaatttgcatgcagcagcttaccggaatgccttggctaatcccttgtattgtcctgactataggattggaaaagtgacatcagaggagttacattacttcgttcagaaccatttcacaagtgcaagaatggctttgattggacttggtgtgagtcatcctgttctaaagcaagttgctgaacagtttctcaacatgaggggtgggcttggtttatctggtgcaaaggccaactaccgtggaggtgaaatccgagaacagaatggagacagtcttgtccatgctgcttttgtagcagaaagtgctgtcgcgggaagtgcagaggcaaatgcatttagtgttcttcagcatgtcctcggtgctgggccacatgtcaagaggggcagcaacaccaccagccatctgcaccaggctgttgccaaggcaactcagcagccatttgatgtttctgcatttaatgccagttactcagattctggactctttgggatttatactatctcccaggccacagctgctggagatgttatcaaggctgcctataatcaagtaaaaacaatagctcaaggaaacctttccaacacagatgtccaagctgccaagaacaagctgaaagctggatacctaatgtcagtggagtcttctgagtgtttcctggaagaagtcgggtcccaggctctagttgctggttcttacatgccaccatccacagtccttcagcagattgattcagtggctaatgctgatatcataaatgcggcaaagaagtttgtttctggccagaagtcaatggcagcaagtggaaatttgggacatacaccttttgttgatgagttgtaatactgatgcacacattacaggagagagctgaacgttctctcagcccagagcagcaaacacatgaaagtcagaagtctctaatatatcatttgtcttttttccagtgaggtaaaataaggcataaatgcaggtaattattcccagctgacctaaagtcaataaaacattctgtttaagtgtttttcttacgtttttctcaatgagttaatcaacaagtatttattatgtgctgatatctttgttttagatgctttaaaggagacaggaatataattattgagtatagaagcatcagaaactattaaaattaaggctaagtggctatcggggtaaatagtgccagattactattggtggcgtttaagatgaaagcaagttcaaaatttgtcattttgggtgtcaacagctaaatggtctggtttttacccctgttttgccttttttgcaataaaattatttccaaaaaacatacatttcctatcaatcata

SEQ ID NO: 33410 - DNA, 604 bp, Homo sapiens
gaccacgatgagtgtgccgcacttccggccagatcgccggatttccgctgagtgacccttacaagtccttcttgatcctgaactgggttaggtgccgctgttgctgctcgtgttgaatctagaaccgtagccagacatgggactggaggacgagcaaaagatgcttaccgaatccggagatcctgaggaggaggaagaggaagaggaggaattagtggatcccctaacaacagtgagagagcaatgcgagcagttggagaaatgtgtaaaggcccgggagcggctagagctctgtgatgagcgtgtatcctctcgatcacatacagaagaggattgcacggaggagctctttgacttcttgcatgcgagggaccattgcgtggcccacaaactctttaacaacttgaaataaatgtgtggacttaattcaccccagtcttcatcatctgggcatcagaatatttccttatggttttggatgtaccatttgtttcttatttgtgtaactgtaagttcacatgaacctcatgggtttggcttaggctggtagcttctatgtaattcgcaatgattccatctaaataaaagttctatgatctgcaaa

SEQ ID NO: 33411 - DNA, 586 bp, Homo sapiens
gagtcaaccggatcggtgactgtggagggcgagctgagccctgtgcgtgagtggggtctggttgtgcagtgttcgtggaccctgggaggctaggggcgccccgctgggctgggaaaggataaggagtgcaggggcaggagtctggggttggggatggacccccgcggggactgcggcgcttcgcgaaagcgagccaagcgcctgtccaccctcggtcctgcagggccgccgccacaatgggccgcgagtttgggaatctgacgcggatgcggcatgtgatcagctacagcttgtcaccgttcgagcagcgcgcctatccgcacgtcttcactaaaggaatccccaatgttctgcgccgcattcgggagtctttctttcgcgtggtgccgcagtttgtagtgttttatcttatctacacatgggggactgaagagttcgagagatccaagaggaagaatccagctgcctatgaaaatgacaaatgagcaacgcatccggatgacggttccctgtctctgaaagacctttctctggaagaggagtctgcattgtagtgtctcaaagacacaataaacttcctatggtc

SEQ ID NO: 33412 - DNA, 429 bp, Homo sapiens
gccggaaatgacgaacgagtcaaccggatcggtgactgtggagggcgagctgagccctgtgcggccgccgccacaatgggccgcgagtttgggaatctgacgcggatgcggcatgtgatcagctacagcttgtcaccgttcgagcagcgcgcctatccgcacgtcttcactaaaggaatccccaatgttctgcgccgcattcgggagtctttctttcgcgtggtgccgcagtttgtagtgttttatcttatctacacatgggggactgaagagttcgagagatccaagaggaagaatccagctgcctatgaaaatgacaaatgagcaacgcatccggatgacggttccctgtctctgaaagacctttctctggaagaggagtctgcattgtagtgtctcaaagacacaataaacttcctatggtctgca

SEQ ID NO: 33413 - DNA, 839 bp, Homo sapiens
cttagagacagtaggaaaatggtatctcccggaagttacctcacgacctccaagagcggcttccaaccttgccggaaatgacgaacgagtcaaccggatcggtgactgtggagggcgagctgagccctggccgccgccacaatgggccgcgagtttgggaatctgacgcggatgcggcatgtgatcagctacagcttgtcaccgttcgagcagcgcgcctatccgcacgtcttcactaaaggaatccccaatgttctgcgccgcattcgggagtctttctttcgcgtggtgccgcagtttgtagtgttttatcttatctacacatgggggactgaagagttcgagagatccaagaggaagaatccagctgcctatgaaaatgacaaatgagcaacgcatccggatgacggttccctgtctctgaaagacctttctctggaagaggagtctgcattgtagtgtctcaaagacacaataaacttcctatggtctgcactgttgtgatattacatttttgtgagtagaatcctgtgtgaccactaatattcaagttcatgaagcgcccctcctcagcatgagtcttgaagttttgcctggtctcgggttttggtgaaagagcagggctccccctttgttccattatctacaagaaagtagctgcaggtactcctgcatctaaccatttgtgggtgacatgggctatggcgagtgctggttcttggccctctgctcccatagcaacaataaagtctactaactatattgtaattagtatgtgtcagggacgcttttattttttattttttgagatggagtcttgctctctcacccaggctgga

SEQ ID NO: 33414 - DNA, 2788 bp, Homo sapiens
gctccgtgcgcaagcgctttcggcggcgattaggtggtttccggttccgctatcttctttttcttcagcgaggcggccgagctgacgcaaacatgcagatctttgtgaagaccctcactggcaaaaccatcacccttgaggtcgagcccagtgacaccattgagaatgtcaaagccaaaattcaagacaaggagggtatcccacctgaccagcagcgtctgatatttgccggcaaacagctggaggatggccgcactctctcagactacaacatccagaaagagtccaccctgcacctggtgttgcgcctgcgaggtggcattattgagccttctctccgccagcttgcccagaaatacaactgcgacaagatgatctgccgcaagtgctatgctcgccttcaccctcgtgctgtcaactgccgcaagaagaagtgtggtcacaccaacaacctgcgtcccaagaagaaggtcaaataaggtggttctttccttgaagggcagcctcctgcccaggccccgtggccctggagcctcaataaagtgtccctttcattgactggagcagcaattggtgtcctcatggctgatctgtccagggaggtggctgaagagtgggcatctcccttagggactctactcagcactccattctgtgccacctgtggggtcttctgtcctagattctgtcacatcggcattggtccctgccctatgcccctgactctggatttgtcatctgtaaaactggagtaaaaacctcagtcgtgtaattggtgggactgaggatcagttttgtcattgctgggatcctgtcaggcactttgaggtgtccctcaggccttggccctgaagtgtctaggtgtgtggagatgggtagaaaattaggtacacccaatggtgtagaacgttgattctcaaatttttttattttatacaaatggggtctcactatgttgtccaggctggtcttgaactcctgggctcaagccatccgcccatctcagcccctcaaagtgttgggattacaagcaagaactgccatgcctgacccagttctcagttttttgtttgtttgtttgtttgtttgttttgagacggagtcttgctctgtcgcccaggctggagtgcagtggcgcagtctcggcttactacaacctctgcctccggggttcacatccttctcctgcctcagcctcccgagtagctgggactacaggtgcccgccacaactcctggctaattttttgtatttttagtagagacggggtttcactgggttagccaggttggtctcgatctcctgaccttgtgatccattcgccttggcctcccagaatgctggtattacaggcgtgagccagcacgcctggcccagttactcagttttgaatctgaggccgtgacatcactcatggtctgcagtcagtgctctgcccctgagctgtaccctctcctatgataatcactcttaagaagggcaacccttggtgttttccccttaaggtcacccaggctggaatgcagtggtgtggtcatggctccctgtaccctggaactcaggcttgggtgatcctctctcctttgcctccgaagtagccaggactacaggtgtgcacccaccaccacactcagataattgctttggtgtttttaaagcttgtaatgatcagtaggctgaggtgggcaaatcataaggtcaagagttttttagatggggtgagcacagaccaattcctgttttatttactgatttaaaattttgagacagtctcactgtcacccaggttggggtgcagtggtaggatcatagcttgctgcagccttgatctcccaggatcttgcctcagcctcccgagtagctgggactgcatgcttgtgccaccacactcggttaatattttgtagagatggggtcttgctatgttgcccaggctggcttcaaactcctgaacttaaaagcctcctgtttagttttggttttttatcactttttttttttttttttgagatggagccttgctcccatcgtgcaggctggagtgcggtggcgcagtctcggctcactgcagcttctgcctctcgggttcaagcgattctcctttctcagcctcttgagtagctggaattaccagtgtgcgccaccaccaccacgcctggctagtttttctgtttttagtagagacagggttttgctatgttggccaggctggtcttgaactactgacctcttgtgatctacctgtcttggccttccaaagtgctaggattacaagcgtaagccacagcgcctggccttgctacatttttttttttttttttttttttacagacatggtctcgctatgttgcccagaatggttttgcactgggtccaagcagttctgccgcagcctcccaaagtgctgggattacaggggtgaggcaccttgctggcccctgttttgattagggtgcagtgctggtgaagccggtgcacgaggccagtgatgcatcctaatgaggggtggagttggcgggacttcctgggccagtttggggactttcacaaaagacccccatgactcagggttttgagttcttaactgatcgaatgaaggattcaaaattaaccactccaaggggggattgaaggaagaaccactcttaatggacaaaaagaaagaaaggggagggagtaacagggatatgagctctagccgcccaagctagcaatggcaacccttctgggtccccttccagcatgtggaagctttcctttcgcttcattcaataaacagctgctgctc

SEQ ID NO: 33415 - DNA, 2810 bp, Homo sapiens
gctccgtgcgcaagcgctttcggcggcgattaggtggtttccggttccgctatcttctttttcttcagcgaggcggccgagctggttggtggcggcggtcgtgcggacgcaaacatgcagatctttgtgaagaccctcactggcaaaaccatcacccttgaggtcgagcccagtgacaccattgagaatgtcaaagccaaaattcaagacaaggagggtatcccacctgaccagcagcgtctgatatttgccggcaaacagctggaggatggccgcactctctcagactacaacatccagaaagagtccaccctgcacctggtgttgcgcctgcgaggtggcattattgagccttctctccgccagcttgcccagaaatacaactgcgacaagatgatctgccgcaagtgctatgctcgccttcaccctcgtgctgtcaactgccgcaagaagaagtgtggtcacaccaacaacctgcgtcccaagaagaaggtcaaataaggtggttctttccttgaagggcagcctcctgcccaggccccgtggccctggagcctcaataaagtgtccctttcattgactggagcagcaattggtgtcctcatggctgatctgtccagggaggtggctgaagagtgggcatctcccttagggactctactcagcactccattctgtgccacctgtggggtcttctgtcctagattctgtcacatcggcattggtccctgccctatgcccctgactctggatttgtcatctgtaaaactggagtaaaaacctcagtcgtgtaattggtgggactgaggatcagttttgtcattgctgggatcctgtcaggcactttgaggtgtccctcaggccttggccctgaagtgtctaggtgtgtggagatgggtagaaaattaggtacacccaatggtgtagaacgttgattctcaaatttttttattttatacaaatggggtctcactatgttgtccaggctggtcttgaactcctgggctcaagccatccgcccatctcagcccctcaaagtgttgggattacaagcaagaactgccatgcctgacccagttctcagttttttgtttgtttgtttgtttgtttgttttgagacggagtcttgctctgtcgcccaggctggagtgcagtggcgcagtctcggcttactacaacctctgcctccggggttcacatccttctcctgcctcagcctcccgagtagctgggactacaggtgcccgccacaactcctggctaattttttgtatttttagtagagacggggtttcactgggttagccaggttggtctcgatctcctgaccttgtgatccattcgccttggcctcccagaatgctggtattacaggcgtgagccagcacgcctggcccagttactcagttttgaatctgaggccgtgacatcactcatggtctgcagtcagtgctctgcccctgagctgtaccctctcctatgataatcactcttaagaagggcaacccttggtgttttccccttaaggtcacccaggctggaatgcagtggtgtggtcatggctccctgtaccctggaactcaggcttgggtgatcctctctcctttgcctccgaagtagccaggactacaggtgtgcacccaccaccacactcagataattgctttggtgtttttaaagcttgtaatgatcagtaggctgaggtgggcaaatcataaggtcaagagttttttagatggggtgagcacagaccaattcctgttttatttactgatttaaaattttgagacagtctcactgtcacccaggttggggtgcagtggtaggatcatagcttgctgcagccttgatctcccaggatcttgcctcagcctcccgagtagctgggactgcatgcttgtgccaccacactcggttaatattttgtagagatggggtcttgctatgttgcccaggctggcttcaaactcctgaacttaaaagcctcctgtttagttttggttttttatcactttttttttttttttttgagatggagccttgctcccatcgtgcaggctggagtgcggtggcgcagtctcggctcactgcagcttctgcctctcgggttcaagcgattctcctttctcagcctcttgagtagctggaattaccagtgtgcgccaccaccaccacgcctggctagtttttctgtttttagtagagacagggttttgctatgttggccaggctggtcttgaactactgacctcttgtgatctacctgtcttggccttccaaagtgctaggattacaagcgtaagccacagcgcctggccttgctacatttttttttttttttttttttttacagacatggtctcgctatgttgcccagaatggttttgcactgggtccaagcagttctgccgcagcctcccaaagtgctgggattacaggggtgaggcaccttgctggcccctgttttgattagggtgcagtgctggtgaagccggtgcacgaggccagtgatgcatcctaatgaggggtggagttggcgggacttcctgggccagtttggggactttcacaaaagacccccatgactcagggttttgagttcttaactgatcgaatgaaggattcaaaattaaccactccaaggggggattgaaggaagaaccactcttaatggacaaaaagaaagaaaggggagggagtaacagggatatgagctctagccgcccaagctagcaatggcaacccttctgggtccccttccagcatgtggaagctttcctttcgcttcattcaataaacagctgctgctc

SEQ ID NO: 33416 - DNA, 1968 bp, Homo sapiens
ctcatttctgtgtgcaggcgagcttcttggcctaagggcaggaagagatggcagcgggggagacgcagctctacgccaaggtctccaacaagctcaagagccgcagcagcccctcgctcctggagcccctcctggccatgggcttcccggtgcacaccgcgctgaaagcgttggcagccacggggaggaagacggcggaggaggccttggcctggctgcatgatcattgcaatgacccttccctagacgaccccatcccccaggagtatgcccttttcctctgtccaacggggcccctgctggaaaaacttcaagagttctggagagagagcaagcgccagtgtgcaaagaacagagctcatgaggtcttcccacacgtgacactctgtgacttcttcacgtgtgaagaccagaaggtggaatgcctgtacgaggcgctgaagagagctggagacaggctcctgggctccttccccacggccgtgcctctggctctccactcctccatcagctacctcggcttcttcgtcagtggcagccccgcagacgtcatccgggaattcgccatgaccttcgccacggaagcatctctcttagcagactgctccgtgaagccttgcaccaaacagctgcatctgaccttggcccacaagttctacccccaccaccagaggacgctggagcagctggccagagccatccccctgggccacagctgccagtggaccgcagcactctactcccgagacatgcgctttgtgcactaccagaccctgagagccctattccagtacaaaccccagaacgtggatgagctgacgctaagtcctggtgactacatctttgtggaccccacgcagcaggacgaagccagcgagggctgggtgattgggatctcacagcggacgggctgccggggcttcctgccggaaaactacacggatcgagccagtgagtctgacacgtgggtgaagcacaggatgtacaccttcagtctagccacagacctgaactccagaaaggatggtgaagccagcagcagatgcagcggggaatttcttccacaaacggcaaggagtcttagcagcttacaggccttgcaggctaccgttgcaaggaagagcgtgctggtggttcgccacggggagagagtggatcagatcttcgggaaggcatggctgcagcaatgctccactcctgatgggaaatactacaggccagacctgaatttcccctgcagtctgccaagacggagtcgtgggatcaaagactttgaaaacgatcccccattatcatcgtgtggcattttccagtccagaattgcaggggacgcgctactggacagtggtatcagaatcagctctgtgtttgcctccccagccctccgctgtgtgcagacggccaaactcatcctggaagaactcaaactggagaaaaaaatcaagatacgagtggaacctggaatctttgaatggacaaaatgggaagctggcaaaaccaccccaaccctcatgagcctggaagagctgaaagaggcaaatttcaacattgacactgattacaggcccgcgtttcccctgtccgccctcatgccggccgagagctaccaggagtacatggacaggtgcacggcgagcatggtgcaaatcgtcaacacctgtccacaggacacgggtgtcatcctaattgtgagtcacggctccactctggactcctgcacgcggccactgctcgggctgccgccccgggaatgtggggattttgcccaactcgtgagaaagatcccttccctgggcatgtgcttctgtgaagaaaataaagaggaaggaaaatgggagttggtgaacccaccggtgaagaccctgacccacggggcgaacgcagcatttaactggaggaactggatctcaggcaactgagagccacggtgatgttgtcataacctcagagtggagaggcagaaaccat

SEQ ID NO: 33417 - DNA, 2504 bp, Homo sapiens
ggcgagcttcttggcctaagggcaggaagagatggcagcgggggagacgcagctctacgccaaggtctccaacaagctcaagagccgcagcagcccctcgctcctggagcccctcctggccatgggcttcccggtgcacaccgcgctgaaagcgttggcagccacggggaggaagacggcggaggaggccttggcctggctgcatgatcattgcaatgacccttccctagacgaccccatcccccaggagtatgcccttttcctctgtccaacggggcccctgctggaaaaacttcaagagttctggagagagagcaagcgccagtgtgcaaagaacagagctcatgaggtcttcccacacgtgacactctgtgacttcttcacgtgtgaagaccagaaggtggaatgcctgtacgaggcgctgaagagagctggagacaggctcctgggctccttccccacggccgtgcctctggctctccactcctccatcagctacctcggcttcttcgtcagtggcagccccgcagacgtcatccgggaattcgccatgaccttcgccacggaagcatctctcttagcaggcacttccgtttcccgcttctggattttcagccaggtgcctggacatggccctaacctgaggctgagcaatttaactagagcctccttcgtgagccactacatccttcaaaaatactgctccgtgaagccttgcaccaaacagctgcatctgaccttggcccacaagttctacccccaccaccagaggacgctggagcagctggccagagccatccccctgggccacagctgccagtggaccgcagcactctactcccgagacatgcgctttgtgcactaccagaccctgagagccctattccagtacaaaccccagaacgtggatgagctgacgctaagtcctggtgactacatctttgtggaccccacgcagcaggacgaagccagcgagggctgggtgattgggatctcacagcggacgggctgccggggcttcctgccggaaaactacacggatcgagccagtgagtctgacacgtgggtgaagcacaggatgtacaccttcagtctagccacagacctgaactccagaaaggatggtgaagccagcagcagatgcagcggggaatttcttccacaaacggcaaggagtcttagcagcttacaggccttgcaggctaccgttgcaaggaagagcgtgctggtggttcgccacggggagagagtggatcagatcttcgggaaggcatggctgcagcaatgctccactcctgatgggaaatactacaggccagacctgaatttcccctgcagtctgccaagacggagtcgtgggatcaaagactttgaaaacgatcccccattatcatcgtgtggcattttccagtccagaattgcaggggacgcgctactggacagtggtatcagaatcagctctgtgtttgcctccccagccctccgctgtgtgcagacggccaaactcatcctggaagaactcaaactggagaaaaaaatcaagatacgagtggaacctggaatctttgaatggacaaaatgggaagctggcaaaaccaccccaaccctcatgagcctggaagagctgaaagaggcaaatttcaacattgacactgattacaggcccgcgtttcccctgtccgccctcatgccggccgagagctaccaggagtacatggacaggtgcacggcgagcatggtgcaaatcgtcaacacctgtccacaggacacgggtgtcatcctaattgtgagtcacggctccactctggactcctgcacgcggccactgctcgggctgccgccccgggaatgtggggattttgcccaactcgtgagaaagatcccttccctgggcatgtgcttctgtgaagaaaataaagaggaaggaaaatgggagttggtgaacccaccggtgaagaccctgacccacggggcgaacgcagcatttaactggaggaactggatctcaggcaactgagagccacggtgatgttgtcataacctcagagtggagaggcagaaaccatgtgcagaggctgggagatgctgctgtttccagaggcgtcttagtctcacccaatgtgatttgtagaagcacgagacgcacttttatatcccggaatatttccctccggctttcgcctttgtaactcccatctgtggacccatcgtccaccagcccagctgcggggagcacagggcaggtggctgggtgaggatgccgccctgcagcatgtacaccgagtgtctgcagctggggacacaactgcccgggactctaacttccaggaattaaagactcaccacacacgaaggatctaaccacttcattttccatggtctaatcattaaattcccaatcgttttttctttttctgggtccatcactctttagccatatccacatgggctaaaacaggtgtaatagtcaataaaatggtcccagaaaaccatcgaccaggtca

SEQ ID NO: 33418 - DNA, 871 bp, Homo sapiens
atttctgtgtgcaggcgagcttcttggcctaagggcaggaagagatggcagcgggggagacgcagctctacgccaaggtctccaacaagctcaagagccgcagcagcccctcgctcctggagcccctcctggccatgggcttcccggtgcacaccgcgctgaaagcgttggcagccacggggaggaagacggcggaggaggccttggcctggctgcatgatcattgcaatgacccttccctagacgaccccatcccccaggagtatgcccttttcctctgtccaacggggcccctgctggaaaaacttcaagagttctggagagagagcaagcgccagtgtgcaaagaacagagctcatgaggtcttcccacacgtgacactctgtgacttcttcacgggaccagccgtctgattcagaaaaaaaatggcccagtgggtagctccacagcaaaacacaatggcccagcaggcagctctacaggggcaccgggaagacaagaagaatgtgggagctgctcaggagaaaagaaggagaagggagagacagacagccactgctctactcagctccgccagaggggcttaaggaagggcacacccacttctgctaccgcggcctggccccaactctgctgttggcaaactgatttgttccacccatttcaaggaattccatcagggcccaaggaaccctccattccaacaccaggcccctcggtgctggatggaaaggaggaatgcaaacctctgaagggaaaagatttctggaagatgtcccaggagaagcagtaccttccaaagcctccaaccaccaccccggattgcccgagacttgcagggatccccagagcacaagactaaacctggaaa

SEQ ID NO: 33419 - DNA, 1733 bp, Homo sapiens
cgagcttcttggcctaagggcaggaagagatggcagcgggggagacgcagctctacgccaaggtctccaacaagctcaagagccgcagcagcccctcgctcctggagcccctcctggccatgggcttcccggtgcacaccgcgctgaaagcgttggcagccacggggaggaagacggcggaggaggccttggcctggctgcatgatcattgcaatgacccttccctagacgaccccatcccccaggagtatgcccttttcctctgtccaacggggcccctgctggaaaaacttcaagagttctggagagagagcaagcgccagtgtgcaaagaacagagctcatgaggtcttcccacacgtgacactctgtgacttcttcacgtgtgaagaccagaaggtggaatgcctgtacgaggcgctgaagagagctggagacaggctcctgggctccttccccacggccgtgcctctggctctccactcctccatcagctacctcggcttcttcgtcagtggcagccccgcagacgtcatccgggaattcgccatgaccttcgccacggaagcatctctcttagcagactgctccgtgaagccttgcaccaaacagctgcatctgaccttggcccacaagttctacccccaccaccagaggacgctggagcagctggccagagccatccccctgggccacagctgccagtggaccgcagcactctactcccgagacatgcgctttgtgcactaccagaccctgagagccctattccagtacaaaccccagaacgtggatgagctgacgctaagtcctggtgactacatctttgtggaccccacgcagcaggacgaagccagcgagggctgggtgattgggatctcacagcggacgggctgccggggcttcctgccggaaaactacacggatcgagccagtgagtctgacacgtgggtgaagcacaggatgtacaccttcagtctagccacagacctgaactccagaaaggatggtgaagccagcagcagatgcagcggggaatttcttccacaaacggcaaggagtcttagcagcttacaggccttgcaggctaccgttgcaaggaagagcgtgctggtggttcgccacggggagagagtggatcagatcttcgggaaggcatggctgcagcaatgctccactcctgatgggaaatactacaggccagacctgaatttcccctgcagtctgccaagacggagtcgtgggatcaaagactttgaaaacgatcccccattatcatcgtgtggcattttccagtccagaattgcaggggacgcgctactggacagtggtatcagaatcagctctgtgtttgcctccccagccctccgctgtgtgcagacggccaaactcatcctggaagaactcaaactggagaaaaaaatcaagatacgagtggaacctggaatctttgaatggacaaaatgggaagctggcaaaaccaccccaaccctcatgagcctggaagagctgaaagaggcaaatttcaacattgacactgattacagatcccttccctgggcatgtgcttctgtgaagaaaataaagaggaaggaaaatgggagttggtgaacccaccggtgaagaccctgacccacggggcgaacgcagcatttaactggaggaactggatctcaggcaactgagagccacggtgatgttgtcataacctcagagtggagaggcagaaaccat

SEQ ID NO: 33420 - DNA, 6912 bp, Homo sapiens
cagcccacaaggctccttttcctttttgatccattcaaaaattactcattgcaaattcccggactgctaggcgaggagagggaagggggcggaggagacagggctactgcaggcgcagagctgggggcagccgggggcccgagtggctgaggctggtcccgcagcggccgcttgccggcgttctggctcctgtggcctcaccaggaagcgtcagagtcccgacactggggaagctcggagcgccgcctccgctgccgccgcctcctgcctggctctgggtccccgagccccctcccctggcccagcccgactccctcctccttcccgaaccatccggctcgggctccttccctggcgatggctggccgctgagccatggctcagtacggccaccccagtccgctcggcatggctgcgagagaggagctgtacagcaaagtcaccccccggaggaaccgccaacagcgccccggcaccatcaagcatggatcggcgctggacgtgctcctctccatggggttccccagagcccgcgcacaaaaagccttggcatccacgggaggaagaagtgttcaggcagcatgtgactggttattctcccatgtcggtgaccccttcctggatgaccccctgccccgggagtacgtcctctacctccgtcccaccggccccttagcacagaagctttccgacttttggcagcagtcgaagcagatctgcgggaagaacaaggcacacaacatcttcccccacatcacactctgccagttctttatgtgcgaggacagcaaggtggatgccctgggggaagccctgcagaccacggtcagtcgctggaaatgtaagttctcggccccgctgcccctggagctctatacgtcgtccaacttcatcggcctctttgtaaaggaagacagtgcggaggtcctcaagaagtttgctgctgactttgctgcagaggctgcatccaaaaccgaagtgcatgtggaacctcataagaagcagctacatgtgaccctggcttaccacttccaagccagccacctacccaccctagagaaactggcccagaacattgacgtcaagctagggtgtgactgggtggctaccatattttctcgggatatccgatttgctaaccatgagacattacaggtcatctacccctataccccacaaaatgacgatgagctggagctggtccccggggacttcatcttcatgtctccaatggagcagaccagcaccagcgagggttggatctatggcacgtccttaaccaccggctgctctggactcctgcctgagaattacattaccaaggctgatgaatgcagcacctggatatttcatggttcttattcaatcttaaatacatcgtcatccaactctctcacgtttggggatggagtattggagaggcggccttatgaggaccaggggctcggggagacgactcctcttactatcatctgccagcccatgcagccgctgagggtcaacagccagcccggcccccagaagcgatgcctttttgtgtgtcggcatggtgagaggatggatgttgtgtttgggaagtactggctgtcccagtgcttcgatgccaaaggccgctacatacgcaccaacctgaacatgcctcatagtttacctcagcggagtggtggtttccgagattacgagaaagatgctcccatcactgtgtttggatgcatgcaagcaagactagtgggtgaagccttattagagagcaataccattatcgatcatgtctattgctccccgtcccttcgctgcgttcagactgcacacaatatcttgaaaggtttacaacaagaaaatcacttgaagatccgtgtagagcccggcttatttgagtggacaaaatgggttgctgggagcacattacctgcatggatacctccatcagagttagctgcagccaacctgagtgttgatacaacctacagacctcacattccaatcagcaaattagttgtttcagaatcctatgatacttatatcagtagaagtttccaagtaacaaaagaaataataagtgaatgtaaaagtaaaggaaataacatcctgattgtggcccacgcatcttcccttgaagcgtgtacctgccaacttcagggcctgtcacctcagaactccaaggacttcgtacaaatggtccgaaagatcccatatctgggattttgttcctgtgaagaattaggagaaactggaatatggcagctgacagatccaccaatccttcctcttacccatggaccaactgggggcttcaactggagagagaccttgcttcaagaataaaccacaccagtgaacaagaaggaaaggccttttggagtgtgtctttctgtgtgtttaaaaacagtgggaaaatccacaccacactctaagtggacagctcagaataatttagcatatttcctttcacacttaaagttcttaagatgagactgtgtaaatgagagaaagacttgattcagaggaaaaaaatgtgttctctctggactcttgcctagctcacaaggctttggagaattgtcttcctaaatcggggcacctgctacagaagagaatgtttcgttccctctgggtatgcacagctaaggggcctcatttctcccagagggagctgctggcccgctctaaggggtgcaagaggaaggagtgtgcccagaccagctgggggagcattgaaaggacagcttggggatggaatttttttttttttatctccattttccagttaggtagagccaagctgaggaatccttttaagattattagaaaacatgccctgaagagagttgttcttaggttacacatgaaatcctaccgtcactagcccccatacaccagtgttgctggctgaagatacccgcttaaggatgctaacatttaccctggtactgccacattttctctagagcagctggcccttcttgctacagccctatcccccctccttgcttctgtgaaatggggagacaaagcacttttgctctccaaagcacttttggatactcaggaggaaagataagatacatgtttgaagtattcaatcataggagcaaagaacttgcaaaatatgaagtgacttggaattaaccatgttgtagcctaacgtgctactgcatttctaaatcatcaatatttgcttgtctttgcccctagactctagactatgttaactagttaaggatgttacattttgaaaggatgtatgttagatatattatttgcagcaagaagttcattctgtgcaatatggacatgtttgcaaaccataccaagggtcaggttgttgtacacttacagtacgtgtcaaccataatggaacatccacaaatgcatcaattataccagggatgtatagtaagtcagggaactaatataaatgatgacagtcatggctgcactgctacttgtgctgtcgttttgtttgtttttctatgataatttaaaatacataggtagggctactgaggaaatttggagagccacattctgtggtttctcattatacttacttcctgcatttagagggagtttatttaaaagaaataaatgacaatcaaaccaaatcatcagttatcaatgtctgtttaattgtgtgactatctgactgttgatggccacagatgatggtctcctatggtatagttcactctgtagaagatgtatgcaaagtgaaatgccagccctttaaagagacattagttagtgtaaaatggatctttacatgttgcagtaacattgactatgtttcaaaactcagatgcataaaacgtaaggtatataaaaatacatctatgcttgcgtttgaaactacaacttgataacccctagaaagaagaggacatgaaaggatgctggctatatatgttaatgagcaaaaggattatagttgttttgttttgtttttagagacagggtctcactataatgcttagactggtcttgaactcctgggctcaagcgatcctcctgcccctgtctcccaaagtgctaggattacaggtgtgagccaccacacctggcccatagttgtattttttttaggtcacttagaaaaatatgtcatgtattttacattttgagaaacaaatcaatcatggtttcttctagcgttgcgcaaacactgacccagcttctgggtatggaaataaccctgtgatgatgtgttaatataaaatgttgggagggaatattcccaataaaggtcttaagagaaaagtcacattacaagtaatgtaatggctctaccattcattcttctggtatttgtaatgaagtgaatccactgtttaatcagatccataatctttaacagattcaccacaaattttcatgggcgttgagtgctcagaataatgcttgaacacctcaccttgaaactgtagcagtgtgttctgggcagtatctgtaatgtatgaaatagagtctggaataggttatccactccatcttctaggttatcttagttgtatgacgaactgataaatctgtctgactgggctacaatccattgttcttagtccaatatggacactgccttaggcaatggtctatataagcaaaaggagatagagatctgaaataattttccgaataattcaggtggaaaacaagaaagattgtatttctctgctttcatttcaatttcattatttcaaattgcttgtcaaaatggcccaaaagatctgaattcacattaagttccccttgcacacttacctatttaaaaaactaaacttgcactgcaactgagaaattatttgtaaatcatgtggcatctatgtataataaaagaaagagacaactatattactcaatttcatatacatccaaaaagtataggctaatatatataacctgaagttgcagctggttctttttgatctgaagctgatgcttattaaaacaaatgatgtatggggagaggagaaggaagggcaaggaaggaattgacagataagaagcaaatggtttcttgtacagaggaattttgttttaatgtagaaagttatttgaaataaactaggtgaaatgaaattaactaaaggttttaatctgggattgaaagcctgaaagcatttcctgcttctacaagtgtgccacatcaatccggtaatgccccagtgttattcacagacagaactttgtttcctgtgattttaaaataccgcgtctgttcctccatggaccagagtaattggcacattttaatgcataagctgggggtttcattttcccaggctctcttcaccatcactgcattggtagctaggagcttattgcttcaccccagtatggagttcagattacagtgttttccattacatttagattcatagaatctgaatggctgattaaatggccatctgatggctgaaagaggggcgtatttttcactctgtagtgaaaggcttggaggagtttctactttttattttaattatactttaaccaaagaattattttaaagtaaccttatatttaaaagatgattttgcaaaaaataaaaaataaaaaatatgccttctggagtgatgtctgtttggtaaatcattgttgataatttccttgttagtggtatttggaatgcatatagattgtcttgtcattgtgcttaacattaccataagtgtgtcttttccactcaactagctgtattcgtattaaaatgaagtctcttatttcaattacctagtgttgttgggaactaattgaacagctacagtaaaagaagttcctatctcattgcctttgtggaaaggcttccctatgtggtaaaagaaaggcattcctccgtaacctaggcactctgcaagtccagtgtttaatttcaaagcagtgatgaattgctcttttgaaattactctaagtaatccatgtgttagaatacagatgaacctccgtttgatttcacagccttcagcacaggcaactgttactgagtctgcacgaacttagataatgaggtgcagggttatttgcatttaaattgcaatccagcacacgtgtgagaaagaagaggcactagtctaaaaggctgcattgcggggagagatgagacaggcagaggagggtggggtaaagagcgatttaacatctatttaggttaatgttcactttacaaaggtgatgggggatattttgttaggtgatagcagaagcttttcatttttaaacatagaattaaaattggatttgcttctctttaatacttcaacatattgaatttccctaggaaagtgactagctataatgaaaattcaagcgaaaagggaaaaagattgtaaatgcagatgaaataacttcatttttaagtacaaataatagtaggattggtgtatgtaggtttaaaattatagtgatgactagtcgaacttaatatacaatcagttcttgcaaatactttacacttagctgccattacacaacaaattggaattttccagctgttcaactatcatggactctgtacaggatagatgtgtataatggaaaatatgtactgcttctttctttgattgccactcaagatggaaacaccatgccaaggcattttggttatacacagatcattctaaacctgttattttggagaggtgtattggtttctttctcatttataaggctattgtatttttttttgtatgtgattcaggtgtatttatttgaagactatttgtagttataggaaaaccacacctacctgtattgccaaattctttgtaaactctccgtggcacttgtgctttcctggctgagagctctcccctgttgatacagctatggcaccattgtaattacagatgcacctttcaggagcatctccattaaatggttcatagatgatttaataaaaagaaacttctcagttga

SEQ ID NO: 33421 - DNA, 2735 bp, Homo sapiens
aaatgagtggggcggtgaggggaaggaggagggaagtaggacttcaacatggcggctgcggcactggcggtggctacggtgacggcctggcccggagcgggcagagttggaggtggtggcgttcgctctccctaggggctgtcgggagctcagcggggaccgagcctgggaggccggccggtgccagcacctttcggcttctgagacggcggcagcagcggcattcaggttctaaatggcttctaagaagttgggtgcagattttcatgggactttcagttaccttgatgatgtcccatttaagacaggagacaaattcaaaacaccagctaaagttggtctacctattggcttctccttgcctgattgtttgcaggttgtcagagaagtacagtatgacttctctttggaaaagaaaaccattgagtgggctgaagagattaagaaaatcgaagaagccgagcgggaagcagagtgcaaaattgcggaagcagaagctaaagtgaattctaagagtggcccagagggcgatagcaaaatgagcttctccaagactcacagtacagccacaatgccacctcctattaaccccatcctcgccagcttgcagcacaacagcatcctcacaccaactcgggtcagcagtagtgccacgaaacagaaagttctcagcccacctcacataaaggcggatttcaatcttgctgactttgagtgtgaagaagacccatttgataatctggagttaaaaactattgatgagaaggaagagctgagaaatattctggtaggaaccactggacccattatggctcagttattggacaataacttgcccaggggaggctctgggtctgtgttacaggatgaggaggtcctggcatccttggaacgggcaaccctagatttcaagcctcttcataaacccaatggctttataaccttaccacagttgggcaactgtgaaaagatgtcactgtcttccaaagtgtccctcccccctatacctgcagtaagcaatatcaaatccctgtctttccccaaacttgactctgatgacagcaatcagaagacagccaagctggcgagcactttccatagcacatcctgcctccgcaatggcacgttccagaattccctaaagccttccacccaaagcagtgccagtgagctcaatgggcatcacactcttgggctttcagctttgaacttggacagtggcacagagatgccagccctgacatcctcccagatgccttccctctctgttttgtctgtgtgcacagaggaatcatcacctccaaatactggtcccacggtcacccctcctaatttctcagtgtcacaagtgcccaacatgcccagctgtccccaggcctattctgaactgcagatgctgtcccccagcgagcggcagtgtgtggagacggtggtcaacatgggctactcgtacgagtgtgtcctcagagccatgaagaagaaaggagagaatattgagcagattctcgactatctctttgcacatggacagctttgtgagaagggcttcgaccctcttttagtggaagaggctctggaaatgcaccagtgttcagaagaaaagatgatggagtttcttcagttaatgagcaaatttaaggagatgggctttgagctgaaagacattaaggaagttttgctattacacaacaatgaccaggacaatgctttggaagacctcatggctcgggcaggagccagctgagaccaggccctgcctaggccctgccgcagaaccaccatccctgggaggccctgcagagcccacctgtggggaaagagaaggggcagcttccggattttcttttgggggttagaaggtcaggtgtggagactgctcgccagtctctgtgagcctaggccctgagctggggaggtggggaagattcgggcatgtgagtgcccccagaactgtcctggctccttccgtattaaacgcatttgcattttgagaagtgtccttcccacttcagccctccggagagactaccctagtctttctggggtgtttatgtcctcagctgaagcctggcctagttgctgagaggggctggggagatggggcgggagggccagactcagtgctgctgtggagctaggtgcttcccccttcccctgagactggtggactgaactccagtcaagttgagttcaagtgaaagattcttccagggttttattttttcccctcctaacaaagtctcatagtgttaacactggttctgcaatatctctgaggtgcaaagaatgcacttttccctatggggcccagagtttgccttttctgccaggcagtcaccatgcttccctaccccagcctgtttcttttggcttggtttggaccacagtcctctgctacccagggttttagagcccctgctctaggaaacagtttaagaaatcattggccccttcccagcacattgaatgggtaagcagacaggccatgatttagttggccagcactaactccacctctgttctccttgaacagcttcccctccagcccactgctttaggatgacacaatgaataacacctagtcatagaaatcagtctctctggtttgttttgtattatgttgtacatcattaaagatctaaatacaaaggatatacagtcttgaatctaaaataatttgctaactaactattttgattcttcagagagaactactaataaaaatctaaaaggta

SEQ ID NO: 33422 - DNA, 2535 bp, Homo sapiens
ctcagcctcccaagtagctgggactacaggttctaaatggcttctaagaagttgggtgcagattttcatgggactttcagttaccttgatgatgtcccatttaagacaggagacaaattcaaaacaccagctaaagttggtctacctattggcttctccttgcctgattgtttgcaggttgtcagagaagtacagtatgacttctctttggaaaagaaaaccattgagtgggctgaagagattaagaaaatcgaagaagccgagcgggaagcagagtgcaaaattgcggaagcagaagctaaagtgaattctaagagtggcccagagggcgatagcaaaatgagcttctccaagactcacagtacagccacaatgccacctcctattaaccccatcctcgccagcttgcagcacaacagcatcctcacaccaactcgggtcagcagtagtgccacgaaacagaaagttctcagcccacctcacataaaggcggatttcaatcttgctgactttgagtgtgaagaagacccatttgataatctggagttaaaaactattgatgagaaggaagagctgagaaatattctggtaggaaccactggacccattatggctcagttattggacaataacttgcccaggggaggctctgggtctgtgttacaggatgaggaggtcctggcatccttggaacgggcaaccctagatttcaagcctcttcataaacccaatggctttataaccttaccacagttgggcaactgtgaaaagatgtcactgtcttccaaagtgtccctcccccctatacctgcagtaagcaatatcaaatccctgtctttccccaaacttgactctgatgacagcaatcagaagacagccaagctggcgagcactttccatagcacatcctgcctccgcaatggcacgttccagaattccctaaagccttccacccaaagcagtgccagtgagctcaatgggcatcacactcttgggctttcagctttgaacttggacagtggcacagagatgccagccctgacatcctcccagatgccttccctctctgttttgtctgtgtgcacagaggaatcatcacctccaaatactggtcccacggtcacccctcctaatttctcagtgtcacaagtgcccaacatgcccagctgtccccaggcctattctgaactgcagatgctgtcccccagcgagcggcagtgtgtggagacggtggtcaacatgggctactcgtacgagtgtgtcctcagagccatgaagaagaaaggagagaatattgagcagattctcgactatctctttgcacatggacagctttgtgagaagggcttcgaccctcttttagtggaagaggctctggaaatgcaccagtgttcagaagaaaagatgatggagtttcttcagttaatgagcaaatttaaggagatgggctttgagctgaaagacattaaggaagttttgctattacacaacaatgaccaggacaatgctttggaagacctcatggctcgggcaggagccagctgagaccaggccctgcctaggccctgccgcagaaccaccatccctgggaggccctgcagagcccacctgtggggaaagagaaggggcagcttccggattttcttttgggggttagaaggtcaggtgtggagactgctcgccagtctctgtgagcctaggccctgagctggggaggtggggaagattcgggcatgtgagtgcccccagaactgtcctggctccttccgtattaaacgcatttgcattttgagaagtgtccttcccacttcagccctccggagagactaccctagtctttctggggtgtttatgtcctcagctgaagcctggcctagttgctgagaggggctggggagatggggcgggagggccagactcagtgctgctgtggagctaggtgcttcccccttcccctgagactggtggactgaactccagtcaagttgagttcaagtgaaagattcttccagggttttattttttcccctcctaacaaagtctcatagtgttaacactggttctgcaatatctctgaggtgcaaagaatgcacttttccctatggggcccagagtttgccttttctgccaggcagtcaccatgcttccctaccccagcctgtttcttttggcttggtttggaccacagtcctctgctacccagggttttagagcccctgctctaggaaacagtttaagaaatcattggccccttcccagcacattgaatgggtaagcagacaggccatgatttagttggccagcactaactccacctctgttctccttgaacagcttcccctccagcccactgctttaggatgacacaatgaataacacctagtcatagaaatcagtctctctggtttgttttgtattatgttgtacatcattaaagatctaaatacaaaggatatacagtcttgaatctaaaataatttgctaactaactattttgattcttcagagagaactactaataaaaatctaaaaggt

SEQ ID NO: 33423 - DNA, 2526 bp, Homo sapiens
gaggagggaagtaggacttcaacatggcggctgcggcactggcggtggctacggtgacggcctggcccggagcgggcagagttggaggtggtggcgttcgctctccctaggggctgtcgggagctcagcggggaccgagcctgggaggccggccggtgccagcacctttcggcttctgagacggcggcagcagcggcattcaggttctaaatggcttctaagaagttgggtgcagattttcatgggactttcagttaccttgatgatgtcccatttaagacaggagacaaattcaaaacaccagctaaagttggtctacctattggcttctccttgcctgattgtttgcaggttgtcagagaagtacagtatgacttctctttggaaaagaaaaccattgagtgggctgaagagattaagaaaatcgaagaagccgagcgggaagcagagtgcaaaattgcggaagcagaagctaaagtgaattctaagagtggcccagagggcgatagcaaaatgagcttctccaagactcacagtacagccacaatgccacctcctattaaccccatcctcgccagcttgcagcacaacagcatcctcacaccaactcgggtcagcagtagtgccacgaaacagaaagttctcagcccacctcacataaaggcggatttcaatcttgctgactttgagtgtgaagaagacccatttgataatctggagttaaaaactattgatgagaaggaagagctgagaaatattctggtaggaaccactggacccattatggctcagttattggacaataacttgcccaggggaggctctgggtctgtgttacaggatgaggaggtcctggcatccttggaacgggcaaccctagatttcaagcctcttcataaacccaatggctttataaccttaccacagttgggcaactgtgaaaagatgtcactgtcttccaaagtgtccctcccccctatacctgcagtaagcaatatcaaatccctgtctttccccaaacttgactctgatgacagcaatcagaagacagccaagctggcgagcactttccatagcacatcctgcctccgcaatggcacgttccagaattccctaaagccttccacccaaagcagtgccagtgagctcaatgggcatcacactcttgggctttcagctttgaacttggacagtggcacagagatgccagccctgacatcctcccagatgccttccctctctgttttgtctgtgtgcacagaggaatcatcacctccaaatactggtcccacgattctcgactatctctttgcacatggacagctttgtgagaagggcttcgaccctcttttagtggaagaggctctggaaatgcaccagtgttcagaagaaaagatgatggagtttcttcagttaatgagcaaatttaaggagatgggctttgagctgaaagacattaaggaagttttgctattacacaacaatgaccaggacaatgctttggaagacctcatggctcgggcaggagccagctgagaccaggccctgcctaggccctgccgcagaaccaccatccctgggaggccctgcagagcccacctgtggggaaagagaaggggcagcttccggattttcttttgggggttagaaggtcaggtgtggagactgctcgccagtctctgtgagcctaggccctgagctggggaggtggggaagattcgggcatgtgagtgcccccagaactgtcctggctccttccgtattaaacgcatttgcattttgagaagtgtccttcccacttcagccctccggagagactaccctagtctttctggggtgtttatgtcctcagctgaagcctggcctagttgctgagaggggctggggagatggggcgggagggccagactcagtgctgctgtggagctaggtgcttcccccttcccctgagactggtggactgaactccagtcaagttgagttcaagtgaaagattcttccagggttttattttttcccctcctaacaaagtctcatagtgttaacactggttctgcaatatctctgaggtgcaaagaatgcacttttccctatggggcccagagtttgccttttctgccaggcagtcaccatgcttccctaccccagcctgtttcttttggcttggtttggaccacagtcctctgctacccagggttttagagcccctgctctaggaaacagtttaagaaatcattggccccttcccagcacattgaatgggtaagcagacaggccatgatttagttggccagcactaactccacctctgttctccttgaacagcttcccctccagcccactgctttaggatgacacaatgaataacacctagtcatagaaatcagtctctctggtttgttttgtattatgttgtacatcattaaagatctaaatacaaaggatatacagtcttgaatctaaaataatttgctaactaactattttgattcttcagagagaactactaataaaaatctaaaaggt

SEQ ID NO: 33424 - DNA, 2898 bp, Homo sapiens
agacgcccaaatgagtggggcggtgaggggaaggaggagggaagtaggacttcaacatggcggctgcggcactggcggtggctacggtgacggcctggcccggagcgggcagagttggaggtggtggcgttcgctctccctaggggctgtcgggagctcagcggggaccgagcctgggaggccggccggtgccagcacctttcggcttctgagacggcggcagcagcggcattcagtttttggtatcagtgttatgctgatctcatacgagaacttggaattcagcaacattcattcagcaggagttactgagcactactgtggccgggcactatgcttggtgtaatggtgaatgagacagaagtggtatttgtcctcgtagtgcataaaggttctaaatggcttctaagaagttgggtgcagattttcatgggactttcagttaccttgatgatgtcccatttaagacaggagacaaattcaaaacaccagctaaagttggtctacctattggcttctccttgcctgattgtttgcaggttgtcagagaagtacagtatgacttctctttggaaaagaaaaccattgagtgggctgaagagattaagaaaatcgaagaagccgagcgggaagcagagtgcaaaattgcggaagcagaagctaaagtgaattctaagagtggcccagagggcgatagcaaaatgagcttctccaagactcacagtacagccacaatgccacctcctattaaccccatcctcgccagcttgcagcacaacagcatcctcacaccaactcgggtcagcagtagtgccacgaaacagaaagttctcagcccacctcacataaaggcggatttcaatcttgctgactttgagtgtgaagaagacccatttgataatctggagttaaaaactattgatgagaaggaagagctgagaaatattctggtaggaaccactggacccattatggctcagttattggacaataacttgcccaggggaggctctgggtctgtgttacaggatgaggaggtcctggcatccttggaacgggcaaccctagatttcaagcctcttcataaacccaatggctttataaccttaccacagttgggcaactgtgaaaagatgtcactgtcttccaaagtgtccctcccccctatacctgcagtaagcaatatcaaatccctgtctttccccaaacttgactctgatgacagcaatcagaagacagccaagctggcgagcactttccatagcacatcctgcctccgcaatggcacgttccagaattccctaaagccttccacccaaagcagtgccagtgagctcaatgggcatcacactcttgggctttcagctttgaacttggacagtggcacagagatgccagccctgacatcctcccagatgccttccctctctgttttgtctgtgtgcacagaggaatcatcacctccaaatactggtcccacggtcacccctcctaatttctcagtgtcacaagtgcccaacatgcccagctgtccccaggcctattctgaactgcagatgctgtcccccagcgagcggcagtgtgtggagacggtggtcaacatgggctactcgtacgagtgtgtcctcagagccatgaagaagaaaggagagaatattgagcagattctcgactatctctttgcacatggacagctttgtgagaagggcttcgaccctcttttagtggaagaggctctggaaatgcaccagtgttcagaagaaaagatgatggagtttcttcagttaatgagcaaatttaaggagatgggctttgagctgaaagacattaaggaagttttgctattacacaacaatgaccaggacaatgctttggaagacctcatggctcgggcaggagccagctgagaccaggccctgcctaggccctgccgcagaaccaccatccctgggaggccctgcagagcccacctgtggggaaagagaaggggcagcttccggattttcttttgggggttagaaggtcaggtgtggagactgctcgccagtctctgtgagcctaggccctgagctggggaggtggggaagattcgggcatgtgagtgcccccagaactgtcctggctccttccgtattaaacgcatttgcattttgagaagtgtccttcccacttcagccctccggagagactaccctagtctttctggggtgtttatgtcctcagctgaagcctggcctagttgctgagaggggctggggagatggggcgggagggccagactcagtgctgctgtggagctaggtgcttcccccttcccctgagactggtggactgaactccagtcaagttgagttcaagtgaaagattcttccagggttttattttttcccctcctaacaaagtctcatagtgttaacactggttctgcaatatctctgaggtgcaaagaatgcacttttccctatggggcccagagtttgccttttctgccaggcagtcaccatgcttccctaccccagcctgtttcttttggcttggtttggaccacagtcctctgctacccagggttttagagcccctgctctaggaaacagtttaagaaatcattggccccttcccagcacattgaatgggtaagcagacaggccatgatttagttggccagcactaactccacctctgttctccttgaacagcttcccctccagcccactgctttaggatgacacaatgaataacacctagtcatagaaatcagtctctctggtttgttttgtattatgttgtacatcattaaagatctaaatacaaaggatatacagtcttgaatctaaaataatttgctaactaactattttgattcttcagagagaactactaataaaaatctaaaaggta

SEQ ID NO: 33425 - DNA, 2866 bp, Homo sapiens
agacgcccaaatgagtggggcggtgaggggaaggaggagggaagtaggacttcaacatggcggctgcggcactggcggtggctacggtgacggcctggcccggagcgggcagagttggaggtggtggcgttcgctctccctaggggctgtcgggagctcagcggggaccgagcctgggaggccggccggtgccagcacctttcggcttctgagacggcggcagcagcggcattcagacggaatttcactcttattgcccaggctggagtgcaatggcgtgatctcggctcactgcaacctctgcctcctgggttcaagcgattctcctgcctcagcctcccgagtagctgggattacaggttctaaatggcttctaagaagttgggtgcagattttcatgggactttcagttaccttgatgatgtcccatttaagacaggagacaaattcaaaacaccagctaaagttggtctacctattggcttctccttgcctgattgtttgcaggttgtcagagaagtacagtatgacttctctttggaaaagaaaaccattgagtgggctgaagagattaagaaaatcgaagaagccgagcgggaagcagagtgcaaaattgcggaagcagaagctaaagtgaattctaagagtggcccagagggcgatagcaaaatgagcttctccaagactcacagtacagccacaatgccacctcctattaaccccatcctcgccagcttgcagcacaacagcatcctcacaccaactcgggtcagcagtagtgccacgaaacagaaagttctcagcccacctcacataaaggcggatttcaatcttgctgactttgagtgtgaagaagacccatttgataatctggagttaaaaactattgatgagaaggaagagctgagaaatattctggtaggaaccactggacccattatggctcagttattggacaataacttgcccaggggaggctctgggtctgtgttacaggatgaggaggtcctggcatccttggaacgggcaaccctagatttcaagcctcttcataaacccaatggctttataaccttaccacagttgggcaactgtgaaaagatgtcactgtcttccaaagtgtccctcccccctatacctgcagtaagcaatatcaaatccctgtctttccccaaacttgactctgatgacagcaatcagaagacagccaagctggcgagcactttccatagcacatcctgcctccgcaatggcacgttccagaattccctaaagccttccacccaaagcagtgccagtgagctcaatgggcatcacactcttgggctttcagctttgaacttggacagtggcacagagatgccagccctgacatcctcccagatgccttccctctctgttttgtctgtgtgcacagaggaatcatcacctccaaatactggtcccacggtcacccctcctaatttctcagtgtcacaagtgcccaacatgcccagctgtccccaggcctattctgaactgcagatgctgtcccccagcgagcggcagtgtgtggagacggtggtcaacatgggctactcgtacgagtgtgtcctcagagccatgaagaagaaaggagagaatattgagcagattctcgactatctctttgcacatggacagctttgtgagaagggcttcgaccctcttttagtggaagaggctctggaaatgcaccagtgttcagaagaaaagatgatggagtttcttcagttaatgagcaaatttaaggagatgggctttgagctgaaagacattaaggaagttttgctattacacaacaatgaccaggacaatgctttggaagacctcatggctcgggcaggagccagctgagaccaggccctgcctaggccctgccgcagaaccaccatccctgggaggccctgcagagcccacctgtggggaaagagaaggggcagcttccggattttcttttgggggttagaaggtcaggtgtggagactgctcgccagtctctgtgagcctaggccctgagctggggaggtggggaagattcgggcatgtgagtgcccccagaactgtcctggctccttccgtattaaacgcatttgcattttgagaagtgtccttcccacttcagccctccggagagactaccctagtctttctggggtgtttatgtcctcagctgaagcctggcctagttgctgagaggggctggggagatggggcgggagggccagactcagtgctgctgtggagctaggtgcttcccccttcccctgagactggtggactgaactccagtcaagttgagttcaagtgaaagattcttccagggttttattttttcccctcctaacaaagtctcatagtgttaacactggttctgcaatatctctgaggtgcaaagaatgcacttttccctatggggcccagagtttgccttttctgccaggcagtcaccatgcttccctaccccagcctgtttcttttggcttggtttggaccacagtcctctgctacccagggttttagagcccctgctctaggaaacagtttaagaaatcattggccccttcccagcacattgaatgggtaagcagacaggccatgatttagttggccagcactaactccacctctgttctccttgaacagcttcccctccagcccactgctttaggatgacacaatgaataacacctagtcatagaaatcagtctctctggtttgttttgtattatgttgtacatcattaaagatctaaatacaaaggatatacagtcttgaatctaaaataatttgctaactaactattttgattcttcagagagaactactaataaaaatctaaaaggta

SEQ ID NO: 33426 - DNA, 2618 bp, Homo sapiens
agacgcccaaatgagtggggcggtgaggggaaggaggagggaagtaggacttcaacatggcggctgcggcactggcggtggctacggtgacggcctggcccggagcgggcagagttggaggtggtggcgttcgctctccctaggggctgtcgggagctcagcggggaccgagcctgggaggccggccggtgccagcacctttcggcttctgagacggcggcagcagcggcattcaggttctaaatggcttctaagaagttgggtgcagattttcatgtatgacttctctttggaaaagaaaaccattgagtgggctgaagagattaagaaaatcgaagaagccgagcgggaagcagagtgcaaaattgcggaagcagaagctaaagtgaattctaagagtggcccagagggcgatagcaaaatgagcttctccaagactcacagtacagccacaatgccacctcctattaaccccatcctcgccagcttgcagcacaacagcatcctcacaccaactcgggtcagcagtagtgccacgaaacagaaagttctcagcccacctcacataaaggcggatttcaatcttgctgactttgagtgtgaagaagacccatttgataatctggagttaaaaactattgatgagaaggaagagctgagaaatattctggtaggaaccactggacccattatggctcagttattggacaataacttgcccaggggaggctctgggtctgtgttacaggatgaggaggtcctggcatccttggaacgggcaaccctagatttcaagcctcttcataaacccaatggctttataaccttaccacagttgggcaactgtgaaaagatgtcactgtcttccaaagtgtccctcccccctatacctgcagtaagcaatatcaaatccctgtctttccccaaacttgactctgatgacagcaatcagaagacagccaagctggcgagcactttccatagcacatcctgcctccgcaatggcacgttccagaattccctaaagccttccacccaaagcagtgccagtgagctcaatgggcatcacactcttgggctttcagctttgaacttggacagtggcacagagatgccagccctgacatcctcccagatgccttccctctctgttttgtctgtgtgcacagaggaatcatcacctccaaatactggtcccacggtcacccctcctaatttctcagtgtcacaagtgcccaacatgcccagctgtccccaggcctattctgaactgcagatgctgtcccccagcgagcggcagtgtgtggagacggtggtcaacatgggctactcgtacgagtgtgtcctcagagccatgaagaagaaaggagagaatattgagcagattctcgactatctctttgcacatggacagctttgtgagaagggcttcgaccctcttttagtggaagaggctctggaaatgcaccagtgttcagaagaaaagatgatggagtttcttcagttaatgagcaaatttaaggagatgggctttgagctgaaagacattaaggaagttttgctattacacaacaatgaccaggacaatgctttggaagacctcatggctcgggcaggagccagctgagaccaggccctgcctaggccctgccgcagaaccaccatccctgggaggccctgcagagcccacctgtggggaaagagaaggggcagcttccggattttcttttgggggttagaaggtcaggtgtggagactgctcgccagtctctgtgagcctaggccctgagctggggaggtggggaagattcgggcatgtgagtgcccccagaactgtcctggctccttccgtattaaacgcatttgcattttgagaagtgtccttcccacttcagccctccggagagactaccctagtctttctggggtgtttatgtcctcagctgaagcctggcctagttgctgagaggggctggggagatggggcgggagggccagactcagtgctgctgtggagctaggtgcttcccccttcccctgagactggtggactgaactccagtcaagttgagttcaagtgaaagattcttccagggttttattttttcccctcctaacaaagtctcatagtgttaacactggttctgcaatatctctgaggtgcaaagaatgcacttttccctatggggcccagagtttgccttttctgccaggcagtcaccatgcttccctaccccagcctgtttcttttggcttggtttggaccacagtcctctgctacccagggttttagagcccctgctctaggaaacagtttaagaaatcattggccccttcccagcacattgaatgggtaagcagacaggccatgatttagttggccagcactaactccacctctgttctccttgaacagcttcccctccagcccactgctttaggatgacacaatgaataacacctagtcatagaaatcagtctctctggtttgttttgtattatgttgtacatcattaaagatctaaatacaaaggatatacagtcttgaatctaaaataatttgctaactaactattttgattcttcagagagaactactaataaaaatctaaaaggta

SEQ ID NO: 33427 - DNA, 2702 bp, Homo sapiens
agacgcccaaatgagtggggcggtgaggggaaggaggagggaagtaggacttcaacatggcggctgcggcactggcggtggctacggtgacggcctggcccggagcgggcagagttggaggtggtggcgttcgctctccctaggggctgtcgggagctcagcggggaccgagcctgggaggccggccggtgccagcacctttcggcttctgagacggcggcagcagcggcattcagggactttcagttaccttgatgatgtcccatttaagacaggagacaaattcaaaacaccagctaaagttggtctacctattggcttctccttgcctgattgtttgcaggttgtcagagaagtacagtatgacttctctttggaaaagaaaaccattgagtgggctgaagagattaagaaaatcgaagaagccgagcgggaagcagagtgcaaaattgcggaagcagaagctaaagtgaattctaagagtggcccagagggcgatagcaaaatgagcttctccaagactcacagtacagccacaatgccacctcctattaaccccatcctcgccagcttgcagcacaacagcatcctcacaccaactcgggtcagcagtagtgccacgaaacagaaagttctcagcccacctcacataaaggcggatttcaatcttgctgactttgagtgtgaagaagacccatttgataatctggagttaaaaactattgatgagaaggaagagctgagaaatattctggtaggaaccactggacccattatggctcagttattggacaataacttgcccaggggaggctctgggtctgtgttacaggatgaggaggtcctggcatccttggaacgggcaaccctagatttcaagcctcttcataaacccaatggctttataaccttaccacagttgggcaactgtgaaaagatgtcactgtcttccaaagtgtccctcccccctatacctgcagtaagcaatatcaaatccctgtctttccccaaacttgactctgatgacagcaatcagaagacagccaagctggcgagcactttccatagcacatcctgcctccgcaatggcacgttccagaattccctaaagccttccacccaaagcagtgccagtgagctcaatgggcatcacactcttgggctttcagctttgaacttggacagtggcacagagatgccagccctgacatcctcccagatgccttccctctctgttttgtctgtgtgcacagaggaatcatcacctccaaatactggtcccacggtcacccctcctaatttctcagtgtcacaagtgcccaacatgcccagctgtccccaggcctattctgaactgcagatgctgtcccccagcgagcggcagtgtgtggagacggtggtcaacatgggctactcgtacgagtgtgtcctcagagccatgaagaagaaaggagagaatattgagcagattctcgactatctctttgcacatggacagctttgtgagaagggcttcgaccctcttttagtggaagaggctctggaaatgcaccagtgttcagaagaaaagatgatggagtttcttcagttaatgagcaaatttaaggagatgggctttgagctgaaagacattaaggaagttttgctattacacaacaatgaccaggacaatgctttggaagacctcatggctcgggcaggagccagctgagaccaggccctgcctaggccctgccgcagaaccaccatccctgggaggccctgcagagcccacctgtggggaaagagaaggggcagcttccggattttcttttgggggttagaaggtcaggtgtggagactgctcgccagtctctgtgagcctaggccctgagctggggaggtggggaagattcgggcatgtgagtgcccccagaactgtcctggctccttccgtattaaacgcatttgcattttgagaagtgtccttcccacttcagccctccggagagactaccctagtctttctggggtgtttatgtcctcagctgaagcctggcctagttgctgagaggggctggggagatggggcgggagggccagactcagtgctgctgtggagctaggtgcttcccccttcccctgagactggtggactgaactccagtcaagttgagttcaagtgaaagattcttccagggttttattttttcccctcctaacaaagtctcatagtgttaacactggttctgcaatatctctgaggtgcaaagaatgcacttttccctatggggcccagagtttgccttttctgccaggcagtcaccatgcttccctaccccagcctgtttcttttggcttggtttggaccacagtcctctgctacccagggttttagagcccctgctctaggaaacagtttaagaaatcattggccccttcccagcacattgaatgggtaagcagacaggccatgatttagttggccagcactaactccacctctgttctccttgaacagcttcccctccagcccactgctttaggatgacacaatgaataacacctagtcatagaaatcagtctctctggtttgttttgtattatgttgtacatcattaaagatctaaatacaaaggatatacagtcttgaatctaaaataatttgctaactaactattttgattcttcagagagaactactaataaaaatctaaaaggta

SEQ ID NO: 33428 - DNA, 1225 bp, Homo sapiens
gtttccagagctttcgaggaaggtttcttcaactcaaattcatccgcctgataattttcttatattttcctaaagaaggaagagaagcgcatagaggagaagggaaataattttttaggagcctttcttacggctatgaggaatttggggctcagttgaaaagcctaaactgcctctcgggaggttgggcgcggcgaactactttcagcggcgcacggagacggcgtctacgtgaggggtgataagtgacgcaacactcgttgcataaatttgcgctccgccagcccggagcatttaggggcggttggctttgttgggtgagcttgtttgtgtccctgtgggtggacgtggttggtgattggcaggatcctggtatccgctaacaggtcaaaatgcagatcttcgtgaaaacccttaccggcaagaccatcacccttgaggtggagcccagtgacaccatcgaaaatgtgaaggccaagatccaggataaggaaggcattccccccgaccagcagaggctcatctttgcaggcaagcagctggaagatggccgtactctttctgactacaacatccagaaggagtcgaccctgcacctggtcctgcgtctgagaggtggtatgcagatcttcgtgaagaccctgaccggcaagaccatcaccctggaagtggagcccagtgacaccatcgaaaatgtgaaggccaagatccaggataaagaaggcatccctcccgaccagcagaggctcatctttgcaggcaagcagctggaagatggccgcactctttctgactacaacatccagaaggagtcgaccctgcacctggtcctgcgtctgagaggtggtatgcagatcttcgtgaagaccctgaccggcaagaccatcactctggaggtggagcccagtgacaccatcgaaaatgtgaaggccaagatccaagataaagaaggcatcccccccgaccagcagaggctcatctttgcaggcaagcagctggaagatggccgcactctttctgactacaacatccagaaagagtcgaccctgcacctggtcctgcgcctgaggggtggctgttaattcttcagtcatggcattcgcagtgcccagtgatggcattactctgcactatagccatttgccccaacttaagtttagaaattacaagtttcagtaatagctgaacctgttcaaaatgttaataaaggtttcgttgcatggta

SEQ ID NO: 33429 - DNA, 1014 bp, Homo sapiens
gggccttgttgacctgaggggggcgagggcggttggcgcgcgcgcgcgttgacggaaactaacggacgcctaaccgatcggcgattctgtcgagtttacttcgcggggaaggcggaaaagaggtagtttgtgtggtttctggaagcctttactttggaatcccagtgtgagaaaggtcaaaatgcagatcttcgtgaaaacccttaccggcaagaccatcacccttgaggtggagcccagtgacaccatcgaaaatgtgaaggccaagatccaggataaggaaggcattccccccgaccagcagaggctcatctttgcaggcaagcagctggaagatggccgtactctttctgactacaacatccagaaggagtcgaccctgcacctggtcctgcgtctgagaggtggtatgcagatcttcgtgaagaccctgaccggcaagaccatcaccctggaagtggagcccagtgacaccatcgaaaatgtgaaggccaagatccaggataaagaaggcatccctcccgaccagcagaggctcatctttgcaggcaagcagctggaagatggccgcactctttctgactacaacatccagaaggagtcgaccctgcacctggtcctgcgtctgagaggtggtatgcagatcttcgtgaagaccctgaccggcaagaccatcactctggaggtggagcccagtgacaccatcgaaaatgtgaaggccaagatccaagataaagaaggcatcccccccgaccagcagaggctcatctttgcaggcaagcagctggaagatggccgcactctttctgactacaacatccagaaagagtcgaccctgcacctggtcctgcgcctgaggggtggctgttaattcttcagtcatggcattcgcagtgcccagtgatggcattactctgcactatagccatttgccccaacttaagtttagaaattacaagtttcagtaatagctgaacctgttcaaaatgttaataaaggtttcgttgcatggta

SEQ ID NO: 33430 - DNA, 1012 bp, Homo sapiens
gtgggggaggggagggcgaggtgacgcggcgctgggcctttccgggacagtgggccttgttgacctgaggggggcgagggcggttggcgcgcgcgcgcgttgacggaaactaacggacgcctaaccgatcggcgattctgtcgagtttacttcgcggggaaggcggaaaagaggtcaaaatgcagatcttcgtgaaaacccttaccggcaagaccatcacccttgaggtggagcccagtgacaccatcgaaaatgtgaaggccaagatccaggataaggaaggcattccccccgaccagcagaggctcatctttgcaggcaagcagctggaagatggccgtactctttctgactacaacatccagaaggagtcgaccctgcacctggtcctgcgtctgagaggtggtatgcagatcttcgtgaagaccctgaccggcaagaccatcaccctggaagtggagcccagtgacaccatcgaaaatgtgaaggccaagatccaggataaagaaggcatccctcccgaccagcagaggctcatctttgcaggcaagcagctggaagatggccgcactctttctgactacaacatccagaaggagtcgaccctgcacctggtcctgcgtctgagaggtggtatgcagatcttcgtgaagaccctgaccggcaagaccatcactctggaggtggagcccagtgacaccatcgaaaatgtgaaggccaagatccaagataaagaaggcatcccccccgaccagcagaggctcatctttgcaggcaagcagctggaagatggccgcactctttctgactacaacatccagaaagagtcgaccctgcacctggtcctgcgcctgaggggtggctgttaattcttcagtcatggcattcgcagtgcccagtgatggcattactctgcactatagccatttgccccaacttaagtttagaaattacaagtttcagtaatagctgaacctgttcaaaatgttaataaaggtttcgttgcatggta

SEQ ID NO: 33431 - DNA, 704 bp, Homo sapiens
atttaggggcggttggctttgttgggtgagcttgtttgtgtccctgtgggtggacgtggttggtgattggcaggatcctggtatccgctaacaggtcaaaatgcagatcttcgtgaaaacccttaccggcaagaccatcacccttgaggtggagcccagtgacaccatcgaaaatgtgaaggccaagatccaggataaggaaggcattccccccgaccagcagaggctcatctttgcaggcaagcagctggaagatggccgtactctttctgactacaacatccagaaggagtcgaccctgcacctggtcctgcgtctgagaggtggtatgcagatcttcgtgaagaccctgaccggcaagaccatcactctggaggtggagcccagtgacaccatcgaaaatgtgaaggccaagatccaagataaagaaggcatcccccccgaccagcagaggctcatctttgcaggcaagcagctggaagatggccgcactctttctgactacaacatccagaaagagtcgaccctgcacctggtcctgcgcctgaggggtggctgttaattcttcagtcatggcattcgcagtgcccagtgatggcattactctgcactatagccatttgccccaacttaagtttagaaattacaagtttcagtaatagctgaacctgttcaaaatgttaataaaggtttcgttgcatggt

SEQ ID NO: 33432 - DNA, 2688 bp, Homo sapiens
ggagggaggggagggagaccccgactctgcagaaggcgctcgctgcgtgccccacgtccgccgaacgcggggttcgcgacccgaggggaccgcgggggctgaggggaggggccgcggagccgcggctaaggaacgcgggccgcccacccgctcccggtgcagcggcctccgcgccgggttttggcgcctcccgcgggcgcccccctcctcacggcgagcgctgccacgtcagacgaagggcgcagcgagcgtcctgatccttccgcccggacgctcaggacagcggcccgctgctcataagactcggccttagaaccccagtatcagcagaaggacattttaggacgggacttgggtgactctagggcactggttttctttccagagagcggaacaggcgaggaaaagtagtcccttctcggcgattctgcggagggatctccgtggggcggtgaacgccgatgattatataaggacgcgccgggtgtggcacagctagttccgtcgcagccgggatttgggtcgcagttcttgtttgtggatcgctgtgatcgtcacttgacaatgcagatcttcgtgaagactctgactggtaagaccatcaccctcgaggttgagcccagtgacaccatcgagaatgtcaaggcaaagatccaagataaggaaggcatccctcctgaccagcagaggctgatctttgctggaaaacagctggaagatgggcgcaccctgtctgactacaacatccagaaagagtccaccctgcacctggtgctccgtctcagaggtgggatgcaaatcttcgtgaagacactcactggcaagaccatcacccttgaggtcgagcccagtgacaccatcgagaacgtcaaagcaaagatccaggacaaggaaggcattcctcctgaccagcagaggttgatctttgccggaaagcagctggaagatgggcgcaccctgtctgactacaacatccagaaagagtctaccctgcacctggtgctccgtctcagaggtgggatgcagatcttcgtgaagaccctgactggtaagaccatcaccctcgaggtggagcccagtgacaccatcgagaatgtcaaggcaaagatccaagataaggaaggcattccttctgatcagcagaggttgatctttgccggaaaacagctggaagatggtcgtaccctgtctgactacaacatccagaaagagtccaccttgcacctggtactccgtctcagaggtgggatgcaaatcttcgtgaagacactcactggcaagaccatcacccttgaggtcgagcccagtgacactatcgagaacgtcaaagcaaagatccaagacaaggaaggcattcctcctgaccagcagaggttgatctttgccggaaagcagctggaagatgggcgcaccctgtctgactacaacatccagaaagagtctaccctgcacctggtgctccgtctcagaggtgggatgcagatcttcgtgaagaccctgactggtaagaccatcactctcgaagtggagccgagtgacaccattgagaatgtcaaggcaaagatccaagacaaggaaggcatccctcctgaccagcagaggttgatctttgccggaaaacagctggaagatggtcgtaccctgtctgactacaacatccagaaagagtccaccttgcacctggtgctccgtctcagaggtgggatgcagatcttcgtgaagaccctgactggtaagaccatcactctcgaggtggagccgagtgacaccattgagaatgtcaaggcaaagatccaagacaaggaaggcatccctcctgaccagcagaggttgatctttgctgggaaacagctggaagatggacgcaccctgtctgactacaacatccagaaagagtccaccctgcacctggtgctccgtcttagaggtgggatgcagatcttcgtgaagaccctgactggtaagaccatcactctcgaagtggagccgagtgacaccattgagaatgtcaaggcaaagatccaagacaaggaaggcatccctcctgaccagcagaggttgatctttgctgggaaacagctggaagatggacgcaccctgtctgactacaacatccagaaagagtccaccctgcacctggtgctccgtcttagaggtgggatgcagatcttcgtgaagaccctgactggtaagaccatcactctcgaagtggagccgagtgacaccattgagaatgtcaaggcaaagatccaagacaaggaaggcatccctcctgaccagcagaggttgatctttgctgggaaacagctggaagatggacgcaccctgtctgactacaacatccagaaagagtccaccctgcacctggtgctccgtctcagaggtgggatgcaaatcttcgtgaagaccctgactggtaagaccatcaccctcgaggtggagcccagtgacaccatcgagaatgtcaaggcaaagatccaagataaggaaggcatccctcctgatcagcagaggttgatctttgctgggaaacagctggaagatggacgcaccctgtctgactacaacatccagaaagagtccactctgcacttggtcctgcgcttgagggggggtgtctaagtttccccttttaaggtttcaacaaatttcattgcactttcctttcaataaagttgttgcattccc

SEQ ID NO: 33433 - DNA, 563 bp, Homo sapiens
ggcttttctccgtcgcaggacgcagggttcgggcctagggtaggctctcctgaatcgacaggcgccggacctctggtgaggggagggataagtgaggcgtcagtttctctgacaatgcagatcttcgtgaagactctgactggtaagaccatcaccctcgaggttgagcccagtgacaccatcgagaatgtcaaggcaaagatccaagataaggaaggcatccctcctgaccagcagaggctgatctttgctggaaaacagctggaagatgggcgcaccctgtctgactacaacatccagaaagagtccaccctgcacctggtgctccgtctcagaggtgggatgcaaatcttcgtgaagacactcactggcaagaccatcacccttgaggtcgagcccagtgacaccatcgagaacgtcaaagcaaagatccaggacaaggaaggcattcctcctgaccagcagaggttgatctttgccggaaagcagctggaagatgggcgcaccctgtctgactacaacatccagaaagagtctaccctgcacctggtgctccgtctcag

SEQ ID NO: 33434 - DNA, 582 bp, Homo sapiens
tattcgggtgagatgggctggggcaccatctggggaccctgacgtgaagtttgtcactgactggagaactcggtttgtcgtctgttgcgggggcggcagttatggcggtgccgttgggcagtgcacccgtacctttgggagcgcgcgccctcgtcgtgtcgtgacgtcacccgttctgttggcttataatgcagggtggggccacctgccgacaatgcagatcttcgtgaagactctgactggtaagaccatcaccctcgaggttgagcccagtgacaccatcgagaatgtcaaggcaaagatccaagataaggaaggcatccctcctgaccagcagaggctgatctttgctggaaaacagctggaagatgggcgcaccctgtctgactacaacatccagaaagagtccaccctgcacctggtgctccgtctcagaggtgggatgcaaatcttcgtgaagacactcactggcaagaccatcacccttgaggtcgagcccagtgacaccatcgagaacgtcaaagcaaagatccaggacaaggaaggcattcctcctgaccagcagaggttgatctttgccgg

SEQ ID NO: 33435 - DNA, 3745 bp, Homo sapiens
gttccccagctttagggccacgcccgccctgagatctgccgagtcattgtccttgtcccgcggccccgggagccccccgcgaccggcctgggaggctcagggaggttgaagggggctgagcaaaggaagccccgtcattacctcaaatgtgacccaaaaataaagacccgtccatctcgcagggtgggccagggcgggtcaggagggaggggagggagaccccgactctgcagaaggcgctcgctgcgtgccccacgtccgccgaacgcggggttcgcgacccgaggggaccgcgggggctgaggggaggggccgcggagccgcggctaaggaacgcgggccgcccacccgctcccggtgcagcggcctccgcgccgggttttggcgcctcccgcgggcgcccccctcctcacggcgagcgctgccacgtcagacgaagggcgcagcgagcgtcctgatccttccgcccggacgctcaggacagcggcccgctgctcataagactcggccttagaaccccagtatcagcagaaggacattttaggacgggacttgggtgactctagggcactggttttctttccagagagcggaacaggcgaggaaaagtagtcccttctcggcgattctgcggagggatctccgtggggcggtgaacgccgatgattatataaggacgcgccgggtgtggcacagctagttccgtcgcagccgggatttgggtcgcagttcttgtttgtggatcgctgtgatcgtcacttggtgagtagcgggctgctgggctggccggggctttcgtggccgccgggccgctcggtgggacggaggcgtgtggagagaccgccaagggctgtagtctgggtccgcgagcaaggttgccctgaactgggggttggggggagcgcagcaaaatggcggctgttcccgagtcttgaatggaagacgcttgtgaggcgggctgtgaggtcgttgaaacaaggtggggggcatggtgggcggcaagaacccaaggtcttgaggccttcgctaatgcgggaaagctcttattcgggtgagatgggctggggcaccatctggggaccctgacgtgaagtttgtcactgactggagaactcggtttgtcgtctgttgcgggggcggcagttatggcggtgccgttgggcagtgcacccgtacctttgggagcgcgcgccctcgtcgtgtcgtgacgtcacccgttctgttggcttataatgcagggtggggccacctgccggtaggtgtgcggtaggcttttctccgtcgcaggacgcagggttcgggcctagggtaggctctcctgaatcgacaggcgccggacctctggtgaggggagggataagtgaggcgtcagtttctctggtcggttttatgtacctatcttcttaagtagctgaagctccggttttgaactatgcgctcggggttggcgagtgtgttttgtgaagttttttaggcaccttttgaaatgtaatcatttgggtcaatatgtaattttcagtgttagactagtaaattgtccgctaaattctggccgtttttggcttttttgttagacaatgcagatcttcgtgaagactctgactggtaagaccatcaccctcgaggttgagcccagtgacaccatcgagaatgtcaaggcaaagatccaagataaggaaggcatccctcctgaccagcagaggctgatctttgctggaaaacagctggaagatgggcgcaccctgtctgactacaacatccagaaagagtccaccctgcacctggtgctccgtctcagaggtgggatgcaaatcttcgtgaagacactcactggcaagaccatcacccttgaggtcgagcccagtgacaccatcgagaacgtcaaagcaaagatccaggacaaggaaggcattcctcctgaccagcagaggttgatctttgccggaaagcagctggaagatgggcgcaccctgtctgactacaacatccagaaagagtctaccctgcacctggtgctccgtctcagaggtgggatgcagatcttcgtgaagaccctgactggtaagaccatcaccctcgaggtggagcccagtgacaccatcgagaatgtcaaggcaaagatccaagataaggaaggcattccttctgatcagcagaggttgatctttgccggaaaacagctggaagatggtcgtaccctgtctgactacaacatccagaaagagtccaccttgcacctggtactccgtctcagaggtgggatgcaaatcttcgtgaagacactcactggcaagaccatcacccttgaggtcgagcccagtgacactatcgagaacgtcaaagcaaagatccaagacaaggaaggcattcctcctgaccagcagaggttgatctttgccggaaagcagctggaagatgggcgcaccctgtctgactacaacatccagaaagagtctaccctgcacctggtgctccgtctcagaggtgggatgcagatcttcgtgaagaccctgactggtaagaccatcactctcgaagtggagccgagtgacaccattgagaatgtcaaggcaaagatccaagacaaggaaggcatccctcctgaccagcagaggttgatctttgccggaaaacagctggaagatggtcgtaccctgtctgactacaacatccagaaagagtccaccttgcacctggtgctccgtctcagaggtgggatgcagatcttcgtgaagaccctgactggtaagaccatcactctcgaggtggagccgagtgacaccattgagaatgtcaaggcaaagatccaagacaaggaaggcatccctcctgaccagcagaggttgatctttgctgggaaacagctggaagatggacgcaccctgtctgactacaacatccagaaagagtccaccctgcacctggtgctccgtcttagaggtgggatgcagatcttcgtgaagaccctgactggtaagaccatcactctcgaagtggagccgagtgacaccattgagaatgtcaaggcaaagatccaagacaaggaaggcatccctcctgaccagcagaggttgatctttgctgggaaacagctggaagatggacgcaccctgtctgactacaacatccagaaagagtccaccctgcacctggtgctccgtcttagaggtgggatgcagatcttcgtgaagaccctgactggtaagaccatcactctcgaagtggagccgagtgacaccattgagaatgtcaaggcaaagatccaagacaaggaaggcatccctcctgaccagcagaggttgatctttgctgggaaacagctggaagatggacgcaccctgtctgactacaacatccagaaagagtccaccctgcacctggtgctccgtctcagaggtgggatgcaaatcttcgtgaagaccctgactggtaagaccatcaccctcgaggtggagcccagtgacaccatcgagaatgtcaaggcaaagatccaagataaggaaggcatccctcctgatcagcagaggttgatctttgctgggaaacagctggaagatggacgcaccctgtctgactacaacatccagaaagagtccactctgcacttggtcctgcgcttgagggggggtgtctaagtttccccttttaaggtttcaacaaatttcattgcactttcctttcaataaagttgttgcattcccaattggtgttttttttttttttttttttaagtttattttgcatt

SEQ ID NO: 33436 - DNA, 622 bp, Homo sapiens
acgtcacccgttctgttggcttataatgcagggtggggccacctgccggtaggtgtgcggtaggcttttctccgtcgcaggacgcagggttcgggcctagggtaggctctcctgaatcgacaggcgccggacctctgacaatgcagatcttcgtgaagactctgactggtaagaccatcaccctcgaggttgagcccagtgacaccatcgagaatgtcaaggcaaagatccaagataaggaaggcatccctcctgaccagcagaggctgatctttgctggaaaacagctggaagatgggcgcaccctgtctgactacaacatccagaaagagtccaccctgcacctggtgctccgtctcagaggtgggatgcaaatcttcgtgaagacactcactggcaagaccatcacccttgaggtcgagcccagtgacaccatcgagaacgtcaaagcaaagatccaggacaaggaaggcattcctcctgaccagcagaggttgatctttgccggaaagcagctggaagatgggcgcaccctgtctgactacaacatccagaaagagtctaccctgcacctggtgctccgtctcagaggtgggatgcagatcttcgtgaagaccctgac

SEQ ID NO: 33437 - DNA, 627 bp, Homo sapiens
acttggtgagtagcgggctgctgggctggccggggctttcgtggccgccgggccgctcggtgggacggaggcgtgtggagagaccgccaagggctgtagtctgggtccgcgagcaaggttgccctgaactgggggttggggggagcgcagcaaaatggcggctgttcccgagtcttgaatggaagacgcttgtgaggcgggctgtgaggtcgttgaaacaagacaatgcagatcttcgtgaagactctgactggtaagaccatcaccctcgaggttgagcccagtgacaccatcgagaatgtcaaggcaaagatccaagataaggaaggcatccctcctgaccagcagaggctgatctttgctggaaaacagctggaagatgggcgcaccctgtctgactacaacatccagaaagagtccaccctgcacctggtgctccgtctcagaggtgggatgcaaatcttcgtgaagacactcactggcaagaccatcacccttgaggtcgagcccagtgacaccatcgagaacgtcaaagcaaagatccaggacaaggaaggcattcctcctgaccagcagaggttgatctttgccggaaagcagctggaagatgggcgcaccctgtctgac

SEQ ID NO: 33438 - DNA, 582 bp, Homo sapiens
ttctccgtcgcaggacgcagggttcgggcctagggtaggctctcctgaatcgacaggcgccggacctctgacaatgcagatcttcgtgaagactctgactggtaagaccatcaccctcgaggttgagcccagtgacaccatcgagaatgtcaaggcaaagatccaagataaggaaggcatccctcctgaccagcagaggctgatctttgctggaaaacagctggaagatgggcgcaccctgtctgactacaacatccagaaagagtccaccctgcacctggtgctccgtctcagaggtgggatgcaaatcttcgtgaagacactcactggcaagaccatcacccttgaggtggagcccagtgacaccatcgagaatgtcaaggcaaagatccaagataaggaaggcattccttctgatcagcagaggttgatctttgccggaaaacagctggaagatggtcgtaccctgtctgactacaacatccagaaagagtccaccttgcacctggtactccgtctcagaggtgggatgcaaatcttcgtgaagacactcactggcaagaccatcacccttgaggtcga

SEQ ID NO: 33439 - DNA, 548 bp, Homo sapiens
ataatgcagggtggggccacctgccggtaggtgtgcggtaggcttttctccgtcgcaggacgcagggttcgggcctaggacaatgcagatcttcgtgaagactctgactggtaagaccatcaccctcgaggttgagcccagtgacaccatcgagaatgtcaaggcaaagatccaagataaggaaggcatccctcctgaccagcagaggctgatctttgctggaaaacagctggaagatgggcgcaccctgtctgactacaacatccagaaagagtccaccctgcacctggtgctccgtctcagaggtgggatgcaaatcttcgtgaagacactcactggcaagaccatcacccttgaggtcgagcccagtgacaccatcgagaacgtcaaagcaaagatccaggacaaggaaggcattcctcctgaccagcagaggttgatctttgccggaaagcagctggaagatgggcgcaccctgtctgactacaacatccagaaagagtctaccctgcacctggtgctccgtctcagaggtgggatgcagatct

SEQ ID NO: 33440 - DNA, 517 bp, Homo sapiens
gttgctgggcctctgtcccttctccattggtgccagctctgaagcaatcttttctggggcgcctgcaaaggacggatctgtgggtggaacgaactgaaaacggatccagtgactcatcccgattcttgcacattctagcacatcgcattctagagagcggaacaggcgaggaaaagtagtcccttctcggcgattctgcggagggatctccgtggggcggtgaacgccgatgattatataaggacgcgccgggtgtggcacagctagttccgtcgcagccgggatttgggtcgcagttcttgtttgtggatcgctgtgatcgtcacttgacaatgcagatcttcgtgaagactctgactggtaagaccatcaccctcgaggttgagcccagtgacaccatcgagaatgtcaaggcaaagatccaagataaggaaggcatccctcctgaccagcagaggctgatctttgctggaaaacagctggaagatgggcgcaccctgtctgactacaacatcca

SEQ ID NO: 33441 - DNA, 1963 bp, Homo sapiens
agttccgtcgcagccgggatttgggtcgcagttcttgtttgtggatcgctgtgatcgtcacttgacaatgcagatcttcgtgaagactctgactggtaagaccatcaccctcgaggttgagcccagtgacaccatcgagaatgtcaaggcaaagatccaagataaggaaggcatccctcctgaccagcagaggctgatctttgctggaaaacagctggaagatgggcgcaccctgtctgactacaacatccagaaagagtccaccctgcacctggtgctccgtctcagaggtgggatgcaaatcttcgtgaagacactcactggcaagaccatcacccttgaggtcgagcccagtgacaccatcgagaacgtcaaagcaaagatccaagataaggaaggcattccttctgatcagcagaggttgatctttgccggaaaacagctggaagatggtcgtaccctgtctgactacaacatccagaaagagtccaccttgcacctggtactccgtctcagaggtgggatgcaaatcttcgtgaagacactcactggcaagaccatcacccttgaggtcgagcccagtgacactatcgagaacgtcaaagcaaagatccaagacaaggaaggcattcctcctgaccagcagaggttgatctttgccggaaagcagctggaagatgggcgcaccctgtctgactacaacatccagaaagagtctaccctgcacctggtgctccgtctcagaggtgggatgcagatcttcgtgaagaccctgactggtaagaccatcactctcgaagtggagccgagtgacaccattgagaatgtcaaggcaaagatccaagacaaggaaggcatccctcctgaccagcagaggttgatctttgccggaaaacagctggaagatggtcgtaccctgtctgactacaacatccagaaagagtccaccttgcacctggtgctccgtctcagaggtgggatgcagatcttcgtgaagaccctgactggtaagaccatcactctcgaggtggagccgagtgacaccattgagaatgtcaaggcaaagatccaagacaaggaaggcatccctcctgaccagcagaggttgatctttgctgggaaacagctggaagatggacgcaccctgtctgactacaacatccagaaagagtccaccctgcacctggtgctccgtcttagaggtgggatgcagatcttcgtgaagaccctgactggtaagaccatcactctcgaagtggagccgagtgacaccattgagaatgtcaaggcaaagatccaagacaaggaaggcatccctcctgaccagcagaggttgatctttgctgggaaacagctggaagatggacgcaccctgtctgactacaacatccagaaagagtccaccctgcacctggtgctccgtcttagaggtgggatgcagatcttcgtgaagaccctgactggtaagaccatcactctcgaagtggagccgagtgacaccattgagaatgtcaaggcaaagatccaagacaaggaaggcatccctcctgaccagcagaggttgatctttgctgggaaacagctggaagatggacgcaccctgtctgactacaacatccagaaagagtccaccctgcacctggtgctccgtctcagaggtgggatgcaaatcttcgtgaagaccctgactggtaagaccatcaccctcgaggtggagcccagtgacaccatcgagaatgtcaaggcaaagatccaagataaggaaggcatccctcctgatcagcagaggttgatctttgctgggaaacagctggaagatggacgcaccctgtctgactacaacatccagaaagagtccactctgcacttggtcctgcgcttgagggggggtgtctaagtttccccttttaaggtttcaacaaatttcattgcactttcctttcaataaagttgttgcattccc

SEQ ID NO: 33442 - DNA, 559 bp, Homo sapiens
agcaaaatggcggctgttcccgagtcttgaatggaagacgcttgtgaggcgggctgtgaggtcgttgaaacaaggtggggggcatggtgggcggcaagaacccaaggtcttgaggccttcgctaatgcgggaaagctcttattcggacaatgcagatcttcgtgaagactctgactggtaagaccatcaccctcgaggttgagcccagtgacaccatcgagaatgtcaaggcaaagatccaagataaggaaggcatccctcctgaccagcagaggctgatctttgctggaaaacagctggaagatgggcgcaccctgtctgactacaacatccagaaagagtccaccctgcacctggtgctccgtctcagaggtgggatgcaaatcttcgtgaagacactcactggcaagaccatcacccttgaggtcgagcccagtgacaccatcgagaacgtcaaagcaaagatccaggacaaggaaggcattcctcctgaccagcagaggttgatctttgccggaaagcagctggaagatgggcgcaccctgtctgactacaacat

SEQ ID NO: 33443 - DNA, 1172 bp, Homo sapiens
tttccccctcgcttggttctgcccctgctccccctgcacaggcctcacagtgcgtctggccggcgctttatagctgcagcctgggcggctccgctagctgtttttcgtcttccctaggctatttctgccgggcgctccgcgaagatgcagctcaagccgatggagatcaaccccgagatgctgaacaaagtgctgtcccggctgggggtcgccggccagtggcgcttcgtggacgtgctggggctggaagaggagtctctgggctcggtgccagcgcctgcctgcgcgctgctgctgctgtttcccctcacggcccagcatgagaacttcaggaaaaagcagattgaagagctgaagggacaagaagttagtcctaaagtgtacttcatgaagcagaccattgggaattcctgtggcacaatcggacttattcacgcagtggccaataatcaagacaaactgggatttgaggatggatcagttctgaaacagtttctttctgaaacagagaaaatgtcccctgaagacagagcaaaatgctttgaaaagaatgaggccatacaggcagcccatgatgccgtggcacaggaaggccaatgtcgggtagatgacaaggtgaatttccattttattctgtttaacaacgtggatggccacctctatgaacttgatggacgaatgccttttccggtgaaccatggcgccagttcagaggacaccctgctgaaggacgctgccaaggtctgcagagaattcaccgagcgtgagcaaggagaagtccgcttctctgccgtggctctctgcaaggcagcctaatgctctgtgggagggactttgctgatttcccctcttcccttcaacatgaaaatatatacccccccatgcagtctaaaatgcttcagtacttgtgaaacacagctgttcttctgttctgcagacacgccttcccctcagccacacccaggcacttaagcacaagcagagtgcacagctgtccactgggccattgtggtgtgagcttcagatggtgaagcattctccccagtgtatgtcttgtatccgatatctaacgctttaaatggctactttggtttctgtctgtaagttaagaccttggatgtggtttaattgtttgtcctcaaaaggaataaaacttttctgctgataagata

SEQ ID NO: 33444 - DNA, 917 bp, Homo sapiens
ggcccggccgtaccactccgcgctgcgcacggggggctatttctgccgggcgctccgcgaagatgcagctcaagccgatggagatcaaccccgagatgctgaacaaagtgctgtcccggctgggggtcgccggccagtggcgcttcgtggacgtgctggggctggaagaggagtctctgggctcggtgccagcgcctgcctgcgcgctgctgctgctgtttcccctcacggcccagcatgagaacttcaggaaaaagcagattgaagagctgaagggacaagaagttagtcctaaagtgtacttcatgaagcagaccattgggaattcctgtggcacaatcggacttattcacgcagtggccaataatcaagacaaactgggatttgaggatggatcagttctgaaacagtttctttctgaaacagagaaaatgtcccctgaagacagagcaaaatgctttgaaaagaatgaggccatacaggcagcccatgatgccgtggcacaggaaggccaatgtcgggtagatgacaaggtgaatttccattttattctgtttaacaacgtggatggccacctctatgaacttgatggacgaatgccttttccggtgaaccatggcgccagttcagaggacaccctgctgaaggacgctgccaaggtctgcagagaattcaccgagcgtgagcaaggagaagtccgcttctctgccgtggctctctgcaaggcagcctaatgctctgtgggagggactttgctgatttcccctcttcccttcaacatgaaaatatatacccccccatgcagtctaaaatgcttcagtacttgtgaaacacagctgttcttctgttctgcagacacgccttcccctcagccacacccaggcacttaagcacaagcagagtgcacagctgtccac

SEQ ID NO: 33445 - DNA, 445 bp, Homo sapiens
gttttattctaggtagtcacttaaaaacgaacctcggtactggtctgacttaacatggaggaggaattgtctaagagactcgagctttagagtaattgggatggtgaaaggatgggtttccagaaacttcgcccaaaattaaagactccatcaaaaggactgctccatacactcaaggaacacccaccaacaaatcccgtctccacaaccaccagattatctcaccggcgagtgagactgcaaggctatttctgccgggcgctccgcgaagatgcagctcaagccgatggagatcaaccccgagatgctgaacaaagtgctgtcccggctgggggtcgccggccagtggcgcttcgtggacgtgctggggctggaagaggagtctctgggctcggtgccagcgcctgcctgcgcgctgctgctgctgtttcccctcacggcccag

SEQ ID NO: 33446 - DNA, 1033 bp, Homo sapiens
gtcagagctggagggccgggcaccgcggccatggagggtcaacgctggctgccgctggaggccaatcccgaggtcaccaaccagtttcttaaacaattaggtctacatcctaactggcaattcgttgatgtatatggaatggatcctgaactccttagcatggtaccaagaccagtctgtgcagtcttacttctctttcctattacagaaaagtatgaagtattcagaacagaagaggaagaaaaaataaaatctcagggacaagatgttacatcatcagtatatttcatgaagcaaacaatcagcaatgcctgtggaacaattggactgattcatgctattgcaaacaataaagacaagatgcactttgaatctggatcaaccttgaaaaaattcctggaggaatctgtgtcaatgagccctgaagaacgagccagatacctggagaactatgatgccatccgagttactcatgagaccagtgcccatgaaggtcagactgagtcctcctcgccatcctcatcacagcctcattctagccactgcagaacgaaggcctcatcattgtgtcaccatgcatccctgccctgggtcaaacgtaaccatgtaggccctgcaaaggctaccagtccatctctccgtcttcgtcgctggcgacccttcttacgtctaccatctttgggtctccattctgttgcaccaagtatagatgagaaagtagatcttcattttattgcattagttcatgtagatgggcatctctatgaattagatgggcggaagccatttccaattaaccatggtgaaactagtgatgaaactttattagaggatgccatagaagtttgcaagaagtttatggagcgcgaccctgatgaactaagatttaatgcgattgctctttctgcagcatagcttgtcaataatggaaacaccaaaaactgtattatttgcaactaaattttctctgccatacactaactcaaaaattttgatattttcattaacttgatgattaaactttatgtgagtt

SEQ ID NO: 33447 - DNA, 844 bp, Homo sapiens
gtcagagctggagggccgggcaccgcggccatggagggtcaacgctggctgccgctggaggccaatcccgaggtcaccaaccagtttcttaaacaattaggtctacatcctaactggcaattcgttgatgtatatggaatggatcctgaactccttagcatggtaccaagaccagtctgtgcagtcttacttctctttcctattacagaaaagtatgaagtattcagaacagaagaggaagaaaaaataaaatctcagggacaagatgttacatcatcagtatatttcatgaagcaaacaatcagcaatgcctgtggaacaattggactgattcatgctattgcaaacaataaagacaagatgcactttgaatctggatcaaccttgaaaaaattcctggaggaatctgtgtcaatgagccctgaagaacgagccagatacctggagaactatgatgccatccgagttactcatgagaccagtgcccatgaaggtcagactgaggcaccaagtatagatgagaaagtagatcttcattttattgcattagttcatgtagatgggcatctctatgaattagatgggcggaagccatttccaattaaccatggtgaaactagtgatgaaactttattagaggatgccatagaagtttgcaagaagtttatggagcgcgaccctgatgaactaagatttaatgcgattgctctttctgcagcatagcttgtcaataatggaaacaccaaaaactgtattatttgcaactaaattttctctgccatacactaactcaaaaattttgatattttcattaacttgatgattaaactttatgtgagttaaa

SEQ ID NO: 33448 - DNA, 824 bp, Homo sapiens
acagaagaggaagaaaaaataaaatctcagggacaagatgttacatcatcagtatatttcatgaagcaaacaatcagcaatgcctgtggaacaattggactgattcatgctattgcaaacaataaagacaagatgcactttgaatctggatcaaccttgaaaaaattcctggaggaatctgtgtcaatgagccctgaagaacgagccagatacctggagaactatgatgccatccgagttactcatgagaccagtgcccatgaaggtcagactgagtcctcctcgccatcctcatcacagcctcattctagccactgcagaacgaaggcctcatcattgtgtcaccatgcatccctgccctgggtcaaacgtaaccatgtaggccctgcaaaggctaccagtccatctctccgtcttcgtcgctggcgacccttcttacgtctaccatctttgggtctccattctgttgcaccaagtatagatgagaaagtagatcttcattttattgcattagttcatgtagatgggcatctctatgaattagatgggcggaagccatttccaattaaccatggtgaaactagtgatgaaactttattagaggatgccatagaagtttgcaagaagtttatggagcgcgaccctgatgaactaagatttaatgcgattgctctttctgcagcatagcttgtcaataatggaaacaccaaaaactgtattatttgcaactaaattttctctgccatacactaactcaaaaattttgatattttcattaacttgatgattaaactttatgtgagttaaactttgccttaacctgt

SEQ ID NO: 33449 - DNA, 1534 bp, Homo sapiens
cgagctcggcggcgggtttgctgagatctgtggccggcggcagctggtgcggggggcagctgagagcgagaggtggatcggggcggtgtgtggccagggccatgacgggcaatgccggggagtggtgcctcatggaaagcgaccccggggtcttcaccgagctcattaaaggattcggttgccgaggagcccaagtagaagaaatatggagtttagagcctgagaattttgaaaaattaaagccagttcatgggttaatttttcttttcaagtggcagccaggagaagaaccagcaggctctgtggttcaggactcccgacttgacacgatattttttgctaagcaggtaattaataatgcttgtgctactcaagccatagtgagtgtgttactgaactgtacccaccaggatgtccatttaggcgagacattatcagagtttaaagaattttcacaaagttttgatgcagctatgaaaggcttggcactgagcaattcagatgtgattcgacaagtacacaacagtttcgccagacagcaaatgtttgaatttgatacgaagacatcagcaaaagaagaagatgcttttcactttgtcagttatgttcctgttaatgggagactgtatgaattagatggattaagagaaggaccgattgatttaggtgcatgcaatcaagatgattggatcagtgcagtaaggcctgtcatagaaaaaaggatacaaaagtacagtgaaggtgaaattcgatttaatttaatggccattgtgtctgacagaaaaatgatatatgagcagaagatagcagagttacaaagacaacttgcagaggaacccatggatacagatcaaggtaatagtatgttaagtgctattcagtcagaagttgccaaaaatcagatgcttattgaagaagaagtacagaaattaaaaagatacaagattgagaatatcagaaggaagcataattatctgcctttcattatggaattgttaaagactttagcagaacaccagcagttaataccactagtagaaaagtttgagaaacactttgagaagacactactaggcaaataaaattttggaccattaacttaaagacgagaatacatgggaaaataggataaaagaacaaggtgtgagaaggaatagaaggaaacaaacaggaaagatatggctgcaccatgcagtgctactatatgctgagattctacaggatgagatttttgaatagctgaggcagttgcctataatctgtgatgacataaaagtatttgacctaaaatctttttatttgcaaaataataaataaaaagtgattctccctcggcatggctataatgaacttggttagaacctataaatgtttttgttatgtgagactttttaaccgatgaattcgttgaatacacaccacatttaaaaactgcctaggaggtaatccaaaaatatatagttataaaacttcttgtattatgtaccaaatctctttcttaaaatataaaataaaattatctagtttaagatta

SEQ ID NO: 33450 - DNA, 1507 bp, Homo sapiens
acggcgcccggaggctgtcgggaagtaggcggggtgacgtgtggttgacgagctcggcggcgggtttgctgagatctgtggccggcggcagctggtgcggggggcagctgagagcgagaggtggatcggggcggtgtgtggccagggccatgacgggcaatgccggggagtggtgcctcatggaaagcgaccccggggtcttcaccgagctcattaaaggattcggttgccgaggagcccaagtagaagaaatatggagtttagagcctgagaattttgaaaaattaaagccagttcatgggttaatttttcttttcaagtggcagccaggagaagaaccagcaggctctgtggttcaggactcccgacttgacacgatattttttgctaagcaggtaattaataatgcttgtgctactcaagccatagtgagtgtgttactgaactgtacccaccaggatgtccatttaggcgagacattatcagagtttaaagaattttcacaaagttttgatgcagctatgaaaggcttggcactgagcaattcagatgtgattcgacaagtacacaacagtttcgccagacagcaaatgtttgaatttgatacgaagacatcagcaaaagaagaagatgcttttcactttgtcagttatgttcctgttaatgggagactgtatgaattagatggattaagagaaggaccgattgatttaggtgcatgcaatcaagatgattggatcagtgcagtaaggcctgtcatagaaaaaaggatacaaaagtacagtgaaggtgaaattcgatttaatttaatggccattgtgtctgacagaaaaatgatatatgagcagaagatagcagagttacaaagacaacttgcagaggaacccatggatacagatcaaggtaatagtatgttaagtgctattcagtcagaagttgccaaaaatcagatgcttattgaagaagaagtacagaaattaaaaagatacaagattgagaatatcagaaggaagcataattatctgcctttcattatggaattgttaaagactttagcagaacaccagcagttaataccactagtagaaaagggaaaataggataaaagaacaaggtgtgagaaggaatagaaggaaacaaacaggaaagatatggctgcaccatgcagtgctactatatgctgagattctacaggatgagatttttgaatagctgaggcagttgcctataatctgtgatgacataaaagtatttgacctaaaatctttttatttgcaaaataataaataaaaagtgattctccctcggcatggctataatgaacttggttagaacctataaatgtttttgttatgtgagactttttaaccgatgaattcgttgaatacacaccacatttaaaaactgcctaggaggtaatccaaaaatatatagttataaaacttcttgtattatgtaccaaatctctttcttaaaatataaaataaaattatctagtttaagatta

SEQ ID NO: 33451 - DNA, 1355 bp, Homo sapiens
gcgagaggtggatcggggcggtgtgtggccagggccatgacgggcaatgccggggagtggtgcctcatggaaagcgaccccggggtcttcaccgagctcattaaaggattcggttgccgaggagcccaagtagaagaaatatggagtttagagcctgagaattttgaaaaattaaagccagttcatgggttaatttttcttttcaagtggcagccaggagaagaaccagcaggctctgtggttcaggactcccgacttgacacgatattttttgctaagcaggtaattaataatgcttgtgctactcaagccatagtgagtgtgttactgaactgtacccaccaggatgtccatttaggcgagacattatcagagtttaaagaattttcacaaagttttgatgcagctatgaaaggcttggcactgagcaattcagatgtgattcgacaagtacacaacagtttcgccagacagcaaatgtttgaatttgatacgaagacatcagcaaaagaagaagatgcttttcactttgtcagttatgttcctgttaatgggagactgtatgaattagatggattaagagaaggaccgattgatttaggtgcatgcaatcaagatgattggatcagtgcagtaaggcctgtcatagaaaaaaggatacaaaaagacgggttttcaccatgttgcccaggctggtctcagactcctgagctcaagccatccgcctgcctcgacctcccaaagtggtacagtgaaggtgaaattcgatttaatttaatggccattgtgtctgacagaaaaatgatatatgagcagaagatagcagagttacaaagacaacttgcagaggaggaacccatggatacagatcaaggtaatagtatgttaagtgctattcagtcagaagttgccaaaaatcagatgcttattgaagaagaagtacagaaattaaaaagatacaagattgagaatatcagaaggaagcataattatctgcctttcattatggaattgttaaagactttagcagaacaccagcagttaataccactagtagaaaaggcaaaagaaaaacagaacgcaaagaaagctcaggaaaccaaatgaagatgttttcagatatgtacacatttctgcttctgcacatattttcatggaaaccattatgtataaagaacttagagcaacatcctaattggctcagtgcacgtttggcaatagtgccagcctgtcttgtctttaatgcatggattcataaacttcttccctacctgcatcatgtgcatgtagtgcatattaaatgaaagtgatattaagaatgctttcccaaattccattatttgacattgagtctg

SEQ ID NO: 33452 - DNA, 1346 bp, Homo sapiens
cgggtttgctgagatctgtggccggcggcagctggtgcggggggcagctgagagcgagaggtggatcggggcggtgtgtggccagggccatgacgggcaatgccggggagtggtgcctcatggaaagcgaccccggggtcttcaccgagctcattaaaggattcggttgccgaggagcccaagtagaagaaatatggagtttagagcctgagaattttgaaaaattaaagccagttcatgggttaatttttcttttcaagtggcagccaggagaagaaccagcaggctctgtggttcaggactcccgacttgacacgatattttttgctaagcaggtaattaataatgcttgtgctactcaagccatagtgagtgtgttactgaactgtacccaccaggatgtccatttaggcgagacattatcagagtttaaagaattttcacaaagttttgatgcagctatgaaaggcttggcactgagcaattcagatgtgattcgacaagtacacaacagtttcgccagacagcaaatgtttgaatttgatacgaagacatcagcaaaagaagaagatgcttttcactttgtcagttatgttcctgttaatgggagactgtatgaattagatggattaagagaaggaccgattgatttaggtgcatgcaatcaagatgattggatcagtgcagtaaggcctgtcatagaaaaaaggatacaaaaagacgggttttcaccatgttgcccaggctggtctcagactcctgagctcaagccatccgcctgcctcgacctcccaaagtggtacagtgaaggtgaaattcgatttaatttaatggccattgtgtctgacagaaaaatgatatatgagcagaagatagcagagttacaaagacaacttgcagaggaacccatggatacagatcaaggtaatagtatgttaagtgctattcagtcagaagttgccaaaaatcagatgcttattgaagaagaagtacagaaattaaaaagatacaagattgagaatatcagaaggaagcataattatctgcctttcattatggaattgttaaagactttagcagaacaccagcagttaataccactagtagaaaaggcaaaagaaaaacagaacgcaaagaaagctcaggaaaccaaatgaagatgttttcagatatgtacacatttctgcttctgcacatattttcatggaaaccattatgtataaagaacttagagcaacatcctaattggctcagtgcacgtttggcaatagtgccagcctgtcttgtctttaatgcatggattcataaacttcttccctacctgcatcatgtgcatgtagtgcata

SEQ ID NO: 33453 - DNA, 1911 bp, Homo sapiens
aaggaggagaaagaggaggagtaaagcaggccctctcgacgtcggcctgtggggagcgatgccgacaagcaggagcggtcccggcttcggaaagggcccaccctgaggaatggtccggccgggcctagcgaggatgtccctaccgcgatgctggttccgttacccagggtggacaggcgcggaagcgggacggggaagagcgatagtttcgcggcgtttgcccagcctcaacccctgggatgcgggtgagagacatggaggactggtcagaatttgcgcgtccctggggccgcacaaaaggctcccagccggcctcccgcaatgtcctcacctgtacctggcagccgaccccctggatccgcagcgccgccaggagaagtcctgcgcagcgctgggaaacgacaaaagaaggcagcctgacgggcagcgacagccacagcaacagcaacagccccactgccgccggggattccaggttgccgaggagcccaagtagaagaaatatggagtttagagcctgagaattttgaaaaattaaagccagttcatgggttaatttttcttttcaagtggcagccaggagaagaaccagcaggctctgtggttcaggactcccgacttgacacgatattttttgctaagcaggtaattaataatgcttgtgctactcaagccatagtgagtgtgttactgaactgtacccaccaggatgtccatttaggcgagacattatcagagtttaaagaattttcacaaagttttgatgcagctatgaaaggcttggcactgagcaattcagatgtgattcgacaagtacacaacagtttcgccagacagcaaatgtttgaatttgatacgaagacatcagcaaaagaagaagatgcttttcactttgtcagttatgttcctgttaatgggagactgtatgaattagatggattaagagaaggaccgattgatttaggtgcatgcaatcaagatgattggatcagtgcagtaaggcctgtcatagaaaaaaggatacaaaagtacagtgaaggtgaaattcgatttaatttaatggccattgtgtctgacagaaaaatgatatatgagcagaagatagcagagttacaaagacaacttgcagaggaacccatggatacagatcaaggtaatagtatgttaagtgctattcagtcagaagttgccaaaaatcagatgcttattgaagaagaagtacagaaattaaaaagatacaagattgagaatatcagaaggaagcataattatctgcctttcattatggaattgttaaagactttagcagaacaccagcagttaataccactagtagaaaagatattctgatataggggaaggattctttaataagttccccaagtgattctaatgcaactggtctgtgtaccacagtttgagaaacactttgagaagacactactaggcaaataaaattttggaccattaacttaaagacgagaatacatggtaggtatattttccttattaattttaaagtttacaaagcaaagattgatttcaaccaagctgtttcatgttatacattctaaataatatgagatgtgagctaataagttttttgtgtatattaccttattgattgaaacatgtgacccaacttttagcattaaatgtaaaaattattgcagaagactgctaaatcttctcttttccattataggtttttctgttcatgcatctcagggtgtattctaagatgggaaactgtttttaaagttttagattaatacagggtcctgtggttctcaaaattgcttggttaacaagaatacctagatatgatgttattaatcatatcaaatgtttttctgttaaaaatattaaaataactataaaatgtgctaaatatgtgatacatcagatttt

SEQ ID NO: 33454 - DNA, 1815 bp, Homo sapiens
cgctacgggtgctgcaaggcctgggaagagtttcgatgtctctagggtggctagagcgtcctcccgcgctcagtcgcgctgcaggtgacggcgcccggaggctgtcgggaagtaggcggggtgacgtgtggttgacgagctcggcggcgggtttgctgagatctgtggccggcggcagctggtgcggggggcagctgagagcgagaggtggatcggggcggtgtgtggccagggccatgacgggcaatgccggggagtggtgcctcatggaaagcgaccccggggtcttcaccgagctcattaaaggattcggttgccgaggagcccaagtagaagaaatatggagtttagagcctgagaattttgaaaaattaaagccagttcatgggttaatttttcttttcaagtggcagccaggagaagaaccagcaggctctgtggttcaggactcccgacttgacacgatattttttgctaagcaggtaattaataatgcttgtgctactcaagccatagtgagtgtgttactgaactgtacccaccaggatgtccatttaggcgagacattatcagagtttaaagaattttcacaaagttttgatgcagctatgaaaggcttggcactgagcaattcagatgtgattcgacaagtacacaacagtttcgccagacagcaaatgtttgaatttgatacgaagacatcagcaaaagaagaagatgcttttcactttgtcagttatgttcctgttaatgggagactgtatgaattagatggattaagagaaggaccgattgatttaggtgcatgcaatcaagatgattggatcagtgcagtaaggcctgtcatagaaaaaaggatacaaaagtacagtgaaggtgaaattcgatttaatttaatggccattgtgtctgacagaaaaatgatatatgagcagaagatagcagagttacaaagacaacttgcagaggaacccatggatacagatcaaggtaatagtatgttaagtgctattcagtcagaagttgccaaaaatcagatgcttattgaagaagaagtacagaaattaaaaagatacaagattgagaatatcagaaggaagcataattatctgcctttcattatggaattgttaaagactttagcagaacaccagcagttaataccactagtagaaaaggcaaaagaaaaacagaacgcaaagaaagctcaggaaaccaaatgaagatgttttcagatatgtacacatttctgcttctgcacatattttcatggaaaccattatgtataaagaacttagagcaacatcctaattggctcagtgcacgtttggcaatagtgccagcctgtcttgtctttaatgcatggattcataaacttcttccctacctgcatcatgtgcatgtagtgcatattaaatgaaagtgatattaagaatgctttcccaaattccattatttgacattgagtctgacaactgttagttttctggttgtctaactaccatatgaagctagaaaatgcacaaacgatattccttatctgtaatttaaatacttaaaatttgcaattgtcagatcttgattaaactggttgtcttatttcttctcatcattaacggaaaaaaaatcagtatttctatctttgatatctaagtgttttgaggattttaaaactgaattttatctgctataccagttatttgagaaagtatgattttaatgtaaatcatttaaaaaggacaaaagtataatttccagtgattttcactgctgtcagtagaaaagtaataaacatctcaattttattttagtaaa

SEQ ID NO: 33455 - DNA, 1818 bp, Homo sapiens
cgctacgggtgctgcaaggcctgggaagagtttcgatgtctctagggtggctagagcgtcctcccgcgctcagtcgcgctgcaggtgacggcgcccggaggctgtcgggaagtaggcggggtgacgtgtggttgacgagctcggcggcgggtttgctgagatctgtggccggcggcagctggtgcggggggcagctgagagcgagaggtggatcggggcggtgtgtggccagggccatgacgggcaatgccggggagtggtgcctcatggaaagcgaccccggggtcttcaccgagctcattaaaggattcggttgccgaggagcccaagtagaagaaatatggagtttagagcctgagaattttgaaaaattaaagccagttcatgggttaatttttcttttcaagtggcagccaggagaagaaccagcaggctctgtggttcaggactcccgacttgacacgatattttttgctaagcaggtaattaataatgcttgtgctactcaagccatagtgagtgtgttactgaactgtacccaccaggatgtccatttaggcgagacattatcagagtttaaagaattttcacaaagttttgatgcagctatgaaaggcttggcactgagcaattcagatgtgattcgacaagtacacaacagtttcgccagacagcaaatgtttgaatttgatacgaagacatcagcaaaagaagaagatgcttttcactttgtcagttatgttcctgttaatgggagactgtatgaattagatggattaagagaaggaccgattgatttaggtgcatgcaatcaagatgattggatcagtgcagtaaggcctgtcatagaaaaaaggatacaaaagtacagtgaaggtgaaattcgatttaatttaatggccattgtgtctgacagaaaaatgatatatgagcagaagatagcagagttacaaagacaacttgcagaggaggaacccatggatacagatcaaggtaatagtatgttaagtgctattcagtcagaagttgccaaaaatcagatgcttattgaagaagaagtacagaaattaaaaagatacaagattgagaatatcagaaggaagcataattatctgcctttcattatggaattgttaaagactttagcagaacaccagcagttaataccactagtagaaaaggcaaaagaaaaacagaacgcaaagaaagctcaggaaaccaaatgaagatgttttcagatatgtacacatttctgcttctgcacatattttcatggaaaccattatgtataaagaacttagagcaacatcctaattggctcagtgcacgtttggcaatagtgccagcctgtcttgtctttaatgcatggattcataaacttcttccctacctgcatcatgtgcatgtagtgcatattaaatgaaagtgatattaagaatgctttcccaaattccattatttgacattgagtctgacaactgttagttttctggttgtctaactaccatatgaagctagaaaatgcacaaacgatattccttatctgtaatttaaatacttaaaatttgcaattgtcagatcttgattaaactggttgtcttatttcttctcatcattaacggaaaaaaaatcagtatttctatctttgatatctaagtgttttgaggattttaaaactgaattttatctgctataccagttatttgagaaagtatgattttaatgtaaatcatttaaaaaggacaaaagtataatttccagtgattttcactgctgtcagtagaaaagtaataaacatctcaattttattttagtaaa

SEQ ID NO: 33456 - DNA, 1063 bp, Homo sapiens
gagatctgtggccggcggcagctggtgcggggggcagctgagagcgagaggtggatcggggcggtgtgtggccagggccatgacgggcaatgccggggagtggtgcctcatggaaagcgaccccggggtcttcaccgagctcattaaaggattcggttgccgaggagcccaagtagaagaaatatggagtttagagcctgagaattttgaaaaattaaagccagttcatgggttaatttttcttttcaagtggcagccaggagaagaaccagcaggctctgtggttcaggactcccgacttgacacgatattttttgctaagcaggtaattaataatgcttgtgctactcaagccatagtgagtgtgttactgaactgtacccaccaggatgtccatttaggcgagacattatcagagtttaaagaattttcacaaagttttgatgcagctatgaaaggcttggcactgagcaattcagatgtgattcgacaagtacacaacagtttcgccagacagcaaatgtttgaatttgatacgaagacatcagcaaaagaagaagatgcttttcactttgtcagttatgttcctgttaatgggagactgtatgaattagatggattaagagaaggaccgattgatttaggtgcatgcaatcaagatgattggatcagtgcagtaaggcctgtcatagaaaaaaggatacaaaagtacagtgaaggtgaaattcgatttaatttaatggccattgtgtctgacagaaaaatgatatatgagcagaagatagcagagttacaaagacaacttgcagaggaggaacccatggatacagatcaaggtaatagtatgttaagtgctattcagtcagaagttgccaaaaatcagatgcttattgaagaagaagtacagaaattaaaaagatacaagattgagaatatcagaaggaagcataattatctgcctttcattatggaattgttaaagactttagcagaacaccagcagttaataccactagtagaaaagtttgagaaacactttgagaagacactactaggcaaataa

SEQ ID NO: 33457 - DNA, 411 bp, Homo sapiens
taatttaatggccattgtgtctgacagaaaaatgatatatgagcagaagatagcagagttacaaagacaacttgcagaggaacccatggatacagatcaaggtaatagtatgttaagtgctattcagtcagaagttgccaaaaatcagatgcttattgaagaagaagtacagaaattaaaaagatacaagattgagaatatcagaaggaagcataattatctgcctttcattatggaattgttaaagactttagcagaacaccagcagttaataccactagtagaaaagatattctgatataggggaaggattctttaataagttccccaagtgattctaatgcaactggtctgtgtaccacagtttgagaaacactttgagaagacactactaggcaaataaaattttgg

SEQ ID NO: 33458 - DNA, 577 bp, Homo sapiens
aggccctctcgacgtcggcctgtggggagcgatgccgacaagcaggagcggtcccggcttcggaaagggcccaccctgaggaatggtccggccgggcctagcgaggatgtccctaccgcgatgctggttccgttacccagggtggacaggcgcggaagcgggacggggaagagcgatagtttcgcggcgtttgcccagcctcaacccctgggatgcgggtgagagacatggaggactggtcagaatttgcgcgtccctggggccgcacaaaaggctcccagccggcctcccgcaatgtcctcacctgtacctggcagccgaccccctggatccgcagcgccgccaggagaagtcctgcgcagcgctgggaaacgacaaaagaaggcagcctgacgggcagcgacagccacagcaacagcaacagccccactgccgccggggattccaggccccagcccttccgaatccgctacgggtgctgcaaggcctgggaagagtttcgatgtctctagggtggctagagcgtcctcccgcgctcagtcgcgctgcaggttgccgaggagcccaagtagaagaa

SEQ ID NO: 33459 - DNA, 1329 bp, Homo sapiens
cattatcagagtttaaagaattttcacaaagttttgatgcagctatgaaaggcttggcactgagcaattcagatgtgattcgacaagtacacaacagtttcgccagacagcaaatgtttgaatttgatacgaagacatcagcaaaagaagaagatgcttttcactttgtcagttatgttcctgttaatgggagactgtatgaattagatggattaagagaaggaccgattgatttaggtgcatgcaatcaagatgattggatcagtgcagtaaggcctgtcatagaaaaaaggatacaaaagtacagtgaaggtgaaattcgatttaatttaatggccattgtgtctgacagaaaaatgatatatgagcagaagatagcagagttacaaagacaacttgcagaggaggaacccatggatacagatcaaggtaatagtatgttaagtgctattcagtcagaagttgccaaaaatcagatgcttattgaagaagaagtacagaaattaaaaagatacaagattgagaatatcagaaggaagcataattatctgcctttcattatggaattgttaaagactttagcagaacaccagcagttaataccactagtagaaaagtttgagaaacactttgagaagacactactaggcaaataaaattttggaccattaacttaaagacgagaatacatggcaaaagaaaaacagaacgcaaagaaagctcaggaaaccaaatgaagatgttttcagatatgtacacatttctgcttctgcacatattttcatggaaaccattatgtataaagaacttagagcaacatcctaattggctcagtgcacgtttggcaatagtgccagcctgtcttgtctttaatgcatggattcataaacttcttccctacctgcatcatgtgcatgtagtgcatattaaatgaaagtgatattaagaatgctttcccaaattccattatttgacattgagtctgacaactgttagttttctggttgtctaactaccatatgaagctagaaaatgcacaaacgatattccttatctgtaatttaaatacttaaaatttgcaattgtcagatcttgattaaactggttgtcttatttcttctcatcattaacggaaaaaaaatcagtatttctatctttgatatctaagtgttttgaggattttaaaactgaattttatctgctataccagttatttgagaaagtatgattttaatgtaaatcatttaaaaaggacaaaagtataatttccagtgattttcactgctgtcagtagaaaagtaataaacatctcaattttattttagtaaa

SEQ ID NO: 33460 - DNA, 834 bp, Homo sapiens
tctcaggccccagcccttccgaatccgctacgggtgctgcaaggcctgggaagagtttcgatgtctctagggtggctagagcgtcctcccgcgctcagtcgcgctgcaggttgccgaggagcccaagtagaagaaatatggagtttagagcctgagaattttgaaaaattaaagccagttcatgggttaatttttcttttcaagtggcagccaggagaagaaccagcaggctctgtggttcaggactcccgacttgacacgatattttttgctaagcaggtaattaataatgcttgtgctactcaagccatagtgagtgtgttactgaactgtacccaccaggatgtccatttaggcgagacattatcagagtttaaagaattttcacaaagttttgatgcagctatgaaaggcttggcactgagcaattcagatgtgattcgacaagtacacaacagtttcgccagacagcaaatgtttgaatttgatacgaagacatcagcaaaagaagaagatgcttttcactttgtcagttatgttcctgttaatgggagactgtatgaattagatggattaagagaaggaccgattgatttaggtgcatgcaatcaagatgattggatcagtgcagtaaggcctgtcatagaaaaaaggatacaaaagtacagtgaaggtgaaattcgatttaatttaatggccattgtgtctgacagaaaaatgatatatgagcagaagatagcagagttacaaagacaacttgcagaggaacccatggatacagatcaaggtaatagtatgttaagtgctattcagtcagaagttgccaaaaatcag

SEQ ID NO: 33461 - DNA, 785 bp, Homo sapiens
acagcaaatgtttgaatttgatacgaagacatcagcaaaagaagaagatgcttttcactttgtcagttatgttcctgttaatgggagactgtatgaattagatggattaagagaaggaccgattgatttaggtgcatgcaatcaagatgattggatcagtgcagtaaggcctgtcatagaaaaaaggatacaaaagtacagtgaaggtgaaattcgatttaatttaatggccattgtgtctgacagaaaaatgatatatgagcagaagatagcagagttacaaagacaacttgcagaggaggaacccatggatacagatcaaggtaatagtatgttaagtgctattcagtcagaagttgccaaaaatcagatgcttattgaagaagaagtacagaaattaaaaagatacaagattgagaatatcagaaggaagcataattatctgcctttcattatggaattgttaaagactttagcagaacaccagcagttaataccactagtagaaaagtttgagaaacactttgagaagacactactaggcaaataaaattttggaccattaacttaaagacgagaatacatgggaaaataggataaaagaacaaggtgtgagaaggaatagaaggaaacaaacaggaaagatatggctgcaccatgcagtgctactatatgctgagattctacaggatgagatttttgaatagctgaggcagttgcctataatctgtgatgacataaaagtatttgacctaaaatctttttatttgcaaaataataaataa

SEQ ID NO: 33462 - DNA, 784 bp, Homo sapiens
tgaaggtgaaattcgatttaatttaatggccattgtgtctgacagaaaaatgatatatgagcagaagatagcagagttacaaagacaacttgcagaggaacccatggatacagatcaaggtaatagtatgttaagtgctattcagtcagaagttgccaaaaatcagatgcttattgaagaagaagtacagaaattaaaaagatacaagattgagaatatcagaaggaagcataattatctgcctttcattatggaattgttaaagactttagcagaacaccagcagttaataccactagtagaaaagtttgagaaacactttgagaagacactactaggcaaataaaattttggaccattaacttaaagacgagaatacatggcaaaagaaaaacagaacgcaaagaaagctcaggaaaccaaatgaagatgttttcagatatgtacacatttctgcttctgcacatattttcatggaaaccattatgtataaagaacttagagcaacatcctaattggctcagtgcacgtttggcaatagtgccagcctgtcttgtctttaatgcatggattcataaacttcttccctacctgcatcatgtgcatgtagtgcatattaaatgaaagtgatattaagaatgctttcccaaattccattatttgacattgagtctgacaactgttagttttctggttgtctaactaccatatgaagctagaaaatgcacaaacgatattccttatctgtaatttaaatacttaaaatttgcaattgtcagatctt

SEQ ID NO: 33463 - DNA, 1067 bp, Homo sapiens
gatctgtggccggcggcagctggtgcggggggcagctgagagcgagaggtggatcggggcggtgtgtggccagggccatgacgggcaatgccggggagtggtgcctcatggaaagcgaccccggggtcttcaccgagctcattaaaggattcggttgccgaggagcccaagtagaagaaatatggagtttagagcctgagaattttgaaaaattaaagtaattaataatgcttgtgctactcaagccatagtgagtgtgttactgaactgtacccaccaggatgtccatttaggcgagacattatcagagtttaaagaattttcacaaagttttgatgcagctatgaaaggcttggcactgagcaattcagatgtgattcgacaagtacacaacagtttcgccagacagcaaatgtttgaatttgatacgaagacatcagcaaaagaagaagatgcttttcactttgtcagttatgttcctgttaatgggagactgtatgaattagatggattaagagaaggaccgattgatttaggtgcatgcaatcaagatgattggatcagtgcagtaaggcctgtcatagaaaaaaggatacaaaagtacagtgaaggtgaaattcgatttaatttaatggccattgtgtctgacagaaaaatgatatatgagcagaagatagcagagttacaaagacaacttgcagaggaggaacccatggatacagatcaaggtaatagtatgttaagtgctattcagtcagaagttgccaaaaatcagatgcttattgaagaagaagtacagaaattaaaaagatacaagattgagaatatcagaaggaagcataattatctgcctttcattatggaattgttaaagactttagcagaacaccagcagttaataccactagtagaaaagatattctgatataggggaaggattctttaataagttccccaagtgattctaatgcaactggtctgtgtaccacagtttgagaaacactttgagaagacactactaggcaaataaaattttggaccattaacttaaagacgagaatacatgg

SEQ ID NO: 33464 - DNA, 1087 bp, Homo sapiens
gattgcttgaggagagaagtatgtgatcagaaagcattctttgtctattaactcctgcccagcaaaagtgaaagaaaattcatgggagcatgcaagaacaaagagcacagcaaagctggacaaacacagcaatccaggcaggggatttccaactcaactctggtatataagctgcatgcaaagtcctttttctgtctctggtttctggccccttgtctgcagagatggctcccaatgcttcctgcctctgtgtgcatgtccgttccgaggaatgggatttaatgacctttgatgccaacccatatgacagcgtgaaaaaaatcaaagaacatgtccggtctaagaccaaggttcctgtgcaggaccaggttcttttgctgggctccaagatcttaaagccacggagaagcctctcatcttatggcattgacaaagagaagaccatccaccttaccctgaaagtggtgaagcccagtgatgaggagctgcccttgtttcttgtggagtcaggtgatgaggcaaagaggcacctcctccaggtgcgaaggtccagctcagtggcacaagtgaaagcaatgatcgagactaagacgggtataatccctgagacccagattgtgacttgcaatggaaagagactggaagatgggaagatgatggcagattacggcatcagaaagggcaacttactcttcctggcatgttattgtattggagggtgaccaccctgggcatggggtgttggcaggggtcaaaaagcttatttcttttaatctcttactcaacgaacacatcttctgatgatttcccaaaattaatgagaatgagatgagtagagtaagatttgggtgggatgggtaggatgaagtatattgcccaactctatgtttctttgattctaacacaattaattaagtgacatgatttttactaatgtattactgagactagtaaataaatttttaaggcaaaatagagcattcaaagccagcttggaatttaattctgtcttgataccttgttatttatgcaaaaactcctatctcctttcctttatgacaagagagtaagttttaggttgggatcc

SEQ ID NO: 33465 - DNA, 990 bp, Homo sapiens
gattgcttgaggagagaagtatgtgatcagaaagcattctttgtctattaactcctgcccagcaaaagtgaaagaaaattcatgggagcatgcaagaacaaagagcacagcaaagctggacaaacacagcaatccaggcaggggatttccaactcaactctggtatataagctgcatgcaaagtcctttttctgtctctggtttctggccccttgtctgcagagatggctcccaatgcttcctgcctctgtgtgcatgtccgttccgaggaatgggatttaatgacctttgatgccaacccatatgacagcgtgaaaaaaatcaaagaacatgtccggtctaagaccaaggttcctgtgcaggaccaggttcttttgctgggctccaagatcttaaagccacggagaagcctctcatcttatggcattgacaaagagaagaccatccaccttaccctgaaagtggtgaagcccagtgatgaggagctgcccttgtttcttgtggagtcaggtgatgaggcaaagaggcacctcctccaggtgcgaaggtccagctcagtggcacaagtgaaagcaatgatcgagactaagacgggtataatccctgagacccagattgtgacttgcaatggaaagagactggaagatgggaagatgatggcagattacggcatcagaaagggcaacttactcttcctggcatcttattgtattggagggtgaccaccctggggatggggtgttggcaggggtcaaaaagcttatttcttttaatctcttactcaacgaacacatcttctgatgatttcccaaaattaatgagaatgagatgagtagagtaagatttgggtgggatgggtaggatgaagtatattgcccaactctatgtttctttgattctaacacaattaattaagtgacatgatttttactaatgtattactgagactagtaaataaatttttaaggcaaaatagagcattcaaagcca

SEQ ID NO: 33466 - DNA, 990 bp, Homo sapiens
gattgcttgaggagagaagtatgtgatcagaaagcattctttgtctattaactcctgcccagcaaaagtgaaagaaaattcatgggagcatgcaagaacaaagagcacagcaaagctggacaaacacagcaatccaggcaggggatttccaactcaactctggtatataagctgcatgcaaagtcctttttctgtctctggtttctggccccttgtctgcagagatggctcccaatgcttcctgcctctgtgtgcatgtccgttccgaggaatgggatttaatgacctttgatgccaacccatatgacagcgtgaaaaaaatcaaagaacatgtccggtctaagaccaaggttcctgtgcaggaccaggttcttttgctgggctccaagatcttaaagccacggagaagcctctcatcttatggcactgacaaagagaagaccatccaccttaccctgaaagtggtgaagcccagtgatgaggagctgcccttgtttcttgtggagtcaggtgatgaggcaaagaggcacctcctccaggtgcgaaggtccagctcagtggcacaagtgaaagcaatgatcgagactaagacgggtataatccctgagacccagattgtgacttgcaatggaaagagactggaagatgggaagatgatggcagattacggcatcagaaagggcaacttactcttcctggcatcttattgtattggagggtgaccaccctggggatggggtgttggcaggggtcaaaaagcttatttcttttaatctcttactcaacgaacacatcttctgatgatttcccaaaattaatgagaatgagatgagtagagtaagatttgggtgggatgggtaggatgaagtatattgcccaactctatgtttctttgattctaacacaattaattaagtgacatgatttttactaatgtattactgagactagtaaataaatttttaaggcaaaatagagcattcaaagcca

SEQ ID NO: 33467 - DNA, 990 bp, Homo sapiens; identical to SEQ ID NO: 33466

SEQ ID NO: 33468 - DNA, 990 bp, Homo sapiens
gattgcttgaggagagaagtatgtgatcagaaagcattctttgtctattaactcctgcccagcaaaagtgaaagaaaattcatgggagcatgcaagaacaaagagcacagcaaagctggacaaacacagcaatccaggcaggggatttccaactcaactctggtatataagctgcatgcaaagtcctttttctgtctctggtttctggccccttgtctgcagagatggctcccaatgcttcctgcctctgtgtgcatgtccgttccgaggaatgggatttaatgacctttgatgccaacccatatgacagcgtgaaaaaaatcaaagaacatgtccggtctaagaccaaggttcctgtgcaggaccaggttcttttgctgggctccaagatcttaaagccacggagaagcctctcatcttatggcattgacaaagagaagaccatccaccttaccctgaaagtggtgaagcccagtgatgaggagctgcccttgtttcttgtggagtcaggtgatgaggcaaagaggcacctcctccaggtgcgaaggtccagctcagtggcacaagtgaaagcaatgatcgagactaagacgggtataatccctgagacccagattgtgacttgcaatggaaagagactggaagatgggaagatgatggcagattacggcatcagaaagggcaacttactcttcctggcatgttattgtattggagggtgaccaccctgggcatggggtgttggcaggggtcaaaaagcttatttcttttaatctcttactcaacgaacacatcttctgatgatttcccaaaattaatgagaatgagatgagtagagtaagatttgggtgggatgggtaggatgaagtatattgcccaactctatgtttctttgattctaacacaattaattaagtgacatgatttttactaatgtattactgagactagtaaataaatttttaaggcaaaatagagcattcaaagcca

SEQ ID NO: 33469 - DNA, 990 bp, Homo sapiens; identical to SEQ ID NO: 33466

SEQ ID NO: 33470 - DNA, 990 bp, Homo sapiens
gattgcttgaggagagaagtatgtgatcagaaagcattctttgtctattaactcctgcccagcaaaagtgaaagaaaattcatgggagcatgcaagaacaaagagcacagcaaagctggacaaacacagcaatccaggcaggggatttccaactcaactctggtatataagctgcatgcaaagtcctttttctgtctctggtttctggccccttgtctgcagagatggctcccaatgcttcctgcctctgtgtgcatgtccgttccgaggaatgggatttaatgacctttgatgccaacccatatgacagcgtgaaaaaaatcaaagaacatgtccggtctaagaccaaggttcctgtgcaggaccaggttcttttgctgggctccaagatcttaaagccacggagaagcctctcatcttacggcattgacaaagagaagaccatccaccttaccctgaaagtggtgaagcccagtgatgaggagctgcccttgtttcttgtggagtcaggtgatgaggcaaagaggcacctcctccaggtgcgaaggtccagctcagtggcacaagtgaaagcaatgatcgagactaagacgggtataatccctgagacccagattgtgacttgcaatggaaagagactggaagatgggaagatgatggcagattacggcatcagaaagggcaacttactcttcctggcatcttattgtattggagggtgaccaccctgggcatggggtgttggcaggggtcaaaaagcttatttcttttaatctcttactcaacgaacacatcttctgatgatttcccaaaattaatgagaatgagatgagtagagtaagatttgggtgggatgggtaggatgaagtatattgcccaactctatgtttctttgattctaacacaattaattaagtgacatgatttttactaatgtattactgagactagtaaataaatttttaaggcaaaatagagcattcaaagcca

SEQ ID NO: 33471 - DNA, 3301 bp, Homo sapiens
ggcgccgcgggccgggggccgatgggtcctggcggacgcgaggcgccggcgcggggctcgcctggactcgggtgtgcggggctgtgagggggcgaggcgggcgctgcggcccgcccgggatgggccagccctggcctggcggggctgagccgaaggcgagggcggcgcgcgggccaggcctgccgggcgggcggcccgggggttgaggtagaagtgggcgcggaggaaggggccgagccaaggcggtgggtggagcggcgaggggggcggaggctgggccgcggcgggcgagcggagcggcgcgcctgtccggagctcggcggtggcgccggaggaggctgcagcggcggcggcggcgggcccggacgagcgtccggaggtggcggacgaggcgccgggggcccccatgggcgggtgtgtgggcgcccagcacgactcctcgggcagcctcaacgagaactcggagggcaccggagttgctctaggtcgtaaccagcctttgaaaaaggagaaaccaaaatggaaaagcgattatcctatgacagatggacaactacgcagcaagagggatgaattttgggatacagcaccagcttttgaaggccggaaagagatttgggatgccttgaaggctgctgcacatgcttttgagagcaatgatcatgaactggcacaagcaatcattgatggtgcaaacataacattaccacatggtgcacttacagagtgctacgatgaactggggaacagatatcagcttccagtgtattgcttggcaccgccaatcaacatgatagaggaaaagagcgacatagagactctggatattcctgagccaccacccaattctggatatgaatgtcagcttcgtttgcgcctttccacaggcaaagacctcaagcttgtggttcgcagcacagacacagtattccacatgaagagacggttgcatgcagcagagggagtggaaccaggtagtcagcggtggtttttttctggcagacctctcactgacaaaatgaagttcgaagagctgaagatcccaaaggactatgttgtacaggttatagtgagccaacctgtgcagaacccaacaccagtggagaactgaactgagccctgttggccagctcccacatccctctgctcctttttatggttcttgttgtcatttcctactctgcggcgtgaaatctatttcactgctctaaattccctatgaatggatttagttctgaggaattaccagtgaaaaattccatctgtgatggagaccaacaaaaataataaaacacaaagagccaggctttgagactcatgtaattacaatttctaatttgaaaggcagttaagaaatagataaccatttattttagaacactcaacaactatgtaatggctatatttcagtgacttggactgtaaatgaaacattgcatccatgaaggacagcaccaagcacctttttgaatacagaatttttttagaaaaatatatcaaattatataatttccagaaaccataaataatggatataaaacttaacctttttgttttgttttgttttgttttgttttgttttgttttgttttggttaatggaaactgaaaagagcagtatttgaggttgcttctattctggttttttattcttagctcaattaatatttagccataaatgagtagagactggcaaattgtgctttagtgttgctttcctcatccccacatcttgagctccttatttacattcacactaaattttggtgccttccagcacattagtggcaggcacccttctggaacactaggcaataatttcatcaatacagtcaggtctcttgagtttcaacagatactcagttgaaaagtcgctgtcatcttgctgcataagtattttgaaaggtctgtataacgaagccatttttatatccaggcttagaaggtcactactatatagtaccttcattgatctatctattctgcttggaacttttcatagctaagtataacccccaaatgcatggttcctgggtcaggagacaccaaaatcaattatagctgttcccactcaagttaataaagtaaatgatttcctccactttgcatggaggggtgtaaggaaagcctattttatctgtgcctgggagaactgtgcctattttcagtcttttagaggaaatttcaactcaaaatttttaagtgtgaaagatttactggtgtcacataaacattagcagtgagaccaaataatgaaacattgctttataccttagtgctttccagttcactgttacctctagtcatggtagatgacaattttcctccctcatcttttgtagcaaagaagcaaattaagagccttttgcaagttagattaggggactgaaaaatccagggagataacctgattcttctatactatgactggagtaaagctgccaagagttaggttgaatttggagccttttaaaagttggttccataagtgagaaggggggctaacatgtgaccactgtgcccctgagaatccatgagatggaaaagtacagacaagaaggcacttaacgctgttctcagttggaaaatgtcagccctccacacctgtttggatgtgaagtgcattattaattttaatgacaaaatgaaactgctaattagtttaaatgtaatgtttaaatggtattgaatttcctattgcctgattaaatatatctgtaattgtaacatcatgtttctgagagctttaactacttccttatttttatgcaatcattttaaagattgtggctatatctaatttaaatttgctgatgattgaatctaaattcaagtgaagaccacagcattaatcccaaaggagattttttttatgtttagaggtggagatattagggtaaatcagtatattgctcctgtcatcaaagtttttgttcatttgtgtgccacatcgaatagcagcacttctcaaagtttgtcaactggaaaaaagtgtttaaaactgtttttttcttaagcagatttggtgatgtcatcaatatctatgatatcgattggtaaaaggtctttctttgttgaggatttgagctctctttttaagagtttattttattttaaaggaacatatgctttgaataacaattctctgggcatgtttaactaacctaggtgggaaaaccatggtgctgtttaattgtaaatagattgatataagattggaccagtacttgatgtgtataattttagtatgtagggtttatgtgctttttttaaaaaaaaaaaaaaggttcaatttttctctt

SEQ ID NO: 33472 - DNA, 1783 bp, Homo sapiens
acttccggtgagcctctggggcgtaccggcttggcgcggcggcagcggcagcggcggctgggagagcggtcggcggggtttcttcgttgcattgcctgagaggagcggagtctgccaggtggtgtccatcatgttctctttcaacatgttcgaccaccctattcccagggtcttccaaaaccgcttctccacacagtaccgctgcttctctgtgtccatgctagcagggcctaatgacaggtcagatgtggagaaaggagggaagataattatgccaccctcggccctggaccaactcagccgacttaacattacctatcccatgctgttcaaactgaccaataagaattcggaccgcatgacgcattgtggcgtgctggagtttgtggctgatgagggcatctgctacctcccacactggatgatgcagaacttactcttggaagaaggcggcctggtccaggtggagagcgtcaaccttcaagtggccacctactccaaattccaacctcagagccctgacttcctggacatcaccaaccccaaagccgtattagaaaacgcacttaggaactttgcctgtctgaccaccggggatgtgattgccatcaactataatgaaaagatctacgaactgcgtgtgatggagaccaaacccgacaaggcagtgtccatcattgagtgtgacatgaacgtggactttgatgctcccctgggctacaaagaacccgaaagacaagtccagcatgaggagtcgacagaaggtgaagccgaccacagtggctatgctggagagctgggcttccgcgctttctctggatctggcaatagactggatggaaagaagaaaggggtagagcccagcccctccccaatcaagcctggagatattaaaagaggaattcccaattatgaatttaaacttggtaagataactttcatcagaaattcacgtccccttgtcaaaaaggttgaagaggatgaagctggaggcagattcgtcgctttctctggagaaggacagtcattgcgtaaaaagggaagaaagccctaagtgaggactgttggctgattggaaaataataaaagaatcatttgcaacatcttggcttttagttactggcactgacagggacgagcctcatcagagaatactctgttacttaagatttatttagagttacctaagaattattaagtttgacttggaagtggagcagcaggactttgtagttgtatgcttgatttggggaaagacaaagagctgtccctgagggcctgtagatagctgcctcctcacctcttcacgctttcagcttgaggggagctcccactgcctcagcaggagcaattctgcatccctaattctgtcaaaacctatgaaggtgactaaattgtctaacatgaagtgttctttctttttcttcatttatcctttcttttcctacatcaattgcataggtgtcagtctttggcctaaaaaaaggctttaaatagacatgtgttctataagtagtggctgtcccactactgtggctgcaatttaagtatttgacaaagaatgtttctatttttattttacatatttttttcaaaaacaccactcagaagaacctgatctgaatgagtttgcacttttattctcatttcatatggacataactggctccttagtgaacctgttcatagtgaaacaactccatggagaagcaaacatgtgaatgttagaatgaacaaatgctaaagagatgttcctctccttcttccctactccccaactccc

SEQ ID NO: 33473 - DNA, 1750 bp, Homo sapiens
acttccggtgagcctctggggcgtaccggcttggcgcggcggcagcggcagcggcggctgggagagcggtcggcggggtttcttcgttgcattgcctgagaggagcggagtctgccaggtggtgtccatcatgttctctttcaacatgttcgaccaccctattcccagggtcttccaaaaccgcttctccacacagtaccgctgcttctctgtgtccatgctagcagggcctaatgacaggtcagatgtggagaaaggagggaagagccgacttaacattacctatcccatgctgttcaaactgaccaataagaattcggaccgcatgacgcattgtggcgtgctggagtttgtggctgatgagggcatctgctacctcccacactggatgatgcagaacttactcttggaagaaggcggcctggtccaggtggagagcgtcaaccttcaagtggccacctactccaaattccaacctcagagccctgacttcctggacatcaccaaccccaaagccgtattagaaaacgcacttaggaactttgcctgtctgaccaccggggatgtgattgccatcaactataatgaaaagatctacgaactgcgtgtgatggagaccaaacccgacaaggcagtgtccatcattgagtgtgacatgaacgtggactttgatgctcccctgggctacaaagaacccgaaagacaagtccagcatgaggagtcgacagaaggtgaagccgaccacagtggctatgctggagagctgggcttccgcgctttctctggatctggcaatagactggatggaaagaagaaaggggtagagcccagcccctccccaatcaagcctggagatattaaaagaggaattcccaattatgaatttaaacttggtaagataactttcatcagaaattcacgtccccttgtcaaaaaggttgaagaggatgaagctggaggcagattcgtcgctttctctggagaaggacagtcattgcgtaaaaagggaagaaagccctaagtgaggactgttggctgattggaaaataataaaagaatcatttgcaacatcttggcttttagttactggcactgacagggacgagcctcatcagagaatactctgttacttaagatttatttagagttacctaagaattattaagtttgacttggaagtggagcagcaggactttgtagttgtatgcttgatttggggaaagacaaagagctgtccctgagggcctgtagatagctgcctcctcacctcttcacgctttcagcttgaggggagctcccactgcctcagcaggagcaattctgcatccctaattctgtcaaaacctatgaaggtgactaaattgtctaacatgaagtgttctttctttttcttcatttatcctttcttttcctacatcaattgcataggtgtcagtctttggcctaaaaaaaggctttaaatagacatgtgttctataagtagtggctgtcccactactgtggctgcaatttaagtatttgacaaagaatgtttctatttttattttacatatttttttcaaaaacaccactcagaagaacctgatctgaatgagtttgcacttttattctcatttcatatggacataactggctccttagtgaacctgttcatagtgaaacaactccatggagaagcaaacatgtgaatgttagaatgaacaaatgctaaagagatgttcctctccttcttccctactccccaactccc

SEQ ID NO: 33474 - DNA, 1164 bp, Homo sapiens
agcggcagcggcggctgggagagcggtcggcggggtttcttcgttgcattgcctgagaggagcggagtctgccaggtggtgtccatcatgttctctttcaacatgttcgaccaccctattcccagggtcttccaaaaccgcttctccacacagtaccgctgcttctctgtgtccatgctagcagggcctaatgacaggtcagatgtggagaaaggagggaagataattatgccaccctcggccctggaccaactcagccgacttaacattacctatcccatgctgttcaaactgaccaataagaattcggaccgcatgacgcattgtggcgtgctggagtttgtggctgatgagggcatctgctacctcccacactgggtggtctacaggctctctttggaaagggatggccttaaatcacttgaggtagctgaagtgtcaggcagtgactacttccccagtcccttctgtggacttgaagtttggatgatgcagaacttactcttggaagaaggcggcctggtccaggtggagagcgtcaaccttcaagtggccacctactccaaattccaacctcagagccctgacttcctggacatcaccaaccccaaagccgtattagaaaacgcacttaggaactttgcctgtctgaccaccggggatgtgattgccatcaactataatgaaaagatctacgaactgcgtgtgatggagaccaaacccgacaaggcagtgtccatcattgagtgtgacatgaacgtggactttgatgctcccctgggctacaaagaacccgaaagacaagtccagcatgaggagtcgacagaaggtgaagccgaccacagtggctatgctggagagctgggcttccgcgctttctctggatctggcaatagactggatggaaagaagaaaggggtagagcccagcccctccccaatcaagcctggagatattaaaagaggaattcccaattatgaatttaaacttggtaagataactttcatcagaaattcacgtccccttgtcaaaaaggttgaagaggatgaagctggaggcagattcgtcgctttctctggagaaggacagtcattgcgtaaaaagggaagaaagccctaagtgaggactgttggctgattggaaaataataaaagaatcatttgc

SEQ ID NO: 33475 - DNA, 1007 bp, Homo sapiens
agcggcagcggcggctgggagagcggtcggcggggtttcttcgttgcattgcctgagaggagcggagtctgccaggtggtgtccatcatgttctctttcaacatgttcgaccaccctattcccagggtcttccaaaaccgcttctccacacagtaccgctgcttctctgtgtccatgctagcagggcctaatgacaggtcagatgtggagaaaggagggaagataattatgccaccctcggccctggaccaactcagccgacttaacattacctatcccatgctgttcaaactgaccaataagaattcggaccgcatgacgcattgtggcgtgctggagtttgtggctgatgagggcatctgctacctcccacactggatgatgcagaacttactcttggaagaaggcggcctggtccaggtggagagcgtcaaccttcaagtggccacctactccaaattccaacctcagagccctgacttcctggacatcaccaaccccaaagccgtattagaaaacgcacttaggaactttgcctgtctgaccaccggggatgtgattgccatcaactataatgaaaagatctacgaactgcgtgtgatggagaccaaacccgacaaggcagtgtccatcattgagtgtgacatgaacgtggactttgatgctcccctgggctacaaagaacccgaaagacaagtccagcatgaggagtcgacagaaggtgaagccgaccacagtggctatgctggagagctgggcttccgcgctttctctggatctggcaatagactggatggaaagaagaaaggggtagagcccagcccctccccaatcaagcctggagatattaaaagaggaattcccaattatgaatttaaacttggatgaagctggaggcagattcgtcgctttctctggagaaggacagtcattgcgtaaaaagggaagaaagccctaagtgaggactgttggctgattggaaaataataaaagaatcatttgcaaca

SEQ ID NO: 33476 - DNA, 1752 bp, Homo sapiens
cggacgcgcgcgcccctccccctccccccgcgctcccaacgtgtggcggctcgcgacccccggcaacccggagaaggtctacagagcggcctgcgccagcgaacaaaaggatgccacggagaaagaaaaaagttaaagaagtctccgaatctcggaacctggagaagaaggatgtggaaactaccagttctgtcagtgtgaagaggaagcgtagacttgaggatgcattcattgtgatatccgatagtgatggagaggaaccaaaggaggaaaatgggttgcagaaaacgaagacaaaacagtcgaatagagcaaagtgtttggccaaaagaaaaatcgcacagatgacagaagaagaacagtttgctctggctctcaaaatgagtgagcaggaagctagggaggtgaacagccaggaggaggaagaagaggagctcttgaggaaagccattgctgaaagcctgaatagttgccggccttctgatgcttccgctaccagatctcgacctctggccactggaccgtcttcccagtcccatcaagagaaaaccacagactctgggctcactgaagtcttcccaagggattgttgaagaaacttctgaagagggaaactctgtacctgcttcacaaagtgttgctgctttgaccagtaagagaagcttagtccttatgccagagagttctgcagaagaaatcactgtttgtcctgagacccagctaagttcctctgaaacttttgaccttgaaagagaagtctctccaggtagcagagatatcttggatggagtcagaataataatggcagataaggaggttggtaacaaggaagatgctgagaaggaagtagctatttctaccttctcatccagtaaccaggtatcctgcccgctatgtgaccaatgctttccacccacaaagattgaacgacatgccatgtactgcaatggtctgatggaggaagatacagaagtattgactcggagacaaaaagaggccaagaccaagagtgacagtgggacagctgcccagacttctctagacattgacaagaatgagaagtgttacctctgtaaatccctggtcccatttagagagtatcagtgtcatgtggactcctgtctccagcttgcaaaggctgaccaaggagatggacctgaagggagtggaagagcatgttcaactgtggaggggaagtggcagcagaggctgaagaacccaaaggaaaaaggccacagtgaaggccgactccttagtttcttggaacagtctgagcacaagacttcagatgcagacatcaagtcttcagaaacaggagccttcagggtgccttcaccagggatggaagaggcaggctgcagcagagagatgcagagttctttcacacgtcgtgacttaaatgaatctcccgtcaagtcttttgtttccatttcagaagccacagattgcttagtggactttaaaaagcaagttactgtccagccaggtagtcggacacggaccaaagctggcagaggaagaaggagaaaattctgaatttctagggtccaaaagttgacaaaaccattagtaggaggggtgggccatgttcattaagccatagtggtccctagttcattgttgagcaagttttagccctgcagttttcaccaccagcacctacccagcattctggtttttatgttttttatgatctatgcagacaactgtgtattctgttttataacagtttgtttgaatttacttacagtt

SEQ ID NO: 33477 - DNA, 2604 bp, Homo sapiens
gaagtcgggggtgggtccctccggacgccgaagtgggctcgggatgcggggctgggaccctcccgattccggggcggattccggacgccgggaccggccattactggtgccgggttgggcttctccagatgccggggctgggtccttcccaaggttgagacaaaaggatgccacggagaaagaaaaaagttaaagaagtctccgaatctcggaacctggagaagaaggatgtggaaactaccagttctgtcagtgtgaagaggaagcgtagacttgaggatgcattcattgtgatatccgatagtgatggagaggaaccaaaggaggaaaatgggttgcagaaaacgaagacaaaacagtcgaatagagcaaagtgtttggccaaaagaaaaatcgcacagatgacagaagaagaacagtttgctctggctctcaaaatgagtgagcaggaagctagggaggtgaacagccaggaggaggaagaagaggagctcttgaggaaagccattgctgaaagcctgaatagttgccggccttctgatgcttccgctaccagatctcgacctctggccactggaccgtcttcccagtcccatcaagagaaaaccacagactctgggctcactgaaggcatatggcagctggtacctccatcactgtttaaaggctcacatatcagtcagggaaacgaggctgaggaaagagaggagccttgggaccacactgaaaaaactgaagaggagccggtctctggcagctcaggaagctgggaccagtcaagccagccagtgtttgagaatgtgaacgttaaatcttttgacagatgtactggccactcggctgagcacacacagtgtgggaagccacaggaaagtactgggaggggttctgcttttctcaaagctgtccagggtagcggggacacatctaggcactgtctacctaccctagcagatgccaaaggtctccaggacactgggggcactgtgaactatttctggggtattccattctgccctgatggagtagaccctaaccagtataccaaggtcattctctgccagttggaggtttatcaaaagagcctgaaaatggctcagaggcagctccttaataaaaaaggttttggggaaccagtgttacctagacctccttctctgatccagaatgaatgtggccaaggagagcaggctagtgagaaaaatgaatgcatctcagaagatatgggagatgaagacaaagaggagaggcaggagtctagggcatctgactggcactcaaaaaccaaggatttccaggaaagctcaattaaaagcttgaaagagaaacttttgttggaggaagaaccaacaaccagtcatggtcagtcttcccaagggattgttgaagaaacttctgaagagggaaactctgtacctgcttcacaaagtgttgctgctttgaccagtaagagaagcttagtccttatgccagagagttctgcagaagaaatcactgtttgtcctgagacccagctaagttcctctgaaacttttgaccttgaaagagaagtctctccaggtagcagagatatcttggatggagtcagaataataatggcagataaggaggttggtaacaaggaagatgctgagaaggaagtagctatttctaccttctcatccagtaaccaggtatcctgcccgctatgtgaccaatgctttccacccacaaagattgaacgacatgccatgtactgcaatggtctgatggaggaagatacagaagtattgactcggagacaaaaagaggccaagaccaagagtgacagtgggacagctgcccagacttctctagacattgacaagaatgagaagtgttacctctgtaaatccctggtcccatttagagagtatcagtgtcatgtggactcctgtctccagcttgcaaaggctgaccaaggagatggacctgaagggagtggaagagcatgttcaactgtggaggggaagtggcagcagaggctgaagaacccaaaggaaaaaggccacagtgaaggccgactccttagtttcttggaacagtctgagcacaagacttcagatgcagacatcaagtcttcagaaacaggagccttcagggtgccttcaccagggatggaagaggcaggctgcagcagagagatgcagagttctttcacacgtcgtgacttaaatgaatctcccgtcaagtcttttgtttccatttcagaagccacagattgcttagtggactttaaaaagcaagttactgtccagccaggtagtcggacacggaccaaagctggcagaggaagaaggagaaaattctgaatttctagggtccaaaagttgacaaaaccattagtaggaggggtgggccatgttcattaagccatagtggtccctagttcattgttgagcaagttttagccctgcagttttcaccaccagcacctacccagcattctggtttttatgttttttatgatctatgcagacaactgtgtattctgttttataacagtttgtttgaatttacttacagttaaaaaatttaaatatatttatgtttgtacgaaatcttatttcaatagatggaaatttt

SEQ ID NO: 33478 - DNA, 2489 bp, Homo sapiens
cggacgcgcgcgcccctccccctccccccgcgctcccaacgtgtggcggctcgcgacccccggcaacccggagaaggtctacagagcggcctgcgccagcgaacaaaaggatgccacggagaaagaaaaaagttaaagaagtctccgaatctcggaacctggagaagaaggatgtggaaactaccagttctgtcagtgtgaagaggaagcgtagacttgaggatgcattcattgtgatatccgatagtgatggagaggaaccaaaggaggaaaatgggttgcagaaaacgaagacaaaacagtcgaatagagcaaagtgtttggccaaaagaaaaatcgcacagatgacagaagaagaacagtttgctctggctctcaaaatgagtgagcaggaagctagggaggtgaacagccaggaggaggaagaagaggagctcttgaggaaagccattgctgaaagcctgaatagttgccggccttctgatgcttccgctaccagatctcgacctctggccactggaccgtcttcccagtcccatcaagagaaaaccacagactctgggctcactgaaggcatatggcagctggtacctccatcactgtttaaaggctcacatatcagtcagggaaacgaggctgaggaaagagaggagccttgggaccacactgaaaaaactgaagaggagccggtctctggcagctcaggaagctgggaccagtcaagccagccagtgtttgagaatgtgaacgttaaatcttttgacagatgtactggccactcggctgagcacacacagtgtgggaagccacaggaaagtactgggaggggttctgcttttctcaaagctgtccagggtagcggggacacatctaggcactgtctacctaccctagcagatgccaaaggtctccaggacactgggggcactgtgaactatttctggggtattccattctgccctgatggagtagaccctaaccagtataccaaggtcattctctgccagttggaggtttatcaaaagagcctgaaaatggctcagaggcagctccttaataaaaaaggttttggggaaccagtgttacctagacctccttctctgatccagaatgaatgtggccaaggagagcaggctagtgagaaaaatgaatgcatctcagaagatatgggagatgaagacaaagaggagaggcaggagtctagggcatctgactggcactcaaaaaccaaggatttccaggaaagctcaattaaaagcttgaaagagaaacttttgttggaggaagaaccaacaaccagtcatggtcagtcttcccaagggattgttgaagaaacttctgaagagggaaactctgtacctgcttcacaaagtgttgctgctttgaccagtaagagaagcttagtccttatgccagagagttctgcagaagaaatcactgtttgtcctgagacccagctaagttcctctgaaacttttgaccttgaaagagaagtctctccaggtagcagagatatcttggatggagtcagaataataatggcagataaggaggttggtaacaaggaagatgctgagaaggaagtagctatttctaccttctcatccagtaaccaggtatcctgcccgctatgtgaccaatgctttccacccacaaagattgaacgacatgccatgtactgcaatggtctgatggaggaagatacagaagtattgactcggagacaaaaagaggccaagaccaagagtgacagtgggacagctgcccagacttctctagacattgacaagaatgagaagtgttacctctgtaaatccctggtcccatttagagagtatcagtgtcatgtggactcctgtctccagcttgcaaaggctgaccaaggagatggacctgaagggagtggaagagcatgttcaactgtggaggggaagtggcagcagaggctgaagaacccaaaggaaaaaggccacagtgaaggccgactccttagtttcttggaacagtctgagcacaagacttcagatgcagacatcaagtcttcagaaacaggagccttcagggtgccttcaccagggatggaagaggcaggctgcagcagagagatgcagagttctttcacacgtcgtgacttaaatgaatctcccgtcaagtcttttgtttccatttcagaagccacagattgcttagtggactttaaaaagcaagttactgtccagccaggtagtcggacacggaccaaagctggcagaggaagaaggagaaaattctgaatttctagggtccaaaagttgacaaaaccattagtaggaggggtgggccatgttcattaagccatagtggtccctagttcattgttgagcaagttttagccctgcagttttcaccaccagcacctacccagcattctggtttttatgttttttatgatctatgcagacaactgtgtattctgttttataacagtttgtttgaatttacttacagtt

SEQ ID NO: 33479 - DNA, 2570 bp, Homo sapiens
gggctcgggatgcggggctgggaccctcccgattccggggcggattccggacgccgggaccggccattactggtgccgggttgggcttctccagatgccggggctgggtccttcccaaggttgagacaaaaggatgccacggagaaagaaaaaagttaaagaagtctccgaatctcggaacctggagaagaaggatgtggaaactaccagttctgtcagtgtgaagaggaagcgtagacttgaggatgcattcattgtgatatccgatagtgatggagaggaaccaaaggaggaaaatgggttgcagaaaacgaagacaaaacagtcgaatagagcaaagtgtttggccaaaagaaaaatcgcacagatgacagaagaagaacagtttgctctggctctcaaaatgagtgagcaggaagctagggaggtgaacagccaggaggaggaagaagaggagctcttgaggaaagccattgctgaaagcctgaatagttgccggccttctgatgcttccgctaccagatctcgacctctggccactggaccgtcttcccagtcccatcaagagaaaaccacagactctgggctcactgaaggcatatggcagctggtacctccatcactgtttaaaggctcacatatcagtcagggaaacgaggctgaggaaagagaggagccttgggaccacactgaaaaaactgaagaggagccggtctctggcagctcaggaagctgggaccagtcaagccagccagtgtttgagaatgtgaacgttaaatcttttgacagatgtactggccactcggctgagcacacacagtgtgggaagccacaggaaagtactgggaggggttctgcttttctcaaagctgtccagggtagcggggacacatctaggcactgtctacctaccctagcagatgccaaaggtctccaggacactgggggcactgtgaactatttctggggtattccattctgccctgatggagtagaccctaaccagtataccaaggtcattctctgccagttggaggtttatcaaaagagcctgaaaatggctcagaggcagctccttaataaaaaaggttttggggaaccagtgttacctagacctccttctctgatccagaatgaatgtggccaaggagagcaggctagtgagaaaaatgaatgcatctcagaagatatgggagatgaagacaaagaggagaggcaggagtctagggcatctgactggcactcaaaaaccaaggatttccaggaaagctcaattaaaagcttgaaagagaaacttttgttggaggaagaaccaacaaccagtcatggtcagtcttcccaagggattgttgaagaaacttctgaagagggaaactctgtacctgcttcacaaagtgttgctgctttgaccagtaagagaagcttagtccttatgccagagagttctgcagaagaaatcactgtttgtcctgagacccagctaagttcctctgaaacttttgaccttgaaagagaagtctctccaggtagcagagatatcttggatggagtcagaataataatggcagataaggaggttggtaacaaggaagatgctgagaaggaagtagctatttctaccttctcatccagtaaccaggtatcctgcccgctatgtgaccaatgctttccacccacaaagattgaacgacatgccatgtactgcaatggtctgatggaggaagatacagtattgactcggagacaaaaagaggccaagaccaagagtgacagtgggacagctgcccagacttctctagacattgacaagaatgagaagtgttacctctgtaaatccctggtcccatttagagagtatcagtgtcatgtggactcctgtctccagcttgcaaaggctgaccaaggagatggacctgaagggagtggaagagcatgttcaactgtggaggggaagtggcagcagaggctgaagaacccaaaggaaaaaggccacagtgaaggccgactccttagtttcttggaacagtctgagcacaagacttcagatgcagacatcaagtcttcagaaacaggagccttcagggtgccttcaccagggatggaagaggcaggctgcagcagagagatgcagagttctttcacacgtcgtgacttaaatgaatctcccgtcaagtcttttgtttccatttcagaagccacagattgcttagtggactttaaaaagcaagttactgtccagccaggtagtcggacacggaccaaagctggcagaggaagaaggagaaaattctgaatttctagggtccaaaagttgacaaaaccattagtaggaggggtgggccatgttcattaagccatagtggtccctagttcattgttgagcaagttttagccctgcagttttcaccaccagcacctacccagcattctggtttttatgttttttatgatctatgcagacaactgtgtattctgttttataacagtttgtttgaatttacttacagttaaaaaatttaaatatatttatgtttgtacgaaatcttatttcaatagatggaaattttaat

SEQ ID NO: 33480 - DNA, 249 bp, Homo sapiens
actctccgggaggggcgcttcccgacgccaagtcttactgttgctcaggctggaatgcagtggtgcgctctcggctcactgcaacctctcccttctgggttcaagcgattctcgtgcctcagcctcccaagtagctgggattacagacaaaaggatgccacggagaaagaaaaaagttaaagaagtctccgaatctcggaacctggagaagaaggatgtggaaactaccagttctgtcagtgtgaagag

SEQ ID NO: 33481 - DNA, 425 bp, Homo sapiens
aacgtgtggcggctcgcgacccccggcaacccggagaaggtctacagagcggcctgcgccagcgagttgaagaaaaaaaacaacaacctaggatcagtttggggagaattgatatgtttactatgttgaagcttccaacctgtgggcatgacaaaaggatgccacggagaaagaaaaaagttaaagaagtctccgaatctcggaacctggagaagaaggatgtggaaactaccagttctgtcagtgtgaagaggaagcgtagacttgaggatgcattcattgtgatatccgatagtgatggagaggaaccaaaggaggaaaatgggttgcagaaaacgaagacaaaacagtcgaatagagcaaagtgtttggccaaaagaaaaatcgcacagatgacagaagaagaacagtttgctctggctctc

SEQ ID NO: 33482 - DNA, 619 bp, Homo sapiens
gcttattttgctttgctacctctggtacctcagagcgtgtgccgtggattcggaaacctgtcgctgattccgcagcagtgacccccccctcccggagaggctcgtgtggttttggctcatggctctcaccttgctcacgacaaaaggatgccacggagaaagaaaaaagttaaagaagtctccgaatctcggaacctggagaagaaggatgtggaaactaccagttctgtcagtgtgaagaggaagcgtagacttgaggatgcattcattgtgatatccgatagtgatggagaggaaccaaaggaggaaaatgggttgcagaaaacgaagacaaaacagtcgaatagagcaaagtgtttggccaaaagaaaaatcgcacagatgacagaagaagaacagtttgctctggctctcaaaatgagtgagcaggaagctagggaggtgaacagccaggaggaggaagaagaggagctcttgaggaaagccattgctgaaagcctgaatagttgccggccttctgatgcttccgctaccagatctcgacctctggccactggaccgtcttcccagtcccatcaagagaaaaccacagactctgggctcactgaaggcatatggc

SEQ ID NO: 33483 - DNA, 2502 bp, Homo sapiens
cggacgcgcgcgcccctccccctccccccgcgctcccaacgtgtggcggctcgcgacccccggcaacccggagaaggtctacagagcggcctgcgccagcgaacaaaaggatgccacggagaaagaaaaaagttaaagaagtctccgaatctcggaacctggagaagaaggatgtggaaactaccagttctgtcagtgtgaagaggaagcgtagacttgaggatgcattcattgtgatatccgatagtgatggagaggaaccaaaggaggaaaatgggttgcagaaaacgaagacaaaacagtcgaatagagcaaagtgtttggccaaaagaaaaatcgcacagatgacagaagaagaacagtttgctctggctctcaaaatgagtgagcaggaagctagggaggtgaacagccaggaggaggaagaagaggagctcttgaggaaagccattgctgaaagcctgaatagttgccggccttctgatgcttccgctaccagatctcgacctctggccactggaccgtcttcccagtcccatcaagagaaaaccacagactctgggctcactgaaggcatatggcagctggtacctccatcactgtttaaaggctcacatatcagtcagggaaacgaggctgaggaaagagaggagccttgggaccacactgaaaaaactgaagaggagccggtctctggcagctcaggaagctgggaccagtcaagccagccagtgtttgagaatgtgaacgttaaatcttttgacagatgtactggccactcggctgagcacacacagtgtgggaagccacaggaaagtactgggaggggttctgcttttctcaaagctgtccagggtagcggggacacatctaggcactgtctacctaccctagcagatgccaaaggtctccaggacactgggggcactgtgaactatttctggggtattccattctgccctgatggagtagaccctaaccagtataccaaggtcattctctgccagttggaggtttatcaaaagagcctgaaaatggctcagaggcagctccttaataaaaaaggttttggggaaccagtgttacctagacctccttctctgatccagaatgaatgtggccaaggagagcaggctagtgagaaaaatgaatgcatctcagaagatatgggagatgaagacaaagaggagaggcaggagtctagggcatctgactggcactcaaaaaccaaggatttccaggaaagctcaattaaaagcttgaaagagaaacttttgttggaggaagaaccaacaaccagtcatggtcagtcttcccaagggattgttgaagaaacttctgaagagggaaactctgtacctgcttcacaaagtgttgctgctttgaccagtaagagaagcttagtccttatgccagagagttctgcagaagaaatcactgtttgtcctgagacccagctaagttcctctgaaacttttgaccttgaaagagaagtctctccaggtagcagagatatcttggatggagtcagaataataatggcagataaggaggttggtaacaaggaagatgctgagaaggaagtagctatttctaccttctcatccagtaaccaggtatcctgcccgctatgtgaccaatgctttccacccacaaagattgaacgacatgccatgtactgcaatggtctgatggaggaagatacagtattgactcggagacaaaaagaggccaagaccaagagtgacagtgggacagctgcccagacttctctagacattgacaagaatgagaagtgttacctctgtaaatccctggtcccatttagagagtatcagtgtcatgtggactcctgtctccagcttgcaaaggctgaccaaggagatggacctgaagggagtggaagagcatgttcaactgtggaggggaagtggcagcagaggctgaagaacccaaaggaaaaaggccacagtgaaggccgactccttagtttcttggaacagtctgagcacaagacttcagatgcagacatcaagtcttcagaaacaggagccttcagggtgccttcaccagggatggaagaggcaggctgcagcagagagatgcagagttctttcacacgtcgtgacttaaatgaatctcccgtcaagtcttttgtttccatttcagaagccacagattgcttagtggactttaaaaagcaagttactgtccagccaggtagtcggacacggaccaaagctggcagaggaagaaggagaaaattctgaatttctagggtccaaaagttgacaaaaccattagtaggaggggtgggccatgttcattaagccatagtggtccctagttcattgttgagcaagttttagccctgcagttttcaccaccagcacctacccagcattctggtttttatgttttttatgatctatgcagacaactgtgtattctgttttataacagtttgtttgaatttacttacagttaaaaaatttaaatata

SEQ ID NO: 33484 - DNA, 7761 bp, Homo sapiens
cctgtctctccgaccggccacaggtttccgcttgcctctggccgggggtcggcaactgcaggcgtcagtttccctcaagatggcggacgaggaggctggaggtactgagaggatggaaatcagcgcggagttaccccagacccctcagcgtctggcatcttggtgggatcagcaagttgatttttatactgctttcttgcatcatttggcacaattggtgccagaaatttactttgctgaaatggacccagacttggaaaagcaggaggaaagtgtacaaatgtcaatattcactccactggaatggtacttatttggagaagatccagatatttgcttagagaaattgaagcacagtggagcatttcagctttgtgggagggttttcaaaagtggagagacaacctattcttgcagggattgtgcaattgatccaacatgtgtactctgtatggactgcttccaggacagtgttcataaaaatcatcgttacaagatgcatacttctactggaggagggttctgtgactgtggagacacagaggcatggaaaactggccctttttgtgtaaatcatgaacctggaagagcaggtactataaaagagaattcacgctgtccgttgaatgaagaggtaattgtccaagccaggaaaatatttccttcagtgataaaatatgtcgtagaaatgactatatgggaagaggaaaaagaactgcctcctgaactccagataagggagaaaaatgaaagatactattgtgtccttttcaatgatgaacaccattcatatgaccacgtcatatacagcctacaaagagctcttgactgtgagctcgcagaggcccagttgcataccactgccattgacaaagagggtcgtcgggctgttaaagcgggagcttatgctgcttgccaggaagcaaaggaagatataaagagtcattcagaaaatgtctctcaacatccacttcatgtagaagtattacactcagagattatggctcatcagaaatttgctttgcgtcttggttcctggatgaacaaaattatgagctattcaagtgactttaggcagatcttttgccaagcatgccttagagaagaacctgactcggagaatccctgtctcataagcaggttaatgctttgggatgcaaagctttataaaggtgcccgtaagatccttcatgaattgatcttcagcagtttttttatggagatggaatacaaaaaactctttgctatggaatttgtgaagtattataaacaactgcagaaagaatatatcagtgatgatcatgacagaagtatctctataactgcactttcagttcagatgtttactgttcctactctggctcgacatcttattgaagagcagaatgttatctctgtcattactgaaactctgctagaagttttacctgagtacttggacaggaacaataaattcaacttccagggttatagccaggacaaattgggaagagtatatgcagtaatatgtgacctaaagtatatcctgatcagcaaacccacaatatggacagaaagattaagaatgcagttccttgaaggttttcgatcttttttgaagattcttacctgtatgcagggaatggaagaaatccgaagacaggttgggcaacacattgaagtggatcctgattgggaggctgccattgctatacagatgcaattgaagaatattttactcatgttccaagagtggtgtgcttgtgatgaagaactcttacttgtggcttataaagaatgtcacaaagctgtgatgaggtgcagtaccagtttcatatctagtagcaagacagtagtacaatcgtgtggacatagtttggaaacaaagtcctacagagtatctgaggatcttgtaagcatacatctgccactctctaggacccttgctggtcttcatgtacgtttaagcaggctgggtgctgtttcaagactgcatgaatttgtgtcttttgaggactttcaagtagaggtactagtggaatatcctttacgttgtctggtgttggttgcccaggttgttgctgagatgtggcgaagaaatggactgtctcttattagccaggtgttttattaccaagatgttaagtgcagagaagaaatgtatgataaagatatcatcatgcttcagattggtgcatctttaatggatcccaataagttcttgttactggtacttcagaggtatgaacttgccgaggcttttaacaagaccatatctacaaaagaccaggatttgattaaacaatataatacactaatagaagaaatgcttcaggtcctcatctatattgtgggtgagcgttatgtacctggagtgggaaatgtgaccaaagaagaggtcacaatgagagaaatcattcacttgctttgcattgaacccatgccacacagtgccattgccaaaaatttacctgagaatgaaaataatgaaactggcttagagaatgtcataaacaaagtggccacatttaagaaaccaggtgtatcaggccatggagtttatgaactaaaagatgaatcactgaaagacttcaatatgtacttttatcattactccaaaacccagcatagcaaggctgaacatatgcagaagaaaaggagaaaacaagaaaacaaagatgaagcattgccgccaccaccacctcctgaattctgccctgctttcagcaaagtgattaaccttctcaactgtgatatcatgatgtacattctcaggaccgtatttgagcgggcaatagacacagattctaacttgtggaccgaagggatgctccaaatggcttttcatattctggcattgggtttactagaagagaagcaacagcttcaaaaagctcctgaagaagaagtaacatttgacttttatcataaggcttcaagattgggaagttcagccatgaatatacaaatgcttttggaaaaactcaaaggaattccccagttagaaggccagaaggacatgataacgtggatacttcagatgtttgacacagtgaagcgattaagagaaaaatcttgtttaattgtagcaaccacatcaggatcggaatctattaagaatgatgagattactcatgataaagaaaaagcagaacgaaaaagaaaagctgaagctgctaggctacatcgccagaagatcatggctcagatgtctgccttacagaaaaacttcattgaaactcataaactcatgtatgacaatacatcagaaatgcctgggaaagaagattccattatggaggaagagagcaccccagcagtcagtgactactctagaattgctttgggtcctaaacggggtccatctgttactgaaaaggaggtgctgacgtgcatcctttgccaagaagaacaggaggtgaaaatagaaaataatgccatggtattatcggcctgtgtccagaaatctactgccttaacccagcacaggggaaaacccatagaactctcaggagaagccctagacccacttttcatggatccagacttggcatatggaacttatacaggaagctgtggtcatgtaatgcacgcagtgtgctggcagaagtattttgaagctgtacagctgagctctcagcagcgcattcatgttgacctttttgacttggaaagtggagaatatctttgccctctttgcaaatctctgtgcaatactgtgatccccattattcctttgcaacctcaaaagataaacagtgagaatgcagatgctcttgctcaacttttgaccctggcacggtggatacagactgttctggccagaatatcaggttataatataagacatgctaaaggagaaaacccaattcctattttctttaatcaaggaatgggagattctactttggagttccattccatcctgagttttggcgttgagtcttcgattaaatattcaaatagcatcaaggaaatggttattctctttgccacaacaatttatagaattggattgaaagtgccacctgatgaaagggatcctcgagtccccatgctgacctggagcacctgcgctttcactatccaggcaattgaaaatctattgggagatgaaggaaaacctctgtttggagcacttcaaaataggcagcataatggtctgaaagcattaatgcagtttgcagttgcacagaggattacctgtcctcaggtcctgatacagaaacatctggttcgtcttctatcagttgttcttcctaacataaaatcagaagatacaccatgccttctgtctatagatctgtttcatgttttggtgggtgctgtgttagcattcccatccttgtattgggatgaccctgttgatctgcagccttcttcagttagttcttcctataaccacctttatctcttccatttgatcaccatggcacacatgcttcagatactacttacagtagacacaggcctaccccttgctcaggttcaagaagacagtgaagaggctcattccgcatcttctttctttgcagaaatttctcaatatacaagtggctccattgggtgtgatattcctggctggtatttgtgggtctcactgaagaatggcatcaccccttatcttcgctgtgctgcattgtttttccactatttacttggggtaactccgcctgaggaactgcataccaattctgcagaaggagagtacagtgcactctgtagctatctatctttacctacaaatttgttcctgctcttccaggaatattgggatactgtaaggcccttgctccagaggtggtgtgcagatcctgccttactaaactgtttgaagcaaaaaaacaccgtggtcaggtaccctagaaaaagaaatagtttgatagagcttcctgatgactatagctgcctcctgaatcaagcttctcatttcaggtgcccacggtctgcagatgatgagcgaaagcatcctgtcctctgccttttctgtggggctatactatgttctcagaacatttgctgccaggaaattgtgaacggggaagaggttggagcttgcatttttcacgcacttcactgtggagccggagtctgcattttcctaaaaatcagagaatgccgagtggtcctggttgaaggtaaagccagaggctgtgcctatccagctccttacttggatgaatatggagaaacagaccctggcctgaagaggggcaacccccttcatttatctcgtgagcggtatcggaagctccatttggtctggcaacaacactgcattatagaagagattgctaggagccaagagactaatcagatgttatttggattcaactggcagttactgtgagctccaactctgcctcaagacaatcacaaatgacgacagtagtaaaggctgattcaaaattatggaaaactttctgagggctgggaaagtattggagggtcttttgctccatgtccaggttcacttacatcaataaaatatttcttaatggagtattgctttcaattagcaaacatatgcttcacaggaaaaaaggacatagatcaatctgttttatgtgctagtatttccaggaatttattccccttcataatttgtctcatttcattttatttcatccacttggtagatgaagtcacgtcaaacagttgtagacattttatatgttggttaactcttctgcaattttgtatttggtgttttccccccaagtttagttcaactgacattggatcactgacaaaattctaataatctgtgatagtcttccttgcagttaaagaagaattgcagaaaccatgcaatatacttgggaaagattccaaaaataaattttttattatttctcttttaaggaaatacccctaatgtgccacctgctgctatcaccacaaattaaactcaatctctatgtggacagaggatgatttctgccaatatggaaaagcttttttctcactgtaggcctcaagaaaagttagggtaatgtatttgttattcattcctgacggtacaaagagcttgcagttctcacctctgactaccagtagctttgttgagttttgaaataatacttgacattttccaaaggcaaatctcattctgcaaggagattgtggcaccatcctgtttgactctcagaaacctcttgtaattctgatgtaaaaactgtagaatgaagatgagaaaattctcgcaatgagtggatcatgacaactgtaaattagaacaatcagatttaaaccaattccgcagtcttctatatctttgtaaaagacaaatccttgatgttgtctgtgtgcaaccttttcataaactctggttttatgactagtacaaaccaccaaaaaagccatgtgatcaatagtctgtgtcctgttataacatgctgtggttgagccatcttgtttataaataatagagctctcctgaatttgtgcatagacttcttggttcctggcttttgttttttgtatcaagagattgtgatataaaacagcagaagataaatggaaaccttccattttaacttacgttgtttctggggtaatgttagaaccttgaaagatgcattcaaagactgtatcttattttgcccttggctattagtgtctcacatatgtgtgtaaatgttttcctaccttctttttgctcagcaaaggcaagcaagtaaaatatatttgctaagtgattagtgatgcacatttggggctagatttttttggtacttttatgtaaagaaaagtggattttgcagtaagggattggcatgagcaggcgtcagaatcacaatcatgattttctacttgaataattacaattcagaaggtatctggataaatagatacatgtctagtgaacaatttgtaacaataacaggtaaggatcaggaaattcagtattcagtttgtcagatttgccagaatgatgaaagtatttgaacatgtgtgtttgtttcttatataattgtattgagtggattgtttgactgggaaatctgggctagaataggaaacagaagatactgacttctaccctaatagatgggccccaatttagcaaagataaactgactttatttttagtcctttttatattaacttaataaattctggagttaggctctcaagaggacagagggactgtctggcaatggccagccagacctttactgccaaagaacccatttcatattgcgttccactgattgagattgattcagatttttgcactgtagatgagcgtatgtctcagtgctgccccaagccccagggatttctcattatgttcaaatgtcctagtgatttaccttaatcattgcaaacaattatgcttatgaagtttacttacaaacaagcaactgagtcactttattttctttagtgtagtatgtgaaggcactggttcaacaggatggctccagaactgtgtttttctaatgtttggtaaggggctagtgagaattttaatgatatggtgaagaaaaatatatctgtataattaatttattatattggtgtatgggctgtgagttcaccttttagtggtcatttgtcatttcataacaactatgcattttggttcactgtgatgatgatctatatttagtgactgcaacatgtttataccactgattcaaattccatccatgatgaagttatacaaataatgcatatattgataacttttattgcaaaaatgtaaatttaaaacttgtataatgttcttgtgctttttaaaataaaatatatgtgtatatttaaaaagaaaaa

SEQ ID NO: 33485 - DNA, 7684 bp, Homo sapiens
ccggccacaggtttccgcttgcctctggccgggggtcggcaactgcaggcgtcagtttccctcaagatggcggacgaggaggctggaggtactgagaggatggaaatcagcgcggagttaccccagacccctcagcgtctggcatcttggtgggatcagcaagttgatttttatactgctttcttgcatcatttggcacaattggtgccagaaatttactttgctgaaatggacccagacttggaaaagcaggaggaaagtgtacaaatgtcaatattcactccactggaatggtacttatttggagaagatccagatatttgcttagagaaattgaagcacagtggagcatttcagctttgtgggagggttttcaaaagtggagagacaacctattcttgcagggattgtgcaattgatccaacatgtgtactctgtatggactgcttccaggacagtgttcataaaaatcatcgttacaagatgcatacttctactggaggagggttctgtgactgtggagacacagaggcatggaaaactggccctttttgtgtaaatcatgaacctggaagagcaggtactataaaagagaattcacgctgtccgttgaatgaagaggtaattgtccaagccaggaaaatatttccttcagtgataaaatatgtcgtagaaatgactatatgggaagaggaaaaagaactgcctcctgaactccagataagggagaaaaatgaaagatactattgtgtccttttcaatgatgaacaccattcatatgaccacgtcatatacagcctacaaagagctcttgactgtgagctcgcagaggcccagttgcataccactgccattgacaaagagggtcgtcgggctgttaaagcgggagcttatgctgcttgccaggaagcaaaggaagatataaagagtcattcagaaaatgtctctcaacatccacttcatgtagaagtattacactcagagattatggctcatcagaaatttgctttgcgtcttggttcctggatgaacaaaattatgagctattcaagtgactttaggcagatcttttgccaagcatgccttagagaagaacctgactcggagaatccctgtctcataagcaggttaatgctttgggatgcaaagctttataaaggtgcccgtaagatccttcatgaattgatcttcagcagtttttttatggagatggaatacaaaaaactctttgctatggaatttgtgaagtattataaacaactgcagaaagaatatatcagtgatgatcatgacagaagtatctctataactgcactttcagttcagatgtttactgttcctactctggctcgacatcttattgaagagcagaatgttatctctgtcattactgaaactctgctagaagttttacctgagtacttggacaggaacaataaattcaacttccagggttatagccaggacaaattgggaagagtatatgcagtaatatgtgacctaaagtatatcctgatcagcaaacccacaatatggacagaaagattaagaatgcagttccttgaaggttttcgatcttttttgaagattcttacctgtatgcagggaatggaagaaatccgaagacaggttgggcaacacattgaagtggatcctgattgggaggctgccattgctatacagatgcaattgaagaatattttactcatgttccaagagtggtgtgcttgtgatgaagaactcttacttgtggcttataaagaatgtcacaaagctgtgatgaggtgcagtaccagtttcatatctagtagcaagacagtagtacaatcgtgtggacatagtttggaaacaaagtcctacagagtatctgaggatcttgtaagcatacatctgccactctctaggacccttgctggtcttcatgtacgtttaagcaggctgggtgctgtttcaagactgcatgaatttgtgtcttttgaggactttcaagtagaggtactagtggaatatcctttacgttgtctggtgttggttgcccaggttgttgctgagatgtggcgaagaaatggactgtctcttattagccaggtgttttattaccaagatgttaagtgcagagaagaaatgtatgataaagatatcatcatgcttcagattggtgcatctttaatggatcccaataagttcttgttactggtacttcagaggtatgaacttgccgaggcttttaacaagaccatatctacaaaagaccaggatttgattaaacaatataatacactaatagaagaaatgcttcaggtcctcatctatattgtgggtgagcgttatgtacctggagtgggaaatgtgaccaaagaagaggtcacaatgagagaaatcattcacttgctttgcattgaacccatgccacacagtgccattgccaaaaatttacctgagaatgaaaccaggtgtatcaggccatggagtttatgaactaaaagatgaatcactgaaagacttcaatatgtacttttatcattactccaaaacccagcatagcaaggctgaacatatgcagaagaaaaggagaaaacaagaaaacaaagatgaagcattgccgccaccaccacctcctgaattctgccctgctttcagcaaagtgattaaccttctcaactgtgatatcatgatgtacattctcaggaccgtatttgagcgggcaatagacacagattctaacttgtggaccgaagggatgctccaaatggcttttcatattctggcattgggtttactagaagagaagcaacagcttcaaaaagctcctgaagaagaagtaacatttgacttttatcataaggcttcaagattgggaagttcagccatgaatatacaaatgcttttggaaaaactcaaaggaattccccagttagaaggccagaaggacatgataacgtggatacttcagatgtttgacacagtgaagcgattaagagaaaaatcttgtttaattgtagcaaccacatcaggatcggaatctattaagaatgatgagattactcatgataaagaaaaagcagaacgaaaaagaaaagctgaagctgctaggctacatcgccagaagatcatggctcagatgtctgccttacagaaaaacttcattgaaactcataaactcatgtatgacaatacatcagaaatgcctgggaaagaagattccattatggaggaagagagcaccccagcagtcagtgactactctagaattgctttgggtcctaaacggggtccatctgttactgaaaaggaggtgctgacgtgcatcctttgccaagaagaacaggaggtgaaaatagaaaataatgccatggtattatcggcctgtgtccagaaatctactgccttaacccagcacaggggaaaacccatagaactctcaggagaagccctagacccacttttcatggatccagacttggcatatggaacttatacaggaagctgtggtcatgtaatgcacgcagtgtgctggcagaagtattttgaagctgtacagctgagctctcagcagcgcattcatgttgacctttttgacttggaaagtggagaatatctttgccctctttgcaaatctctgtgcaatactgtgatccccattattcctttgcaacctcaaaagataaacagtgagaatgcagatgctcttgctcaacttttgaccctggcacggtggatacagactgttctggccagaatatcaggttataatataagacatgctaaaggagaaaacccaattcctattttctttaatcaaggaatgggagattctactttggagttccattccatcctgagttttggcgttgagtcttcgattaaatattcaaatagcatcaaggaaatggttattctctttgccacaacaatttatagaattggattgaaagtgccacctgatgaaagggatcctcgagtccccatgctgacctggagcacctgcgctttcactatccaggcaattgaaaatctattgggagatgaaggaaaacctctgtttggagcacttcaaaataggcagcataatggtctgaaagcattaatgcagtttgcagttgcacagaggattacctgtcctcaggtcctgatacagaaacatctggttcgtcttctatcagttgttcttcctaacataaaatcagaagatacaccatgccttctgtctatagatctgtttcatgttttggtgggtgctgtgttagcattcccatccttgtattgggatgaccctgttgatctgcagccttcttcagttagttcttcctataaccacctttatctcttccatttgatcaccatggcacacatgcttcagatactacttacagtagacacaggcctaccccttgctcaggttcaagaagacagtgaagaggctcattccgcatcttctttctttgcagaaatttctcaatatacaagtggctccattgggtgtgatattcctggctggtatttgtgggtctcactgaagaatggcatcaccccttatcttcgctgtgctgcattgtttttccactatttacttggggtaactccgcctgaggaactgcataccaattctgcagaaggagagtacagtgcactctgtagctatctatctttacctacaaatttgttcctgctcttccaggaatattgggatactgtaaggcccttgctccagaggtggtgtgcagatcctgccttactaaactgtttgaagcaaaaaaacaccgtggtcaggtaccctagaaaaagaaatagtttgatagagcttcctgatgactatagctgcctcctgaatcaagcttctcatttcaggtgcccacggtctgcagatgatgagcgaaagcatcctgtcctctgccttttctgtggggctatactatgttctcagaacatttgctgccaggaaattgtgaacggggaagaggttggagcttgcatttttcacgcacttcactgtggagccggagtctgcattttcctaaaaatcagagaatgccgagtggtcctggttgaaggtaaagccagaggctgtgcctatccagctccttacttggatgaatatggagaaacagaccctggcctgaagaggggcaacccccttcatttatctcgtgagcggtatcggaagctccatttggtctggcaacaacactgcattatagaagagattgctaggagccaagagactaatcagatgttatttggattcaactggcagttactgtgagctccaactctgcctcaagacaatcacaaatgacgacagtagtaaaggctgattcaaaattatggaaaactttctgagggctgggaaagtattggagggtcttttgctccatgtccaggttcacttacatcaataaaatatttcttaatggagtattgctttcaattagcaaacatatgcttcacaggaaaaaaggacatagatcaatctgttttatgtgctagtatttccaggaatttattccccttcataatttgtctcatttcattttatttcatccacttggtagatgaagtcacgtcaaacagttgtagacattttatatgttggttaactcttctgcaattttgtatttggtgttttccccccaagtttagttcaactgacattggatcactgacaaaattctaataatctgtgatagtcttccttgcagttaaagaagaattgcagaaaccatgcaatatacttgggaaagattccaaaaataaattttttattatttctcttttaaggaaatacccctaatgtgccacctgctgctatcaccacaaattaaactcaatctctatgtggacagaggatgatttctgccaatatggaaaagcttttttctcactgtaggcctcaagaaaagttagggtaatgtatttgttattcattcctgacggtacaaagagcttgcagttctcacctctgactaccagtagctttgttgagttttgaaataatacttgacattttccaaaggcaaatctcattctgcaaggagattgtggcaccatcctgtttgactctcagaaacctcttgtaattctgatgtaaaaactgtagaatgaagatgagaaaattctcgcaatgagtggatcatgacaactgtaaattagaacaatcagatttaaaccaattccgcagtcttctatatctttgtaaaagacaaatccttgatgttgtctgtgtgcaaccttttcataaactctggttttatgactagtacaaaccaccaaaaaagccatgtgatcaatagtctgtgtcctgttataacatgctgtggttgagccatcttgtttataaataatagagctctcctgaatttgtgcatagacttcttggttcctggcttttgttttttgtatcaagagattgtgatataaaacagcagaagataaatggaaaccttccattttaacttacgttgtttctggggtaatgttagaaccttgaaagatgcattcaaagactgtatcttattttgcccttggctattagtgtctcacatatgtgtgtaaatgttttcctaccttctttttgctcagcaaaggcaagcaagtaaaatatatttgctaagtgattagtgatgcacatttggggctagatttttttggtacttttatgtaaagaaaagtggattttgcagtaagggattggcatgagcaggcgtcagaatcacaatcatgattttctacttgaataattacaattcagaaggtatctggataaatagatacatgtctagtgaacaatttgtaacaataacaggtaaggatcaggaaattcagtattcagtttgtcagatttgccagaatgatgaaagtatttgaacatgtgtgtttgtttcttatataattgtattgagtggattgtttgactgggaaatctgggctagaataggaaacagaagatactgacttctaccctaatagatgggccccaatttagcaaagataaactgactttatttttagtcctttttatattaacttaataaattctggagttaggctctcaagaggacagagggactgtctggcaatggccagccagacctttactgccaaagaacccatttcatattgcgttccactgattgagattgattcagatttttgcactgtagatgagcgtatgtctcagtgctgccccaagccccagggatttctcattatgttcaaatgtcctagtgatttaccttaatcattgcaaacaattatgcttatgaagtttacttacaaacaagcaactgagtcactttattttctttagtgtagtatgtgaaggcactggttcaacaggatggctccagaactgtgtttttctaatgtttggtaaggggctagtgagaattttaatgatatggtgaagaaaaatatatctgtataattaatttattatattggtgtatgggctgtgagttcaccttttagtggtcatttgtcatttcataacaactatgcattttggttcactgtgatgatgatctatatttagtgactgcaacatgtttataccactgattcaaattccatccatgatgaagttatacaaataatgcatatattgataacttttattgcaaaaatgtaaatttaaaacttgtataatgttcttgtgctttttaaaataaaatatatgtgtatattt

SEQ ID NO: 33486 - DNA, 3105 bp, Homo sapiens
ccggccacaggtttccgcttgcctctggccgggggtcggcaactgcaggcgtcagtttccctcaagatggcggacgaggaggctggaggtactgagaggatggaaatcagcgcggagttaccccagacccctcagcgtctggcatcttggtgggatcagcaagttgatttttatactgctttcttgcatcatttggcacaattggtgccagaaatttactttgctgaaatggacccagacttggaaaagcaggaggaaagtgtacaaatgtcaatattcactccactggaatggtacttatttggagaagatccagatatttgcttagagaaattgaagcacagtggagcatttcagctttgtgggagggttttcaaaagtggagagacaacctattcttgcagggattgtgcaattgatccaacatgtgtactctgtatggactgcttccaggacagtgttcataaaaatcatcgttacaagatgcatacttctactggaggagggttctgtgactgtggagacacagaggcatggaaaactggccctttttgtgtaaatcatgaacctggaagagcaggtactataaaagagaattcacgctgtccgttgaatgaagaggtaattgtccaagccaggaaaatatttccttcagtgataaaatatgtcgtagaaatgactatatgggaagaggaaaaagaactgcctcctgaactccagataagggagaaaaatgaaagatactattgtgtccttttcaatgatgaacaccattcatatgaccacgtcatatacagcctacaaagagctcttgactgtgagctcgcagaggcccagttgcataccactgccattgacaaagagggtcgtcgggctgttaaagcgggagcttatgctgcttgccaggaagcaaaggaagatataaagagtcattcagaaaatgtctctcaacatccacttcatgtagaagtattacactcagagattatggctcatcagaaatttgctttgcgtcttggttcctggatgaacaaaattatgagctattcaagtgactttaggcagatcttttgccaagcatgccttagagaagaacctgactcggagaatccctgtctcataagcaggttaatgctttgggatgcaaagctttataaaggtgcccgtaagatccttcatgaattgatcttcagcagtttttttatggagatggaatacaaaaaactctttgctatggaatttgtgaagtattataaacaactgcagaaagaatatatcagtgatgatcatgacagaagtatctctataactgcactttcagttcagatgtttactgttcctactctggctcgacatcttattgaagagcagaatgttatctctgtcattactgaaactctgctagaagttttacctgagtacttggacaggaacaataaattcaacttccagggttatagccaggacaaattgggaagagtatatgcagtaatatgtgacctaaagtatatcctgatcagcaaacccacaatatggacagaaagattaagaatgcagttccttgaaggttttcgatcttttttgaagattcttacctgtatgcagggaatggaagaaatccgaagacaggttgggcaacacattgaagtggatcctgattgggaggctgccattgctatacagatgcaattgaagaatattttactcatgttccaagagtggtgtgcttgtgatgaagaactcttacttgtggcttataaagaatgtcacaaagctgtgatgaggtgcagtaccagtttcatatctagtagcaagacagtagtacaatcgtgtggacatagtttggaaacaaagtcctacagagtatctgaggatcttgtaagcatacatctgccactctctaggacccttgctggtcttcatgtacgtttaagcaggctgggtgctgtttcaagactgcatgaatttgtgtcttttgaggactttcaagtagaggtactagtggaatatcctttacgttgtctggtgttggttgcccaggttgttgctgagatgtggcgaagaaatggactgtctcttattagccaggtgttttattaccaagatgttaagtgcagagaagaaatgtatgataaagatatcatcatgcttcagattggtgcatctttaatggatcccaataagttcttgttactggtacttcagaggtatgaacttgccgaggcttttaacaagaccatatctacaaaagaccaggatttgattaaacaatataatacactaatagaagaaatgcttcaggtcctcatctatattgtgggtgagcgttatgtacctggagtgggaaatgtgaccaaagaagaggtcacaatgagagaaatcattcacttgctttgcattgaacccatgccacacagtgccattgccaaaaatttacctgagaatgaaaataatgaaactggcttagagaatgtcataaacaaagtggccacatttaagaaaccaggtgtatcaggccatggagtttatgaactaaaagatgaatcactgaaagacttcaatatgtacttttatcattactccaaaacccagcatagcaaggctgaacatatgcagaagaaaaggagaaaacaagaaaacaaagatgaagcattgccgccaccaccacctcctgaattctgccctgctttcagcaaagtgattaaccttctcaactgtgatatcatgatgtacattctcaggaccgtatttgagcgggcaatagacacagattctaacttgtggaccgaagggatgctccaaatggcttttcatattctggcattgggtttactagaagagaagcaacagcttcaaaaagctcctgaagaagaagtaacatttgacttttatcataaggcttcaagattgggaagttcagccatgaatatacaaatgcttttggaaaaactcaaaggaattccccagttagaaggccagaaggacatgataacgtggatacttcagatgtttgacacagtgaagcgattaagagaaaaatcttgtttaattgtagcaaccacatcaggatcggaatctattaagaatgatgagattctacatcat

SEQ ID NO: 33487 - DNA, 4208 bp, Homo sapiens
attccagttattgttctcatagcagtgttatcttcttgacttcctccagcactgacttttcattataatccttaaacatttggtcattgtggattagagaactatgagcgtttgcagagtgattatgtgacagatgaccacgacagagagttttcagtcgcagacctctcggttcagatattcacggttccttcacttgctcgaatgctcatcacagaagaaaacttaatgagcattatcattaagacttttatggatcatttgagacatcgagatgcccagggcagatttcagtttgaacgatacactgctttacaagccttcaaatttaggagagtacagagccttattttagatctcaagtatgtgttaattagcaaaccaactgaatggtcagatgagctgaggcagaagttcctagaagggtttgatgcctttttggaattactaaaatgtatgcaggaaacatccctatatacaaaacagaatctagaagtagaaacgaacagggaatggatccaattacacgtcaagtaggacaacatattgaaatggaaccagagtgggaagcagccttcacactacaaatgaaattaacacatgtcatttcaatgatgcaggactggtgtgcttcagatgaaaaagtgttaatcgaagcttacaagaaatgtctcgctgtactgatgcagtgtcatggtggttatactgatggtgaacagccaatcacactaagcatttgtggacattcagtggaaactatcagatactgtgtttcccaagaaaaagttagcattcacctcccagtttctcgcttacttgcaggtttacatgtattattaagcaaaagtgaagtggcatataaatttccagagctcctacctctaagtgaacttagcccacccatgttgatagaacaccctcttagatgtcttgttctgtgtgcccaagtacatgccggaatgtggagaagaaatgggttctctctagtaaaccagatttattactaccataatgtgaaatgcagacgtgagatgtttgacaaggatgtagtaatgcttcagacaggtgtctccatgatggatccaaatcatttcctgatgatcatgctcagccgctttgaactttatcagattttcagtactccagactatggaaaaagatttagttctgagattacccataaggatgttgttcagcagaacaatactctaatagaagaaatgctatacctcattataatgcttgttggagagagatttagtcctggagttggacaggtaaatgctacagatgaaatcaagcgagagattatccatcagttgagtatcaagcctatggctcatagtgaattggtaaagtctttacctgaagatgagaacaaggagactggcatggagagtgtaatcgaagcagttgcccatttcaagaaacctggattaacaggacgaggcatgtatgaactgaaaccagaatgtgccaaagagttcaacttgtatttctatcacttttcaagggcagaacagtccaaggcagaagaagcgcaacggaaattgaaaagacaaaatagagaagatacagcactcccacctccggtgttgcctccattctgccctctgtttgcaagcctggttaacattttgcagtcagatgtcatgttgtgcatcatgggaacaattctgcaatgggctgtggaacataatggatatgcctggtcagagtccatgctgcaaagggtgttacatttaattggcatggcactacaagaagaaaaacaacatttagagaatgtcacggaagagcatgtagtaacatttaccttcactcagaagatatcaaaacctggtgaagcgccaaaaaattctcctagcatactagctatgctggaaacactacaaaatgctccctacctagaagtccacaaagacatgattcggtggatattgaagacttttaatgctgttaaaaagatgagggagagttcacctaccagtcccgtggcagagacagaaggaaccataatggaagagcataatttcagagttcaagggacaaagacaaagctgagaggaagagaaaagcagagattgccagactgcgcagagaaaagatcatggctcagatgtctgaaatgcagcggcattttattgatgaaaacaaagaactctttcagcagacattagaactggatgcctcaacctctgctgttcttgatcatagccctgtggcttcagatatgacacttacagcactgggccccgcacaaactcaggttcctgaacaaagacaattcgttacatgtatattgtgtcaagaggagcaagaagttaaagtggaaagcagggcaatggtcttggcagcatttgttcagagatcaactgtattatcaaaaaacagaagtaaatttattcaagatccagaaaaatatgatccattattcatgcaccctgatctgtcttgtggaacacacactagtagctgtgggcacattatgcatgcccattgttggcaaaggtattttgattccgttcaagctaaagaacagcgaaggcaacagagattacgcttacatacgagctatgatgtagaaaacggagaattcctttgccccctttgtgaatgcttgagtaatactgttattcctctgctgcttcctccaagaaatatttttaacaacaggttaaatttttcagaccaaccaaatctgactcagtggattagaacaatatctcagcaaataaaagcattacagtttcttaggaaagaagaaagtactcctaataatgcctctacaaagaattcagaaaatgtggatgaattacagctccctgaagggttcaggcctgattttcgtcctaagatcccttattctgagagcataaaagaaatgctaacgacatttggaactgctacctacaaggtgggactaaaggttcatcccaatgaagaggatcctcgtgttcccataatgtgttggggtagctgcgcgtacaccatccaaagcatagaaagaattttgagtgatgaagataaaccattgtttggtcctttaccttgcagactggatgactgtcttaggtcattgacgagatttgccgcagcacactggacagtggcatcagtttcagtggtgcaaggacatttttgtaaactttttgcatcactggtgcctaatgacagccatgaggaacttccatgcatattagatattgacatgtttcatttattgaagagaatggcatggatcaagaaaatcccccttgtgaagaagaatcagcagttcttgctttgtataaaacacttcaccagtatacgggaagtgccttgaaagaaataccatccggctggcatctgtggaggagtgtcagagctggaatcatgcctttcctgaagtgttctgctttattttttcattacttaaatggagttccttccccacccgacattcaagttcctggaacaagccattttgaacatttatgtagctatctttccctaccaaacaacctcatttgcctttttcaagaaaatagtgagataatgaattcactgattgaaagttggtgccgtaacagtgaagttaaaagatatctagaaggtgaaagagatgctataagatatccaagagaatctaacaaattaataaaccttccagaggattacagcagcctcattaatcaagcatccaatttctcgtgcccgaaatcaggtggtgataagagcagagccccaactctgtgccttgtgtgcggatctctgctgtgctcccagagttactgctgccagactgaactggaaggggaggatgtaggagcctgcacagctcacacctactcctgtggctctggagtgggcatcttcctgagagtacgggaatgtcaggtgctatttttagctggcaaaaccaaaggctgtttttattctcctccttaccttgatgactatggggagaccgaccagggactcagacggggaaatcctttacatttatgcaaagagcgattcaagaagattcagaagctctggcaccaacacagtgtcacagaggaaattggacatgcacaggaagccaatcagacactggttggcattgactggcaacatttataattattgcaccaccaaaaaacacaaacttggatttttttaacccagttggctttttaagaaagaaagaagttctgctgaatttggaaataaattctttattt

SEQ ID NO: 33488 - DNA, 7857 bp, Homo sapiens
ttctgtgtccttccctgggtcagggacgagccagtgacttgactcttgggcgctaagcttgggagggagcgcaggaggccgctgtccttcctttccggttcacgtcacccttctctccctctgttgctccacctgcagccacttggacggctccgggactgattgcctggggcaggggtggcagtcgaggccgccggggccgaggtgaggctgcagctctccgggcggcggtagcgctggggaggaggaggagagaagatggcgtcggagctagagccagaggtgcaggccatcgaccggagcttgctggaatgttcggccgaggagattgcggggaaatggctgcaagcaactgacctcactagagaagtgtaccagcatttagcccactatgtacccaaaatctactgcaggggtcccaacccttttccacagaaagaagacatgctggcacagcatgttttgttgggaccaatggaatggtacctttgtggtgaagatcctgcatttggatttccaaaacttgagcaagcaaacaaaccttctcatctttgtggtcgtgtttttaaagtaggagagcctacatattcttgcagagactgtgcagttgatccaacttgtgttttgtgcatggagtgctttttgggaagtattcacagagatcatcgatataggatgacaacatcaggaggtggaggtttctgtgactgtggtgatactgaagcctggaaagagggtccttactgtcaaaaacatgaacttaacacctctgaaattgaggaagaagaggatcctcttgttcatttatcagaagatgtgatagcaagaacttataacatttttgctattacgtttcggtatgcagtagaaatattaacctgggaaaaagaaagtgaattgccagcagatttagagatggtagagaagagtgacacctactattgcatgctgtttaatgatgaggttcacacctatgaacaagttatttatactcttcagaaagctgttaactgtacacaaaaagaagctattggttttgcaactacagtagatcgagatgggcgtaggtctgttcgatatggagattttcagtattgtgagcaagcaaaatcagtaattgtgagaaataccagtagacagacaaagccactcaaagttcaagttatgcattcgtctattgtcgcacatcagaattttggtttgaaacttttgtcttggctgggaagtattattggatattcagatggccttcgccggattttatgtcaagttggtttacaagaagggccagatggtgaaaactcttctctagtggacagactgatgcttagtgattccaaattatggaaaggtgctaggagtgtatatcatcagttgttcatgagcagtctgcttatggatttgaaatacaagaaactatttgctgttcgatttgcaaaaaattaccagcagttgcagagagattttatggaggatgatcacgagcgagcagtgtcggtgactgctctatctgtccagttcttcaccgcacctactctggctcgaatgctcatcacagaagaaaacttaatgagcattatcattaagacttttatggatcatttgagacatcgagatgcccagggcagatttcagtttgaacgatacactgctttacaagccttcaaatttaggagagtacagagccttattttagatctcaagtatgtgttaattagcaaaccaactgaatggtcagatgagctgaggcagaagttcctagaagggtttgatgcctttttggaattactaaaatgtatgcagggaatggatccaattacacgtcaagtaggacaacatattgaaatggaaccagagtgggaagcagccttcacactacaaatgaaattaacacatgtcatttcaatgatgcaggactggtgtgcttcagatgaaaaagtgttaatcgaagcttacaagaaatgtctcgctgtactgatgcagtgtcatggtggttatactgatggtgaacagccaatcacactaagcatttgtggacattcagtggaaactatcagatactgtgtttcccaagaaaaagttagcattcacctcccagtttctcgcttacttgcaggtttacatgtattattaagcaaaagtgaagtggcatataaatttccagagctcctacctctaagtgaacttagcccacccatgttgatagaacaccctcttagatgtcttgttctgtgtgcccaagtacatgccggaatgtggagaagaaatgggttctctctagtaaaccagatttattactaccataatgtgaaatgcagacgtgagatgtttgacaaggatgtagtaatgcttcagacaggtgtctccatgatggatccaaatcatttcctgatgatcatgctcagccgctttgaactttatcagattttcagtactccagactatggaaaaagatttagttctgagattacccataaggatgttgttcagcagaacaatactctaatagaagaaatgctatacctcattataatgcttgttggagagagatttagtcctggagttggacaggtaaatgctacagatgaaatcaagcgagagattatccatcagttgagtatcaagcctatggctcatagtgaattggtaaagtctttacctgaagatgagaacaaggagactggcatggagagtgtaatcgaagcagttgcccatttcaagaaacctggattaacaggacgaggcatgtatgaactgaaaccagaatgtgccaaagagttcaacttgtatttctatcacttttcaagggcagaacagtccaaggcagaagaagcgcaacggaaattgaaaagacaaaatagagaagatacagcactcccacctccggtgttgcctccattctgccctctgtttgcaagcctggttaacattttgcagtcagatgtcatgttgtgcatcatgggaacaattctgcaatgggctgtggaacataatggatatgcctggtcagagtccatgctgcaaagggtgttacatttaattggcatggcactacaagaagaaaaacaacatttagagaatgtcacggaagagcatgtagtaacatttaccttcactcagaagatatcaaaacctggtgaagcgccaaaaaattctcctagcatactagctatgctggaaacactacaaaatgctccctacctagaagtccacaaagacatgattcggtggatattgaagacttttaatgctgttaaaaagatgagggagagttcacctaccagtcccgtggcagagacagaaggaaccataatggaagagagttcaagggacaaagacaaagctgagaggaagagaaaagcagagattgccagactgcgcagagaaaagatcatggctcagatgtctgaaatgcagcggcattttattgatgaaaacaaagaactctttcagcagacattagaactggatgcctcaacctctgctgttcttgatcatagccctgtggcttcagatatgacacttacagcactgggccccgcacaaactcaggttcctgaacaaagacaattcgttacatgtatattgtgtcaagaggagcaagaagttaaagtggaaagcagggcaatggtcttggcagcatttgttcagagatcaactgtattatcaaaaaacagaagtaaatttattcaagatccagaaaaatatgatccattattcatgcaccctgatctgtcttgtggaacacacactagtagctgtgggcacattatgcatgcccattgttggcaaaggtattttgattccgttcaagctaaagaacagcgaaggcaacagagattacgcttacatacgagctatgatgtagaaaacggagaattcctttgccccctttgtgaatgcttgagtaatactgttattcctctgctgcttcctccaagaaatatttttaacaacaggttaaatttttcagaccaaccaaatctgactcagtggattagaacaatatctcagcaaataaaagcattacagtttcttaggaaagaagaaagtactcctaataatgcctctacaaagaattcagaaaatgtggatgaattacagctccctgaagggttcaggcctgattttcgtcctaagatcccttattctgagagcataaaagaaatgctaacgacatttggaactgctacctacaaggtgggactaaaggttcatcccaatgaagaggatcctcgtgttcccataatgtgttggggtagctgcgcgtacaccatccaaagcatagaaagaattttgagtgatgaagataaaccattgtttggtcctttaccttgcagactggatgactgtcttaggtcattgacgagatttgccgcagcacactggacagtggcatcagtttcagtggtgcaaggacatttttgtaaactttttgcatcactggtgcctaatgacagccatgaggaacttccatgcatattagatattgacatgtttcatttattggtgggcttggtgcttgcatttcctgcgttgcagtgtcaggatttttcagggatcagccttggcactggagaccttcacattttccatctggttactatggcacacatcatacagatcttacttacctcatgtacagaagagaatggcatggatcaagaaaatcccccttgtgaagaagaatcagcagttcttgctttgtataaaacacttcaccagtatacgggaagtgccttgaaagaaataccatccggctggcatctgtggaggagtgtcagagctggaatcatgcctttcctgaagtgttctgctttattttttcattacttaaatggagttccttccccacccgacattcaagttcctggaacaagccattttgaacatttatgtagctatctttccctaccaaacaacctcatttgcctttttcaagaaaatagtgagataatgaattcactgattgaaagttggtgccgtaacagtgaagttaaaagatatctagaaggtgaaagagatgctataagatatccaagagaatctaacaaattaataaaccttccagaggattacagcagcctcattaatcaagcatccaatttctcgtgcccgaaatcaggtggtgataagagcagagccccaactctgtgccttgtgtgcggatctctgctgtgctcccagagttactgctgccagactgaactggaaggggaggatgtaggagcctgcacagctcacacctactcctgtggctctggagtgggcatcttcctgagagtacgggaatgtcaggtgctatttttagctggcaaaaccaaaggctgtttttattctcctccttaccttgatgactatggggagaccgaccagggactcagacggggaaatcctttacatttatgcaaagagcgattcaagaagattcagaagctctggcaccaacacagtgtcacagaggaaattggacatgcacaggaagccaatcagacactggttggcattgactggcaacatttataattattgcaccaccaaaaaacacaaacttggatttttttaacccagttggctttttaagaaagaaagaagttctgctgaatttggaaataaattctttatttaaactttccttcccagttttatagtttctggttctgaggactgatgaaaatcatcttccatcagcagattttcttgcactgtttgctgtgcccctcaaatataatgtcttgggttttaagatcgagcaaggagcttctcttcctagattggatcccagcccctttgtgggggtctgactgcatagtcccagccattatgtgatatttcacgttattgatgatagtgaaccgtgggtccgaagctgactcaacggaggcagggaacaaagtctctgtggtctgttgggtcatacttcctggttccactgagtggcccaacactgggactgggttggtgtcccctctgctgacaggaccctactcctaggagcaaagtggttgattttgaaggcagtgttcccttctctccattgactatgagagagttgggggacacacatgcagaagaagcccgtggggagaaggtggattcctggtgtgctggctggtttttcagggctgttagaggttttttttttttctttttttttttatggcaagacttttggctttgagaaaactcacttagagggctttccaaaaacttaggatggtctaaaaaattaggatattcttttagaattaggaagaaaaattaggatattctaaaagaatatggattaaaaatttaggatattcttttagatatcctaatatctagatgagaggccttccttcataagatctggttgtttgggctgtggttggcataagtgatatttattttggcctctgtcacatccagtttcttgagcttttaaggtaagcttcttttggctttttttcagatgttcaccaagcttaagtttaaaataataggtattctaaaagagtatcctaattttcttatctgtattcttttagaataccctaatgtttcagacagtgatattctcttgttatttctaaggctaaattggcagagtatatcatctaaagccaaacactgaagaaggtgagaacccactcccacccagccagcatttcctggaacagacaagctgctgcttccttgctggctcacttagtgcattcctgggatggtctggcacccaggctttttattctttttgatcattgttcttactgaggtgccttcctagaacaagagccacttacaaaatagcttataattattatgtaccacacaactactattgtttgatgtatgactgctgagagcttgaatacatgcagagagtgactgaagacttagtagaggaataaattctgagcctgtctaaggtggggctaaggaacagatgagtaataagaggctcttggatttttttaaccaatgcaactgaccctttcaatcagttttctttgaattacatctacaagttttgttccactcagctaccagtcaactaggcatgctccacagtatcacaggaagaaggtcagaaatctggaactgaagctaaaagaagtgaggatgtagaagccacattcctctccaaggtagtgtgtgaaagaaccgccccctcttgacaggaggatgaccgtcgccattcttgcgtgggactgactcacccagctgagaggaggaccaatagaaagaaaattcacatttgagtccacctctctccccctttttctggccttcattcataagatctggttgtttgggctgtaggtggcataattcatgtttattttggcctctgtcacatccagtttctttagcttttaaggtaagcttcttttggctttttttcatatgttcaccaagctaaaatttaaaataataagaccaggtttctctctgtacaagtggattataaacattttcaccaaatcataacaatactccagctttccggtccgacttcctaggagcctggagttagcaaaggttgtctctggatttcattctctgagaatatcacagagcctgggagaagatgaatttacatgaaattgcaacatacacacctttttattttctggtgttaagctagttgtctttcctaccttacaaatcatgttagttttatgatttgttccgcatgttttatgtttattgtagaaatgtttatataacatacgctttccatatcagggaaaatcatatctgtttaataaattggctataactttaatatctgtggacaacttgtaaaatttggaatgtatcatatgtaaaaagtttaaagatatccaaataaatgctttaggtgttggcatt

SEQ ID NO: 33489 - DNA, 7857 bp, Homo sapiens
ttctgtgtccttccctgggtcagggacgagccagtgacttgactcttgggcgctaagcttgggagggagcgcaggaggccgctgtccttcctttccggttcacgtcacccttctctccctctgttgctccacctgcagccacttggacggctccgggactgattgcctggggcaggggtggcagtcgaggccgccggggccgaggtgaggctgcagctctccgggcggcggtagcgctggggaggaggaggagagaagatggcgtcggagctagagccagaggtgcaggccatcgaccggagcttgctggaatgttcggccgaggagattgcggggaaatggctgcaagcaactgacctcactagagaagtgtaccagcatttagcccactatgtacccaaaatctactgcaggggtcccaacccttttccacagaaagaagacatgctggcacagcatgttttgttgggaccaatggaatggtacctttgtggtgaagatcctgcatttggatttccaaaacttgagcaagcaaacaaaccttctcatctttgtggtcgtgtttttaaagtaggagagcctacatattcttgcagagactgtgcagttgatccaacttgtgttttgtgcatggagtgctttttgggaagtattcacagagatcatcgatataggatgacaacatcaggaggtggaggtttctgtgactgtggtgatactgaagcctggaaagagggtccttactgtcaaaaacatgaacttaacacctctgaaattgaggaagaagaggatcctcttgttcatttatcagaagatgtgatagcaagaacttataacatttttgctattacgtttcggtatgcagtagaaatattaacctgggaaaaagaaagtgaattgccagcagatttagagatggtagagaagagtgacacctactattgcatgctgtttaatgatgaggttcacacctatgaacaagttatttatactcttcagaaagctgttaactgtacacaaaaagaagctattggttttgcaactacagtagatcgagatgggcgtaggtctgttcgatatggagattttcagtattgtgagcaagcaaaatcagtaattgtgagaaataccagtagacagacaaagccactcaaagttcaagttatgcattcgtctattgtcgcacatcagaattttggtttgaaacttttgtcttggctgggaagtattattggatattcagatggccttcgccggattttatgtcaagttggtttacaagaagggccagatggtgaaaactcttctctagtggacagactgatgcttagtgattccaaattatggaaaggtgctaggagtgtatatcatcagttgttcatgagcagtctgcttatggatttgaaatacaagaaactatttgctgttcgatttgcaaaaaactatgagcgtttgcagagtgattatgtgacagatgaccacgacagagagttttcagtcgcagacctctcggttcagatattcacggttccttcacttgctcgaatgctcatcacagaagaaaacttaatgagcattatcattaagacttttatggatcatttgagacatcgagatgcccagggcagatttcagtttgaacgatacactgctttacaagccttcaaatttaggagagtacagagccttattttagatctcaagtatgtgttaattagcaaaccaactgaatggtcagatgagctgaggcagaagttcctagaagggtttgatgcctttttggaattactaaaatgtatgcagggaatggatccaattacacgtcaagtaggacaacatattgaaatggaaccagagtgggaagcagccttcacactacaaatgaaattaacacatgtcatttcaatgatgcaggactggtgtgcttcagatgaaaaagtgttaatcgaagcttacaagaaatgtctcgctgtactgatgcagtgtcatggtggttatactgatggtgaacagccaatcacactaagcatttgtggacattcagtggaaactatcagatactgtgtttcccaagaaaaagttagcattcacctcccagtttctcgcttacttgcaggtttacatgtattattaagcaaaagtgaagtggcatataaatttccagagctcctacctctaagtgaacttagcccacccatgttgatagaacaccctcttagatgtcttgttctgtgtgcccaagtacatgccggaatgtggagaagaaatgggttctctctagtaaaccagatttattactaccataatgtgaaatgcagacgtgagatgtttgacaaggatgtagtaatgcttcagacaggtgtctccatgatggatccaaatcatttcctgatgatcatgctcagccgctttgaactttatcagattttcagtactccagactatggaaaaagatttagttctgagattacccataaggatgttgttcagcagaacaatactctaatagaagaaatgctatacctcattataatgcttgttggagagagatttagtcctggagttggacaggtaaatgctacagatgaaatcaagcgagagattatccatcagttgagtatcaagcctatggctcatagtgaattggtaaagtctttacctgaagatgagaacaaggagactggcatggagagtgtaatcgaagcagttgcccatttcaagaaacctggattaacaggacgaggcatgtatgaactgaaaccagaatgtgccaaagagttcaacttgtatttctatcacttttcaagggcagaacagtccaaggcagaagaagcgcaacggaaattgaaaagacaaaatagagaagatacagcactcccacctccggtgttgcctccattctgccctctgtttgcaagcctggttaacattttgcagtcagatgtcatgttgtgcatcatgggaacaattctgcaatgggctgtggaacataatggatatgcctggtcagagtccatgctgcaaagggtgttacatttaattggcatggcactacaagaagaaaaacaacatttagagaatgtcacggaagagcatgtagtaacatttaccttcactcagaagatatcaaaacctggtgaagcgccaaaaaattctcctagcatactagctatgctggaaacactacaaaatgctccctacctagaagtccacaaagacatgattcggtggatattgaagacttttaatgctgttaaaaagatgagggagagttcacctaccagtcccgtggcagagacagaaggaaccataatggaagagagttcaagggacaaagacaaagctgagaggaagagaaaagcagagattgccagactgcgcagagaaaagatcatggctcagatgtctgaaatgcagcggcattttattgatgaaaacaaagaactctttcagcagacattagaactggatgcctcaacctctgctgttcttgatcatagccctgtggcttcagatatgacacttacagcactgggccccgcacaaactcaggttcctgaacaaagacaattcgttacatgtatattgtgtcaagaggagcaagaagttaaagtggaaagcagggcaatggtcttggcagcatttgttcagagatcaactgtattatcaaaaaacagaagtaaatttattcaagatccagaaaaatatgatccattattcatgcaccctgatctgtcttgtggaacacacactagtagctgtgggcacattatgcatgcccattgttggcaaaggtattttgattccgttcaagctaaagaacagcgaaggcaacagagattacgcttacatacgagctatgatgtagaaaacggagaattcctttgccccctttgtgaatgcttgagtaatactgttattcctctgctgcttcctccaagaaatatttttaacaacaggttaaatttttcagaccaaccaaatctgactcagtggattagaacaatatctcagcaaataaaagcattacagtttcttaggaaagaagaaagtactcctaataatgcctctacaaagaattcagaaaatgtggatgaattacagctccctgaagggttcaggcctgattttcgtcctaagatcccttattctgagagcataaaagaaatgctaacgacatttggaactgctacctacaaggtgggactaaaggttcatcccaatgaagaggatcctcgtgttcccataatgtgttggggtagctgcgcgtacaccatccaaagcatagaaagaattttgagtgatgaagataaaccattgtttggtcctttaccttgcagactggatgactgtcttaggtcattgacgagatttgccgcagcacactggacagtggcatcagtttcagtggtgcaaggacatttttgtaaactttttgcatcactggtgcctaatgacagccatgaggaacttccatgcatattagatattgacatgtttcatttattggtgggcttggtgcttgcatttcctgcgttgcagtgtcaggatttttcagggatcagccttggcactggagaccttcacattttccatctggttactatggcacacatcatacagatcttacttacctcatgtacagaagagaatggcatggatcaagaaaatcccccttgtgaagaagaatcagcagttcttgctttgtataaaacacttcaccagtatacgggaagtgccttgaaagaaataccatccggctggcatctgtggaggagtgtcagagctggaatcatgcctttcctgaagtgttctgctttattttttcattacttaaatggagttccttccccacccgacattcaagttcctggaacaagccattttgaacatttatgtagctatctttccctaccaaacaacctcatttgcctttttcaagaaaatagtgagataatgaattcactgattgaaagttggtgccgtaacagtgaagttaaaagatatctagaaggtgaaagagatgctataagatatccaagagaatctaacaaattaataaaccttccagaggattacagcagcctcattaatcaagcatccaatttctcgtgcccgaaatcaggtggtgataagagcagagccccaactctgtgccttgtgtgcggatctctgctgtgctcccagagttactgctgccagactgaactggaaggggaggatgtaggagcctgcacagctcacacctactcctgtggctctggagtgggcatcttcctgagagtacgggaatgtcaggtgctatttttagctggcaaaaccaaaggctgtttttattctcctccttaccttgatgactatggggagaccgaccagggactcagacggggaaatcctttacatttatgcaaagagcgattcaagaagattcagaagctctggcaccaacacagtgtcacagaggaaattggacatgcacaggaagccaatcagacactggttggcattgactggcaacatttataattattgcaccaccaaaaaacacaaacttggatttttttaacccagttggctttttaagaaagaaagaagttctgctgaatttggaaataaattctttatttaaactttccttcccagttttatagtttctggttctgaggactgatgaaaatcatcttccatcagcagattttcttgcactgtttgctgtgcccctcaaatataatgtcttgggttttaagatcgagcaaggagcttctcttcctagattggatcccagcccctttgtgggggtctgactgcatagtcccagccattatgtgatatttcacgttattgatgatagtgaaccgtgggtccgaagctgactcaacggaggcagggaacaaagtctctgtggtctgttgggtcatacttcctggttccactgagtggcccaacactgggactgggttggtgtcccctctgctgacaggaccctactcctaggagcaaagtggttgattttgaaggcagtgttcccttctctccattgactatgagagagttgggggacacacatgcagaagaagcccgtggggagaaggtggattcctggtgtgctggctggtttttcagggctgttagaggttttttttttttctttttttttttatggcaagacttttggctttgagaaaactcacttagagggctttccaaaaacttaggatggtctaaaaaattaggatattcttttagaattaggaagaaaaattaggatattctaaaagaatatggattaaaaatttaggatattcttttagatatcctaatatctagatgagaggccttccttcataagatctggttgtttgggctgtggttggcataagtgatatttattttggcctctgtcacatccagtttcttgagcttttaaggtaagcttcttttggctttttttcagatgttcaccaagcttaagtttaaaataataggtattctaaaagagtatcctaattttcttatctgtattcttttagaataccctaatgtttcagacagtgatattctcttgttatttctaaggctaaattggcagagtatatcatctaaagccaaacactgaagaaggtgagaacccactcccacccagccagcatttcctggaacagacaagctgctgcttccttgctggctcacttagtgcattcctgggatggtctggcacccaggctttttattctttttgatcattgttcttactgaggtgccttcctagaacaagagccacttacaaaatagcttataattattatgtaccacacaactactattgtttgatgtatgactgctgagagcttgaatacatgcagagagtgactgaagacttagtagaggaataaattctgagcctgtctaaggtggggctaaggaacagatgagtaataagaggctcttggatttttttaaccaatgcaactgaccctttcaatcagttttctttgaattacatctacaagttttgttccactcagctaccagtcaactaggcatgctccacagtatcacaggaagaaggtcagaaatctggaactgaagctaaaagaagtgaggatgtagaagccacattcctctccaaggtagtgtgtgaaagaaccgccccctcttgacaggaggatgaccgtcgccattcttgcgtgggactgactcacccagctgagaggaggaccaatagaaagaaaattcacatttgagtccacctctctccccctttttctggccttcattcataagatctggttgtttgggctgtaggtggcataattcatgtttattttggcctctgtcacatccagtttctttagcttttaaggtaagcttcttttggctttttttcatatgttcaccaagctaaaatttaaaataataagaccaggtttctctctgtacaagtggattataaacattttcaccaaatcataacaatactccagctttccggtccgacttcctaggagcctggagttagcaaaggttgtctctggatttcattctctgagaatatcacagagcctgggagaagatgaatttacatgaaattgcaacatacacacctttttattttctggtgttaagctagttgtctttcctaccttacaaatcatgttagttttatgatttgttccgcatgttttatgtttattgtagaaatgtttatataacatacgctttccatatcagggaaaatcatatctgtttaataaattggctataactttaatatctgtggacaacttgtaaaatttggaatgtatcatatgtaaaaagtttaaagatatccaaataaatgctttaggtgttggcatt

SEQ ID NO: 33490 - DNA, 2423 bp, Homo sapiens
ttctgtgtccttccctgggtcagggacgagccagtgacttgactcttgggcgctaagcttgggagggagcgcaggaggccgctgtccttcctttccggttcacgtcacccttctctccctctgttgctccacctgcagccacttggacggctccgggactgattgcctggggcaggggtggcagtcgaggccgccggggccgaggtgaggctgcagctctccgggcggcggtagcgctggggaggaggaggagagaagatggcgtcggagctagagccagaggtgcaggccatcgaccggagcttgctggaatgttcggccgaggagattgcggggaaatggctgcaagcaactgacctcactagagaagtgtaccagcatttagcccactatgtacccaaaatctactgcaggggtcccaacccttttccacagaaagaagacatgctggcacagcatgttttgttgggaccaatggaatggtacctttgtggtgaagatcctgcatttggatttccaaaacttgagcaagcaaacaaaccttctcatctttgtggtcgtgtttttaaagtaggagagcctacatattcttgcagagactgtgcagttgatccaacttgtgttttgtgcatggagtgctttttgggaagtattcacagagatcatcgatataggatgacaacatcaggaggtggaggtttctgtgactgtggtgatactgaagcctggaaagagggtccttactgtcaaaaacatgaacttaacacctctgaaattgaggaagaagaggatcctcttgttcatttatcagaagatgtgatagcaagaacttataacatttttgctattacgtttcggtatgcagtagaaatattaacctgggaaaaagaaagtgaattgccagcagatttagagatggtagagaagagtgacacctactattgcatgctgtttaatgatgaggttcacacctatgaacaagttatttatactcttcagaaagctgttaactgtacacaaaaagaagctattggttttgcaactacagtagatcgagatgggcgtaggtctgttcgatatggagattttcagtattgtgagcaagcaaaatcagtaattgtgagaaataccagtagacagacaaagccactcaaagttcaagttatgcattcgtctattgtcgcacatcagaattttggtttgaaacttttgtcttggctgggaagtattattggatattcagatggccttcgccggattttatgtcaagttggtttacaagaagggccagatggtgaaaactcttctctagtggacagactgatgcttagtgattccaaattatggaaaggtgctaggagtgtatatcatcagttgttcatgagcagtctgcttatggatttgaaatacaagaaactatttgctgttcgatttgcaaaaaactatgagcgtttgcagagtgattatgtgacagatgaccacgacagagagttttcagtcgcagacctctcggttcagatattcacggttccttcacttttctctatctctgctgggcgcagtggctcacctctgtaatcctagccaaggcaggtggatcacctgagcttaggagtctgagaccagcctggccaacatggtgaaaccccatctctactaaaaatagaaaaattagccaggcgtggtggcgcacgcctgaggctgaggcagaagaatcacttgaacccaagaggcggaggttgcagtgagctgagatcaagccattgcactccagcctgggcgacagagcgagattcggtatccaaaaaaaaaaagttcttgctctgtcactcaggctggagtgaggtggcacgatcacagctcactgcagctttgaccacctgggcttaggcaatcctcctgtctcagcctcccaagtagctgggaccacagatgcatgccaccacacccagctagtcttaacatttttaaattaagcttatatggtttatatttttgatgctgtagtaaactttttatatttttgatgctgtagtaaactttttatatttttaaacaggctatggtagtatttaggaaaactactgatttttatatgtccatcttatatctgtctggtctatctggatatgtatgtattcagattaaataggttctaccagactcttttccataatggttaaaccaattcatgcttctgttaataacgtatgaaagtgatagttgctccacatcctcaccaacacttggttttaccagtcttttaagattttatctattctagtgggacatagtggtttctcattatggttttaatttgcattcttctgatgatgatgaagctgaattcctttttatatgtttattggcatttggatatactcctttgtgaatccctgttaaagttgtcctttgattatcta

SEQ ID NO: 33491 - DNA, 8005 bp, Homo sapiens
tccctggaggagccgctggccctggactctccaaattctgagctctcatcatggcggcggcggccgcggcggccgtcgggggccagcagccgtcacagcccgagctgcccgcgccggggctggccctagacaaggcggccaccgccgcgcacctcaaggcggccctcagccggccggacaaccgcgcaggtgctgaggagctgcaggcgctgctggagcgggtgctgagcgccgagcggccgctggccgcggctgccggcggcgaggacgcggcggcggccggaggcgggggcggtccgggggcggccgaggaggaggccctggagtggtgtaagtgccttctggcgggcggcggcggctacgacgagttctgcgcggcggtgcgggcctacgatcccgcggcgctctgcggcctggtctggacagccaacttcgtggcctaccgctgccggacgtgcggcatctcgccctgcatgtcgctgtgcgccgagtgcttccaccagggcgaccacaccggacacgacttcaacatgttccgcagccaggccgggggcgcctgcgactgcggggacagcaacgtgatgcgggagagcgggttttgcaaaaggcatcaaattaaatcaagttcaaatattccctgtgtccctaaagacttactgatgatgtctgaatttgttcttccaagatttatattttgtcttattcagtacttaagagaaggctataatgaaccagcagctgatggaccatcagaaaaggaccttaacaaagtccttcagcttttggaacctcaaatttcctttttagaagacctgactaaaatgggaggagcaatgcggtctgttcttactcaggttttgacaaaccaacaaaactacaaagatctgacttctggtcttggagaaaatgcttgtgtaaagaaaagtcatgaaaagtaccttatagctttaaagagctctggacttacatatcctgaggataagcttgtatatggtgtgcaggagccatctgctggtactagttctctggctgttcaaggtttcataggcgcaacaggaactttgggacaagtggattcttcagatgaggatgatcaggatggtagtcaaggtctgggcaagagaaaaagggtaaaactaagcagtggcaccaaagatcaatccataatggatgttttgaagcataaaagcttcctagaagaactattattttggactataaaatatgaattccctcaaaagatggtaactttcttactcaacatgcttccagatcaagagtataaggttgcttttacaaaaacttttgttcagcattatgctttcattatgaaaacactgaagaaaagtcatgaatcagacacaatgtctaacagaattgtgcatattagtgttcagttgttcagcaatgaggagctagccagacaggtaacagaagaatgtcagctgctggatattatggtcactgtgctattatacatgatggaaagttgccttattaaaagtgagctacaagatgaagaaaatagtttacatgtggtagtgaactgtggagaagcattactgaagaataacacttactggcctcttgttagtgattttattaatattctttctcatcaaagtgtggccaagagatttttggaggatcacggtttgttagttacatggatgaactttgtatctttctttcaaggtatgaacttaaacaagcgagaactaaacgagcatgtggaatttgagtctcagacctactatgctgcctttgctgctgaacttgaggcctgtgcacagccaatgtgggggcttttatcacattgtaaagttagggaaactcaagagtatacccgaaatgttgttagatattgccttgaagctcttcaagactggtttgatgctattaacttcgtagacgagccagcacctaaccaagtcacttttcatctgccactacatcgttactatgctatgtttttgagtaaggctgtgaaatgtcaagaactagatttggattctgttttaccagatcaggaaatgttaatgaaactaatgattcacccactccaaattcaagcaagtcttgcagaaatccacagcaatatgtgggtaagaaatggtctgcaaatcaaaggacaagccatgacgtatgtccagtctcatttctgtaattccatgattgatcctgacatttacctgttacaggtttgtgcttctagacttgacccagattattttatttcatccgtctttgaaagatttaaggtagtggatttgttgacaatggcatcacaacatcaaaatacagtacttgatgcagagcatgagaggtcgatgttagaaggcgctcttacatttcttgtgattcttttgagtcttcgtttacatttaggaatgtctgatgatgagattctcagggccgagatggtagcccagctgtgtatgaatgacaggacacacagttcattgctggacctcattccagaaaatcctaatcccaaaagtggcattattccaggcagttacagctttgaatcagttttatcagctgtagctgattttaaggctcctgtttttgaacctggaggttctatgcaacaaggcatgtatactcccaaagctgaagtctgggatcaagagtttgaccccgtcatggtcattcttcgaacagtttaccgtagagatgtgcagtctgcaatggacagatatactgcatttttaaaacagagtggaaaatttcctggaaatccctggcctccatataagaaaaggacatcactccatcctagctataaaggtcttatgagacttttgcactgtaaaactttacacattgtgctattcactctgctttacaagattttgatggatcatcaaaatctgtcagaacatgtactctgcatggttttatatctgattgaattaggacttgaaaattctgctgaagaagaatcagatgaagaggcatcagtgggtggaccagaacgttgtcatgacagttggtttcctggcagtaacttagtgtcaaacatgcgacactttataaactatgttagagtaagagttccagagactgctcctgaagtaaagagagactcacctgcaagtactagctctgataacttgggttctttacaaaattctggtacagctcaagttttcagtttagtagcagaacgtagaaagaaatttcaggaaatcatcaatcgcagtagcagtgaagcaaatcaggtggttcgtcccaaaacttcaagtaaatggtctgctcctggttcagctccacagttaactacagccattttggaaattaaagaaagcatattgtctttgctaattaaacttcaccacaaactctcaggaaaacaaaactcctactatcctccttggcttgatgacatagaaattttaatccaaccagaaattcctaaatacagtcatggagatggtataactgccgtggaaagaattttactaaaagctgcatcgcaaagtagaatgaacaaacgcatcattgaagagatatgtagaaaagtgacccctcctgtaccacctaaaaaagtcactgcagcagagaagaaaacattggacaaagaagaaaggcgacagaaggctagagagaggcagcagaaattgcttgcggagtttgcttcacgacagaaaagctttatggaaactgcaatggatgttgattctcctgagaatgatattcctatggagatcaccacggcagaaccacaggtttccgaggcagtatatgactgtgttatttgtggacagagtggcccctcctctgaagatcgacctactggattagttgtactgttacaagcatcctcagttttggggcagtgccgtgacaatgttgagccaaaaaagttgccgatcagtgaagaggagcagatttacccttgggatacctgtgcagccgttcatgatgtgaggctttcattattacagcgttattttaaggatagttcatgtctcttggcagtatcaattggctgggaaggaggtgtttatgtacaaacctgtggtcacacattacatatagattgtcataaatcttacatggaatcattacggaatgaccaggttcttcagggcttctcggtggacaaaggagaattcacgtgtccactctgtaggcagtttgctaacagtgttcttccatgttatcctggaagcaatgtggaaaataacccttggcaacgtcctagcaacaaaagcatacaagatctcataaaggaagtggaggagctgcagggacgaccgggagctttcccatcagaaacaaatttaagtaaagaaatggaatctgtaatgaaagatataaaaaataccactcagaagaaatatagagactatagcaagaccccgggctcaccagacaatgattttctctttatgtactctgttgctagaaccaatttagaacttgaattgattcatcgaggaggcaatttgtgttcaggtggtgcaagcacagctggcaaaaggtcttgtttaaatcagctgtttcatgtattagccttgcacatgcggctttatagcattgactctgagtataatccctggagaaagctcacccagttagaagagatgaatccacagctgggatatgaagaacaacagcctgaggttccaattctttatcatgatgtaacatcccttttgctcatccagatcttaatgatgccacaacccttacgcaaagaccactttacctgcattgtgaaggtactttttaccctactgtacacacaggctcttgcagcactctcagttaaatgcagcgaagaagataggtcagcctggaaacacgcgggagctctcaaaaagagtacatgtgatgcagaaaagtcttacgaagtattactgagctttgtgataagtgaactatttaaaggaaagttataccatgaagaaggaactcaggaatgtgcaatggttaaccctattgcttggtctcctgaatccatggaaaaatgcttacaggacttctgcttaccttttctcagaatcaccagccttcttcagcaccacctttttggggaagatttacctagctgccaggaagaagaagaattttcagttcttgccagctgcctgggacttctgccaacgttttaccaaacagaacatccattcatcagtgcctcctgtctggattggccagttccagcatttgatattataactcagtggtgttttgagataaaatcatttactgaaagacatgcagaacaaggaaaggccttgcttatccaagagtcaaaatggaaattaccacacctactacagttgcctgagaattataacaccatttttcagtactaccacagaaaaacctgtagtgtctgcaccaaggttcctaaagatcctgctgtttgccttgtgtgtggtacttttgtatgcctgaaaggactttgctgcaagcaacaaagttactgtgaatgtgtactgcactctcagaactgtggtgcaggaacaggtattttccttttgatcaatgcatcggtaattatcatcattcgaggtcaccgcttctgcctctggggttccgtgtatttggatgctcatggagaggaagaccgggatcttaggcgaggcaaacctctctacatttgtaaggaaagatacaaagttcttgagcaacagtggatttctcatacttttgatcacatcaataaaagatggggtccacattacaatgggctgtgactctccacctcagcattgcatcgtatcatcattttcgctacgaatttatttttcaacaataagctttaacttaatttgggggattaacacttttgctgagggagaaaaagaaaacatacattatgaagcctttccaaaattaggtgcttggtaatcacgttaatggtataattttttttttttaatatctggagaacattaataacaagttaaattattctttagtggtcattttttaagtgcacaattaataagaagcacaacttgttcacaaactcattcagaaatgattctcccaacaatgcgtatcagctattcattgatacttagagtgggtgtgatttatttgacattttactgcttctttctgtctgtgtgttttaatttgcatctgccaagcataatgcatcttttttcctctgccattcttgtgttgattggagaatttttctgtatgtaattagaaaaaaatgtaaaacatgatttatgtgaaatactgtatagtaaaagttggtctaatagtagaactttaaaattttttcttattgtgaggaatctgttaaaagtttaaagctttgctgaaaactgaattcattctcaggaatttcataaatcttctccccaggtaaataattgaaatagctgtaaaataagtagatagctgctgttaatataatacagtacattttggggggcatatgtgtggttggggggtccttaaaaatcaaaatttgccatttcagttggatgaattactagaggtaataacaaatcttactatgaaatcaagaggtttaagaacatacactgggcagatgttgattccgtgcatgcccaccttttattaccaaacaaggttttgtttatatgattgtattagaaatgctcagacttccccagaaatgaaccataaattttggaacttcctttcagctcaagaggttcagctatattgtatttgtgcagtgtaatcactactatttctgctcggtttcctaaaaggaaaaaaaaggcgcagtggtgatgaccctcatgaatgagccacgcttctgcattcttcttagaaactgctgtgaaaaacaatttatgtttgcagggtttaaaaatcagtaaaaatgggaatgattgagctaaaacccactctatgagaaggaagattactgaaaagcatgtgacatattgctacaaagattttttttcctaaatgattcagtaattgaatgattatttaatatatagtgctatcaagcaatccctggtactttggacttccatggcttgttatataaaattacatttttacatgtaaaaataaactaaacaaatctaatgataaaatatgtcagatccatgttctaaaaaatttttgtaatgacatgacattacaagagtataaaaatggacattaaatcatggccttgcattaaaatatggaaagcagagcagtacatattcaaatgtattcagaaagtcaaaagattacctatcgttctacaataaaatacatggaaatagcttgctatttttatatacatttccaaaatattaagataactttctgtaagagtcaatgattctgttcgactaaatagctgtcctttccaacacattgctacttttttaaatactgtatcataagttcagcctgtcatactttttgcattgatcgttatgaataccagaccatttgtaagtgtggttgaagagcaaaatgctaattgacatctctagtaaatactgttacaggattcatgaacttgaataattctacagtttgaaactctgatgctatatatacatggtataatgtattcagactttgattactacttatttaaaatggaatgttttatggttgtgcatatggatgtgaagtgaaaatattagccttaactttaaaatttgggtgtttgatagtgtttattttgatattggtgaattagtcaccagtaaattttaaaaaagcacttggttgaaaattgtacttgaatacatacatgcatgctgctaaactagaactttaatttttccccataacttttataagtcccatttataaacccacttttaaaaataacaggtccaagttagagtgatgtgtgtatattattcaaaaaaatgtactggtgtgatatcttgtatgaatgatcatttaaatacagtacattactgtagaagctaaattgatctttataattaagcagaaattacaaaactaggaataatcaacattgtaagatatgttaataaaaacctgctgtcatttggtttgtgaaaggtccttaaaa

SEQ ID NO: 33492 - DNA, 4414 bp, Homo sapiens
atgattgctagcaaacagaggcagttcacagaagtcttcaggataatgagctctactttctcccagtctcggttcttgtatgctgcagtggtgacagattctcctgagaatgatattcctatggagatcaccacggcagaaccacaggtttccgaggcagtatatgactgtgttatttgtggacagagtggcccctcctctgaagatcgacctactggattagttgtactgttacaagcatcctcagttttggggcagtgccgtgacaatgttgagccaaaaaagttgccgatcagtgaagaggagcagatttacccttgggatacctgtgcagccgttcatgatgtgaggctttcattattacagcgttattttaaggatagttcatgtctcttggcagtatcaattggctgggaaggaggtgtttatgtacaaacctgtggtcacacattacatatagattgtcataaatcttacatggaatcattacggaatgaccaggttcttcagggcttctcggtggacaaaggagaattcacgtgtccactctgtaggcagtttgctaacagtgttcttccatgttatcctggaagcaatgtggaaaataacccttggcaacgtcctagcaacaaaagcatacaagatctcataaaggaagtggaggagctgcagggacgaccgggagctttcccatcagaaacaaatttaagtaaagaaatggaatctgtaatgaaagatataaaaaataccactcagaagaaatatagagactatagcaagaccccgggctcaccagacaatgattttctctttatgtactctgttgctagaaccaatttagaacttgaattgattcatcgaggaggcaatttgtgttcaggtggtgcaagcacagctggcaaaaggtcttgtttaaatcagctgtttcatgtattagccttgcacatgcggctttatagcattgactctgagtataatccctggagaaagctcacccagttagaagagatgaatccacagctgggatatgaagaacaacagcctgaggttccaattctttatcatgatgtaacatcccttttgctcatccagatcttaatgatgccacaacccttacgcaaagaccactttacctgcattgtgaaggtactttttaccctactgtacacacaggctcttgcagcactctcagttaaatgcagcgaagaagataggtcagcctggaaacacgcgggagctctcaaaaagagtacatgtgatgcagaaaagtcttacgaagtattactgagctttgtgataagtgaactatttaaaggaaagttataccatgaagaaggaactcaggaatgtgcaatggttaaccctattgcttggtctcctgaatccatggaaaaatgcttacaggacttctgcttaccttttctcagaatcaccagccttcttcagcaccacctttttggggaagatttacctagctgccaggaagaagaagaattttcagttcttgccagctgcctgggacttctgccaacgttttaccaaacagaacatccattcatcagtgcctcctgtctggattggccagttccagcatttgatattataactcagtggtgttttgagataaaatcatttactgaaagacatgcagaacaaggaaaggccttgcttatccaagagtcaaaatggaaattaccacacctactacagttgcctgagaattataacaccatttttcagtactaccacagaaaaacctgtagtgtctgcaccaaggttcctaaagatcctgctgtttgccttgtgtgtggtacttttgtatgcctgaaaggactttgctgcaagcaacaaagttactgtgaatgtgtactgcactctcagaactgtggtgcaggaacaggtattttccttttgatcaatgcatcggtaattatcatcattcgaggtcaccgcttctgcctctggggttccgtgtatttggatgctcatggagaggaagaccgggatcttaggcgaggcaaacctctctacatttgtaaggaaagatacaaagttcttgagcaacagtggatttctcatacttttgatcacatcaataaaagatggggtccacattacaatgggctgtgactctccacctcagcattgcatcgtatcatcattttcgctacgaatttatttttcaacaataagctttaacttaatttgggggattaacacttttgctgagggagaaaaagaaaacatacattatgaagcctttccaaaattaggtgcttggtaatcacgttaatggtataattttttttttttaatatctggagaacattaataacaagttaaattattctttagtggtcattttttaagtgcacaattaataagaagcacaacttgttcacaaactcattcagaaatgattctcccaacaatgcgtatcagctattcattgatacttagagtgggtgtgatttatttgacattttactgcttctttctgtctgtgtgttttaatttgcatctgccaagcataatgcatcttttttcctctgccattcttgtgttgattggagaatttttctgtatgtaattagaaaaaaatgtaaaacatgatttatgtgaaatactgtatagtaaaagttggtctaatagtagaactttaaaattttttcttattgtgaggaatctgttaaaagtttaaagctttgctgaaaactgaattcattctcaggaatttcataaatcttctccccaggtaaataattgaaatagctgtaaaataagtagatagctgctgttaatataatacagtacattttggggggcatatgtgtggttggggggtccttaaaaatcaaaatttgccatttcagttggatgaattactagaggtaataacaaatcttactatgaaatcaagaggtttaagaacatacactgggcagatgttgattccgtgcatgcccaccttttattaccaaacaaggttttgtttatatgattgtattagaaatgctcagacttccccagaaatgaaccataaattttggaacttcctttcagctcaagaggttcagctatattgtatttgtgcagtgtaatcactactatttctgctcggtttcctaaaaggaaaaaaaaggcgcagtggtgatgaccctcatgaatgagccacgcttctgcattcttcttagaaactgctgtgaaaaacaatttatgtttgcagggtttaaaaatcagtaaaaatgggaatgattgagctaaaacccactctatgagaaggaagattactgaaaagcatgtgacatattgctacaaagattttttttcctaaatgattcagtaattgaatgattatttaatatatagtgctatcaagcaatccctggtactttggacttccatggcttgttatataaaattacatttttacatgtaaaaataaactaaacaaatctaatgataaaatatgtcagatccatgttctaaaaaatttttgtaatgacatgacattacaagagtataaaaatggacattaaatcatggccttgcattaaaatatggaaagcagagcagtacatattcaaatgtattcagaaagtcaaaagattacctatcgttctacaataaaatacatggaaatagcttgctatttttatatacatttccaaaatattaagataactttctgtaagagtcaatgattctgttcgactaaatagctgtcctttccaacacattgctacttttttaaatactgtatcataagttcagcctgtcatactttttgcattgatcgttatgaataccagaccatttgtaagtgtggttgaagagcaaaatgctaattgacatctctagtaaatactgttacaggattcatgaacttgaataattctacagtttgaaactctgatgctatatatacatggtataatgtattcagactttgattactacttatttaaaatggaatgttttatggttgtgcatatggatgtgaagtgaaaatattagccttaactttaaaatttgggtgtttgatagtgtttattttgatattggtgaattagtcaccagtaaattttaaaaaagcacttggttgaaaattgtacttgaatacatacatgcatgctgctaaactagaactttaatttttccccataacttttataagtcccatttataaacccacttttaaaaataacaggtccaagttagagtgatgtgtgtatattattcaaaaaaatgtactggtgtgatatcttgtatgaatgatcatttaaatacagtacattactgtagaagctaaattgatctttataattaagcagaaattacaaaactaggaataatcaacattgtaagatatgttaataaaaacctgctgtcatttggtttgtgaaaggtcctt

SEQ ID NO: 33493 - DNA, 7951 bp, Homo sapiens
atggcggcggcggccgcggcggccgtcgggggccagcagccgtcacagcccgagctgcccgcgccggggctggccctagacaaggcggccaccgccgcgcacctcaaggcggccctcagccggccggacaaccgcgcaggtgctgaggagctgcaggcgctgctggagcgggtgctgagcgccgagcggccgctggccgcggctgccggcggcgaggacgcggcggcggccggaggcgggggcggtccgggggcggccgaggaggaggccctggagtggtgtaagtgccttctggcgggcggcggcggctacgacgagttctgcgcggcggtgcgggcctacgatcccgcggcgctctgcggcctggtctggacagccaacttcgtggcctaccgctgccggacgtgcggcatctcgccctgcatgtcgctgtgcgccgagtgcttccaccagggcgaccacaccggacacgacttcaacatgttccgcagccaggccgggggcgcctgcgactgcggggacagcaacgtgatgcgggagagcgggttttgcaaaaggcatcaaattaaatcaagttcaaatattccctgtgtccctaaagacttactgatgatgtctgaatttgttcttccaagatttatattttgtcttattcagtacttaagagaaggctataatgaaccagcagctgatggaccatcagaaaaggaccttaacaaagtccttcagcttttggaacctcaaatttcctttttagaagacctgactaaaatgggaggagcaatgcggtctgttcttactcaggttttgacaaaccaacaaaactacaaagatctgacttctggtcttggagaaaatgcttgtgtaaagaaaagtcatgaaaagtaccttatagctttaaagagctctggacttacatatcctgaggataagcttgtatatggtgtgcaggagccatctgctggtactagttctctggctgttcaaggtttcataggcgcaacaggaactttgggacaagtggattcttcagatgaggatgatcaggatggtagtcaaggtctgggcaagagaaaaagggtaaaactaagcagtggcaccaaagatcaatccataatggatgttttgaagcataaaagcttcctagaagaactattattttggactataaaatatgaattccctcaaaagatggtaactttcttactcaacatgcttccagatcaagagtataaggttgcttttacaaaaacttttgttcagcattatgctttcattatgaaaacactgaagaaaagtcatgaatcagacacaatgtctaacagaattgtgcatattagtgttcagttgttcagcaatgaggagctagccagacaggtaacagaagaatgtcagctgctggatattatggtcactgtgctattatacatgatggaaagttgccttattaaaagtgagctacaagatgaagaaaatagtttacatgtggtagtgaactgtggagaagcattactgaagaataacacttactggcctcttgttagtgattttattaatattctttctcatcaaagtgtggccaagagatttttggaggatcacggtttgttagttacatggatgaactttgtatctttctttcaaggtatgaacttaaacaagcgagaactaaacgagcatgtggaatttgagtctcagacctactatgctgcctttgctgctgaacttgaggcctgtgcacagccaatgtgggggcttttatcacattgtaaagttagggaaactcaagagtatacccgaaatgttgttagatattgccttgaagctcttcaagactggtttgatgctattaacttcgtagacgagccagcacctaaccaagtcacttttcatctgccactacatcgttactatgctatgtttttgagtaaggctgtgaaatgtcaagaactagatttggattctgttttaccagatcaggaaatgttaatgaaactaatgattcacccactccaaattcaagcaagtcttgcagaaatccacagcaatatgtgggtaagaaatggtctgcaaatcaaaggacaagccatgacgtatgtccagtctcatttctgtaattccatgattgatcctgacatttacctgttacaggtttgtgcttctagacttgacccagattattttatttcatccgtctttgaaagatttaaggtagtggatttgttgacaatggcatcacaacatcaaaatacagtacttgatgcagagcatgagaggtcgatgttagaaggcgctcttacatttcttgtgattcttttgagtcttcgtttacatttaggaatgtctgatgatgagattctcagggccgagatggtagcccagctgtgtatgaatgacaggacacacagttcattgctggacctcattccagaaaatcctaatcccaaaagtggcattattccaggcagttacagctttgaatcagttttatcagctgtagctgattttaaggctcctgtttttgaacctggaggttctatgcaacaaggcatgtatactcccaaagctgaagtctgggatcaagagtttgaccccgtcatggtcattcttcgaacagtttaccgtagagatgtgcagtctgcaatggacagatatactgcatttttaaaacagagtggaaaatttcctggaaatccctggcctccatataagaaaaggacatcactccatcctagctataaaggtcttatgagacttttgcactgtaaaactttacacattgtgctattcactctgctttacaagattttgatggatcatcaaaatctgtcagaacatgtactctgcatggttttatatctgattgaattaggacttgaaaattctgctgaagaagaatcagatgaagaggcatcagtgggtggaccagaacgttgtcatgacagttggtttcctggcagtaacttagtgtcaaacatgcgacactttataaactatgttagagtaagagttccagagactgctcctgaagtaaagagagactcacctgcaagtactagctctgataacttgggttctttacaaaattctggtacagctcaagttttcagtttagtagcagaacgtagaaagaaatttcaggaaatcatcaatcgcagtagcagtgaagcaaatcaggtggttcgtcccaaaacttcaagtaaatggtctgctcctggttcagctccacagttaactacagccattttggaaattaaagaaagcatattgtctttgctaattaaacttcaccacaaactctcaggaaaacaaaactcctactatcctccttggcttgatgacatagaaattttaatccaaccagaaattcctaaatacagtcatggagatggtataactgccgtggaaagaattttactaaaagctgcatcgcaaagtagaatgaacaaacgcatcattgaagagatatgtagaaaagtgacccctcctgtaccacctaaaaaagtcactgcagcagagaagaaaacattggacaaagaagaaaggcgacagaaggctagagagaggcagcagaaattgcttgcggagtttgcttcacgacagaaaagctttatggaaactgcaatggatgttgattctcctgagaatgatattcctatggagatcaccacggcagaaccacaggtttccgaggcagtatatgactgtgttatttgtggacagagtggcccctcctctgaagatcgacctactggattagttgtactgttacaagcatcctcagttttggggcagtgccgtgacaatgttgagccaaaaaagttgccgatcagtgaagaggagcagatttacccttgggatacctgtgcagccgttcatgatgtgaggctttcattattacagcgttattttaaggatagttcatgtctcttggcagtatcaattggctgggaaggaggtgtttatgtacaaacctgtggtcacacattacatatagattgtcataaatcttacatggaatcattacggaatgaccaggttcttcagggcttctcggtggacaaaggagaattcacgtgtccactctgtaggcagtttgctaacagtgttcttccatgttatcctggaagcaatgtggaaaataacccttggcaacgtcctagcaacaaaagcatacaagatctcataaaggaagtggaggagctgcagggacgaccgggagctttcccatcagaaacaaatttaagtaaagaaatggaatctgtaatgaaagatataaaaaataccactcagaagaaatatagagactatagcaagaccccgggctcaccagacaatgattttctctttatgtactctgttgctagaaccaatttagaacttgaattgattcatcgaggaggcaatttgtgttcaggtggtgcaagcacagctggcaaaaggtcttgtttaaatcagctgtttcatgtattagccttgcacatgcggctttatagcattgactctgagtataatccctggagaaagctcacccagttagaagagatgaatccacagctgggatatgaagaacaacagcctgaggttccaattctttatcatgatgtaacatcccttttgctcatccagatcttaatgatgccacaacccttacgcaaagaccactttacctgcattgtgaaggtactttttaccctactgtacacacaggctcttgcagcactctcagttaaatgcagcgaagaagataggtcagcctggaaacacgcgggagctctcaaaaagagtacatgtgatgcagaaaagtcttacgaagtattactgagctttgtgataagtgaactatttaaaggaaagttataccatgaagaaggaactcaggaatgtgcaatggttaaccctattgcttggtctcctgaatccatggaaaaatgcttacaggacttctgcttaccttttctcagaatcaccagccttcttcagcaccacctttttggggaagatttacctagctgccaggaagaagaagaattttcagttcttgccagctgcctgggacttctgccaacgttttaccaaacagaacatccattcatcagtgcctcctgtctggattggccagttccagcatttgatattataactcagtggtgttttgagataaaatcatttactgaaagacatgcagaacaaggaaaggccttgcttatccaagagtcaaaatggaaattaccacacctactacagttgcctgagaattataacaccatttttcagtactaccacagaaaaacctgtagtgtctgcaccaaggttcctaaagatcctgctgtttgccttgtgtgtggtacttttgtatgcctgaaaggactttgctgcaagcaacaaagttactgtgaatgtgtactgcactctcagaactgtggtgcaggaacaggtattttccttttgatcaatgcatcggtaattatcatcattcgaggtcaccgcttctgcctctggggttccgtgtatttggatgctcatggagaggaagaccgggatcttaggcgaggcaaacctctctacatttgtaaggaaagatacaaagttcttgagcaacagtggatttctcatacttttgatcacatcaataaaagatggggtccacattacaatgggctgtgactctccacctcagcattgcatcgtatcatcattttcgctacgaatttatttttcaacaataagctttaacttaatttgggggattaacacttttgctgagggagaaaaagaaaacatacattatgaagcctttccaaaattaggtgcttggtaatcacgttaatggtataattttttttttttaatatctggagaacattaataacaagttaaattattctttagtggtcattttttaagtgcacaattaataagaagcacaacttgttcacaaactcattcagaaatgattctcccaacaatgcgtatcagctattcattgatacttagagtgggtgtgatttatttgacattttactgcttctttctgtctgtgtgttttaatttgcatctgccaagcataatgcatcttttttcctctgccattcttgtgttgattggagaatttttctgtatgtaattagaaaaaaatgtaaaacatgatttatgtgaaatactgtatagtaaaagttggtctaatagtagaactttaaaattttttcttattgtgaggaatctgttaaaagtttaaagctttgctgaaaactgaattcattctcaggaatttcataaatcttctccccaggtaaataattgaaatagctgtaaaataagtagatagctgctgttaatataatacagtacattttggggggcatatgtgtggttggggggtccttaaaaatcaaaatttgccatttcagttggatgaattactagaggtaataacaaatcttactatgaaatcaagaggtttaagaacatacactgggcagatgttgattccgtgcatgcccaccttttattaccaaacaaggttttgtttatatgattgtattagaaatgctcagacttccccagaaatgaaccataaattttggaacttcctttcagctcaagaggttcagctatattgtatttgtgcagtgtaatcactactatttctgctcggtttcctaaaaggaaaaaaaaggcgcagtggtgatgaccctcatgaatgagccacgcttctgcattcttcttagaaactgctgtgaaaaacaatttatgtttgcagggtttaaaaatcagtaaaaatgggaatgattgagctaaaacccactctatgagaaggaagattactgaaaagcatgtgacatattgctacaaagattttttttcctaaatgattcagtaattgaatgattatttaatatatagtgctatcaagcaatccctggtactttggacttccatggcttgttatataaaattacatttttacatgtaaaaataaactaaacaaatctaatgataaaatatgtcagatccatgttctaaaaaatttttgtaatgacatgacattacaagagtataaaaatggacattaaatcatggccttgcattaaaatatggaaagcagagcagtacatattcaaatgtattcagaaagtcaaaagattacctatcgttctacaataaaatacatggaaatagcttgctatttttatatacatttccaaaatattaagataactttctgtaagagtcaatgattctgttcgactaaatagctgtcctttccaacacattgctacttttttaaatactgtatcataagttcagcctgtcatactttttgcattgatcgttatgaataccagaccatttgtaagtgtggttgaagagcaaaatgctaattgacatctctagtaaatactgttacaggattcatgaacttgaataattctacagtttgaaactctgatgctatatatacatggtataatgtattcagactttgattactacttatttaaaatggaatgttttatggttgtgcatatggatgtgaagtgaaaatattagccttaactttaaaatttgggtgtttgatagtgtttattttgatattggtgaattagtcaccagtaaattttaaaaaagcacttggttgaaaattgtacttgaatacatacatgcatgctgctaaactagaactttaatttttccccataacttttataagtcccatttataaacccacttttaaaaataacaggtccaagttagagtgatgtgtgtatattattcaaaaaaatgtactggtgtgatatcttgtatgaatgatcatttaaatacagtacattactgtagaagctaaattgatctttataattaagcagaaattacaaaactaggaataatcaacattgtaagatatgttaataaaaacctgctgtcatttggtttgtgaaaggtcctt

SEQ ID NO: 33494 - DNA, 8038 bp, Homo sapiens
atggcggcggcggccgcggcggccgtcgggggccagcagccgtcacagcccgagctgcccgcgccggggctggccctagacaaggcggccaccgccgcgcacctcaaggcggccctcagccggccggacaaccgcgcaggtgctgaggagctgcaggcgctgctggagcgggtgctgagcgccgagcggccgctggccgcggctgccggcggcgaggacgcggcggcggccggaggcgggggcggtccgggggcggccgaggaggaggccctggagtggtgtaagtgccttctggcgggcggcggcggctacgacgagttctgcgcggcggtgcgggcctacgatcccgcggcgctctgcggcctggtctggacagccaacttcgtggcctaccgctgccggacgtgcggcatctcgccctgcatgtcgctgtgcgccgagtgcttccaccagggcgaccacaccggacacgacttcaacatgttccgcagccaggccgggggcgcctgcgactgcggggacagcaacgtgatgcgggagagcgggttttgcaaaaggcatcaaattaaatcaagttcaaatattccctgtgtccctaaagacttactgatgatgtctgaatttgttcttccaagatttatattttgtcttattcagtacttaagagaaggctataatgaaccagcagctgatggaccatcagaaaaggaccttaacaaagtccttcagcttttggaacctcaaatttcctttttagaagacctgactaaaatgggaggagcaatgcggtctgttcttactcaggttttgacaaaccaacaaaactacaaagatctgacttctggtcttggagaaaatgcttgtgtaaagaaaagtcatgaaaagtaccttatagctttaaagagctctggacttacatatcctgaggataagcttgtatatggtgtgcaggagccatctgctggtactagttctctggctgttcaaggtttcataggcgcaacaggaactttgggacaagtggattcttcagatgaggatgatcaggatggtagtcaaggtctgggcaagagaaaaagggtaaaactaagcagtggcaccaaagatcaatccataatggatgttttgaagcataaaagcttcctagaagaactattattttggactataaaatatgaattccctcaaaagatggtaactttcttactcaacatgcttccagatcaagagtataaggttgcttttacaaaaacttttgttcagcattatgctttcattatgaaaacactgaagaaaagtcatgaatcagacacaatgtctaacagaattgtgcatattagtgttcagttgttcagcaatgaggagctagccagacaggtaacagaagaatgtcagctgctggatattatggtcactgtgctattatacatgatggaaagttgccttattaaaagtgagctacaagatgaagaaaatagtttacatgtggtagtgaactgtggagaagcattactgaagaataacacttactggcctcttgttagtgattttattaatattctttctcatcaaagtgtggccaagagatttttggaggatcacggtttgttagttacatggatgaactttgtatctttctttcaaggtatgaacttaaacaagcgagaactaaacgagcatgtggaatttgagtctcagacctactatgctgcctttgctgctgaacttgaggcctgtgcacagccaatgtgggggcttttatcacattgtaaagttagggaaactcaagagtatacccgaaatgttgttagatattgccttgaagctcttcaagactggtttgatgctattaacttcgtagacgagccagcacctaaccaagtcacttttcatctgccactacatcgttactatgctatgtttttgagtaaggctgtgaaatgtcaagaactagatttggattctgttttaccagatcaggaaatgttaatgaaactaatgattcacccactccaaattcaagcaagtcttgcagaaatccacagcaatatgtgggtaagaaatggtctgcaaatcaaaggacaagccatgacgtatgtccagtctcatttctgtaattccatgattgatcctgacatttacctgttacaggtttgtgcttctagacttgacccagattattttatttcatccgtctttgaaagatttaaggtagtggatttgttgacaatggcatcacaacatcaaaatacagtacttgatgcagagcatgagaggtcgatgttagaaggcgctcttacatttcttgtgattcttttgagtcttcgtttacatttaggaatgtctgatgatgagattctcagggccgagatggtagcccagctgtgtatgaatgacaggacacacagttcattgctggacctcattccagaaaatcctaatcccaaaagtggcattattccaggcagttacagctttgaatcagttttatcagctgtagctgattttaaggctcctgtttttgaacctggaggttctatgcaacaaggcatgtatactcccaaagctgaagtctgggatcaagagtttgaccccgtcatggtcattcttcgaacagtttaccgtagagatgtgcagtctgcaatggacagatatactgcatttttaaaacagagtggaaaatttcctggaaatccctggcctccatataagaaaaggacatcactccatcctagctataaaggtcttatgagacttttgcactgtaaaactttacacattgtgctattcactctgctttacaagattttgatggatcatcaaaatctgtcagaacatgtactctgcatggttttatatctgattgaattaggacttgaaaattctgctgaagaagaatcagatgaagaggcatcagtgggtggaccagaacgttgtcatgacagttggtttcctggcagtaacttagtgtcaaacatgcgacactttataaactatgttagagtaagagttccagagactgctcctgaagtaaagagagactcacctgcaagtactagctctgataacttgggttctttacaaaattctggtacagctcaagttttcagtttagtagcagaacgtagaaagaaatttcaggaaatcatcaatcgcagtagcagtgaagcaaatcaggtggttcgtcccaaaacttcaagtaaatggtctgctcctggttcagctccacagttaactacagccattttggaaattaaagaaagcatattgtctttgctaattaaacttcaccacaaactctcaggaaaacaaaactcctactatcctccttggcttgatgacatagaaattttaatccaaccagaaattcctaaatacagtcatggagatggtataactgccgtggaaagaattttactaaaagctgcatcgcaaagtagaatgaacaaacgcatcattgaagagatatgtagaaaagtgacccctcctgtaccacctaaaaaagtcactgcagcagagaagaaaacattggacaaagaagaaaggcgacagaaggctagagagaggcagcagaaattgcttgcggagtttgcttcacgacagaaaagctttatggaaactgcaatggatgttgattctcctgagaatgatattcctatggagatcaccacggcagaaccacaggtttccgaggcagtatatgactgtgttatttgtggacagagtggcccctcctctgaagatcgacctactggattagttgtactgttacaagcatcctcagttttggggcagtgccgtgacaatgttgagccaaaaaagttgccgatcagtgaagaggagcagatttacccttgggatacctgtgcagccgttcatgatgtgaggctttcattattacagcgttattttaaggatagttcatgtctcttggcagtatcaattggctgggaaggaggtgtttatgtacaaacctgtggtcacacattacatatagattgtcataaatcttacatggaatcattacggaatgaccaggttcttcagggcttctcggtggacaaaggagaattcacgtgtccactctgtaggcagtttgctaacagtgttcttccatgttatcctggaagcaatgtggaaaataacccttggcaacgtcctagcaacaaaagcatacaagatctcataaaggaagtggaggagctgcagggacgaccgggagctttcccatcagaaacaaatttaagtaaagaaatggaatctgtaatgaaagatataaaaaataccactcagaagaaatatagagactatagcaagaccccgggctcaccagacaatgattttctctttatgtactctgttgctagaaccaatttagaacttgaattgattcatcgaggaggcaatttgtgttcaggtggtgcaagcacagctggcaaaaggtcttgtttaaacttttgcttcattatttttccctttactaaatcagaaattatactgtgccaatatagaaaaagtcatgataaagtttatcctaaatatcagctgtttcatgtattagccttgcacatgcggctttatagcattgactctgagtataatccctggagaaagctcacccagttagaagagatgaatccacagctgggatatgaagaacaacagcctgaggttccaattctttatcatgatgtaacatcccttttgctcatccagatcttaatgatgccacaacccttacgcaaagaccactttacctgcattgtgaaggtactttttaccctactgtacacacaggctcttgcagcactctcagttaaatgcagcgaagaagataggtcagcctggaaacacgcgggagctctcaaaaagagtacatgtgatgcagaaaagtcttacgaagtattactgagctttgtgataagtgaactatttaaaggaaagttataccatgaagaaggaactcaggaatgtgcaatggttaaccctattgcttggtctcctgaatccatggaaaaatgcttacaggacttctgcttaccttttctcagaatcaccagccttcttcagcaccacctttttggggaagatttacctagctgccaggaagaagaagaattttcagttcttgccagctgcctgggacttctgccaacgttttaccaaacagaacatccattcatcagtgcctcctgtctggattggccagttccagcatttgatattataactcagtggtgttttgagataaaatcatttactgaaagacatgcagaacaaggaaaggccttgcttatccaagagtcaaaatggaaattaccacacctactacagttgcctgagaattataacaccatttttcagtactaccacagaaaaacctgtagtgtctgcaccaaggttcctaaagatcctgctgtttgccttgtgtgtggtacttttgtatgcctgaaaggactttgctgcaagcaacaaagttactgtgaatgtgtactgcactctcagaactgtggtgcaggaacaggtattttccttttgatcaatgcatcggtaattatcatcattcgaggtcaccgcttctgcctctggggttccgtgtatttggatgctcatggagaggaagaccgggatcttaggcgaggcaaacctctctacatttgtaaggaaagatacaaagttcttgagcaacagtggatttctcatacttttgatcacatcaataaaagatggggtccacattacaatgggctgtgactctccacctcagcattgcatcgtatcatcattttcgctacgaatttatttttcaacaataagctttaacttaatttgggggattaacacttttgctgagggagaaaaagaaaacatacattatgaagcctttccaaaattaggtgcttggtaatcacgttaatggtataattttttttttttaatatctggagaacattaataacaagttaaattattctttagtggtcattttttaagtgcacaattaataagaagcacaacttgttcacaaactcattcagaaatgattctcccaacaatgcgtatcagctattcattgatacttagagtgggtgtgatttatttgacattttactgcttctttctgtctgtgtgttttaatttgcatctgccaagcataatgcatcttttttcctctgccattcttgtgttgattggagaatttttctgtatgtaattagaaaaaaatgtaaaacatgatttatgtgaaatactgtatagtaaaagttggtctaatagtagaactttaaaattttttcttattgtgaggaatctgttaaaagtttaaagctttgctgaaaactgaattcattctcaggaatttcataaatcttctccccaggtaaataattgaaatagctgtaaaataagtagatagctgctgttaatataatacagtacattttggggggcatatgtgtggttggggggtccttaaaaatcaaaatttgccatttcagttggatgaattactagaggtaataacaaatcttactatgaaatcaagaggtttaagaacatacactgggcagatgttgattccgtgcatgcccaccttttattaccaaacaaggttttgtttatatgattgtattagaaatgctcagacttccccagaaatgaaccataaattttggaacttcctttcagctcaagaggttcagctatattgtatttgtgcagtgtaatcactactatttctgctcggtttcctaaaaggaaaaaaaaggcgcagtggtgatgaccctcatgaatgagccacgcttctgcattcttcttagaaactgctgtgaaaaacaatttatgtttgcagggtttaaaaatcagtaaaaatgggaatgattgagctaaaacccactctatgagaaggaagattactgaaaagcatgtgacatattgctacaaagattttttttcctaaatgattcagtaattgaatgattatttaatatatagtgctatcaagcaatccctggtactttggacttccatggcttgttatataaaattacatttttacatgtaaaaataaactaaacaaatctaatgataaaatatgtcagatccatgttctaaaaaatttttgtaatgacatgacattacaagagtataaaaatggacattaaatcatggccttgcattaaaatatggaaagcagagcagtacatattcaaatgtattcagaaagtcaaaagattacctatcgttctacaataaaatacatggaaatagcttgctatttttatatacatttccaaaatattaagataactttctgtaagagtcaatgattctgttcgactaaatagctgtcctttccaacacattgctacttttttaaatactgtatcataagttcagcctgtcatactttttgcattgatcgttatgaataccagaccatttgtaagtgtggttgaagagcaaaatgctaattgacatctctagtaaatactgttacaggattcatgaacttgaataattctacagtttgaaactctgatgctatatatacatggtataatgtattcagactttgattactacttatttaaaatggaatgttttatggttgtgcatatggatgtgaagtgaaaatattagccttaactttaaaatttgggtgtttgatagtgtttattttgatattggtgaattagtcaccagtaaattttaaaaaagcacttggttgaaaattgtacttgaatacatacatgcatgctgctaaactagaactttaatttttccccataacttttataagtcccatttataaacccacttttaaaaataacaggtccaagttagagtgatgtgtgtatattattcaaaaaaatgtactggtgtgatatcttgtatgaatgatcatttaaatacagtacattactgtagaagctaaattgatctttataattaagcagaaattacaaaactaggaataatcaacattgtaagatatgttaataaaaacctgctgtcatttggtttgtgaaaggtcctt

SEQ ID NO: 33495 - DNA, 3694 bp, Homo sapiens
agaacacgacaccgggaagcgccacccggaggcggaaatcagcccgcgtccggcgcaggcgggagaagggagaggagtgacatccgtttgtcggaagtcgctcctcccccttccttcgctttttttccttgtcattggttcctggcactcgggccccacctcctccggctacgcccctcacggccgcttttcccgcctccgccggggccgagccgctgttcggctgacagttgaggatggccggagccgagggcgccgctgggcggcagtcggagctggagcccgtggtatcgttggtcgacgtccttgaggaggacgaggagctggagaatgaggcgtgcgctgtcctgggcggcagcgactccgagaagtgctcctactctcagggctcagtaaagagacaagcactatatgcctgtagtacctgcaccccagagggagaagaaccagcaggaatttgtttagcttgcagttatgaatgtcatggaagtcacaaactatttgagctatacacaaaaagaaattttcgttgtgattgtggaaacagcaagtttaaaaatttggaatgcaaattacttcctgacaaagcaaaggtaaattctggcaataagtacaatgacaacttttttggattgtactgcatttgcaagagaccttatcctgatcctgaagacgagattccagatgagatgatccagtgcgtagtctgtgaagactggttccatggaaggcatcttggtgccattccccctgagagtggggattttcaggagatggtatgccaggcctgcatgaaacgttgttcttttttgtgggcttatgctgcacaattggcagtaaccaaaatatccactgaggatgatggattggtgcggaacattgatggaataggtgatcaggaagttatcaaacctgaaaatggagagcatcaagatagtaccctcaaagaggatgttccagaacagggaaaggatgatgtccgggaggttaaagtagagcagaacagtgaaccatgtgccggctctagttctgaatctgatctccagacagtgtttaagaatgaaagcctcaacgcagaatcaaaatctggctgcaaacttcaggagcttaaagctaagcagcttataaagaaagacactgccacctattggcccctgaactggcgtagcaagttgtgtacctgccaagactgtatgaaaatgtatggagatctagatgtcttattcctgacagatgaatacgacacagttctggcttatgaaaacaaagggaagattgcccaggccactgacaggagcgatcccctaatggatacccttagcagcatgaatagagtccagcaagtggaactcatttgtgaatacaatgatttgaagactgaacttaaagactatctcaagagatttgctgatgaaggcacggttgttaagagagaggacattcagcagttctttgaagagtttcagtcaaaaaagagaagaagagtggatgggatgcagtattactgcagctagagtggagtatgaagctttctcattcaagccaatgaaaatgcgcttcccattcttggaataaaagaggtgtggttcacatttggccccctttccgtcctcctctgtttggagaggcctcgcgctcccttcattctctttagctgcagtagccaccgtgtggatgctgacttcacagccagcgtcctctgtgactcagctgatgcagctcattccacagacttctccagtgtactcctactccagtgcacccagggttatttgcatagtttttaagtttgattttgttttgagaaagcaaattggtgtcttgtttaatgatctgttatttcactcccagatgtgtgtgttttgccacagagctgttgccttccagaacctcctccgcaggcatcacggaaggctctcttcccgtcacctagaacctctacaggtcccctcgcccctatgatcgtggtgccttgggtcaaagcttcctcaagcctggtctgctccttctttcacgtccctgttttctgaggtttggtcatagcttagaaaggatcttggggcttgttttctctaggcccaacctccagagtagccaggactgatggttttctggtctggatgtctgtcacaggcggagagattaacagatgacagggttgaggaagcaagcctttgttatgaattttactaatacagttcaagtgaaattttcgttcatgattctattggcactagaattagaatttcagtactgtagtgctcacagggcttcctggagaacatttgcccgtatactagtcccttctctgctgcctagaaaacagaccgggtctcacccctgtgaaatcttggtggtttacgaagtcctctggatttcttgatattatcagggatattcataagcatatatcaaaaatggacctattttgatattctgttatgaaaatgttattagaaccccaataaattattatttttcccccttgaatctgctaaagaaaacagatcctgacttagcttacttgaaataagcagggcagggagccctgttttggaagagacagactgtggaagagattacaaacaaggcccgaggctgcacgaatgatgagttttgtgtatataatgttaatgtccaccgccacttccctaacgactatgagatcttttttttgaagatcctcatggaaggttgtacagagccccacatttgaggggaagtcctttcagttgatatgagatctctttaacacccctcagtctatgtaggaaatgccttgtgatacatagagaaccctcagcttctctctgcctctggaggaccaaggtctttcctgacagtcggagacacaccttgatgtatgttaataaaagcatttcaggctgtggggccaccatgtatattaatactccttatgtgtccagcatctgtgtattcattcgagtgcccaatccctggatgagatgaactaggccttataaaaagtcaaagcctcaaagaaatggcacaaccatgttcttcggcactcaggctcctaattgcagatcctcacgaagggtggtatgtggagctggaaggtcttgtggccacaggacatgctggtgagccctgagctggccttgtgcagagggctccgttcaaaggctcggggtgtctttgaggttgtttatcaagctggggaactcttccaagtctgacaatgtttcgaaccctttttgcaaggttgcactattagtataccatcatgtccggaaaacttttaatcttctcaaatatctgatgtaactaccagaaagtcccttacttcctatgaccaatcaggaccaagtcttggaggtgatgtgttacattacgtgcagcacaatagtaccgatcagttaactcagcgctgaagggcttgttttatgaaaggtactattccttctttcacattaactggaaacctctttttttacctgttgttcacaactagttttcttattgactgtattggactgtctcttcttgtagagactgattttggccaacatattaatgcatgttttatgcaaaacacaaatatgatattagttgcttttaaggagttctggcattgtatgtgcatttttgtagaaattgttactggacttataattacatacttaactctgatcaggtttctgtaaaatttaaataaaaccaatacaaaata

SEQ ID NO: 33496 - DNA, 3552 bp, Homo sapiens
agaacacgacaccgggaagcgccacccggaggcggaaatcagcccgcgtccggcgcaggcgggagaagggagaggagtgacatccgtttgtcggaagtcgctcctcccccttccttcgctttttttccttgtcattggttcctggcactcgggccccacctcctccggctacgcccctcacggccgcttttcccgcctccgccggggccgagccgctgttcggctgacagttgaggatggccggagccgagggcgccgctgggcggcagtcggagctggagcccgtggtatcgttggtcgacgtccttgaggaggacgaggagctggagaatgaggcgtgcgctgtcctgggcggcagcgactccgagaagtgctcctactctcagaaattttcgttgtgattgtggaaacagcaagtttaaaaatttggaatgcaaattacttcctgacaaagcaaaggtaaattctggcaataagtacaatgacaacttttttggattgtactgcatttgcaagagaccttatcctgatcctgaagacgagattccagatgagatgatccagtgcgtagtctgtgaagactggttccatggaaggcatcttggtgccattccccctgagagtggggattttcaggagatggtatgccaggcctgcatgaaacgttgttcttttttgtgggcttatgctgcacaattggcagtaaccaaaatatccactgaggatgatggattggtgcggaacattgatggaataggtgatcaggaagttatcaaacctgaaaatggagagcatcaagatagtaccctcaaagaggatgttccagaacagggaaaggatgatgtccgggaggttaaagtagagcagaacagtgaaccatgtgccggctctagttctgaatctgatctccagacagtgtttaagaatgaaagcctcaacgcagaatcaaaatctggctgcaaacttcaggagcttaaagctaagcagcttataaagaaagacactgccacctattggcccctgaactggcgtagcaagttgtgtacctgccaagactgtatgaaaatgtatggagatctagatgtcttattcctgacagatgaatacgacacagttctggcttatgaaaacaaagggaagattgcccaggccactgacaggagcgatcccctaatggatacccttagcagcatgaatagagtccagcaagtggaactcatttgtgaatacaatgatttgaagactgaacttaaagactatctcaagagatttgctgatgaaggcacggttgttaagagagaggacattcagcagttctttgaagagtttcagtcaaaaaagagaagaagagtggatgggatgcagtattactgcagctagagtggagtatgaagctttctcattcaagccaatgaaaatgcgcttcccattcttggaataaaagaggtgtggttcacatttggccccctttccgtcctcctctgtttggagaggcctcgcgctcccttcattctctttagctgcagtagccaccgtgtggatgctgacttcacagccagcgtcctctgtgactcagctgatgcagctcattccacagacttctccagtgtactcctactccagtgcacccagggttatttgcatagtttttaagtttgattttgttttgagaaagcaaattggtgtcttgtttaatgatctgttatttcactcccagatgtgtgtgttttgccacagagctgttgccttccagaacctcctccgcaggcatcacggaaggctctcttcccgtcacctagaacctctacaggtcccctcgcccctatgatcgtggtgccttgggtcaaagcttcctcaagcctggtctgctccttctttcacgtccctgttttctgaggtttggtcatagcttagaaaggatcttggggcttgttttctctaggcccaacctccagagtagccaggactgatggttttctggtctggatgtctgtcacaggcggagagattaacagatgacagggttgaggaagcaagcctttgttatgaattttactaatacagttcaagtgaaattttcgttcatgattctattggcactagaattagaatttcagtactgtagtgctcacagggcttcctggagaacatttgcccgtatactagtcccttctctgctgcctagaaaacagaccgggtctcacccctgtgaaatcttggtggtttacgaagtcctctggatttcttgatattatcagggatattcataagcatatatcaaaaatggacctattttgatattctgttatgaaaatgttattagaaccccaataaattattatttttcccccttgaatctgctaaagaaaacagatcctgacttagcttacttgaaataagcagggcagggagccctgttttggaagagacagactgtggaagagattacaaacaaggcccgaggctgcacgaatgatgagttttgtgtatataatgttaatgtccaccgccacttccctaacgactatgagatcttttttttgaagatcctcatggaaggttgtacagagccccacatttgaggggaagtcctttcagttgatatgagatctctttaacacccctcagtctatgtaggaaatgccttgtgatacatagagaaccctcagcttctctctgcctctggaggaccaaggtctttcctgacagtcggagacacaccttgatgtatgttaataaaagcatttcaggctgtggggccaccatgtatattaatactccttatgtgtccagcatctgtgtattcattcgagtgcccaatccctggatgagatgaactaggccttataaaaagtcaaagcctcaaagaaatggcacaaccatgttcttcggcactcaggctcctaattgcagatcctcacgaagggtggtatgtggagctggaaggtcttgtggccacaggacatgctggtgagccctgagctggccttgtgcagagggctccgttcaaaggctcggggtgtctttgaggttgtttatcaagctggggaactcttccaagtctgacaatgtttcgaaccctttttgcaaggttgcactattagtataccatcatgtccggaaaacttttaatcttctcaaatatctgatgtaactaccagaaagtcccttacttcctatgaccaatcaggaccaagtcttggaggtgatgtgttacattacgtgcagcacaatagtaccgatcagttaactcagcgctgaagggcttgttttatgaaaggtactattccttctttcacattaactggaaacctctttttttacctgttgttcacaactagttttcttattgactgtattggactgtctcttcttgtagagactgattttggccaacatattaatgcatgttttatgcaaaacacaaatatgatattagttgcttttaaggagttctggcattgtatgtgcatttttgtagaaattgttactggacttataattacatacttaactctgatcaggtttctgtaaaatttaaataaaaccaat

SEQ ID NO: 33497 - DNA, 3550 bp, Homo sapiens
agaacacgacaccgggaagcgccacccggaggcggaaatcagcccgcgtccggcgcaggcgggagaagggagaggagtgacatccgtttgtcggaagtcgctcctcccccttccttcgctttttttccttgtcattggttcctggcactcgggccccacctcctccggctacgcccctcacggccgcttttcccgcctccgccggggccgagccgctgttcggctgacagttgaggatggccggagccgagggcgccgctgggcggcagtcggagctggagcccgtggtatcgttggtcgacgtccttgaggaggacgaggagctggagaatgaggcgtgcgctgtcctgggcggcagcgactccgagaagtgctcctactctcagaaattttcgttgtgattgtggaaacagcaagtttaaaaatttggaatgcaaattacttcctgacaaagcaaaggtaaattctggcaataagtacaatgacaacttttttggattgtactgcatttgcaagagaccttatcctgatcctgaagacgagattccagatgagatgatccagtgcgtagtctgtgaagactggttccatggaaggcatcttggtgccattccccctgagagtggggattttcaggagatggtatgccaggcctgcatgaaacgttgttcttttttgtgggcttatgctgcacaattggcagtaaccaaaatatccactgaggatgatggattggtgcggaacattgatggaataggtgatcaggaagttatcaaacctgaaaatggagagcatcaagatagtaccctcaaagaggatgttccagaacagggaaaggatgatgtccgggaggttaaagtagagcagaacagtgaaccatgtgccggctctagttctgaatctgatctccagacagtgtttaagaatgaaagcctcaacgcagaatcaaaatctggctgcaaacttcaggagcttaaagctaagcagcttataaagaaagacactgccacctattggcccctgaactggcgtagcaagttgtgtacctgccaagactgtatgaaaatgtatggagatctagatgtcttattcctgacagatgaatacgacacagttctggcttatgaaaacaaagggaagattgcccaggccactgacaggagcgatcccctaatggatacccttagcagcatgaatagagtccagcaagtggaactcatttgtgaatacaatgatttgaagactgaacttaaagactatctcaagagatttgctgatgaaggcacggttgttaagagagaggacattcagcagttctttgaagagtttcagaaaaaagagaagaagagtggatgggatgcagtattactgcagctagagtggagtatgaagctttctcattcaagccaatgaaaatgcgcttcccattcttggaataaaagaggtgtggttcacatttggccccctttccgtcctcctctgtttggagaggcctcgcgctcccttcattctctttagctgcagtagccaccgtgtggatgctgacttcacagccagcgtcctctgtgactcagctgatgcagctcattccacagacttctccagtgtactcctactccagtgcacccagggttatttgcatagtttttaagtttgattttgttttgagaaagcaaattggtgtcttgtttaatgatctgttatttcactcccagatgtgtgtgttttgccacagagctgttgccttccagaacctcctccgcaggcatcacggaaggctctcttcccgtcacctagaacctctacaggtcccctcgcccctatgatcgtggtgccttgggtcaaagcttcctcaagcctggtctgctccttctttcacgtccctgttttctgaggtttggtcatagcttagaaaggatcttggggcttgttttctctaggcccaacctccagagtagccaggactgatggttttctggtctggatgtctgtcacaggcggagagattaacagatgacagggttgaggaagcaagcctttgttatgaattttactaatacagttcaagtgaaattttcgttcatgattctattggcactagaattagaatttcagtactgtagtgctcacagggcttcctggagaacatttgcccgtatactagtcccttctctgctgcctagaaaacagaccgggtctcacccctgtgaaatcttggtggtttacgaagtcctctggatttcttgatattatcagggatattcataagcatatatcaaaaatggacctattttgatattctgttatgaaaatgttattagaaccccaataaattattatttttcccccttgaatctgctaaagaaaacagatcctgacttagcttacttgaaataagcagggcagggagccctgttttggaagagacagactgtggaagagattacaaacaaggcccgaggctgcacgaatgatgagttttgtgtatataatgttaatgtccaccgccacttccctaacgactatgagatcttttttttgaagatcctcatggaaggttgtacagagccccacatttgaggggaagtcctttcagttgatatgagatctctttaacacccctcagtctatgtaggaaatgccttgtgatacatagagaaccctcagcttctctctgcctctggaggaccaaggtctttcctgacagtcggagacacaccttgatgtatgttaataaaagcatttcaggctgtggggccaccatgtatattaatactccttatgtgtccagcatctgtgtattcattcgagtgcccaatccctggatgagatgaactaggccttataaaaagtcaaagcctcaaagaaatggcacaaccatgttcttcggcactcaggctcctaattgcagatcctcacgaagggtggtatgtggagctggaaggtcttgtggccacaggacatgctggtgagccctgagctggccttgtgcagagggctccgttcaaaggctcggggtgtctttgaggttgtttatcaagctggggaactcttccaagtctgacaatgtttcgaaccctttttgcaaggttgcactattagtataccatcatgtccggaaaacttttaatcttctcaaatatctgatgtaactaccagaaagtcccttacttcctatgaccaatcaggaccaagtcttggaggtgatgtgttacattacgtgcagcacaatagtaccgatcagttaactcagcgctgaagggcttgttttatgaaaggtactattccttctttcacattaactggaaacctctttttttacctgttgttcacaactagttttcttattgactgtattggactgtctcttcttgtagagactgattttggccaacatattaatgcatgttttatgcaaaacacaaatatgatattagttgcttttaaggagttctggcattgtatgtgcatttttgtagaaattgttactggacttataattacatacttaactctgatcaggtttctgtaaaatttaaataaaaccaat

SEQ ID NO: 33498 - DNA, 5179 bp, Homo sapiens
ccaagatggtggcgctgggctcggggtgactacaggagacgacggggccttttcccttcgccaggacccgacacaccaggcttcgctcgctcgcgcacccctccgccgcgtagccatccgccagcgcgggcgcccgccatccgccgcctacttacgcttcacctctgccgacccggcgcgctcggctgcgggcggcggcgcctccttcggctcctcctcggaatagctcgcggcctgtagcccctggcaggagggcccctcagccccccggtgtggacaggcagcggcggctggcgacgaacgccgggatttcggcggccccggcgctccctttcccggcctcgttttccggataaggaagcgcgggtcccgcatgagccccggcggtggcggcagcgaaagagaacgaggcggtggcgggcggaggcggcgggcgagggcgactacgaccagtgaggcggccgccgcagcccaggcgcgggggcgacgacaggttaaaaatctgtaagagcctgattttagaattcaccagctcctcagaagtttggcgaaatatgagttattaagcctacgctcagatcaaggtagcagctagactggtgtgacaacctgtttttaatcagtgactcaaagctgtgatcaccctgatgtcaccgaatggccacagcttgtaaaagatcaggagaacctcagtctgacgacattgaagctagccgaatgaagcgagcagctgcaaagcatctaatagaacgctactaccaccagttaactgagggctgtggaaatgaagcctgcacgaatgagttttgtgcttcctgtccaacttttcttcgtatggataataatgcagcagctattaaagccctcgagctttataagattaatgcaaaactctgtgatcctcatccctccaagaaaggagcaagctcagcttaccttgagaactcgaaaggtgcccccaacaactcctgctctgagataaaaatgaacaagaaaggcgctagaattgattttaaagatgtgacttacttaacagaagagaaggtatatgaaattcttgaattatgtagagaaagagaggattattcccctttaatccgtgttattggaagagttttttctagtgctgaggcattggtacagagcttccggaaagttaaacaacacaccaaggaagaactgaaatctcttcaagcaaaagatgaagacaaagatgaagatgaaaaggaaaaagctgcatgttctgctgctgctatggaagaagactcagaagcatcttcctcaaggataggtgatagctcacagggagacaacaatttgcaaaaattaggccctgatgatgtgtctgtggatattgatgccattagaagggtctacaccagattgctctctaatgaaaaaattgaaactgcctttctcaatgcacttgtatatttgtcacctaacgtggaatgtgacttgacgtatcacaatgtatactctcgagatcctaattatctgaatttgttcattatcgtaatggagaatagaaatctccacagtcctgaatatctggaaatggctttgccattattttgcaaagcgatgagcaagctaccccttgcagcccaaggaaaactgatcagactgtggtctaaatacaatgcagaccagattcggagaatgatggagacatttcagcaacttattacttataaagtcataagcaatgaatttaacagtcgaaatctagtgaatgatgatgatgccattgttgctgcttcgaagtgcttgaaaatggtttactatgcaaatgtagtgggaggggaagtggacacaaatcacaatgaagaagatgatgaagagcccatccctgagtccagcgagctgacacttcaggaacttttgggagaagaaagaagaaacaagaaaggtcctcgagtggaccccctggaaactgaacttggtgttaaaaccctggattgtcgaaaaccacttatcccttttgaagagtttattaatgaaccactgaatgaggttctagaaatggataaagattatacttttttcaaagtagaaacagagaacaaattctcttttatgacatgtccctttatattgaatgctgtcacaaagaatttgggattatattatgacaatagaattcgcatgtacagtgaacgaagaatcactgttctctacagcttagttcaaggacagcagttgaatccatatttgagactcaaagttagacgtgaccatatcatagatgatgcacttgtccggctagagatgatcgctatggaaaatcctgcagacttgaagaagcagttgtatgtggaatttgaaggagaacaaggagttgatgagggaggtgtttccaaagaattttttcagctggttgtggaggaaatcttcaatccagatattggtatgttcacatacgatgaatctacaaaattgttttggtttaatccatcttcttttgaaactgagggtcagtttactctgattggcatagtactgggtctggctatttacaataactgtatactggatgtacattttcccatggttgtctacaggaagctaatggggaaaaaaggaacttttcgtgacttgggagactctcacccagttctatatcagagtttaaaagatttattggagtatgaagggaatgtggaagatgacatgatgatcactttccagatatcacagacagatctttttggtaacccaatgatgtatgatctaaaggaaaatggtgataaaattccaattacaaatgaaaacaggaaggaatttgtcaatctttattctgactacattctcaataaatcagtagaaaaacagttcaaggcttttcggagaggttttcatatggtgaccaatgaatctcccttaaagtacttattcagaccagaagaaattgaattgcttatatgtggaagccggaatctagatttccaagcactagaagaaactacagaatatgacggtggctataccagggactctgttctgattagggagttctgggaaatcgttcattcatttacagatgaacagaaaagactcttcttgcagtttacaacgggcacagacagagcacctgtgggaggactaggaaaattaaagatgattatagccaaaaatggcccagacacagaaaggttacctacatctcatacttgctttaatgtgcttttacttccggaatactcaagcaaagaaaaacttaaagagagattgttgaaggccatcacgtatgccaaaggatttggcatgctgtaaaacaaaacaaaacaaaataaaacaaaaaaaaggaaggaaaaaaaaagaaaaaatttaaaaaattttaaaaatataacgagggataaatttttggtggtgatagtgtcccagtacaaaaaggctgtaagatagtcaaccacagtagtcacctatgtctgtgcctcccttctttattggggacatgtgggctggaacagcagatttcagctacatatatgaacaaatcctttattattattataattatttttttgcgtgaaagtgttacatattctttcacttgtatgtacagagaggtttttctgaatatttattttaagggttaaatcacttttgcttgtgtttattactgcttgaggttgagccttttgagtatttaaaaaatatataccaacagaactactctcccaaggaaaatattgccaccatttgtagaccacgtaaccttcaagtatgtgctacttttttgtccctgtatctaactcaaatcaggaactgtattttttttaatgatttgcttttgaaacttgaagtcttgaaaacagtgtgatgcaattactgctgttctagcccccaaagagttttctgtgcaaaatcttgagaatcaatcaataaagaaagatggaaggaagggagaaattggaatgttttaactgcagccctcagaactttagtaacagcacaacaaattaaaaacaaaaacaactcatgccacagtatgtcgtcttcatgtgtcttgcaatgaactgtttcagtagccaatcctctttcttagtatatgaaaggacagggatttttgttcttgttgttctcgttgttgttttaagtttactggggaaagtgcatttggccaaatgaaatggtagtcaagcctattgcaacaaagttaggaagtttgttgtttgtttattataaacaaaaagcatgtgaaagtgcacttaagatagagtttttattaattacttacttattacctagattttaaatagacaatccaaagtctccccttcgtgttgccatcatcttgttgaatcagccattttatcgaggcacgtgatcagtgttgcaacataatgaaaaagatggctactgtgccttgtgttacttaatcatacagtaagctgacctggaaatgaatgaaactattactcctaagaattacattgtatagccccacagattaaatttaattaattaattcaaaacatgttaaacgttactttcatgtactatggaaaagtacaagtaggtttacattactgatttccagaagtaagtagtttcccctttcctagtcttctgtgtatgtgatgttgttaatttcttttattgcattataaaataaaaggattatgtatttttaactaaggtgagacattgatatatccttttgctacaagctatagctaatgtgctgagcttgtgccttggtgattgattgattgattgactgattgttttaactgattactgtagatcaacctgatgatttgtttgtttgaaattggcaggaaaaatgcagctttcaaatcattggggggagaaaaaggatgtctttcaggattattttaattaatttttttcataattgagacagaactgtttgttatgtaccataatgctaaataaaactgtggcacttttcaccataatttaatttagtggaaaaagaagacaatgctttccatattgtgataaggtaacatggggtttttctgggccagcctttagaacactgttagggtacatacgctaccttgatgaaagggaccttcgtgcaactgtagtcatcttaaaggcttctcatccactgtgcttcttaatgtgtaattaaagtgaggagaaattaaatactctgagggcgttttatataataaattcgtgaagaaatgtgtgctcttca

SEQ ID NO: 33499 - DNA, 4507 bp, Homo sapiens
atgagatctgtgtgtcatagatcaggagaacctcagtctgacgacattgaagctagccgaatgaagcgagcagctgcaaagcatctaatagaacgctactaccaccagttaactgagggctgtggaaatgaagcctgcacgaatgagttttgtgcttcctgtccaacttttcttcgtatggataataatgcagcagctattaaagccctcgagctttataagattaatgcaaaactctgtgatcctcatccctccaagaaaggagcaagctcagcttaccttgagaactcgaaaggtgcccccaacaactcctgctctgagataaaaatgaacaagaaaggcgctagaattgattttaaagatgtgacttacttaacagaagagaaggtatatgaaattcttgaattatgtagagaaagagaggattattcccctttaatccgtgttattggaagagttttttctagtgctgaggcattggtacagagcttccggaaagttaaacaacacaccaaggaagaactgaaatctcttcaagcaaaagatgaagacaaagatgaagatgaaaaggaaaaagctgcatgttctgctgctgctatggaagaagactcagaagcatcttcctcaaggataggtgatagctcacagggagacaacaatttgcaaaaattaggccctgatgatgtgtctgtggatattgatgccattagaagggtctacaccagattgctctctaatgaaaaaattgaaactgcctttctcaatgcacttgtatatttgtcacctaacgtggaatgtgacttgacgtatcacaatgtatactctcgagatcctaattatctgaatttgttcattatcgtaatggagaatagaaatctccacagtcctgaatatctggaaatggctttgccattattttgcaaagcgatgagcaagctaccccttgcagcccaaggaaaactgatcagactgtggtctaaatacaatgcagaccagattcggagaatgatggagacatttcagcaacttattacttataaagtcataagcaatgaatttaacagtcgaaatctagtgaatgatgatgatgccattgttgctgcttcgaagtgcttgaaaatggtttactatgcaaatgtagtgggaggggaagtggacacaaatcacaatgaagaagatgatgaagagcccatccctgagtccagcgagctgacacttcaggaacttttgggagaagaaagaagaaacaagaaaggtcctcgagtggaccccctggaaactgaacttggtgttaaaaccctggattgtcgaaaaccacttatcccttttgaagagtttattaatgaaccactgaatgaggttctagaaatggataaagattatacttttttcaaagtagaaacagagaacaaattctcttttatgacatgtccctttatattgaatgctgtcacaaagaatttgggattatattatgacaatagaattcgcatgtacagtgaacgaagaatcactgttctctacagcttagttcaaggacagcagttgaatccatatttgagactcaaagttagacgtgaccatatcatagatgatgcacttgtccggctagagatgatcgctatggaaaatcctgcagacttgaagaagcagttgtatgtggaatttgaaggagaacaaggagttgatgagggaggtgtttccaaagaattttttcagctggttgtggaggaaatcttcaatccagatattggtatgttcacatacgatgaatctacaaaattgttttggtttaatccatcttcttttgaaactgagggtcagtttactctgattggcatagtactgggtctggctatttacaataactgtatactggatgtacattttcccatggttgtctacaggaagctaatggggaaaaaaggaacttttcgtgacttgggagactctcacccagttctatatcagagtttaaaagatttattggagtatgaagggaatgtggaagatgacatgatgatcactttccagatatcacagacagatctttttggtaacccaatgatgtatgatctaaaggaaaatggtgataaaattccaattacaaatgaaaacaggaaggaatttgtcaatctttattctgactacattctcaataaatcagtagaaaaacagttcaaggcttttcggagaggttttcatatggtgaccaatgaatctcccttaaagtacttattcagaccagaagaaattgaattgcttatatgtggaagccggaatctagatttccaagcactagaagaaactacagaatatgacggtggctataccagggactctgttctgattagggagttctgggaaatcgttcattcatttacagatgaacagaaaagactcttcttgcagtttacaacgggcacagacagagcacctgtgggaggactaggaaaattaaagatgattatagccaaaaatggcccagacacagaaaggttacctacatctcatacttgctttaatgtgcttttacttccggaatactcaagcaaagaaaaacttaaagagagattgttgaaggccatcacgtatgccaaaggatttggcatgctgtaaaacaaaacaaaacaaaataaaacaaaaaaaaggaaggaaaaaaaaagaaaaaatttaaaaaattttaaaaatataacgagggataaatttttggtggtgatagtgtcccagtacaaaaaggctgtaagatagtcaaccacagtagtcacctatgtctgtgcctcccttctttattggggacatgtgggctggaacagcagatttcagctacatatatgaacaaatcctttattattattataattatttttttgcgtgaaagtgttacatattctttcacttgtatgtacagagaggtttttctgaatatttattttaagggttaaatcacttttgcttgtgtttattactgcttgaggttgagccttttgagtatttaaaaaatatataccaacagaactactctcccaaggaaaatattgccaccatttgtagaccacgtaaccttcaagtatgtgctacttttttgtccctgtatctaactcaaatcaggaactgtattttttttaatgatttgcttttgaaacttgaagtcttgaaaacagtgtgatgcaattactgctgttctagcccccaaagagttttctgtgcaaaatcttgagaatcaatcaataaagaaagatggaaggaagggagaaattggaatgttttaactgcagccctcagaactttagtaacagcacaacaaattaaaaacaaaaacaactcatgccacagtatgtcgtcttcatgtgtcttgcaatgaactgtttcagtagccaatcctctttcttagtatatgaaaggacagggatttttgttcttgttgttctcgttgttgttttaagtttactggggaaagtgcatttggccaaatgaaatggtagtcaagcctattgcaacaaagttaggaagtttgttgtttgtttattataaacaaaaagcatgtgaaagtgcacttaagatagagtttttattaattacttacttattacctagattttaaatagacaatccaaagtctccccttcgtgttgccatcatcttgttgaatcagccattttatcgaggcacgtgatcagtgttgcaacataatgaaaaagatggctactgtgccttgtgttacttaatcatacagtaagctgacctggaaatgaatgaaactattactcctaagaattacattgtatagccccacagattaaatttaattaattaattcaaaacatgttaaacgttactttcatgtactatggaaaagtacaagtaggtttacattactgatttccagaagtaagtagtttcccctttcctagtcttctgtgtatgtgatgttgttaatttcttttattgcattataaaataaaaggattatgtatttttaactaaggtgagacattgatatatccttttgctacaagctatagctaatgtgctgagcttgtgccttggtgattgattgattgattgactgattgttttaactgattactgtagatcaacctgatgatttgtttgtttgaaattggcaggaaaaatgcagctttcaaatcattggggggagaaaaaggatgtctttcaggattattttaattaatttttttcataattgagacagaactgtttgttatgtaccataatgctaaataaaactgtggcacttttcaccataatttaatttagtggaaaaagaagacaatgctttccatattgtgataaggtaacatggggtttttctgggccagcctttagaacactgttagggtacatacgctaccttgatgaaagggaccttcgtgcaactgtagtcatcttaaaggcttctcatccactgtgcttcttaatgtgtaattaaagtgaggagaaattaaatactctgagggcgttttatataataaattcgtgaaga

SEQ ID NO: 33500 - DNA, 4516 bp, Homo sapiens
atggagaagctgcaccagtgttattggaaatcaggagaacctcagtctgacgacattgaagctagccgaatgaagcgagcagctgcaaagcatctaatagaacgctactaccaccagttaactgagggctgtggaaatgaagcctgcacgaatgagttttgtgcttcctgtccaacttttcttcgtatggataataatgcagcagctattaaagccctcgagctttataagattaatgcaaaactctgtgatcctcatccctccaagaaaggagcaagctcagcttaccttgagaactcgaaaggtgcccccaacaactcctgctctgagataaaaatgaacaagaaaggcgctagaattgattttaaagatgtgacttacttaacagaagagaaggtatatgaaattcttgaattatgtagagaaagagaggattattcccctttaatccgtgttattggaagagttttttctagtgctgaggcattggtacagagcttccggaaagttaaacaacacaccaaggaagaactgaaatctcttcaagcaaaagatgaagacaaagatgaagatgaaaaggaaaaagctgcatgttctgctgctgctatggaagaagactcagaagcatcttcctcaaggataggtgatagctcacagggagacaacaatttgcaaaaattaggccctgatgatgtgtctgtggatattgatgccattagaagggtctacaccagattgctctctaatgaaaaaattgaaactgcctttctcaatgcacttgtatatttgtcacctaacgtggaatgtgacttgacgtatcacaatgtatactctcgagatcctaattatctgaatttgttcattatcgtaatggagaatagaaatctccacagtcctgaatatctggaaatggctttgccattattttgcaaagcgatgagcaagctaccccttgcagcccaaggaaaactgatcagactgtggtctaaatacaatgcagaccagattcggagaatgatggagacatttcagcaacttattacttataaagtcataagcaatgaatttaacagtcgaaatctagtgaatgatgatgatgccattgttgctgcttcgaagtgcttgaaaatggtttactatgcaaatgtagtgggaggggaagtggacacaaatcacaatgaagaagatgatgaagagcccatccctgagtccagcgagctgacacttcaggaacttttgggagaagaaagaagaaacaagaaaggtcctcgagtggaccccctggaaactgaacttggtgttaaaaccctggattgtcgaaaaccacttatcccttttgaagagtttattaatgaaccactgaatgaggttctagaaatggataaagattatacttttttcaaagtagaaacagagaacaaattctcttttatgacatgtccctttatattgaatgctgtcacaaagaatttgggattatattatgacaatagaattcgcatgtacagtgaacgaagaatcactgttctctacagcttagttcaaggacagcagttgaatccatatttgagactcaaagttagacgtgaccatatcatagatgatgcacttgtccggctagagatgatcgctatggaaaatcctgcagacttgaagaagcagttgtatgtggaatttgaaggagaacaaggagttgatgagggaggtgtttccaaagaattttttcagctggttgtggaggaaatcttcaatccagatattggtatgttcacatacgatgaatctacaaaattgttttggtttaatccatcttcttttgaaactgagggtcagtttactctgattggcatagtactgggtctggctatttacaataactgtatactggatgtacattttcccatggttgtctacaggaagctaatggggaaaaaaggaacttttcgtgacttgggagactctcacccagttctatatcagagtttaaaagatttattggagtatgaagggaatgtggaagatgacatgatgatcactttccagatatcacagacagatctttttggtaacccaatgatgtatgatctaaaggaaaatggtgataaaattccaattacaaatgaaaacaggaaggaatttgtcaatctttattctgactacattctcaataaatcagtagaaaaacagttcaaggcttttcggagaggttttcatatggtgaccaatgaatctcccttaaagtacttattcagaccagaagaaattgaattgcttatatgtggaagccggaatctagatttccaagcactagaagaaactacagaatatgacggtggctataccagggactctgttctgattagggagttctgggaaatcgttcattcatttacagatgaacagaaaagactcttcttgcagtttacaacgggcacagacagagcacctgtgggaggactaggaaaattaaagatgattatagccaaaaatggcccagacacagaaaggttacctacatctcatacttgctttaatgtgcttttacttccggaatactcaagcaaagaaaaacttaaagagagattgttgaaggccatcacgtatgccaaaggatttggcatgctgtaaaacaaaacaaaacaaaataaaacaaaaaaaaggaaggaaaaaaaaagaaaaaatttaaaaaattttaaaaatataacgagggataaatttttggtggtgatagtgtcccagtacaaaaaggctgtaagatagtcaaccacagtagtcacctatgtctgtgcctcccttctttattggggacatgtgggctggaacagcagatttcagctacatatatgaacaaatcctttattattattataattatttttttgcgtgaaagtgttacatattctttcacttgtatgtacagagaggtttttctgaatatttattttaagggttaaatcacttttgcttgtgtttattactgcttgaggttgagccttttgagtatttaaaaaatatataccaacagaactactctcccaaggaaaatattgccaccatttgtagaccacgtaaccttcaagtatgtgctacttttttgtccctgtatctaactcaaatcaggaactgtattttttttaatgatttgcttttgaaacttgaagtcttgaaaacagtgtgatgcaattactgctgttctagcccccaaagagttttctgtgcaaaatcttgagaatcaatcaataaagaaagatggaaggaagggagaaattggaatgttttaactgcagccctcagaactttagtaacagcacaacaaattaaaaacaaaaacaactcatgccacagtatgtcgtcttcatgtgtcttgcaatgaactgtttcagtagccaatcctctttcttagtatatgaaaggacagggatttttgttcttgttgttctcgttgttgttttaagtttactggggaaagtgcatttggccaaatgaaatggtagtcaagcctattgcaacaaagttaggaagtttgttgtttgtttattataaacaaaaagcatgtgaaagtgcacttaagatagagtttttattaattacttacttattacctagattttaaatagacaatccaaagtctccccttcgtgttgccatcatcttgttgaatcagccattttatcgaggcacgtgatcagtgttgcaacataatgaaaaagatggctactgtgccttgtgttacttaatcatacagtaagctgacctggaaatgaatgaaactattactcctaagaattacattgtatagccccacagattaaatttaattaattaattcaaaacatgttaaacgttactttcatgtactatggaaaagtacaagtaggtttacattactgatttccagaagtaagtagtttcccctttcctagtcttctgtgtatgtgatgttgttaatttcttttattgcattataaaataaaaggattatgtatttttaactaaggtgagacattgatatatccttttgctacaagctatagctaatgtgctgagcttgtgccttggtgattgattgattgattgactgattgttttaactgattactgtagatcaacctgatgatttgtttgtttgaaattggcaggaaaaatgcagctttcaaatcattggggggagaaaaaggatgtctttcaggattattttaattaatttttttcataattgagacagaactgtttgttatgtaccataatgctaaataaaactgtggcacttttcaccataatttaatttagtggaaaaagaagacaatgctttccatattgtgataaggtaacatggggtttttctgggccagcctttagaacactgttagggtacatacgctaccttgatgaaagggaccttcgtgcaactgtagtcatcttaaaggcttctcatccactgtgcttcttaatgtgtaattaaagtgaggagaaattaaatactctgagggcgttttatataataaattcgtgaaga

SEQ ID NO: 33501 - DNA, 2699 bp, Homo sapiens
atggagaagctgcaccagtgttattggaactcttctgtctgggagatacaagtttggaagcaatcttggggtacttacccacaaggctggtggagaccagatcaggagaacctcagtctgacgacattgaagctagccgaatgaagcgagcagctgcaaagcatctaatagaacgctactaccaccagttaactgagggctgtggaaatgaagcctgcacgaatgagttttgtgcttcctgtccaacttttcttcgtatggataataatgcagcagctattaaagccctcgagctttataagattaatgcaaaactctgtgatcctcatccctccaagaaaggagcaagctcagcttaccttgagaactcgaaaggtgcccccaacaactcctgctctgagataaaaatgaacaagaaaggcgctagaattgattttaaagatgtgacttacttaacagaagagaaggtatatgaaattcttgaattatgtagagaaagagaggattattcccctttaatccgtgttattggaagagttttttctagtgctgaggcattggtacagagcttccggaaagttaaacaacacaccaaggaagaactgaaatctcttcaagcaaaagatgaagacaaagatgaagatgaaaaggaaaaagctgcatgttctgctgctgctatggaagaagactcagaagcatcttcctcaaggataggtgatagctcacagggagacaacaatttgcaaaaattaggccctgatgatgtgtctgtggatattgatgccattagaagggtctacaccagattgctctctaatgaaaaaattgaaactgcctttctcaatgcacttgtatatttgtcacctaacgtggaatgtgacttgacgtatcacaatgtatactctcgagatcctaattatctgaatttgttcattatcgtaatggagaatagaaatctccacagtcctgaatatctggaaatggctttgccattattttgcaaagcgatgagcaagctaccccttgcagcccaaggaaaactgatcagactgtggtctaaatacaatgcagaccagattcggagaatgatggagacatttcagcaacttattacttataaagtcataagcaatgaatttaacagtcgaaatctagtgaatgatgatgatgccattgttgctgcttcgaagtgcttgaaaatggtttactatgcaaatgtagtgggaggggaagtggacacaaatcacaatgaagaagatgatgaagagcccatccctgagtccagcgagctgacacttcaggaacttttgggagaagaaagaagaaacaagaaaggtcctcgagtggaccccctggaaactgaacttggtgttaaaaccctggattgtcgaaaaccacttatcccttttgaagagtttattaatgaaccactgaatgaggttctagaaatggataaagattatacttttttcaaagtagaaacagagaacaaattctcttttatgacatgtccctttatattgaatgctgtcacaaagaatttgggattatattatgacaatagaattcgcatgtacagtgaacgaagaatcactgttctctacagcttagttcaaggacagcagttgaatccatatttgagactcaaagttagacgtgaccatatcatagatgatgcacttgtccggctagagatgatcgctatggaaaatcctgcagacttgaagaagcagttgtatgtggaatttgaaggagaacaaggagttgatgagggaggtgtttccaaagaattttttcagctggttgtggaggaaatcttcaatccagatattggtatgttcacatacgatgaatctacaaaattgttttggtttaatccatcttcttttgaaactgagggtcagtttactctgattggcatagtactgggtctggctatttacaataactgtatactggatgtacattttcccatggttgtctacaggaagctaatggggaaaaaaggaacttttcgtgacttgggagactctcacccagttctatatcagagtttaaaagatttattggagtatgaagggaatgtggaagatgacatgatgatcactttccagatatcacagacagatctttttggtaacccaatgatgtatgatctaaaggaaaatggtgataaaattccaattacaaatgaaaacaggaaggaatttgtcaatctttattctgactacattctcaataaatcagtagaaaaacagttcaaggcttttcggagaggttttcatatggtgaccaatgaatctcccttaaagtacttattcagaccagaagaaattgaattgcttatatgtggaagccggaatctagatttccaagcactagaagaaactacagaatatgacggtggctataccagggactctgttctgattagggagttctgggaaatcgttcattcatttacagatgaacagaaaagactcttcttgcagtttacaacgggcacagacagagcacctgtgggaggactaggaaaattaaagatgattatagccaaaaatggcccagacacagaaaggttacctacatctcatacttgctttaatgtgcttttacttccggaatactcaagcaaagaaaaacttaaagagagattgttgaaggccatcacgtatgccaaaggatttggcatgctgtaa

SEQ ID NO: 33502 - DNA, 4491 bp, Homo sapiens
acagatcaggagaacctcagtctgacgacattgaagctagccgaatgaagcgagcagctgcaaagcatctaatagaacgctactaccaccagttaactgagggctgtggaaatgaagcctgcacgaatgagttttgtgcttcctgtccaacttttcttcgtatggataataatgcagcagctattaaagccctcgagctttataagattaatgcaaaactctgtgatcctcatccctccaagaaaggagcaagctcagcttaccttgagaactcgaaaggtgcccccaacaactcctgctctgagataaaaatgaacaagaaaggcgctagaattgattttaaagatgtgacttacttaacagaagagaaggtatatgaaattcttgaattatgtagagaaagagaggattattcccctttaatccgtgttattggaagagttttttctagtgctgaggcattggtacagagcttccggaaagttaaacaacacaccaaggaagaactgaaatctcttcaagcaaaagatgaagacaaagatgaagatgaaaaggaaaaagctgcatgttctgctgctgctatggaagaagactcagaagcatcttcctcaaggataggtgatagctcacagggagacaacaatttgcaaaaattaggccctgatgatgtgtctgtggatattgatgccattagaagggtctacaccagattgctctctaatgaaaaaattgaaactgcctttctcaatgcacttgtatatttgtcacctaacgtggaatgtgacttgacgtatcacaatgtatactctcgagatcctaattatctgaatttgttcattatcgtaatggagaatagaaatctccacagtcctgaatatctggaaatggctttgccattattttgcaaagcgatgagcaagctaccccttgcagcccaaggaaaactgatcagactgtggtctaaatacaatgcagaccagattcggagaatgatggagacatttcagcaacttattacttataaagtcataagcaatgaatttaacagtcgaaatctagtgaatgatgatgatgccattgttgctgcttcgaagtgcttgaaaatggtttactatgcaaatgtagtgggaggggaagtggacacaaatcacaatgaagaagatgatgaagagcccatccctgagtccagcgagctgacacttcaggaacttttgggagaagaaagaagaaacaagaaaggtcctcgagtggaccccctggaaactgaacttggtgttaaaaccctggattgtcgaaaaccacttatcccttttgaagagtttattaatgaaccactgaatgaggttctagaaatggataaagattatacttttttcaaagtagaaacagagaacaaattctcttttatgacatgtccctttatattgaatgctgtcacaaagaatttgggattatattatgacaatagaattcgcatgtacagtgaacgaagaatcactgttctctacagcttagttcaaggacagcagttgaatccatatttgagactcaaagttagacgtgaccatatcatagatgatgcacttgtccggctagagatgatcgctatggaaaatcctgcagacttgaagaagcagttgtatgtggaatttgaaggagaacaaggagttgatgagggaggtgtttccaaagaattttttcagctggttgtggaggaaatcttcaatccagatattggtatgttcacatacgatgaatctacaaaattgttttggtttaatccatcttcttttgaaactgagggtcagtttactctgattggcatagtactgggtctggctatttacaataactgtatactggatgtacattttcccatggttgtctacaggaagctaatggggaaaaaaggaacttttcgtgacttgggagactctcacccagttctatatcagagtttaaaagatttattggagtatgaagggaatgtggaagatgacatgatgatcactttccagatatcacagacagatctttttggtaacccaatgatgtatgatctaaaggaaaatggtgataaaattccaattacaaatgaaaacaggaaggaatttgtcaatctttattctgactacattctcaataaatcagtagaaaaacagttcaaggcttttcggagaggttttcatatggtgaccaatgaatctcccttaaagtacttattcagaccagaagaaattgaattgcttatatgtggaagccggaatctagatttccaagcactagaagaaactacagaatatgacggtggctataccagggactctgttctgattagggagttctgggaaatcgttcattcatttacagatgaacagaaaagactcttcttgcagtttacaacgggcacagacagagcacctgtgggaggactaggaaaattaaagatgattatagccaaaaatggcccagacacagaaaggttacctacatctcatacttgctttaatgtgcttttacttccggaatactcaagcaaagaaaaacttaaagagagattgttgaaggccatcacgtatgccaaaggatttggcatgctgtaaaacaaaacaaaacaaaataaaacaaaaaaaaggaaggaaaaaaaaagaaaaaatttaaaaaattttaaaaatataacgagggataaatttttggtggtgatagtgtcccagtacaaaaaggctgtaagatagtcaaccacagtagtcacctatgtctgtgcctcccttctttattggggacatgtgggctggaacagcagatttcagctacatatatgaacaaatcctttattattattataattatttttttgcgtgaaagtgttacatattctttcacttgtatgtacagagaggtttttctgaatatttattttaagggttaaatcacttttgcttgtgtttattactgcttgaggttgagccttttgagtatttaaaaaatatataccaacagaactactctcccaaggaaaatattgccaccatttgtagaccacgtaaccttcaagtatgtgctacttttttgtccctgtatctaactcaaatcaggaactgtattttttttaatgatttgcttttgaaacttgaagtcttgaaaacagtgtgatgcaattactgctgttctagcccccaaagagttttctgtgcaaaatcttgagaatcaatcaataaagaaagatggaaggaagggagaaattggaatgttttaactgcagccctcagaactttagtaacagcacaacaaattaaaaacaaaaacaactcatgccacagtatgtcgtcttcatgtgtcttgcaatgaactgtttcagtagccaatcctctttcttagtatatgaaaggacagggatttttgttcttgttgttctcgttgttgttttaagtttactggggaaagtgcatttggccaaatgaaatggtagtcaagcctattgcaacaaagttaggaagtttgttgtttgtttattataaacaaaaagcatgtgaaagtgcacttaagatagagtttttattaattacttacttattacctagattttaaatagacaatccaaagtctccccttcgtgttgccatcatcttgttgaatcagccattttatcgaggcacgtgatcagtgttgcaacataatgaaaaagatggctactgtgccttgtgttacttaatcatacagtaagctgacctggaaatgaatgaaactattactcctaagaattacattgtatagccccacagattaaatttaattaattaattcaaaacatgttaaacgttactttcatgtactatggaaaagtacaagtaggtttacattactgatttccagaagtaagtagtttcccctttcctagtcttctgtgtatgtgatgttgttaatttcttttattgcattataaaataaaaggattatgtatttttaactaaggtgagacattgatatatccttttgctacaagctatagctaatgtgctgagcttgtgccttggtgattgattgattgattgactgattgttttaactgattactgtagatcaacctgatgatttgtttgtttgaaattggcaggaaaaatgcagctttcaaatcattggggggagaaaaaggatgtctttcaggattattttaattaatttttttcataattgagacagaactgtttgttatgtaccataatgctaaataaaactgtggcacttttcaccataatttaatttagtggaaaaagaagacaatgctttccatattgtgataaggtaacatggggtttttctgggccagcctttagaacactgttagggtacatacgctaccttgatgaaagggaccttcgtgcaactgtagtcatcttaaaggcttctcatccactgtgcttcttaatgtgtaattaaagtgaggagaaattaaatactctgagggcgttttatataataaattcgtgaaga

SEQ ID NO: 33503 - DNA, 5229 bp, Homo sapiens
tctgcagggccgcgcacgcactgacggctgaccgccatcttccctcccgaggcggcagttccaggtgcaagcgccgggtttgctgcccgctgggcgcccctgcagcggcccgagctgtggccggcgtggatgaggggcaggcgaggcagggccgcccctccagtattgccgcccctcccgccccagggcagggctgggagggtacagcccgggggcgggctcgggtcgcctcccggccgccgcgtcctcgctgccccgggccgggcgggcgggcgccgagagcctcccagcccgccccgtgccccgcccgcccggctgcttccgcggcggcgctgcccgcacatgggctaggctgccaggatgttcagcttcgaaggcgacttcaagacgcggcccaaggtgtcccttggcggcgcgagcaggaaggaggaaaaggcttctcttttacatcgtactcaggaagaaagaagaaagagagaggaagaaaggcgaaggttgaaaaatgcaataattatccagtcatttattcgaggctatagagacagaaaacagcaatattccatccaaagaagtgcatttgatcgctgtgctaccttgtcacagtccgggggcgcttttcccattgctaatggccccaaccttacccttttggtaaggcagcttctgtttttttacaaacaaaatgaagactcaaaacgtttgatatggctgtatcagaacttaattaaacacagctctctgtttgtcaagcagttggatggatctgagagacttacatgcttatttcagataaaaagattgatgagcctctgttgcaggttgctgcaaaactgtaatgatgacagtttgaatgttgcacttccaatgagaatgcttgaagtattttcgtctgagaatacttacttgcctgttttacaagatgctagctatgtggtgtcagtgattgaacaaattttgcactacatgattcacaatgggtattataggtctctatatttgttgattaacagcaagcttccatcaagtattgaatattctgatttatctcgagttcctatagcaaaaattttgctagagaatgttctaaaaccattgcactttacttacaactcctgtccggaaggtgcgaggcaacaagtttttacagccttcacagaggagtttctggcagcaccttttacagatcagatttttcatttcatcattccggcgcttgcagatgcgcagaccgttttcccttacgagccctttctgaatgcactgttgttaatagagagtagatgttcaagaaagagtggtggagcaccctggcttttctatttcgttttaactgttggcgaaaattatttgggggccctctctgaggaagggctgctggtgtatttgcgggtgctgcagaccttcctctctcagttaccagtctctcctgccagcgcgagctgtcacgactcagccagtgactctgaggaggagagtgaagaagccgacaagccctcaagcccggaggatggcagactgtcagtatcatacataacagaggaatgcctgaagaagctggacacaaagcagcagaccaacaccctgctcaacctggtgtggagggactctgcgagcgaggaggtcttcaccaccatggcctccgtctgccacacgctgatggtgcagcaccgcatgatggtacccaaagtcaggcttctctacagtttagcctttaatgccaggtttctgagacatctttggtttctaatatcttccatgtcaacacggatgatcacagggtctatggtaccgttgcttcaggtgatatccaggggttctcctatgtcttttgaagattctagtcgaatcatcccactcttttatctttttagctccttgtttagtcattcactaatttccatacatgataacgaattcttcggtgatcccatagaagttgtaggtcaaagacaatcatcaatgatgccttttactttagaagagctgataatgttgtctcgatgccttcgagatgcatgcctggggatcatcaagttggcttatccagaaaccaagccagaagttcgagaagaatatattacagcatttcagagtattggagttactactagctctgaaatgcaacaatgcatacagatggaacagaaaagatggattcagttatttaaggttatcaccaatctagtgaaaatgttgaagtccagagacacgaggagaaatttttgtcctccaaaccactggctgtcagaacaagaagatattaaagcagataaggtcactcagctctatgtgccagcatccagacatgtgtggaggttccggcggatggggaggataggcccgctgcagtccaccctggacgtgggtttggagtccccgccgctgtctgtgtctgaggaaagacagcttgctgtcctgacagagttgccttttgtggttccatttgaggaacgagtaaagatctttcagaggttgatttatgcagataagcaagaagttcaaggagatggtccatttctggatggaattaatgtcacaataagaagaaattacatttatgaagatgcttatgacaaactttctccagaaaatgagcctgatttgaaaaagcggatccgtgtgcacttgctcaatgcccatggcctggatgaagctggcattgatggtggtggtattttcagagagtttttaaatgaactactgaagtcaggatttaaccccaaccaggggttctttaagactactaatgaagggcttctgtaccccaacccggctgctcagatgcttgtgggagattcttttgccagacattactacttcctaggcagaatgcttggaaaggctctctatgagaacatgctggtggagctgccctttgcaggcttctttctttccaagttgcttggaaccagtgccgacgtggacattcaccacctcgcctccctagaccctgaggtgtataagaatttgctctttctgaagagctacgaagacgatgtggaggagcttgggctgaacttcactgtggtgaacaatgacctgggagaggcgcaggtagttgaactaaaattcggtgggaaagacatccctgtcaccagcgccaaccggattgcgtacatccacttggtggcagactacaggctgaacaggcagatccgccagcactgcctggctttccgccagggccttgccaatgtcgtcagcctcgagtggctccgaatgtttgatcagcaagaaattcaggtattaatttctggtgcacaagttcccataagcctagaggacctaaaatcctttacaaactattcaggaggctattctgcagaccatcctgttattaaggtcttctggagagttgtggaagggttcactgatgaagaaaagcgcaaactgctgaagtttgtaacaagctgctctcgaccccctctcttggggtttaaggagttgtatcccgcattttgtattcacaacggaggctccgaccttgagcggctccccacagccagcacctgcatgaacctgctgaagctccccgagttctatgacgagacacttttgcgaagtaaacttctctatgcgattgaatgtgccgctggctttgagctgagctgaagctgatgctggggtcagacccctacagagaaccagtgcttccttcgtcagcagcgcctccccagacccacgaggatactcacactgcacgcctgaggctctcctaagctccttctttcattctgccattcctccctcccttccttttttaaatgatttttattacggtgtggtcacttatttagatggacattgcttttcaaataacttaaaataacacgttatgtgccatgtggctactttagtaatattgccaagaagagcacagtttttacactagtggcatctcagtgaaattaaccaaagatgaagctttggctttgctggtgagatcagagccctcctgagcaggcagcgccactccagggttcagacagggctgcacaggcggcagagatacagggtctgagggctgagacgccatggggccgctgctgcttatgtggttggattgtttacaagcctcattattaaaactgaaggcattttttttttctgctgcctttcccaaagtggttaggtttggaaaagagatgatgatggtaatattttatttgtgctttttaagccatttccccaaatgggactagcatgcttgttttcagtataccgtggcctgcctcatgatggtttggagatactgtctgtggatgtgaggtggggacttcattcattgtcctatttctatctccactttgtgcctggagagctttcaggggaggtggaggaggagggtctgccaagctactgcaacatctgtcacccactatacccagttacttgggggaggacagacactgtggtgtcattaaagttgtttgaaccaaagtggcggctgcatctttgtcccgatgctagccgtgccggtctcccatcatccgctcgccctcctttcccctgggctgcgcccacttgtcttcctggatatttgggggtgactcgccatgcttggcaccctctgcttcctggtgctgctctgactcgaagacgggacagtccctggtgcacatccagggaagaggagtgtcggtagttcttgcagtaggcactttatcaggacctgacctgttgctgggtgattttagtctctacaaacagaaagcgtttcaaagcgtcagctgtgggagcagagtgaccctttgctgatgctggggggaggggatctaaatcctcatttatctcttctatgtctcgtattttactgtcactggaggctctgtgggctgtcatagttaattgaccataattagcaatatacttttaaagtgggaaagctgaatgacacttttaagacaatgaacattatcaaaacaaaatgtataatttcttaatttgaataataaattaagcgtttaaatgctatttgtagtcttgatatacagaaataaaataattagggttggtcttttttattttaggttgttttatgttgaatgttctatatcttattagttaatttgtatattttattagtattttggaaatagcatatctgagactgaagagaaattgacaattcacttatttgtggtttttttctcagctattctgagcttatttatttatttgtatgttctaatggctaaacatttacattaaatgttttttttcccaaga

SEQ ID NO: 33504 - DNA, 1626 bp, Homo sapiens
cctcccagcccgccccgtgccccgcccgcccggctgcttccgcggcggcgctgcccgcacatgggctaggctgccaggatgttcagcttcgaaggcgacttcaagacgcggcccaaggtgtcccttggcggcgcgagcaggaagtattccatccaaagaagtgcatttgatcgctgtgctaccttgtcacagtccgggggcgcttttcccattgctaatggccccaaccttacccttttggtaaggcagcttctgtttttttacaaacaaaatgaagactcaaaacgtttgatatggctgtatcagaacttaattaaacacagctctctgtttgtcaagcagttggatggatctgagagacttacatgcttatttcagataaaaagattgatgagcctctgttgcaggttgctgcaaaactgtaatgatgacagtttgaatgttgcacttccaatgagaatgcttgaagtattttcgtctgagaatacttacttgcctgttttacaagatgctagctatgtggtgtcagtgattgaacaaattttgcactacatgattcacaatgggtattataggtctctatatttgttgattaacagcaagcttccatcaagtattgaatattctgatttatctcgagttcctatagcaaaaattttgctagagaatgttctaaaaccattgcactttacttacaactcctgtccggaaggtgcgaggcaacaagtttttacagccttcacagaggagtttctggcagcaccttttacagatcagatttttcatttcatcattccggcgcttgcagatgcgcagaccgttttcccttacgagccctttctgaatgcactgttgttaatagagagtagatgttcaagaaagagtggtggagcaccctggcttttctatttcgttttaactgttggcgaaaattatttgggggccctctctgaggaagggctgctggtgtatttgcgggtgctgcagaccttcctctctcagttaccagtctctcctgccagcgcgagctgtcacgactcagccagtgactctgaggaggagagtgaagaagccgacaagccctcaagcccggaggatggcagactgtcagtatcatacataacagaggaatgcctgaagaagctggacacaaagcagcagaccaacaccctgctcaacctggtgtggagggactctgcgagcgaggaggtcttcaccaccatggcctccgtctgccacacgctgatggtgcagcaccgcatgatggtacccaaagtcagggtgtacaaatgaatgtggagacctttgtaccctgacatggaaagatttccgagacagatgcgtacatgaaaaccgggaagacacaggacagtatgtagaagaaccggcttttcctataagaaggatggaaaaaataggaatatatattcatattgcataaagaaacttggaagcatatacaagaaactcatgaaagtgaacactcgtgtctgaatatgccgaggaagctggggctggagcagaagtgctcttctgagtacactatttttatatcacttttaagttttggattaggtgaatgacttaatattttaaaattggttaagtaataaatgaattgccagc

SEQ ID NO: 33505 - DNA, 753 bp, Homo sapiens
cttcctcaacatggctgcgcccttgtcagtggaggtggagttcgggagctcacctggctgtctttttctctggtcctcctttgcagaggtggtgcggagctcctgtttgacggtattaagaaacatcgagtcactttgcctggacaggaggaaccctgggacatccggaacctgctcatctggatcaagaagaatttgctaaaagagcggccagagttgttcatccagggagacagcgtgtgagtcccactcctcccttccctgaagcaggtggagggagggacggatatttgagcccccaccctcgggttcagtcctggccttctctgaatccggttctccccttcctcctccctaactcttccagctctgagatctgttttcagttttcttgttactaaaccgaactcttgaggattttttaaatcccagatgaaaggagcctggtgaatttctcagaaaacttggattctgccctctggttgccacagacttgctgtgggaccttaggcgacttacttcgcttctctgggcctcagttactctctacacagaaagtgctgaggaaaaaacgtagctagtacaactgaagagctaaatattctgttttatttcattgtaatttaaatagccacatgcagctagtagattaccatacagtgcagcacgggtctagaattccaaggagtcattgactctgtgcgtgcacacacccatgcacatgcacacacactcactggggacaccccatag

SEQ ID NO: 33506 - DNA, 3045 bp, Homo sapiens
gcgagctcggcttcctcaacatggctgcgcccttgtcagtggaggtggagttcggaggtggtgcggagctcctgtttgacggtattaagaaacatcgagtcactttgcctggacaggaggaaccctgggacatccggaacctgctcatctggatcaagaagaatttgctaaaagagcggccagagttgttcatccagggagacagcgtgtgagtcccactcctcccttccctgaagcaggtggagggagggacggatatttgagcccccaccctcgggttcagtcctggccttctctgaatccggttctccccttcctcctccctaactcttccagctctgagatctgttttcagttttcttgttactaaaccgaactcttgaggattttttaaatcccagatgaaaggagcctggtgaatttctcagaaaacttggattctgccctctggttgccacagacttgctgtgggaccttaggcgacttacttcgcttctctgggcctcagttactctctacacagaaagtgctgaggaaaaaacgtagctagtacaactgaagagctaaatattctgttttatttcattgtaatttaaatagccacatgcagctagtagattaccatacagtgcagcacgggtctagaattccaaggagtcattgactctgtgcgtgcacacacccatgcacatgcacacacactcactggggacaccccatagaagcccagtgcagtctccttggaaaggaccaggttccagttgccacgaagttacttctaaaacaaggccagtcccccacgtgaaaggtggccggtgcagttgtgaggctcgcttatttgcctcgaagcataggtcactgtcaggtcctaagggatcaggcctaggggatcagccctccttcaggtcatggtccagtggtcctggaggccacctctaaggccagcagtgctccttgggccattaccagtgggagccaggctaagctgcctgaccaaatgttgacctaccctgccttatgccaggcaggactgcacgtgagcattgccatgtggcatggcaactgattcggaagaggcaaaacagccttctctccaggatgggcatgcagaggcctaaaaaaaagccgaagttcttttccagggctaacgagaataagattagacccctggaaaagtcctactaatggttaccatgacagtgtggcaagcactccacacatatcagctcatttcgttttcgtataggccttgtgggttagacagtatcacttatcccattttcagatgaggaacctgatactcagaaacaaaatgacctgcccatggtctgggtggtggtgctggctggcatttgcacccattttccatctggctacaaagaccatgcatgactgacctggtttccttcacactcagaccagcctccccttcctgggatatctttagccagaccccaggaggaaggctcctcagcacactctcctgcagcccaaagctctcagcctctcttcctctgtgctactgcctcctgcctctcactccttgctactcaccaccatctttcccacaggcggccaggaattctggtgctgattaacgatgccgactgggagctactggtcagtaccttgggggacatccctcccccagcccctgcccttgctgcttcagtgggaaagcgttgggcctctcctcaggcacatatagagtggctgggtaatcctccgccccactccagccccacactgaggctgctggagtctcccactccaggtgaggaagggatgggtagctggggacatgggagtactcctccatcctgaagatttgcaggttgaggtataggatacccatttttctggtagagtctgtctcttccagagcagccagtcctcagcccctgttctcccaactcctggggtggacctgggaaggtggccctgagggtctcccgctcccctctctcccgcaccagggtgagctggactaccagcttcaggaccaggacagcgtcctcttcatctccactctgcacggcggctgagggcccttctctgggcctgggcacccttagaggggagaacgaagcaatcagacatccccttgggccctgcttccaggtctccctgtcccccttgcctgccttcttccctgctctgtcccctaagctccctccaggcagggaaaagaggccaggtgctaaaaatgagcctttctcaagcacgtgagcagcggaaggcagacaggcgccagagcccagcactcccttttccagcagctgtggtgggggagggttcccctccagtttgtcaagagttgaaggaggctctgtggccaggtgacctggctgccttccactccttgtacctcagtctaaacatggagtggccgctgacaaggcgctccagccccagagccagcgtcttcatggggaagatgaatggacctgagtagctgaaggaaggcccctccctacccaaagactggaggcttctcagcctcaatttccctgtctgtacagctgagggctctgcctgtcccccactgctatcagtatggaaccccagctggggtcccctattgagtgccgactccccccaccgccagcagctgctcctccagccacacccctcctgctccccccacccctagcccttgaccctggctggcctgccccgctccacaggccaccagatgggctcctgagaccctccccaggctgcttacagctcattctgctgggggtagagatgaggggagggagtaagttaaaccttggactagcaagtagaagcctggggggatgcgtgtgcctcagtttcctcctccacaactgaatatagtggctgaaaactggggagatacttgatggcgcgaatgtccgttttctctcccttcccacctcctgcaggaagcaggacggggcaggcagcacctggtaggcacagtgctttgcccctcctccccttcccttctggaagtcttggggcctcagtgcttgcaacagccggccttgggcaaataaaagactaggttgtttacta

SEQ ID NO: 33507 - DNA, 1368 bp, Homo sapiens
ccggaaatttgcgggcgcgccggaagttgaggggagtttcctgcgagctcggcttcctcaacatggctgcgcccttgtcagtggaggtggagttcggaggtggtgcggagctcctgtttgacggtattaagaaacatcgagtcactttgcctggacaggaggaaccctgggacatccggaacctgctcatctggatcaagaagaatttgctaaaagagcggccagagttgttcatccagggagacagcgtgcggccaggaattctggtgctgattaacgatgccgactgggagctactgggtgagctggactaccagcttcaggaccaggacagcgtcctcttcatctccactctgcacggcggctgagggcccttctctgggcctgggcacccttagaggggagaacgaagcaatcagacatccccttgggccctgcttccaggtctccctgtcccccttgcctgccttcttccctgctctgtcccctaagctccctccaggcagggaaaagaggccaggtgctaaaaatgagcctttctcaagcacgtgagcagcggaaggcagacaggcgccagagcccagcactcccttttccagcagctgtggtgggggagggttcccctccagtttgtcaagagttgaaggaggctctgtggccaggtgacctggctgccttccactccttgtacctcagtctaaacatggagtggccgctgacaaggcgctccagccccagagccagcgtcttcatggggaagatgaatggacctgagtagctgaaggaaggcccctccctacccaaagactggaggcttctcagcctcaatttccctgtctgtacagctgagggctctgcctgtcccccactgctatcagtatggaaccccagctggggtcccctattgagtgccgactccccccaccgccagcagctgctcctccagccacacccctcctgctccccccacccctagcccttgaccctggctggcctgccccgctccacaggccaccagatgggctcctgagaccctccccaggctgcttacagctcattctgctgggggtagagatgaggggagggagtaagttaaaccttggactagcaagtagaagcctggggggatgcgtgtgcctcagtttcctcctccacaactgaatatagtggctgaaaactggggagatacttgatggcgcgaatgtccgttttctctcccttcccacctcctgcaggaagcaggacggggcaggcagcacctggtaggcacagtgctttgcccctcctccccttcccttctggaagtcttggggcctcagtgcttgcaacagccggccttgggcaaataaaagactaggttgtttacta

SEQ ID NO: 33508 - DNA, 1726 bp, Homo sapiens
ccggaaatttgcgggcgcgccggaagttgaggggagtttcctgcgagctcggcttcctcaacatggctgcgcccttgtcagtggaggtggagttcggaggtggtgcggagctcctgtttgacggtattaagaaacatcgagtcactttgcctggacaggaggaaccctgggacatccggaacctgctcatctggatcaagaagaatttgctaaaagagcggccagagttgttcatccagggagacagcgtgcggccaggaattctggtgctgattaacgatgccgactgggagctactggtcagtaccttgggggacatccctcccccagcccctgcccttgctgcttcagtgggaaagcgttgggcctctcctcaggcacatatagagtggctgggtaatcctccgccccactccagccccacactgaggctgctggagtctcccactccaggtgaggaagggatgggtagctggggacatgggagtactcctccatcctgaagatttgcaggttgaggtataggatacccatttttctggtagagtctgtctcttccagagcagccagtcctcagcccctgttctcccaactcctggggtggacctgggaaggtggccctgagggtctcccgctcccctctctcccgcaccagggtgagctggactaccagcttcaggaccaggacagcgtcctcttcatctccactctgcacggcggctgagggcccttctctgggcctgggcacccttagaggggagaacgaagcaatcagacatccccttgggccctgcttccaggtctccctgtcccccttgcctgccttcttccctgctctgtcccctaagctccctccaggcagggaaaagaggccaggtgctaaaaatgagcctttctcaagcacgtgagcagcggaaggcagacaggcgccagagcccagcactcccttttccagcagctgtggtgggggagggttcccctccagtttgtcaagagttgaaggaggctctgtggccaggtgacctggctgccttccactccttgtacctcagtctaaacatggagtggccgctgacaaggcgctccagccccagagccagcgtcttcatggggaagatgaatggacctgagtagctgaaggaaggcccctccctacccaaagactggaggcttctcagcctcaatttccctgtctgtacagctgagggctctgcctgtcccccactgctatcagtatggaaccccagctggggtcccctattgagtgccgactccccccaccgccagcagctgctcctccagccacacccctcctgctccccccacccctagcccttgaccctggctggcctgccccgctccacaggccaccagatgggctcctgagaccctccccaggctgcttacagctcattctgctgggggtagagatgaggggagggagtaagttaaaccttggactagcaagtagaagcctggggggatgcgtgtgcctcagtttcctcctccacaactgaatatagtggctgaaaactggggagatacttgatggcgcgaatgtccgttttctctcccttcccacctcctgcaggaagcaggacggggcaggcagcacctggtaggcacagtgctttgcccctcctccccttcccttctggaagtcttggggcctcagtgcttgcaacagccggccttgggcaaataaaagactaggttgtttactagc

SEQ ID NO: 33509 - DNA, 3996 bp, Homo sapiens
gtggcccatcccgtctgctctctgtcccgtctcccgacccgtacgcttttccctcaactcgcgcgcacgaatggttaaaaaaagggtgtgaggctcgagcccgccagccaggccgctagcacctcgcgcgcgccctcagcgaggacccgcacgagctgcccggctctgtgcctgcgttgtttgaaactgtggaacccgttaggcttttggggaactacagtcccagctggctccggagcccgtgcgtgccaggggcgagtggccgtcgcgagacggctcctgcctttcgtgtctctgcagcgtggagactggaaccggcaatttcaaaggacgccacgttcaatcgcagcgctggcgcgggcggaggctaaaacacgggggtcctgagactgaggaaaacgcgccaagttcccctcggtggcggagtgctaaagaccctagcggttcaggcgttcggcgagcggggccgctgcttgttgcgctcctggctctcccggggcgggcgcagatgggcgccgctcccgggatgtagttggtgttggtgcaagacgggagcgagcggcggtcggggttcccgctcttgggagcggatggtcactcccccgcggggagggcgagccgaccagattttcctggggccggggacccggcgggctcggggcagggactcacctgtcgcacccacactcattcgggttggacttgccggcgtcaccgccgcggacttcgctttgggccatgaccagatataattggtgattacaactttcctctataaattaactcttgacactccttgggatttgaagaaaaaaatgcctggtgtcatacctagtgaaagtaatggactttcaagaggtagcccttcaaagaaaaacagactttccttaaagttttttcagaaaaaggaaactaagagagctttggatttcacagattctcaagaaaatgaagaaaaagcttctgaatatagagcatctgaaattgatcaagttgttcctgcagcacagtcttcacctataaactgtgagaagagagaaaacttgttaccatttgtgggactgaataatctcggcaatacttgctatcttaatagtatacttcaggtattatatttttgtcccggttttaaatctggagtaaagcacttatttaatattatttcaaggaagaaagaagctctaaaggatgaagccaatcaaaaagacaagggaaattgcaaagaagattctttggcaagttatgaattgatatgcagtttacagtccttaatcatttcggttgaacagctccaggctagttttctcttaaatccagagaaatatactgatgaacttgccactcagccaaggcgactgcttaacacactgagggaactcaaccctatgtatgaaggatatctacagcatgatgcacaggaagtattacaatgtattttgggaaacattcaagaaacatgccaactcctaaaaaaagaagaagtaaaaaatgtggcagaattacctactaaggtagaagaaatacctcatccgaaagaggaaatgaatggtattaacagcatagagatggacagtatgaggcattctgaagactttaaagagaaactcccaaaaggaaatgggaaaagaaaaagtgacactgaatttggtaacatgaagaaaaaagttaaattatccaaggaacaccagtcattggaagagaaccagagacaaactagatcaaaaagaaaagctacaagtgatacattagagagtcctcctaaaataattcccaagtatatttctgaaaatgagagtccaagaccctcacaaaagaaatcaagagttaaaataaattggttaaagtctgcaactaagcaacccagcattctttctaaattttgtagtctgggaaaaataacaacaaaccaaggagtcaaaggacaatctaaagaaaatgaatgtgatcctgaagaggacttggggaagtgtgaaagtgataacacaactaatggttgtggacttgaatctccaggaaatactgttacacctgtaaatgttaatgaagttaaacccataaacaaaggtgaagaacaaattggttttgagctagtggagaaattatttcaaggtcagctggtattaaggacgcgttgcttggaatgtgaaagtttaacagaaagaagagaagattttcaagacatcagtgtgccagtacaagaagatgagctttccaaagtagaggagagttctgaaatttctccagagccaaaaacagaaatgaagaccctgagatgggcaatttcacaatttgcttcagtagaaaggattgtaggagaagataaatatttctgtgaaaactgccatcattatactgaagctgaacgaagtcttttgtttgacaaaatgcctgaagttataactattcatttgaagtgctttgctgctagtggtttggagtttgattgttatggtggtggactttccaagatcaacactcctttattgacacctcttaaattgtcactagaagaatggagcacaaagccaactaacgacagctatggattatttgcggttgtgatgcatagtggcattacaattagtagtgggcattacactgcttctgttaaagtcactgaccttaacagtttagaactagataaaggaaattttgtggttgaccaaatgtgtgaaataggtaagccagaaccattgaatgaggaggaagcaaggggtgtggttgagaattataatgatgaagaagtgtcaattagagttggtggaaatacacagccaagtaaagttttgaacaaaaaaaatgtagaagctattggacttcttggaggacaaaagagcaaagcagattatgagctatacaacaaagcctctaatcctgataaggttgctagtacagcgtttgctgaaaatagaaattctgagactagtgatactactgggacccatgaatctgatagaaacaaggaatccagtgaccaaacaggcattaatattagtggatttgagaacaaaatttcatacgtagtgcaaagcttaaaggagtatgaggggaagtggttgctttttgatgattctgaagtcaaagttactgaagagaaggactttctgaattctctttccccttctacatctcctacttctactccttacttgctattttataagaaattatagagtgagtgtattttccttgtgtatatattaaacacacccatacaaacattggtaaagttgattacatcaaagaatctttagcttatcttttgaagctactggatattattggtctctctaggtttttatataaatagtgaaatttgaattactgaaaaccatgttaatttttagaactcattttcctcagtagagactagtgatgcattagcttctgggaacaaacttgtatcggttcttaattaaattatccaaaacggaggcatttaaacacttggatttacaccagtcttttgtgtttgctttttaaaataaagtgctcgtatttgtattctccatattttggagtaattatctacatgatgtttatagttcctgtggtttttcacccaagaagcagaatctcattcagtacatttagttttataagagtcatgaagctaaatccttgggctatgtcagaggcacaaagtctagaatgtgtgtattcacaatggtgtatgtacattttgtgccttgattcacttagaagtgtctcagaaaacctggacagttcgcttctacacaagaattttatatgtatttatgaagatgattctgtaccctagtatatctttttgggcatggactaatttgtatctgtttaactcatattctgcacgatctgtatatagtacatcaaacttagaggtgtgaccttaaatttaactttttttaaaaactgggaggtcaataaaatttaaactgcttaactatgtatatgaatatttgaattttttacttgtatatttttataaatacagctgagttttcttaaagcgaa

SEQ ID NO: 33510 - DNA, 3507 bp, Homo sapiens
ggggcttaccgcgagggcctcgctccggaagccgcaccctccgcggcgtcccaccgtcgaggattaacaaaacgccaaacaagattttaacagtcggcagcgaaagcgcgcactcgagcgccaatgagagcggaaggaggggcaccgcgcctgaggaacactccgtatgtcgaacaatgattggctggagcccacctttcttcttttttgctattagatgggcttgctgctcccgcccatctaattggctttggtctagatataattggtgattacaactttcctctataaattaactcttgacactccttgggatttgaagaaaaaaatgcctggtgtcatacctagtgaaagtaatggactttcaagaggtagcccttcaaagaaaaacagactttccttaaagttttttcagaaaaaggaaactaagagagctttggatttcacagattctcaagaaaatgaagaaaaagcttctgaatatagagcatctgaaattgatcaagttgttcctgcagcacagtcttcacctataaactgtgagaagagagaaaacttgttaccatttgtgggactgaataatctcggcaatacttgctatcttaatagtatacttcaggtattatatttttgtcccggttttaaatctggagtaaagcacttatttaatattatttcaaggaagaaagaagctctaaaggatgaagccaatcaaaaagacaagggaaattgcaaagaagattctttggcaagttatgaattgatatgcagtttacagtccttaatcatttcggttgaacagctccaggctagttttctcttaaatccagagaaatatactgatgaacttgccactcagccaaggcgactgcttaacacactgagggaactcaaccctatgtatgaaggatatctacagcatgatgcacaggaagtattacaatgtattttgggaaacattcaagaaacatgccaactcctaaaaaaagaagaagtaaaaaatgtggcagaattacctactaaggtagaagaaatacctcatccgaaagaggaaatgaatggtattaacagcatagagatggacagtatgaggcattctgaagactttaaagagaaactcccaaaaggaaatgggaaaagaaaaagtgacactgaatttggtaacatgaagaaaaaagttaaattatccaaggaacaccagtcattggaagagaaccagagacaaactagatcaaaaagaaaagctacaagtgatacattagagagtcctcctaaaataattcccaagtatatttctgaaaatgagagtccaagaccctcacaaaagaaatcaagagttaaaataaattggttaaagtctgcaactaagcaacccagcattctttctaaattttgtagtctgggaaaaataacaacaaaccaaggagtcaaaggacaatctaaagaaaatgaatgtgatcctgaagaggacttggggaagtgtgaaagtgataacacaactaatggttgtggacttgaatctccaggaaatactgttacacctgtaaatgttaatgaagttaaacccataaacaaaggtgaagaacaaattggttttgagctagtggagaaattatttcaaggtcagctggtattaaggacgcgttgcttggaatgtgaaagtttaacagaaagaagagaagattttcaagacatcagtgtgccagtacaagaagatgagctttccaaagtagaggagagttctgaaatttctccagagccaaaaacagaaatgaagaccctgagatgggcaatttcacaatttgcttcagtagaaaggattgtaggagaagataaatatttctgtgaaaactgccatcattatactgaagctgaacgaagtcttttgtttgacaaaatgcctgaagttataactattcatttgaagtgctttgctgctagtggtttggagtttgattgttatggtggtggactttccaagatcaacactcctttattgacacctcttaaattgtcactagaagaatggagcacaaagccaactaacgacagctatggattatttgcggttgtgatgcatagtggcattacaattagtagtgggcattacactgcttctgttaaagtcactgaccttaacagtttagaactagataaaggaaattttgtggttgaccaaatgtgtgaaataggtaagccagaaccattgaatgaggaggaagcaaggggtgtggttgagaattataatgatgaagaagtgtcaattagagttggtggaaatacacagccaagtaaagttttgaacaaaaaaaatgtagaagctattggacttcttggaggacaaaagagcaaagcagattatgagctatacaacaaagcctctaatcctgataaggttgctagtacagcgtttgctgaaaatagaaattctgagactagtgatactactgggacccatgaatctgatagaaacaaggaatccagtgaccaaacaggcattaatattagtggatttgagaacaaaatttcatacgtagtgcaaagcttaaaggagtatgaggggaagtggttgctttttgatgattctgaagtcaaagttactgaagagaaggactttctgaattctctttccccttctacatctcctacttctactccttacttgctattttataagaaattatagagtgagtgtattttccttgtgtatatattaaacacacccatacaaacattggtaaagttgattacatcaaagaatctttagcttatcttttgaagctactggatattattggtctctctaggtttttatataaatagtgaaatttgaattactgaaaaccatgttaatttttagaactcattttcctcagtagagactagtgatgcattagcttctgggaacaaacttgtatcggttcttaattaaattatccaaaacggaggcatttaaacacttggatttacaccagtcttttgtgtttgctttttaaaataaagtgctcgtatttgtattctccatattttggagtaattatctacatgatgtttatagttcctgtggtttttcacccaagaagcagaatctcattcagtacatttagttttataagagtcatgaagctaaatccttgggctatgtcagaggcacaaagtctagaatgtgtgtattcacaatggtgtatgtacattttgtgccttgattcacttagaagtgtctcagaaaacctggacagttcgcttctacacaagaattttatatgtatttatgaagatgattctgtaccctagtatatctttttgggcatggactaatttgtatctgtttaactcatattctgcacgatctgtatatagtacatcaaacttagaggtgtgaccttaaatttaactttttttaaaaactgggaggtcaataaaatttaaactgcttaactatgtatatgaatatttgaattttttacttgtatatttttataaatacagctgagttttcttaaagcg

SEQ ID NO: 33511 - DNA, 502 bp, Homo sapiens
ggaggcggggcttaccgcgagggcctcgctccggaagccgcaccctccgcggcgtcccaccgtcgaggattaacaaaacgccaaacaagattttaacagtcggcagcgaaagcgcgcactcgagcgccaatgagagcggaaggaggggcaccgcgcctgaggaacactccatataattggtgattacaactttcctctataaattaactcttgacactccttgggatttgaagaaaaaaatgcctggtgtcatacctagtgaaagtaatggactttcaagaggtagcccttcaaagaaaaacagactttccttaaagttttttcagaaaaaggaaactaagagagctttggatttcacagattctcaagaaaatgaagaaaaagcttctgaatatagagcatctgaaattgatcaagttgttcctgcagcacagtcttcacctataaactgtgagaagagagaaaacttgttaccatttgtgggactgaataatctcggcaa

SEQ ID NO: 33512 - DNA, 893 bp, Homo sapiens
cggaggcggggcttaccgcgagggcctcgctccggaagccgcaccctccgcggcgtcccaccgtcgaggattaacaaaacgccaaacaagattttaacagtcggcagcgaaagcgcgcactcgagcgccaatgagagcggaaggaggggcaccgcgcctgaggaacactccgtatgtcgaacaatgattggctggagcccacctttcttcttttttgctattagatgggcttgctgctcccgcccatctaattggctttggtctagatataattggtgattacaactttcctctataaattaactcttgacactccttgggatttgaagaaaaaaatgcctggtgtcatacctagtgaaagtaatggactttcaagaggtagcccttcaaagaaaaacagactttccttaaagttttttcagaaaaaggaaactaagagagctttggatttcacagattctcaagaaaatgaagaaaaagcttctgaatatagagcatctgaaattgatcaagttgttcctgcagcacagtcttcacctataaactgtgagaagagagaaaacttgttaccatttgtgggactgaataatctcggcaatacttgctatcttaatagtatacttcaggtattatatttttgtcccggttttaaatctggagtaaagcacttatttaatattatttcaaggaagaaagaagctctaaaggatgaagccaatcaaaaagacaagggaaattgcaaagaagattctttggcaagttatgaattgatatgcagtttacagtccttaatcatttcggttgaacagctccaggctagttttctcttaaatccagagaaatatactgatgaacttgccactcagccaaggcgactgcttaacacactgagg

SEQ ID NO: 33513 - DNA, 3376 bp, Homo sapiens
ctccccgcgccccgcggcgcgcggccagtgcgcaggcgcggcggccgatgcgagtgtgtatgtgcgggcgagaagatggcggcggcgggggaagcagcgtgagcagccggaggatcgcggagtcccaatgaaacgggcagccatggccctccacagcccgcagtatatttttggagattttagccctgatgaattcaatcaattctttgtgactcctcgatcttcagttgagcttcctccatacagtggaacagttctgtgtggcacacaggctgtggataaactacctgatggacaagaatatcagagaattgagtttggtgtcgatgaagtcattgaacccagtgacactttgccgagaacccccagctacagtatttcaagcacactgaaccctcaggcccctgaatttattctcggttgtacagcttccaaaataacccctgatggtatcactaaagaagcaagctatggctccatcgactgccagtacccaggctctgccctcgctttggatggaagttctaatgtggaggcggaagttttggaaaatgatggtgtctcaggtggtcttggacaaagggagcgtaaaaagaagaaaaagcggccacctggatattacagctatttgaaagatggtggcgatgatagtatctccacagaagccctggtcaatggccatgccaattcagcagtcccgaacagtgtcagtgcagaggatgcagaatttatgggtgacatgcccccgtcagttacgcccaggacttgtaacagcccccagaactccacagactctgtcagtgacattgtgcctgacagtcctttccccggagcactcggcagtgacaccaggactgcagggcagccagaggggggccccggggctgattttggtcagtcctgcttccctgcagaggctggcagagacaccctgtcaaggacagctggggctcagccctgcgttggtaccgatactactgaaaaccttggagttgctaatggacaaatacttgaatcctcgggtgagggcacagctaccaacggggtggagttgcacaccacggaaagcatagacttggacccaaccaaacccgagagtgcatcacctcctgctgacggcacgggctctgcatcaggcacccttcctgtcagccagcccaagtcctgggccagcctctttcatgattctaagccctcttcctcctcgccggtggcctatgtggaaactaagtattcccctcccgccatatctcccctggtttctgaaaagcaggttgaagtcaaagaagggcttgttccggtttcagaggatcctgtagccataaagattgcagagttgctggagaatgtaaccctaatccataaaccagtgtcgttgcaaccccgtgggctgatcaataaagggaactggtgctacattaatgctacactgcaggcattggttgcttgcccgccgatgtaccacctgatgaagttcattcctctgtattccaaagtgcaaaggccttgtacgtcaacacccatgatagacagctttgttcggctaatgaatgagttcactaatatgccagtacctccaaaaccccgacaagctcttggagataaaatcgtgagggatattcgccctggagctgcctttgagcccacatatatttacagactcctgacagttaacaagtcaagcctgtctgaaaagggtcgacaagaagatgctgaggaatacttaggcttcattctaaatggacttcatgaggaaatgttgaacctaaagaagcttctctcaccaagtaatgaaaaacttacgatttccaacggccccaaaaaccactcggtcaatgaagaagagcaggaagaacaaggtgaaggaagcgaggatgaatgggaacaagtgggcccccggaacaagacttccgtcacccgccaggcggattttgttcagactccaatcaccggcatttttggtggacacatcaggtctgtggtttaccagcagagttcaaaagaatctgccactttgcagccatttttcacgttgcagttggatatccagtcagacaagatacgcacagtccaggatgcactggagagcttggtggcaagagaatctgtccaaggttataccacaaaaaccaaacaagaggttgagataagtcgaagagtgactctggaaaaactccctcctgtcctcgtgctgcacctgaaacgattcgtttatgagaagactggtgggtgccagaagcttatcaaaaatattgaatatcctgtggacttggaaattagtaaagaactgctttctccaggggttaaaaataagaattttaaatgccaccgaacctatcggctctttgcagtggtctaccatcacggcaacagtgcgacgggcggccattacactacagacgtcttccagatcggtctgaatggctggctgcgcatcgatgaccagacagtcaaggtgatcaaccagtaccaggtggtgaaaccaactgctgaacgcacagcctacctcctgtattaccgccgagtggacctgctgtaaaccctgtgtgcgctgtgtgtgcgcccagtgcccgcttcgtaggacaccacctcacactcacttcccgcctctctttagtggctctttagagagaaactctttctccctttgcaaaaatgggctagaatgaaaaggagatgccttggggttcgtgcacaacacagcttctgttgactctaacttccaaatcaaaatcatttggttgaaacagactgttgcttgattttagaaaatacacaaaaacccatatttctgaaataatgctgattcctgagataagaaagtggatttgatccccagtctcattgcttagtagaataaatcctgcaccagcaacaacacttgtaaatttgtgaaaatgaattttatctttccttaaaaaagaaattttttaatccatcacacttttcttccctaccctttagtttttgataaatgataaaaatgagccagttatcaaagaagaactagttcttacttcaaaagaaaaataaacataaaaaataagttgctggttcctaacaggaaaaattttaataattgtactgagagaaactgcttacgtacacattgcagatcaaatatttggagttaaaatgttagtctacatagatgggtgattgtaactttattgccattaaaagatttcaaattgcattcatgcttctgtgtacacataatgaaaaatgggcaaataatgaagatctctccttcagtctgctctgtttaattctgctgtctgctcttctctaatgctgcgtccctaattgtacacagtttagtgatatctaggagtataaagttgtcgcccatcaataaaaatcacaaagttggttt

SEQ ID NO: 33514 - DNA, 3311 bp, Homo sapiens
gcgggcgagaagatggcggcggcgggggaagcagcgtgagcagccggaggatcgcggagtcccaatgaaacgggcagccatggccctccacagcccgcagtatatttttggagattttagccctgatgaattcaatcaattctttgtgactcctcgatcttcagttgagcttcctccatacagtggaacagttctgtgtggcacacaggctgtggataaactacctgatggacaagaatatcagagaattgagtttggtgtcgatgaagtcattgaacccagtgacactttgccgagaacccccagctacagtatttcaagcacactgaaccctcaggcccctgaatttattctcggttgtacagcttccaaaataacccctgatggtatcactaaagaagcaagctatggctccatcgactgccagtacccaggctctgccctcgctttggatggaagttctaatgtggaggcggaagttttggaaaatgatggtgtctcaggtggtcttggacaaagggagcgtaaaaagaagaaaaagcggccacctggatattacagctatttgaaagatggtggcgatgatagtatctccacagaagccctggtcaatggccatgccaattcagcagtcccgaacagtgtcagtgcagaggatgcagaatttatgggtgacatgcccccgtcagttacgcccaggacttgtaacagcccccagaactccacagactctgtcagtgacattgtgcctgacagtcctttccccggagcactcggcagtgacaccaggactgcagggcagccagaggggggccccggggctgattttggtcagtcctgcttccctgcagaggctggcagagacaccctgtcaaggacagctggggctcagccctgcgttggtaccgatactactgaaaaccttggagttgctaatggacaaatacttgaatcctcgggtgagggcacagctaccaacggggtggagttgcacaccacggaaagcatagacttggacccaaccaaacccgagagtgcatcacctcctgctgacggcacgggctctgcatcaggcacccttcctgtcagccagcccaagtcctgggccagcctctttcatgattctaagccctcttcctcctcgccggtggcctatgtggaaactaagtattcccctcccgccatatctcccctggtttctgaaaagcaggttgaagtcaaagaagggcttgttccggtttcagaggatcctgtagccataaagattgcagagttgctggagaatgtaaccctaatccataaaccagtgtcgttgcaaccccgtgggctgatcaataaagggaactggtgctacattaatgctacactgcaggcattggttgcttgcccgccgatgtaccacctgatgaagttcattcctctgtattccaaagtgcaaaggccttgtacgtcaacacccatgatagacagctttgttcggctaatgaatgagttcactaatatgccagtacctccaaaaccccgacaagctcttggagataaaatcgtgagggatattcgccctggagctgcctttgagcccacatatatttacagactcctgacagttaacaagtcaagcctgtctgaaaagggtcgacaagaagatgctgaggaatacttaggcttcattctaaatggacttcatgaggaaatgttgaacctaaagaagcttctctcaccaagtaatgaaaaacttacgatttccaacggccccaaaaaccactcggtcaatgaagaagagcaggaagaacaaggtgaaggaagcgaggatgaatgggaacaagtgggcccccggaacaagacttccgtcacccgccaggcggattttgttcagactccaatcaccggcttttggtggacacatcaggtctgtggtttaccagcagagttcaaaagaatctgccactttgcagccatttttcacgttgcagttggatatccagtcagacaagatacgcacagtccaggatgcactggagagcttggtggcaagagaatctgtccaaggttataccacaaaaaccaaacaagaggttgagataagtcgaagagtgactctggaaaaactccctcctgtcctcgtgctgcacctgaaacgattcgtttatgagaagactggtgggtgccagaagcttatcaaaaatattgaatatcctgtggacttggaaattagtaaagaactgctttctccaggggttaaaaataagaattttaaatgccaccgaacctatcggctctttgcagtggtctaccatcacggcaacagtgcgacgggcggccattacactacagacgtcttccagatcggtctgaatggctggctgcgcatcgatgaccagacagtcaaggtgatcaaccagtaccaggtggtgaaaccaactgctgaacgcacagcctacctcctgtattaccgccgagtggacctgctgtaaaccctgtgtgcgctgtgtgtgcgcccagtgcccgcttcgtaggacaccacctcacactcacttcccgcctctctttagtggctctttagagagaaactctttctccctttgcaaaaatgggctagaatgaaaaggagatgccttggggttcgtgcacaacacagcttctgttgactctaacttccaaatcaaaatcatttggttgaaacagactgttgcttgattttagaaaatacacaaaaacccatatttctgaaataatgctgattcctgagataagaaagtggatttgatccccagtctcattgcttagtagaataaatcctgcaccagcaacaacacttgtaaatttgtgaaaatgaattttatctttccttaaaaaagaaattttttaatccatcacacttttcttccctaccctttagtttttgataaatgataaaaatgagccagttatcaaagaagaactagttcttacttcaaaagaaaaataaacataaaaaataagttgctggttcctaacaggaaaaattttaataattgtactgagagaaactgcttacgtacacattgcagatcaaatatttggagttaaaatgttagtctacatagatgggtgattgtaactttattgccattaaaagatttcaaattgcattcatgcttctgtgtacacataatgaaaaatgggcaaataatgaagatctctccttcagtctgctctgtttaattctgctgtctgctcttctctaatgctgcgtccctaattgtacacagtttagtgatatctaggagtataaagttgtcgcccatcaataaaaatcacaaagttggttt

SEQ ID NO: 33515 - DNA, 3067 bp, Homo sapiens
gatgcgagtgtgtatgtgcgggcgagaagatggcggcggcgggggaagcagcgtgagcagccggaggatcgcggagtcccaatgaaacgggcagccatggccctccacagcccgcagtatatttttggagattttagccctgatgaattcaatcaattctttgtgactcctcgatcttcagttgaggacaagaatatcagagaattgagtttggtgtcgatgaagtcattgaacccagtgacactttgccgagaacccccagctacagtatttcaagcacactgaaccctcaggcccctgaatttattctcggttgtacagcttccaaaataacccctgatggtatcactaaagaagcaagctatggctccatcgactgccagtacccaggctctgccctcgctttggatggaagttctaatgtggaggcggaagttttggaaaatgatggtgtctcaggtggtcttggacaaagggagcgtaaaaagaagaaaaagcggccacctggatattacagctatttgaaagatggtggcgatgatagtatctccacagaagccctggtcaatggccatgccaattcagcagtcccgaacagtgtcagtgcagaggatgcagaatttatgggtgacatgcccccgtcagttacgcccaggacttgtaacagcccccagaactccacagactctgtcagtgacattgtgcctgacagtcctttccccggagcactcggcagtgacaccaggactgcagggcagccagaggggggccccggggctgattttggtcagtcctgcttccctgcagaggctggcagagacaccctgtcaaggacagctggggctcagccctgcgttggtaccgatactactgaaaaccttggagttgctaatggacaaatacttgaatcctcgggtgagggcacagctaccaacggggtggagttgcacaccacggaaagcatagacttggacccaaccaaacccgagagtgcatcacctcctgctgacggcacgggctctgcatcaggcacccttcctgtcagccagcccaagtcctgggccagcctctttcatgattctaagccctcttcctcctcgccggtggcctatgtggaaactaagtattcccctcccgccatatctcccctggtttctgaaaagcaggttgaagtcaaagaagggcttgttccggtttcagaggatcctgtagccataaagattgcagtgttcggctaatgaatgagttcactaatatgccagtacctccaaaaccccgacaagctcttggagataaaatcgtgagggatattcgccctggagctgcctttgagcccacatatatttacagactcctgacagttaacaagtcaagcctgtctgaaaagggtcgacaagaagatgctgaggaatacttaggcttcattctaaatggacttcatgaggaaatgttgaacctaaagaagcttctctcaccaagtaatgaaaaacttacgatttccaacggccccaaaaaccactcggtcaatgaagaagagcaggaagaacaaggtgaaggaagcgaggatgaatgggaacaagtgggcccccggaacaagacttccgtcacccgccaggcggattttgttcagactccaatcaccggcatttttggtggacacatcaggtctgtggtttaccagcagagttcaaaagaatctgccactttgcagccatttttcacgttgcagttggatatccagtcagacaagatacgcacagtccaggatgcactggagagcttggtggcaagagaatctgtccaaggttataccacaaaaaccaaacaagaggttgagataagtcgaagagtgactctggaaaaactccctcctgtcctcgtgctgcacctgaaacgattcgtttatgagaagactggtgggtgccagaagcttatcaaaaatattgaatatcctgtggacttggaaattagtaaagaactgctttctccaggggttaaaaataagaattttaaatgccaccgaacctatcggctctttgcagtggtctaccatcacggcaacagtgcgacgggcggccattacactacagacgtcttccagatcggtctgaatggctggctgcgcatcgatgaccagacagtcaaggtgatcaaccagtaccaggtggtgaaaccaactgctgaacgcacagcctacctcctgtattaccgccgagtggacctgctgtaaaccctgtgtgcgctgtgtgtgcgcccagtgcccgcttcgtaggacaccacctcacactcacttcccgcctctctttagtggctctttagagagaaactctttctccctttgcaaaaatgggctagaatgaaaaggagatgccttggggttcgtgcacaacacagcttctgttgactctaacttccaaatcaaaatcatttggttgaaacagactgttgcttgattttagaaaatacacaaaaacccatatttctgaaataatgctgattcctgagataagaaagtggatttgatccccagtctcattgcttagtagaataaatcctgcaccagcaacaacacttgtaaatttgtgaaaatgaattttatctttccttaaaaaagaaattttttaatccatcacacttttcttccctaccctttagtttttgataaatgataaaaatgagccagttatcaaagaagaactagttcttacttcaaaagaaaaataaacataaaaaataagttgctggttcctaacaggaaaaattttaataattgtactgagagaaactgcttacgtacacattgcagatcaaatatttggagttaaaatgttagtctacatagatgggtgattgtaactttattgccattaaaagatttcaaattgcattcatgcttctgtgtacacataatgaaaaatgggcaaataatgaagatctctccttcagtctgctctgtttaattctgctgtctgctcttctctaatgctgcgtccctaattgtacacagtttagtgatatctaggagtataaagttgtcgcccatcaataaaaatcacaaagttggttt

SEQ ID NO: 33516 - DNA, 3289 bp, Homo sapiens
atggcagtagccccgcgactgtttggggggctctgcttccgtttccgggaccagaatccggaagtggctgttgaggggcgtcttccaatctcgcacagctgcgttggctgtagaagagaacggacggcgatggcgacggtcgcagcaaatccagctgctgctgcggcggctgtggcggcggcagcggcggtgactgaggatagagagccacagcacgaggagctgccaggcctggacagccagtggcgccagatagaaaacggcgagagtgggcgagaacgtccactgcgggccggcgaaagctggttccttgtggagaagcactggtataagcagtgggaggcatacgtgcagggaggggaccaggactccagcaccttccctggctgcatcaacaatgccacactctttcaagatgagataaactggcgcctcaaggagggactggtggaaggcgaggattatgtgctgctcccagcagctgcttggcattacctggtcagctggtatggtctagagcatggccagccacccattgaacgcaaggtcatagagctgcccaacatccagaaggtcgaagtgtacccagtagaactgctgcttgtccggcacaatgatttgggcaaatctcacactgttcagttcagccataccgattctattggcctagtattgcgcacagctcgggagcggtttctggtggagccccaggaagacactcggctttgggccaagaactcagaaggctctttggataggttgtatgacacacacatcacggttctcgatgcggcccttgagactgggcagttgatcatcatggagacccgcaagaaagatggcacttggcccagcgcacagctgcatgtcatgaacaacaacatgtcggaagaggatgaggacttcaagggtcagccaggcatctgtggcctcaccaatctgggcaacacgtgcttcatgaactcggccctgcagtgcctcagcaatgtgccacagctcaccgagtacttcctcaacaactgctacctggaggagctcaacttccgcaacccactgggcatgaagggtgagatcgcagaggcctatgcagacctggtgaagcaggcgtggtctggccaccaccgctccattgtgccacatgtgttcaagaacaaggttggccattttgcatcccaatttctgggctaccagcagcatgactctcaggagctgctgtcattcctcctggacgggctgcatgaggaccttaatcgggtgaagaagaaggagtatgtggagctgtgcgatgctgctgggcgaccggatcaggaggtggcacaggaggcatggcaaaaccacaaacggcggaacgattctgtgatcgtggacactttccacggcctcttcaagtccacgctggtgtgccccgattgtggcaatgtatctgtgaccttcgaccccttctgctacctcagtgttccactgcctatcagccacaagagggtcttggaggtcttctttatccccatggatccgcgccgcaagccagagcagcaccggctcgtggtccccaagaaaggcaagatctcggatctatgtgtggctctgtccaaacacacgggcatctcgccagagaggatgatggtggctgatgtcttcagtcaccgcttctataagctctatcagctagaggagcctctgagcagcatcttggaccgtgatgatatcttcgtctatgaggtgtcaggtcgcattgaggccattgagggctcaagagaggacatcgtggttcctgtctacctgcgggagcgcacccctgcccgtgactacaacaactcctactacggcctgatgctttttggacaccccctcctggtatcagtgccccgggaccgcttcacctgggagggcctgtataacgtcctgatgtaccggctctcacgctacgtgaccaaacccaactcagatgatgaggacgatggggatgagaaagaagatgacgaggaggataaagatgacgtccctgggccctcaactgggggcagcctccgagaccctgagccagagcaggctgggcccagctctggagtcacgaacaggtgcccgttcctcctggacaattgccttggcacatctcagtggcccccaaggcgacgacgcaagcagctgttcaccctgcagacggtgaactccaatgggaccagcgaccgcacaacctcccctgaagaagtccatgcccagccgtacattgctatcgactgggagccagagatgaagaagcgttactatgacgaggtagaggctgagggctacgtgaagcatgactgcgtcgggtacgtgatgaagaaggctcccgtgcggctgcaggagtgcattgagctcttcaccactgtggagaccctggagaaggaaaacccctggtactgcccttcctgcaagcagcaccagctggcaaccaagaagctggacctgtggatgctgccggagattctcatcatccacctgaaacgcttttcctacaccaagttctcccgagagaagctggacaccctcgtggagtttcctatccgggacctggacttctctgagtttgtcatccagccacagaatgagtcgaatccggagctgtacaaatatgacctcatcgcggtttccaaccattatgggggcatgcgtgatggacactacacaacatttgcctgcaacaaggacagcggccagtggcactactttgatgacaacagcgtctcccctgtcaatgagaatcagatcgagtccaaggcagcctatgtcctcttctaccaacgccaggacgtggcgcgacgcctgctgtccccggccggctcatctggcgccccagcctcccctgcctgcagctccccacccagctctgagttcatggatgttaattgagagccctgggtcctgccacagaaaaaaaaaaaaaaaagccctctctgcaatctcgcttctcgtgtccgccccgcttctcttattcgtgttaggtgcccccgccaggcattgcaggcttagtcgtggctactgttctcctgtgccgctgcatcgctctctcccgggaaagaacaggtcgtgtctcctcctagcagtgcgcgccccgcctgtgtttgcccttccagcagtgaccctcccttctagtctttatttatggtcgtgcccttccctctcctcagcccagagtgttctgcgtgggtggtgatgggggttcacctgaacacagagtgtattttcttattgaggccctgtaccttctgctgtgtgtgtgtatatataaagcaccagtctgctcccc

SEQ ID NO: 33517 - DNA, 3515 bp, Homo sapiens
gatggtacaatgaagggcattctgatcaggctaacaaaaacactgctcccagggtaggagtcctagcccacctcgggaacctcagcctccactttccatgccacctgtgccctaagtctacagggcgttaggaccccacaaggcacttttgtctttcttggttcccactgaagattttaccccacctagcccttcgacgcgtctgtgcacggggccatttccaatatggcagtagccccgcgactgtttggggggctctgcttccgtttccgggaccagaatccggaagtggctgttgaggggcgtcttccaatctcgcacagctgcgttggctgtagaagagaacggacggcgatggcgacggtcgcagcaaatccagctgctgctgcggcggctgtggcggcggcagcggcggtgactgaggatagagagccacagcacgaggagctgccaggcctggacagccagtggcgccagatagaaaacggcgagagtgggcgagaacgtccactgcgggccggcgaaagctggttccttgtggagaagcactggtataagcagtgggaggcatacgtgcagggaggggaccaggactccagcaccttccctggctgcatcaacaatgccacactctttcaagatgagataaactggcgcctcaaggagggactggtggaaggcgaggattatgtgctgctcccagcagctgcttggcattacctggtcagctggtatggtctagagcatggccagccacccattgaacgcaaggtcatagagctgcccaacatccagaaggtcgaagtgtacccagtagaactgctgcttgtccggcacaatgatttgggcaaatctcacactgttcagttcagccataccgattctattggcctagtattgcgcacagctcgggagcggtttctggtggagccccaggaagacactcggctttgggccaagaactcagaaggctctttggataggttgtatgacacacacatcacggttctcgatgcggcccttgagactgggcagttgatcatcatggagacccgcaagaaagatggcacttggcccagcgcacagctgcatgtcatgaacaacaacatgtcggaagaggatgaggacttcaagggtcagccaggcatctgtggcctcaccaatctgggcaacacgtgcttcatgaactcggccctgcagtgcctcagcaatgtgccacagctcaccgagtacttcctcaacaactgctacctggaggagctcaacttccgcaacccactgggcatgaagggtgagatcgcagaggcctatgcagacctggtgaagcaggcgtggtctggccaccaccgctccattgtgccacatgtgttcaagaacaaggttggccattttgcatcccaatttctgggctaccagcagcatgactctcaggagctgctgtcattcctcctggacgggctgcatgaggaccttaatcgggtgaagaagaaggagtatgtggagctgtgcgatgctgctgggcgaccggatcaggaggtggcacaggaggcatggcaaaaccacaaacggcggaacgattctgtgatcgtggacactttccacggcctcttcaagtccacgctggtgtgccccgattgtggcaatgtatctgtgaccttcgaccccttctgctacctcagtgttccactgcctatcagccacaagagggtcttggaggtcttctttatccccatggatccgcgccgcaagccagagcagcaccggctcgtggtccccaagaaaggcaagatctcggatctatgtgtggctctgtccaaacacacgggcatctcgccagagaggatgatggtggctgatgtcttcagtcaccgcttctataagctctatcagctagaggagcctctgagcagcatcttggaccgtgatgatatcttcgtctatgaggtgtcaggtcgcattgaggccattgagggctcaagagaggacatcgtggttcctgtctacctgcgggagcgcacccctgcccgtgactacaacaactcctactacggcctgatgctttttggacaccccctcctggtatcagtgccccgggaccgcttcacctgggagggcctgtataacgtcctgatgtaccggctctcacgctacgtgaccaaacccaactcagatgatgaggacgatggggatgagaaagaagatgacgaggaggataaagatgacgtccctgggccctcaactgggggcagcctccgagaccctgagccagagcaggctgggcccagctctggagtcacgaacaggtgcccgttcctcctggacaattgccttggcacatctcagtggcccccaaggcgacgacgcaagcagctgttcaccctgcagacggtgaactccaatgggaccagcgaccgcacaacctcccctgaagaagtccatgcccagccgtacattgctatcgactgggagccagagatgaagaagcgttactatgacgaggtagaggctgagggctacgtgaagcatgactgcgtcgggtacgtgatgaagaaggctcccgtgcggctgcaggagtgcattgagctcttcaccactgtggagaccctggagaaggaaaacccctggtactgcccttcctgcaagcagcaccagctggcaaccaagaagctggacctgtggatgctgccggagattctcatcatccacctgaaacgcttttcctacaccaagttctcccgagagaagctggacaccctcgtggagtttcctatccgggacctggacttctctgagtttgtcatccagccacagaatgagtcgaatccggagctgtacaaatatgacctcatcgcggtttccaaccattatgggggcatgcgtgatggacactacacaacatttgcctgcaacaaggacagcggccagtggcactactttgatgacaacagcgtctcccctgtcaatgagaatcagatcgagtccaaggcagcctatgtcctcttctaccaacgccaggacgtggcgcgacgcctgctgtccccggccggctcatctggcgccccagcctcccctgcctgcagctccccacccagctctgagttcatggatgttaattgagagccctgggtcctgccacagaaaaaaaaaaaaaaaagccctctctgcaatctcgcttctcgtgtccgccccgcttctcttattcgtgttaggtgcccccgccaggcattgcaggcttagtcgtggctactgttctcctgtgccgctgcatcgctctctcccgggaaagaacaggtcgtgtctcctcctagcagtgcgcgccccgcctgtgtttgcccttccagcagtgaccctcccttctagtctttatttatggtcgtgcccttccctctcctcagcccagagtgttctgcgtgggtggtgatgggggttcacctgaacacagagtgtattttcttattgaggccctgtaccttctgctgtgtgtgtgtatatataaagcaccagtctgctcccca

SEQ ID NO: 33518 - DNA, 4497 bp, Homo sapiens
cggaggcagcggctgcgccctgcgccggggcggagccgggggcgggccggcggccggcaggcgggggctggggcccgaggccgggagtgcctgagcgccggcggcgacgacggcagcggcggcccagcgggctcggtggttgggtccgcggcggctcggggtccgcccgcgggctgcggtgcgagcgggcggcccggctcccctcctcccccgcccgccgccgccgctgtgattgggtggaagatggcgctggccggatggaaatcctaatgacagtctccaaattcgcctccatctgtaccatgggcgccaatgcttcggcattagagaaagagattggtccagaacagtttccggtcaatgagcactattttggattagtcaattttgggaatacctgctactgcaattcagttcttcaagcactttatttttgtcgtccatttcgggaaaaagttcttgcgtataagagtcaacctaggaaaaaggagagccttcttacatgcttagcagatctcttccatagcatagccactcagaagaaaaaggttggagtaataccccctaagaagttcatcacaagattacggaaagaaaatgagctttttgacaactacatgcaacaagatgcccatgaattcttaaattacctactaaatacaattgctgatattttacaagaagagagaaagcaggaaaaacaaaatggtcgtttacctaatggtaatattgataatgaaaataataacagcacaccagacccaacgtgggttcatgagatttttcagggaacattaactaatgaaaccagatgtcttacttgtgaaactataagcagcaaagatgaagattttttagacctttctgttgacgtggaacaaaatacatcaattactcactgcttaaggggtttcagcaacacagaaactctgtgcagtgaatacaagtattactgtgaagagtgtcgcagcaaacaggaagcacacaaacggatgaaagttaaaaaactgcccatgattctagctctacacctgaagagatttaaatatatggatcaacttcatcgatatacaaaactctcttaccgggtagtttttcctttagaacttcgtctgtttaacacttcaggtgatgccaccaatccagacagaatgtacgaccttgttgctgttgtggttcactgtggaagtggtcccaatcgaggccattatattgcaatagttaagagtcatgatttttggttgttgtttgatgacgacattgtagaaaaaatagatgcacaagctattgaagaattctacgggttgacatcagatatctcaaagaactctgagtctggttacatccttttctatcagtctcgggactgagagggaaccgtgatgaagagacactttctgcctcatttcttctctggttattttggaaaggatcaagcactgatttttcaagaaaagagaaatgcaggaagctcagggggcagtagcacactttgcacacgataaagcaaagacgatggattgacaagcccttccgatcatggtagttgatttatttgctcaggtatcatgctgtctgtacagttccatacaacaaggaggtgaaatcagagataccagctcctcttttaaaacagccttccagtcattggcacgcattttctctttattaattgcaccaataatgctttgaattccttgggggtgcagtagaaagaatcggaatctgtgccgtattgataaggagatgatgttgaacacactgcataaatttgcctggttcagtatgtatagaagcatattcagtggtcttttcaagagtaaaccagaaatacttttgggcccaacacttgcagttgccttcctgatgtaaaaactaacatgctagataatccagtgtcgggaagacaaagatgttttgcttctctgaagaagcttataataatatacagtatatgtatatgtagggagcaattggtcaaaagtggctttttgtttccccaaggggaaagactggctttgtaattataattttttccttatttattttacttaaaactggtagagtctaagtattatatgaagtgcccatgattctgtcagtaaatttgaacatatttttattagttaatgtcagtttaagttgtccttttgtttgtttctatttttaaggtgaattttaatttctatctgaaatcagttaagataccttgagaaaaactgcagtgagaggagataaatatcctttttcaggaggaactgatatctctggctaaatatttgtccttttattatggtttctaaatcagttattttcttcagctttaatttcataaaattaaaaaactattttaaaaattcctgtagttgttggaataattaaaaattctggtgcagtggtggtataccaatctttagaattcttaagtattctaatgtttcaagttgagatcatgcttgggaaaatcatgtcatagcatttatgttattttcagatgccattttttaccctggaaagaagtcataatgttcatcataaccctagcagcctggatagtgagctaaacaaacccttcaaagattaaattttaatcaagtagaccgggaatacaaaagacaagtccttccttcccttccccccacctttacaaatcttactggaagggtgttcagaaattaaaatctgtgtttgctaagacttcattctgttgggggttttaagaagtaatatatgtaacataaaatatatgtaaacgattgcagtttttttggacgtttttccatgcatcagtaagttgtctgacagtagccaaatgtaacttgcagaaaattattgaaaattatattcagaataatagcaatcaggccttggatgttctttattaaactcttttcaggcagtaaatttaaaaaaaattgtcattttctaaagtccttttgctaaaactgttgactatggaaaacaacaaaaaggaattttttagtctgctgctattattaacatttattatctgtatcttttggctcaggaaatgacttcacctattttttccataagcagacctttaacagagtcacttaattgggctgcttaaacagatgttctgggagaaaattataatatttagtatttgtacaaaatatcaaaaagtattttgacaagtttctttttaagatagttcctaaagccttaccctggctagaggtgttttgtacaaattatatataagccagcctgatctaccaacatgccacagagaatcacaatcaacagtgtggggaaagtcagggcagtggaagtggatgcactctttttattttgaaggcttaaaccaaattgtcttggaattaaagctgtatttctgcagctttcggtacagagaaaaagaggaaagtgaagctgtgtcagttttaacattagctatatcaacatgtttaagaaagatagatgaagtcatttgcataaaggtacagcattgaaatactatgttgtgtttgtttttacatttttgcattaaaaaaaaacatgccgtaaaagccaagttaaatttcatattaaagcaagttctagtgtatgtgttgagttcctggtaatcacatacttgttcacatctacaccgtacttcatagtatgatttgtcaggggagggattgtggggtgacagttttacatttactttttcttcttaatgcagctggatctaagtaaaatgttttgaagtttatcagaaactaaatgtacttttaaaacgtatagggtcagggttgggggaaaaatacaggtatagtaagtaagaaaagtgacccatgaagaaagcatcgtgaggttgtatgttggttgactgtgattaaaatgcggggctggtgtaagttgtaagtggtggctgattgccgtgtaactatgtacatgattgttgggatggctgtcccatattttgtatattggaataaaaatttctataaattattgtaactaaaagtaaatattctaaattaagtcccacttcttaagtcacatggcttctgtcttggaaattttacctttaaaagattatttaagacaggaaccaggaggcttgggaacagggaaagagggaaatgttgtattatgtgggtcttggggcctctaaccatcagtatagggttttttctttccttgatggcagtagaaagacctcattttcataacataactactcttgatactttctttaaaaacactttttattaaagattctatcatgaggtatttggctgggagctgggaggctaaagcgctcatgtcctggctcttcagtgaatttaactgtgtgaccttgggcaagtcacttaacctctctgtgcttcagtctccctgtcttgtaaaatgggagtaatacctacctcacagggttgttgtggggattaattagagataatgtctgtaaagcatttaaggttcttgaagaaggcactatataaatacaaaataatatctattaaagttggtttatttgtg

SEQ ID NO: 33519 - DNA, 8323 bp, Homo sapiens
ggcctcctcggagttgcccctctgcaagccaacaattcgggatagaaaacacctccgtggtgttttcccggggccctcccgcgccgcgttcggccgccagcccgctcgagctcccgcgccaacgcctcaggggttcgccctccgccccccgccgccgcgcccggcccacgcgcagggcccctctccagcgccccctccccggcacgctgcggctggcgctccccagccccgcctgacgctgcagctgggccggagactcgccattggattaaaaatagcgtcgccagtccgccccaagcccgcggtgcccgctcccgccccgcagcccgctctccccgcccgccccggctcggccggctgccgttgcccgcgcagcccgcccgtcagcccgctcgctggcgccgccgccgccggcagaccccgcgctccggctccggctcggctcgctcggctccggtgcgcgccgaggccatgcagcgccggggcgccctgttcggcatgccgggcggcagcggaggcaggaagatggctgcaggagacatcggcgagctgctagtgccccacatgcccacgatccgcgtgcccaggtccggcgacagggtctacaagaacgagtgcgccttctcctacgactctcccaattctgaaggtggactctatgtatgcatgaatacatttttggcctttggaagggaacatgttgaaagacattttcgaaaaactggacagagtgtatacatgcacctgaaaagacatgtgcgagagaaggtaagaggggcgtctggtggagcgttaccaaaaaggaggaattccaagatttttttagatctagatactgatgacgatttaaatagcgacgattatgaatatgaagatgaagccaaacttgttatattcccagatcactatgaaatagcactaccaaatattgaggagttaccagccctggtaacaattgcttgtgatgcagttctcagctcaaaatctccatacagaaagcaggacccagacacgtgggaaaatgaattgccagtatctaaatatgccaacaacctcacccagctggacaatggagtcaggattcctccaagtggttggaagtgtgccagatgcgacctgcgagaaaacctctggttgaatctgactgacggctctgtcctgtgtggaaagtggttctttgacagctctgggggcaacgggcatgcgctggagcattacagagacatgggctacccactagccgtgaaactgggaaccatcactcctgacggggcagatgtttattcttttcaagaagaagaacctgttttggatcctcatttggccaagcacttagcgcattttggaattgatatgcttcatatgcatgggacagagaatgggctccaggacaatgacatcaagctgagggtcagtgagtgggaagtgatccaggagtcgggcacgaaactgaagccaatgtatggtcctggctacacgggtctgaagaacctgggcaacagctgctatctcagctctgtcatgcaggccatcttcagcatcccagaattccagagagcgtatgtaggaaaccttcccagaatatttgactactcgcctttagatccaacacaagatttcaacacacagatgactaagttaggacatggccttctctcaggccagtattcaaagcctccggtgaaatctgaactcattgaacaggtgatgaaggaggagcacaagccacagcagaacgggatctctccgcgcatgtttaaggcctttgtaagcaagagccacccggaattctcctctaacaggcagcaagatgcccaggaattcttcttgcacctggtgaatctagtagagaggaaccgcatcggctcagaaaacccaagcgatgtttttcgttttttggtggaagaacgcattcagtgctgtcagacccggaaagtccgctacacggagagggtggattacctgatgcagttacctgtggccatggaggcggcaaccaacaaggatgaactgatcgcttatgaactaacgagaagggaagcagaagcaaacagaagaccccttcctgagttggtacgtgccaagataccatttagtgcctgccttcaggccttctctgaaccagaaaatgttgatgatttctggagcagtgccctacaagcaaagtctgcgggtgtgaaaacatctcgctttgcttcattccctgaatacttggtagtgcagataaagaagttcacttttggtcttgactgggttcccaaaaaatttgatgtttctattgatatgccagacctacttgatatcaaccatctccgagccagggggttacagccaggagaggaagaacttccagacatcagcccccccatagtcattcctgatgactcaaaagatcgcctgatgaaccaattgatagacccatcagacatcgatgagtcatcagtgatgcagctggccgagatgggtttcccgctggaagcatgtcgcaaggctgtgtacttcactggaaatatgggcgccgaggtggccttcaactggatcattgttcacatggaagagccagattttgctgagccgctgaccatgcctggttatggaggggcagcttctgctggagcctctgtttttggtgcttctggactggataaccaacctccagaggaaatcgtagctatcatcacctccatgggatttcagcgaaatcaggctattcaggcactacgagcaacgaataataacctggaaagagcactggattggatctttagccaccctgagtttgaagaagacagtgattttgtgattgagatggagaataatgccaatgcaaacattatttctgaggccaagcccgaaggacctagagtcaaggatggatctggaacatatgagctatttgcattcatcagtcacatgggaacatccacaatgagtggtcattacatttgccatatcaaaaaggaaggaagatgggtgatttacaatgaccacaaagtttgtgcctcagaaaggccccctaaagacctgggctacatgtacttttaccgcaggataccaagctaaacctcaaatataaaaattggcgaaaagaagccatacgcctttttaatttgccaaaaaaaaaaagaagaagaagaagttgaaacaactagacatgaaggaatatatggggtatttatcgtttatttaaagagcacgatcagttgacaccttctgaaatagaactgagaagaaatttctattagtgatgatacactattatattgtagatagtttttataaatgttcaaaaagatgatgatatttaaaaacaaaaaaagtattcatattgctggtggaggatctgccatcagcacatcaaaaatggggatgtgcccccagccctctattttgctttgggggtcagtgatagtggcctctggagaaaccaaataatgtggccagtggtgtggccttacccacaacaaatgaaaagcccacttgtgtttcatatagaaaatcagcagttgggtggggctttatttgtgacataatttttttcatgacatacaataatttctgatgtatccatgtagatattatgctctgtccataatagagcctctgcaatgaaagatatttttaatttgtcacattaaaattcataatacgattgtgtgaatgtgtgtgagactgactgagagtgtgagacttttactagaaaagtgagtccactagaaaatctgtgacaagttggtttttaaagtctgaacagttgatattaagcatatctgaaaaaagcaagtaaatattttaacaaaactatgactcaggaaccttcgagaagattagttccccacttagatttttaaggagtaaaaagggctgagttatgcctttaagtgctgtcaagaattcacttgggtttgggacatttgctggtgtaatgctagatgcccacagcagcataatattgtactttgtcaaaggtaggtaaattctctgtttctcagcagccctttccccaaaaggtatggtgtttatttttagtaaaaatagctaatctctttttaccatctcacatgataactctttggagtcatgtcaagtgccccaaatttgtctgtgattttcccatctctgagctctttatctgcctccgtttccttgtttttctggggccagagtctcatctctgcctttttttggtgtatcaccttctgacttgccttcattgcttgtctgatgtgaccaacagtgtgatcttggacacactaaggattttagatgcaaagaaactttatacaacattatgaaagactatcctttccattttggttatttcagcattttagttgcaacctgggattagattagagtttccaacgtgatgaaaagtggaatgatagcattctataatttccataattttcctactggtccgtaccaaattctagagtctctggagttgctatttcagagtatttggtcaaacgaaaaagaatttattgctgtctgtttaacatgtatttgtttggttgaaaggatctttttagaaactgtaggaaaataaacagaaccaaccaggtgaaacaaagcacagacattgggttaggatgtagtgagttgtgaacaatcaggattctgggtgtgatgggggtccctgtctcataggtgatcctttggtgccatgtgaccgagagacatggtgtctaaggcccatggcctggagacctgggtgctgctcctagctgactgtggaccttgggcaagtccttcatccgtcctgtgcctcactgtcctcatctgaacaatggtatgatgacacctgccctctctttcaatcatgctttgaggatacagtgagattggttacagtgaaccttcaatgagtagaatgtggtatgccatggtgggttgtagtagatggtgctccctgccttttctcctctgttttcctcaatttgggaacaaatgagattggcagaaggagggagctcacggtgcagtacttttctaccaaagtgtgcccactggtgtcacctcctaatgttaacttggatttcctaaagcagtcccactctgttatgagagtcactgactcccgtggacatccccacagtaagcagccttacaaaatccagtccccttagggcagagtgagtgtcatagaataatgactccaaacccacgtcaaaaatggcttgttttcagcgatgttataaaacaaaggcctgttttttggaattgggggtgactgggtggtttggattgaaatgtggacaaagatagcatgtgtattttgaataaaataaaaattttgtaataaaacttttaaaaatcagtgatgtaaaatcaatatttaagactataggctataaattgtttgatttcattaactagcccttttgatgcctagacatgttgtaaaaaaattgtgctatggctgccttttcttctgccccacaacacaaagggctatttctacaaggcaaagttttgtatatgtgctattctttacttcagattgagagttgggaaaaactggagtaaataatgggtttcttacttgcttaaaagcatatttatatgtgtatctcaatatatacaaggcaggttcccctataaaagtctggaatgtactgcttaattttacacttgtgtagacacgattatttgtgactgaaaagtggaataacgtgtggattttgtcaactcattatcagtctgttagcagtcctctatgtgaggcatggtggtctaattgtgaaattctccctgtatatgggtgtctgtgtgaaagacagcactttcttcctgtaaatatcttttgatatccatttatgtagaattccaatgaatatgtctttggaaaaggtaatgtatcaaagtttttattttgccaattgatctaaatgcccatataactaatcagaaatccagtttggttcagattgggattttcttttaaagaaaaaaaaagtatgcagaaaagactattggaagaatcatgtgttagtgacactttacatcaacgttgcttcaatattttggaattgaccaggctgctttctcctacctgcaagagaatgtgcctgacatttcccagtgcttactttgggctataggaagtccagcggggatagctcgagcctcttgctccctgagtcatttattccctttacctgaacagagccttacctgcaattcatagtgagagcacctgggtctgtatcctgactccactctaagtgaggtgggactgaatcactgtacctctctgggccttttcatttgaaacaagtgggttagactagattagctccaaagtcctctcttgccctaacattttatttttattttcctgtggttaccactagggtctgacacgtaaaatgtgagggatcacttagaggtttggatgttatatttttgcattgttacagcttatactccccagttgaggacctgtgtcattcttagtggccccacgacccctctgtttgtattcctgctccacttatctatacttttttgggtaatcatcccactttttttttttcttgagatggagtctcgctgtgttgccaaggctggagtacagtggtgcaatctcagctcactgcagcctcctcccgggttcaagtgattctcctgcctcagcttcccaagtagctgggattactggcgcacgccactacgcccagctaatttttgtatttttagtagagacagggttttgccatgttggccaggctggtcttgaactcttgacctcaacctgcctcagcctcccaaagtgctgggattacacgcatgagctaccgcgtccagccccactttttttctactcttgaaaaaaacaactttctagtccatgaggtactttggctccatccccctcaaaaacaaaacaaaaaatccatttaaagtgtcctcctagaaaagcctcagaactgccttcaactacatctgtcacctttatagaatattttgaaattctggaagaggatgggaaacaaaattctaatttagctagagctgtgatccccaaataagtgctgacaaaattgtctaccacagaaaggccgtccttgtcatcttgtaggcatcactgctgctaaatcacatcagtacatgccttctgtggggagatggcagggggcaggggcaggaccaggggatgggattagataaagtgtgataatgtcctttagataaaagaaatcctacgctatagaacaaggttctgtactcttgagttggtgtctgagatcacctgcacagtgttacagagattttccactccataaatcactctaaaagagtttgcataagactcggtagacctgtgctattcaatgtggcagtcaacagccatatgtggcgatgactactcaaagtttggcttgttcaaatcgagactgtgttgtacacatacaatacacaccagattttgaaggcttggtaccaaaaaggaatttaaaatatttcaccaatatttcatattgataacatgctgaaatgacactattttggatgtactaagtaaaatattaacaatttaatatatttatataattgaaattaaaattcttttcacccatttttatttttttaaaaatgtggcccctaaagaacttcaaattagacatgtggataacgttatacttctattggacagccccactctagacttacatggtgtggggtaggcagtgaaatccgtaaataggaaacgcaattctgcaaagtatctaaatagacagaaacaacacaaatatttttgctggagtcaggagcactgtgaggcacagaacatctcccagaaagcagattttttttttctgccgaaaaaccaatatatatatgtatgatcccaattaaaagacaaaagcaaatgagccccaaactgcctgtcttcagctttgcctgggagctgctacctttgctcttctagcatcttctaggtaccaaggatattagccacttgagggtgttgggcatatttgtttcattgtaggcaaaatcctcttgtggtttcccctccccaggtattgttgagtctgttcaaagctgggtgtgttgaaacactgcacaaatcctgccactcttgatgtgccgcttgtctcagccttggcagaggctgagtctgttcctgtgcccacctgtccagcaggttttgatgttggctcctgaaagagtttgtatttattttattttgcactagtcacagttgttgttaaactgtatcaaatgttttgggagattatttgcctgagatggaaagagagatggatgatttattgcttcaattgttttaaattaaaagctattctcacaa

SEQ ID NO: 33520 - DNA, 4156 bp, Homo sapiens
gtctcctcgctgcagtcgctccggagctgcacgggtgttttgcgtgttgctgcgtcatcgccagtggccggtttgaatgagactcgtcgcaccgaagccgccgccaccaccgcgcctccgcctcggccgccgccgcagctgctcctggtccccgtccctttgccgccctcgtcaggcccagctctcctgcgccgccgcctcccgccgcgccccgccatgccgctctactccgttactgtaaaatggggaaaggagaaatttgaaggtgtagaattgaatacagatgaacctccaatggtattcaaggctcagctgtttgcgttgactggagtccagcctgccagacagaaagttatggtgaaaggaggaacgctaaaggatgatgattggggaaacatcaaaataaaaaatggaatgactctactaatgatggggtcagcagatgctcttccagaagaaccctcagccaaaactgtcttcgtagaagacatgacagaagaacagttagcatctgctatggagttaccatgtggattgacaaaccttggtaacacttgttacatgaatgccacagttcagtgtattcgttctgtgcctgaactcaaagatgcccttaaaaggtatgcaggtgccttgagagcttcaggggaaatggcttcagcgcagtatattactgcagcccttagagatttgtttgattccatggataaaacttcttccagtattccacctattattctactgcagtttttgcacatggctttcccacagtttgccgagaaaggtgaacaaggacagtatcttcaacaggatgctaatgaatgttggatacaaatgatgcgagtattgcaacagaaattggaagcaatagaggatgattctgttaaagagacagactcctcatctgcatcggcagcgacaccttctaaaaagaaaagtttaatcgatcagttcttcggtgttgagtttgaaactaccatgaaatgtacagaatctgaagaagaagaagtcaccaaaggaaaggaaaatcaacttcagcttagctgttttatcaatcaggaagtcaagtatctttttacaggacttaaattgcgacttcaggaagaaatcaccaaacagtctccaacgttgcaaagaaatgccttgtatatcaaatcttccaagatcagccggctgcctgcttacttgaccattcagatggttcgatttttttataaagagaaggaatctgtgaatgccaaagttcttaaggatgttaaatttcctcttatgttggatatgtatgaactgtgtacaccagaacttcaagagaaaatggtgtcttttcgatccaaattcaaggatctagaagataaaaaagtgaatcagcagccaaatacaagtgacaaaaagagtagtccccagaaagaagttaagtatgaacccttttcttttgctgatgatattggctccaataattgtggatactatgacttacaagcagtactaacacaccagggaaggtctagttcttcaggtcattatgtatcatgggtgaaaaggaaacaagatgaatggattaagtttgatgatgacaaagtcagcatcgtaacaccagaagatatcttacggctttctggtggtggagactggcatatcgcttacgttctactctatgggcctcgcagagttgaaataatggaagaggaaagtgaacagtaatcttcattttagtatttatgcttagatgtgaaaataaatgttatttgttgatcatttctataatccagagctttagaggaagacacataggtgggtttatgtttcacctcatttggaacaaaagaggacagaagcagaccactctgtgcaccaacctaaaaaattacagagaagagaaaattatctttggattgtgctgccctatataaaggtggcagaaagacatttttaaaaagcttattatttcttgcattattttaaaaagttcagagttgaaatgcctttcaaccatttccttctgtggtcatttttcttgctgcctttttcacccaagattcagcagtcagatgtttactgcacacctattacctattatttgctgttcttgcatggttcaaaccaccattctgtagccacccatcctttgccttatctaacaaacatttttccaggaaggtggaaaaggaagtgttgctctcattgtgtgactcagtgctgctgtccatcccatggaaacatgggcacaatcaagtatttgtccagcctattgcaggcttttcctgactttaaaataaattgtgatcaataatagtacctttgattatacatttattattgtgtctctctctgatgtactgtggattgtacatttaactttggaatggctttgtaataatcagtcttaagaaaatgttgacaagctctggttgcttatttttagaaaatgaggacatttaataataataaaaaaaaagggattaatagcttttgacctcaagtcttttgtcttctgagtgttggagcttggctgaagacatgtttaatactgtacaatttctgaagatggttattaacactgtgctgttaagcatccatttaaaaatatttgttatcttctttgcctgcctgtattttaaaaagaaatacaaagttgtaaaagtaatggatttctttggatgctgaatgcagtgatgttatcagtcagattctttccttggctcagttgtgtttgtatttcctttcttaattccccaaatcttggctgggcacggtggctcacgcctgtaatcccagcactttgggaggctgaggcaggtggttcactggaggttgagttcgagaccagcctggccacatggtgaaaccctgtctctactaaagatataaaaattagctggatgtggtggtgcacacctgtgatcccagctacttgggaggctgaggtgggagaattgcttgaacctggaaggcagaagttgcagtgagctgagatcacaccactgcactccagcctgggtgacagagagactctgtctcaaaaaaaaaaagaaaaaattcccaaatcttaatgtctgtttcagaattttagtgattttaaagtgatagtagaaaataccaagcatatgaggtatttcaatatgataggcttcttacattttaatagttactcatctttgttccaggacccttgactgatgctagggaaaggataaagcatagaataccagccagtttggctctgattttgagttatttataataaagtttggggattatcataacatctcatatctttgtgtatgttgttttaatgctcggcagagcacaacactgatgataactattaaaaatagaaaataacagccattttactttcaaatctgatgtgatgcaatctgtgaacactaggaggggataaaataagcattgcagggaaacttatttgtaaatagcttcctcacctaaactttgacttggcaatcaatactttctactttgtggaggggattaagaatagaatgggcaggatgagaccatgaaaattataatgattcatgtatatttgtatgatgcttgtaactttgcaaagtcttttttattcattgtctcatttggtcagaacaattttattgaggacatgaatttaacaattagaatttagattttctgactgtagctactaaatgttgtagctactagaccaggtgagctaggtttagagcaaagtatataagccttgtatggactatattagaattttaaaaattgtaattaattccttatcatcattataaaaagcttgatttttttatttgatctaaaaaagcattattccaaagaattttttcaagtagaaatgggagttagttataccagtgttgtttttaactaataaggctattttagaattcagccttgcctgtaaggtctttgagaagggagaggagtaggccaaaaaaaaaaaagtcttgattcctgaatgtgccttatatgctgtgccactcacaccgaggccatcatctcaacattagagttgtgctagattactgcttgactgactagctaggttaggcctaagagtgtttaccgaataatctgcactcactcagtagcccttcttcaggattaaaaacgatgatgacctcatcttagagccctaaagggaaatgcttat

SEQ ID NO: 33521 - DNA, 4051 bp, Homo sapiens
gtctcctcgctgcagtcgctccggagctgcacgggtgttttgcgtgttgctgcgtcatcgccagtggccggtttgaatgagactcgtcgcaccgaagccgccgccaccaccgcgcctccgcctcggccgccgccgcagctgctcctggtccccgtccctttgccgccctcgtcaggcccagctctcctgcgccgccgcctcccgccgcgccccgccatgccgctctactccgttactgtaaaatggggaaaggagaaatttgaaggtgtagaattgaatacagatgaacctccaatggtattcaaggctcagctgtttgcgttgactggagtccagcctgccagacagaaagttatggtgaaaggaggaacgctaaaggatgatgattggggaaacatcaaaataaaaaatatggagttaccatgtggattgacaaaccttggtaacacttgttacatgaatgccacagttcagtgtattcgttctgtgcctgaactcaaagatgcccttaaaaggtatgcaggtgccttgagagcttcaggggaaatggcttcagcgcagtatattactgcagcccttagagatttgtttgattccatggataaaacttcttccagtattccacctattattctactgcagtttttgcacatggctttcccacagtttgccgagaaaggtgaacaaggacagtatcttcaacaggatgctaatgaatgttggatacaaatgatgcgagtattgcaacagaaattggaagcaatagaggatgattctgttaaagagacagactcctcatctgcatcggcagcgacaccttctaaaaagaaaagtttaatcgatcagttcttcggtgttgagtttgaaactaccatgaaatgtacagaatctgaagaagaagaagtcaccaaaggaaaggaaaatcaacttcagcttagctgttttatcaatcaggaagtcaagtatctttttacaggacttaaattgcgacttcaggaagaaatcaccaaacagtctccaacgttgcaaagaaatgccttgtatatcaaatcttccaagatcagccggctgcctgcttacttgaccattcagatggttcgatttttttataaagagaaggaatctgtgaatgccaaagttcttaaggatgttaaatttcctcttatgttggatatgtatgaactgtgtacaccagaacttcaagagaaaatggtgtcttttcgatccaaattcaaggatctagaagataaaaaagtgaatcagcagccaaatacaagtgacaaaaagagtagtccccagaaagaagttaagtatgaacccttttcttttgctgatgatattggctccaataattgtggatactatgacttacaagcagtactaacacaccagggaaggtctagttcttcaggtcattatgtatcatgggtgaaaaggaaacaagatgaatggattaagtttgatgatgacaaagtcagcatcgtaacaccagaagatatcttacggctttctggtggtggagactggcatatcgcttacgttctactctatgggcctcgcagagttgaaataatggaagaggaaagtgaacagtaatcttcattttagtatttatgcttagatgtgaaaataaatgttatttgttgatcatttctataatccagagctttagaggaagacacataggtgggtttatgtttcacctcatttggaacaaaagaggacagaagcagaccactctgtgcaccaacctaaaaaattacagagaagagaaaattatctttggattgtgctgccctatataaaggtggcagaaagacatttttaaaaagcttattatttcttgcattattttaaaaagttcagagttgaaatgcctttcaaccatttccttctgtggtcatttttcttgctgcctttttcacccaagattcagcagtcagatgtttactgcacacctattacctattatttgctgttcttgcatggttcaaaccaccattctgtagccacccatcctttgccttatctaacaaacatttttccaggaaggtggaaaaggaagtgttgctctcattgtgtgactcagtgctgctgtccatcccatggaaacatgggcacaatcaagtatttgtccagcctattgcaggcttttcctgactttaaaataaattgtgatcaataatagtacctttgattatacatttattattgtgtctctctctgatgtactgtggattgtacatttaactttggaatggctttgtaataatcagtcttaagaaaatgttgacaagctctggttgcttatttttagaaaatgaggacatttaataataataaaaaaaaagggattaatagcttttgacctcaagtcttttgtcttctgagtgttggagcttggctgaagacatgtttaatactgtacaatttctgaagatggttattaacactgtgctgttaagcatccatttaaaaatatttgttatcttctttgcctgcctgtattttaaaaagaaatacaaagttgtaaaagtaatggatttctttggatgctgaatgcagtgatgttatcagtcagattctttccttggctcagttgtgtttgtatttcctttcttaattccccaaatcttggctgggcacggtggctcacgcctgtaatcccagcactttgggaggctgaggcaggtggttcactggaggttgagttcgagaccagcctggccacatggtgaaaccctgtctctactaaagatataaaaattagctggatgtggtggtgcacacctgtgatcccagctacttgggaggctgaggtgggagaattgcttgaacctggaaggcagaagttgcagtgagctgagatcacaccactgcactccagcctgggtgacagagagactctgtctcaaaaaaaaaaagaaaaaattcccaaatcttaatgtctgtttcagaattttagtgattttaaagtgatagtagaaaataccaagcatatgaggtatttcaatatgataggcttcttacattttaatagttactcatctttgttccaggacccttgactgatgctagggaaaggataaagcatagaataccagccagtttggctctgattttgagttatttataataaagtttggggattatcataacatctcatatctttgtgtatgttgttttaatgctcggcagagcacaacactgatgataactattaaaaatagaaaataacagccattttactttcaaatctgatgtgatgcaatctgtgaacactaggaggggataaaataagcattgcagggaaacttatttgtaaatagcttcctcacctaaactttgacttggcaatcaatactttctactttgtggaggggattaagaatagaatgggcaggatgagaccatgaaaattataatgattcatgtatatttgtatgatgcttgtaactttgcaaagtcttttttattcattgtctcatttggtcagaacaattttattgaggacatgaatttaacaattagaatttagattttctgactgtagctactaaatgttgtagctactagaccaggtgagctaggtttagagcaaagtatataagccttgtatggactatattagaattttaaaaattgtaattaattccttatcatcattataaaaagcttgatttttttatttgatctaaaaaagcattattccaaagaattttttcaagtagaaatgggagttagttataccagtgttgtttttaactaataaggctattttagaattcagccttgcctgtaaggtctttgagaagggagaggagtaggccaaaaaaaaaaaagtcttgattcctgaatgtgccttatatgctgtgccactcacaccgaggccatcatctcaacattagagttgtgctagattactgcttgactgactagctaggttaggcctaagagtgtttaccgaataatctgcactcactcagtagcccttcttcaggattaaaaacgatgatgacctcatcttagagccctaaagggaaatgcttat

SEQ ID NO: 33522 - DNA, 1681 bp, Homo sapiens
gtcatcgccagtggccggtttgaatgagactcgtcgcaccgaagccgccgccaccaccgcgcctccgcctcggccgccgccgcagctgctcctggtccccgtccctttgccgccctcgtcaggcccagctctcctgcgccgccgcctcccgccgcgccccgccatgccgctctactccgttactgtaaaatggggaaaggagaaatttgaaggtgtagaattgaatacagatgaacctccaatggtattcaaggctcagctgtttgcgttgactggagtccagcctgccagacagaaagttatggtgaaaggaggaacgctaaagggaatgactctactaatgatggggtcagcagatgctcttccagaagaaccctcagccaaaactgtcttcgtagaagacatgacagaagaacagttagcatctgctatggagttaccatgtggattgacaaaccttggtaacacttgttacatgaatgccacagttcagtgtattcgttctgtgcctgaactcaaagatgcccttaaaaggtatgcaggtgccttgagagcttcaggggaaatggcttcagcgcagtatattactgcagcccttagagatttgtttgattccatggataaaacttcttccagtattccacctattattctactgcagtttttgcacatggctttcccacagtttgccgagaaaggtgaacaaggacagtatcttcaacaggatgctaatgaatgttggatacaaatgatgcgagtattgcaacagaaattggaagcaatagaggatgattctgttaaagagacagactcctcatctgcatcggcagcgacaccttctaaaaagaaaagtttaatcgatcagttcttcggtgttgagtttgaaactaccatgaaatgtacagaatctgaagaagaagaagtcaccaaaggaaaggaaaatcaacttcagcttagctgttttatcaatcaggaagtcaagtatctttttacaggacttaaattgcgacttcaggaagaaatcaccaaacagtctccaacgttgcaaagaaatgccttgtatatcaaatcttccaagatcagccggctgcctgcttacttgaccattcagatggttcgatttttttataaagagaaggaatctgtgaatgccaaagttcttaaggatgttaaatttcctcttatgttggatatgtatgaactgtgtacaccagaacttcaagagaaaatggtgtcttttcgatccaaattcaaggatctagaagataaaaaagtgaatcagcagccaaatacaagtgacaaaaagagtagtccccagaaagaagttaagtatgaacccttttcttttgctgatgatattggctccaataattgtggatactatgacttacaagcagtactaacacaccagggaaggtctagttcttcaggtcattatgtatcatgggtgaaaaggaaacaagatgaatggattaagtttgatgatgacaaagtcagcatcgtaacaccagaagatatcttacggctttctggtggtggagactggcatatcgcttacgttctactctatgggcctcgcagagttgaaataatggaagaggaaagtgaacagtaatcttcattttagtatttatgcttagatgtgaaaataaatgttatttgttgatcatttctataatcc

SEQ ID NO: 33523 - DNA, 1803 bp, Homo sapiens
ccctcacttgctccctccttccttcccgccacccctccaccgccttccccctcctccctcctctcgccacctctaggccccgccccggtcctgccgcccagtctcctcgctgcagtcgctccggagctgcacgggtgttttgcgtgttgctgcgtcatcgccagtggccggtttgaatgagactcgtcgcaccgaagccgccgccaccaccgcgcctccgcctcggccgccgccgcagctgctcctggtccccgtccctttgccgccctcgtcaggcccagctctcctgcgccgccgcctcccgccgcgccccgccatgccgctctactccgttactgtaaaatggggaaaggagaaatttgaaggtgtagaattgaatacagatgaacctccaatggtattcaaggctcagctgtttgcgttgactggagtccagcctgccagacagaaagttatggtgaaaggaggaacgctaaaggatgatgattggggaaacatcaaaataaaaaatatggagttaccatgtggattgacaaaccttggtaacacttgttacatgaatgccacagttcagtgtattcgttctgtgcctgaactcaaagatgcccttaaaaggtatgcaggtgccttgagagcttcaggggaaatggcttcagcgcagtatattactgcagcccttagagatttgtttgattccatggataaaacttcttccagtattccacctattattctactgcagtttttgcacatggctttcccacagtttgccgagaaaggtgaacaaggacagtatcttcaacaggatgctaatgaatgttggatacaaatgatgcgagtattgcaacagaaattggaagcaatagaggatgattctgttaaagagacagactcctcatctgcatcggcagcgacaccttctaaaaagaaaagtttaatcgatcagttcttcggtgttgagtttgaaactaccatgaaatgtacagaatctgaagaagaagaagtcaccaaaggaaaggaaaatcaacttcagcttagctgttttatcaatcaggaagtcaagtatctttttacaggacttaaattgcgacttcaggaagaaatcaccaaacagtctccaacgttgcaaagaaatgccttgtatatcaaatcttccaagatcagccggctgcctgcttacttgaccattcagatggttcgatttttttataaagagaaggaatctgtgaatgccaaagttcttaaggatgttaaatttcctcttatgttggatatgtatgaactgtgtacaccagaacttcaagagaaaatggtgtcttttcgatccaaattcaaggatctagaagataaaaaagtgaatcagcagccaaatacaagtgacaaaaagagtagtccccagaaagaagttaagtatgaacccttttcttttgctgatgatattggctccaataattgtggatactatgacttacaagcagtactaacacaccagggaaggtctagttcttcaggtcattatgtatcatgggtgaaaaggaaacaagatgaatggattaagtttgatgatgacaaagtcagcatcgtaacaccagaagatatcttacggctttctggtggtggagactggcatatcgcttacgttctactctatgggcctcgcagagttgaaataatggaagaggaaagtgaacagtaatcttcattttagtatttatgcttagatgtgaaaataaatgttatttgttgatcatttctataatccagagctttagaggaagacacataggtgggtttatgtttcac

SEQ ID NO: 33524 - DNA, 2129 bp, Homo sapiens
gacagaatgagactccgtctcaaaaaaaaaaaaaaaaaaaaaaagcgagggctggaagtctggagcaggtgcgcggctgcaacggcagccgcgggaagctcgggccggcagggtttccccgcacgctggcgcccagctcccggcgcggaggccgctgtaagtttcgctttccattcagtggaaaacgaaagctgggcggggtgccacgagcgcggggccagaccaaggcgggcccggagcggaacttcggtcccagctcggtccccggctcagtcccgacgtggaactcagcagcggaggctggacgcttgcatggcgcttgagagattccatcgtgcctggctcacataagcgcttcctggaagtgaagtcgtgctgtcctgaacgcgggccaggcagctgcggcctgggggttttggagtgatcacgaatgagcaaggcgtttgggctcctgaggcaaatctgtcagtccatcctggctgagtcctcgcagtccccggcagatcttgaagaaaagaaggaagaagacagcaacatgaagagagagcagcccagagagcgtcccagggcctgggactaccctcatggcctggttggtttacacaacattggacagacctgctgccttaactccttgattcaggtgttcgtaatgaatgtggacttcaccaggatattgaagaggatcacggtgcccaggggagctgacgagcagaggagaagcgtccctttccagatgcttctgctgctggagaagatgcaggacagccggcagaaagcagtgcggcccctggagctggcctactgcctgcagaagtgcaacgtgcccttgtttgtccaacatgatgctgcccaactgtacctcaaactctggaacctgattaaggaccagatcactgatgtgcacttggtggagagactgcaggccctgtatacgatccgggtgaaggactccttgatttgcgttgactgtgccatggagagtagcagaaacagcagcatgctcaccctcccactttctctttttgatgtggactcaaagcccctgaagacactggaggacgccctgcactgcttcttccagcccagggagttatcaagcaaaagcaagtgcttctgtgagaactgtgggaagaagacccgtgggaaacaggtcttgaagctgacccatttgccccagaccctgacaatccacctcatgcgattctccatcaggaattcacagacgagaaagatctgccactccctgtacttcccccagagcttggatttcagccagatccttccaatgaagcgagagtcttgtgatgctgaggagcagtctggagggcagtatgagctttttgctgtgattgcgcacgtgggaatggcagactccggtcattactgtgtctacatccggaatgctgtggatggaaaatggttctgcttcaatgactccaatatttgcttggtgtcctgggaagacatccagtgtacctacggaaatcctaactaccactggcaggaaactgcatatcttctggtttacatgaagatggagtgctaatggaaatgcccaaaaccttcagagattgacacgctgtcattttccatttccgttcctggatctacggagtcttctaagagattttgcaatgaggagaagcattgttttcaaactatataactgagccttatttataattagggatattatcaaaatatgtaaccatgaggcccctcaggtcctgatcagtcagaatggatgctttcaccagcagacccggccatgtggctgctcggtcctgggtgctcgctgctgtgcaagacattagccctttagttatgagcctgtgggaacttcaggggttcccagtggggagagcagtggcagtgggaggcatctgggggccaaaggtcagtggcagggggtatttcagtattatacaactgctgtgaccagacttgtatactggctgaatatcagtgctgtttgtaatttttcactttgagaaccaacattaattccatatgaatcaagtgttttgtaactgctattcatttattcagcaaatatttattgatcatctcttctccataagatagtgtgataaacacagtcatgaataaagttattttccacaaaa

SEQ ID NO: 33525 - DNA, 1180 bp, Homo sapiens
ataactgctgacccatgtctgctcccagagctaggtgacccagcagccaagcccttgagtgggaactgcaaaagctggggctgcctatgtgtggtccaaaccctcccctctccaggagaaagctgggagtagggattccttcctcacagtaagtgtttgtccaacatgatgctgcccaactgtacctcaaactctggaacctgattaaggaccagatcactgatgtgcacttggtggagagactgcaggccctgtatacgatccgggtgaaggactccttgatttgcgttgactgtgccatggagagtagcagaaacagcagcatgctcaccctcccactttctctttttgatgtggactcaaagcccctgaagacactggaggacgccctgcactgcttcttccagcccagggagttatcaagcaaaagcaagtgcttctgtgagaactgtgggaagaagacccgtgggaaacaggtcttgaagctgacccatttgccccagaccctgacaatccacctcatgcgattctccatcaggaattcacagacgagaaagatctgccactccctgtacttcccccagagcttggatttcagccagatccttccaatgaagcgagagtcttgtgatgctgaggagcagtctggagggcagtatgagctttttgctgtgattgcgcacgtgggaatggcagactccggtcattactgtgtctacatccggaatgctgtggatggaaaatggttctgcttcaatgactccaatatttgcttggtgtcctgggaagacatccagtgtacctacggaaatcctaactaccactggcctccttttctttgtcatgcatgcatattaattgaggatggagaatatctacgcttgttcaggccagccaacatacgacagtttacttcaagagaggagacatgggttgaatgctggtgtgttttaactctgcagtgcaaacagctgcaacaagtgtggtgaactaaacaccagatggccctttgctgccttatttgtcattgtgccttacatgtagcttgcaggatttgattacgcttatgttttgtggtgatcatactttcaactattcctaaaatactgcttcagtcttatctgtttggggtcaactgccgaggatttcatacaaattaatgaagtttgtgaatctaaag

SEQ ID NO: 33526 - DNA, 2195 bp, Homo sapiens
gagacggtgaagccggtggccggtggccgggcgggaccaacaaagatggcggcggcccctgcggcgggagcgatctgggcaacggctgcggctaaagctgcagccgggcccacgggggggctgcacgggggtagtagggggtggccctgaactggggcctggccctggctggcctctcccgccgcctcactgggggacaggtccagcctgtggtgtccacaatgccccaggcctctgagcaccgcctgggccgtacccgagagccacctgttaatatccagccccgagtgggatccaagctaccatttgcccccagggcccgcagcaaggagcgcagaaacccagcctctgggccaaaccccatgttacgacctctgcctccccggccaggtctgcctgatgaacggctcaagaaactggagctgggacggggacggacctcaggccctcgtcccagaggcccccttcgagcagatcatggggttcccctgcctggctcaccacccccaacagtggctttgcctctcccatctcggaccaacttagcccgttccaagtctgtgagcagtggggacttgcgtccaatggggattgccttgggagggcaccgtggcaccggagagcttggggctgcactgagccgcttggccctccggcctgagccacccactttgagacgtagcacttctctccgccgcctagggggctttcctggaccccctaccctgttcagcatacggacagagccccctgcttcccatggctccttccacatgatatccgcccggtcctctgagcctttctactctgatgacaagatggctcatcacacactccttctgggctctggtcatgttggccttcgaaacctgggaaacacgtgcttcctgaatgctgtgctgcagtgtctgagcagcactcgacctcttcgggacttctgtctgagaagggacttccggcaagaggtgcctggaggaggccgagcccaagagctcactgaagcctttgcagatgtgattggtgccctctggcaccctgactcctgcgaagctgtgaatcctactcgattccgagctgtcttccagaaatatgttccctccttctctggatacagccagcaggatgcccaagagttcctgaagctcctcatggagcggctacaccttgaaatcaaccgccgaggccgccgggctccaccgatacttgccaatggtccagttccctctccaccccgccgaggaggggctctgctagaagaacctgagttaagtgatgatgaccgagccaacctaatgtggaaacgttacctggagcgagaggacagcaagattgtggacctgtttgtgggccagttgaaaagttgtctcaagtgccaggcctgtgggtatcgctccacgaccttcgaggttttttgtgacctgtccctgcccatccccaagaaaggatttgctgggggcaaggtgtctctgcgggattgtttcaaccttttcactaaggaagaagagctagagtcggagaatgccccagtgtgtgaccgatgtcggcagaaaactcgaagtaccaaaaagttgacagtacaaagattccctcgaatcctcgtgctccatctgaatcgattttctgcctcccgaggctccatcaaaaaaagttcagtaggtgtagactttccactgcagcgactgagcctaggggactttgccagtgacaaagccggaagtcctgtataccagctgtatgccctttgcaaccactcaggcagcgtccactatggccactacacagccctgtgccggtgccagactggttggcatgtctacaatgactctcgtgtctcccctgtcagtgaaaaccaggtggcatccagcgagggctacgtgctgttctaccaactgatgcaggagccaccccggtgcctgtgacacctctaagctctggcacctgtgaagccctttaaacacccttaagccccaggctccccgtttacctcagagacgtctatttttgtgtctttttaatcggggaggggggagggggtggttgtagctccattattttttttattaaaaaatacccttccacctggaggctcccttgtctcccagccccatgtacaaagctcaccaagcccctgcccatgtacagcccccagaccctctgcaatatcactttttgtgaataaatttattaagaaaaaa

SEQ ID NO: 33527 - DNA, 2095 bp, Homo sapiens
ctgcggcgggagcgatctgggcaacggctgcggctaaagctgcagccgggcccacgggggggctgcacgggggtagtagggggtggccctgaactggggcctggccctggctggcctctcccgccgcctcactgggggacaggtccagcctgtggtgtccacaatgccccaggcctctgagcaccgcctgggccgtacccgagagccacctgttaatatccagccccgagtgggatccaagctaccatttgcccccagggcccgcagcaaggagcgcagaaacccagcctctgggccaaaccccatgttacgacctctgcctccccggccaggtctgcctgatgaacggctcaagaaactggagctgggacggggacggacctcaggccctcgtcccagaggcccccttcgagcagatcatggggttcccctgcctggctcaccacccccaacagtggctttgcctctcccatctcggaccaacttagcccgttccaagtctgtgagcagtggggacttgcgtccaatggggattgccttgggagggcaccgtggcaccggagagcttggggctgcactgagccgcttggccctccggcctgagccacccactttgagacgtagcacttctctccgccgcctagggggctttcctggaccccctaccctgttcagcatacggacagagccccctgcttcccatggctccttccacatgatatccgcccggtcctctgagcctttctactctgatgacaagatggctcatcacacactccttctgggctctggtcatgttggccttcgaaacctgggaaacacgtgcttcctgaatgctgtgctgcagtgtctgagcagcactcgacctcttcgggacttctgtctgagaagggacttccggcaagaggtgcctggaggaggccgagcccaagagctcactgaagcctttgcagatgtgattggtgccctctggcaccctgactcctgcgaagctgtgaatcctactcgattccgagctgtcttccagaaatatgttccctccttctctggatacagccagcaggatgcccaagagttcctgaagctcctcatggagcggctacaccttgaaatcaaccgccgaggccgccgggctccaccgatacttgccaatggtccagttccctctccaccccgccgaggaggggctctgctagaagaacctgagttaagtgatgatgaccgagccaacctaatgtggaaacgttacctggagcgagaggacagcaagattgtggacctgtttgtgggccagttgaaaagttgtctcaagtgccaggcctgtgggtatcgctccacgaccttcgaggttttttgtgacctgtccctgcccatccccaagaaaggatttgctgggggcaaggtgtctctgcgggattgtttcaaccttttcactaaggaagaagagctagagtcggagaatgccccagtgtgtgaccgatgtcggcagaaaactcgaagtaccaaaaagttgacagtacaaagattccctcgaatcctcgtgctccatctgaatcgattttctgcctcccgaggctccatcaaaaaaagttcagtaggtgtagactttccactgcagcgactgagcctaggggactttgccagtgacaaagccggcagcgtccactatggccactacacagccctgtgccggtgccagactggttggcatgtctacaatgactctcgtgtctcccctgtcagtgaaaaccaggtggcatccagcgagggctacgtgctgttctaccaactgatgcaggagccaccccggtgcctgtgacacctctaagctctggcacctgtgaagccctttaaacacccttaagccccaggctccccgtttacctcagagacgtctatttttgtgtctttttaatcggggaggggggagggggtggttgtagctccattattttttttattaaaaaatacccttccacctggaggctcccttgtctcccagccccatgtacaaagctcaccaagcccctgcccatgtacagcccccagaccctctgcaatatcactttttgtgaataaatttattaagaaaaaa

SEQ ID NO: 33528 - DNA, 2342 bp, Homo sapiens
gcgcaggcgctttgagagacggtgaagccggtggccggtggccgggcgggaccaacaaagatggcggcggcccctgcggcgggagcgatctgggcaacggctgcggctaaagctgcagccgggcccacgggggggctgcacgggggtagtagggggtggccctgaactggggcctggccctggctggcctctcccgccgcctcactgggggacaggtactggggatacgatggctgattcgatagatctggttcctgccctcagtgcgtatactgctccccactttcgttgatgtggtagtggtgatgactgagccaaccacctaatgtggaaatgagaggacagcaagattgtgggtccagcctgtggtgtccacaatgccccaggcctctgagcaccgcctgggccgtacccgagagccacctgttaatatccagccccgagtgggatccaagctaccatttgcccccagggcccgcagcaaggagcgcagaaacccagcctctgggccaaaccccatgttacgacctctgcctccccggccaggtctgcctgatgaacggctcaagaaactggagctgggacggggacggacctcaggccctcgtcccagaggcccccttcgagcagatcatggggttcccctgcctggctcaccacccccaacagtggctttgcctctcccatctcggaccaacttagcccgttccaagtctgtgagcagtggggacttgcgtccaatggggattgccttgggagggcaccgtggcaccggagagcttggggctgcactgagccgcttggccctccggcctgagccacccactttgagacgtagcacttctctccgccgcctagggggctttcctggaccccctaccctgttcagcatacggacagagccccctgcttcccatggctccttccacatgatatccgcccggtcctctgagcctttctactctgatgacaagatggctcatcacacactccttctgggctctggtcatgttggccttcgaaacctgggaaacacgtgcttcctgaatgctgtgctgcagtgtctgagcagcactcgacctcttcgggacttctgtctgagaagggacttccggcaagaggtgcctggaggaggccgagcccaagagctcactgaagcctttgcagatgtgattggtgccctctggcaccctgactcctgcgaagctgtgaatcctactcgattccgagctgtcttccagaaatatgttccctccttctctggatacagccagcaggatgcccaagagttcctgaagctcctcatggagcggctacaccttgaaatcaaccgccgaggccgccgggctccaccgatacttgccaatggtccagttccctctccaccccgccgaggaggggctctgctagaagaacctgagttaagtgatgatgaccgagccaacctaatgtggaaacgttacctggagcgagaggacagcaagattgtggacctgtttgtgggccagttgaaaagttgtctcaagtgccaggcctgtgggtatcgctccacgaccttcgaggttttttgtgacctgtccctgcccatccccaagaaaggatttgctgggggcaaggtgtctctgcgggattgtttcaaccttttcactaaggaagaagagctagagtcggagaatgccccagtgtgtgaccgatgtcggcagaaaactcgaagtaccaaaaagttgacagtacaaagattccctcgaatcctcgtgctccatctgaatcgattttctgcctcccgaggctccatcaaaaaaagttcagtaggtgtagactttccactgcagcgactgagcctaggggactttgccagtgacaaagccggaagtcctgtataccagctgtatgccctttgcaaccactcaggcagcgtccactatggccactacacagccctgtgccggtgccagactggttggcatgtctacaatgactctcgtgtctcccctgtcagtgaaaaccaggtggcatccagcgagggctacgtgctgttctaccaactgatgcaggagccaccccggtgcctgtgacacctctaagctctggcacctgtgaagccctttaaacacccttaagccccaggctccccgtttacctcagagacgtctatttttgtgtctttttaatcggggaggggggagggggtggttgtagctccattattttttttattaaaaaatacccttccacctggaggctcccttgtctcccagccccatgtacaaagctcaccaagcccctgcccatgtacagcccccagaccctctgcaatatcactttttgtgaataaatttatt

SEQ ID NO: 33529 - DNA, 5220 bp, Homo sapiens
gcagccgcagctcgggggcggtgcctgccttgcagcctcccctcggcgatcgcgcagccccatctttgtccggcctccgcgctttgttctcggcgcccgggccttggccagcctggccagccgccgagcagcccccacgccgcgctggcgtcgtcctcgcctccctcgccgccgccccccgcgcgcggccgggccttgccccccatggtgtcccggccagagcccgagggcgaggccatggacgccgagctggcggtagcgccgccgggctgctcgcacctgggcagcttcaaggtggacaactggaagcagaacctgcgggccatctaccagtgcttcgtgtggagcggcacggctgaggcccgcaagcgcaaggccaagtcctgtatctgccatgtctgtggcgtccacctcaacaggctgcattcctgcctctactgtgtcttcttcggctgtttcacaaagaagcatattcacgagcatgcgaaggcgaagcggcacaacctggccattgatctgatgtacggaggcatctactgttttctgtgccaggactacatctatgacaaagacatggaaataatcgccaaggaggagcagcgaaaagcttggaaaatgcaaggcgttggagagaagttttcaacttgggaaccaaccaaacgggagcttgaactgctgaagcacaacccgaaaaggagaaagatcacctcgaactgcaccataggtctgcgtgggctgatcaaccttgggaacacatgcttcatgaactgcatcgtgcaggccctgacccacacgccacttctgcgggacttcttcctgtctgacaggcaccgctgtgagatgcagagccccagctcctgtctggtctgtgagatgtcctcactgtttcaggagttttactctggacaccggtcccctcacatcccgtataagttgctgcacctggtgtggacccacgcgaggcacctagcaggctacgagcagcaggacgcccacgagttcctcatcgcggccctggacgtgctccaccgacactgcaaaggtgatgacaatgggaagaaggccaacaaccccaaccactgcaactgcatcatagaccagatcttcacaggcgggttgcagtcagacgtcacctgccaagtctgccatggagtctccaccaccatcgaccccttctgggacatcagcttggatctccccggctcttccaccccattctggcccctgagcccagggagcgagggcaacgtggtaaacggggaaagccacgtgtcgggaaccaccacgctcacggactgcctgcgacgattcaccagaccagagcacttgggcagcagcgccaagatcaagtgcagcggttgccatagctaccaggagtccacaaagcagctcactatgaagaaactgcccatcgtagcctgttttcatctcaaacgatttgaacactcagccaagctgcggcggaagatcaccacgtatgtgtccttccccctggagctggacatgacccctttcatggcctccagcaaagagagcaggatgaatggacagtaccagcagcccacggacagtctcaacaatgacaacaagtattccctgtttgctgttgttaaccatcaagggaccttggagagtggccactacaccagctttatccggcagcacaaagaccagtggttcaagtgtgacgatgccatcatcaccaaggccagcatcaaggacgtcctggacagcgaagggtacttgctgttctatcacaaacagttcctggaatacgagtagccttatctgcagctggtcagaaaaacaaaggcaatgcattggcaagcctcacaaagtgatcctccctggcccccccctcccccaagtctcccgccgcctccccggcctggtgacaccacctcccatgcagatgtggcccctctgcacctgggacccatcgggtcgggatggaccacacggacggggaggctcctggagctgctttgaagatggatgagatgaggggtgtgctctgggtgggaggagcagcgtacacccgtcaccagaacatctcttgtgtcatgacatgggggtgcaacgggggcctcacagcacagagtgaccgctgcctggcgttccccagcactcggtgtggaaaggcccctacctgctgtaagattatgggtccatgaaagcagtaagctggacacagaggtgtagtgtgcgggacagagggccttgcagatgcctttctgttggtgttttagtgttaaaatacggagagtatggaactcttcacctccattttctcagcggctgtgaagcagcctcctagcttcggaagtacggacactacgtcgcgttttcaagcgtgtctgttctgcaggtaacagcatcaagctgcacgtggaagcatctcgcggttttctagaaacaggcattttcttatccctctcccgctcctttttccacaaaggtgaatttcataaatgtaatactagtaaagtgaatgaattactgagtttatacagaaatttaggtaacttctcctttagtctcaagagcgagtcttgctttttaatgggtgccgtttatgttgctgcccgccctgtgtgcctggctcctctgggtgccttggtgtctgctggtggctggcagtgggcgcagcggaggagagttgtgctgcagctcatacggtgtgtctgtcatctcagtctggagtaaatgcagtgtctgccggtgtctgatgggttctgtccctcgtattttctttgccttctatcccattgcctggctaccgctgcctggcagccaagggtgttggtcgcgaagctggagtggcctctggtggagcctgcatcttgtctcgtctgcctctgctttacatttggtgtactttcgggcgtggtggcagtaaaatgacaccgtgattgagcttgtcagcagagctgaaagagaaagtagaaggatgtgcattgtttcttgtaagatatcttgcatgtatctgtgtattcaaattcaaacagagatggtttgtccatttgtccactgagaaattagaaactagggacaagggggaggaaaagtactgaaatacagtttatgaagcaagtgtgtctcgggctgtgcttgtcccaggagccccagcagcatctgaactgaggcttcttcagtcctgcaggaacaggatcatctgtctcagcggtgggcagatgttttcatagacagccagggagtaaacactgttggctctgtgggctgtatggtctctgccataaatagtacagagatgtggctgtgtctagtacaacttttagacacagaaatctgaatgacatatattgttctgtgtcaagaaacttagattttttttttaactatttaaaaacgtgaaacctattcttagctcacaggccatggagaagctggtggggaccagacccagctccttagctggctgggctggggagggggtagtgacagtggcagctgctactcactgctcagtgtggaaaacacaggacttggcaatcacagcccgcagaaccatcatgtgtggcagaagcctgagggatgcggtttcttgcccacgtgctctgttcattttctgttgtttttctgcacttaaagaattcacatggaagcatgttttataaaatgaattaccagagaaacagagatgggccgagattttcagaaatggtcccatgtgaccaagttctgctgtttgggtgacagtgctttgaagatctcctttgaggatgtgcagtctttttttttttttttttgagatggagtttgttgcccaggctggagtgagtggcacagtctcggctcactgcaacctccacctcctgggttcaagcagttctcgtgccgcagcctcccaagtagctgggactacaggcatgcaccaccacgccaggctaatttttgtatttttagtagagatggggtttcaccatgtctcaaactcctgacctcaggcgatccacccacctcagcgtcccaaagtgctgggattataggcgtgagccaccgcacctggcctatgagtggtcttttaattaggaacaaatctaatggaaaggagagttgactgaagttggcccacaggattgtgagctgggcagtgccttcatgaaggcttgccaccttgggacgccccagtttactggggtgtcttgcggagtgcagaaggctttctggcagctgcctgggtttggccagaccctgcctcccctcccgccggccaacccctagtccccttcctgtctccacttgcattcaggggtggctgctgttctgagaacattagaactgggaagagagatggagtcacatggatttttggtgggcattattctaaactttcgtatccaagttagtcccccttattccactgtggcattgccgttctaagcagttacctgatgcctgctgctgaagagctgctcacaggaggcggcggcggccctggcactgccccttgcattaggtcttgtgtttgatgtgttcttgtgaatttactttgtcagaacaaaatatttacgcgttgggttcaggaatttcttttagctccccatctggctgtgaaattcaggaaacctcccgttgcctagtaatcaccccatgtaggtgtacattgtgacaaagtgcatctgaccactaaggggcccccttggtgaccccagcacattcacagcagtgttaaaatggcctgcattttggagatgctggctggcctttcagtgcctcccaggaagacacatggcctttccctcttcagatgcctgaagggagtgctttgaggcaggtgatgtgctgggagtgtgggcggcctccctctggccccggggccctctgtggaccttggctccctccgtggacctgggcttcgtggtgagcactgcagcctccctgggcattccctccagcgccagcaccactgcaacatatagacctgagtgctattgtattttggcttggtgtgtatgctcttcattgtgtaaaattgctgttcttttgacaatttaagtgattgttttgtttactgtaagtttgaaaataaaaatgaagaaaaaaattccaatgactgtgctgtggttggagactttatttaccaagatgtttactcttcctttccccttccattttgaggagctgtgtcactcctcctcccccccagtgctttgtagtctctcctatgtcataataaagctacattttctctgagaa

SEQ ID NO: 33530 - DNA, 5237 bp, Homo sapiens
agcgcaggcggtccgcagcagccgcagctcgggggcggtgcctgccttgcagcctcccctcggcgatcgcgcagccccatctttgtccggcctccgcgctttgttctcggcgcccgggccttggccagcctggccagccgccgagcagcccccacgccgcgctggcgtcgtcctcgcctccctcgccgccgccccccgcgcgcggccgggccttgccccccatggtgtcccggccagagcccgagggcgaggccatggacgccgagctggcggtagcgccgccgggctgctcgcacctgggcagcttcaaggtggacaactggaagcagaacctgcgggccatctaccagtgcttcgtgtggagcggcacggctgaggcccgcaagcgcaaggccaagtcctgtatctgccatgtctgtggcgtccacctcaacaggctgcattcctgcctctactgtgtcttcttcggctgtttcacaaagaagcatattcacgagcatgcgaaggcgaagcggcacaacctggccattgatctgatgtacggaggcatctactgttttctgtgccaggactacatctatgacaaagacatggaaataatcgccaaggaggagcagcgaaaagcttggaaaatgcaaggcgttggagagaagttttcaacttgggaaccaaccaaacgggagcttgaactgctgaagcacaacccgaaaaggagaaagatcacctcgaactgcaccataggtctgcgtgggctgatcaaccttgggaacacatgcttcatgaactgcatcgtgcaggccctgacccacacgccacttctgcgggacttcttcctgtctgacaggcaccgctgtgagatgcagagccccagctcctgtctggtctgtgagatgtcctcactgtttcaggagttttactctggacaccggtcccctcacatcccgtataagttgctgcacctggtgtggacccacgcgaggcacctagcaggctacgagcagcaggacgcccacgagttcctcatcgcggccctggacgtgctccaccgacactgcaaaggtgatgacaatgggaagaaggccaacaaccccaaccactgcaactgcatcatagaccagatcttcacaggcgggttgcagtcagacgtcacctgccaagtctgccatggagtctccaccaccatcgaccccttctgggacatcagcttggatctccccggctcttccaccccattctggcccctgagcccagggagcgagggcaacgtggtaaacggggaaagccacgtgtcgggaaccaccacgctcacggactgcctgcgacgattcaccagaccagagcacttgggcagcagcgccaagatcaagtgcagcggttgccatagctaccaggagtccacaaagcagctcactatgaagaaactgcccatcgtagcctgttttcatctcaaacgatttgaacactcagccaagctgcggcggaagatcaccacgtatgtgtccttccccctggagctggacatgacccctttcatggcctccagcaaagagagcaggatgaatggacagtaccagcagcccacggacagtctcaacaatgacaacaagtattccctgtttgctgttgttaaccatcaagggaccttggagagtggccactacaccagctttatccggcagcacaaagaccagtggttcaagtgtgacgatgccatcatcaccaaggccagcatcaaggacgtcctggacagcgaagggtacttgctgttctatcacaaacagttcctggaatacgagtagccttatctgcagctggtcagaaaaacaaaggcaatgcattggcaagcctcacaaagtgatcctccctggcccccccctcccccaagtctcccgccgcctccccggcctggtgacaccacctcccatgcagatgtggcccctctgcacctgggacccatcgggtcgggatggaccacacggacggggaggctcctggagctgctttgaagatggatgagatgaggggtgtgctctgggtgggaggagcagcgtacacccgtcaccagaacatctcttgtgtcatgacatgggggtgcaacgggggcctcacagcacagagtgaccgctgcctggcgttccccagcactcggtgtggaaaggcccctacctgctgtaagattatgggtccatgaaagcagtaagctggacacagaggtgtagtgtgcgggacagagggccttgcagatgcctttctgttggtgttttagtgttaaaatacggagagtatggaactcttcacctccattttctcagcggctgtgaagcagcctcctagcttcggaagtacggacactacgtcgcgttttcaagcgtgtctgttctgcaggtaacagcatcaagctgcacgtggaagcatctcgcggttttctagaaacaggcattttcttatccctctcccgctcctttttccacaaaggtgaatttcataaatgtaatactagtaaagtgaatgaattactgagtttatacagaaatttaggtaacttctcctttagtctcaagagcgagtcttgctttttaatgggtgccgtttatgttgctgcccgccctgtgtgcctggctcctctgggtgccttggtgtctgctggtggctggcagtgggcgcagcggaggagagttgtgctgcagctcatacggtgtgtctgtcatctcagtctggagtaaatgcagtgtctgccggtgtctgatgggttctgtccctcgtattttctttgccttctatcccattgcctggctaccgctgcctggcagccaagggtgttggtcgcgaagctggagtggcctctggtggagcctgcatcttgtctcgtctgcctctgctttacatttggtgtactttcgggcgtggtggcagtaaaatgacaccgtgattgagcttgtcagcagagctgaaagagaaagtagaaggatgtgcattgtttcttgtaagatatcttgcatgtatctgtgtattcaaattcaaacagagatggtttgtccatttgtccactgagaaattagaaactagggacaagggggaggaaaagtactgaaatacagtttatgaagcaagtgtgtctcgggctgtgcttgtcccaggagccccagcagcatctgaactgaggcttcttcagtcctgcaggaacaggatcatctgtctcagcggtgggcagatgttttcatagacagccagggagtaaacactgttggctctgtgggctgtatggtctctgccataaatagtacagagatgtggctgtgtctagtacaacttttagacacagaaatctgaatgacatatattgttctgtgtcaagaaacttagattttttttttaactatttaaaaacgtgaaacctattcttagctcacaggccatggagaagctggtggggaccagacccagctccttagctggctgggctggggagggggtagtgacagtggcagctgctactcactgctcagtgtggaaaacacaggacttggcaatcacagcccgcagaaccatcatgtgtggcagaagcctgagggatgcggtttcttgcccacgtgctctgttcattttctgttgtttttctgcacttaaagaattcacatggaagcatgttttataaaatgaattaccagagaaacagagatgggccgagattttcagaaatggtcccatgtgaccaagttctgctgtttgggtgacagtgctttgaagatctcctttgaggatgtgcagtctttttttttttttttttgagatggagtttgttgcccaggctggagtgagtggcacagtctcggctcactgcaacctccacctcctgggttcaagcagttctcgtgccgcagcctcccaagtagctgggactacaggcatgcaccaccacgccaggctaatttttgtatttttagtagagatggggtttcaccatgtctcaaactcctgacctcaggcgatccacccacctcagcgtcccaaagtgctgggattataggcgtgagccaccgcacctggcctatgagtggtcttttaattaggaacaaatctaatggaaaggagagttgactgaagttggcccacaggattgtgagctgggcagtgccttcatgaaggcttgccaccttgggacgccccagtttactggggtgtcttgcggagtgcagaaggctttctggcagctgcctgggtttggccagaccctgcctcccctcccgccggccaacccctagtccccttcctgtctccacttgcattcaggggtggctgctgttctgagaacattagaactgggaagagagatggagtcacatggatttttggtgggcattattctaaactttcgtatccaagttagtcccccttattccactgtggcattgccgttctaagcagttacctgatgcctgctgctgaagagctgctcacaggaggcggcggcggccctggcactgccccttgcattaggtcttgtgtttgatgtgttcttgtgaatttactttgtcagaacaaaatatttacgcgttgggttcaggaatttcttttagctccccatctggctgtgaaattcaggaaacctcccgttgcctagtaatcaccccatgtaggtgtacattgtgacaaagtgcatctgaccactaaggggcccccttggtgaccccagcacattcacagcagtgttaaaatggcctgcattttggagatgctggctggcctttcagtgcctcccaggaagacacatggcctttccctcttcagatgcctgaagggagtgctttgaggcaggtgatgtgctgggagtgtgggcggcctccctctggccccggggccctctgtggaccttggctccctccgtggacctgggcttcgtggtgagcactgcagcctccctgggcattccctccagcgccagcaccactgcaacatatagacctgagtgctattgtattttggcttggtgtgtatgctcttcattgtgtaaaattgctgttcttttgacaatttaagtgattgttttgtttactgtaagtttgaaaataaaaatgaagaaaaaaattccaatgactgtgctgtggttggagactttatttaccaagatgtttactcttcctttccccttccattttgaggagctgtgtcactcctcctcccccccagtgctttgtagtctctcctatgtcataataaagctacattttctctgagaa

SEQ ID NO: 33531 - DNA, 4980 bp, Homo sapiens
atggcgccgggttggccctcactatcagcgggctcccgacaggaggcgccccagcttgcggccgggggcagcgcctaccaggcagttggcaggcagttccagccccgggccacggcactgcagggcccgagccaggccaagtcctgtatctgccatgtctgtggcgtccacctcaacaggctgcattcctgcctctactgtgtcttcttcggctgtttcacaaagaagcatattcacgagcatgcgaaggcgaagcggcacaacctggccattgatctgatgtacggaggcatctactgttttctgtgccaggactacatctatgacaaagacatggaaataatcgccaaggaggagcagcgaaaagcttggaaaatgcaaggcgttggagagaagttttcaacttgggaaccaaccaaacgggagcttgaactgctgaagcacaacccgaaaaggagaaagatcacctcgaactgcaccataggtctgcgtgggctgatcaaccttgggaacacatgcttcatgaactgcatcgtgcaggccctgacccacacgccacttctgcgggacttcttcctgtctgacaggcaccgctgtgagatgcagagccccagctcctgtctggtctgtgagatgtcctcactgtttcaggagttttactctggacaccggtcccctcacatcccgtataagttgctgcacctggtgtggacccacgcgaggcacctagcaggctacgagcagcaggacgcccacgagttcctcatcgcggccctggacgtgctccaccgacactgcaaaggtgatgacaatgggaagaaggccaacaaccccaaccactgcaactgcatcatagaccagatcttcacaggcgggttgcagtcagacgtcacctgccaagtctgccatggagtctccaccaccatcgaccccttctgggacatcagcttggatctccccggctcttccaccccattctggcccctgagcccagggagcgagggcaacgtggtaaacggggaaagccacgtgtcgggaaccaccacgctcacggactgcctgcgacgattcaccagaccagagcacttgggcagcagcgccaagatcaagtgcagcggttgccatagctaccaggagtccacaaagcagctcactatgaagaaactgcccatcgtagcctgttttcatctcaaacgatttgaacactcagccaagctgcggcggaagatcaccacgtatgtgtccttccccctggagctggacatgacccctttcatggcctccagcaaagagagcaggatgaatggacagtaccagcagcccacggacagtctcaacaatgacaacaagtattccctgtttgctgttgttaaccatcaagggaccttggagagtggccactacaccagctttatccggcagcacaaagaccagtggttcaagtgtgacgatgccatcatcaccaaggccagcatcaaggacgtcctggacagcgaagggtacttgctgttctatcacaaacagttcctggaatacgagtagccttatctgcagctggtcagaaaaacaaaggcaatgcattggcaagcctcacaaagtgatcctccctggcccccccctcccccaagtctcccgccgcctccccggcctggtgacaccacctcccatgcagatgtggcccctctgcacctgggacccatcgggtcgggatggaccacacggacggggaggctcctggagctgctttgaagatggatgagatgaggggtgtgctctgggtgggaggagcagcgtacacccgtcaccagaacatctcttgtgtcatgacatgggggtgcaacgggggcctcacagcacagagtgaccgctgcctggcgttccccagcactcggtgtggaaaggcccctacctgctgtaagattatgggtccatgaaagcagtaagctggacacagaggtgtagtgtgcgggacagagggccttgcagatgcctttctgttggtgttttagtgttaaaatacggagagtatggaactcttcacctccattttctcagcggctgtgaagcagcctcctagcttcggaagtacggacactacgtcgcgttttcaagcgtgtctgttctgcaggtaacagcatcaagctgcacgtggaagcatctcgcggttttctagaaacaggcattttcttatccctctcccgctcctttttccacaaaggtgaatttcataaatgtaatactagtaaagtgaatgaattactgagtttatacagaaatttaggtaacttctcctttagtctcaagagcgagtcttgctttttaatgggtgccgtttatgttgctgcccgccctgtgtgcctggctcctctgggtgccttggtgtctgctggtggctggcagtgggcgcagcggaggagagttgtgctgcagctcatacggtgtgtctgtcatctcagtctggagtaaatgcagtgtctgccggtgtctgatgggttctgtccctcgtattttctttgccttctatcccattgcctggctaccgctgcctggcagccaagggtgttggtcgcgaagctggagtggcctctggtggagcctgcatcttgtctcgtctgcctctgctttacatttggtgtactttcgggcgtggtggcagtaaaatgacaccgtgattgagcttgtcagcagagctgaaagagaaagtagaaggatgtgcattgtttcttgtaagatatcttgcatgtatctgtgtattcaaattcaaacagagatggtttgtccatttgtccactgagaaattagaaactagggacaagggggaggaaaagtactgaaatacagtttatgaagcaagtgtgtctcgggctgtgcttgtcccaggagccccagcagcatctgaactgaggcttcttcagtcctgcaggaacaggatcatctgtctcagcggtgggcagatgttttcatagacagccagggagtaaacactgttggctctgtgggctgtatggtctctgccataaatagtacagagatgtggctgtgtctagtacaacttttagacacagaaatctgaatgacatatattgttctgtgtcaagaaacttagattttttttttaactatttaaaaacgtgaaacctattcttagctcacaggccatggagaagctggtggggaccagacccagctccttagctggctgggctggggagggggtagtgacagtggcagctgctactcactgctcagtgtggaaaacacaggacttggcaatcacagcccgcagaaccatcatgtgtggcagaagcctgagggatgcggtttcttgcccacgtgctctgttcattttctgttgtttttctgcacttaaagaattcacatggaagcatgttttataaaatgaattaccagagaaacagagatgggccgagattttcagaaatggtcccatgtgaccaagttctgctgtttgggtgacagtgctttgaagatctcctttgaggatgtgcagtctttttttttttttttttgagatggagtttgttgcccaggctggagtgagtggcacagtctcggctcactgcaacctccacctcctgggttcaagcagttctcgtgccgcagcctcccaagtagctgggactacaggcatgcaccaccacgccaggctaatttttgtatttttagtagagatggggtttcaccatgtctcaaactcctgacctcaggcgatccacccacctcagcgtcccaaagtgctgggattataggcgtgagccaccgcacctggcctatgagtggtcttttaattaggaacaaatctaatggaaaggagagttgactgaagttggcccacaggattgtgagctgggcagtgccttcatgaaggcttgccaccttgggacgccccagtttactggggtgtcttgcggagtgcagaaggctttctggcagctgcctgggtttggccagaccctgcctcccctcccgccggccaacccctagtccccttcctgtctccacttgcattcaggggtggctgctgttctgagaacattagaactgggaagagagatggagtcacatggatttttggtgggcattattctaaactttcgtatccaagttagtcccccttattccactgtggcattgccgttctaagcagttacctgatgcctgctgctgaagagctgctcacaggaggcggcggcggccctggcactgccccttgcattaggtcttgtgtttgatgtgttcttgtgaatttactttgtcagaacaaaatatttacgcgttgggttcaggaatttcttttagctccccatctggctgtgaaattcaggaaacctcccgttgcctagtaatcaccccatgtaggtgtacattgtgacaaagtgcatctgaccactaaggggcccccttggtgaccccagcacattcacagcagtgttaaaatggcctgcattttggagatgctggctggcctttcagtgcctcccaggaagacacatggcctttccctcttcagatgcctgaagggagtgctttgaggcaggtgatgtgctgggagtgtgggcggcctccctctggccccggggccctctgtggaccttggctccctccgtggacctgggcttcgtggtgagcactgcagcctccctgggcattccctccagcgccagcaccactgcaacatatagacctgagtgctattgtattttggcttggtgtgtatgctcttcattgtgtaaaattgctgttcttttgacaatttaagtgattgttttgtttactgtaagtttgaaaataaaaatgaagaaaaaaattccaatgactgtgctgtggttggagactttatttaccaagatgtttactcttcctttccccttccattttgaggagctgtgtcactcctcctcccccccagtgctttgtagtctctcctatgtcataataaagctacattttctctgagaa

SEQ ID NO: 33532 - DNA, 10802 bp, Homo sapiens
ggaggaggccaacatggcggcgcgcagggctgggccgggccgcagccgcgcctgagcgcctcaccgcactagctcggctcgcaggacccaagcccgcacccagcctggcccggctgctgcggagcacccggggcaggaacgcaggggccaacctgggcgcggaggcggcgcggagggtgcgccgcgcggcccgccaggcccgggacccgtagcttcgccgtgcgctggccggggcggccaggaggcccaagccatggaatcggaggaggagcagcacatgaccacgctgctgtgcatgggcttctcagaccccgccaccatccgcaaggccctgcgcctggccaagaacgacattaacgaggccgtggcactgctcaccaacgagcggccgggcctcgactacggcggctacgagcccatggacagcggcggtggccccagccccgggcccggcgggggcccgcggggcgacggcggaggtgacggcggcggcggcggcccctcccgcggcgggagcaccggaggcgggggcggcttcgaccccccgcccgcctaccacgaggtggtggacgcggagaagaatgatgagaatggaaactgctcaggggaaggaattgaattccctacaacaaatttatatgaactggaaagccgtgttttgactgatcattggtccatcccttacaagcgagaagaatcactaggcaaatgcctgttggcatctacctacctagcaagacttggtctttccgagtctgatgagaattgtagaaggtttatggacaggtgtatgcctgaagcatttaaaaagctcctgacatcaagtgctgttcacaagtggggtactgaaattcatgaaggaatttacaacatgttgatgctattaatagaactggtcgcagagagaataaaacaagatccaattcccactggtctcctgggtgtgcttacaatggctttcaatcctgataatgaataccattttaaaaacagaatgaaagtgtctcaaaggaattgggcagaagtgtttggagagggaaatatgtttgctgtttcacctgtatcgactttccaaaaggagcctcatggatgggttgtggatttggtaaataagtttggagaattaggtggatttgcagcaatccaagccaagctccattcagaagatatagaacttggggctgtctcagcactgattcagcccttaggagtgtgtgcagagtacctcaattcctccgtggtacagcccatgctagacccagtcattcttactacaatccaggatgtacggagtgtagaagagaaagacctcaaagacaagagattggttagcatccctgagctcttgtctgccgttaagttactttgcatgcgcttccaaccggatctggtgacaattgtggatgaccttcgactagatattctattgcgcatgctgaaatcaccacatttcagtgctaagatgaattctctcaaagaagtaaccaaactaatagaagatagcactttatccaaatctgtgaagaatgctatagatacagacagattattagattggctagttgaaaactcagttctgtcgattgcactggaaggcaacatagaccaagcacaatactgtgaccgtataaagggaattattgaactcttgggtagtaaattgtcgttagatgaactcactaaaatttggaagatacagtcaggacaatcatctactgtgattgagaacattcatactattattgctgcagcggctgtgaaatttaattcagatcagcttaatcatttgtttgttctcattcagaagagctgggagactgagagtgatagagtaagacagaagcttttgagcctgattggacgaataggccgggaagctcgctttgagaccacttctggaaaggttttagacgtactctgggaactggctcaccttccaaccctgcccagtagccttattcagcaggccttggaggagcacctgacaatccttagtgatgcatatgcagtgaaagaagcaatcaagaggagctacatcatcaagtgcatagaagatattaagaggcctggagaatggtcaggtttggaaaaaaacaagaaggatggattcaagtcatctcagcttaataatccccagtttgtatgggtggtaccagctttgcgtcagctccatgaaattactcgctcattcataaaacaaacctatcaaaagcaagacaagagcattattcaagacttgaagaagaattttgaaatagtgaaattggtaacgggaagtttgatcgcttgtcatcggcttgcagctgctgtggccgggcctggaggcttaagtggctcgacactagtggatggccggtacacttaccgggagtatttagaggcacatctaaaatttctagcgtttttcttgcaagaagctactctgtatctgggctggaatcgtgccaaggagatctgggagtgtcttgtaactggccaggatgtttgtgaattagatagagagatgtgttttgaatggtttacaaaaggacagcatgatcttgagagtgatgttcagcagcagctcttcaaggagaaaattcttaaattggagtcatatgaaatcactatgaatggttttaacttatttaaaactttttttgaaaatgtgaatctttgtgatcatcgattgaaaagacaaggagctcagttgtatgtagaaaagctggaattgataggaatggatttcatttggaaaatagccatggaatcacctgatgaagaaattgctaatgaagctattcagctaatcataaactatagttacattaatctaaatcctagattaaagaaggattcagtatctttacataagaaattcattgctgattgctacacaagattagaagcagccagttcagcacttggtggccccactctaacacatgctgtgaccagagcaacaaaaatgcttacagcaactgccatgccaactgtagcaacctcagttcagtctccttatagatctactaaacttgtaataattgagagattgctgcttctggcagagcgctatgtgatcactatagaggatttttactctgttccacgaactattctacctcatggtgcctcatttcatggacatcttttaacccttaatgttacctatgagtctaccaaagataccttcactgtcgaggctcacagtaatgaaaccatagggagtgtccggtggaaaatagccaagcagttgtgctctcctgtggataatatacagatatttacaaatgatagcctgctgacagtgaataaagatcaaaagctactccaccaactgggcttttctgatgaacaaatccttacagtgaagacttctggcagtgggaccccatctgggagttcagcagattcttcaaccagctccagcagcagcagcagtggggtttttagttcttcatatgccatggagcaggagaaatccctccctggtgtagtgatggctctcgtatgtaacgtatttgacatgctttatcagctcgccaatctggaagagccaaggataactctacgagtacggaagcttctgctcttgatacccactgatccagccattcaggaagcccttgatcaacttgattctttaggaagaaagaaaacattgctgtctgaatcaagttctcagtcctcaaaatctccatccctgtcatcaaagcaacagcaccagccaagtgccagttcaattttagaaagtctgtttcgatcttttgccccgggaatgtctaccttcagagtgctctacaacttagaagttctaagctccaaactcatgccaacagctgatgatgacatggccagaagctgtgccaaatccttctgtgaaaacttcctcaaagctggcggtttgagtttggttgtaaatgtcatgcagagagactccatcccatcagaagtagactatgaaacaaggcagggtgtttattccatctgtctacagcttgcaagatttttacttgtcggacaaacaatgcccacgttattagatgaagacctcaccaaagatggtatagaagcactttcttcccgcccattccgaaatgtcagccggcagacaagcagacagatgtccttatgtggtaccccagaaaagtcatcctaccgacagttgtccgtgtctgataggtcttctattagggttgaggaaatcatccctgctgctcgagttgcaatacaaacaatggaagtaagtgatttcacttctactgtggcttgcttcatgagattgtcatgggctgcggctgcaggacggcttgatcttgttgggagtagccagccaattaaagaaagtaattccctgtgtcctgctggaattcgaaacagactcagcagttcaggaagcaattgcagctctggaagtgaaggagaaccagtagccctgcatgcgggaatctgtgttcgacaacagtctgtatccaccaaagactcgctgattgcgggagaggctttgtctcttcttgttacgtgcctacagcttcggagccagcaactggcatctttctataacttgccctgtgttgctgatttcatcattgatattctgctcggatcaccaagtgctgagattcgccgggttgcctgtgatcagctgtacactcttagtcagacagacacatcagcgcatccagatgtgcagaagccaaatcagtttcttctaggcgtaatcctcacggctcagctgcctctctggtctccaactagtattatgagaggagtcaatcagagactgttatctcagtgtatggagtattttgatttgagatgccagttattagatgatctgacaacttcagaaatggagcagttaaggatcagcccagctacgatgcttgaagatgagattacttggctggataactttgaacctaatcgtacagctgaatgtgagaccagtgaagcggacaacatcttactggcagggcacttacgcctcatcaagacccttctttcactctgtggggcagaaaaggaaatgcttggttcatcactcattaaaccattgttagatgacttccttttccgagcttctagaattattttaaatagtcattctccagctggcagtgccgccatcagtcaacaggactttcatccaaagtgtagtacagcgaatagccgattggcagcctatgaagtccttgtgatgttggctgatagttcaccttcaaatcttcaaattattataaaagaactgctttctatgcatcaccagcctgaccctgctcttaccaaggagtttgattaccttcccccagtggatagcaggtccagttcagggtttgtggggctgagaaatggtggtgcaacttgttatatgaatgcagtcttccagcagctgtatatgcaacctgggctccctgagtcattactttcagtggatgatgacacagacaatccagatgatagcgtgttttaccaagtgcagtctctctttggacatttaatggaaagcaagctgcagtactatgtacctgagaatttttggaagattttcaagatgtggaataaagaactttatgtgagagaacagcaggatgcatatgaattctttactagtctcattgatcagatggatgaatacctcaagaaaatggggagagaccaaatttttaagaatacatttcagggcatctactctgatcagaagatctgtaaagactgtcctcacagatatgagcgtgaagaagctttcatggctctcaatctaggagtgacttcttgtcagagtttggaaatttctttggaccaatttgttagaggagaagttctagaaggaagtaatgcgtactactgtgaaaagtgtaaagaaaagagaataacagtgaaaaggacctgtattaaatctttacctagcgtcttggtaattcacctaatgagatttgggtttgactgggaaagcggacgctccattaaatatgatgaacaaataaggtttccctggatgctaaacatggagccttacacagtttcaggaatggctcgccaagattcttcttctgaagttggggaaaatgggcgaagtgtggatcagggcggtggaggatccccacgaaaaaaggttgccctcacagaaaactatgaacttgtcggtgtcatcgtacacagtgggcaggcacacgcaggccactactattccttcattaaggacaggcgagggtgtggaaaaggaaagtggtataaatttaatgacacagttatagaagaatttgacctaaatgacgagaccctggagtatgaatgctttggaggagaatatagaccaaaagtttatgatcaaacaaacccatacactgatgtgcgccgaagatactggaatgcctatatgcttttctaccaaagggtgtctgatcagaactccccagtattaccaaagaaaagtcgagtcagcgttgtacggcaggaagctgaggatctctctctgtcagctccatcttcaccagaaatttcacctcagtcatcccctcggccccataggccgaacaatgaccggctgtctattcttaccaagctggttaaaaaaggcgagaagaaaggactgtttgtggagaaaatgcctgctcgaatataccagatggtgagagatgagaacctcaagtttatgaagaatagagatgtatacagtagtgattatttcagttttgttttgtctttagcttcattgaatgctactaaattaaagcatccatattatccttgcatggcaaaggtgagcttacagcttgctattcaattcctttttcaaacttatctacggacaaagaagaaactcagggttgatactgaagaatggattgctaccattgaagcattgctttcaaaaagttttgatgcttgtcagtggttagttgaatattttattagttctgaaggacgagaattgataaagattttcttactggagtgcaatgtgagagaagtacgagttgctgtggccaccattctggagaaaaccctagacagtgccttgttttatcaggataagttaaaaagccttcatcagttactggaggtactacttgctctgttggacaaagacgtcccagaaaattgtaaaaactgtgctcagtactttttcctgttcaacacttttgtacaaaagcaaggaattagggctggagatcttcttctgaggcattcagctctgcggcacatgatcagcttcctcctaggggccagtcggcaaaacaatcagatacgtcgatggagttcagcacaagcacgagaatttgggaatcttcacaatacagtggcgttacttgttttgcattcagatgtctcatcccaaaggaatgttgctcctggcatatttaagcaacgaccacccattagcattgctccctcaagccctctgttgcccctccatgaggaggtagaagccttgttgttcatgtctgaagggaaaccttacctgttagaggtaatgtttgctttgcgggagctgacaggctcgctcttggcactcattgagatggtagtgtactgctgtttctgtaatgagcatttttccttcacaatgctgcatttcattaagaaccaactagaaacggctccacctcatgagttaaagaatacgttccaactacttcatgaaatattggttattgaagatcctatacaagtagagcgagtcaaatttgtgtttgagacagaaaatggattactagctttgatgcaccacagtaatcatgtggacagtagtcgctgctaccagtgtgtcaaatttcttgtcactcttgctcaaaagtgtcctgcagctaaggagtacttcaaggagaattcccaccactggagctgggctgtgcagtggctacagaagaagatgtcagaacattactggacaccacagagtaatgtctctaatgaaacatcaactggaaaaacctttcagcgaaccatttcagctcaggacacgttagcgtatgccacagctttgttgaatgaaaaagagcaatcaggaagcagtaatgggtcggagagtagtcctgccaatgagaacggagacaggcatctacagcagggttcagaatctcccatgatgattggtgagttgagaagtgaccttgatgatgttgatccctagaggaacatgcccagcctgagaggagtcaagacacaatactggatgctcagcaccttcttggaatcagaatctcgaaccctttggaagagcctggagattggactgggaaagctgctgtgacttgggcggatcgtgtatttctcaaggaaagcatttttaagccactagaaggtttgggagctgtttggcagtgggagaactccggcatgtggatcagctgtcccgggagcgtggtctatatgtggattcacatttctgtggagattttcggaaatagagccagtggcagacttttttgttacacgaacatacaagagtgagcataaagctgttgctttctctacgatgctacaaaagaaattcctttggtttttatattttaagaaaaagcaagctgcttttagatatgtgggggcaaatttttaatcttgcagtaatattaaacaggaatatccaatttaaaatgatgtaaagatgtaataaaattccttttcattgtaaaatagtaattaagtcaatttacacagacctttgtatttaatatgtctccctatttgtatagaatttcagatgggtctagatgagaaccctatgcataagcttggatcttgatgaaaggttaccaggatcaggatcaaaaattgggaaatactaagctcttgaagatatttttctgatataattagattgaaaagagcaattttgaaaatgctgtgttctccagaagtacagggtgcattatttgacatcaattacttaaagaagttatgagttgttccccaaacagattttaaaaacagcaaaataaaagcactttaagatataattttactgagtttaacttcacagaattatctttttaatgcttggagacatattgaataaactgtagtcttaaatcatgtgatctgcaatcgtttgcttttgcttaaaacataattactgaaacccttggtattggttgtatatgaagttaactatttgagttggtacacactgcttgtgagtttcatagttattgtaatgcagagaaggaatttgagaatttgtttctcctcaacatgactaattaacactgaaaagtcagtcaaggtttaagatttattttcccagaaataaatataaagcaattgaataaccatccatttagtcgtatttccaaagtatagcaccattcactcatttataccagctcccttttatggtgtgggggagaggtttacacccacatatttcatatatattttgtacattttgtattttgaattgctcacattttcggccctgttttgcctttagttacaggtcctgccttattttcatctcaccatgcacagaactagggagccttaggaagtgccaggttttcactgtcagatttgccaagtcacagaggcgcagccagccctgaagtgcctgtctggctgctgtggcattgtgtgggcatgtggccaggcagatggcatctcattactgtgctctcgccatggcccagtcttttcattctctggcagtgagggtttctgtgctgtcagacttcattgttattctgtgacttgctggaggttggcagtggcctttgtcaaacacactgagaagatggaagggccagcacttaagagcagaactgtacccttagagaaacggacagaggcgagtggcaaacttcagacggttccaatggtcttgcagtttgaaatgtgatgttctaccattggttttgagtacgtgaatacttcctgtcctactgtttcccctaccctattctcaccttctctccgcccacatcctcaccaagagattgtgtgggacatgaccttgaaatgctggcgatgatccacactgggatatcatcgctggcgactgcactctcaggagcccaaaatcaggagtgaaattgccacttctagtccccttatttcctatggaaacaacgccttccgcacccctagcacctgccgtcctcactgtaaagcttcatcaggatcgtccaccgtgtatattatacgcttcagatcatgttgcttatattgttgctgcaatgaccatcgttttcactttgctggtaaccacttgattgctgacagctacagtcaatgaacctgctgatgactttttttaatgtagtacaacagtgacagttatgacaggcttaccttggaagagttgtcatttttactgccaattttttggatgaagatgtttttataaacctttcaaaatggtctgcaaacagagcaggaattgcacaattaactcaataatgctgtgtgttctcaagaagctcccttagtgaggccgatcttaagatggccgattctgcccgttgaaggcatcctgggaaagaaaacaagcatcccagcgggcatctcaccacgacttctcctggagtcctcacacggtcactgacaactacagtcagttttaggaactagagtgccgtatcatcagacttaccctgtcctgccccaccttccctgctaacatcgaggtgtgtgcagttaccttctgagcttggaacaagcagactggaattttcctctgctacctcttgtgtataaaatcttgtttataaaatttcaaaaggaagtagatacactagggaagaaccttaattctaaatttggttcatgtgtggcaaagttcttagcttctaagagtataaaataaatttttcaaaaacaga

SEQ ID NO: 33533 - DNA, 10060 bp, Homo sapiens
atgaccacgctgctgtgcatgggcttctcagaccccgccaccatccgcaaggccctgcgcctggccaagaacgacattaacgaggccgtggcactgctcaccaacgagcggccgggcctcgactacggcggctacgagcccatggacagcggcggtctttccgagtctgatgagaattgtagaaggtttatggacaggtgtatgcctgaagcatttaaaaagctcctgacatcaagtgctgttcacaagtggggtactgaaattcatgaaggaatttacaacatgttgatgctattaatagaactggtcgcagagagaataaaacaagatccaattcccactggtctcctgggtgtgcttacaatggctttcaatcctgataatgaataccattttaaaaacagaatgaaagtgtctcaaaggaattgggcagaagtgtttggagagggaaatatgtttgctgtttcacctgtatcgactttccaaaaggagcctcatggatgggttgtggatttggtaaataagtttggagaattaggtggatttgcagcaatccaagccaagctccattcagaagatatagaacttggggctgtctcagcactgattcagcccttaggagtgtgtgcagagtacctcaattcctccgtggtacagcccatgctagacccagtcattcttactacaatccaggatgtacggagtgtagaagagaaagacctcaaagacaagagattggttagcatccctgagctcttgtctgccgttaagttactttgcatgcgcttccaaccggatctggtgacaattgtggatgaccttcgactagatattctattgcgcatgctgaaatcaccacatttcagtgctaagatgaattctctcaaagaagtaaccaaactaatagaagatagcactttatccaaatctgtgaagaatgctatagatacagacagattattagattggctagttgaaaactcagttctgtcgattgcactggaaggcaacatagaccaagcacaatactgtgaccgtataaagggaattattgaactcttgggtagtaaattgtcgttagatgaactcactaaaatttggaagatacagtcaggacaatcatctactgtgattgagaacattcatactattattgctgcagcggctgtgaaatttaattcagatcagcttaatcatttgtttgttctcattcagaaggttttagacgtactctgggaactggctcaccttccaaccctgcccagtagccttattcagcaggccttggaggagcacctgacaatccttagtgatgcatatgcagtgaaagaagcaatcaagaggagctacatcatcaagtgcatagaagatattaagaggtcatctcagcttaataatccccagtttgtatgggtggtaccagctttgcgtcagctccatgaaattactcgctcattcataaaacaaacctatcaaaagcaagacaagagcattattcaagacttgaagaagaattttgaaatagtgaaattggtaacgggaagtttgatcgcttgtcatcggcttgcagctgctgtggccgggcctggaggcttaagtggctcgacactagtggatggccggtacacttaccgggagtatttagaggcacatctaaaatttctagcgtttttcttgcaagaagctactctgtatctgggctggaatcgtgccaaggagatctgggagtgtcttgtaactggccaggatgtttgtgaattagatagagagatgtgttttgaatggtttacaaaaggacagcatgatcttgagagtgatgttcagcagcagctcttcaaggagaaaattcttaaattggagtcatatgaaatcactatgaatggttttaacttatttaaaactttttttgaaaatgtgaatctttgtgatcatcgattgaaaagacaaggagctcagttgtatgtagaaaagctggaattgataggaatggatttcatttggaaaatagccatggaatcacctgatgaagaaattgctaatgaagctattcagctaatcataaactatagttacattaatctaaatcctagattaaagaaggattcagtatctttacataagaaattcattgctgattgctacacaagattagaagcagccagttcagcacttggtggccccactctaacacatgctgtgaccagagcaacaaaaatgcttacagcaactgccatgccaactgtagcaacctcagttcagtctccttatagatctactaaacttgtaataattgagagattgctgcttctggcagagcgctatgtgatcactatagaggatttttactctgttccacgaactattctacctcatggtgcctcatttcatggacatcttttaacccttaatgttacctatgagtctaccaaagataccttcactgtcgaggctcacagtaatgaaaccatagggagtgtccggtggaaaatagccaagcagttgtgctctcctgtggataatatacagatatttacaaatgatagcctgctgacagtgaataaagatcaaaagctactccaccaactgggcttttctgatgaacaaatccttacagtgaagacttctggcagtgggaccccatctgggagttcagcagattcttcaaccagctccagcagcagcagcagtggggtttttagttcttcatatgccatggagcaggagaaatccctccctggtgtagtgatggctctcgtatgtaacgtatttgacatgctttatcagctcgccaatctggaagagccaaggataactctacgagtacggaagcttctgctcttgatacccactgatccagccattcaggaagcccttgatcaacttgattctttaggaagaaagaaaacattgctgtctgaatcaagttctcagtcctcaaaatctccatccctgtcatcaaagcaacagcaccagccaagtgccagttcaattttagaaagtctgtttcgatcttttgccccgggaatgtctaccttcagagtgctctacaacttagaagttctaagctccaaactcatgccaacagctgatgatgacatggccagaagctgtgccaaatccttctgtgaaaacttcctcaaagctggcggtttgagtttggttgtaaatgtcatgcagagagactccatcccatcagaagtagactatgaaacaaggcagggtgtttattccatctgtctacagcttgcaagatttttacttgtcggacaaacaatgcccacgttattagatgaagacctcaccaaagatggtatagaagcactttcttcccgcccattccgaaatgtcagccggcagacaagcagacagatgtccttatgtggtaccccagaaaagtcatcctaccgacagttgtccgtgtctgataggtcttctattagggttgaggaaatcatccctgctgctcgagttgcaatacaaacaatggaagtaagtgatttcacttctactgtggcttgcttcatgagattgtcatgggctgcggctgcaggacggcttgatcttgttgggagtagccagccaattaaagaaagtaattccctgtgtcctgctggaattcgaaacagactcagcagttcaggaagcaattgcagctctggaagtgaaggagaaccagtagccctgcatgcgggaatctgtgttcgacaacagtctgtatccaccaaagactcgctgattgcgggagaggctttgtctcttcttgttacgtgcctacagcttcggagccagcaactggcatctttctataacttgccctgtgttgctgatttcatcattgatattctgctcggatcaccaagtgctgagattcgccgggttgcctgtgatcagctgtacactcttagtcagacagacacatcagcgcatccagatgtgcagaagccaaatcagtttcttctaggcgtaatcctcacggctcagctgcctctctggtctccaactagtattatgagaggagtcaatcagagactgttatctcagtgtatggagtattttgatttgagatgccagttattagatgatctgacaacttcagaaatggagcagttaaggatcagcccagctacgatgcttgaagatgagattacttggctggataactttgaacctaatcgtacagctgaatgtgagaccagtgaagcggacaacatcttactggcagggcacttacgcctcatcaagacccttctttcactctgtggggcagaaaaggaaatgcttggttcatcactcattaaaccattgttagatgacttccttttccgagcttctagaattattttaaatagtcattctccagctggcagtgccgccatcagtcaacaggactttcatccaaagtgtagtacagcgaatagccgattggcagcctatgaagtccttgtgatgttggctgatagttcaccttcaaatcttcaaattattataaaagaactgctttctatgcatcaccagcctgaccctgctcttaccaaggagtttgattaccttcccccagtggatagcaggtccagttcagggtttgtggggctgagaaatggtggtgcaacttgttatatgaatgcagtcttccagcagctgtatatgcaacctgggctccctgagtcattactttcagtggatgatgacacagacaatccagatgatagcgtgttttaccaagtgcagtctctctttggacatttaatggaaagcaagctgcagtactatgtacctgagaatttttggaagattttcaagatgtggaataaagaactttatgtgagagaacagcaggatgcatatgaattctttactagtctcattgatcagatggatgaatacctcaagaaaatggggagagaccaaatttttaagaatacatttcagggcatctactctgatcagaagatctgtaaagactgtcctcacagatatgagcgtgaagaagctttcatggctctcaatctaggagtgacttcttgtcagagtttggaaatttctttggaccaatttgttagaggagaagttctagaaggaagtaatgcgtactactgtgaaaagtgtaaagaaaagagaataacagtgaaaaggacctgtattaaatctttacctagcgtcttggtaattcacctaatgagatttgggtttgactgggaaagcggacgctccattaaatatgatgaacaaataaggtttccctggatgctaaacatggagccttacacagtttcaggaatggctcgccaagattcttcttctgaagttggggaaaatgggcgaagtgtggatcagggcggtggaggatccccacgaaaaaaggttgccctcacagaaaactatgaacttgtcggtgtcatcgtacacagtgggcaggcacacgcaggccactactattccttcattaaggacaggcgagggtgtggaaaaggaaagtggtataaatttaatgacacagttatagaagaatttgacctaaatgacgagaccctggagtatgaatgctttggaggagaatatagaccaaaagtttatgatcaaacaaacccatacactgatgtgcgccgaagatactggaatgcctatatgcttttctaccaaagggtgtctgatcagaactccccagtattaccaaagaaaagtcgagtcagcgttgtacggcaggaagctgaggatctctctctgtcagctccatcttcaccagaaatttcacctcagtcatcccctcggccccataggccgaacaatgaccggctgtctattcttaccaagctggttaaaaaaggcgagaagaaaggactgtttgtggagaaaatgcctgctcgaatataccagatggtgagagatgagaacctcaagtttatgaagaatagagatgtatacagtagtgattatttcagttttgttttgtctttagcttcattgaatgctactaaattaaagcatccatattatccttgcatggcaaaggtgagcttacagcttgctattcaattcctttttcaaacttatctacggacaaagaagaaactcagggttgatactgaagaatggattgctaccattgaagcattgctttcaaaaagttttgatgcttgtcagtggttagttgaatattttattagttctgaaggacgagaattgataaagattttcttactggagtgcaatgtgagagaagtacgagttgctgtggccaccattctggagaaaaccctagacagtgccttgttttatcaggataagttaaaaagccttcatcagttactggaggtactacttgctctgttggacaaagacgtcccagaaaattgtaaaaactgtgctcagtactttttcctgttcaacacttttgtacaaaagcaaggaattagggctggagatcttcttctgaggcattcagctctgcggcacatgatcagcttcctcctaggggccagtcggcaaaacaatcagatacgtcgatggagttcagcacaagcacgagaatttgggaatcttcacaatacagtggcgttacttgttttgcattcagatgtctcatcccaaaggaatgttgctcctggcatatttaagcaacgaccacccattagcattgctccctcaagccctctgttgcccctccatgaggaggtagaagccttgttgttcatgtctgaagggaaaccttacctgttagaggtaatgtttgctttgcgggagctgacaggctcgctcttggcactcattgagatggtagtgtactgctgtttctgtaatgagcatttttccttcacaatgctgcatttcattaagaaccaactagaaacggctccacctcatgagttaaagaatacgttccaactacttcatgaaatattggttattgaagatcctatacaagtagagcgagtcaaatttgtgtttgagacagaaaatggattactagctttgatgcaccacagtaatcatgtggacagtagtcgctgctaccagtgtgtcaaatttcttgtcactcttgctcaaaagtgtcctgcagctaaggagtacttcaaggagaattcccaccactggagctgggctgtgcagtggctacagaagaagatgtcagaacattactggacaccacagagtaatgtctctaatgaaacatcaactggaaaaacctttcagcgaaccatttcagctcaggacacgttagcgtatgccacagctttgttgaatgaaaaagagcaatcaggaagcagtaatgggtcggagagtagtcctgccaatgagaacggagacaggcatctacagcagggttcagaatctcccatgatgattggtgagttgagaagtgaccttgatgatgttgatccctagaggaacatgcccagcctgagaggagtcaagacacaatactggatgctcagcaccttcttggaatcagaatctcgaaccctttggaagagcctggagattggactgggaaagctgctgtgacttgggcggatcgtgtatttctcaaggaaagcatttttaagccactagaaggtttgggagctgtttggcagtgggagaactccggcatgtggatcagctgtcccgggagcgtggtctatatgtggattcacatttctgtggagattttcggaaatagagccagtggcagacttttttgttacacgaacatacaagagtgagcataaagctgttgctttctctacgatgctacaaaagaaattcctttggtttttatattttaagaaaaagcaagctgcttttagatatgtgggggcaaatttttaatcttgcagtaatattaaacaggaatatccaatttaaaatgatgtaaagatgtaataaaattccttttcattgtaaaatagtaattaagtcaatttacacagacctttgtatttaatatgtctccctatttgtatagaatttcagatgggtctagatgagaaccctatgcataagcttggatcttgatgaaaggttaccaggatcaggatcaaaaattgggaaatactaagctcttgaagatatttttctgatataattagattgaaaagagcaattttgaaaatgctgtgttctccagaagtacagggtgcattatttgacatcaattacttaaagaagttatgagttgttccccaaacagattttaaaaacagcaaaataaaagcactttaagatataattttactgagtttaacttcacagaattatctttttaatgcttggagacatattgaataaactgtagtcttaaatcatgtgatctgcaatcgtttgcttttgcttaaaacataattactgaaacccttggtattggttgtatatgaagttaactatttgagttggtacacactgcttgtgagtttcatagttattgtaatgcagagaaggaatttgagaatttgtttctcctcaacatgactaattaacactgaaaagtcagtcaaggtttaagatttattttcccagaaataaatataaagcaattgaataaccatccatttagtcgtatttccaaagtatagcaccattcactcatttataccagctcccttttatggtgtgggggagaggtttacacccacatatttcatatatattttgtacattttgtattttgaattgctcacattttcggccctgttttgcctttagttacaggtcctgccttattttcatctcaccatgcacagaactagggagccttaggaagtgccaggttttcactgtcagatttgccaagtcacagaggcgcagccagccctgaagtgcctgtctggctgctgtggcattgtgtgggcatgtggccaggcagatggcatctcattactgtgctctcgccatggcccagtcttttcattctctggcagtgagggtttctgtgctgtcagacttcattgttattctgtgacttgctggaggttggcagtggcctttgtcaaacacactgagaagatggaagggccagcacttaagagcagaactgtacccttagagaaacggacagaggcgagtggcaaacttcagacggttccaatggtcttgcagtttgaaatgtgatgttctaccattggttttgagtacgtgaatacttcctgtcctactgtttcccctaccctattctcaccttctctccgcccacatcctcaccaagagattgtgtgggacatgaccttgaaatgctggcgatgatccacactgggatatcatcgctggcgactgcactctcaggagcccaaaatcaggagtgaaattgccacttctagtccccttatttcctatggaaacaacgccttccgcacccctagcacctgccgtcctcactgtaaagcttcatcaggatcgtccaccgtgtatattatacgcttcagatcatgttgcttatattgttgctgcaatgaccatcgttttcactttgctggtaaccacttgattgctgacagctacagtcaatgaacctgctgatgactttttttaatgtagtacaacagtgacagttatgacaggcttaccttggaagagttgtcatttttactgccaattttttggatgaagatgtttttataaacctttcaaaatggtctgcaaacagagcaggaattgcacaattaactcaataatgctgtgtgttctcaagaagctcccttagtgaggccgatcttaagatggccgattctgcccgttgaaggcatcctgggaaagaaaacaagcatcccagcgggcatctcaccacgacttctcctggagtcctcacacggtcactgacaactacagtcagttttaggaactagagtgccgtatcatcagacttaccctgtcctgccccaccttccctgctaacatcgaggtgtgtgcagttaccttctgagcttggaacaagcagactggaattttcctctgctacctcttgtgtataaaatcttgtttataaaatttcaaaaggaagtagatacactagggaagaaccttaattctaaatttggttcatgtgtggcaaagttcttagcttctaagagtataaaataaatttttc

SEQ ID NO: 33534 - DNA, 3642 bp, Homo sapiens
cttcaagattatcaataatcggagatacgtatattttatttgtaaagaaaacatggctgccctattcctacgtggttttgtccaaatagggaactgcaagactgggatatctaagtcaaaagaagcattcattgaagcagtggaaagaaagaagaaagatagactggtgctgtatttcaaaagtggaaaatatagcacttttcggctaagtgataatattcaaaatgtagtccttaaatcctatagaggaaaccaaaatcacctgcatttaactttacaaaataataatggcttgtttattgaaggattatcctccacagatgctgaacaattgaagatattcttggacagagttcatcaaaacgaggttcagccacctgtgagacctggtaagggtgggagtgtcttttctagcacaacacagaaggaaatcaacaaaacttcattccacaaagttgatgagaaatcaagtagcaaatcttttgagatagcaaaaggaagtgggacaggtgtccttcagaggatgcctttgcttacatcaaaattgacacttacttgcggagagttatcagaaaatcagcacaagaagaggaaaagaatgctctcatctagctcagagatgaatgaggaattcttgaaagaaaataattctgtagaatacaagaaatccaaggcagattgttcgaggtgtgtaagctataatcgagagaaacaattgaagttaaaagagttagaagagaataagaaattggaatgtgaatcttcatgcatcatgaacgccactggaaatccttacctagatgacattggtcttctccaagctctcactgagaaaatggttttggtatttctgttacaacaagggtatagtgacggttacacaaagtgggataaattaaaactattttttgaattatttccagagaaaatatgccacggcctccccaatttgggaaacacctgttatatgaatgcagtgttacagtctctactttcaatcccatcgtttgctgatgatttacttaatcagagtttcccatggggtaaaattccccttaatgctcttaccatgtgcttggcacggctacttttttttaaagatacctataatatagaaatcaaggagatgttactcttgaatcttaaaaaggccatttcagcagctgcagagatattccatggcaatgcacagaacgatgctcatgagtttttagctcactgtttagatcaactgaaagataacatggaaaaactcaacacaatttggaagcctaaaagtgaatttggggaagataattttcctaaacaggtttttgctgatgatcctgacaccagtgggttttcttgccctgtcattactaattttgagttagagttgttgcactccattgcttgtaaagcttgtggtcaggttattctcaagacagaactgaataattacctctccatcaaccttccccaaagaataaaagcacatccttcatctattcagtctacttttgatcttttttttggagcagaagagcttgagtataaatgtgcaaaatgtgagcacaagacttccgttggagtgcactcattcagtaggctacctagaatccttattgttcacctcaaacgctatagcttgaatgagttttgtgcattaaagaagaatgaccaggaagtcatcatttccaaatatttaaaggtgtcttctcattgcaatgaaggcaccagaccacctcttcccttgagtgaggatggagaaattacagatttccaattattaaaagttattcgaaagatgacttctggaaacatcagtgtatcatggcctgcaacaaaggaatccaaagatatcctggctccacacattggatcagataaggagtctgaacaaaaaaaaggccagacagtctttaaaggggcaagcagaagacagcagcaaaagtaccttggaaaaaattctaaaccaaatgagctagaatctgtatactcaggagatcgagcattcattgaaaaagaaccgttagctcacttaatgacgtatctggaagatacctcactttgtcagttccacaaagctggaggtaaacctgccagcagcccaggcacacctctctcaaaagttgactttcaaacagtgcccgaaaatccaaaacgaaagaaatatgtgaaaaccagtaagtttgtagcttttgataggattatcaatcctactaaagatttgtatgaagataaaaatatcagaattccagaaagattccaaaaagtgtctgaacagactcagcagtgtgacggtatgagaatctgtgaacaagcccctcagcaggcactgcctcaaagctttccaaagccaggcacccaggggcacacaaagaacctcctaagacctacaaaattaaatctacagaagtctaacaggaattccctacttgcactgggttccaataagaatccaagaaacaaagacattttagataagataaaatctaaagccaaggaaacaaaaagaaatgatgataagggagatcatacctaccggctcattagtgttgtcagccatcttgggaagactctaaagtcaggccattatatctgtgatgcctatgactttgagaaacagatctggttcacttacgatgatatgcgggtgttaggtatccaggaggcccagatgcaggaggataggcgttgcactgggtacatcttcttttacatgcataatgagatctttgaagagatgttgaaaagagaagagaatgcccagcttaatagcaaggaggtagaggagacccttcagaaggaataagaggaacgtactcctccttgtacagatctgcctgactgtctcactcgataccacttcctccatggaaggaaaactgtgaactttatccagagatgaaaatgcaattagtctaggaccaaaggtcaaacagaaacacttaatggggagatctgcattctaatcctgacacagacacctcaatcccatagctctggctgatgagcatccttctctcctacaagactgaaattgtgtttttcatgttcttcttcattttaatatagtcagggtcttgctctgtcatcctggctagagtgcagtccttcaataataactcactgcagcctcaaactcctggcatcaagcgattctctctcagcctcctgaaaagagagggacttatcttcttgcttgagatgggactatagatgtgtgccaccaggcctagctatttttttttttttttttgctttttgcagagacagggtctcactatgctgcccaggttggacttgaactcctggcctcaagcaatcttcctgcctctttccatgttctaatacagtggtttaaaaagtatgctccttaaactagcagcaccaggagcatgggggtagtcatttgaaatgcaaaatcttgggttccactgtagacctactgattcagaaacttggggtaagggatagcaatctgatggagaccgtgatgcttgatacagtttgagaaccactactgtactacatacactaccttggttgtatatttaaattgcttattttgtaaaaggttttgattacatttttgtgtttttcatattaatgtatgccttgcctttgtgaacttattaaaagccaaactcacaaaaatca

SEQ ID NO: 33535 - DNA, 3342 bp, Homo sapiens
caacagattccctgtttctgctttaacctgggctgcttgctaagtgcttgcctctcaggatccttgtggagctgaacttgcaaaacagattggaacttcaagattatcaataatcggagatacgtatattttatttgtaaagaaaacatggctgccctattcctacgtggttttgtccaaatagggaactgcaagactgggatatctaagtcaaaagaagcattcattgaagcagtggaaagaaagaagaaagatagactggtgctgtatttcaaaagtggaaaatatagcacttttcggctaagtgataatattcaaaatgtagtccttaaatcctatagaggaaaccaaaatcacctgcatttaactttacaaaataataatggcttgtttattgaaggattatcctccacagatgctgaacaattgaagatattcttggacagagttcatcaaaacgaggttcagccacctgtgagacctggtaagggtgggagtgtcttttctagcacaacacagaaggaaatcaacaaaacttcattccacaaagttgatgagaaatcaagtagcaaatcttttgagatagcaaaaggaagtgggacaggtgtccttcagaggatgcctttgcttacatcaaaattgacacttacttgcggagagttatcagaaaatcagcacaagaagaggaaaagaatgctctcatctagctcagagatgaatgaggaattcttgaaagaaaataattctgtagaatacaagaaatccaaggcagattgttcgaggtgtgtaagctataatcgagagaaacaattgaagttaaaagagttagaagagaataagaaattggaatgtgaatcttcatgcatcatgaacgccactggaaatccttacctagatgacattggtcttctccaagctctcactgagaaaatggttttggtatttctgttacaacaagggtatagtgacggttacacaaagtgggataaattaaaactattttttgaattatttccagagaaaatatgccacggcctccccaatttgggaaacacctgttatatgaatgcagtgttacagtctctactttcaatcccatcgtttgctgatgatttacttaatcagagtttcccatggggtaaaattccccttaatgctcttaccatgtgcttggcacggctacttttttttaaagatacctataatatagaaatcaaggagatgttactcttgaatcttaaaaaggccatttcagcagctgcagagatattccatggcaatgcacagaacgatgctcatgagtttttagctcactgtttagatcaactgaaagataacatggaaaaactcaacacaatttggaagcctaaaagtgaatttggggaagataattttcctaaacaggtttttgctgatgatcctgacaccagtgggttttcttgccctgtcattactaattttgagttagagttgttgcactccattgcttgtaaagcttgtggtcaggttattctcaagacagaactgaataattacctctccatcaaccttccccaaagaataaaagcacatccttcatctattcagtctacttttgatcttttttttggagcagaagagcttgagtataaatgtgcaaaatgtgagcacaagacttccgttggagtgcactcattcagtaggctacctagaatccttattgttcacctcaaacgctatagcttgaatgagttttgtgcattaaagaagaatgaccaggaagtcatcatttccaaatatttaaaggtgtcttctcattgcaatgaaggcaccagaccacctcttcccttgagtgaggatggagaaattacagatttccaattattaaaagttattcgaaagatgacttctggaaacatcagtgtatcatggcctgcaacaaaggaatccaaagatatcctggctccacacattggatcagataaggagtctgaacaaaaaaaaggccagacagtctttaaaggggcaagcagaagacagcagcaaaagtaccttggaaaaaattctaaaccaaatgagctagaatctgtatactcaggagatcgagcattcattgaaaaagaaccgttagctcacttaatgacgtatctggaagatacctcactttgtcagttccacaaagctggaggtaaacctgccagcagcccaggcacacctctctcaaaagttgactttcaaacagtgcccgaaaatccaaaacgaaagaaatatgtgaaaaccagtaagtttgtagcttttgataggattatcaatcctactaaagatttgtatgaagataaaaatatcagaattccagaaagattccaaaaagtgtctgaacagactcagcagtgtgacggtatgagaatctgtgaacaagcccctcagcaggcactgcctcaaagctttccaaagccaggcacccaggggcacacaaagaacctcctaagacctacaaaattaaatctacagaagtctaacaggaattccctacttgcactgggttccaataagaatccaagaaacaaagacattttagataagataaaatctaaagccaaggaaacaaaaagaaatgatgataagggagatcatacctaccggctcattagtgttgtcagccatcttgggaagactctaaagtcaggccattatatctgtgatgcctatgactttgagaaacagatctggttcacttacgatgatatgcgggtgttaggtatccaggaggcccagatgcaggaggataggcgttgcactgggtacatcttcttttacatgcataatgagatctttgaagagatgttgaaaagagaagagaatgcccagcttaatagcaaggaggtagaggagacccttcagaaggaataagaggaacgtactcctccttgtacagatctgcctgactgtctcactcgataccacttcctccatggaaggaaaactgtgaactttatccagagatgaaaatgcaattagtctaggaccaaaggtcaaacagaaacacttaatggggagatctgcattctaatcctgacacagacacctcaatcccatagctctggctgatgagcatccttctctcctacaagactgaaattgtgtttttcatgttcttcttcattttaatatagtcagggtcttgctctgtcatcctggctagagtgcagtccttcaataataactcactgcagcctcaaactcctggcatcaagcgattctctctcagcctcctgaaaagagagggacttatcttcttgcttgagatgggactatagatgtgtgccaccaggcctagctatttttttttttttttttgctttt

SEQ ID NO: 33536 - DNA, 4669 bp, Homo sapiens
agtcctgagaggctgggccggcggcggctgcggcgggagaccggtgacccgcggctgggcgcctcggccatgactgcggagctgcagcaggacgacgcggccggcgcggcagacggccacggctcgagctgccaaatgctgttaaatcaactgagagaaatcacaggcattcaggacccttcctttctccatgaagctctgaaggccagtaatggtgacattactcaggcagtcagccttctcactgatgagagagttaaggagcccagtcaagacactgttgctacagaaccatctgaagtagaggggagtgctgccaacaaggaagtattagcaaaagttatagaccttactcatgataacaaagatgatcttcaggctgccattgctttgagtctactggagtctcccaaaattcaagctgatggaagagatcttaacaggatgcatgaagcaacctctgcagaaactaaacgctcaaagagaaaacgctgtgaagtctggggagaaaaccccaatcccaatgactggaggagagttgatggttggccagttgggctgaaaaatgttggcaatacatgttggtttagtgctgttattcagtctctctttcaattgcctgaatttcgaagacttgttctcagttatagtctgccacaaaatgtacttgaaaattgtcgaagtcatacagaaaagagaaatatcatgtttatgcaagagcttcagtatttgtttgctctaatgatgggatcaaatagaaaatttgtagacccgtctgcagccctggatctattaaagggagcattccgatcatctgaggaacagcagcaagatgtgagtgaattcacacacaagctcctggattggctagaggacgcattccagctagctgttaatgttaacagtcccaggaacaaatctgaaaatccaatggtgcagctgttctatggtactttcctgactgaaggggttcgtgaaggaaaacccttttgtaacaatgagaccttcggccagtatcctcttcaggtaaacggttatcgcaacttagacgagtgtttggaaggggccatggtggagggtgatgttgagcttcttccctccgatcactcggtgaagtatggacaagagcgttggtttacaaagctacctccagtgttgacctttgaactctcaagatttgagtttaatcagtcccttgggcagccagagaaaattcacaataagctggaatttcctcagattatttatatggacaggtacatgtacaggagcaaggagcttattcgaaataagagagagtgtattcgaaagttgaaggaggaaataaaaattctgcagcaaaaattggaaaggtatgtgaaatatggctcaggcccagctcggttcccgctcccggacatgctgaaatatgttattgaatttgctagtacaaaacctgcctcagaaagctgtccacctgaaagtgacacacatatgacattaccactttcttcagtgcactgctcggtttctgaccagacatccaaggaaagtacaagtacagaaagctcttctcaggatgttgaaagtaccttttcttctcctgaagattctttacccaagtctaaaccactgacatcttctcggtcttccatggaaatgccttcacagccagctccacgaacagtcacagatgaggagataaattttgttaagacctgtcttcagagatggaggagtgagattgaacaagatatacaagatttaaagacttgtattgcaagtactactcagactattgaacagatgtactgcgatcctctccttcgtcaggtgccttatcgcttgcatgcagttcttgttcatgaaggacaagcaaatgctggacactattgggcctatatctataatcaaccccgacagagctggctcaagtacaatgacatctctgttactgaatcttcctgggaagaagttgaaagagattcctatggaggcctgagaaatgttagtgcttactgtctgatgtacattaatgacaaactaccctacttcaatgcagaggcagccccaactgaatcagatcaaatgtcagaagtggaagccctatctgtggaactcaagcattacattcaggaggataactggcggtttgagcaggaagtagaggagtgggaagaagagcagtcttgcaaaatccctcaaatggagtcctccaccaactcctcatcacaggactactctacatcacaagagccttcagtagcctcttctcatggggttcgctgcttgtcgtctgagcatgctgtgattgtaaaggagcaaactgcccaggctattgcaaacacagcccgtgcctatgagaagagcggtgtagaagcggcactgagtgaggtgatgctgagccctgccatgcaaggggtcatcctggccatagctaaagcccgtcagacctttgaccgagatgggtctgaagcagggctgattaaggcattccatgaagaatactccaggctctatcagcttgccaaagagacccccacctctcacagtgatcctcgacttcagcatgtccttgtctactttttccaaaatgaagcacccaaaagggtagtagaacgaacccttctggaacagtttgcagataaaaatcttagctatgatgaaagatcaatcagcattatgaaggtggctcaagcgaaactgaaggaaattggtccagatgacatgaatatggaagagtacaagaagtggcatgaagattatagtttgttccgaaaagtgtctgtgtatctcctaacaggcctagaactctatcaaaaaggaaagtaccaagaggcactttcctacctggtatatgcctaccagagcaatgctgccctgctgatgaaggggccccgccggggggtcaaagaatccgtgattgctttataccgaagaaaatgccttctggagctgaatgccaaagcagcttctctttttgaaacaaatgatgatcactccgtaactgagggcattaatgtgatgaatgaactgatcatcccctgcattcaccttatcattaataatgacatttccaaggatgatctggatgccattgaggtcatgagaaaccattggtgctcttaccttgggcaagatattgcagaaaatctgcagctgtgcctaggggagtttctacccagacttctagatccttctgcagaaatcatcgtcttgaaagagcctccaacaattcgacccaattctccctatgacctatgtagccgatttgcagctgtcatggagtcaattcagggagtttcaactgtgacagtgaaataagctcccacatgttcaaggcccattctggttcctggctgcctgcctcttgcacagaagttcgttgtcatagtgctcaccttgggaaaaggattaggtgggcacataagattccgatcagaccccaaccatgctgcatgtgtaaagaaggattgaaaataaaattgcactttttaggtacaaaatcataaaagctgtttcactagaaaaggcagaaagcagtgtattaaggtgttgaattacgccagaagacctgaaatgccttgtacctacaacaatgcttaggcttttctaagcctcttgccacttttaaaattatccttcaggcataaatatttttgacagcagaatagaagaatgattcatgagaacctgaaccagatgaacagctactagttattttatcaaatacagatgacatttaaaaattcttaactacaagagattagaaatataaaccttgcctggctcttgccaggagataacaaaatgggttgctgatgaactgcacccttttacatgtgggtagaatataagctcacatggcagtgagatgttgaaaagtcaaaagagacctgtctctctcctttcttttctatctttaaaccagaaaacctcatactcagtcctcagtgaaagaaagtaaagtattaaggactttagacagaagagcattgtgtaacttgactgaagatcatccattaatagttattaggcatttaggtaaaattttctaatacctaaaaattgtcaaaaacagtcaatagggctactgctggcccaaagaccatttaggtccacctcctcttttttgctctttttttttttctgtgacagtttcactgtgtcgcccaggctggcgttcagtggtgcaatctcagctcactgcaaactctgtctcctgggctcaagtgattctcgtgcctcagcctcccgaatagctggaattacgggcatgcaccaccacacctggctaatttttgtatttttaatagagatggggtttcaccatattggccaggctgatctctaactcctggcctcaagtgatctatctgcctccctcagcctcccaaagtctgggattgcagacaagtcatcgtacccggccttcttttttgcccttaaaagtaagggatgtgggtttgtacaaaaaaaaaaaaaaaaaaaaaaaaaccagcatacatatgcaaaactatatatatatgtatatgtagagaaaaatacttcccattgatcatttttaaaaggcttctgattggatattgtgttttaaccaaattttaaagattaatggaatcatgaaagggaaaaaaattgatacaactatgcagattttataaatgtgcaataaaagtatttgttttac

SEQ ID NO: 33537 - DNA, 4535 bp, Homo sapiens
gagaccggtgacccgcggctgggcgcctcggccatgactgcggagctgcagcaggacgacgcggccggcgcggcagacggccacggctcgagctgccaaatgctgttaaatcaactgagagaaatcacaggcattcaggacccttcctttctccatgaagctctgaaggccagtaatggtgacattactcaggcagtcagccttctcactgatgagagagttaaggagcccagtcaagacactgttgctacagaaccatctgaagtagaggggagtgctgccaacaaggaagtattagcaaaagttatagaccttactcatgataacaaagatgatcttcaggctgccattgctttgagtctactggagtctcccaaaattcaagctgatggaagagatcttaacaggatgcatgaagcaacctctgcagaaactaaacgctcaaagagaaaacgctgtgaagtctggggagaaaaccccaatcccaatgactggaggagagttgatggttggccagttgggctgaaaaatgttggcaatacatgttggtttagtgctgttattcagtctctctttcaattgcctgaatttcgaagacttgttctcagttatagtctgccacaaaatgtacttgaaaattgtcgaagtcatacagaaaagagaaatatcatgtttatgcaagagcttcagtatttgtttgctctaatgatgggatcaaatagaaaatttgtagacccgtctgcagccctggatctattaaagggagcattccgatcatctgaggaacagcagcaagatgtgagtgaattcacacacaagctcctggattggctagaggacgcattccagctagctgttaatgttaacagtcccaggaacaaatctgaaaatccaatggtgcagctgttctatggtactttcctgactgaaggggttcgtgaaggaaaacccttttgtaacaatgagaccttcggccagtatcctcttcaggtaaacggttatcgcaacttagacgagtgtttggaaggggccatggtggagggtgatgttgagcttcttccctccgatcactcggtgaagtatggacaagagcgttggtttacaaagctacctccagtgttgacctttgaactctcaagatttgagtttaatcagtcccttgggcagccagagaaaattcacaataagctggaatttcctcagattatttatatggacaggtacatgtacaggagcaaggagcttattcgaaataagagagagtgtattcgaaagttgaaggaggaaataaaaattctgcagcaaaaattggaaaggtatgtgaaatatggctcaggcccagctcggttcccgctcccggacatgctgaaatatgttattgaatttgctagtacaaaacctgcctcagaaagctgtccacctgaaagtgacacacatatgacattaccactttcttcagtgcactgctcggtttctgaccagacatccaaggaaagtacaagtacagaaagctcttctcaggatgttgaaagtaccttttcttctcctgaagattctttacccaagtctaaaccactgacatcttctcggtcttccatggaaatgccttcacagccagctccacgaacagtcacagatgaggagataaattttgttaagacctgtcttcagagatggaggagtgagattgaacaagatatacaagatttaaagacttgtattgcaagtactactcagactattgaacagatgtactgcgatcctctccttcgtcaggtgccttatcgcttgcatgcagttcttgttcatgaaggacaagcaaatgctggacactattgggcctatatctataatcaaccccgacagagctggctcaagtacaatgacatctctgttactgaatcttcctgggaagaagttgaaagagattcctatggaggcctgagaaatgttagtgcttactgtctgatgtacattaatgacaaactaccctacttcaatgcagaggcagccccaactgaatcagatcaaatgtcagaagtggaagccctatctgtggaactcaagcattacattcaggaggataactggcggtttgagcaggaagtagaggagtgggaagaagagcagtcttgcaaaatccctcaaatggagtcctccaccaactcctcatcacaggactactctacatcacaagagccttcagtagcctcttctcatggggttcgctgcttgtcgtctgagcatgctgtgattgtaaaggagcaaactgcccaggctattgcaaacacagcccgtgcctatgagaagagcggtgtagaagcggcactgagtgaggcattccatgaagaatactccaggctctatcagcttgccaaagagacccccacctctcacagtgatcctcgacttcagcatgtccttgtctactttttccaaaatgaagcacccaaaagggtagtagaacgaacccttctggaacagtttgcagataaaaatcttagctatgatgaaagatcaatcagcattatgaaggtggctcaagcgaaactgaaggaaattggtccagatgacatgaatatggaagagtacaagaagtggcatgaagattatagtttgttccgaaaagtgtctgtgtatctcctaacaggcctagaactctatcaaaaaggaaagtaccaagaggcactttcctacctggtatatgcctaccagagcaatgctgccctgctgatgaaggggccccgccggggggtcaaagaatccgtgattgctttataccgaagaaaatgccttctggagctgaatgccaaagcagcttctctttttgaaacaaatgatgatcactccgtaactgagggcattaatgtgatgaatgaactgatcatcccctgcattcaccttatcattaataatgacatttccaaggatgatctggatgccattgaggtcatgagaaaccattggtgctcttaccttgggcaagatattgcagaaaatctgcagctgtgcctaggggagtttctacccagacttctagatccttctgcagaaatcatcgtcttgaaagagcctccaacaattcgacccaattctccctatgacctatgtagccgatttgcagctgtcatggagtcaattcagggagtttcaactgtgacagtgaaataagctcccacatgttcaaggcccattctggttcctggctgcctgcctcttgcacagaagttcgttgtcatagtgctcaccttgggaaaaggattaggtgggcacataagattccgatcagaccccaaccatgctgcatgtgtaaagaaggattgaaaataaaattgcactttttaggtacaaaatcataaaagctgtttcactagaaaaggcagaaagcagtgtattaaggtgttgaattacgccagaagacctgaaatgccttgtacctacaacaatgcttaggcttttctaagcctcttgccacttttaaaattatccttcaggcataaatatttttgacagcagaatagaagaatgattcatgagaacctgaaccagatgaacagctactagttattttatcaaatacagatgacatttaaaaattcttaactacaagagattagaaatataaaccttgcctggctcttgccaggagataacaaaatgggttgctgatgaactgcacccttttacatgtgggtagaatataagctcacatggcagtgagatgttgaaaagtcaaaagagacctgtctctctcctttcttttctatctttaaaccagaaaacctcatactcagtcctcagtgaaagaaagtaaagtattaaggactttagacagaagagcattgtgtaacttgactgaagatcatccattaatagttattaggcatttaggtaaaattttctaatacctaaaaattgtcaaaaacagtcaatagggctactgctggcccaaagaccatttaggtccacctcctcttttttgctctttttttttttctgtgacagtttcactgtgtcgcccaggctggcgttcagtggtgcaatctcagctcactgcaaactctgtctcctgggctcaagtgattctcgtgcctcagcctcccgaatagctggaattacgggcatgcaccaccacacctggctaatttttgtatttttaatagagatggggtttcaccatattggccaggctgatctctaactcctggcctcaagtgatctatctgcctccctcagcctcccaaagtctgggattgcagacaagtcatcgtacccggccttcttttttgcccttaaaagtaagggatgtgggtttgtacaaaaaaaaaaaaaaaaaaaaaaaaaccagcatacatatgcaaaactatatatatatgtatatgtagagaaaaatacttcccattgatcatttttaaaaggcttctgattggatattgtgttttaaccaaattttaaagattaatggaatcatgaaagggaaaaaaattgatacaactatgcagattttataaatgtgcaataaaagtatttgtttt

SEQ ID NO: 33538 - DNA, 2439 bp, Homo sapiens
gagcgcccggctagaagcgacaccagacggagcctccggagttcctccgcccccacctcgccgggtcctggagccgcagtcctcccagctgccctcctcgtggccatggagtgtccacacctgagctccagcgtctgcattgctccggactcagccaagttccccaacggctccccgtcgtcctggtgctgcagcgccttcaaatgtttatctggtgtgactgtattatgccctcagagagtactgtatgttgcccaggctggcctcgaactctaggctcaagtgattcttctgcctcagcctcccaagtagctgggactacagatgcaatcaccaccacacttggcagtgtgccggtccaacaaaagcccttgggtctgtttgacttgttcaagtgtccactgtggaaggtatgtgaatggccatgcaaaaaaacattatgaagatgcacaagtacctttaaccaaccataagaaatcagaaaagcaagataaagttcagcacacagtatgtatggattgcagtagctacagtacatactgttatcgctgtgatgattttgtggttaatgacaccaagctgggactggtacagaaagtcagagaacacttacagaacttggaaaactcagctttcacagctgacaggcataagaaaagaaaacttttggaaaactcaacactaaacagcaagttattaaaagtaaatggaagcaccactgccatttgtgccacaggccttcggaatttggggaacacatgtttcatgaatgccatccttcagtcactcagtaacattgagcagttttgctgttatttcaaagaactgcccgccgtggagttaaggaatgggaaaacagcaggaaggcggacataccacaccaggagccaaggggataacaatgtgtctttggtagaagagtttagaaagacactctgtgctttatggcaaggcagccagactgcatttagcccagagtccttattttatgttgtttggaagattatgccaaactttaggggctatcaacagcaggacgcccatgaattcatgcgctaccttttggaccacctacacttggaacttcagggcggtttcaacggtgtttcccgctcagcaattctgcaggagaattctactctgtctgcaagtaacaagtgttgcataaatggagcatctactgttgtcacggctatattcggaggcattctccaaaatgaggttaactgcctcatatgtgggacagaatctagaaagtttgatccattcctagacctttcattagatattccaagtcagttcagaagtaagcgctctaagaatcaagaaaatggaccagtttgttcgttacgagattgtcttcgcagttttaccgacttagaagaacttgatgagacagagttatatatgtgccataaatgcaaaaagaaacaaaagtccacaaaaaagttttggattcaaaaactacccaaggtgctatgcttacatttgaaaagatttcattggacagcatatttaagaaataaagttgatacatacgtagaatttccactgagaggcctagacatgaaatgctacttactagagcctgagaacagtggcccggagagctgcctgtatgacctcgccgctgtggtggtgcaccatggttccggggttggttctggacattacacagcatacgcaactcacgaaggccgctggttccacttcaatgacagtactgtaacactgactgacgaggagactgtggtgaaggcgaaggcctacatccttttctacgtggaacaccaggccaaagctggatcggataaactttaatacctcctccaaatcatcattcaccaaccataccagagaaacatttccagttttccacaaatacttgatacaagatttaatttcattatgcacttttcaatttcctattttggatttagttttgtcaatggtagtgacttactgaacatgggcaccaactaattttgttgttgttctaccagaaaacctcagcagatgttttgatttgctgctttagttgtaataattcaatttttataggtagttgtaagaacttagtcttatttgacttttttattttatgttaatgttttcagttctcactttgaggcacatttacatcaatgcttttgttcctctcacatgctgaaagcaagatgtgttccttattgtgaagagcgacacaactgcctgctgcctttccacagctataatggacatcaggttgactctaaatcaaggatcatgtgtgcacaatacttgtggcccacaaaatttcacaatgactgctgaggaatcattctttttgcctgtaaaatataacaaagggcatcattaagtagaccaggtaattactgcttgtctctcaaggctgctgtctttatcagcactaactaaataaatttgttggttcagttg

SEQ ID NO: 33539 - DNA, 2333 bp, Homo sapiens
ctcgagacgcagccgccgtcggccgagcgcccggctagaagcgacaccagacggagcctccggagttcctccgcccccacctcgccgggtcctggagccgcagtcctcccagctgccctcctcgtggccatggagtgtccacacctgagctccagcgtctgcattgctccggactcagccaagttccccaacggctccccgtcgtcctggtgctgcagcgtgtgccggtccaacaaaagcccttgggtctgtttgacttgttcaagtgtccactgtggaaggtatgtgaatggccatgcaaaaaaacattatgaagatgcacaagtacctttaaccaaccataagaaatcagaaaagcaagataaagttcagcacacagtatgtatggattgcagtagctacagtacatactgttatcgctgtgatgattttgtggttaatgacaccaagctgggactggtacagaaagtcagagaacacttacagaacttggaaaactcagctttcacagctgacaggcataagaaaagaaaacttttggaaaactcaacactaaacagcaagttattaaaagtaaatggaagcaccactgccatttgtgccacaggccttcggaatttggggaacacatgtttcatgaatgccatccttcagtcactcagtaacattgagcagttttgctgttatttcaaagaactgcccgccgtggagttaaggaatgggaaaacagcaggaaggcggacataccacaccaggagccaaggggataacaatgtgtctttggtagaagagtttagaaagacactctgtgctttatggcaaggcagccagactgcatttagcccagagtccttattttatgttgtttggaagattatgccaaactttaggggctatcaacagcaggacgcccatgaattcatgcgctaccttttggaccacctacacttggaacttcagggcggtttcaacggtgtttcccgctcagcaattctgcaggagaattctactctgtctgcaagtaacaagtgttgcataaatggagcatctactgttgtcacggctatattcggaggcattctccaaaatgaggttaactgcctcatatgtgggacagaatctagaaagtttgatccattcctagacctttcattagatattccaagtcagttcagaagtaagcgctctaagaatcaagaaaatggaccagtttgttcgttacgagattgtcttcgcagttttaccgacttagaagaacttgatgagacagagttatatatgtgccataaatgcaaaaagaaacaaaagtccacaaaaaagttttggattcaaaaactacccaaggtgctatgcttacatttgaaaagatttcattggacagcatatttaagaaataaagttgatacatacgtagaatttccactgagaggcctagacatgaaatgctacttactagagcctgagaacagtggcccggagagctgcctgtatgacctcgccgctgtggtggtgcaccatggttccggggttggttctggacattacacagcatacgcaactcacgaaggccgctggttccacttcaatgacagtactgtaacactgactgacgaggagactgtggtgaaggcgaaggcctacatccttttctacgtggaacaccaggccaaagctggatcggataaactttaatacctcctccaaatcatcattcaccaaccataccagagaaacatttccagttttccacaaatacttgatacaagatttaatttcattatgcacttttcaatttcctattttggatttagttttgtcaatggtagtgacttactgaacatgggcaccaactaattttgttgttgttctaccagaaaacctcagcagatgttttgatttgctgctttagttgtaataattcaatttttataggtagttgtaagaacttagtcttatttgacttttttattttatgttaatgttttcagttctcactttgaggcacatttacatcaatgcttttgttcctctcacatgctgaaagcaagatgtgttccttattgtgaagagcgacacaactgcctgctgcctttccacagctataatggacatcaggttgactctaaatcaaggatcatgtgtgcacaatacttgtggcccacaaaatttcacaatgactgctgaggaatcattctttttgcctgtaaaatataacaaagggcatcattaagtagaccaggtaattactgcttgtctctcaaggctgctgtctttatcagcactaactaaataaatttgttggttcagttgtacttgtcctgcaaatacaagaa

SEQ ID NO: 33540 - DNA, 961 bp, Homo sapiens
accagacggagcctccggagttcctccgcccccacctcgccgggtcctggagccgcagtcctcccagctgccctcctcgtggccatggagtgtccacacctgagctccagcgtctgcattgctccggactcagccaagttccccaacggctccccgtcgtcctggtgctgcagcgtgtgccggtccaacaaaagcccttgggtctgtttgacttgttcaagtgtccactgtggaaggtatgtgaatggccatgcaaaaaaacattatgaagatgcacaagtacctttaaccaaccataagaaatcagaaaagcaagataaagttcagcacacagtatgtatggattgcagtagctacagtacatactgttatcgctgtgatgattttgtggttaatgacaccaagctgggactggtacagaaagtcagagaacacttacagaacttggaaaactcagctttcacagctgacaggcataagaaaagaaaacttttggaaaactcaacactaaacagcaagttattaaaagtaaatgtctttggtagaagagtttagaaagacactctgtgctttatggcaaggcagccagactgcatttagcccagagtccttattttatgttgtttggaagattatgccaaactttaggggctatcaacagcaggacgcccatgaattcatgcgctaccttttggaccacctacacttggaacttcagggcggtttcaacggtgtttcccgctcagcaattctgcaggagaattctactctgtctgcaagtaacaagtgttgcataaatggagcatctactgttgtcacggctatattcggaggcattctccaaaatgaggttaactgcctcatatgtgggacagaatctagaaagtttgatccattcctagacctttcattagatattccaagtcagttcagaagtaagcgctctaagaatcaagaaaat

SEQ ID NO: 33541 - DNA, 2014 bp, Homo sapiens
aagatgcacaagtacctttaaccaaccataagaaatcagaaaagcaagataaagttcagcacacagtatgtatggattgcagtagctacagtacatactgttatcgctgtgatgattttgtggttaatgacaccaagctgggactggtacagaaagtcagagaacacttacagaacttggaaaactcagctttcacagctgacaggcataagaaaagaaaacttttggaaaactcaacactaaacagcaagttattaaaagtaaatggaagcaccactgccatttgtgccacaggccttcggaatttggggaacacatgtttcatgaatgccatccttcagtcactcagtaacattgagcagttttgctgttatttcaaagaactgcccgccgtggagttaaggaatgggaaaacagcaggaaggcggacataccacaccaggagccaaggggataacaatgtgtctttggtagaagagtttagaaagacactctgtgctttatggcaaggcagccagactgcatttagcccagagtccttattttatgttgtttggaagattatgccaaactttaggggctatcaacagcaggacgcccatgaattcatgcgctaccttttggaccacctacacttggaacttcagggcggtttcaacggtgtttcccgctcagcaattctgcaggagaattctactctgtctgcaagtaacaagtgttgcataaatggagcatctactgttgtcacggctatattcggaggcattctccaaaatgaggttaactgcctcatatgtgggacagaatctagaaagtttgatccattcctagacctttcattagatattccaagtcagttcagaagtaagcgctctaagaatcaagaaaatggaccagtttgttcgttacgagattgtcttcgcagttttaccgacttagaagaacttgatgagacagagttatatatgtgccataaatgcaaaaagaaacaaaagtccacaaaaaagttttggattcaaaaactacccaaggtgctatgcttacatttgaaaagatttcattggacagcatatttaagaaataaagttgatacatacgtagaatttccactgagaggcctagacatgaaatgctactactagagcctgagaacagtggcccggagagctgcctgtatgacctcgccgctgtggtggtgcaccatggttccggggttggttctggacattacacagcatacgcaactcacgaaggccgctggttccacttcaatgacagtactgtaacactgactgacgaggagactgtggtgaaggcgaaggcctacatccttttctacgtggaacaccaggccaaagctggatcggataaactttaatacctcctccaaatcatcattcaccaaccataccagagaaacatttccagttttccacaaatacttgatacaagatttaatttcattatgcacttttcaatttcctattttggatttagttttgtcaatggtagtgacttactgaacatgggcaccaactaattttgttgttgttctaccagaaaacctcagcagatgttttgatttgctgctttagttgtaataattcaatttttataggtagttgtaagaacttagtcttatttgacttttttattttatgttaatgttttcagttctcactttgaggcacatttacatcaatgcttttgttcctctcacatgctgaaagcaagatgtgttccttattgtgaagagcgacacaactgcctgctgcctttccacagctataatggacatcaggttgactctaaatcaaggatcatgtgtgcacaatacttgtggcccacaaaatttcacaatgactgctgaggaatcattctttttgcctgtaaaatataacaaagggcatcattaagtagaccaggtaattactgcttgtctctcaaggctgctgtctttatcagcactaactaaataaatttgttggttcagttgtacttgtcctgcaaatac

SEQ ID NO: 33542 - DNA, 1502 bp, Homo sapiens
accagacggagcctccggagttcctccgcccccacctcgccgggtcctggagccgcagtcctcccagctgccctcctcgtggccatggagtgtccacacctgagctccagcgtctgcattgctccggactcagccaagttccccaacggctccccgtcgtcctggtgctgcagcggtctttggtagaagagtttagaaagacactctgtgctttatggcaaggcagccagactgcatttagcccagagtccttattttatgttgtttggaagattatgccaaactttaggggctatcaacagcaggacgcccatgaattcatgcgctaccttttggaccacctacacttggaacttcagggcggtttcaacggtgtttcccgctcagcaattctgcaggagaattctactctgtctgcaagtaacaagtgttgcataaatggagcatctactgttgtcacggctatattcggaggcattctccaaaatgaggttaactgcctcatatgtgggacagaatctagaaagtttgatccattcctagacctttcattagatattccaagtcagttcagaagtaagcgctctaagaatcaagaaaatggaccagtttgttcgttacgagattgtcttcgcagttttaccgacttagaagaacttgatgagacagagttatatatgtgccataaatgcaaaaagaaacaaaagtccacaaaaaagttttggattcaaaaactacccaaggtgctatgcttacatttgaaaagatttcattggacagcatatttaagaaataaagttgatacatacgtagaatttccactgagaggcctagacatgaaatgctacttactagagcctgagaacagtggcccggagagctgcctgtatgacctcgccgctgtggtggtgcaccatggttccggggttggttctggacattacacagcatacgcaactcacgaaggccgctggttccacttcaatgacagtactgtaacactgactgacgaggagactgtggtgaaggcgaaggcctacatccttttctacgtggaacaccaggccaaagctggatcggataaactttaatacctcctccaaatcatcattcaccaaccataccagagaaacatttccagttttccacaaatacttgatacaagatttaatttcattatgcacttttcaatttcctattttggatttagttttgtcaatggtagtgacttactgaacatgggcaccaactaattttgttgttgttctaccagaaaacctcagcagatgttttgatttgctgctttagttgtaataattcaatttttataggtagttgtaagaacttagtcttatttgacttttttattttatgttaatgttttcagttctcactttgaggcacatttacatcaatgcttttgttcctctcacatgctgaaagcaagatgtgttccttattgtgaagagcgacacaactgcctgctgcctttccacagctat

SEQ ID NO: 33543 - DNA, 1972 bp, Homo sapiens
ttctttgacgcaagggctcgagacgcagccgccgtcggccgagcgcccggctagaagcgacaccagacggagcctccggagttcctccgcccccacctcgccgggtcctggagccgcagtcctcccagctgccctcctcgtggccatggagtgtccacacctgagctccagcgtctgcattgctccggactcagccaagttccccaacggctccccgtcgtcctggtgctgcagcgtgtgccggtccaacaaaagcccttgggtctgtttgacttgttcaagtgtccactgtggaagttatcgctgtgatgattttgtggttaatgacaccaagctgggactggtacagaaagtcagagaacacttacagaacttggaaaactcagctttcacagctgacaggcataagaaaagaaaacttttggaaaactcaacactaaacagcaagttattaaaagtaaatggaagcaccactgccatttgtgccacaggccttcggaatttggggaacacatgtttcatgaatgccatccttcagtcactcagtaacattgagcagttttgctgttatttcaaagaactgcccgccgtggagttaaggaatgggaaaacagcaggaaggcggacataccacaccaggagccaaggggataacaatgtgtctttggtagaagagtttagaaagacactctgtgctttatggcaaggcagccagactgcatttagcccagagtccttattttatgttgtttggaagattatgccaaactttaggggctatcaacagcaggacgcccatgaattcatgcgctaccttttggaccacctacacttggaacttcagggcggtttcaacggtgtttcccgctcagcaattctgcaggagaattctactctgtctgcaagtaacaagtgttgcataaatggagcatctactgttgtcacggctatattcggaggcattctccaaaatgaggttaactgcctcatatgtgggacagaatctagaaagtttgatccattcctagacctttcattagatattccaagtcagttcagaagtaagcgctctaagaatcaagaaaatggaccagtttgttcgttacgagattgtcttcgcagttttaccgacttagaagaacttgatgagacagagttatatatgtgccataaatgcaaaaagaaacaaaagtccacaaaaaagttttggattcaaaaactacccaaggtgctatgcttacatttgaaaagatttcattggacagcatatttaagaaataaagttgatacatacgtagaatttccactgagaggcctagacatgaaatgctacttactagagcctgagaacagtggcccggagagctgcctgtatgacctcgccgctgtggtggtgcaccatggttccggggttggttctggacattacacagcatacgcaactcacgaaggccgctggttccacttcaatgacagtactgtaacactgactgacgaggagactgtggtgaaggcgaaggcctacatccttttctacgtggaacaccaggccaaagctggatcggataaactttaatacctcctccaaatcatcattcaccaaccataccagagaaacatttccagttttccacaaatacttgatacaagatttaatttcattatgcacttttcaatttcctattttggatttagttttgtcaatggtagtgacttactgaacatgggcaccaactaattttgttgttgttctaccagaaaacctcagcagatgttttgatttgctgctttagttgtaataattcaatttttataggtagttgtaagaacttagtcttatttgacttttttattttatgttaatgttttcagttctcactttgaggcacatttacatcaatgcttttgttcctctcacatgctgaaagcaagatgtgttccttattgtgaagagcgacacaactgcctgctg

SEQ ID NO: 33544 - DNA, 5499 bp, Homo sapiens
gtggccatggagtgtccacacctgagctccagcgtctgcattgctccggactcagccaagttccccaacggctccccgtcgtcctggtgctgcagcgtgtgccggtccaacaaaagcccttgggtctgtttgacttgttcaagtgtccactgtggaaggatttggggaacctgaaaatactttgtacagataacttttttttaaaaaagaagaaaagtagaagcacttaaattctgcagttgaagagacagattcctctcctagattttgagaggtatgtgaatggccatgcaaaaaaacattatgaagatgcacaagtacctttaaccaaccataagaaatcagaaaagcaagataaagttcagcacacagtatgtatggattgcagtagctacagtacatactgttatcgctgtgatgattttgtggttaatgacaccaagctgggactggtacagaaagtcagagaacacttacagaacttggaaaactcagctttcacagctgacaggcataagaaaagaaaacttttggaaaactcaacactaaacagcaagttattaaaagtaaatggaagcaccactgccatttgtgccacaggccttcggaatttggggaacacatgtttcatgaatgccatccttcagtcactcagtaacattgagcagttttgctgttatttcaaagaactgcccgccgtggagttaaggaatgggaaaacagcaggaaggcggacataccacaccaggagccaaggggataacaatgtgtctttggtagaagagtttagaaagacactctgtgctttatggcaaggcagccagactgcatttagcccagagtccttattttatgttgtttggaagattatgccaaactttaggggctatcaacagcaggacgcccatgaattcatgcgctaccttttggaccacctacacttggaacttcagggcggtttcaacggtgtttcccgctcagcaattctgcaggagaattctactctgtctgcaagtaacaagtgttgcataaatggagcatctactgttgtcacggctatattcggaggcattctccaaaatgaggttaactgcctcatatgtgggacagaatctagaaagtttgatccattcctagacctttcattagatattccaagtcagttcagaagtaagcgctctaagaatcaagaaaatggaccagtttgttcgttacgagattgtcttcgcagttttaccgacttagaagaacttgatgagacagagttatatatgtgccataaatgcaaaaagaaacaaaagtccacaaaaaagttttggattcaaaaactacccaaggtgctatgcttacatttgaaaagatttcattggacagcatatttaagaaataaagttgatacatacgtagaatttccactgagaggcctagacatgaaatgctacttactagagcctgagaacagtggcccggagagctgcctgtatgacctcgccgctgtggtggtgcaccatggttccggggttggttctggacattacacagcatacgcaactcacgaaggccgctggttccacttcaatgacagtactgtaacactgactgacgaggagactgtggtgaaggcgaaggcctacatccttttctacgtggaacaccaggccaaagctggatcggataaactttaatacctcctccaaatcatcattcaccaaccataccagagaaacatttccagttttccacaaatacttgatacaagatttaatttcattatgcacttttcaatttcctattttggatttagttttgtcaatggtagtgacttactgaacatgggcaccaactaattttgttgttgttctaccagaaaacctcagcagatgttttgatttgctgctttagttgtaataattcaatttttataggtagttgtaagaacttagtcttatttgacttttttattttatgttaatgttttcagttctcactttgaggcacatttacatcaatgcttttgttcctctcacatgctgaaagcaagatgtgttccttattgtgaagagcgacacaactgcctgctgcctttccacagctataatggacatcaggttgactctaaatcaaggatcatgtgtgcacaatacttgtggcccacaaaatttcacaatgactgctgaggaatcattctttttgcctgtaaaatataacaaagggcatcattaagtagaccaggtaattactgcttgtctctcaaggctgctgtctttatcagcactaactaaataaatttgttggttcagttgtacttgtcctgcaaatacaagaattactctctttgttggtttttttggttttggggcatacttgtttgcggggaggtaagatgggagtaaagaccaaatacatgtaatgtttaaaaaaaatgctgtgactcactgacatggtataggtgttaccagtgaggtaaagccatggcgtctgcctccttttgaatcagtatctcattcccccttagttgtaccactggaagtcacgacatgtccattatagacttacttactgcttgtgtttggcatctgagtctgaggtgtgaccctctgggatttacttggatcatcacccgcacttcagtttatcactggggggtgtgcttccacaggaggaaatttagaatcttcgctgctctgggttttaacacctctctctggcctatcctgattgataggacaagttgaaaatactgttggagtaagtaagtggagttttcgttttgttttttgggggtttttggagacaagagtctctctctgttgcccaggctggagtgcagtggcacgatctcagctcattgcaacctcggcctcccgagtagcaattctcctgcctcaacctcctgagtagctgggattacaggtgcccaccactacacctggctaattttttttttgtatttttagtaaagacgggggtttaccatgttggctagggtggtctcaacctccctcctgacctcaggtgatccgcctgcctcagcctcccaaagtgctgagattacaggcgtgagccatcacgcccagacagttttgtttttaaaaaacagatttaactcaaagattcaaatttggaaccagaatcccatttaaagaaagcagttgtggtttctacaagtgttctaagacagtcctgtggtggttttttttttttcttttttttggttgggggcggtgggggttggtagacatagcctaccaattctccacaagggacaaaatgtatcttgtgttaagccaacgagactttctggcaattttttttttttttttttaatggagtcttactctgtccctcaggctggagtgcagtgtggcatgatcacagctcactgtagcctcaacctcccaggctcaagcgatcctcccacttcagcctcgaagtagctggcaccaccacacccagctaatttttaatatttttactagagatggggtttcaccacgttgcccaggctggtcttgcactcctgggctcaagtgatccacccaccttggcttcccaaggtgctagcattacaggcatgagccaccacgcccagcctgttctattaaaaacatcttgacctttttttttttttaagtttatgatataaaaacagtctggtggctttccctcaggttggatatctgaagttgtgggagcagatgtagctccatttccattttaatattaactggataaatcccacatcttcccagaacacatctgctaaacactttaacatgacaaggagcaaattacaattatgtgtaaacttatatcatccagtacaatggcccctagccacatgtgactgaaatttaaattagaaactcagtgccttcagtcacactagccacatttcaagtgctcagcacccacatacggcgtaggacaatgctggtctaaattttcactccaaagaataaaactttgccatcatgtttaggtcttacaactttgagtcctaaaagataatagggagatgtgtgcttaaattaatttacaatgctaaattatattaggttaaactgtatgaaaccctgctatttgatgagttctgatctacaaaaatgacagctccacctgatctgatgtatcacacattaacatcacatctaattcaacctgaaatgtgagtctcctttgatcttgcaaagtatctcctatgaatccgggctcttttgcttagaaggtagacagctgtaacctctaacattgatacttcgatcttcagtctctctgaatgggcagctgttaaacagtaaaggcctgggcagagttgatggtgaaaaaaagctgtatttttataccaaatggaacttcagcaacacgttggactactttgtcgggcagagtggtcttcagacaggtgatgctgttggcttaagagatgaacacgtcttctctctgaatttgtttttattggttggttttacttgaacagaaacgtttgaatggtgtgaagattctttagaaaagtgattggatccatctcaattgtgcacttgaacagcagtgatgtaaatgtgcttatttgtgttttcatttttaactgtgcagccttaccacacctattttgaaagctgatcttttgtcctcttcagggcttttcccttgtgccatgttgtctccagcaatatatgtggcttctggctcagagcttctgctgaggcagggcctcgcgctgagtcacatggctccttggaacaagaaaactttctcagaagtccccacacgggtgggtgacagaaacagtttgtggcaacacaaatctctctccatggtggagaaacctttgcttatccactgtattctactcagtgtatagtgatgacagatgtactagaattaaaccagtcaagtgtactggcccggggtgagtgttaaatgtgtatctcgcctgtggaacctactcagcagcttggtttctggggttgggggcatatttatttcttaaagccaaacctctccttcattggtttagtgtacataagtctatttagatacacttatcccactttaatctccaccagcccctaaactctctcctgtaccctctgttgctgaagtggcctcttcacctgggccctggaaaagccgatggaaaaagtctgttcctgcagccaaggcctgggtcccaggtgactaggagtagccataggaaggtgaggaaggagaagtgggcatgtggtgtcatctgtagtccaaggtctctgcgtctcgtcagtgggtgcagtgccttccccctcaggtgtgagcgtgatggactctagactgccttccatgagtgttggtcatgctatgatgtcatcatttgccattaaaacccagtttgtatgatgccaagaggattaattgtgcaagtgactgattcatttaaattgtaatcacatcccttttctgcttcaccaacctgaactgtttttaaaaatatcattaaaagtctgttctctttccttttga

SEQ ID NO: 33545 - DNA, 3742 bp, Homo sapiens
gttccgctgtctcgggaaccgtcgtatccctcggtccggcggcggcggcggcggtagcggaggagacggtttcaggcctccggtgcggctgcaatgctgagctcccgggccgaggcggcgatgaccgcggccgacagggccatccagcgcttcctgcggaccggggcggccgtcagatataaagtcatgaagaactggggagttataggtggaattgctgctgctcttgcagcaggaatatatgttatttggggtcccattacagaaagaaagaagcgtagaaaagggcttgtgcctggccttgttaatttagggaacacctgcttcatgaactccctgctacaaggcctgtctgcctgtcctgctttcatcaggtggctggaagagttcacctcccagtactccagggatcagaaggagcccccctcacaccagtatttatccttaacactcttgcaccttctgaaagccttgtcctgccaagaagttactgatgatgaggtcttagatgcaagctgcttgttggatgtcttaagaatgtacagatggcagatctcatcatttgaagaacaggatgctcacgaattattccatgtcattacctcgtcattggaagatgagcgagaccgccagcctcgggtcacacatttgtttgatgtgcattccctggagcagcagtcagaaataactcccaaacaaattacctgccgcacaagagggtcacctcaccctacatccaatcactggaagtctcaacatccttttcatggaagactcactagtaatatggtctgcaaacactgtgaacaccagagtcctgttcgatttgatacctttgatagcctttcactaagtattccagccgccacatggggtcacccattgaccctggaccactgccttcaccacttcatctcatcagaatcagtgcgggatgttgtgtgtgacaactgtacaaagattgaagccaagggaacgttgaacggggaaaaggtggaacaccagaggaccacttttgttaaacagttaaaactagggaagctccctcagtgtctctgcatccacctacagcggctgagctggtccagccacggcacgcctctgaagcggcatgagcacgtgcagttcaatgagttcctgatgatggacatttacaagtaccacctccttggacataaacctagtcaacacaaccctaaactgaacaagaacccagggcctacactggagctgcaggatgggccgggagcccccacaccagttctgaatcagccaggggcccccaaaacacagatttttatgaatggcgcctgctccccatctttattgccaacgctgtcagcgccgatgcccttccctctcccagttgttcccgactacagctcctccacatacctcttccggctgatggcagttgtcgtccaccatggagacatgcactctggacactttgtcacttaccgacggtccccaccttctgccaggaaccctctctcaactagcaatcagtggctgtgggtctccgatgacactgtccgcaaggccagcctgcaggaggtcctgtcctccagcgcctacctgctgttctacgagcgcgtcctttccaggatgcagcaccagagccaggagtgcaagtctgaagaatgactgtgccctcctgcaaggctagagctgatggcactgtctgcactgtccaggaaaaaagtaaaactgtactgttgcgtgtgcaagcggccccactagagccttccagccttctggtgtgttctaagagcaggctccacctgggagccagccccagttcacaccaaaccaggctccctgaacagtcctgttcatgtgtgtaggtggttctgttgtgttaagaaagcattcattatgtccggagtgtctttttactcatctgatacaggtaattaaaagaactcagattcttgaagccaccgttttcatattgtaatgttaggtgttctcagaggggaggtacctttgtctaatcaacgtttccacttagatcttttatttttaataagcaggcccataaaaattgttgacaagaattaatgaaattattaaaggcaacaatttagaagaaaaagtgcctttcactttcgattgcttttgtagcacgtccattgtgaaatattccttccaggctactcaaaggatagcaagagaacaggtaaatgatgcctaaagaacaccttcctttttctatgccttttctaatctttcaattctttctatggagtaaaggctcatctgccaaatctgccccctggggaaactctttcactactttgtcagttataagtgaagagcttacttgttgcttttatcttttgtatattggactgagatgtaattacactgtattataaaactctgtgaatagccagaactgagctggatctttgcaacacctgattcctctgctctgtggaaaactttttcttacacaaggatccactgtggacggttactttcatctgtttatttattgcccatgcagagctcttaaggtttacaggtgggagcttggggctgtataaaaaaataatccctgccctgagttgacacctggcttaggaaggaagggctgactatggggctgcagtctctctgaacctcagtttcctcatttgtgaagtgaagggttagatttgatgaccaccaaagttcagcccttttcacgaaaaggagaaagcagcttttgactttttaaaaaacatataactacagctggcatctagtattgtcatgttgctctaggtccatattctgaatttattcatttccaatagcctaatacaaaaagtatatattgagcactttcttcccttttcaggtaagtctctgaatgcagcccagggccaaaggaattttgatgacacagtagtacctatgttttaagctatatttttaatttagaaaaatggataccaaattcaaaccgactcatcagaggtaagatttggaatcagacctttccaaaaggtcatctgaggtaaggctaagaccgcacttcctctgctgggggtgagctggcagacacaccaaacagtgccttggcagcagctcacagtgcaggaagcccaggtgatcactcttctgctgggcccaggctgcaccctgaggactcagtaactcactctcaacagaatattctgtgcaggctctccaggctctgggcgtcagggtgcaaggggcagcttgaactgtacggtccgtcctgcactcacccgatgcagaccttgactttgatgttgaaatgaacacacttgttttacccaagtctggtggaacaaatgcccaatcatgtgaccttaaagtgtactgcaaagctgtagctttaagtaattgctgttctgccactgcttactctgaaatctaccatcaaagaaagatagagaaaaggggctgagccttggaatatatggttataagcagatctttctttggtcagagaccagggtttgagccaaggctgtaaatgtgaacaatagctgtgcaaagccttttaacctgacttcttcattttgtaaattattatgcattaagtagcagcccaataatctgatttctagttttattttcaaagtaagtagcttcttttgggaaaaacctaagttaaactagtagttttgccataataactgctgatttatgtatttgctaaaggtacttttgtatctgctgtgtattatagcaataaaataatcattttgttagaaaaaaatca

SEQ ID NO: 33546 - DNA, 7026 bp, Homo sapiens
aagagggcgtgaggagggaaggagagggaggagagagaggagagagaagggcggagtaggaggcaggggaagggggcggggcggaagagtcacgtgatccggcatggaggcggtggcggcgaccgggaggagccgccggggcagaagccgcacttgttagtgtggggggaggtgggggcgggggacgccgacaccgtcaccgtcacccagggacgccgaggagaaggcgggaggggggtgggggcgagatcaggctccgaccccccgccgaggggatgaggggagcatgggtgccaaggagtcacggatcggattcctcagctacgaggaggcgctgaggagagttacagatgtagagctaaaacgactgaaggatgctttcaagaggacctgtggactctcatattacatgggccagcactgcttcatccgggaagtgcttggggatggagtgcctccaaaggttgctgaggtgatttactgttcttttggtggaacatccaaagggctgcacttcaataatttaatagttggacttgtcctccttacaagaggcaaagatgaagagaaagcaaaatacatttttagtcttttttcaagtgaatctgggaactatgttatacgggaagaaatggaaagaatgctccacgtggtggatggtaaagtcccagatacactcaggaagtgtttctcagagggtgaaaaggtaaactatgaaaagtttagaaattggctttttctaaacaaagatgcttttactttctctcgatggcttctatctggaggtgtgtatgttaccctcactgatgatagtgatactcctactttctaccaaactctggctggagtcacacatttggaggaatcagacatcattgatcttgagaaacgctattggttattgaaggctcaatcccggactggacgatttgatttagagacatttggcccattggtttcaccacctattcgtccatctctaagtgaaggtttgtttaatgcttttgatgaaaatcgtgacaatcacatagattttaaggagatatcctgtgggttatcagcctgttgcaggggacccctggctgaaagacaaaaattttgcttcaaggtatttgatgttgaccgtgatggagttctctccagggttgaactgagagacatggtggttgcacttttagaagtctggaaggacaaccgcactgatgatattcctgaattacatatggatctctctgatattgtagaaggcatactgaatgcacatgacaccacaaagatgggtcatcttactctggaagactatcagatctggagtgtgaaaaatgttcttgccaatgagtttttgaacctccttttccaggtgtgtcacatagttctggggttaagaccagctactccggaagaagaaggacaaattattagaggatggttagaacgagagagcaggtatggtctgcaagcaggacacaactggtttatcatctccatgcagtggtggcaacagtggaaagaatatgtcaaatacgatgccaaccctgtggtaattgagccatcatctgttttgaatggaggaaaatactcatttggaactgcagcccatcctatggagcaggtcgaagatagaattggaagcagcctcagttacgtgaatactacagaagagaaattttcagacaacatttctactgcatctgaagcctcagaaactgctggcagcggctttctgtattctgccacaccaggggcagatgtttgctttgctcgacaacataacacttctgacaataacaaccagtgtttgctgggagccaatgggaatattttgttgcaccttaaccctcagaaaccaggggctattgataatcagccattagtaactcaagaaccagtaaaggctacatcattaacactagaaggaggacgattaaaacgaactccacagctgattcatggaagagactatgaaatggtcccagaacctgtgtggagagcactttatcactggtatggagcaaacctggccttacctagaccagttatcaagaacagcaagacagacatcccagagctggaattatttccccgctatcttctcttcctgagacagcagcctgccactcggacacagcagtctaacatctgggtgaatatgggaaatgtaccttctccgaatgcacctttaaagcgggtattagcctatacaggctgttttagtcgaatgcagaccatcaaggaaattcacgaatatctatctcaaaggctgcgcattaaagaggaagatatgcgcctgtggctatacaacagtgagaactaccttactcttctggatgatgaggatcataaattggaatatttgaaaatccaggatgaacaacacctggtaattgaagttcgcaacaaagatatgagttggcctgaggagatgtcttttatagcaaatagtagtaaaatagatagacacaaggttcccacagaaaagggagccacaggtctaagcaatctgggaaacacatgcttcatgaactcaagcatccagtgtgttagtaacacacagccactgacacagtattttatctcagggagacatctttatgaactcaacaggacaaatcccattggtatgaaggggcatatggctaaatgctatggtgatttagtgcaggaactttggagtggaactcagaagaatgttgccccattaaagcttcggtggaccatagcaaaatatgctcccaggtttaatgggtttcagcaacaggactcccaagaacttctggcttttctcttggatggtcttcatgaagatcttaatcgagtccatgaaaagccatatgtggaactgaaggacagtgatgggcgaccagactgggaagtagctgcagaggcctgggacaaccatctaagaagaaatagatcaattgttgtggatttgttccatgggcagctaagatctcaagtaaaatgcaagacatgtgggcatataagtgtccgatttgaccctttcaattttttgtctttgccactaccaatggacagttatatgcacttagaaataacagtgattaagttagatggtactacccctgtacggtatggactaagactgaatatggatgaaaagtacacaggtttaaaaaaacagctgagtgatctctgtggacttaattcagaacaaatccttctagcagaagtacatggttccaacataaagaactttcctcaggacaaccaaaaagtacgactctcagtgagtggatttttgtgtgcatttgaaattcctgtccctgtgtctccaatttcagcttctagtccaacacagacagatttctcctcttcgccatctacaaatgaaatgttcaccctaactaccaatggggacctaccccgaccaatattcatccccaatggaatgccaaacactgttgtgccatgtggaactgagaagaacttcacaaatggaatggttaatggtcacatgccatctcttcctgacagcccctttacaggttacatcattgcagtccaccgaaaaatgatgaggacagaactgtatttcctgtcatctcagaagaatcgccccagcctctttggaatgccattgattgttccatgtactgtgcatacccggaagaaagacctatatgatgcggtttggattcaagtatcccggttagcgagcccactcccacctcaggaagctagtaatcatgcccaggattgtgacgacagtatgggctatcaatatccattcactctacgagttgtgcagaaagatgggaactcctgtgcttggtgcccatggtatagattttgcagaggctgtaaaattgattgtggggaagacagagctttcattggaaatgcctatatcgctgtggattgggatcccacagcccttcaccttcgctatcaaacatcccaggaaagggttgtagatgagcatgagagtgtggagcagagtcggcgagcgcaagccgagcccatcaacctggacagctgtctccgtgctttcaccagtgaggaagagctaggggaaaatgagatgtactactgttccaagtgtaagacccactgcttagcaacaaagaagctggatctctggaggcttccacccatcctgattattcaccttaagcgatttcaatttgtaaatggtcggtggataaaatcacagaaaattgtcaaatttcctcgggaaagttttgatccaagtgcttttttggtaccaagagacccggctctctgccagcataaaccactcacaccccagggggatgagctctctgagcccaggattctggcaagggaggtgaagaaagtggatgcgcagagttcggctggggaagaggacgtgctcctgagcaaaagcccatcctcactcagcgctaacatcatcagcagcccgaaaggttctccttcttcatcaagaaaaagtggaaccagctgtccctccagcaaaaacagcagccctaatagcagcccacggactttggggaggagcaaagggaggctccggctgccccagattggcagcaaaaataaactgtcaagtagtaaagagaacttggatgccagcaaagaaaatggggctgggcagatatgtgagctggctgacgccttgagtcgagggcatgtgctggggggcagccaaccagagttggtcactcctcaggaccatgaggtagctttggccaatggattcctttatgagcatgaagcatgtggcaatggctacagcaatggtcagcttggaaaccacagtgaagaagacagcactgatgaccaaagagaagatactcgtattaagcctatttataatctatatgcaatttcgtgccattcaggaattctgggtgggggccattacgtcacttatgccaaaaacccaaactgcaagtggtactgttacaatgacagcagctgtaaggaacttcacccggatgaaattgacaccgactctgcctacattcttttctatgagcagcaggggatagactatgcacaatttctgccaaagactgatggcaaaaagatggcagacacaagcagtatggatgaagactttgagtctgattacaaaaagtactgtgtgttacagtaaagctaccactctggctgctagacagcttggcggtgagggagatgactccttgtagctgacatttggcaaaagcgtcactgaaaggcaagctaaatgtagttattttatcctgtggccctgaagcacaaaataaaaattctaattaaaatagttaactttaagagtagtaatcattttattttgaagtctcatacaagctctccgatagagaactttcaggcagatcccaccattagcctgtaaacaaaaggtttggcaccagccacctgggaccaaataagaattcaattgtgcttgtccagatatgaacaaatatgtagtgagtatagagtttaccataatcataacaaatattaaagatttccttggagtcagagtaaaaaacaaacaattataatgttgtctagggacgacatgatatgctacctcctttttcctgaagttttattccattatattgacaagatggagaaagcaagatcacgaaggtgtgcaaatgattcttaaggcatggacgaggatttttcaatttattttttaaactgtttccataccctttctttgtctttcttgctttttgtttttgccgttgtatttatgtttgagacacaaccagtcattggtggcaggggcatatagtggtcagtctgaaagggaggctctcttaagagctgtgtgccttccacccagagccttgtgggagacccagtagaaagaaacagcatcctgggaaatccagctaccatggccctcccagtggaggcatcttacatttaggatacttcaagtatcctcagaaatgtattctgcacccccggccccacccatgctgagggaaggggagcagttgccaatatttgcaccatcttcacatgcacctgttgcaacaagagcttctgggaaggtaagtggcattggagctagatcacgtttcacaattagtggttgttcttttctgtgtttgtcttgcactttaaaaaagagagaacacatgcaaatgaacttgcttgtgtgtatttgatggctctaagggctataaattacaaacaaaacacatcccagacattaggagttcataagtgtatttaatgaaattggtggttttaggaagtcaactttagttttgctttgtttgcatgtccactaatttttttattttgatatttgtcttttttttaaattttacagtagtcatcgaaagttatgtttctttgcttacttcatttttttctctaatcaagactggaacaaaagtataaatattatttatttcaggtagcatttttttcgtgtagttttttaatatatacttgaaggaaatgtttcaccttatttttggtctttgtttattcatttagaccctgcaagttgattctcattaattgtcagattccactaccctttcttcctcatagatagtaattaccaatgtaactaagtatttgtgttctgatatctgaggccagtaactattaatatctagttctcagagcatttggaaaggttatcttaaatggctacctaaattgaaatccttttcagaaaaaatataattgcaagtaggtaggactggcctaaattgtctaatgtaataaagtcagacaaaatgcatactttatagtttcaagattttcagtatataaaatctgtccattcccattaaaaagtggaagattttaaataatttctttacagatgttttatttaagcaggtagctcaatctactaatgttgtttgatctgtgtttgttatactggttgtaattaatttttttaattcatgaactagcagaaaatttattaaattaactattaactacattcaccttgtaaattactgtataaaacttgttgacaatgcactgactttagaaagatgttaatgtacataaatagagtgtaaataaaatagtgttgatgtaccg

SEQ ID NO: 33547 - DNA, 1843 bp, Homo sapiens
caggctccgaccccccgccgaggggatgaggggagcatgggtgccaaggagtcacggatcggattcctcagctacgaggaggcgctgaggagagttacagatgtagagctaaaacgactgaaggatgctttcaagaggacctgtggactctcatattacatgggccagcactgcttcatccgggaagtgcttggggatggagtgcctccaaaggttgctgaggtgatttactgttcttttggtggaacatccaaagggctgcacttcaataatttaatagttggacttgtcctccttacaagaggcaaagatgaagagaaagcaaaatacatttttagtcttttttcaagtgaatctgggaactatgttatacgggaagaaatggaaagaatgctccacgtggtggatggtaaagtcccagatacactcaggaagtgtttctcagagggtgaaaaggtaaactatgaaaagtttagaaattggctttttctaaacaaagatgcttttactttctctcgatggcttctatctggaggtgtgtatgttaccctcactgatgatagtgatactcctactttctaccaaactctggctggagtcacacatttggaggaatcagacatcattgatcttgagaaacgctattggttattgaaggctcaatcccggactggacgatttgatttagagacatttggcccattggtttcaccacctattcgtccatctctaagtgaaggtttgtttaatgcttttgatgaaaatcgtgacaatcacatagattttaaggagatatcctgtgggttatcagcctgttgcaggggacccctggctgaaagacaaaaattttgcttcaaggtatttgatgttgaccgtgatggagttctctccagggttgaactgagagacatggtggttgcacttttagaagtctggaaggacaaccgcactgatgatattcctgaattacatatggatctctctgatattgtagaaggcatactgaatgcacatgacaccacaaagatgggtcatcttactctggaagactatcagatctggagtgtgaaaaatgttcttgccaatgagtttttgaacctccttttccaggtgtgtcacatagttctggggttaagaccagctactccggaagaagaaggacaaattattaggactctggaaactgaccaaatatatacaagaaattgagaagcatttattcaagaactactaatccttggtgagaacaatggaagtgtgtggtaatttaaccaggagcagctttcatttcctcccatccagcaagtctgcatgggctgtcagtctgattcatgatttgaaggagagcaggaataaatgcctgtccaaggataataaaataaatacataccatcatggtggtaaacagtgagggaaaactgacatcaccagcttggggataaaatactggttaggggaagcagcagactaacaacagaccagtcaaatttttaacagggaacaggatcaccatagtgagccttagcaagctttctcatgtccccagtgatctgtagactgcttgtacaaggctatacacaaactcaggagaaaccaaagtgggctttagcactttattcttccctagttgaaggtgaagccttgcatgtgcagaaagtaaaagccagggtaggcttgtaacctgcccaaactttaaatgcattccccaaaccatgtacagatccatcaggaaaagggtgtgaatgttactggctaaacacaaccagtaaactgctgagagcacaacctctcagcagtcattggctgaccagtaagttaggctcaccccaagaaggccaagctt

SEQ ID NO: 33548 - DNA, 5234 bp, Homo sapiens
agcgcagcgcgaacgctgggtgcggcgcctttaagcgtcgcggtgacacgtgtgtgaggcgccggaggcccggatggtgcgcgtgctgggccgcgggccgaaggagtcgccagggctgcgtaggcttgtggcgcgcccgcggagaggccggggctctgacgcccgctctgcggcttcggtgtttgaacaggccacagtccaggagcgcttacattcaggagctccgcgtagcacctgcccaaccaaactcagccctccgttaagatcctggttccatgccgcagtaggacagcaggcccaagtctgcacatcccagtgatgcaccatgccaatagtggataagttgaaggaggccctgaaacccggccgcaaggactcggctgatgatggagaactggggaagcttcttgcctcctctgccaagaaggtccttttacagaaaatcgagttcgagccagccagcaagagcttctcctaccagctggaggccttaaagagcaaatatgtgttgctcaaccccaaaacagagggagctagtcgccacaagagtggagatgacccaccggccaggagacagggcagtgagcacacgtatgagagctgtggtgacggagtcccagccccgcagaaagtgcttttccccacggagcgactgtctctgaggtgggagcgggtcttccgcgtgggcgcaggactccacaaccttggcaacacctgctttctcaatgccaccatccagtgcttgacctacacaccacctctagccaactacctgctctccaaggagcatgctcgcagctgccaccagggaagcttctgcatgctgtgtgtcatgcagaaccacattgtccaggccttcgccaacagcggcaacgccatcaagcccgtctccttcatccgagacctgaaaaagatcgcccgacacttccgctttgggaaccaggaggacgcgcatgagttcctgcggtacaccatcgacgccatgcagaaagcctgcctgaatggctgtgccaagttggatcgtcaaacgcaggctactaccttggtccatcaaatttttggagggtatctcagatcacgcgtgaagtgctccgtgtgcaagagcgtctcggacacctacgacccctacttggacgtcgcgctggagatccggcaagctgcgaatattgtgcgtgctctggaactttttgtgaaagcagatgtcctgagtggagagaatgcctacatgtgtgctaaatgcaagaagaaggttccagccagcaagcgcttcaccatccacagaacatccaacgtcttaaccctttccctcaagcgctttgccaacttcagcggggggaagatcaccaaggatgtaggctatccggaattcctcaacatacgtccgtatatgtcccagaataatggtgatcctgtcatgtatggactctatgctgtcctggtgcactcgggctacagctgccatgccgggcactattactgctacgtgaaggcaagcaatggacagtggtaccagatgaatgattccttggtccattccagcaacgtcaaggtggttctgaaccagcaggcctacgtgctgttctatctgcgaattccaggctctaagaaaagtcccgagggcctcatctccaggacaggctcctcctcccttcccggccgcccgagtgtgattccagatcactccaagaagaacatcggcaatgggattatttcctccccactgactggaaagcgacaagactctgggacgatgaagaagccgcacaccactgaagagattggtgtgcccatatccaggaatggctccaccctgggcctgaagtcccagaacggctgcattcctccaaagctgccctcggggtccccttcccccaaactctcccagacacccacacacatgccaaccatcctagacgaccctggaaagaaggtgaagaagccagctcctccacagcacttttcccccagaactgctcaggggctgcctgggaccagcaactcgaatagcagcagatctgggagccaaaggcagggctcctgggacagcagggatgttgtcctctctacctcacctaagctcctggctacagccactgccaacgggcatgggctgaaggggaacgacgagagcgctggcctcgacaggaggggctccagcagctccagcccagagcactcggccagcagcgactccaccaaggccccccagacccccaggagtggagcggcccatctctgcgattctcaggaaacgaactgttccaccgctggccactccaaaacgccgccaagtggagcagattctaagacggtgaagctgaagtcccctgtcctgagcaacaccaccactgagcctgcaagcaccatgtctcctccaccagccaaaaaactggccctttctgccaagaaggccagcaccctgtggagggcgaccggcaatgacctccgtccacctcccccctcaccatcctccgacctcacccaccccatgaaaacctctcaccccgtcgttgcctccacttggcccgtccatagagccagggctgtgtcacctgctccccaatcatccagccgcctgcaaccccccttcagcccccaccccacattgctgtccagtacccccaagcccccagggacgtcagaaccacggagctgctcctccatctcgacggcgctgcctcaggtcaacgaggaccttgtgtctcttccacaccagttgccagaggccagtgagcccccccagagcccctctgagaagaggaaaaagacctttgtgggagagccgcagaggctgggctcagagacgcgcctcccacagcacatcagggaggccactgcggctccccacgggaagaggaagaggaagaagaagaagcgcccggaggacacagctgccagcgccctgcaggaggggcagacacagagacagcctgggagccccatgtacaggagggagggccaggcacagctgcccgctgtcagacggcaggaagatggcacacagccacaggtgaatggccagcaggtgggatgtgttacggacggccaccacgcgagcagcaggaagcggaggaggaaaggagcagaaggtcttggtgaagaaggcggcctgcaccaggacccacttcggcacagctgctctcccatgggtgatggtgatccagaggccatggaagagtctccaaggaaaaagaaaaagaaaaaaagaaagcaggagacacagcgggcagtagaagaggatgggcatctcaaatgcccaaggagtgccaagccccaagatgctgttgtccccgagtccagcagctgcgcaccatccgcgaatggctggtgtcctggggaccgcatggggctgagccaggcccctcctgtgtcttggaatggagagcgggagtctgatgtggtccaggaactgctcaaatactcatctgataaagcttacgggagaaaagttctgacctgggatggcaagatgtcggcggtcagtcaggatgctattgaagacagcagacaggcccggactgagaccgtggttgatgactgggacgaagagtttgaccgagggaaggaaaagaaaattaaaaaatttaagagagagaagaggagaaacttcaacgccttccagaaacttcagactcgacggaacttctggtctgtgactcacccagcaaaggctgccagcctcagctatcgccgctgactgtgcccctgtggaaggaggtcggttccgagggggtgggtgtaagggtgaggtgggggtgtgtgtgccgtgtatgtgtgtaggggtgtggtggggtgtggcgtgtgtgtatgatgtatgtgggctgtgtatctggcacatgtgtgttgggtggtgtgtgtggtgtgggcgcgtctgtggtgtgtgtcctagtcacttggagaagggtgtgtgtgggatgcgtgtgtataagggggtgtgtgtgggatgcgtgtgtataagggggtgtgtgtagtgtgtgttgggtgtggggtgtgtacacctggcatctgtggcatgtgttctggtcacttggagaagggcatgtgtggggtgtgtgtgggatgtgggttgtgtgtatatctggcatgtgtcccagtcacttgcagaagggtgacttcttgccagccgcatcgagatgccatgcattgggttcctaggttggactcatacccgagggtggcagtgggaagattcgggtctcgtttctctctgtcaggactaccgtggtttgttctgcagcctcctggagacaaggcgtcccttcccgggagctgtcggtctggatctgagggagctctctgtgtgggctctgctgcgctgggagcctgtcacggtaggagctctcccggtaccagtgtccacagaccgcccaacacagaggctttgaggcttctctagatcggaacctctttggtgacattcccgaccagccctgcaagagaaacgacagtgtgtgtgtgagcagaggtggccgcacacctgctggacatctttgccaggctgtgccttctcatgtttcatagacagtggtctgtgctggcagaggctgctgcccctggttggggctatcaggagagtgggggatggtggccacatgtcccccaggtggtctcccggtgcatagctggtggctctgggcaagccatcccttgcttctcggggctgacgccaccgttgtgtccgagcccgccctcccctgcttcctcagcgggaccccttcatctgttggccttacctgtcctcagaaaggaagaggtgaccccacccagccacctctcccttttatggaactcgagagggtggccctactgtgcaccccttccttgtgagtagctctcaactgtcctggagagcagaggctatttggggtcggaggagccctcgatacctgcgaatacatctgctttccaggctgctgtttattctgagacgactgtgctgtagcttcccttgcagctgcaataacccgcaggtcttcactgaggtggaggctttggggtagaattctccatttattttactacttaatacaaaacatttatttttgaccagtcctgtggcttccattagcaatatgtttcctttcccaaatatgcaaatagtggctttgtttgctcaattttgtgagtgctttggaatttaaatgattgtataactcaagaagattacttttctatgttgctcaagctgtgcctgccaacttgtaacttaataaatacaggaaatcctcagagaa

SEQ ID NO: 33549 - DNA, 1647 bp, Homo sapiens
atgccaatagtggataagttgaaggaggccctgaaacccggccgcaaggactcggctgatgatggagaactggggaagcttcttgcctcctctgccaagaaggtccttttacagaaaatcgagttcgagccagccagcaagagcttctcctaccagctggaggccttaaagagcaaatatgtgttgctcaaccccaaaacagagggagctagtcgccacaagagtggagatgacccaccggccaggagacagggcagtgagcacacgtatgagagctgtggtgacggagtcccagccccgcagaaagtgcttttccccacggagcgactgtctctgaggtgggagcgggtcttccgcgtgggcgcaggactccacaaccttggcaacacctgctttctcaatgccaccatccagtgcttgacctacacaccacctctagccaactacctgctctccaaggagcatgctcgcagctgccaccagggaagcttctgcatgctgtgtgtcatgcagaaccacattgtccaggccttcgccaacagcggcaacgccatcaagcccgtctccttcatccgagacctgaaaaagatcgcccgacacttccgctttgggaaccaggaggacgcgcatgagttcctgcggtacaccatcgacgccatgcagaaagcctgcctgaatggctgtgccaagttggatcgtcaaacgcaggctactaccttggtccatcaaatttttggagggtatctcagatcacgcgtgaagtgctccgtgtgcaagagcgtctcggacacctacgacccctacttggacgtcgcgctggagatccggcaagctgcgaatattgtgcgtgctctggaactttttgtgaaagcagatgtcctgagtggagagaatgcctacatgtgtgctaaatgcaagaagaaggttccagccagcaagcgcttcaccatccacagaacatccaacgtcttaaccctttccctcaagcgctttgccaacttcagcggggggaagatcaccaaggatgtaggctatccggaattcctcaacatacgtccgtatatgtcccagaataatggtgatcctgtcatgtatggactctatgctgtcctggtgcactcgggctacagctgccatgccgggcactattactgctacgtgaaggcaagcaatggacagtggtaccagatgaatgattccttggtccattccagcaacgtcaaggtggttctgaaccagcaggcctacgtgctgttctatctgcgaattccaggctctaagaaaagtcccgagggcctcatctccaggacaggctcctcctcccttcccggccgcccgagtgtgattccagatcactccaagaagaacatcggcaatgggattatttcctccccactgactggaaagcgacaagactctgggacgatgaagaagccgcacaccactgaagagattggtgtgcccatatccaggaatggctccaccctgggcctgaagtcccagaacggctgcattcctccaaagctgccctcggggtccccttcccccaaactctcccagacacccacacacatgccaaccatcctagacgaccctggaaagaaggtgaagaagccagctcctccactgccaacgggcatgggctga

SEQ ID NO: 33550 - DNA, 4656 bp, Homo sapiens
gtcacttttgaagaatggtgggacagtagatggtggcagttgatttttcattttctaactttgcagaataaaaattgaatgatcctgtattggtcccccaagtatttcagagctcccggagtctgggaagtgccatggtaaatagtcacacaggccagatgagagactgaggtgtgcatgttctgtgggaggggaagtgtagcctgcgggtgtggaatggtctgggtggccgtgggaaacgtggagagagccctggaaacagccccgctttgtgccagtgaggagtcggggaagcagctggggagacggggctggagagcctggggagaggggaagctcttctggagggagtgggtgcaccggcgcactgcgcagcctcctagtaaagggcctgcagacccagctggcctcatgcctggaggccttaggcgactctgaggaaggcagttccagagcagtgagtcaggaccagatgcagtgggttgcaagtagaaccaggagcagagactggatgtggtgtattgtttcagaaccttccagcgtgagtagctaccatatggatacgtaggcgtgggaggcgccaggcagccccgggtccgggtgagaagaggccccagagctcagagtgcctcagatcccagttagtgagcggtgcgggggacatgaatgagggcagggctcctgaccccgaagcccacgtctgactccgctgtcctctctgagacgggtgcagagccggggagatttggtcctgtttgtgcctttgttcccacccccacccctcttcccagattggggaccagctgtctgtgaccagcagagaagtggaagggtgggctgggtgggcgccctagctcagggggatgtttggcctcccgcctcactctagatttgggtacttactttttattgagaccaaaaagaaaaggcaacactgggtgaggatacacgtacatttctcggggcttttattttctgtgaagtgggtggcagtgggcattgtgaaggtttgaaatggctactgtgggtagtggggccctgaggaggtcagagctctgcagagagactgccaggcagcgtgggctgaggatggaggttaagggtctgtggtgactcgggtggggggtggagtttcccagcctcacgctgagcttgtgactggtgggcatggggctgctgggatggggccatccctcgtgtcatcttgctgagcccttcccttaaaggctggggtctccttttcaggttggatcgtcaaacgcaggctactaccttggtccatcaaatttttggagggtatctcagatcacgcgtgaagtgctccgtgtgcaagagcgtctcggacacctacgacccctacttggacgtcgcgctggagatccggcaagctgcgaatattgtgcgtgctctggaactttttgtgaaagcagatgtcctgagtggagagaatgcctacatgtgtgctaaatgcaagaagaaggttccagccagcaagcgcttcaccatccacagaacatccaacgtcttaaccctttccctcaagcgctttgccaacttcagcggggggaagatcaccaaggatgtaggctatccggaattcctcaacatacgtccgtatatgtcccagaataatggtgatcctgtcatgtatggactctatgctgtcctggtgcactcgggctacagctgccatgccgggcactattactgctacgtgaaggcaagcaatggacagtggtaccagatgaatgattccttggtccattccagcaacgtcaaggtggttctgaaccagcaggcctacgtgctgttctatctgcgaattccaggctctaagaaaagtcccgagggcctcatctccaggacaggctcctcctcccttcccggccgcccgagtgtgattccagatcactccaagaagaacatcggcaatgggattatttcctccccactgactggaaagcgacaagactctgggacgatgaagaagccgcacaccactgaagagattggtgtgcccatatccaggaatggctccaccctgggcctgaagtcccagaacggctgcattcctccaaagctgccctcggggtccccttcccccaaactctcccagacacccacacacatgccaaccatcctagacgaccctggaaagaaggtgaagaagccagctcctccacagcacttttcccccagaactgctcaggggctgcctgggaccagcaactcgaatagcagcagatctgggagccaaaggcagggctcctgggacagcagggatgttgtcctctctacctcacctaagctcctggctacagccactgccaacgggcatgggctgaaggggaacgacgagagcgctggcctcgacaggaggggctccagcagctccagcccagagcactcggccagcagcgactccaccaaggccccccagacccccaggagtggagcggcccatctctgcgattctcaggaaacgaactgttccaccgctggccactccaaaacgccgccaagtggagcagattctaagacggtgaagctgaagtcccctgtcctgagcaacaccaccactgagcctgcaagcaccatgtctcctccaccagccaaaaaactggccctttctgccaagaaggccagcaccctgtggagggcgaccggcaatgacctccgtccacctcccccctcaccatcctccgacctcacccaccccatgaaaacctctcaccccgtcgttgcctccacttggcccgtccatagagccagggctgtgtcacctgctccccaatcatccagccgcctgcaaccccccttcagcccccaccccacagctgccagcgccctgcaggaggggcagacacagagacagcctgggagccccatgtacaggagggagggccaggcacagctgcccgctgtcagacggcaggaagatggcacacagccacaggtgaatggccagcaggtgggatgtgttacggacggccaccacgcgagcagcaggaagcggaggaggaaaggagcagaaggtcttggtgaagaaggcggcctgcaccaggacccacttcggcacagctgctctcccatgggtgatggtgatccagaggccatggaagagtctccaaggaaaaagaaaaagaaaaaaagaaagcaggagacacagcgggcagtagaagaggatgggcatctcaaatgcccaaggagtgccaagccccaagatgctgttgtccccgagtccagcagctgcgcaccatccgcgaatggctggtgtcctggggaccgcatggggctgagccaggcccctcctgtgtcttggaatggagagcgggagtctgatgtggtccaggaactgctcaaatactcatctgataaagcttacgggagaaaagttctgacctgggatggcaagatgtcggcggtcagtcaggatgctattgaagacagcagacaggcccggactgagaccgtggttgatgactgggacgaagagtttgaccgagggaaggaaaagaaaattaaaaaatttaagagagagaagaggagaaacttcaacgccttccagaaacttcagactcgacggaacttctggtctgtgactcacccagcaaaggctgccagcctcagctatcgccgctgactgtgcccctgtggaaggagcctcctggagacaaggcgtcccttcccgggagctgtcggtctggatctgagggagctctctgtgtgggctctgctgcgctgggagcctgtcacggtaggagctctcccggtaccagtgtccacagaccgcccaacacagaggctttgaggcttctctagatcggaacctctttggtgacattcccgaccagccctgcaagagaaacgacagtgtgtgtgtgagcagaggtggccgcacacctgctggacatctttgccaggctgtgccttctcatgtttcatagacagtggtctgtgctggcagaggctgctgcccctggttggggctatcaggagagtgggggatggtggccacatgtcccccaggtggtctcccggtgcatagctggtggctctgggcaagccatcccttgcttctcggggctgacgccaccgttgtgtccgagcccgccctcccctgcttcctcagcgggaccccttcatctgttggccttacctgtcctcagaaaggaagaggtgaccccacccagccacctctcccttttatggaactcgagagggtggccctactgtgcaccccttccttgtgagtagctctcaactgtcctggagagcagaggctatttggggtcggaggagccctcgatacctgcgaatacatctgctttccaggctgctgtttattctgagacgactgtgctgtagcttcccttgcagctgcaataacccgcaggtcttcactgaggtggaggctttggggtagaattctccatttattttactacttaatacaaaacatttatttttgaccagtcctgtggcttccattagcaatatgtttcctttcccaaatatgcaaatagtggctttgtttgctcaattttgtgagtgctttggaatttaaatgattgtataactcaagaagattacttttctatgttgctcaagctgtgcctgccaacttgtaacttaataaatacaggaaatcctcag

SEQ ID NO: 33551 - DNA, 4504 bp, Homo sapiens
gggtattcccgaggagggtccggggccgggctgtcctcgccggtctccgccgtcccccgggctccgggccggtgatgggggtcgccggggcccgctgtctgtgcaggattcaggtcaacttcggagaggctctgacgcccgctctgcggcttcggtgtttgaacaggccacagtccaggagcgcttacattcaggagctccgcgtagcacctgcccaaccaaactcagccctccgttaagatcctggttccatgccgcagtaggacagcaggcccaagtctgcacatcccagtgatgcaccatgccaatagtggataagttgaaggaggccctgaaacccggccgcaaggactcggctgatgatggagaactggggaagcttcttgcctcctctgccaagaaggtccttttacagaaaatcgagttcgagccagccagcaagagcttctcctaccagctggaggccttaaagagcaaatatgtgttgctcaaccccaaaacagagggagctagtcgccacaagagtggagatgacccaccggccaggagacagggcagtgagcacacgtatgagagctgtggtgacggagtcccagccccgcagaaagtgcttttccccacggagcgactgtctctgaggtgggagcgggtcttccgcgtgggcgcaggactccacaaccttggcaacacctgctttctcaatgccaccatccagtgcttgacctacacaccacctctagccaactacctgctctccaaggagcatgctcgcagctgccaccagggaagcttctgcatgctgtgtgtcatgcagaaccacattgtccaggccttcgccaacagcggcaacgccatcaagcccgtctccttcatccgagacctgaaaaagatcgcccgacacttccgctttgggaaccaggaggacgcgcatgagttcctgcggtacaccatcgacgccatgcagaaagcctgcctgaatggctgtgccaagttggatcgtcaaacgcaggctactaccttggtccatcaaatttttggagggtatctcagatcacgcgtgaagtgctccgtgtgcaagagcgtctcggacacctacgacccctacttggacgtcgcgctggagatccggcaagctgcgaatattgtgcgtgctctggaactttttgtgaaagcagatgtcctgagtggagagaatgcctacatgtgtgctaaatgcaagaagaaggttccagccagcaagcgcttcaccatccacagaacatccaacgtcttaaccctttccctcaagcgctttgccaacttcagcggggggaagatcaccaaggatgtaggctatccggaattcctcaacatacgtccgtatatgtcccagaataatggtgatcctgtcatgtatggactctatgctgtcctggtgcactcgggctacagctgccatgccgggcactattactgctacgtgaaggcaagcaatggacagtggtaccagatgaatgattccttggtccattccagcaacgtcaaggtggttctgaaccagcaggcctacgtgctgttctatctgcgaattccaggctctaagaaaagtcccgagggcctcatctccaggacaggctcctcctcccttcccggccgcccgagtgtgattccagatcactccaagaagaacatcggcaatgggattatttcctccccactgactggaaagcgacaagactctgggacgatgaagaagccgcacaccactgaagagattggtgtgcccatatccaggaatggctccaccctgggcctgaagtcccagaacggctgcattcctccaaagctgccctcggggtccccttcccccaaactctcccagacacccacacacatgccaaccatcctagacgaccctggaaagaaggtgaagaagccagctcctccacagcacttttcccccagaactgctcaggggctgcctgggaccagcaactcgaatagcagcagatctgggagccaaaggcagggctcctgggacagcagggatgttgtcctctctacctcacctaagctcctggctacagccactgccaacgggcatgggctgaaggggaacgacgagagcgctggcctcgacaggaggggctccagcagctccagcccagagcactcggccagcagcgactccaccaaggccccccagacccccaggagtggagcggcccatctctgcgattctcaggaaacgaactgttccaccgctggccactccaaaacgccgccaagtggagcagattctaagacggtgaagctgaagtcccctgtcctgagcaacaccaccactgagcctgcaagcaccatgtctcctccaccagccaaaaaactggccctttctgccaagaaggccagcaccctgtggagggcgaccggcaatgacctccgtccacctcccccctcaccatcctccgacctcacccaccccatgaaaacctctcaccccgtcgttgcctccacttggcccgtccatagagccagggctgtgtcacctgctccccaatcatccagccgcctgcaaccccccttcagcccccaccccacattgctgtccagtacccccaagcccccagggacgtcagaaccacggagctgctcctccatctcgacggcgctgcctcaggtcaacgaggaccttgtgtctcttccacaccagttgccagaggccagtgagcccccccagagcccctctgagaagaggaaaaagacctttgtgggagagccgcagaggctgggctcagagacgcgcctcccacagcacatcagggaggccactgcggctccccacgggaagaggaagaggaagaagaagaagcgcccggaggacacagctgccagcgccctgcaggaggggcagacacagagacagcctgggagccccatgtacaggagggagggccaggcacagctgcccgctgtcagacggcaggaagatggcacacagccacaggtgaatggccagcaggtgggatgtgttacggacggccaccacgcgagcagcaggaagcggaggaggaaaggagcagaaggtcttggtgaagaaggcggcctgcaccaggacccacttcggcacagctgctctcccatgggtgatggtgatccagaggccatggaagagtctccaaggaaaaagaaaaagaaaaaaagaaagcaggagacacagcgggcagtagaagaggatgggcatctcaaatgcccaaggagtgccaagccccaagatgctgttgtccccgagtccagcagctgcgcaccatccgcgaatggctggtgtcctggggaccgcatggggctgagccaggcccctcctgtgtcttggaatggagagcgggagtctgatgtggtccaggaactgctcaaatactcatctgataaagcttacgggagaaaagttctgacctgggatggcaagatgtcggcggtcagtcaggatgctattgaagacagcagacaggcccggactgagaccgtggttgatgactgggacgaagagtttgaccgagggaaggaaaagaaaattaaaaaatttaagagagagaagaggagaaacttcaacgccttccagaaacttcagactcgacggaacttctggtctgtgactcacccagcaaaggctgccagcctcagctatcgccgctgactgtgcccctgtggaaggagcctcctggagacaaggcgtcccttcccgggagctgtcggtctggatctgagggagctctctgtgtgggctctgctgcgctgggagcctgtcacggtaggagctctcccggtaccagtgtccacagaccgcccaacacagaggctttgaggcttctctagatcggaacctctttggtgacattcccgaccagccctgcaagagaaacgacagtgtgtgtgtgagcagaggtggccgcacacctgctggacatctttgccaggctgtgccttctcatgtttcatagacagtggtctgtgctggcagaggctgctgcccctggttggggctatcaggagagtgggggatggtggccacatgtcccccaggtggtctcccggtgcatagctggtggctctgggcaagccatcccttgcttctcggggctgacgccaccgttgtgtccgagcccgccctcccctgcttcctcagcgggaccccttcatctgttggccttacctgtcctcagaaaggaagaggtgaccccacccagccacctctcccttttatggaactcgagagggtggccctactgtgcaccccttccttgtgagtagctctcaactgtcctggagagcagaggctatttggggtcggaggagccctcgatacctgcgaatacatctgctttccaggctgctgtttattctgagacgactgtgctgtagcttcccttgcagctgcaataacccgcaggtcttcactgaggtggaggctttggggtagaattctccatttattttactacttaatacaaaacatttatttttgacc

SEQ ID NO: 33552 - DNA, 2177 bp, Homo sapiens
ggtagtggagatgtccggccggtctaagcgggagtctcgcggttccactcgcgggaagcgagagtctgagtcgcggggcagctccggtcgcgtcaagcgggagcgagatcgggagcgggagcctgaggcggcgagctcccggggcagccctgtgcgcgtgaagcgggagttcgagccggcgagcgcgcgcgaggccccggcttctgttgtcccgtttgtgcgggtgaagcgggagcgcgaggtcgatgaggactcggagcctgagcgggaggtgcgagcaaagaatggccgagtggattctgaggaccggaggagccgccactgcccgtacctggacaccattaacaggagtgtgctggactttgactttgagaaactgtgttctatctccctctcacacatcaatgcttatgcctgtctggtgtgtggcaagtactttcaaggccggggtttgaagtctcacgcctacattcacagtgtccagtttagccaccatgttttcctcaacctccacaccctcaagttttactgccttccagacaactatgagatcatcgattcctcattggaggatatcacgtatgtgttgaagcccactttcacaaagcagcaaattgcaaacttggacaagcaagccaaattgtcccgggcatatgatggtaccacttacctgccgggtattgtgggactgaataacataaaggccaatgattatgccaacgctgtccttcaggctctatctaatgttcctcctctccggaactactttctggaagaagacaattataagaacatcaaacgtcctccaggggatatcatgttcttgttggtccagcgttttggagagctgatgagaaagctctggaaccctcgaaatttcaaggcacatgtgtctccccatgagatgcttcaggcagttgtactttgcagtaagaagacttttcagatcaccaaacaaggagatggcgttgactttctgtcttggtttctgaatgctctgcactcagctctggggggcacaaagaagaaaaagaagactattgtgactgatgttttccaggggtccatgaggatcttcactaaaaagcttccccatcctgatctgccagcagaagaaaaagagcagttgctccataatgacgagtaccaggagacaatggtggagtccacttttatgtacctgacgctggaccttcctactgcccccctctacaaggacgagaaggagcagctcatcattccccaagtgccactcttcaacatcctggctaagttcaatggcatcactgagaaggaatataagacttacaaggagaactttctgaagcgcttccagcttaccaagttgcctccatatctaatcttttgtatcaagagattcactaagaacaacttctttgttgagaagaatccaactattgtcaatttccctattacaaatgtggatctgagagaatacttgtctgaagaagtacaagcagtacacaagaataccacctatgacctcattgccaacatcgtgcatgacggcaagccctccgagggctcctaccggatccacgtgcttcatcatgggacaggcaaatggtatgaattacaagacctccaggtgactgacatccttccccagatgatcacactgtcagaggcttacattcagatttggaagaggcgagataatgatgaaaccaaccagcagggggcttgaaggaggcgtctagggctttgctcccaagggctgtggctgatgatggtaaataagaacacagaagctgtagctgaacacaggctggctggtgggcttcctaggccagcccagcttgtatgggttctggctacaccagagcaccaagagcccacttgcctgggatggccccacactgtcactcagctgttctttgatcatttttttctagattgatgctcctttctcccatgcattgagctcccatctagcttcagcagggcagaacccttctccagatgtgtgtaacttatgtcttgagtatctgggagtagttgaagaacagataattccttccaaacatcaagccttgggattcttggagcaagcagaaagccagtaacttcgctctgttagaggtggaggattttcctatggttccccccatttcctgatttgtatttttagatggattaaatagtctcctgttttt

SEQ ID NO: 33553 - DNA, 2034 bp, Homo sapiens
cgctggacgactcggccggtagtggagatgtccggccggtctaagcgggagtctcgcggttccactcgcgggaagcgagagtctgagtcgcggggcagctccggtcgcgtcaagcgggagcgagatcgggagcgggagcctgaggcggcgagctcccggggcagccctgtgcgcgtgaagcgggagttcgagccggcgagcgcgcgcgaggccccggcttctgttgtcccgtttgtgcgggtgaagcgggagcgcgaggtcgatgaggactcggagcctgagcgggaggtgcgagcaaagaatggccgagtggattctgaggaccggaggagccgccactgcccgtacctggacaccattaacaggagtgtgctggactttgactttgagaaactgtgttctatctccctctcacacatcaatgcttatgcctgtctggtgtgtggcaagtactttcaaggccggggtttgaagtctcacgcctacattcacagtgtccagtttagccaccatgttttcctcaacctccacaccctcaagttttactgccttccagacaactatgagatcatcgattcctcattggaggatatcacgtatgtgttgaagcccactttcacaaagcagcaaattgcaaacttggacaagcaagccaaattgtcccgggcatatgatggtaccacttacctgccgggtattgtgggactgaataacataaaggccaatgattatgccaacgctgtccttcaggctctatctaatgttcctcctctccggaactactttctggaagaagacaattataagaacatcaaacgtcctccaggggatatcatgttcttgttggtccagcgttttggagagctgatgagaaagctctggaaccctcgaaatttcaaggcacatgtgtctccccatgagatgcttcaggcagttgtactttgcagtaagaagacttttcagatcaccaaacaaggagatggcgttgactttctgtcttggtttctgaatgctctgcactcagctctggggggcacaaagaagaaaaagaagactattgtgactgatgttttccaggggtccatgaggatcttcactaaaaagcttccccatcctgatctgccagcagaagaaaaagagcagttgctccataatgacgagtaccaggagacaatggtggagtccacttttatgtacctgacgctggaccttcctactgcccccctctacaaggacgagaaggagcagctcatcattccccaagtgccactcttcaacatcctggctaagttcaatggcatcactgagaaggaatataagacttacaaggagaactttctgaagcgcttccagcttaccaagttgcctccatatctaatcttttgtatcaagagattcactaagaacaacttctttgttgagaagaatccaactattgtcaatttccctattacaaatgtggatctgagagaatacttgtctgaagaagtacaagcagtacacaagaataccacctatgacctcattgccaacatcgtgcatgacggcaagccctccgagggctcctaccggatccacgtgcttcatcatgggacaggcaaatggtatgaattacaagacctccaggtgactgacatccttccccagatgatcacactgtcagaggcttacattcagatttggaagaggcgagataatgatgaaaccaaccagcagggggcttgaaggaggcgtctagggctttgctcccaagggctgtggctgatgatgattgatgctcctttctcccatgcattgagctcccatctagcttcagcagggcagaacccttctccagatgtgtgtaacttatgtcttgagtatctgggagtagttgaagaacagataattccttccaaacatcaagccttgggattcttggagcaagcagaaagccagtaacttcgctctgttagaggtggaggattttcctatggttccccccatttcctgatttgtatttttagatggattaaatagtctcctgtttttaaa

SEQ ID NO: 33554 - DNA, 2026 bp, Homo sapiens
gaggccccggcctggccaagcgatgcagcgcacggagttttcgggtctggtcgggtcgggtggagtagggtatgcttgacttccaccccccggacggagggcttttgtttttgtttttttttgtttgttttttcgtaacatatcaataggaaacaaggacttcggcttacagctgataccagaaccttcagaaaaatgcaaatcatctataacacaactcgatgcttacggcggtgccttcccatcttttttctgcaaagaatggccgagtggattctgaggaccggaggagccgccactgcccgtacctggacaccattaacagcttttcacccttccctacaggccggggtttgaagtctcacgcctacattcacagtgtccagtttagccaccatgttttcctcaacctccacaccctcaagttttactgccttccagacaactatgagatcatcgattcctcattggaggatatcacgtatgtgttgaagcccactttcacaaagcagcaaattgcaaacttggacaagcaagccaaattgtcccgggcatatgatggtaccacttacctgccgggtattgtgggactgaataacataaaggccaatgattatgccaacgctgtccttcaggctctatctaatgttcctcctctccggaactactttctggaagaagacaattataagaacatcaaacgtcctccaggggatatcatgttcttgttggtccagcgttttggagagctgatgagaaagctctggaaccctcgaaatttcaaggcacatgtgtctccccatgagatgcttcaggcagttgtactttgcagtaagaagacttttcagatcaccaaacaaggagatggcgttgactttctgtcttggtttctgaatgctctgcactcagctctggggggcacaaagaagaaaaagaagactattgtgactgatgttttccaggggtccatgaggatcttcactaaaaagcttccccatcctgatctgccagcagaagaaaaagagcagttgctccataatgacgagtaccaggagacaatggtggagtccacttttatgtacctgacgctggaccttcctactgcccccctctacaaggacgagaaggagcagctcatcattccccaagtgccactcttcaacatcctggctaagttcaatggcatcactgagaaggaatataagacttacaaggagaactttctgaagcgcttccagcttaccaagttgcctccatatctaatcttttgtatcaagagattcactaagaacaacttctttgttgagaagaatccaactattgtcaatttccctattacaaatgtggatctgagagaatacttgtctgaagaagtacaagcagtacacaagaataccacctatgacctcattgccaacatcgtgcatgacggcaagccctccgagggctcctaccggatccacgtgcttcatcatgggacaggcaaatggtatgaattacaagacctccaggtgactgacatccttccccagatgatcacactgtcagaggcttacattcagatttggaagaggcgagataatgatgaaaccaaccagcagggggcttgaaggaggcgtctagggctttgctcccaagggctgtggctgatgatggtaaataagaacacagaagctgtagctgaacacaggctggctggtgggcttcctaggccagcccagcttgtatgggttctggctacaccagagcaccaagagcccacttgcctgggatggccccacactgtcactcagctgttctttgatcatttttttctagattgatgctcctttctcccatgcattgagctcccatctagcttcagcagggcagaacccttctccagatgtgtgtaacttatgtcttgagtatctgggagtagttgaagaacagataattccttccaaacatcaagccttgggattcttggagcaagcagaaagccagtaacttcgctctgttagaggtggaggattttcctatggtt

SEQ ID NO: 33555 - DNA, 2033 bp, Homo sapiens
agatgtccggccggtctaagcgggagtctcgcggttccactcgcgggaagcgagagtctgagtcgcggggcagctccggtcgcgtcaagcgggagcgagatcgggagcgggagcctgaggcggcgagctcccggggcagccctgtgcgcgtgaagcgggagttcgagccggcgagcgcgcgcgaggccccggcttctgttgtcccgtttgtgcgggtgaagcgggagcgcgaggtcgatgaggactcggagcctgagcgggaggtgcgagcaaagaatggccgagtggattctgaggaccggaggagccgccactgcccgtacctggacaccattaacaggagtgtgctggactttgactttgagaaactgtgttctatctccctctcacacatcaatgcttatgcctgtctggtgtgtggcaagtactttcaaggccggggtttgaagtctcacgcctacattcacagtgtccagtttagccaccatgttttcctcaacctccacaccctcaagttttactgccttccagacaactatgagatcatcgattcctcattggaggatatcacgtatgtgttgaagcccactttcacaaagcagcaaattgcaaacttggacaagcaagccaaattgtcccgggcatatgatggtaccacttacctgccgggtattgtgggactgaataacataaaggccaatgattatgccaacgctgtccttcaggctctatctaatgttcctcctctccggaactactttctggaagaagacaattataagaacatcaaacgtcctccaggggatatcatgttcttgttggtccagcgttttggagagctgatgagaaagctctggaaccctcgaaatttcaaggcacatgtgtctccccatgagatgcttcaggcagttgtactttgcagtaagaagacttttcagatcaccaaacaaggagatggcgttgactttctgtcttggtttctgaatgctctgcactcagctctggggggcacaaagaagaaaaagaagactattgtgactgatgttttccaggggtccatgaggatcttcactaaaaagcttccccatcctgatctgccagcagaagaaaaagagcagttgctccataatgacgagtaccaggagacaatggtggagtccacttttatgtacctgacgctggaccttcctactgcccccctctacaaggacgagaaggagcagctcatcattccccaagtgccactcttcaacatcctggctaagttcaatggcatcactgagaaggaatataagacttacaaggagaactttctgaagcgcttccagcttaccaagttgcctccatatctaatcttttgtatcaagagattcactaagaacaacttctttgttgagaagaatccaactattgtcaatttccctattacgggacaggcaaatggtatgaattacaagacctccaggtgactgacatccttccccagatgatcacactgtcagaggcttacattcagatttggaagaggcgagataatgatgaaaccaaccagcagggggcttgaaggaggcgtctagggctttgctcccaagggctgtggctgatgatggtaaataagaacacagaagctgtagctgaacacaggctggctggtgggcttcctaggccagcccagcttgtatgggttctggctacaccagagcaccaagagcccacttgcctgggatggccccacactgtcactcagctgttctttgatcatttttttctagattgatgctcctttctcccatgcattgagctcccatctagcttcagcagggcagaacccttctccagatgtgtgtaacttatgtcttgagtatctgggagtagttgaagaacagataattccttccaaacatcaagccttgggattcttggagcaagcagaaagccagtaacttcgctctgttagaggtggaggattttcctatggttccccccatttcctgatttgtatttttagatggattaaatagtctcctgttttt

SEQ ID NO: 33556 - DNA, 3126 bp, Homo sapiens
cgcgcggggcggatgtccgggccggctgggccggggccgcggaggagatggcggaaggtggaggctgccgtgagcgaccggatgcggagactcagaagtccgagcttggacccttaatgaggaccacactccaacgcggggcgcagtggtatcttattgacagccggtggttcaagcagtggaagaagtatgtgggctttgacagctgggacatgtacaatgtgggtgaacataacctatttcctggcccaatagacaactctgggctattttcagatcctgagagtcagaccttgaaagaacacttaattgatgaattggactatgtattggtccctaccgaggcgtggaataaactactaaactggtacggctgtgtagaaggccagcaacccatcgtcagaaaagttgtggagcatggcctgtttgtcaagcactgcaaagtcgaggtgtatttgctggaactgaagctctgtgagaacagtgaccccaccaatgtgctgagttgccatttcagcaaggcagacaccattgcaaccatcgagaaagagatgcggaagctattcaacatccctgcggagcgtgaaacacggctctggaacaaatacatgagcaacacctacgagcagttgagcaagctagacaacactgtccaggatgctgggctataccagggtcaggtgctagtaattgagcctcaaaatgaagatggcacatggcccaggcagaccttgcagtcaaaatcaagcactgcgcctagcagaaattttactacctctccaaaatcatcagcaagtccctattcctcagtgtctgcctctctcattgcaaatggtgatagcactagcacctgtgggatgcacagttccggtgtcagcaggggtggatctggcttttctgcttcgtataattgtcaggagccaccatcctctcatatacaacctgggctctgtggacttggaaacctgggaaacacctgcttcatgaactccgctttgcagtgtttgagcaacactgcaccactgactgactactttctcaaagatgagtatgaagccgaaatcaacagagacaaccctctggggatgaaaggggaaattgcagaagcctatgctgaactcattaagcagatgtggtctggaagggacgcccatgtggcacctcgcatgttcaaaactcaagtaggacgttttgctcctcaattttctggctaccagcaacaagattctcaggagctgctggcctttcttctagatggattgcatgaagatctgaaccgggtaaagaaaaagccctacttggagctgaaggatgccaatgggcggccagatgcggtggtggcaaaggaagcctgggagaatcacaggttgaggaatgattctgtgattgtggatactttccatggcctcttcaaatctactttggtttgcccagaatgtgctaaggtttctgtgacctttgacccattttgctatctaacgctgccactgcccttgaagaaagatcgagttatggaggttttcctggttcctgctgaccctcactgcagacctactcagtaccgtgtgactgtgccgctgatgggggctgtgtccgacctgtgcgaggctctctccaggctgtctggcattgctgcagaaaatatggtggtcgcagatgtgtataatcaccgattccacaaaattttccaaatggatgaaggtttaaaccacatcatgcctcgggatgacattttcgtgtacgaggtctgcagcacttccgtggatggctcggaatgtgtcacgcttccagtctacttcagggagaggaagtccaggccatcaagcacttcctccgcatcagcgctatatgggcagccactattgctttctgtccccaagcacaagttaacccttgagtctttgtaccaggctgtttgtgatcgtatcagccgctatgtgaaacagcctttacctgatgagtttggcagctcacccttggagccaggggcctgcaatggctccaggaacagctgtgaaggagaagatgaggaagaaatggagcatcaggaagaaggcaaagagcagctttcagaaacagaaggcagtggggaagatgagccaggaaatgaccccagtgagaccacccaaaagaagatcaaaggccagccctgcccaaaaaggctttttaccttcagtcttgtgaactcctatggaacagctgacataaattcacttgcagctgatggaaaactacttaaactcaactctcgatctacactggccatggattgggacagtgaaactcggagactttactatgatgagcaagaatctgaggcctacgagaagcatgtgagcatgttgcagcctcagaagaagaagaagaccacagtggccctgagagactgcatcgagctcttcaccaccatggagacccttggggagcatgacccctggtactgtcccaactgtaagaagcatcaacaggccacaaaaaagtttgacctatggtccttgcccaagatcctggtggtccacctcaaacgtttctcctacaacagatactggagggataagctcgacacagtcgtagaattcccaatcagagggctgaacatgtccgagtttgtctgtaacctgtcagcaaggccttatgtgtacgacctcattgccgtgtccaatcattatggagccatgggggttggccactacactgcatatgcgaagaacaaactgaatggtaaatggtattactttgatgatagcaacgtgtccctggcctctgaggatcagatagtgactaaagcagcttatgtgctattttaccaacgtcgagatgatgaattttataagacaccttcacttagcagttctggttcctctgatggagggacacgaccaagcagctctcagcagggctttggggatgatgaggcttgcagcatggacaccaactaatgctgactccacgatcctgccaccctgtagcgccagtgtaatcccccaggagaacatctttgacactctgcagactgctagtgttctgtctaaaaaccagacaaggaaatacccttcttttatgagcagaaggaaacaaaaaaaaaaaaagaagaccgtttacctagaagaagctatgtcaagaggc

SEQ ID NO: 33557 - DNA, 3222 bp, Homo sapiens
gcggaggagatggcggaaggtggaggctgccgtgagcgaccggatgcggagactcagaagtccgagcttggacccttaatgaggaccacactccaacgcggggcgcagtggtatcttattgacagccggtggttcaagcagtggaagaagtatgtgggctttgacagctgggacatgtacaatgtgggtgaacataacctatttcctggcccaatagacaactctgggctattttcagatcctgagagtcagaccttgaaagaacacttaattgatgaattggactatgtattggtccctaccgaggcgtggaataaactactaaactggtacggctgtgtagaaggccagcaacccatcgtcagaaaagttgtggagcatggcctgtttgtcaagcactgcaaagtcgaggtgtatttgctggaactgaagctctgtgagaacagtgaccccaccaatgtgctgagttgccatttcagcaaggcagacaccattgcaaccatcgagaaagagatgcggaagctattcaacatccctgcggagcgtgaaacacggctctggaacaaatacatgagcaacacctacgagcagttgagcaagctagacaacactgtccaggatgctgggctataccagggtcaggtgctagtaattgagcctcaaaatgaagatggcacatggcccaggcagaccttgcagtcaaatggatctggcttttctgcttcgtataattgtcaggagccaccatcctctcatatacaacctgggctctgtggacttggaaacctgggaaacacctgcttcatgaactccgctttgcagtgtttgagcaacactgcaccactgactgactactttctcaaagatgagtatgaagccgaaatcaacagagacaaccctctggggatgaaaggggaaattgcagaagcctatgctgaactcattaagcagatgtggtctggaagggacgcccatgtggcacctcgcatgttcaaaactcaagtaggacgttttgctcctcaattttctggctaccagcaacaagattctcaggagctgctggcctttcttctagatggattgcatgaagatctgaaccgggtaaagaaaaagccctacttggagctgaaggatgccaatgggcggccagatgcggtggtggcaaaggaagcctgggagaatcacaggttgaggaatgattctgtgattgtggatactttccatggcctcttcaaatctactttggtttgcccagaatgtgctaaggtttctgtgacctttgacccattttgctatctaacgctgccactgcccttgaagaaagatcgagttatggaggttttcctggttcctgctgaccctcactgcagacctactcagtaccgtgtgactgtgccgctgatgggggctgtgtccgacctgtgcgaggctctctccaggctgtctggcattgctgcagaaaatatggtggtcgcagatgtgtataatcaccgattccacaaaattttccaaatggatgaaggtttaaaccacatcatgcctcgggatgacattttcgtgtacgaggtctgcagcacttccgtggatggctcggaatgtgtcacgcttccagtctacttcagggagaggaagtccaggccatcaagcacttcctccgcatcagcgctatatgggcagccactattgctttctgtccccaagcacaagttaacccttgagtctttgtaccaggctgtttgtgatcgtatcagccgctatgtgaaacagcctttacctgatgagtttggcagctcacccttggagccaggggcctgcaatggctccaggaacagctgtgaaggagaagatgaggaagaaatggagcatcaggaagaaggcaaagagcagctttcagaaacagaaggcagtggggaagatgagccaggaaatgaccccagtgagaccacccaaaagaagatcaaaggccagccctgcccaaaaaggctttttaccttcagtcttgtgaactcctatggaacagctgacataaattcacttgcagctgatggaaaactacttaaactcaactctcgatctacactggccatggattgggacagtgaaactcggagactttactatgatgagcaagaatctgaggcctacgagaagcatgtgagcatgttgcagcctcagaagaagaagaagaccacagtggccctgagagactgcatcgagctcttcaccaccatggagacccttggggagcatgacccctggtactgtcccaactgtaagaagcatcaacaggccacaaaaaagtttgacctatggtccttgcccaagatcctggtggtccacctcaaacgtttctcctacaacagatactggagggataagctcgacacagtcgtagaattcccaatcagagggctgaacatgtccgagtttgtctgtaacctgtcagcaaggccttatgtgtacgacctcattgccgtgtccaatcattatggagccatgggggttggccactacactgcatatgcgaagaacaaactgaatggtaaatggtattactttgatgatagcaacgtgtccctggcctctgaggatcagatagtgactaaagcagcttatgtgctattttaccaacgtcgagatgatgaattttataagacaccttcacttagcagttctggttcctctgatggagggacacgaccaagcagctctcagcagggctttggggatgatgaggcttgcagcatggacaccaactaatgctgactccacgatcctgccaccctgtagcgccagtgtaatcccccaggagaacatctttgacactctgcagactgctagtgttctgtctaaaaaccagacaaggaaatacccttcttttatgagcagaaggaaacaaaaaaaaaaaaagaagaccgtttacctagaagaagctatgtcaagaggctgaattatttttatttttaaacaggtggtgagaaatttctgtgaaacctgtgaagctgaaaagggggtgggatgggggtactcaatggagtatgtctgatggatcccgaagaatggagaggaacacaggcgctgagtatggagcagcctggagacccaccccacctgcagggctgccctgagcgcctggatttctggttctgatgccaatactagtcaccccaagtagtctgctcacagtaacccaaacctcaagtaaactcccctttccctcgc

SEQ ID NO: 33558 - DNA, 1536 bp, Homo sapiens
gccgcggaggagatggcggaaggtggaggctgccgtgagcgaccggatgcggagactcagaagtccgagcttggacccttaatgaggaccacactccaacgcggggcgcagtggtatcttattgacagccggtggttcaagcagtggaagaagtatgtgggctttgacagctgggacatgtacaatgtgggtgaacataacctatttcctggcccaatagacaactctgggctattttcagatcctgagagtcagaccttgaaagaacacttaattgatgaattggactatgtattggtccctaccgaggcgtggaataaactactaaactggtacggctgtgtagaaggccagcaacccatcgtcagaaaagttgtggagcatggcctgtttgtcaagcactgcaaagtcgaggtgtatttgctggaactgaagctctgtgagaacagtgaccccaccaatgtgctgagttgccatttcagcaaggcagacaccattgcaaccatcgagaaagagatgcggaagctattcaacatccctgcggagcgtgaaacacggctctggaacaaatacatgagcaacacctacgagcagttgagcaagctagacaacactgtccaggatgctgggctataccagggtcaggtgctagtaattgagcctcaaaatgaagatggcacatggcccaggcagaccttgcagtcaaaagtttcgttctttttgcccaggctggagtgcaatggcgcgatcttggctcactgcaacttctgcctcccgggttcaagcaattctcctgcctcagcttcccgagtagcgccatcacatctggctaatttttttttttttgagatggagtctcactctgtcaccaagctggagtgcggtggtgcagtctcggcttactcccgggttcaagtgatgcttctgccccagcctcccgagtggctgggatgacaggcgcccgccaccatgtccagataatttttgtatttttagtagagatgtggtttcactgtgtcttgaactcctgacctcatggccaggctggtcttgaattcctgaccttgtgatcgtgacctcatgatccgccagcctcggcctcccaaagtgctgggattacaagggtgagccacctcacccagcctaattttgtatttttagtagtgacggggtttctccatgttggtcaggctggtctcaaactcctgacctcaggtgatccgtctgcctcggcctcccaaagtgctgagattacaggcatgagccaccacgcgcgacctggctaatttcttttgcattttagtagagacagggtttcactgtgttgcccaggctggtctcgaactcctgagctcaggcaatctgcctgcctcagcctcccaaagtactaggattacaggcacgagccactgcgcctggtcagccttgtggtttttcacactgaaagggtatgtggtggtgtggactgatgtgacaggaagaccagttaatttgtggactctcacttaaataaagtttaccttgaagtagtatgaa

SEQ ID NO: 33559 - DNA, 4022 bp, Homo sapiens
gacttcaggaaagcagtttccaggaggtgagagtttaagccaaacctgaaagaggttgatttgtaatgatttgcaggggggcactggaggcagccgccaggacttttcacttaggagatcagcatttgccctgatggaaactgggcgatcctgcagggactgacctctgagttatccaaaggccgacctggggaaagactgattttgaggttttaatagttttcagatgcttcaagtgttgtgaacagagacttgtttggattatgcatttctcagctagactaaataaatgctagcaatggatacgtgcaaacatgttgggcagctgcagcttgctcaagaccattccagcctcaaccctcagaaatggcactgtgtggactgcaacacgaccgagtccatttgggcttgccttagctgctcccatgttgcctgtggaagatatattgaagagcatgcactcaagcactttcaagaaagcagtcatcctgttgcattggaggtgaatgagatgtacgttttttgttacctttgtgatgattatgttctgaatgataacacaactggagacctgaagttactacgacgtacattaagtgccatcaaaagtcaaaattatcactgcacaactcgtagtgggaggtttttacggtccatgggtacaggtgatgattcttatttcttacatgacggtgcccaatctctgcttcaaagtgaagatcaactgtatactgctctttggcacaggagaaggatactaatgggtaaaatctttcgaacatggtttgaacaatcacccattggaagaaaaaagcaagaagaaccatttcaggaaaaaatagtagtaaaaagagaagtaaagaaaagacggcaggaattggagtatcaagttaaagcagaattggaaagtatgcctccaagaaagagtttacgtttacaagggctcgctcagtcgaccataatagaaatagtttctgttcaggtgccagcacaaacgccagcatcaccagcaaaagataaagtactctctacctcagaaaatgaaatatctcaaaaagtcagtgactcctcagttaaacgaaggccaatagtaactcctggtgtaacaggattgagaaatttgggaaatacttgctatatgaattctgttcttcaggtgttgagtcatttacttatttttcgacaatgttttttaaagcttgatctgaaccaatggctggctatgactgctagcgagaagacaagatcttgtaagcatccaccagtcacagatacagtagtatatcaaatgaatgaatgtcaggaaaaagatacaggttttgtttgctccagacaatcaagtctgtcatcaggactaagtggtggagcatcaaaaggtagaaagatggaacttattcagccaaaggagccaacttcacagtacatttctctttgtcatgaattgcatactttgttccaagtcatgtggtctggaaagtgggcgttggtctcaccatttgctatgctacactcagtgtggagactcattcctgcctttcgtggttacgcccaacaagacgctcaggaatttctttgtgaacttttagataaaatacaacgtgaattagagacaactggtaccagtttaccagctcttatccccacttctcaaaggaaactcatcaaacaagttctgaatgttgtaaataacatttttcatggacaacttcttagtcaggttacatgtcttgcatgtgacaacaaatcaaataccatagaacctttctgggacttgtcattggagtttccagaaaggtatcaatgcagtggaaaagatattgcttcccagccatgtctggttactgaaatgttggccaaatttacagaaactgaagctttagaaggaaaaatctacgtatgtgaccagtgtaactcaaagcgtagaaggttttcctccaaaccagttgtactcacagaagcccagaaacaacttatgatatgccacctacctcaggttctcagactgcacctcaaacgattcaggtggtcaggacgtaataaccgagagaagattggtgttcatgttggctttgaggaaatcttaaacatggagccctattgctgcagggagaccctgaaatccctcagaccagaatgctttatctatgacttgtccgcggtggtgatgcaccatgggaaaggatttggctcagggcactacactgcctactgctataattctgaaggagggttctgggtacactgcaatgattccaaactaagcatgtgcactatggatgaagtatgcaaggctcaagcttatatcttgttttatacccaacgagttactgagaatggacattctaaacttttgcctccagagctcctgttggggagccaacatcccaatgaagacgctgatacctcgtctaatgaaatccttagctgatccaaagacaatggggttttcttcctgtgatttatatatatactttttaaaagactgatgtaccattttaaacttcattttttcttgtgaatcagtgtatactacatttatacattttatatctaacaatttttttttttacaaagtataaatgtatatatcaactgaaggtaactacttttttcatatttggagttttaaacttttggtgtttacctcagactgatgttacctcttttatatttttatgtcttaattggctcggatgatgaacttgtgcaatcttctaccaacaaagttcaagtggcatcattttatatacatgtatctttttcaggtattttctatacaaattcttaatagatggaaaattagactctactttggtcactaatagtctttcatttgtatattgaagttaccttgccccttggagttattgaagtgacatgtcaaggtatcacctaaatattcttcagtcacactcactggtatttctgaggctttgtgtgttaacaggccttgtaattgacattattttggttaatgtaaccccaaaattgctttagtaattgctctttggcatagtcaaactataaatgaaaatggcagctttacaaatagtatatttaagtgaactctggaactatggacatgaaaaaaatgatggctgggatttatgatttttgtctggcagcaaacaggtttgtccagaagtctaataattaagcagtcataaaaagtctgaatttagtaaaccagtgtatgatgttattcaaatagtttaccttgggtatgagttcattttataatgtctgatgacattagatctcttaaaactttatgtattttttttagttcaaaggaatagagtcttgaagagaaaaaattatagggcagaaaagataagtgttcaaaattggcaactggactattattatgtctagcatctcattctaaataactaaagcttgatttactcttgctaggattatgtgactactaggtaggagcctcttaaaacactggccctgagcattaaaaaaaaaaaaaaaaactaaaagctatctatctaaacttgcacaaaaaaaaatacagtgtgagtcactctttttcttcttctgataatctcactgggtttctttaaagtcctgttgctgctaactttatcttatttggagagggtagaatcaactaatctctgtagaccagctatgtatctaagctctgttaaccacaggaagatcatgtatcccttttttataagtgggtttatttgcaggttgaagtcttagtgaaagatagtatcctgtagaatgctgttcaccactagtgatcatctgttaagtacaaacttgaaagaggtctctaccaataaatttttcttaaatttcacaaaacaagtcatctgggttagctgatagtgaggtgcagtgagacttttatcactgaatagacaaatcatttgtgccgaaaatacatctggaatattaaatggctatgtttaaaattgttcataatacctatgcaagttgttacctcaactgttacacacttcttaatacctcattaaaaatttacatggtcaagataa

SEQ ID NO: 33560 - DNA, 3161 bp, Homo sapiens
gggtcgtcgcggccgccgaaccggggggcggggggccggggtgagcgctaagatggccgccccggctcgggctgttttcagatgcttcaagtgttgtgaacagagacttgtttggattatgcatttctcagctagactaaataaatgctagcaatggatacgtgcaaacatgttgggcagctgcagcttgctcaagaccattccagcctcaaccctcagaaatggcactgtgtggactgcaacacgaccgagtccatttgggcttgccttagctgctcccatgttgcctgtggaagatatattgaagagcatgcactcaagcactttcaagaaagcagtcatcctgttgcattggaggtgaatgagatgtacgttttttgttacctttgtgatgattatgttctgaatgataacacaactggagacctgaagttactacgacgtacattaagtgccatcaaaagtcaaaattatcactgcacaactcgtagtgggaggtttttacggtccatgggtacaggtgatgattcttatttcttacatgacggtgcccaatctctgcttcaaagtgaagatcaactgtatactgctctttggcacaggagaaggatactaatgggtaaaatctttcgaacatggtttgaacaatcacccattggaagaaaaaagcaagaagaaccatttcaggaaaaaatagtagtaaaaagagaagtaaagaaaagacggcaggaattggagtatcaagttaaagcagaattggaaagtatgcctccaagaaagagtttacgtttacaagggctcgctcagtcgaccataatagaaatagtttctgttcaggtgccagcacaaacgccagcatcaccagcaaaagataaagtactctctacctcagaaaatgaaatatctcaaaaagtcagtgactcctcagttaaacgaaggccaatagtaactcctggtgtaacaggattgagaaatttgggaaatacttgctatatgaattctgttcttcaggtgttgagtcatttacttatttttcgacaatgttttttaaagcttgatctgaaccaatggctggctatgactgctagcgagaagacaagatcttgtaagcatccaccagtcacagatacagtagtatatcaaatgaatgaatgtcaggaaaaagatacaggttttgtttgctccagacaatcaagtctgtcatcaggactaagtggtggagcatcaaaaggtagaaagatggaacttattcagccaaaggagccaacttcacagtacatttctctttgtcatgaattgcatactttgttccaagtcatgtggtctggaaagtgggcgttggtctcaccatttgctatgctacactcagtgtggagactcattcctgcctttcgtggttacgcccaacaagacgctcaggaatttctttgtgaacttttagataaaatacaacgtgaattagagacaactggtaccagtttaccagctcttatccccacttctcaaaggaaactcatcaaacaagttctgaatgttgtaaataacatttttcatggacaacttcttagtcaggttacatgtcttgcatgtgacaacaaatcaaataccatagaacctttctgggacttgtcattggagtttccagaaaggtatcaatgcagtggaaaagatattgcttcccagccatgtctggttactgaaatgttggccaaatttacagaaactgaagctttagaaggaaaaatctacgtatgtgaccagtgtaactcaaagcgtagaaggttttcctccaaaccagttgtactcacagaagcccagaaacaacttatgatatgccacctacctcaggttctcagactgcacctcaaacgattcaggtggtcaggacgtaataaccgagagaagattggtgttcatgttggctttgaggaaatcttaaacatggagccctattgctgcagggagaccctgaaatccctcagaccagaatgctttatctatgacttgtccgcggtggtgatgcaccatgggaaaggatttggctcagggcactacactgcctactgctataattctgaaggagggttctgggtacactgcaatgattccaaactaagcatgtgcactatggatgaagtatgcaaggctcaagcttatatcttgttttatacccaacgagttactgagaatggacattctaaacttttgcctccagagctcctgttggggagccaacatcccaatgaagacgctgatacctcgtctaatgaaatccttagctgatccaaagacaatggggttttcttcctgtgatttatatatatactttttaaaagactgatgtaccattttaaacttcattttttcttgtgaatcagtgtatactacatttatacattttatatctaacaatttttttttttacaaagtataaatgtatatatcaactgaaggtaactacttttttcatatttggagttttaaacttttggtgtttacctcagactgatgttacctcttttatatttttatgtcttaattggctcggatgatgaacttgtgcaatcttctaccaacaaagttcaagtggcatcattttatatacatgtatctttttcaggtattttctatacaaattcttaatagatggaaaattagactctactttggtcactaatagtctttcatttgtatattgaagttaccttgccccttggagttattgaagtgacatgtcaaggtatcacctaaatattcttcagtcacactcactggtatttctgaggctttgtgtgttaacaggccttgtaattgacattattttggttaatgtaaccccaaaattgctttagtaattgctctttggcatagtcaaactataaatgaaaatggcagctttacaaatagtatatttaagtgaactctggaactatggacatgaaaaaaatgatggctgggatttatgatttttgtctggcagcaaacaggtttgtccagaagtctaataattaagcagtcataaaaagtctgaatttagtaaaccagtgtatgatgttattcaaatagtttaccttgggtatgagttcattttataatgtctgatgacattagatctcttaaaactttatgtattttttttagttcaaaggaatagagtcttg

SEQ ID NO: 33561 - DNA, 2499 bp, Homo sapiens
gattaccgcgaggtgatgctcgaagccccggggcacttcgggagggcggttgtggcactcggttgaggaggaatgcgcttcccggcgtcttgcccgccttctctccatcgatcggtccccgcgctgccggcacctgctgccgcttaaagcttgaaaatcagcttcctaaagccattcccgatggccttcgatgggaaagaatgccatatggctgaattcattatgggggataagaaatatgtcagtgtgcgcggaggggaacctgttaatacgttcaaatttaagagtagttttcagatgcttcaagtgttgtgaacagagacttgtttggattatgcatttctcagctagactaaataaatgctagcaatggatacgtgcaaacatgttgggcagctgcagcttgctcaagaccattccagcctcaaccctcagaaatggcactgtgtggactgcaacacgaccgagtccatttgggcttgccttagctgctcccatgttgcctgtggaagatatattgaagagcatgcactcaagcactttcaagaaagcagtcatcctgttgcattggaggtgaatgagatgtacgttttttgttacctttgtgatgattatgttctgaatgataacacaactggagacctgaagttactacgacgtacattaagtgccatcaaaagtcaaaattatcactgcacaactcgtagtgggaggtttttacggtccatgggtacaggtgatgattcttatttcttacatgacggtgcccaatctctgcttcaaagtgaagatcaactgtatactgctctttggcacaggagaaggatactaatgggtaaaatctttcgaacatggtttgaacaatcacccattggaagaaaaaagcaagaagaaccatttcaggaaaaaatagtagtaaaaagagaagtaaagaaaagacggcaggaattggagtatcaagttaaagcagaattggaaagtatgcctccaagaaagagtttacgtttacaagggctcgctcagtcgaccataatagaaatagtttctgttcaggtgccagcacaaacgccagcatcaccagcaaaagataaagtactctctacctcagaaaatgaaatatctcaaaaagtcagtgactcctcagttaaacgaaggccaatagtaactcctggtgtaacaggattgagaaatttgggaaatacttgctatatgaattctgttcttcaggtgttgagtcatttacttatttttcgacaatgttttttaaagcttgatctgaaccaatggctggctatgactgctagcgagaagacaagatcttgtaagcatccaccagtcacagatacagtagtatatcaaatgaatgaatgtcaggaaaaagatacaggttttgtttgctccagacaatcaagtctgtcatcaggactaagtggtggagcatcaaaaggtagaaagatggaacttattcagccaaaggagccaacttcacagtacatttctctttgtcatgaattgcatactttgttccaagtcatgtggtctggaaagtgggcgttggtctcaccatttgctatgctacactcagtgtggagactcattcctgcctttcgtggttacgcccaacaagacgctcaggaatttctttgtgaacttttagataaaatacaacgtgaattagagacaactggtaccagtttaccagctcttatccccacttctcaaaggaaactcatcaaacaagttctgaatgttgtaaataacatttttcatggacaacttcttagtcaggttacatgtcttgcatgtgacaacaaatcaaataccatagaacctttctgggacttgtcattggagtttccagaaaggtatcaatgcagtggaaaagatattgcttcccagccatgtctggttactgaaatgttggccaaatttacagaaactgaagctttagaaggaaaaatctacgtatgtgaccagtgtaactcaaagcgtagaaggttttcctccaaaccagttgtactcacagaagcccagaaacaacttatgatatgccacctacctcaggttctcagactgcacctcaaacgattcaggtggtcaggacgtaataaccgagagaagattggtgttcatgttggctttgaggaaatcttaaacatggagccctattgctgcagggagaccctgaaatccctcagaccagaatgctttatctatgacttgtccgcggtggtgatgcaccatgggaaaggatttggctcagggcactacactgcctactgctataattctgaaggagggttctgggtacactgcaatgattccaaactaagcatgtgcactatggatgaagtatgcaaggctcaagcttatatcttgttttatacccaacgagttactgagaatggacattctaaacttttgcctccagagctcctgttggggagccaacatcccaatgaagacgctgatacctcgtctaatgaaatccttagctga

SEQ ID NO: 33562 - DNA, 677 bp, Homo sapiens
gctaagatggccgccccggctcgggctggtgagtgtgcgcgagggcgcgcggccgcggcgattggcggagtgaggacccctgcgggagcggacgtgcgacggcagcccccggggccgggaggcacctgggggcctattctcgccgcgcagggcgctggggggtcctgagagagggagagcctggggctgcgggcgcgcggaagggaatgagccgaggggcgcgcggcggcgacgcgtccggcgaattttgaattgcccccctgggaagtttcgttttcagatgcttcaagtgttgtgaacagagacttgtttggattatgcatttctcagctagactaaataaatgctagcaatggatacgtgcaaacatgttgggcagctgcagcttgctcaagaccattccagcctcaaccctcagaaatggcactgtgtggactgcaacacgaccgagtccatttgggcttgccttagctgctcccatgttgcctgtggaagatatattgaagagcatgcactcaagcactttcaagaaagcagtcatcctgttgcattggaggtgaatgagatgtacgttttttgttacctttgtgatgattatgttctgaatgataacacaactggagacctgaagttactacgacgtacattaagtgccatcaaaagtcaaaattatcact

SEQ ID NO: 33563 - DNA, 666 bp, Homo sapiens
gggcggggggccggggtgagcgctaagatggccgccccggctcgggctgccaactgtcaagtctgttcggcctcagagtatgttatagagccatgaattaaagttttcagatgcttcaagtgttgtgaacagagacttgtttggattatgcatttctcagctagactaaataaatgctagcaatggatacgtgcaaacatgttgggcagctgcagcttgctcaagaccattccagcctcaaccctcagaaatggcactgtgtggactgcaacacgaccgagtccatttgggcttgccttagctgctcccatgttgcctgtggaagatatattgaagagcatgcactcaagcactttcaagaaagcagtcatcctgttgcattggaggtgaatgagatgtacgttttttgttacctttgtgatgattatgttctgaatgataacacaactggagacctgaagttactacgacgtacattaagtgccatcaaaagtcaaaattatcactgcacaactcgtagtgggaggtttttacggtccatgggtacaggtgatgattcttatttcttacatgacggtgcccaatctctgcttcaaagtgaagatcaactgtatactgctctttggcacaggagaaggatactaatgggtaaaatctttcgaacat

SEQ ID NO: 33564 - DNA, 4752 bp, Homo sapiens
cgctccctccccgccctccccgcgccgccgcctcctcctcccggcctccctctcccagccaaactgaaagccggaccccaggccgccgcgctgccgcccggcctccccgccagcgcgccaccatgggcagtcccggtttccccttgtaaagatggcggtgagggatcgctgcaacctttagactaatgactgtccgaaacatcgcctccatctgtaatatgggcaccaatgcctctgctctggaaaaagacattggtccagagcagtttccaatcaatgaacactatttcggattggtcaattttggaaacacatgctactgtaactccgtgcttcaggcattgtacttctgccgtccattccgggagaatgtgttggcatacaaggcccagcaaaagaagaaggaaaacttgctgacgtgcctggcggaccttttccacagcattgccacacagaagaagaaggttggcgtcatcccaccaaagaagttcatttcaaggctgagaaaagagaatgatctctttgataactacatgcagcaggatgctcatgaatttttaaattatttgctaaacactattgcggacatccttcaggaggagaagaaacaggaaaaacaaaatggaaaattaaaaaatggcaacatgaacgaacctgcggaaaataataaaccagaactcacctgggtccatgagatttttcagggaacgcttaccaatgaaactcgatgcttgaactgtgaaactgttagtagcaaagatgaagattttcttgacctttctgttgatgtggagcagaatacatccattacccactgtctaagagacttcagcaacacagaaacactgtgtagtgaacaaaaatattattgtgaaacatgctgcagcaaacaagaagcccagaaaaggatgagggtaaaaaagctgcccatgatcttggccctgcacctaaagcggttcaagtacatggagcagctgcacagatacaccaagctgtcttaccgtgtggtcttccctctggaactccggctcttcaacacctccagtgatgcagtgaacctggaccgcatgtatgacttggttgcggtggtcgttcactgtggcagtggtcctaatcgtgggcattatatcactattgtgaaaagtcacggcttctggcttttgtttgatgatgacattgtagagaaaatagatgctcaagctattgaagaattctatggcctgacgtcagatatatcaaaaaattcagaatctggatatattttattctatcagtcaagagagtaactgaaagacctgcgggactgattcacgtggggagaatgttcacagcactgtcacccggcttctccgcaggctttcctcttccccagtggcccactaatggtatcactccgagtctcaatggtctggctgtgttagactctctccttttgtgtttttacatgcagcactactcttggttttatttcagtctgacatagagttaactgcaatcagattgtagtctgatttatatgaataacggttgctaattttaggactgggtgaaagctatgccattcattatgtctggctgtattagaatgacatttcctatgaatgtctacggtctgttttaggtgtttgctaaacttctatggcttccagggtcttcttacaatgcattcctttaacttgtccctggaagcattgctacccattttcagcttctctgcctctcttctgatacaaggacagaagaattgggtagatattcaccttttaggggtgcaagtatagctttaagtttgtgcaagtgaaaatgttgaaaagtgagtaacctcgatattaaaatcatccttgacatgaaacagggtgaagagaagctgtccgtggcggctggtgttggctggcattggcactgggctgtgctgacctagccattacaattccaggggctaagaaggctcagggcagacaaagtcaagaggaggaagtttttgtggacaatgaaaagttattttcgtacctttctaccaaaaccaagtttcaggaaaataactctatgttgtttattttcagtgacacttatgtaaggccctgtgagttgtatttatcctgtatccggcactgctaagcttttcaaggtatctttccaatcctgctgatgtggcagtcaatggctgcagggctggcaaacctccccttagccagtcagcacggcattgttccttatcaggaataacaaaggtactacatctttccagccatcagcacgttgtacaacttaactttttaacatagtccgtctgtttactgaggcactggcgagtcccagggctgatacagaaccttccctagagggaataccagagttagctgggtatagaggtggctcaaaggaagtgtccgtgggcagggggaggaatgaacaaaatggcgctgtttctttggctcagactcctagaatgcttgacaagacagaatttttttggaagaacctcatctcactatagttacttttttcacttttgttatatatgtatttattagagcatttgaatattggtacctttaaaagggtcatttggtgttttgctgttgagctggtttttgagtcatagatcttggcttcctttagaagccacttaacttccatacactataataaactgtgaacatatttttgttacctaatgcatccactgatgaacatgcaaactttgggcataatgtgaactaaaattgaaatggaaaatgttagtggccattttgcaacaatgaagaggatagcactttatctagatgaaaactggatttcttatctttgaaatatcttgaactgtttattgctcagaacttaagtaagcatgccaacatttcgtttgtttatgcttgaagtgaaatgttttacttttcactggagaagacaaaacagggtgatcttcatgttattgttttatacaagtgatggaaatgtaccttgccttgtttagaggcaatttcacatttataaatatttttttttcctccatgaaacttacgcagtaatcactacctggaaggtgagttttgatctctttttaaggagaggcactttccaactgaaggtgattgatgtagggaaatgtttgtactatatagaatccatatatttgactgcaagttacaaagttttaagaacatgatggttggtctctaatatatttggaactgattcataagaaaagttattaaaattatctttgaaacacctcttgaagctaatttattagaaaaaatatttcagttggaaggctgtagaagtaatgtttaaatgctaagtcataagttcaggatatttcttttctatttggttgtgcaaaatgtttttcccagttatttaatcgaagtaattccttttaatagaaagagtcagttaaaattcagcattcatggatagatttttggaacgaaaaagggtaagtataagaaaatattgcaaacacattaaaacagttgtatggtgcaggaaaagaagattggaaaaagaccaaaacacacttctccagcaacactccatcagctttttaaaatttagagctatctgctaattttttccctcttccttctcaataaatgaaacaaacactgggcagctgcaggtttctcccaatcatgtctctttatgtaaagacagtaacatgcaaacacttttagtttacatccctcattcacagtgtaaagcaggaaatggtgtgggagatgtgagaccattctgaggtcagcgatagcccaaaggctctgcagtattccctccaatggccaaggattccgtgtgtcatctgcaggagtgagtaggcctgctgtatttcttgtaactgctgggtgttacaaaataagttacaatgttttacactttaaaaaaaaaacagaaggaacatttgctttattggttacttactagtttagcctctaggttatggcacagcatgctaaaaaatcatgtgtttaaaagtaaatgttggtaaaatgctggcatctggtcctattgtgttgatgcattttcacttctgtggtcataggaaatggactggtctaaagagagtgaggcacaacacaagcagggcattagtttgaataggaagtcaatcatatttggttttatggcctggtgtattttgggtttaagataaaatagggaaaaatgtcagaaatgatccctatgcatttattttcatggatacccttaatttcatgggcatgcctaataatgatctatgttctaactggagcttagggcttattttagatattggagtgtagctttattacagatggattttatctttcaacattgcattttgatcaactttgtatattcacgtgtattaaaatattgtgcactaaatgttttgcccttgtttgctattatatggtcaaggcatttatcagcactattgtaatgaactcatgtaagtggcatgggtcagggaaaattatttcctacttttctgcctaattaaatttctgttttccagtattacattaatttatttttggcttccatttctgtataaccaaaatagttactgtatttgtgtggcattcctattattttgttgctaaaaatattgtagtttttatttaaaataatctgtaccttaattttttaaaatgtaaccaattcaagcactttaagcaataatgtcaatcttgtgaaattttaatcagtttaacaccctgcctctaaaattgtttgcaaaaaataaataaatgaataaaatgggaa

SEQ ID NO: 33565 - DNA, 1419 bp, Homo sapiens
tgttatgtcatctaccaggtgtttaagggacagtggagatcatgccatttcagacctggtggaagcaaccactaatataaacacctcccatgtataggaaggctggagtgggaatccttaaccccgccccctgctcaggtcaatcccccacccaccgcccccactgtccctcccagtcttccttcccagaggagaaggctgggtatgaggaaactgctgtcttttcactggatcagacgtaaatattaactggacctctctttagattctttgctcaataatgaattgttttcagggcaccaatgcctctgctctggaaaaagacattggtccagagcagtttccaatcaatgaacactatttcggattggtcaattttggaaacacatgctactgtaactccgtgcttcaggcattgtacttctgccgtccattccgggagaatgtgttggcatacaaggcccagcaaaagaagaaggaaaacttgctgacgtgcctggcggaccttttccacagcattgccacacagaagaagaaggttggcgtcatcccaccaaagaagttcatttcaaggctgagaaaagagaatgatctctttgataactacatgcagcaggatgctcatgaatttttaaattatttgctaaacactattgcggacatccttcaggaggagaagaaacaggaaaaacaaaatggaaaattaaaaaatggcaacatgaacgaacctgcggaaaataataaaccagaactcacctgggtccatgagatttttcagggaacgcttaccaatgaaactcgatgcttgaactgtgaaactgttagtagcaaagatgaagattttcttgacctttctgttgatgtggagcagaatacatccattacccactgtctaagagacttcagcaacacagaaacactgtgtagtgaacaaaaatattattgtgaaacatgctgcagcaaacaagaagcccagaaaaggatgagggtaaaaaagctgcccatgatcttggccctgcacctaaagcggttcaagtacatggagcagctgcacagatacaccaagctgtcttaccgtgtggtcttccctctggaactccggctcttcaacacctccagtgatgcagtgaacctggaccgcatgtatgacttggttgcggtggtcgttcactgtggcagtggtcctaatcgtgggcattatatcactattgtgaaaagtcacggcttctggcttttgtttgatgatgacattgtagagaaaatagatgctcaagctattgaagaattctatggcctgacgtcagatatatcaaaaaattcagaatctggatatattttattctatcagtcaagagagtaactgaaagacctgcgggactgattcacgtggggagaatgttcacagcactgtcacccggc

SEQ ID NO: 33566 - DNA, 7976 bp, Homo sapiens
ctaaaaataccattaagtaatagtattagcttttgtattctgagattcaacagcagcagtcacttccctccactcctatgtgtatcccaggaccaccctgggcggggagggctgaggtcagggaggtctgaagctggtcctgggctccgggggtgacagtgatgaggaactgggtgcacacatgagtggggcagccgggcctggccagagaagcaacacacacgtgcacagacatgtttatccacatacacatgtgcacgcatgtgcacaaacacattgcaggcaggcatgttgacgcctcaggcagcggaggaccctgactctgggccctgctgacccaggcaaggccccattgtgatgcgtgccatgacctcagaatgtcactggtgcttagcacctatccgctctccagactgcgtctgtgttctacggcagttacacacacgcagtggtattcacaagcggttttgtggactcaaaggttttctccctgagaggcataacccaggccagctgattcatcagaatcaggtgagtgtgacctgctctcttccctccaggctgacttggggacagtggctatggtatgggcggtgttggcctctgggcagctacagaggagggtcatccctgagcactcaccgggcgcccgttctacactgcccatgtagacgattttctctttcgtcttcatggtggcttcgtagagtgggtgctgttcccgaatgtacccattcgacaggtgagccgtctggggtcagagaggcagtaactggcctgggaatccagacaagaccctgggttttgctctcagccctgctgtgtgccatgctagacttcaggcctcaaccctgagacctccctgctctagatcccaaatctgcccagatttccgatcccaatggggcagagcctggccctggcagagacactgggatggatccactgtgggtggggaggagggaagggtcctcagaacacacctggggcctaagctgggtcttgatggtcactgtgggacccactggacacacacagtcccttgtctgggagtggcatggggagccttctgcccttgggcagttgtggaaagtgaaggagccctggagagctggctgaggggagactatcttcccttgtgttcaaaggggtccaggcactggggctctccccaagtatttcttattctgtctggcctcgctttccttttgccctgagtattctcaggagggacggtccatctagatgtcctccaggagcaaggacccactgttcttcatcagtgacccaggaaaatgaagccccctcctgtggggacagctcagaatggtggagtccacagtccctccctgagagacatggtttccatgagcacagtggctgctttggagacagtaatcattttcatccccaaaaccaaacacactcctgctcaaatggtgttattgctaaagcagcttcactggttagactgaagggccatggtagcccaagtgatgagcggggtagaatggagcagtcaggagagatcttgttccccgtaggaaactgggcatctctgtggccctgaacatcccaggaggccgatcgtacagagacctctggtgcctgaccgcagttcacatccacatccctggaatagaccatcacaggctcttcacccttggcaggtggacaccattcaacctgccggggcaggatggacatggtagagaatgcagatagtttgcaggcacaggagcggaaggacatacttatgaagtatgacaagggacaccgagctgggctgccagaggacaaggggcctgagcccgttggaatcaacagcagcattgatcgttttggcattttgcatgagacggagctgcctcctgtgactgcacgggaggcgaagaaaattcggcgggagatgacacgaacgagcaagtggatggaaatgctgggagaatgggagacatataagcacagtagcaaactcatagatcgagtgtacaagggaattcccatgaacatccggggcccggtgtggtcagtcctcctgaacattcaggaaatcaagttgaaaaaccccggaagataccagatcatgaaggagaggggcaagaggtcatctgaacacatccaccacatcgacctggacgtgaggacgactctccggaaccatgtcttctttagggatcgatatggagccaagcagagggaactattctacatcctcctggcctattcggagtataacccggaggtgggctactgcagggacctgagccacatcaccgccttgttcctcctttatctgcctgaggaggacgcattctgggcactggtgcagctgctggccagtgagaggcactccctgccaggattccacagcccaaatggtgggacagtccaggggctccaagaccaacaggagcatgtggtacccaagtcacaacccaagaccatgtggcatcaggacaaggaaggtctatgcgggcagtgtgcctcgttaggctgccttctccggaacctgattgacgggatctctctcgggctcaccctgcgcctgtgggacgtgtatttggtggaaggagaacaggtgttgatgccaataaccagcattgctcttaaggttcagcagaagcgcctcatgaagacatccaggtgtggcctgtgggcacgtctgcggaaccaattcttcgatacctgggccatgaacgatgacaccgtgctcaagcatcttagggcctctacgaagaaactaacaaggaagcaaggggacctgccacccccagccaaacgcgagcaagggtccttggcacccaggcctgtgccggcttcacgtggtgggaagaccctctgcaaggggtataggcaggcccctccaggcccaccagcccagttccagcggcccatttgctcagcttccccgccatgggcatctcgtttttccacgccctgtcctggtggggctgtccgggaagacacgtaccctgtgggcactcagggtgtgcccagcctggccctggctcagggaggacctcagggttcctggagattcctggagtggaagtcaatgccccggctcccaacggacctggatatagggggcccttggttcccccattatgattttgaatggagctgctgggtccgtgccatatcccaggaggaccagctggccacctgctggcaggctgaacactgcggagaggttcacaacaaagatatgagttggcctgaggagatgtcttttacagcaaatagtagtaaaatagatagacaaaaggttcccacagaaaagggagccacaggtctaagcaacctgggaaacacatgcttcatgaactcaagcatccagtgcgttagtaacacacagccactgacacagtattttatctcagggagacatctttatgaactcaacaggacaaatcccattggtatgaaggggcatatggctaaatgctatggtgatttagtgcaggaactctggagtggaactcagaagagtgttgccccattaaagcttcggcggaccatagcaaaatatgctcccaagtttgatgggtttcagcaacaagactcccaagaacttctggcttttctcttggatggtcttcatgaagatctcaaccgagtccatgaaaagccatatgtggaactgaaggacagtgatggccgaccagactgggaagtagctgcagaggcctgggacaaccatctaagaagaaatagatcaattattgtggatttgttccatgggcagctaagatctcaagtcaaatgcaagacatgtgggcatataagtgtccgatttgaccctttcaattttttgtctttgccactaccaatggacagttacatggacttagaaataacagtgattaagttagatggtactacccctgtacggtatggactaagactgaatatggatgaaaagtacacaggtttaaaaaaacagctgagggatctctgtggacttaattcagaacaaatcctactagcagaagtacatgattccaacataaagaactttcctcaggataaccaaaaagtacaactctcagtgagcggatttttgtgtgcatttgaaattcctgtcccttcatctccaatttcagcttctagtccaacacaaatagatttctcctcttcaccatctacaaatggaatgttcaccctaactaccaatggggacctacccaaaccaatattcatccccaatggaatgccaaacactgttgtgccatgtggaactgagaagaacttcacaaatggaatggttaatggtcacatgccatctcttcctgacagcccctttacaggttacatcattgcagtccaccgaaaaatgatgaggacagaactgtatttcctgtcacctcaggagaatcgccccagcctctttggaatgccattgattgttccatgcactgtgcatacccggaagaaagacctatatgatgcggtttggattcaagtatcctggttagcaagaccactcccacctcaggaagctagtattcatgcccaggatcgtgataactgtatgggctatcaatatccattcactctacgagttgtgcagaaagatgggaactcctgtgcttggtgcccacagtatagattttgcagaggctgtaaaattgattgtggggaagacagagctttcattggaaatgcctatattgctgtggattggcaccccacagcccttcaccttcgctatcaaacatcccaggaaagggttgtagataagcatgagagtgtggagcagagtcggcgagcgcaagccgagcccatcaacctggacagctgtctccgtgctttcaccagtgaggaagagctaggggaaagtgagatgtactactgttccaagtgtaagacccactgcttagcaacaaagaagctggatctctggaggcttccacccttcctgattattcaccttaagcgatttcaatttgtaaatgatcagtggataaaatcacagaaaattgtcagatttcttcgggaaagttttgatccgagtgcttttttggtaccacgagacccggccctctgccagcataaaccactcacaccccagggggatgagctctccaagcccaggattctggcaagagaggtgaagaaagtggatgcgcagagttcggctggaaaagaggacatgctcctaagcaaaagcccatcctcactcagcgctaacatcagcagcagcccaaaaggttctccttcttcatcaagaaaaagtggaaccagctgtccctccagcaaaaacagcagccctaatagcagcccacggactttggggaggagcaaagggaggctccggctgccccagattggcagcaaaaataagccgtcaagtagtaagaagaacttggatgccagcaaagagaatggggctgggcagatctgtgagctggctgacgccttgagccgagggcatatgcgggggggcagccaaccagagctggtcactcctcaggaccatgaggtagctttggccaatggattcctttatgagcatgaagcatgtggcaatggctgtggcgatggctacagcaatggtcagcttggaaaccacagtgaagaagacagcactgatgaccaaagagaagacactcatattaagcctatttataatctatatgcaatttcatgccattcaggaattctgagtgggggccattacatcacttatgccaaaaacccaaactgcaagtggtactgttataatgacagcagctgtgaggaacttcaccctgatgaaattgacaccgactctgcctacattcttttctatgagcagcaggggatagactacgcacaatttctgccaaagattgatggcaaaaagatggcagacacaagcagtacggatgaagactctgagtctgattacgaaaagtactctatgttacagtaaagctaccactctggctgctagacagcttggtggcgagggagatgactccttgtagctgatacttggcaaaagtgtcactgaaagacaagctaaatgtagttattttatcctgttagaacaaaaattctaattaaaatagttaacttgaagagtagaaacaattgtattttgaagtctcatacaagctgtctgatagagaactttcaggcagatcccaccattagcctgtaaacaaaaggtgtggcaccagccacctgggaccaaataagaattgaattgtgcttgtccagatatgaacaaatatgtagtgagtatagagtttaccaataatcataacaaatattaaagatttccttggagtcagaggaaaaaacaaacaattataatgttgtctagggacgacatgatacgctacctcctttttcctgaagttttattccattatattgacaagatggagaaagcaagatcatgaaggtgtgcaaatgattcttacggcatggacaaggatttttcaatttattttttaaactgtttccataccctttctttttcttgctttttgtttttgccattgtgtttacgtttgagacacaaccagtcattggtggcaggggcatagagtggtcagtctgaaagggaggctctcttaagagctatgtgccttccaaccagagggagacccagtagaaagaaaaacatcctgggaaatccagctaccagggccctcccagtggaggcatcttacatttaggctacttcaagtatcctcagaaatgtattctgcacccccggccccgcccatgctgagggaaggggagcagttgccaatatttgcaccatcttcacatgcacatgttgcaacaagagcttctgggaaggtaagcggcatcggagctagatcacgtttcacaattagtggttattcttttctgtgtttgttttgcactttaaaaaagagagaacacatgcaaatgaacttgcttgtgtgtatttgatggctctaagggctataaattacaaacaaaacacatcccagacattaggagttcataagtatatttaatgaaattggtggttttaggaagtcaactttagttttgctttgtttgcatgtccactggtttttttattttgatatttgtctttttttaaattttacagtagtcattgaaagttatgtttctttgcttacttcattttttccctctaattatttaagattggaacaaaagtataaatattatttatttgaggtagaatttttttcatgtagtttcttaatatatacttgaaggaaatgtttcaccttatttttggtctttgtttattcatttagaccctgcaagttgattctcattgccagattccattaccctttcttcctcataggtagtaattaccaatgtaactaagcatttgtgttctgatatctgaggccagtaactattaatatctagttctcagagcatttggaaaggttatcttaaatggctacctaaattgaaatccttttcagaaaaaatataattgcaagtaggtaggagtggcctaaattgtctaatgtaataaagtcagacaaaatgcacactttatagtttcaagattttcagtaaataaaatctgtccattcctacctggacatgtcccattaaaaagtggaagattttaaataatttctttacagatgttttatttaaacaggtagcacaatctactaatgttgtgtgatttgtgttatactggttgtaattaatttttttaattcatgaactagcggaaaatttattaaattaactattaactacattcaccttgtaaattactgtataaaacttgttgacaatgcactgactttagaaagatgttaatgtacataaatagagtgtaaataaaatagtgttgatgtactgaaatatgaactgtatcaaaagtattggtaattgtatatggggtgtacctgtttatctgttaactattatccaaacaaattaaatactgtggttgcctctatgtgctgtttttcctcatacaagtaaacacagaaagtcaaatt

SEQ ID NO: 33567 - DNA, 8182 bp, Homo sapiens
ctaaaaataccattaagtaatagtattagcttttgtattctgagattcaacagcagcagtcacttccctccactcctatgtgtatcccaggaccaccctgggcggggagggctgaggtcagggaggtctgaagctggtcctgggctccgggggtgacagtgatgaggaactgggtgcacacatgagtggggcagccgggcctggccagagaagcaacacacacgtgcacagacatgtttatccacatacacatgtgcacgcatgtgcacaaacacattgcaggcaggcatgttgacgcctcaggcagcggaggaccctgactctgggccctgctgacccaggcaaggccccattgtgatgcgtgccatgacctcagaatgtcactggtgcttagcacctatccgctctccagactgcgtctgtgttctacggcagttacacacacgcagtggtattcacaagcggttttgtggactcaaaggttttctccctgagaggcataacccaggccagctgattcatcagaatcaggtgagtgtgacctgctctcttccctccaggctgacttggggacagtggctatggtatgggcggtgttggcctctgggcagctacagaggagggtcatccctgagcactcaccgggcgcccgttctacactgcccatgtagacgattttctctttcgtcttcatggtggcttcgtagagtgggtgctgttcccgaatgtacccattcgacaggtgagccgtctggggtcagagaggcagtaactggcctgggaatccagacaagaccctgggttttgctctcagccctgctgtgtgccatgctagacttcaggcctcaaccctgagacctccctgctctagatcccaaatctgcccagatttccgatcccaatggggcagagcctggccctggcagagacactgggatggatccactgtgggtggggaggagggaagggtcctcagaacacacctggggcctaagctgggtcttgatggtcactgtgggacccactggacacacacagtcccttgtctgggagtggcatggggagccttctgcccttgggcagttgtggaaagtgaaggagccctggagagctggctgaggggagactatcttcccttgtgttcaaaggggtccaggcactggggctctccccaagtatttcttattctgtctggcctcgctttccttttgccctgagtattctcaggagggacggtccatctagatgtcctccaggagcaaggacccactgttcttcatcagtgacccaggaaaatgaagccccctcctgtggggacagctcagaatggtggagtccacagtccctccctgagagacatggtttccatgagcacagtggctgctttggagacagtaatcattttcatccccaaaaccaaacacactcctgctcaaatggtgttattgctaaagcagcttcactggttagactgaagggccatggtagcccaagtgatgagcggggtagaatggagcagtcaggagagatcttgttccccgtaggaaactgggcatctctgtggccctgaacatcccaggaggccgatcgtacagagacctctggtgcctgaccgcagttcacatccacatccctggaatagaccatcacaggctcttcacccttggcaggtggacaccattcaacctgccggggcaggatggacatggtagagaatgcagatagtttgcaggcacaggagcggaaggacatacttatgaagtatgacaagggacaccgagctgggctgccagaggacaaggggcctgagcccgttggaatcaacagcagcattgatcgttttggcattttgcatgagacggagctgcctcctgtgactgcacgggaggcgaagaaaattcggcgggagatgacacgaacgagcaagtggatggaaatgctgggagaatgggagacatataagcacagtagcaaactcatagatcgagtgtacaagggaattcccatgaacatccggggcccggtgtggtcagtcctcctgaacattcaggaaatcaagttgaaaaaccccggaagataccagatcatgaaggagaggggcaagaggtcatctgaacacatccaccacatcgacctggacgtgaggacgactctccggaaccatgtcttctttagggatcgatatggagccaagcagagggaactattctacatcctcctggcctattcggagtataacccggaggtgggctactgcagggacctgagccacatcaccgccttgttcctcctttatctgcctgaggaggacgcattctgggcactggtgcagctgctggccagtgagaggcactccctgccaggattccacagcccaaatggtgggacagtccaggggctccaagaccaacaggagcatgtggtacccaagtcacaacccaagaccatgtggcatcaggacaaggaaggtctatgcgggcagtgtgcctcgttaggctgccttctccggaacctgattgacgggatctctctcgggctcaccctgcgcctgtgggacgtgtatttggtggaaggagaacaggtgttgatgccaataaccagcattgctcttaaggttcagcagaagcgcctcatgaagacatccaggtgtggcctgtgggcacgtctgcggaaccaattcttcgatacctgggccatgaacgatgacaccgtgctcaagcatcttagggcctctacgaagaaactaacaaggaagcaaggggacctgccacccccaggcccaacagccctgggacgaaggtgtgtggcaggaagcccccagccagtctgaaccctgggggcagtcccaggagccacccaccatgccccaacggcttccccatgccaggcagcacacacccctccctctgggatcagcagactacaggcgtgtcgtcagtgtcagaccacaggggccacacagagaccccaaggactccagagatgcagccaaacgcgagcaagggtccttggcacccaggcctgtgccggcttcacgtggtgggaagaccctctgcaaggggtataggcaggcccctccaggcccaccagcccagttccagcggcccatttgctcagcttccccgccatgggcatctcgtttttccacgccctgtcctggtggggctgtccgggaagacacgtaccctgtgggcactcagggtgtgcccagcctggccctggctcagggaggacctcagggttcctggagattcctggagtggaagtcaatgccccggctcccaacggacctggatatagggggcccttggttcccccattatgattttgaatggagctgctgggtccgtgccatatcccaggaggaccagctggccacctgctggcaggctgaacactgcggagaggttcacaacaaagatatgagttggcctgaggagatgtcttttacagcaaatagtagtaaaatagatagacaaaaggttcccacagaaaagggagccacaggtctaagcaacctgggaaacacatgcttcatgaactcaagcatccagtgcgttagtaacacacagccactgacacagtattttatctcagggagacatctttatgaactcaacaggacaaatcccattggtatgaaggggcatatggctaaatgctatggtgatttagtgcaggaactctggagtggaactcagaagagtgttgccccattaaagcttcggcggaccatagcaaaatatgctcccaagtttgatgggtttcagcaacaagactcccaagaacttctggcttttctcttggatggtcttcatgaagatctcaaccgagtccatgaaaagccatatgtggaactgaaggacagtgatggccgaccagactgggaagtagctgcagaggcctgggacaaccatctaagaagaaatagatcaattattgtggatttgttccatgggcagctaagatctcaagtcaaatgcaagacatgtgggcatataagtgtccgatttgaccctttcaattttttgtctttgccactaccaatggacagttacatggacttagaaataacagtgattaagttagatggtactacccctgtacggtatggactaagactgaatatggatgaaaagtacacaggtttaaaaaaacagctgagggatctctgtggacttaattcagaacaaatcctactagcagaagtacatgattccaacataaagaactttcctcaggataaccaaaaagtacaactctcagtgagcggatttttgtgtgcatttgaaattcctgtcccttcatctccaatttcagcttctagtccaacacaaatagatttctcctcttcaccatctacaaatggaatgttcaccctaactaccaatggggacctacccaaaccaatattcatccccaatggaatgccaaacactgttgtgccatgtggaactgagaagaacttcacaaatggaatggttaatggtcacatgccatctcttcctgacagcccctttacaggttacatcattgcagtccaccgaaaaatgatgaggacagaactgtatttcctgtcacctcaggagaatcgccccagcctctttggaatgccattgattgttccatgcactgtgcatacccggaagaaagacctatatgatgcggtttggattcaagtatcctggttagcaagaccactcccacctcaggaagctagtattcatgcccaggatcgtgataactgtatgggctatcaatatccattcactctacgagttgtgcagaaagatgggaactcctgtgcttggtgcccacagtatagattttgcagaggctgtaaaattgattgtggggaagacagagctttcattggaaatgcctatattgctgtggattggcaccccacagcccttcaccttcgctatcaaacatcccaggaaagggttgtagataagcatgagagtgtggagcagagtcggcgagcgcaagccgagcccatcaacctggacagctgtctccgtgctttcaccagtgaggaagagctaggggaaagtgagatgtactactgttccaagtgtaagacccactgcttagcaacaaagaagctggatctctggaggcttccacccttcctgattattcaccttaagcgatttcaatttgtaaatgatcagtggataaaatcacagaaaattgtcagatttcttcgggaaagttttgatccgagtgcttttttggtaccacgagacccggccctctgccagcataaaccactcacaccccagggggatgagctctccaagcccaggattctggcaagagaggtgaagaaagtggatgcgcagagttcggctggaaaagaggacatgctcctaagcaaaagcccatcctcactcagcgctaacatcagcagcagcccaaaaggttctccttcttcatcaagaaaaagtggaaccagctgtccctccagcaaaaacagcagccctaatagcagcccacggactttggggaggagcaaagggaggctccggctgccccagattggcagcaaaaataagccgtcaagtagtaagaagaacttggatgccagcaaagagaatggggctgggcagatctgtgagctggctgacgccttgagccgagggcatatgcgggggggcagccaaccagagctggtcactcctcaggaccatgaggtagctttggccaatggattcctttatgagcatgaagcatgtggcaatggctgtggcgatggctacagcaatggtcagcttggaaaccacagtgaagaagacagcactgatgaccaaagagaagacactcatattaagcctatttataatctatatgcaatttcatgccattcaggaattctgagtgggggccattacatcacttatgccaaaaacccaaactgcaagtggtactgttataatgacagcagctgtgaggaacttcaccctgatgaaattgacaccgactctgcctacattcttttctatgagcagcaggggatagactacgcacaatttctgccaaagattgatggcaaaaagatggcagacacaagcagtacggatgaagactctgagtctgattacgaaaagtactctatgttacagtaaagctaccactctggctgctagacagcttggtggcgagggagatgactccttgtagctgatacttggcaaaagtgtcactgaaagacaagctaaatgtagttattttatcctgttagaacaaaaattctaattaaaatagttaacttgaagagtagaaacaattgtattttgaagtctcatacaagctgtctgatagagaactttcaggcagatcccaccattagcctgtaaacaaaaggtgtggcaccagccacctgggaccaaataagaattgaattgtgcttgtccagatatgaacaaatatgtagtgagtatagagtttaccaataatcataacaaatattaaagatttccttggagtcagaggaaaaaacaaacaattataatgttgtctagggacgacatgatacgctacctcctttttcctgaagttttattccattatattgacaagatggagaaagcaagatcatgaaggtgtgcaaatgattcttacggcatggacaaggatttttcaatttattttttaaactgtttccataccctttctttttcttgctttttgtttttgccattgtgtttacgtttgagacacaaccagtcattggtggcaggggcatagagtggtcagtctgaaagggaggctctcttaagagctatgtgccttccaaccagagggagacccagtagaaagaaaaacatcctgggaaatccagctaccagggccctcccagtggaggcatcttacatttaggctacttcaagtatcctcagaaatgtattctgcacccccggccccgcccatgctgagggaaggggagcagttgccaatatttgcaccatcttcacatgcacatgttgcaacaagagcttctgggaaggtaagcggcatcggagctagatcacgtttcacaattagtggttattcttttctgtgtttgttttgcactttaaaaaagagagaacacatgcaaatgaacttgcttgtgtgtatttgatggctctaagggctataaattacaaacaaaacacatcccagacattaggagttcataagtatatttaatgaaattggtggttttaggaagtcaactttagttttgctttgtttgcatgtccactggtttttttattttgatatttgtctttttttaaattttacagtagtcattgaaagttatgtttctttgcttacttcattttttccctctaattatttaagattggaacaaaagtataaatattatttatttgaggtagaatttttttcatgtagtttcttaatatatacttgaaggaaatgtttcaccttatttttggtctttgtttattcatttagaccctgcaagttgattctcattgccagattccattaccctttcttcctcataggtagtaattaccaatgtaactaagcatttgtgttctgatatctgaggccagtaactattaatatctagttctcagagcatttggaaaggttatcttaaatggctacctaaattgaaatccttttcagaaaaaatataattgcaagtaggtaggagtggcctaaattgtctaatgtaataaagtcagacaaaatgcacactttatagtttcaagattttcagtaaataaaatctgtccattcctacctggacatgtcccattaaaaagtggaagattttaaataatttctttacagatgttttatttaaacaggtagcacaatctactaatgttgtgtgatttgtgttatactggttgtaattaatttttttaattcatgaactagcggaaaatttattaaattaactattaactacattcaccttgtaaattactgtataaaacttgttgacaatgcactgactttagaaagatgttaatgtacataaatagagtgtaaataaaatagtgttgatgtactgaaatatgaactgtatcaaaagtattggtaattgtatatggggtgtacctgtttatctgttaactattatccaaacaaattaaatactgtggttgcctctatgtgctgtttttcctcatacaagtaaacacagaaagtc

SEQ ID NO: 33568 - DNA, 8351 bp, Homo sapiens
gccgccgtctcgtgtggtgtctgaggggcgtctacctggagtcactgagccgacgaaagggaaaaggccagtgcctgtccgggaagagctcagcctagtggggcgggcgacaagttacagttgctgccttacgatggccgtggcccgtggaggcactagaccctcaccaggggtctgtcaggaaaggcgggcagatacgtgaggcctgaacaggaaggaactgggagacccaagactgtaccgccaagaccgctttcgagtcgggccgaccggaatttgaattcgtttcttcacttactagttgatttttttccttgattccttcgtgggactcaagacaggggtgccctgtttactcagcccactgtgctcaacctcttgcaggagtgtgcaggaaatgaaggccctttgaggtcaggtggatgaggatgtcagtgtgaagatggacactgtgcctggagtgaacctgagctggatcctgaatgagatgcatgaccaggacaagaaattggtggagaagagctacaaggatgccaagggctgtttcttcagcatgagagaggggctgaactgcgaggtggccaccaacacagaggccctgcagagcggcaggatagagatatggagctctacatctctgtgcagaacctgagccatcccagctcagcaaggtagggcctctgtcccctccccaccctgtacctatcaccccagggtgagcccagccttatagacccctgcttggaggtgtgttacgggacccaactggcccagctgcaggggctcatcagaagcatggagcagcagctgtgcgagctctgctgcgacgcggagcaccaggaccatgagcaccaggtccttctggacgtgaagacacggctggagcaggagatcgccacctacagccgcttgctagaggttgaggacgctcaagtcacagggagaagacgtccacccacacatcaggagacaggcctggaacagagccttcctgcacagcctcagaagggacccaccctggtgacaccttgatcttggactgacactcatgacctccagtactgtgagacagtaacattctgttgttgaaggtgcccagtctgtggtactgtaaaacagccctgggaaactaacgcagcctgttagcccacagatggtgaagggatggaatgctccacggagctccaggcttactatctacagcccccaaagtgtgctgcgggacccttgggtgggtgtaggtatgcaaggtaattttgggtggttcaaggtgaataatttcaattgacataataatgtatttatcttgctgggtaaatgagggatacccaactgttaggaaccaggcaacacagcaggaggtgagcagccagccagtgagcaaagcttcatctgtagaaacagccacttcccatccctcgcattaccgcatgagctctgcctcctgtcagatgagcggtgccgttagattctcacagaagcatgaaccctactgtgaactgcgcatgccagggatctagattgcgtgctccttatgagaacctaatgcctgatgatctgtgactgtctcatcactgccagatggaaccacgtagttgcaggaaaacaagttcagggctcccactgattctacattatggctggagtgcaatggcgcaatctcggctctctgcaacttccgcctcctgggttcaagcaattctcctgcctcagcctcccgagtagctgggactacaggcatgtgccaccatgcctggggctgtcattgggacagtctgagatggggagtcgggggagacaatggatgaatggatggatgaatggacagcagtccagggagatgtccctgtgtgtcctgaactgggcccttcctccagtgagaagccttcctgagctgacttggggacagtggctatggtatgggcggtgttggcctctgggcagctacagaggagggtcatccctgagcactcaccgggcgcccgttctacactgcccatgtagacgattttctctttcgtcttcatggtggcttcgtagagtgggtgctgttcccgaatgtacccattcgacaggaaactgggcatctctgtggccctgaacatcccaggaggccgatcgtacagagacctctggtgcctgaccgcagttcacatccacatccctggaatagaccatcacaggctcttcacccttggcaggtggacaccattcaacctgccggggcaggatggacatggtagagaatgcagatagtttgcaggcacaggagcggaaggacatacttatgaagtatgacaagggacaccgagctgggctgccagaggacaaggggcctgagcccgttggaatcaacagcagcattgatcgttttggcattttgcatgagacggagctgcctcctgtgactgcacgggaggcgaagaaaattcggcgggagatgacacgaacgagcaagtggatggaaatgctgggagaatgggagacatataagcacagtagcaaactcatagatcgagtgtacaagggaattcccatgaacatccggggcccggtgtggtcagtcctcctgaacattcaggaaatcaagttgaaaaaccccggaagataccagatcatgaaggagaggggcaagaggtcatctgaacacatccaccacatcgacctggacgtgaggacgactctccggaaccatgtcttctttagggatcgatatggagccaagcagagggaactattctacatcctcctggcctattcggagtataacccggaggtgggctactgcagggacctgagccacatcaccgccttgttcctcctttatctgcctgaggaggacgcattctgggcactggtgcagctgctggccagtgagaggcactccctgccaggattccacagcccaaatggtgggacagtccaggggctccaagaccaacaggagcatgtggtacccaagtcacaacccaagaccatgtggcatcaggacaaggaaggtctatgcgggcagtgtgcctcgttaggctgccttctccggaacctgattgacgggatctctctcgggctcaccctgcgcctgtgggacgtgtatttggtggaaggagaacaggtgttgatgccaataaccagcattgctcttaaggttcagcagaagcgcctcatgaagacatccaggtgtggcctgtgggcacgtctgcggaaccaattcttcgatacctgggccatgaacgatgacaccgtgctcaagcatcttagggcctctacgaagaaactaacaaggaagcaaggggacctgccacccccagccaaacgcgagcaagggtccttggcacccaggcctgtgccggcttcacgtggtgggaagaccctctgcaaggggtataggcaggcccctccaggcccaccagcccagttccagcggcccatttgctcagcttccccgccatgggcatctcgtttttccacgccctgtcctggtggggctgtccgggaagacacgtaccctgtgggcactcagggtgtgcccagcctggccctggctcagggaggacctcagggttcctggagattcctggagtggaagtcaatgccccggctcccaacggacctggatatagggggcccttggttcccccattatgattttgaatggagctgctgggtccgtgccatatcccaggaggaccagctggccacctgctggcaggctgaacactgcggagaggttcacaacaaagatatgagttggcctgaggagatgtcttttacagcaaatagtagtaaaatagatagacaaaaggttcccacagaaaagggagccacaggtctaagcaacctgggaaacacatgcttcatgaactcaagcatccagtgcgttagtaacacacagccactgacacagtattttatctcagggagacatctttatgaactcaacaggacaaatcccattggtatgaaggggcatatggctaaatgctatggtgatttagtgcaggaactctggagtggaactcagaagagtgttgccccattaaagcttcggcggaccatagcaaaatatgctcccaagtttgatgggtttcagcaacaagactcccaagaacttctggcttttctcttggatggtcttcatgaagatctcaaccgagtccatgaaaagccatatgtggaactgaaggacagtgatggccgaccagactgggaagtagctgcagaggcctgggacaaccatctaagaagaaatagatcaattattgtggatttgttccatgggcagctaagatctcaagtcaaatgcaagacatgtgggcatataagtgtccgatttgaccctttcaattttttgtctttgccactaccaatggacagttacatggacttagaaataacagtgattaagttagatggtactacccctgtacggtatggactaagactgaatatggatgaaaagtacacaggtttaaaaaaacagctgagggatctctgtggacttaattcagaacaaatcctactagcagaagtacatgattccaacataaagatttctcctcttcaccatctacaaatggaatgttcaccctaactaccaatggggacctacccaaaccaatattcatccccaatggaatgccaaacactgttgtgccatgtggaactgagaagaacttcacaaatggaatggttaatggtcacatgccatctcttcctgacagcccctttacaggttacatcattgcagtccaccgaaaaatgatgaggacagaactgtatttcctgtcacctcaggagaatcgccccagcctctttggaatgccattgattgttccatgcactgtgcatacccggaagaaagacctatatgatgcggtttggattcaagtatcctggttagcaagaccactcccacctcaggaagctagtattcatgcccaggatcgtgataactgtatgggctatcaatatccattcactctacgagttgtgcagaaagatgggaactcctgtgcttggtgcccacagtatagattttgcagaggctgtaaaattgattgtggggaagacagagctttcattggaaatgcctatattgctgtggattggcaccccacagcccttcaccttcgctatcaaacatcccaggaaagggttgtagataagcatgagagtgtggagcagagtcggcgagcgcaagccgagcccatcaacctggacagctgtctccgtgctttcaccagtgaggaagagctaggggaaagtgagatgtactactgttccaagtgtaagacccactgcttagcaacaaagaagctggatctctggaggcttccacccttcctgattattcaccttaagcgatttcaatttgtaaatgatcagtggataaaatcacagaaaattgtcagatttcttcgggaaagttttgatccgagtgcttttttggtaccacgagacccggccctctgccagcataaaccactcacaccccagggggatgagctctccaagcccaggattctggcaagagaggtgaagaaagtggatgcgcagagttcggctggaaaagaggacatgctcctaagcaaaagcccatcctcactcagcgctaacatcagcagcagcccaaaaggttctccttcttcatcaagaaaaagtggaaccagctgtccctccagcaaaaacagcagccctaatagcagcccacggactttggggaggagcaaagggaggctccggctgccccagattggcagcaaaaataagccgtcaagtagtaagaagaacttggatgccagcaaagagaatggggctgggcagatctgtgagctggctgacgccttgagccgagggcatatgcgggggggcagccaaccagagctggtcactcctcaggaccatgaggtagctttggccaatggattcctttatgagcatgaagcatgtggcaatggctgtggcgatggctacagcaatggtcagcttggaaaccacagtgaagaagacagcactgatgaccaaagagaagacactcatattaagcctatttataatctatatgcaatttcatgccattcaggaattctgagtgggggccattacatcacttatgccaaaaacccaaactgcaagtggtactgttataatgacagcagctgtgaggaacttcaccctgatgaaattgacaccgactctgcctacattcttttctatgagcagcaggggatagactacgcacaatttctgccaaagattgatggcaaaaagatggcagacacaagcagtacggatgaagactctgagtctgattacgaaaagtactctatgttacagtaaagctaccactctggctgctagacagcttggtggcgagggagatgactccttgtagctgatacttggcaaaagtgtcactgaaagacaagctaaatgtagttattttatcctgttagaacaaaaattctaattaaaatagttaacttgaagagtagaaacaattgtattttgaagtctcatacaagctgtctgatagagaactttcaggcagatcccaccattagcctgtaaacaaaaggtgtggcaccagccacctgggaccaaataagaattgaattgtgcttgtccagatatgaacaaatatgtagtgagtatagagtttaccaataatcataacaaatattaaagatttccttggagtcagaggaaaaaacaaacaattataatgttgtctagggacgacatgatacgctacctcctttttcctgaagttttattccattatattgacaagatggagaaagcaagatcatgaaggtgtgcaaatgattcttacggcatggacaaggatttttcaatttattttttaaactgtttccataccctttctttttcttgctttttgtttttgccattgtgtttacgtttgagacacaaccagtcattggtggcaggggcatagagtggtcagtctgaaagggaggctctcttaagagctatgtgccttccaaccagagggagacccagtagaaagaaaaacatcctgggaaatccagctaccagggccctcccagtggaggcatcttacatttaggctacttcaagtatcctcagaaatgtattctgcacccccggccccgcccatgctgagggaaggggagcagttgccaatatttgcaccatcttcacatgcacatgttgcaacaagagcttctgggaaggtaagcggcatcggagctagatcacgtttcacaattagtggttattcttttctgtgtttgttttgcactttaaaaaagagagaacacatgcaaatgaacttgcttgtgtgtatttgatggctctaagggctataaattacaaacaaaacacatcccagacattaggagttcataagtatatttaatgaaattggtggttttaggaagtcaactttagttttgctttgtttgcatgtccactggtttttttattttgatatttgtctttttttaaattttacagtagtcattgaaagttatgtttctttgcttacttcattttttccctctaattatttaagattggaacaaaagtataaatattatttatttgaggtagaatttttttcatgtagtttcttaatatatacttgaaggaaatgtttcaccttatttttggtctttgtttattcatttagaccctgcaagttgattctcattgccagattccattaccctttcttcctcataggtagtaattaccaatgtaactaagcatttgtgttctgatatctgaggccagtaactattaatatctagttctcagagcatttggaaaggttatcttaaatggctacctaaattgaaatccttttcagaaaaaatataattgcaagtaggtaggagtggcctaaattgtctaatgtaataaagtcagacaaaatgcacactttatagtttcaagattttcagtaaataaaatctgtccattcctacctggacatgtcccattaaaaagtggaagattttaaataatttctttacagatgttttatttaaacaggtagcacaatctactaatgttgtgtgatttgtgttatactggttgtaattaatttttttaattcatgaactagcggaaaatttattaaattaactattaactacattcaccttgtaaattactgtataaaacttgttgacaatgcactgactttagaaagatgttaatgtacataaatagagtgtaaataaaatagtgttgatgtactgaaatatgaactgtatcaaaagtattggtaattgtatatggggtgtacctgtttatctgttaactattatccaaacaaattaaatactgtggttgcctct

SEQ ID NO: 33569 - DNA, 576 bp, Homo sapiens
gtctgtgttctacggcagttacacacacgcagtggtattcacaagcggttttgtggactcaaaggttttctccctgagaggcataacccaggccagctgattcatcagaatcaggaaactgggcatctctgtggccctgaacatcccaggaggccgatcgtacagagacctctggtgcctgaccgcagttcacatccacatccctggaatagaccatcacaggctcttcacccttggcaggtggacaccattcaacctgccggggcaggatggacatggtagagaatgcagatagtttgcaggcacaggagcggaaggacatacttatgaagtatgacaagggacaccgagctgggctgccagaggacaaggggcctgagcccgttggaatcaacagcagcattgatcgttttggcattttgcatgagacggagctgcctcctgtgactgcacgggaggcgaagaaaattcggcgggagatgacaccgtgctcaagcatcttagggcctctacgaagaaactaacaaggaagcaaggggacctgccacccccagccaaacgcgagcaagggtcctt

SEQ ID NO: 33570 - DNA, 572 bp, Homo sapiens
gtctgtgttctacggcagttacacacacgcagtggtattcacaagcggttttgtggactcaaaggttttctccctgagaggcataacccaggccagctgattcatcagaatcaggaaactgggcatctctgtggccctgaacatcccaggaggccgatcgtacagagacctctggtgcctgaccgcagttcacatccacatccctggaatagaccatcacaggctcttcacccttggcaggtggacaccattcaacctgccggggcaggatggacatggtagagaatgcagatagtttgcaggcacaggagcggaaggacatacttatgaagtatgacaagggacaccgagctgggctgccagaggacaaggggagcccgttggaatcaacagcagcattgatcgttttggcattttgcatgagacggagctgcctcctgtgactgcacgggaggcgaagaaaattcggcgggagatgacaccgtgctcaagcatcttagggcctctacgaagaaactaacaaggaagcaaggggacctgccacccccagccaaacgcgagcaagggtcctt

SEQ ID NO: 33571 - DNA, 5412 bp, Homo sapiens
gtacgtgcgcgtctccctgccgccgccgccgcccgccgcgggccgccccggggccgccgtcgccgacgacgcgcgggaggaggaggaggaggccgccccgccgccgccgccgccgccgccgccccggctcgccgccgcccgcccgccgggctcgcagccccggcccccggccgcaggcgaggcccaggccgcggccgacatgaaccaccagcagcagcagcagcagcagaaagcgggcgagcagcagttgagcgagcccgaggacatggagatggaagcgggagatacagatgacccaccaagaattactcagaaccctgtgatcaatgggaatgtggccctgagtgatggacacaacaccgcggaggaggacatggaggatgacaccagttggcgctccgaggcaacctttcagttcactgtggagcgcttcagcagactgagtgagtcggtccttagccctccgtgttttgtgcgaaatctgccatggaagattatggtgatgccacgcttttatccagacagaccacaccaaaaaagcgtaggattctttctccagtgcaatgctgaatctgattccacgtcatggtcttgccatgcacaagcagtgctgaagataataaattacagagatgatgaaaagtcgttcagtcgtcgtattagtcatttgttcttccataaagaaaatgattggggattttccaattttatggcctggagtgaagtgaccgatcctgagaaaggatttatagatgatgacaaagttacctttgaagtctttgtacaggcggatgctccccatggagttgcgtgggattcaaagaagcacacaggctacgtcggcttaaagaatcagggagcgacttgttacatgaacagcctgctacagacgttatttttcacgaatcagctacgaaaggctgtgtacatgatgccaaccgagggggatgattcgtctaaaagcgtccctttagcattacaaagagtgttctatgaattacagcatagtgataaacctgtaggaacaaaaaagttaacaaagtcatttgggtgggaaactttagatagcttcatgcaacatgatgttcaggagctttgtcgagtgttgctcgataatgtggaaaataagatgaaaggcacctgtgtagagggcaccatacccaaattattccgcggcaaaatggtgtcctatatccagtgtaaagaagtagactatcggtctgatagaagagaagattattatgatatccagctaagtatcaaaggaaagaaaaatatatttgaatcatttgtggattatgtggcagtagaacagctcgatggggacaataaatacgacgctggggaacatggcttacaggaagcagagaaaggtgtgaaattcctaacattgccaccagtgttacatctacaactgatgagatttatgtatgaccctcagacggaccaaaatatcaagatcaatgataggtttgaattcccagagcagttaccacttgatgaatttttgcaaaaaacagatcctaaggaccctgcaaattatattcttcatgcagtcctggttcatagtggagataatcatggtggacattatgtggtttatctaaaccccaaaggggatggcaaatggtgtaaatttgatgacgacgtggtgtcaaggtgtactaaagaggaagcaattgagcacaattatgggggtcacgatgacgacctgtctgttcgacactgcactaatgcttacatgttagtctacatcagggaatcaaaactgagtgaagttttacaggcggtcaccgaccatgatattcctcagcagttggtggagcgattacaagaagagaaaaggatcgaggctcagaagcggaaggagcggcaggaagcccatctctatatgcaagtgcagatagtcgcagaggaccagttttgtggccaccaagggaatgacatgtacgatgaagaaaaagtgaaatacactgtgttcaaagtattgaagaactcctcgcttgctgagtttgttcagagcctctctcagaccatgggatttccacaagatcaaattcgattgtggcccatgcaagcaaggagtaatggaacaaaacgaccagcaatgttagataatgaagccgacggcaataaaacaatgattgagctcagtgataatgaaaacccttggacaatattcctggaaacagttgatcccgagctggctgctagtggagcgaccttacccaagtttgataaagatcatgatgtaatgttatttttgaagatgtatgatcccaaaacgcggagcttgaattactgtgggcatatctacacaccaatatcctgtaaaatacgtgacttgctcccagttatgtgtgacagagcaggatttattcaagatactagccttatcctctatgaggaagttaaaccgaatttaacagagagaattcaggactatgacgtgtctcttgataaagcccttgatgaactaatggatggtgacatcatagtatttcagaaggatgaccctgaaaatgataacagtgaattacccaccgcaaaggagtatttccgagatctctaccaccgcgttgatgtcattttctgtgataaaacaatccctaatgatcctggatttgtggttacgttatcaaatagaatgaattattttcaggttgcaaagacagttgcacagaggctcaacacagatccaatgttgctgcagtttttcaagtctcaaggttatagggatggcccaggtaatcctcttagacataattatgaaggtactttaagagatcttctacagttcttcaagcctagacaacctaagaaactttactatcagcagcttaagatgaaaatcacagactttgagaacaggcgaagttttaaatgtatatggttaaacagccaatttagggaagaggaaataacactatatccagacaagcatgggtgtgtccgggacctgttagaagaatgtaaaaaggccgtggagcttggggagaaagcatcagggaaacttaggctgctagaaattgtaagctacaaaatcattggtgttcatcaagaagatgaactattagaatgtttatctcctgcaacgagccggacgtttcgaatagaggaaatccctttggaccaggtggacatagacaaagagaatgagatgcttgtcacagtggcgcatttccacaaagaggtcttcggaacgttcggaatcccgtttttgctgaggatacaccagggcgagcattttcgagaagtgatgaagcgaatccagagcctgctggacatccaggagaaggagtttgagaagtttaaatttgcaattgtaatgatgggccgacaccagtacataaatgaagacgagtatgaagtaaatttgaaagactttgagccacagcccggtaatatgtctcatcctcggccttggctagggctcgaccacttcaacaaagccccaaagaggagtcgctacacttaccttgaaaaggccattaaaatccataactgatttccaagctggtgtgttcaaggcgaggacggtgtgtgggtggccccttaacagcctagaactttggtgcacgtgccctctagccgaagtcttcagcaagaggattcgctgctggtgttaattttattttattgaggctgttcagtttggcttctctgtatctattgactgccctttttgagcaaaatgaagatgtttttataaagcttggatgccaatgagagttattttatggtaaccacagtgcaaggcaactgtcagcgcaatgggggagaagaggttagtggatcgggggtccctggctcaaggtctctgggctgtccctagtgggcacgagtggctcggctgccttcctggggtcccgtgcaccagccctgcagctagcaagtcttgtgtttaggctcgtctgacctatttccttcagttatactttcaatgaccttttgtgcatctgttaaggcaaaacagagaaactcacaacctaataaatagcgctcttcccttcattgtgtgcattgtcggcccttcctcgggttctcctcctccagctgcctgggggctttttaataaacttgtctcacctcgtcagccactactgtctgcagcccctttgcaaagtggatgcactgaatacagtccggacagacattgtgggggtctttttattaaatcaagaacattgttaaattcaattaaggtttactctgctgccttggcagacttacgatctcaacagttcatacgagcaggtgaaaggattataaatagaatttcgttaaagtggaacagacgacaagaaagccttttagcaagagggcatgctcactagtggttagtaagctgtcgactttgtaaaaaagttaaaaatgaaaaaaaaaggaaaaatgaattgtatatttaatgaatgaacatgtacaatttgccactgggaggaggttcctttttgttgggtgagtctgcaagtgaatttcactgatgttgatattcattgtgtgtagttttatttcggtcccagccccgtttccttttattttggagctaatgccagctgcgtgtctagttttgagtgcagtaaaatagaatcagcaaatcactcttatttttcatccttttccggtattttttgggttgtttctgtgggagcagtgtacaccaactcttcctgtatattgcctttttgctggaaaatgttgtatgttgaataaaattttctataaaaattataattcagtgagttacgtggaagtggaggaagatttctactctccctggaaacaggcctgggaaaccttggcatttgtaacaaggtttcactgagatgtacttttccttctaattccgttttgcgggggcagggtctcttgtttctttttttttttttttttttttttagcctctaactagtcacatttactcttaagaaatgaaaggttttccaggagagaactgtgtacaaataaggtgactggagatgtgacctgatgtgtcacgaggcccttcggggcggcaggcgctatcgtgggcgtggtccttgcaccgtcccatcggccttgccttccagctccgtggcacggtttcctggtctttgggccagtgtgtaccttggagtgacttcctttctcaacttccactgcagtgtgtgtgccttctgctctgagagctgccttgtgacccgtgtgatagaaagcagggagtgagggtccccgcggacctggcccttccctccttcctcccccagaaagaggagttagagcaggggtgcgagagccgttcgctgtgggtttgtctttgaacaaacattaaggtgtcttgtttttgttctgggctgggggttggctgtagtcttaggtaactgaaagttcctactctcccttaaggtattaaatgactctttttccaaagaa

SEQ ID NO: 33572 - DNA, 3579 bp, Homo sapiens
aaaaaataaaaaagaatgctgaggtagagctcctagagattctatgcagtcactctgatgtgggtgagagaacctcccccatcccccagcagaggccactgcagagccatgcagagatggctgggaaccacaggcttgggctggaagcgggagatacagatgacccaccaagaattactcagaaccctgtgatcaatgggaatgtggccctgagtgatggacacaacaccgcggaggaggacatggaggatgacaccagttggcgctccgaggcaacctttcagttcactgtggagcgcttcagcagactgagtgagtcggtccttagccctccgtgttttgtgcgaaatctgccatggaagattatggtgatgccacgcttttatccagacagaccacaccaaaaaagcgtaggattctttctccagtgcaatgctgaatctgattccacgtcatggtcttgccatgcacaagcagtgctgaagataataaattacagagatgatgaaaagtcgttcagtcgtcgtattagtcatttgttcttccataaagaaaatgattggggattttccaattttatggcctggagtgaagtgaccgatcctgagaaaggatttatagatgatgacaaagttacctttgaagtctttgtacaggcggatgctccccatggagttgcgtgggattcaaagaagcacacaggctacgtcggcttaaagaatcagggagcgacttgttacatgaacagcctgctacagacgttatttttcacgaatcagctacgaaaggctgtgtacatgatgccaaccgagggggatgattcgtctaaaagcgtccctttagcattacaaagagtgttctatgaattacagcatagtgataaacctgtaggaacaaaaaagttaacaaagtcatttgggtgggaaactttagatagcttcatgcaacatgatgttcaggagctttgtcgagtgttgctcgataatgtggaaaataagatgaaaggcacctgtgtagagggcaccatacccaaattattccgcggcaaaatggtgtcctatatccagtgtaaagaagtagactatcggtctgatagaagagaagattattatgatatccagctaagtatcaaaggaaagaaaaatatatttgaatcatttgtggattatgtggcagtagaacagctcgatggggacaataaatacgacgctggggaacatggcttacaggaagcagagaaaggtgtgaaattcctaacattgccaccagtgttacatctacaactgatgagatttatgtatgaccctcagacggaccaaaatatcaagatcaatgataggtttgaattcccagagcagttaccacttgatgaatttttgcaaaaaacagatcctaaggaccctgcaaattatattcttcatgcagtcctggttcatagtggagataatcatggtggacattatgtggtttatctaaaccccaaaggggatggcaaatggtgtaaatttgatgacgacgtggtgtcaaggtgtactaaagaggaagcaattgagcacaattatgggggtcacgatgacgacctgtctgttcgacactgcactaatgcttacatgttagtctacatcagggaatcaaaactgagtgaagttttacaggcggtcaccgaccatgatattcctcagcagttggtggagcgattacaagaagagaaaaggatcgaggctcagaagcggaaggagcggcaggaagcccatctctatatgcaagtgcagatagtcgcagaggaccagttttgtggccaccaagggaatgacatgtacgatgaagaaaaagtgaaatacactgtgttcaaagtattgaagaactcctcgcttgctgagtttgttcagagcctctctcagaccatgggatttccacaagatcaaattcgattgtggcccatgcaagcaaggagtaatggaacaaaacgaccagcaatgttagataatgaagccgacggcaataaaacaatgattgagctcagtgataatgaaaacccttggacaatattcctggaaacagttgatcccgagctggctgctagtggagcgaccttacccaagtttgataaagatcatgatgtaatgttatttttgaagatgtatgatcccaaaacgcggagcttgaattactgtgggcatatctacacaccaatatcctgtaaaatacgtgacttgctcccagttatgtgtgacagagcaggatttattcaagatactagccttatcctctatgaggaagttaaaccgaatttaacagagagaattcaggactatgacgtgtctcttgataaagcccttgatgaactaatggatggtgacatcatagtatttcagaaggatgaccctgaaaatgataacagtgaattacccaccgcaaaggagtatttccgagatctctaccaccgcgttgatgtcattttctgtgataaaacaatccctaatgatcctggatttgtggttacgttatcaaatagaatgaattattttcaggttgcaaagacagttgcacagaggctcaacacagatccaatgttgctgcagtttttcaagtctcaaggttatagggatggcccaggtaatcctcttagacataattatgaaggtactttaagagatcttctacagttcttcaagcctagacaacctaagaaactttactatcagcagcttaagatgaaaatcacagactttgagaacaggcgaagttttaaatgtatatggttaaacagccaatttagggaagaggaaataacactatatccagacaagcatgggtgtgtccgggacctgttagaagaatgtaaaaaggccgtggagcttggggagaaagcatcagggaaacttaggctgctagaaattgtaagctacaaaatcattggtgttcatcaagaagatgaactattagaatgtttatctcctgcaacgagccggacgtttcgaatagaggaaatccctttggaccaggtggacatagacaaagagaatgagatgcttgtcacagtggcgcatttccacaaagaggtcttcggaacgttcggaatcccgtttttgctgaggatacaccagggcgagcattttcgagaagtgatgaagcgaatccagagcctgctggacatccaggagaaggagtttgagaagtttaaatttgcaattgtaatgatgggccgacaccagtacataaatgaagacgagtatgaagtaaatttgaaagactttgagccacagcccggtaatatgtctcatcctcggccttggctagggctcgaccacttcaacaaagccccaaagaggagtcgctacacttaccttgaaaaggccattaaaatccataactgatttccaagctggtgtgttcaaggcgaggacggtgtgtgggtggccccttaacagcctagaactttggtgcacgtgccctctagccgaagtcttcagcaagaggattcgctgctggtgttaattttattttattgaggctgttcagtttggcttctctgtatctattgactgccctttttgagcaaaatgaagatgtttttat

SEQ ID NO: 33573 - DNA, 3554 bp, Homo sapiens
gatgtgggtgagagaacctcccccatcccccagcagaggccactgcagagccatgcagagatggctgggaaccacaggcttgggctggaagcgggagatacagatgacccaccaagaattactcagaaccctgtgatcaatgggaatgtggccctgagtgatggacacaacaccgcggaggaggacatggaggatggggagtaacggggcagttgaaagaaaccatcagtcacgggctgcaccaccagaaggactgctgttcagacctcctgccaaaagttcagcctccatgagaaactgcagccgtagttgagagttctctcacagtgcggtttacccctggcagctggctgaggcaatatctgaggaagacaccagttggcgctccgaggcaacctttcagttcactgtggagcgcttcagcagactgagtgagtcggtccttagccctccgtgttttgtgcgaaatctgccatggaagattatggtgatgccacgcttttatccagacagaccacaccaaaaaagcgtaggattctttctccagtgcaatgctgaatctgattccacgtcatggtcttgccatgcacaagcagtgctgaagataataaattacagagatgatgaaaagtcgttcagtcgtcgtattagtcatttgttcttccataaagaaaatgattggggattttccaattttatggcctggagtgaagtgaccgatcctgagaaaggatttatagatgatgacaaagttacctttgaagtctttgtacaggcggatgctccccatggagttgcgtgggattcaaagaagcacacaggctacgtcggcttaaagaatcagggagcgacttgttacatgaacagcctgctacagacgttatttttcacgaatcagctacgaaaggctgtgtacatgatgccaaccgagggggatgattcgtctaaaagcgtccctttagcattacaaagagtgttctatgaattacagcatagtgataaacctgtaggaacaaaaaagttaacaaagtcatttgggtgggaaactttagatagcttcatgcaacatgatgttcaggagctttgtcgagtgttgctcgataatgtggaaaataagatgaaaggcacctgtgtagagggcaccatacccaaattattccgcggcaaaatggtgtcctatatccagtgtaaagaagtagactatcggtctgatagaagagaagattattatgatatccagctaagtatcaaaggaaagaaaaatatatttgaatcatttgtggattatgtggcagtagaacagctcgatggggacaataaatacgacgctggggaacatggcttacaggaagcagagaaaggtgtgaaattcctaacattgccaccagtgttacatctacaactgatgagatttatgtatgaccctcagacggaccaaaatatcaagatcaatgataggtttgaattcccagagcagttaccacttgatgaatttttgcaaaaaacagatcctaaggaccctgcaaattatattcttcatgcagtcctggttcatagtggagataatcatggtggacattatgtggtttatctaaaccccaaaggggatggcaaatggtgtaaatttgatgacgacgtggtgtcaaggtgtactaaagaggaagcaattgagcacaattatgggggtcacgatgacgacctgtctgttcgacactgcactaatgcttacatgttagtctacatcagggaatcaaaactgagtgaagttttacaggcggtcaccgaccatgatattcctcagcagttggtggagcgattacaagaagagaaaaggatcgaggctcagaagcggaaggagcggcaggaagcccatctctatatgcaagtgcagatagtcgcagaggaccagttttgtggccaccaagggaatgacatgtacgatgaagaaaaagtgaaatacactgtgttcaaagtattgaagaactcctcgcttgctgagtttgttcagagcctctctcagaccatgggatttccacaagatcaaattcgattgtggcccatgcaagcaaggagtaatggaacaaaacgaccagcaatgttagataatgaagccgacggcaataaaacaatgattgagctcagtgataatgaaaacccttggacaatattcctggaaacagttgatcccgagctggctgctagtggagcgaccttacccaagtttgataaagatcatgatgtaatgttatttttgaagatgtatgatcccaaaacgcggagcttgaattactgtgggcatatctacacaccaatatcctgtaaaatacgtgacttgctcccagttatgtgtgacagagcaggatttattcaagatactagccttatcctctatgaggaagttaaaccgaatttaacagagagaattcaggactatgacgtgtctcttgataaagcccttgatgaactaatggatggtgacatcatagtatttcagaaggatgaccctgaaaatgataacagtgaattacccaccgcaaaggagtatttccgagatctctaccaccgcgttgatgtcattttctgtgataaaacaatccctaatgatcctggatttgtggttacgttatcaaatagaatgaattattttcaggttgcaaagacagttgcacagaggctcaacacagatccaatgttgctgcagtttttcaagtctcaaggttatagggatggcccaggtaatcctcttagacataattatgaaggtactttaagagatcttctacagttcttcaagcctagacaacctaagaaactttactatcagcagcttaagatgaaaatcacagactttgagaacaggcgaagttttaaatgtatatggttaaacagccaatttagggaagaggaaataacactatatccagacaagcatgggtgtgtccgggacctgttagaagaatgtaaaaaggccgtggagcttggggagaaagcatcagggaaacttaggctgctagaaattgtaagctacaaaatcattggtgttcatcaagaagatgaactattagaatgtttatctcctgcaacgagccggacgtttcgaatagaggaaatccctttggaccaggtggacatagacaaagagaatgagatgcttgtcacagtggcgcatttccacaaagaggtcttcggaacgttcggaatcccgtttttgctgaggatacaccagggcgagcattttcgagaagtgatgaagcgaatccagagcctgctggacatccaggagaaggagtttgagaagtttaaatttgcaattgtaatgatgggccgacaccagtacataaatgaagacgagtatgaagtaaatttgaaagactttgagccacagcccggtaatatgtctcatcctcggccttggctagggctcgaccacttcaacaaagccccaaagaggagtcgctacacttaccttgaaaaggccattaaaatccataactgatttccaagctggtgtgttcaaggcgaggacggtgtgtgggtggccccttaacagccta

SEQ ID NO: 33574 - DNA, 1966 bp, Homo sapiens
aagaacaagattgcactctgagagaaggaaggcatggtgaagaggtggtgttgtggtgggccttaaagtaggcttaggacttgagctcggggatttggagcgggagatacagatgacccaccaagaattactcagaaccctgtgatcaatgggaatgtggccctgagtgatggacacaacaccgcggaggaggacatggaggatgacaccagttggcgctccgaggcaacctttcagttcactgtggagcgcttcagcagactgagtgagtcggtccttagccctccgtgttttgtgcgaaatctgccatggaagattatggtgatgccacgcttttatccagacagaccacaccaaaaaagcgtaggattctttctccagtgcaatgctgaatctgattccacgtcatggtcttgccatgcacaagcagtgctgaagataataaattacagagatgatgaaaagtcgttcagtcgtcgtattagtcatttgttcttccataaagaaaatgattggggattttccaattttatggcctggagtgaagtgaccgatcctgagaaaggatttatagatgatgacaaagttacctttgaagtctttgtacaggcggatgctccccatggagttgcgtgggattcaaagaagcacacaggctacgtcggcttaaagaatcagggagcgacttgttacatgaacagcctgctacagacgttatttttcacgaatcagctacgaaaggctgtgtacatgatgccaaccgagggggatgattcgtctaaaagcgtccctttagcattacaaagagtgttctatgaattacagcatagtgataaacctgtaggaacaaaaaagttaacaaagtcatttgggtgggaaactttagatagcttcatgcaacatgatgttcaggagctttgtcgagtgttgctcgataatgtggaaaataagatgaaaggcacctgtgtagagggcaccatacccaaattattccgcggcaaaatggtgtcctatatccagtgtaaagaagtagactatcggtctgatagaagagaagattattatgatatccagctaagtatcaaaggaaagaaaaatatatttgaatcatttgtggattatgtggcagtagaacagctcgatggggacaataaatacgacgctggggaacatggcttacaggaagcagagaaaggtgtgaaattcctaacattgccaccagtgttacatctacaactgatgagatttatgtatgaccctcagacggaccaaaatatcaagatcaatgataggtttgaattcccagagcagttaccacttgatgaatttttgcaaaaaacagatcctaaggaccctgcaaattatattcttcatgcagtcctggttcatagtggagataatcatggtggacattatgtggtttatctaaaccccaaaggggatggcaaatggtgtaaatttgatgacgacgtggtgtcaaggtgtactaaagaggaagcaattgagcacaattatgggggtcacgatgacgacctgtctgttcgacactgcactaatgcttacatgttagtctacatcagggaatcaaaactgacagttggtggagcgattacaagaagagaaaaggatcgaggctcagaagcggaaggagcggcaggaagcccatctctatatgcaagtgcagatagtcgcagaggaccagttttgtggccaccaagggaatgacatgtacgatgaagaaaaagtgaaatacactgtgttcaaagtattgaagaactcctcgcttgctgagtttgttcagagcctctctcagaccatgggatttccacaagatcaaattcgattgtggcccatgcaagcaaggagtaatggaacaaaacgaccagcaatgttagataatgaagccgacggcaataaaacaatgattgagctcagtgataatgaaaacccttggacaatattcctg

SEQ ID NO: 33575 - DNA, 8754 bp, Homo sapiens
gcggccgccttagcgcccggtgcttgggtcggcgccgggagcgaggagcgagctacttcaaagccaccaggcctggagcggggacagaggcggcgactaggggaaggtgaagccgtcgctgcaggaggaggagcaggaggaggtgacgcaggagaaacgcaccgcccggagcccgtctgagctcagcgagagccccagcctgaggggagaaggggaagagggccgtcgccggccaaggaggaggaggaggcgggcgcggcgaggagcgagttccggcgccggtgtgcagccttttggttgagacgcccgcagccccgagcccggccgccgcagcctttcgatacactttgttgccggtcacccccgggcctgggatgcacccagggtaggtctcgtcccgggaccgagccccaccgtcgcctggtgcctcccgcctccgtgtgccctggttgtgagaagacgtctgtgtcgtgcggttatgcaatggtctctgcaagatggtttattcttgaattggacctttttaagactgacaaatgctggtacttcatcttctataagtggactataatttcttttctcaagacaactacataagcagacaaaattgcaaagatctgccctgtgtcgagtatgacagccacgactcgtggctctccggtcggagggaatgacaaccagggccaggctcctgatggacagtctcagccccccctccaacagaatcagacttcatcgcctgattcttccaatgaaaattccccggcaactcccccagatgagcaaggtcaaggtgatgccccaccacagcttgaagatgaggaacctgcatttccacatactgacttggccaagttggatgacatgatcaacaggcctcgatgggtggttccagttttgccgaaaggggaattagaagtgcttttagaagctgctattgatcttagtaaaaagggccttgatgttaaaagtgaagcatgtcagcgatttttccgtgatgggctaacaatatcattcactaaaattcttacagatgaagcagtgagtggctggaagtttgaaattcataggtgtattattaacaatactcatcgtctggtggagctatgtgtggccaagttgtcccaagactggtttccacttttagaacttcttgccatggccttaaatcctcattgcaaattccatatctacaatggtacacgtccatgtgaatcagtttcctcaagtgttcagttgcctgaagatgaactctttgctcgttctccagatcctcgatcaccaaagggttggctagtggatcttctcaacaaatttggcactttaaatgggttccagattttgcatgatcgttttattaatggatcagcattaaacgttcaaataattgcagcccttattaaaccatttgggcaatgctatgagtttctcactcttcatacagtgaaaaagtactttcttccaataatagaaatggttccacagtttttagaaaacttaactgatgaagaactgaaaaaagaagcaaagaatgaagccaaaaatgatgctctttcaatgattattaaatctttgaagaatttagcttcaagggttccaggacaagaagaaactgttaaaaacttagaaatatttaggttaaaaatgatacttagattattgcaaatttcttctttcaatggaaagatgaatgcactgaatgaagttaataaggtgatatctagtgtatcatactatactcatcgacatggtaatcctgaggaggaagagtggctcacagctgaacgaatggcagaatggatacagcagaacaatatcttatccatagtgttgcgagatagtcttcatcagccacagtatgtagaaaagttagagaagattcttcgttttgtcatcaaagaaaaagctctgaccttacaggatcttgataatatctgggcagcacaggcagggaaacatgaagccattgtgaagaatgtacatgatctcctggcaaaattggcatgggatttttctcctgaacaacttgatcatctttttgattgttttaaggccagttggacaaatgcgagtaaaaagcaacgtgaaaagctacttgagctgatacgtcgtcttgcagaagatgataaagatggtgtgatggcacacaaagtgttgaaccttctgtggaatctggctcacagtgatgatgtgcctgtagatatcatggacctggctctcagtgcccacataaaaatactagattacagttgctcccaggaccgtgatacacaaaagatccaatggatagatcgctttatagaagaacttcgcacaaatgacaaatgggttattcccgcactgaaacaaattagagaaatttgtagtttgtttggtgaagcgcctcaaaatttgagtcaaactcagcgaagtccccatgtgttttatcgccatgacttaatcaatcaacttcaacacaatcatgccctagttactttggtagcagaaaaccttgcaacttacatggaaagcatgagactatatgctagagaccatgaagattatgacccacaaactgtgaggctgggaagtagatatagtcatgttcaagaagttcaagaacggcttaacttccttagatttttattgaaggatggtcagctgtggctatgtgctcctcaggcaaaacaaatatggaaatgcttagctgagaatgcagtttacctttgtgatcgtgaagcctgttttaagtggtattccaagttgatgggggatgaaccagacttagatcctgatattaataaggacttctttgaaagtaatgtgcttcagcttgatccttctctgttaactgaaaatggaatgaagtgttttgagcgattcttcaaagctgtgaattgtcgagaaggaaaactagtagcaaaaaggagagcctatatgatggatgacttggagttaataggattagattacctttggagggtcgtgattcagagtaatgatgatattgccagcagagctatagatctcctcaaagagatatacacgaaccttggtccaagactacaagtcaatcaggtggtgatccatgaagacttcattcagtcttgttttgatcgtctgaaggcttcctatgacacattgtgtgttttggatggtgacaaagacagtgttaattgtgcaagacaggaagctgttcgaatggttcgagtattaactgttttaagggaatatataaatgaatgtgacagtgattatcatgaggaaagaacaattctccctatgtcgagagcattccgcggtaaacacctctcttttgtagttcgatttccaaaccagggcagacaggttgatgacttggaggtatggtctcatacaaatgatacaattggttcagtacgacgatgtattctcaatcgtattaaagccaacgtagcccatacaaaaattgagctctttgtgggcggtgagctgatagatcctgcagatgatagaaagttgattggacaattaaacttaaaagataaatcgcttattacagccaaacttacacagataagttccaatatgccttcaagccctgatagctcttctgattcctccactggatctcctggaaaccatggtaatcattacagtgatggtcccaatccagaagtggaaagctgtttgcctggagtgataatgtcactgcatcccagatacatctcttttctttggcaagttgcagacttaggtagcagcctaaatatgccaccccttagagatggagcaagagtacttatgaaacttatgccgccagatagcacaacgatagaaaaattaagagctatttgtttagaccatgccaaacttggagaaagcagccttagtccatctcttgactcacttttctttggtccttcagcctcacaagtgctatatctaacagaggtagtctatgccttgttaatgcctgctggtgcacctctggctgatgattcctctgattttcagtttcacttcttgaaaagtggtggcctaccccttgtactgagtatgctaaccagaaataacttcctaccgaatgcagatatggaaactcgaaggggtgcctacctcaatgctcttaaaatagccaagcttttgctaactgccattggctatggtcatgttcgagctgtggcagaagcttgtcagccaggtgtagaaggtgtgaatcccatgacacagatcaaccaagttacccatgatcaagcagtggtgctacaaagtgcccttcagagcattcctaatccatcatccgagtgcatgcttagaaatgtgtcagttcgtcttgctcagcagatatctgatgaggcttcaagatatatgcctgatatttgtgtaattagagctatacaaaaaattatctgggcatcaggatgtgggtcgttacagctagtatttagcccaaatgaagaaatcactaaaatttatgagaagaccaatgcaggcaatgagccagacttggaagacgaacaggtttgctgtgaagcattggaagtgatgaccttatgttttgccttgattccaacagccttagatgctcttagtaaagaaaaggcttggcagacattcatcattgacttactattgcactgtcacagcaaaactgttcgtcaggtggcacaggagcagttctttttaatgtgcaccagatgttgcatgggacaccggcctctacttttcttcattactctactctttactgttttggggagcacagcaagagagagagctaaacactcaggcgactactttactcttttaagacaccttcttaattacgcttacaatagtaatattaatgtacccaatgctgaagttcttctcaataatgaaattgattggcttaaaagaattagggatgatgttaaaagaacaggagaaacgggtattgaagagacgatcttagagggccaccttggagtgacaaaggagttactggcctttcaaacttctgagaaaaaatttcatattggttgtgaaaaaggaggtgctaatctcattaaagaattaattgatgatttcatatttcctgcatccaatgtttacctacagtatatgagaaatggagagcttccagctgaacaggctattccggtctgtggttcaccacctacaattaatgctggttttgaattacttgtagcattagctgttggctgtgtgaggaatctcaaacaaatagtagattctttgactgaaatgtattacattggcacagcaataactacttgtgaagcacttactgagtgggaatatctgccacctgttggaccccgcccacccaaaggattcgtggggctgaaaaatgccggtgctacttgttacatgaattctgtgattcagcaactctacatgattccttccattaggaacggtattcttgccattgaaggcacaggtagtgatgtagatgatgatatgtctggggatgagaagcaggacaatgagagcaatgttgatcccagggatgatgtatttggatatcctcaacaatttgaagataaaccagcattaagtaaaactgaagatagaaaagagtacaacattggtgtcctaagacaccttcaggtcatctttggtcatttagctgcttctcgactgcaatactatgtgcccagaggattttggaaacagttcaggctttggggtgagcctgttaatctgcgtgaacaacacgatgctttagaattttttaattcattggtggatagtttagatgaagctttaaaagctttaggacatccagctatgctaagtaaagtcttaggaggttcctttgctgatcagaagatctgccaaggctgcccacataggtacgaatgtgaagaatcttttacgaccctaaacgtagacattagaaatcaccaaaatcttcttgattctttggaacagtatgtcaaaggagatttactagaaggtgcaaatgcatatcattgtgaaaaatgcaataaaaaggttgataccgtaaagcgcttgctgattaaaaaattacctcctgttcttgctatacaactaaagcgatttgactatgactgggaaagagaatgtgcaatcaagttcaatgattattttgaatttcctcgagagctggacatggaaccttacacagttgcaggtgtcgcaaagctggaaggggataatgtaaacccagagagtcagttgatacaacagagtgagcagtctgaaagtgagacagcaggaagcacaaaatacagacttgtgggtgtgctcgtacacagtggtcaagcgagtggggggcattattattcttacatcatccaaaggaatggtggagatggtgagagaaatcgctggtataaatttgatgatggtgatgtaacagaatgtaaaatggatgatgacgaagaaatgaaaaaccagtgttttggtggagagtacatgggagaagtgtttgatcacatgatgaagcgtatgtcatacaggcgccagaaaaggtggtggaatgcttatatacttttttatgaacgaatggacacaatagaccaagatgatgagttgataagatatatatcagagcttgctatcaccaccagacctcatcagattattatgccatcagccattgagagaagtgtacggaaacagaacgtacaattcatgcataaccgaatgcagtacagtatggagtattttcagtttatgaaaaaactgcttacatgtaatggcgtttacttaaaccctcctcccgggcaagatcacctgttgcctgaagcagaagaaatcactatgatcagtattcaacttgctgctaggttcctctttactacaggatttcacacaaagaaagtagtccgtggctctgccagtgattggtatgatgcattgtgtattctccttcgtcacagcaagaatgtacgtttttggtttgctcataacgtcctttttaatgtttcaaatcgcttctccgaataccttctggagtgccctagtgcagaagtgaggggtgcgtttgcaaaacttatagtctttattgcacatttttccttgcaagatgggccatgtccttcaccttttgcctctcctggaccttctagtcaggcttatgacaacttaagcttgagtgatcacttactaagagcagtactaaatctcttgagaagggaagtttcagagcatgggcgtcatttacagcagtatttcaacctgtttgtaatgtatgccaatttaggtgtggcagagaagacacagcttctgaaattgagtgtacctgctacttttatgcttgtgtctttagatgaaggtccaggtcctccaatcaaataccagtatgctgaattaggcaaattatactcagtagtgtcacagctgatccgctgttgcaatgtctcttcaagaatgcagtcttcaatcaatggtaatcctcctcttcccaatccttttggtgatcctaatttatcacaacctataatgccaattcagcagaatgtggcagacattttatttgtgagaacaagttatgtgaagaaaatcattgaagactgcagtaattcagaggaaaccgtcaaattgcttcgtttttgctgctgggagaatcctcagttctcatctactgtcctcagtgaacttctctggcaggttgcatattcctatacctatgaactgcggccctatttggatctgcttttgcaaatcttactgattgaggactcctggcaaactcacagaattcataatgcactgaaaggaattccagatgaccgagatgggctgtttgacacaatccagcgctctaagaatcactatcaaaaaagagcataccagtgtataaaatgtatggtagctctatttagtaactgtcctgttgcttaccaaatcctgcagggcaatggagatcttaaaagaaagtggacctgggcagtggaatggcttggagatgaacttgaaagaagaccatatactggcaatcctcagtacacttacaacaattggtctcccccagtgcaaagcaatgaaacgtccaatggttatttcttggagagatcacatagtgctaggatgacacttgcaaaagcttgtgaactctgtccagaggaggtaaaaaaagccaccagtgtgcagcagatagaaatggaagagagcaaagagccagatgaccaagatgctccagatgaacatgagtcgcctccacctgaagatgccccattgtacccccattcacctggatctcagtatcaacagaataaccatgtgcatggacagccatatacaggcccagcagcacatcacatgaacaaccctcagagaactggccaacgagcacaagaaaattatgaaggcagtgaagaagtatccccacctcaaaccaaggatcaatgaaatgcacataattaactggttccatcaagactgtgcacccaggccttacagtccaacctttttctgtgtctggctaatatttaaaactagaaaaactattcctaatcaacatggagtggagagtttattcactgtcttatctgcagaaatttgctgtcaatatataacccgcctgcagtggaaagtgtatagtgttttgtaataaatggcctgatgctaatgtgtaaatggcaaaggtgtatatagtatattaatgttgactgttaattcttaagcaagaaacttttttcttgatgagactcacagatctacacaaactacaaaagttaattttcttgttacacccactgcactctgcaaccagtgttgcctgcctcatggcagttggatcagctcctttacaaaaaa

SEQ ID NO: 33576 - DNA, 8371 bp, Homo sapiens
gcggccgccttagcgcccggtgcttgggtcggcgccgggagcgaggagcgagctacttcaaagccaccaggcctggagcggggacagaggcggcgactaggggaaggtgaagccgtcgctgcaggaggaggagcaggaggaggtgacgcaggagaaacgcaccgcccggagcccgtctgagctcagcgagagccccagcctgaggggagaaggggaagagggccgtcgccggccaaggaggaggaggaggcgggcgcggcgaggagcgagttccggcgccggtgtgcagccttttggttgagacgcccgcagccccgagcccggccgccgcagcctttcgatacactttgttgccggtcacccccgggcctgggatgcacccagggtaggtctcgtcccgggaccgagccccaccgtcgcctggtgcctcccgcctccgtgtgccctggttgtgagaagacgtctgtgtcgtgcggttatgcaatggtctctgcaagatggtttattcttgaattggacctttttaagactgacaaatgctggtacttcatcttctataagtggactataatttcttttctcaagacaactacataagcagacaaaattgcaaagatctgccctgtgtcgagtatgacagccacgactcgtggctctccggtcggagggaatgacaaccagggccaggctcctgatggacagtctcagccccccctccaacagaatcagacttcatcgcctgattcttccaatgaaaattccccggcaactcccccagatgagcaaggtcaaggtgatgccccaccacagcttgaagatgaggaacctgcatttccacatactgacttggccaagttggatgacatgatcaacaggcctcgatgggtggttccagttttgccgaaaggggaattagaagtgcttttagaagctgctattgatcttagtaaaaagggccttgatgttaaaagtgaagcatgtcagcgatttttccgtgatgggctaacaatatcattcactaaaattcttacagatgaagcagtgagtggctggaagtttgaaattcataggtgtattattaacaatactcatcgtctggtggagctatgtgtggccaagttgtcccaagactggtttccacttttagaacttcttgccatggccttaaatcctcattgcaaattccatatctacaatggtacacgtccatgtgaatcagtttcctcaagtgttcagttgcctgaagatgaactctttgctcgttctccagatcctcgatcaccaaagggttggctagtggatcttctcaacaaatttggcactttaaatgggttccagattttgcatgatcgttttattaatggatcagcattaaacgttcaaataattgcagcccttattaaaccatttgggcaatgctatgagtttctcactcttcatacagtgaaaaagtactttcttccaataatagaaatggttccacagtttttagaaaacttaactgatgaagaactgaaaaaagaagcaaagaatgaagccaaaaatgatgctctttcaatgattattaaatctttgaagaatttagcttcaagggttccaggacaagaagaaactgttaaaaacttagaaatatttaggttaaaaatgatacttagattattgcaaatttcttctttcaatggaaagatgaatgcactgaatgaagttaataaggtgatatctagtgtatcatactatactcatcgacatggtaatcctgaggaggaagagtggctcacagctgaacgaatggcagaatggatacagcagaacaatatcttatccatagtgttgcgagatagtcttcatcagccacagtatgtagaaaagttagagaagattcttcgttttgtcatcaaagaaaaagctctgaccttacaggatcttgataatatctgggcagcacaggcagggaaacatgaagccattgtgaagaatgtacatgatctcctggcaaaattggcatgggatttttctcctgaacaacttgatcatctttttgattgttttaaggccagttggacaaatgcgagtaaaaagcaacgtgaaaagctacttgagctgatacgtcgtcttgcagaagatgataaagatggtgtgatggcacacaaagtgttgaaccttctgtggaatctggctcacagtgatgatgtgcctgtagatatcatggacctggctctcagtgcccacataaaaatactagattacagttgctcccaggaccgtgatacacaaaagatccaatggatagatcgctttatagaagaacttcgcacaaatgacaaatgggttattcccgcactgaaacaaattagagaaatttgtagtttgtttggtgaagcgcctcaaaatttgagtcaaactcagcgaagtccccatgtgttttatcgccatgacttaatcaatcaacttcaacacaatcatgccctagttactttggtagcagaaaaccttgcaacttacatggaaagcatgagactatatgctagagaccatgaagattatgacccacaaactgtgaggctgggaagtagatatagtcatgttcaagaagttcaagaacggcttaacttccttagatttttattgaaggatggtcagctgtggctatgtgctcctcaggcaaaacaaatatggaaatgcttagctgagaatgcagtttacctttgtgatcgtgaagcctgttttaagtggtattccaagttgatgggggatgaaccagacttagatcctgatattaataaggacttctttgaaagtaatgtgcttcagcttgatccttctctgttaactgaaaatggaatgaagtgttttgagcgattcttcaaagctgtgaattgtcgagaaggaaaactagtagcaaaaaggagagcctatatgatggatgacttggagttaataggattagattacctttggagggtcgtgattcagagtaatgatgatattgccagcagagctatagatctcctcaaagagatatacacgaaccttggtccaagactacaagtcaatcaggtggtgatccatgaagacttcattcagtcttgttttgatcgtctgaaggcttcctatgacacattgtgtgttttggatggtgacaaagacagtgttaattgtgcaagacaggaagctgttcgaatggttcgagtattaactgttttaagggaatatataaatgaatgtgacagtgattatcatgaggaaagaacaattctccctatgtcgagagcattccgcggtaaacacctctcttttgtagttcgatttccaaaccagggcagacaggttgatgacttggaggtatggtctcatacaaatgatacaattggttcagtacgacgatgtattctcaatcgtattaaagccaacgtagcccatacaaaaattgagctctttgtgggcggtgagctgatagatcctgcagatgatagaaagttgattggacaattaaacttaaaagataaatcgcttattacagccaaacttacacagataagttccaatatgccttcaagccctgatagctcttctgattcctccactggatctcctggaaaccatggtaatcattacagtgatggtcccaatccagaagtggaaagctgtttgcctggagtgataatgtcactgcatcccagatacatctcttttctttggcaagttgcagacttaggtagcagcctaaatatgccaccccttagagatggagcaagagtacttatgaaacttatgccgccagatagcacaacgatagaaaaattaagagctatttgtttagaccatgccaaacttggagaaagcagccttagtccatctcttgactcacttttctttggtccttcagcctcacaagtgctatatctaacagaggtagtctatgccttgttaatgcctgctggtgcacctctggctgatgattcctctgattttcagtttcacttcttgaaaagtggtggcctaccccttgtactgagtatgctaaccagaaataacttcctaccgaatgcagatatggaaactcgaaggggtgcctacctcaatgctcttaaaatagccaagcttttgctaactgccattggctatggtcatgttcgagctgtggcagaagcttgtcagccaggtgtagaaggtgtgaatcccatgacacagatcaaccaagttacccatgatcaagcagtggtgctacaaagtgcccttcagagcattcctaatccatcatccgagtgcatgcttagaaatgtgtcagttcgtcttgctcagcagatatctgatgaggcttcaagatatatgcctgatatttgtgtaattagagctatacaaaaaattatctgggcatcaggatgtgggtcgttacagctagtatttagcccaaatgaagaaatcactaaaatttatgagaagaccaatgcaggcaatgagccagacttggaagacgaacaggtttgctgtgaagcattggaagtgatgaccttatgttttgccttgattccaacagccttagatgctcttagtaaagaaaaggcttggcagacattcatcattgacttactattgcactgtcacagcaaaactgttcgtcaggtggcacaggagcagttctttttaatgtgcaccagatgttgcatgggacaccggcctctacttttcttcattactctactctttactgttttggggagcacagcaagagagagagctaaacactcaggcgactactttactcttttaagacaccttcttaattacgcttacaatagtaatattaatgtacccaatgctgaagttcttctcaataatgaaattgattggcttaaaagaattagggatgatgttaaaagaacaggagaaacgggtattgaagagacgatcttagagggccaccttggagtgacaaaggagttactggcctttcaaacttctgagaaaaaatttcatattggttgtgaaaaaggaggtgctaatctcattaaagaattaattgatgatttcatatttcctgcatccaatgtttacctacagtatatgagaaatggagagcttccagctgaacaggctattccggtctgtggttcaccacctacaattaatgctggttttgaattacttgtagcattagctgttggctgtgtgaggaatctcaaacaaatagtagattctttgactgaaatgtattacattggcacagcaataactacttgtgaagcacttactgagtgggaatatctgccacctgttggaccccgcccacccaaaggattcgtggggctgaaaaatgccggtgctacttgttacatgaattctgtgattcagcaactctacatgattccttccattaggaacggtattcttgccattgaaggcacaggtagtgatgtagatgatgatatgtctggggatgagaagcaggacaatgagagcaatgttgatcccagggatgatgtatttggatatcctcaacaatttgaagataaaccagcattaagtaaaactgaagatagaaaagagtacaacattggtgtcctaagacaccttcaggtcatctttggtcatttagctgcttctcgactgcaatactatgtgcccagaggattttggaaacagttcaggctttggggtgagcctgttaatctgcgtgaacaacacgatgctttagaattttttaattcattggtggatagtttagatgaagctttaaaagctttaggacatccagctatgctaagtaaagtcttaggaggttcctttgctgatcagaagatctgccaaggctgcccacataggtacgaatgtgaagaatcttttacgaccctaaacgtagacattagaaatcaccaaaatcttcttgattctttggaacagtatgtcaaaggagatttactagaaggtgcaaatgcatatcattgtgaaaaatgcaataaaaaggttgataccgtaaagcgcttgctgattaaaaaattacctcctgttcttgctatacaactaaagcgatttgactatgactgggaaagagaatgtgcaatcaagttcaatgattattttgaatttcctcgagagctggacatggaaccttacacagttgcaggtgtcgcaaagctggaaggggataatgtaaacccagagagtcagttgatacaacagagtgagcagtctgaaagtgagacagcaggaagcacaaaatacagacttgtgggtgtgctcgtacacagtggtcaagcgagtggggggcattattattcttacatcatccaaaggaatggtggagatggtgagagaaatcgctggtataaatttgatgatggtgatgtaacagaatgtaaaatggatgatgacgaagaaatgaaaaaccagtgttttggtggagagtacatgggagaagtgtttgatcacatgatgaagcgtatgtcatacaggcgccagaaaaggtggtggaatgcttatatacttttttatgaacgaatggacacaatagaccaagatgatgagttgataagatatatatcagagcttgctatcaccaccagacctcatcagattattatgccatcagccattgagagaagtgtacggaaacagaacgtacaattcatgcataaccgaatgcagtacagtatggagtattttcagtttatgaaaaaactgcttacatgtaatggcgtttacttaaaccctcctcccgggcaagatcacctgttgcctgaagcagaagaaatcactatgatcagtattcaacttgctgctaggttcctctttactacaggatttcacacaaagaaagtagtccgtggctctgccagtgattggtatgatgcattgtgtattctccttcgtcacagcaagaatgtacgtttttggtttgctcataacgtcctttttaatgtttcaaatcgcttctccgaataccttctggagtgccctagtgcagaagtgaggggtgcgtttgcaaaacttatagtctttattgcacatttttccttgcaagatgggccatgtccttcaccttttgcctctcctggaccttctagtcaggcttatgacaacttaagcttgagtgatcacttactaagagcagtactaaatctcttgagaagggaagtttcagagcatgggcgtcatttacagcagtatttcaacctgtttgtaatgtatgccaatttaggtgtggcagagaagacacagcttctgaaattgagtgtacctgctacttttatgcttgtgtctttagatgaaggtccaggtcctccaatcaaataccagtatgctgaattaggcaaattatactcagtagtgtcacagctgatccgctgttgcaatgtctcttcaagaatgcagtcttcaatcaatggtaatcctcctcttcccaatccttttggtgatcctaatttatcacaacctataatgccaattcagcagaatgtggcagacattttatttgtgagaacaagttatgtgaagaaaatcattgaagactgcagtaattcagaggaaaccgtcaaattgcttcgtttttgctgctgggagaatcctcagttctcatctactgtcctcagtgaacttctctggcaggttgcatattcctatacctatgaactgcggccctatttggatctgcttttgcaaatcttactgattgaggactcctggcaaactcacagaattcataatgcactgaaaggaattccagatgaccgagatgggctgtttgacacaatccagcgctctaagaatcactatcaaaaaagagcataccagtgtataaaatgtatggtagctctatttagtaactgtcctgttgcttaccaaatcctgcagggcaatggagatcttaaaagaaagtggacctgggcagtggaatggcttggagatgaacttgaaagaagaccatatactggcaatcctcagtacacttacaacaattggtctcccccagtgcaaagcaatgaaacgtccaatggttatttcttggagagatcacatagtgctaggatgacacttgcaaaagcttgtgaactctgtccagaggaggagccagatgaccaagatgctccagatgaacatgagtcgcctccacctgaagatgccccattgtacccccattcacctggatctcagtatcaacagaataaccatgtgcatggacagccatatacaggcccagcagcacatcacatgaacaaccctcagagaactggccaacgagcacaagaaaattatgaaggcagtgaagaagtatccccacctcaaaccaaggatcaatgaaatgcacataattaactggttccatcaagactgtgcacccaggccttacagtccaacctttttctgtgtctgg

SEQ ID NO: 33577 - DNA, 10036 bp, Homo sapiens
tgaataattgaactttgtttatttctccatatttttgcagtggtaattccattataaaacctaatgaaacaatgtttttatagatggtgtggaaagacttttctgggctcagaggtgaaactgacccttgtgtatcagcagcatttctgactgactgagagagtgtagtgattaacagagttgtgatgttagttaagaaacttagatttgccattgtagcttttctaccaattagcagattgtttaactcactgaaattgtaaagtggtagacgtggacttagtcattactgggcagcttatgaattgtattcatttactcatgatgtaaaaatggttagtctccacttttaaggctctagttctagtggctaaataggtacttatttatacagtatgataactgctgtattaaaatacatgtctcaaatgtggaatagtagaagaggtgaagaaaatcatagtttgaggtagaatactgtttgctggtcttaaaaactgtggtattttggtgattccataaattaggtcagatacttccactggagggaaacagtttaaaggatatatgtgatactattaatagaatgaggaagacacaccagatatttaggagggaattagcgagcttgaaactaagagctggtttgaatgagactgggtcataagtgatttcaagtaccagattaaggcactgagattttatttttaagcactgaagtcagattttttccttttaaaagaaaggattcatgatgaaatctgctttttgttttgcagagagcttggagataattctggtggctgtgtggagtatgtgttggaggtattaaattttcacagtatatataaggcagcaattgataggcctttcacagattcttctgataactacataaagagacaaaaaaaagaaaaaagagcaaagatctgtgctgtgtcaagtatgacagccatcactcatggctctccagtaggagggaacgacagccagggccaggttcttgatggccagtctcagcatctcttccaacagaaccagacttcatcacctgattcttccaatgagaattccgtagcaactcctcctccagaggaacaagggcaaggtgatgccccaccacagcatgaagatgaagagcctgcatttccacatactgagctggcaaacctggatgacatgatcaacaggcctcgatgggtggttcctgttttgccaaaaggggaattagaagtgcttttagaagctgctattgatcttagtgtaaaaggccttgatgttaaaagtgaagcatgccaacgtttttttcgagatggactaacaatatctttcactaaaattcttatggatgaggctgtgagtggctggaagtttgaaattcatagatgtattattaacaatactcatcgcctagtggagctttgtgtggccaagttgtcccaagattggtttccacttctagaacttctcgccatggccttaaatcctcactgcaagtttcatatctacaatggtacacgtccgtgtgaattaatttcctcaaatgctcagttgcctgaagatgaattatttgctcgttcttcagatcctcgatcaccaaaaggttggctagtggatctcatcaataaatttggcacattaaatgggttccagattttgcatgatcgtttttttaatggatcagcattaaatattcaaataattgcagctcttattaaaccatttggacaatgctatgagtttctcagtcaacatacactgaaaaagtacttcattccagttatagaaatagttccacatttattggaaaacttaactgatgaagaactgaaaaaggaggcaaagaatgaagccaaaaatgatgccctttcaatgattattaaatctttgaagaacttagcttcaagaatttcaggacaagatgagactataaaaaatttggaaatttttaggttaaagatgatactcagattgttgcaaatttcctcttttaatggaaagatgaatgcactgaatgaaataaataaggttatatctagtgtatcatattatactcatcggcatagtaatcctgaggaggaagaatggctgacagctgagcgaatggcagaatggatacagcaaaataatatcttatccatagtcttgcaagacagtcttcatcaaccacaatatgtagaaaagctagagaaaattcttcgttttgtgattaaagaaaaggctcttacattacaggaccttgataatatctgggcagcacaggcaggaaaacatgaagccattgtgaagaatgtacatgatctgctagcaaagttggcttgggatttttctcctggacaacttgatcatctttttgattgctttaaggcaagttggacaaatgcaagtaaaaagcaacgtgaaaagctccttgagttgatacgccgtcttgcagaagatgataaagatggtgtgatggcacacaaagtgttgaaccttctttggaacctggctcagagtgatgatgtgcctgtagacatcatggaccttgctcttagtgcccacataaaaatactagattatagttgttcccaggatcgagatgcacagaagatccagtggatagatcactttatagaagaacttcgcacaaatgacaagtgggtaattcctgctctgaaacaaataagagaaatttgtagtttgtttggtgaagcatctcaaaatttgagtcaaactcagcgaagtccccacatattttatcgccatgatttaatcaaccagcttcaacaaaatcatgctttagttactttggtagcagaaaaccttgcaacctacatgaatagcatcagattgtatgctggagatcatgaagactatgatccacaaacagtgaggcttggaagtcgatacagtcatgttcaagaagttcaagaacgactaaacttccttagatttttactgaaggatggccaactgtggctctgtgctcctcaggcaaaacaaatatggaagtgcttagcagaaaatgcagtttatctttgtgatcgtgaagcctgttttaagtggtattccaagttaatgggggatgaaccagacttggatcctgatattaataaggacttctttgaaagtaatgtacttcagcttgatccttcccttttaactgaaaatggaatgaaatgctttgaaagatttttcaaagctgtcaattgtcgagaaaggaaactaatagcaaaaagaagatcctatatgatggatgatttggaattaattggactagactacctttggagggttgtgattcagagtagtgacgagattgctaacagagctatagatcttcttaaagagatatacacaaaccttggcccaagattaaaagccaatcaggtggttatccatgaagacttcattcagtcttgctttgatcgtttaaaagcatcatatgatacactgtgtgtttttgatggtgacaaaaacagcattaattgtgcaagacaagaagccattcgaatggttagagtattaactgttataaaagagtacattaatgaatgtgacagtgattatcacaaggaaagaatgattctacctatgtcgagagcatttcgtggcaaacacctctctcttatagttcggtttccaaaccagggcagacaggttgatgagttggatatatggtctcatacgaatgacacaattggttcagtacggcgatgtattgttaatcgtattaaagccaatgtagcccacaaaaaaattgaactttttgtgggtggtgagctgatagattctgaagatgacagaaagctaattggacaattaaacttaaaagataaatctctaattacagccaaacttacacaaataaatttcaatatgccatcaagtcctgatagctcttccgattcctcaactgcatctcctggaaaccaccgtaatcattacaatgatggtcccaatctagaggtggaaagttgtttgcctggggtgataatgtcagtgcatcccagatacatctctttcctttggcaagttgcagacttaggtagcaacctgaatatgccacctcttagagatggagcaagagtacttatgaaacttatgccaccagatagaacagctgtagaaaaattacgagctgtttgtttggaccatgcaaaacttggagaaggcaaacttagtccaccccttgactctcttttctttggtccttctgcctcccaagttctatacctaacagaggtagtttatgccttgttaatgcctgctggtgtgcctctaactgatgggtcctctgactttcaagttcacttcttgaaaagtggtggcttacctcttgtactgagtatgctaataagaaataacttcttgccaaatacagatatggaaactcgaaggggtgcttatttaaatgctcttaaaatagccaaactgttgttaactgcgattggctatggccatgttcgagctgtagcagaagcttgtcagccagttgtagatggtacagaccccataacacagattaaccaagttactcatgatcaagcagtggtgctacaaagtgcccttcagagcattcctaatccctcatccgagtgcgtacttagaaatgagtccatacttcttgctcaggaaatatctaatgaggcttcaagatatatgcctgatatttgtgtaattagggctatacagaaaattatctgggcatcagcatgtggggcattaggactagtttttagcccaaatgaagaaataactaaaatttatcagatgaccaccaatggaagcaataagctggaggtggaagatgaacaagtttgctgtgaagcactggaagtgatgaccttatgttttgctttacttccaacagcgttggatgcacttagtaaagaaaaagcctggcagaccttcatcattgacttattattgcactgtccaagcaaaactgttcgtcagttggcacaggagcagttctttttaatgtgcaccagatgttgcatgggacacaggcctctgcttttcttcattactttactctttaccatactggggagcacagcaagagagaagggtaaatattcaggtgattatttcacacttttacggcaccttctcaattatgcttacaatggcaatattaacatacccaatgctgaagttcttcttgtcagtgaaattgattggctcaaaaggattagggataatgttaaaaacacaggtgaaacaggtgtcgaagagccaatactggaaggccaccttggggtaacaaaagagttattggcctttcaaacttctgagaaaaagtatcactttggttgtgaaaaaggaggtgctaatctcattaaagaattaattgatgatttcatctttcccgcatccaaagtttacctgcagtatttaagaagtggagaactaccagctgagcaggctattccagtctgtagttcacccgttaccatcaatgccggttttgagctacttgtagcattagctattggctgtgtgaggaatctcaaacagatagtagactgtttgactgaaatgtattacatgggcacagcaattactacttgtgaagcacttactgagtgggaatatctgccccctgttggaccccgcccaccaaaaggatttgtgggactcaaaaatgctggtgctacgtgttacatgaactctgtgatccagcagctatacatgattccttctatcaggaacagtattcttgcaattgaaggcacaggtagtgatttacacgatgatatgttcggggatgagaagcaggacagtgagagtaatgttgatccccgagatgatgtatttggatatcctcatcaatttgaagacaagccagcattaagtaagacagaagataggaaagagtataatattggtgtcctaagacaccttcaggtcatctttggtcatttagctgcttcccaactacaatactatgtacccagaggattttggaaacagttcaggctttggggtgaacctgttaatctccgtgaacaacatgatgccttagagttttttaattctttggtggatagtttagatgaagctttaaaagctttaggacacccggctatactaagtaaagtcctaggaggctcctttgctgatcagaagatctgccaaggctgcccacataggtatgaatgtgaagaatcttttacaactttgaatgtggatattagaaatcatcaaaatcttcttgactctttggaacagtatatcaaaggagatttattggaaggtgcaaatgcatatcattgtgaaaaatgtgataaaaaggttgacacagtaaagcgcctgctaattaaaaaattgcctcgggttcttgctatccaactcaaacgatttgactatgactgggaaagagaatgtgcaattaaattcaatgattattttgaatttcctcgagagctggatatgggaccttacacagtagcaggtgttgcaaacctggaaagggataatgtaaactcagaaaatgagttgattgaacagaaagagcagtctgacaatgaaactgcaggaggcacaaagtacagacttgtaggagtgcttgtacacagtggtcaagcaagcggtgggcattattattcttacatcattcaaaggaatggtaaagatgatcagacagatcactggtataaatttgatgatggagatgtaacagaatgcaaaatggatgatgatgaagaaatgaaaaatcagtgttttggtggagagtacatgggagaagtatttgatcacatgatgaagcgcatgtcatataggcgacagaagaggtggtggaatgcttacatacttttttatgaacaaatggatatgatagatgaagatgatgagatgataagatacatatcagagctaactattgcaagaccccatcagatcattatgtcaccagccattgagagaagtgtacggaaacaaaatgtgaaatttatgcataaccgattgcaatatagtttagagtattttcagtttgtgaaaaaactgcttacatgtaatggtgtttatttaaaccctgctccagggcaggattatttgttgcctgaagcagaagaaattactatgattagtattcagcttgctgctagattcctctttaccactggatttcacaccaagaaaatagttcgtggtcctgccagtgactggtatgatgcactgtgcgttcttctccgtcacagcaaaaatgtacgtttttggtttactcataatgtcctttttaatgtatcaaatcgcttctctgaataccttctggagtgccctagtgcagaagtgaggggtgcatttgcaaaacttatagtgtttattgcacacttttccttgcaagatgggtcttgtccttctccttttgcatctccaggaccttctagtcaggcatgtgataacttgagcttgagtgaccacttactaagagccacactaaatctcttgagaagggaagtttcagagcatggacatcatttacagcaatattttaatttgtttgtaatgtatgccaatttaggtgtggcagaaaaaacacagcttctgaaattgaatgtacctgctacctttatgcttgtgtctttagacgaaggaccaggtcctccaatcaaatatcagtatgctgaattaggcaagttatattcagtagtgtctcagctgattcgttgttgcaatgtgtcatcaacaatgcagtcttcaatcaatggtaatccccctctccccaatcctttcggtgaccttaatttatcacagcctataatgccaattcagcagaatgtgttagacattttatttgtgagaacaagttatgtgaagaaaattattgaagactgcagtaactcagaggataccatcaaattacttcgcttttgctcttgggagaatcctcagttctcatctactgtcctcagcgaacttctctggcaggttgcatattcatatacctatgaacttcggccatatttagatctacttttccaaattttactgattgaggactcctggcagactcacagaattcataatgcacttaaaggaattccagatgacagagatgggctgttcgatacaatacagcgctcgaagaatcactatcaaaaacgagcatatcagtgcataaaatgtatggtagctctatttagcagttgtcctgttgcttaccagatcttacagggtaacggagatcttaaaagaaaatggacctgggcagtggaatggctaggagatgaacttgaaagaagaccatatactggcaatcctcagtatagttacaacaattggtctcctccagtacaaagcaatgaaacagcaaatggttatttcttagaaagatcacatagtgctaggatgacacttgcaaaagcttgtgaactctgtccagaagaggagccagatgaccaggatgccccagatgagcatgagccctctccatcagaagatgccccattatatcctcattcacctgcctctcagtatcaacagaataatcatgtacatggacagccatatacaggaccagcagcacatcacttgaacaaccctcagaaaacaggccaacgaacacaagaaaattatgaaggcaatgaagaagtatcctcacctcagatgaaggatcagtgaaaagcaataattaactgcttcctttatgactatgcactaaggtcttatagtccaaactttctctgtgtctggctagtattgaaaactagataaactgctccaaaccaacatggagtaaagagcatattcactggtttatttgcagtaatttgcaatttgtcagtgtataagacacatgcagggtgaagtgtacagagttttgtaacaaatgactggtcctaatctgtaaatgagaaaggtatatatactatgttaatgtctgactgttaattcttaagcaagaaactttttttgatgaaaacaagtcagatctacacagtcacacaattattttttgttgtgttcactacattgtgcaattgatattgcctgctttgagcagtttggtcaacttaccaacttccccccaaaaaagggaacataaaagagcccatctttgtcagtttacaccaatagtttcttgttaatccttctttcctggatatataaggctggtggtaacttttgaattatatggttgatgtggaaaattggcagtgtaacatttctagatacttttcattacctttttattctggtatataggctaaccactttaaagctattcttatgctgtaacagttagcatggcttcacactgtttgtgtagccaagaggacagaattacatgaatgacagtgcccagagtgacagctgtatattgctcagagcttttatttcttatacctagaataaatataaaatgggggaaaaatgtgacagacaagcagtttttcattgcacacatattcttcacatttaatgtttgatagttcaatttcttgagctgaagaatatcaaagtatcgataatacgaattttaaaatattaaaaccaatacacaaaattttcctatgtcagaatgtggtggagcataatagattgtatttggtgtgcttgcgattttttttttccatagaatttattaagtgaagtttctaaaactttgcttctcctgatcccggtgaagtgtacatcataagaatccatagtactttgaagtaccattgcaccaagatgtctgactgaattcatagtcacacttttatttgaaagaaagaattgttgtagttttttttcattattctaaaactcttgttgttagatacaagatttaattaagatctaagctcctgcttatttaatgtaattctaaggtaccattttagaaaaaacatttgttttaagattccaagaaacctgtgagttaatactatatttaaaagagaattggtaaattttgaatgtgtgtaatattttggaacctgtttaaaaaccaaatatacctgcaaatagatacagcctatcctatactatttaaatgtttggctgttttgttttatagaaattattttgctgaattcacaaataaaatttaagaaga

SEQ ID NO: 33578 - DNA, 909 bp, Homo sapiens
aattattgaagactgcagtaactcagaggataccatcaaattacttcgcttttgctcttgggagaatcctcagttctcatctactgtcctcagcgaacttctctggcagaattcataatgcacttaaaggaattccagatgacagagatgggctgttcgatacaatacagcgctcgaagaatcactatcaaaaacgagcatatcagtgcataaaatgtatggtagctctatttagcagttgtcctgttgcttaccagatcttacagggtaacggagatcttaaaagaaaatggacctgggcagtggaatggctaggagatgaacttgaaagaagaccatatactggcaatcctcagtatagttacaacaattggtctcctccagtacaaagcaatgaaacagcaaatggttatttcttagaaagatcacatagtgctaggatgacacttgcaaaagcttgtgaactctgtccagaagaggagccagatgaccaggatgccccagatgagcatgagccctctccatcagaagatgccccattatatcctcattcacctgcctctcagtatcaacagaataatcatgtacatggacagccatatacaggaccagcagcacatcacttgaacaaccctcagaaaacaggccaacgaacacaagaaaattatgaaggcaatgaagaagtatcctcacctcagatgaaggatcagtgaaaagcaataattaactgcttcctttatgactatgcactaaggtcttatagtccaaactttctctgtgtctggctagtattgaaaactagataaactgctccaaaccaacatggagtaaagagcatattcactggtttatttgcagtaatttgcaatttgtcagtgtataagacacatgcagggtgaagtgtacaga

SEQ ID NO: 33579 - DNA, 6103 bp, Homo sapiens
taacttccggttgctgtgctgagtcggaagtgggaacccttcggccgctgagattctgtcgtgtcgtcgctgctggcacttcaggctctgcctctcccactaggtctggatggaggataccttaaagtgaaatgacagaccaggagaataacaacaacatctcaagtaacccctttgctgctctttttggctccctggctgatgccaaacagtttgcggcaatccaaaaagagcagctgaagcaacaatctgatgaactcccagctagcccagatgactcggataatagcgtgtcagagagcctggatgaattcgattactctgtggctgagattagccgctcattccgatcacagcaggaaatatgtgagcaactcaacatcaatcacatgatccaaaggatcttccttattactctggacaacagtgatcccagcttgaaaagcgggaatggcatccctagccgttgtgtgtatttggaagaaatggcagtagagctagaagatcaagactggcttgatatgagcaatgttgagcaggccctcttcgctcgcttattacttcaagatccaggcaaccacttaattaacatgacttcttctacaacgctaaatctctctgctgatcgagatgcaggagagaggcacattttttgttacctttactcctgcttccagagagccaaggaagagattaccaaagttccagagaacctgctaccctttgcagtgcagtgcagaaacctcactgtgtccaatacccgaacagttcttctcaccccagagatctatgttgaccaaaacatccatgagcaactggtagatttgatgttagaagccatccagggagcccattttgaagatgtaactgagtttctggaagaggtcattgaagccttgatattggatgaggaagttagaacatttccagaagtcatgattccagtgtttgatattttattgggccgaataaaagatctagagctctgtcagatccttttgtatgcatatctggatattcttctctatttcactaggcaaaaagatatggcaaaggtttttgtagaatacattcagcccaaggaccctaccaatgggcaaatgtaccagaagaccttgctgggagtaattctgagtatctcctgcttattaaagactccgggtgttgtagaaaatcatggctactttttgaatccatctcgttccagcccccaggagatcaaagtacaggaggccaacatccatcagttcatggctcagttccacgaaaagatctaccagatgctgaagaacttactccagctctctccagaaaccaaacactgtatcttgtcctggcttggaaactgtttgcatgcaaatgcaggccgcaccaagatttgggccaatcagatgccagaaatctttttccaaatgtatgcctcagatgctttctttctgaatctgggtgctgctctcctgaagctatgccagccattttgcaaacccagatcctctcggctcctcacctttaatcccacatactgtgccctcaaggagttgaatgatgaagaacgaaaaattaaaaatgtacacatgagaggtttggacaaagaaacctgtttgatcccagctgtgcaggagccgaagtttccacagaactacaaccttgtaacagagaaccttgctctgacagagtacaccttgtacttgggatttcacaggttgcatgatcagatggtaaaaatcaaccaaaatctgcatcggctgcaggttgcctggcgggatgctcagcaaagttctagccctgctgctgacaatcttcgtgagcagtttgaacgactgatgaccatctatctttctaccaagactgccatgacagagccacaaatgctacaaaactgcctaaacttgcaggtgtccatggctgttctactggttcaactggccataggcaatgagggctcacagccaatagagctaacctttcctttgccagatggctacagctctttggcttatgtgccagaattttttgcagataacctgggtgattttctcatttttctccgccgctttgccgatgacattttggagacatcagcagattccctggagcatgtccttcactttatcaccattttcactggaagcatagaaagaatgaagaatccccacctgagggccaaactagcagaggtgttggaagcagtgatgccccacctggatcagaccccaaatcccttggtatccagtgtgttccaccggaaacgtgtgttctgcaactttcagtatgcaccccaacttgcagaggctctaatcaaggtttttgtggacatcgaatttacaggagacccccatcaatttgaacagaagtttaattaccgccgtcccatgtatcctatcctaagatacatgtgggggacagatacctatcgggagagcattaaggatttggctgactatgcctctaagaatttagaagccatgaatcccccacttttcctccgctttcttaacctgctaatgaatgatgccatcttccttttggatgaagccatacagtatttgagcaagataaagattcagcaaattgagaaggatcgaggtgaatgggatagtctgactccagaagcccgccgagaaaaggaggctggcctacagatgtttggacagctggcacgtttccataacatcatgtccaatgaaacaatcggtacccttgcctttctcacatcagagatcaagtcactctttgtgcatcccttcctggctgagcgcatcatctccatgttgaactacttcctgcaacacctggttggccccaagatgggtgccttaaaagtcaaggacttcagcgaatttgacttcaaaccccagcagcttgtatcagatatctgcactatctacttaaatcttggggatgaggagaatttctgtgccactgtgcccaaggatggacgttcctattccccaactctctttgcacagacagttcgagtcttgaagaaaataaataagcctgggaatatgattatggctttcagcaacttggcagagagaatcaagtctcttgcagacctccaacaacaggaagaggaaacctatgcagatgcctgtgatgagttcctggatcccattatgagcacactgatgtgtgaccctgtggtgctgccatcttccagagtcactgtggatagatccaccattgcaagacatttgctcagtgaccaaacagatccctttaaccgtagtcccctcaccatggaccagatccggccaaacacagaactaaaagaaaaaatccaacggtggcttgcagagaggaaacaacaaaaggagcaacttgaatagatactgtgaactaaccaaaccaaaaccaaccccagagtgcagataaacaattgtttgtggtttctctctttctggttctgttccttttctttcttcttttctttttcttttttttttttttttttactaaattagagaactgctcttgctgaaattatgatagttaagattcctaagaacttgacaatgctcccctggcttgcaggaaattatacttattatagcatcaccaagtttagaaatcatcactaattttcaccctctgttgtctcttcatattcttcttccttttcctaaatgaaattatattatttcaactactaaaacttcccgccaccctgctatttctcttccaattactgttcaaacatttttggtgagtgctgcttttataaatatgtgatgtcacatatttcagtgacagctgatgttatcagaaaaatcctgttatcctgtgtatttactagtcctcatgatctagacttaaccccttttctgtgttacagagtaacttcacataaaagcagatacctttaagtttgtgtagacttctgaataagatgatagacgagaattttttttaaaaaaggaatttaaaggaatcttgtgcaacttctgttgatagctcttaattttgttatacagtctttttaatgaggattggtagggcaatcctaccaattgatgggggtgaggagactgttgggcccttattctcttatgaaaatctgtttctacaaggactaggcctaagtagatttaggcaacgggtatcatatccatgaaaaatgtcattttaagacactaatatcaacagtatatctcagtgtgtgagatatataaatacacatacaccccatgtgcttttttgttggtttagtgtaaactgagtaccactttatattttctcttccatagtgagatgtatgcagtatgtggccatgtttactaacatactcattcttcacaaaattctgagattataaaatgtatatagttaatatttgtttgagcttgtgacctgacttctaagagctacttctaacacagccttaggtcttcaattaacaaagtaggaagttgagcacaaccttgtccacagccattttaaatatccacttagccctgtgtagttggtaggtggacaccactttcataagtgaacttgagctcactactcaattgtgcagcttaatatgctgactagggacattcccctatggattatctttatatcactgtctttctaagcccagagatgtcataagtgacaagaaaagtgataggatcaagaaatgggtgtcactgcttcatttggaacatgttattaactatggtctctttcaaataaatagtagttttatatttcaacacaagttgctataagcagtccttgatgggtttttgattgcatcagctggaaagcctcaaatctaagagggcttcccatcctagatataaaataggtgttgcctattgctgtgcttataaaatgaaaaaggaaattgaggacacttttgcaaatgccagaatgtaagattcattcagtgtgctccctgggcctttatggcatgggttgacaggatttgtttattttctaaaattagcttcattcaatatttatcatcctcctttccctctctgagaatgaactatgtataaaataagcttctgcctatttgcatttatcttccaaacccaatctagtaggatgttctcattttaaaaacgaggggaaaagaccagagtttttcaggagaaaactggaggaaaatgggcacaaaaactcagaaggcagctattcccagcagcttcctagttaacaacccccatgctgcctccagtctttgtctgtattcttctgtatttaaccttcagattgtaagccttttctggcaagcttttcttctttttttaaactcttttcctgaaactttttatgaatggctatggcaccattaatgctgctgaatatctttaaactctgcacaagcaagtgtgtagcttaaggccactactggtaaggaaaccaagtgtcctctgtgccttttttctttctgtgaagtaatttaagaatatccaaaaaaattagactttaaaaagttatcttggtacaacaccgtgtgtatatacacttggaagcttaaaaaggtgttttgtctggaacttagaagcagctctaaatctagtagagcagactttctaacatacctagttttgtgtattggctttgctggagtatgatagcaaaatgaagactcttttactcagctctggtattgctcataacttaccaagaggctaatactaaacttggaaaattgtttaagtatgttttatcaagcagtctgggttttgttttttaatatactttttaatggatatgtgaaaactgaaggaaatgttaaaggttttttaatggtgcaagtgaaggtgccagttgctatttgatatcacactctacaaaagcttcattactttatttgatggtggttgctaagcagccattgcacagagcataagtctactgggtgcctttacatgccagaggctgatgctgcactgttgatgtcatgtgaggaaataatgcacatgctctaactgctcaacaggaaatgaacctagaaacagaaaatgaaaaggttgattgaaataaaacttgatcaacgcgactgtattttgaaacattccaggaaggttacttcttgtcaaacttgcctggcagtgtttgttcaaaacttgtatttaataaatgaacatctgacttacaa

SEQ ID NO: 33580 - DNA, 6061 bp, Homo sapiens
cgtgtcgtcgctgctggcacttcaggctctgcctctcccactaggtctggatggaggataccttaaagtgaaatgacagaccaggagaataacaacaacatctcaagtaacccctttgctgctctttttggctccctggctgatgccaaacagtttgcggcaatccaaaaagagcagctgaagcaacaatctgatgaactcccagctagcccagatgactcggataatagcgtgtcagagagcctggatgaattcgattactctgtggctgagattagccgctcattccgatcacagcaggaaatatgtgagcaactcaacatcaatcacatgatccaaaggatcttccttattactctggacaacagtgatcccagcttgaaaagcgggaatggcatccctagccgttgtgtgtatttggaagaaatggcagtagagctagaagatcaagactggcttgatatgagcaatgttgagcaggccctcttcgctcgcttattacttcaagatccaggcaaccacttaattaacatgacttcttctacaacgctaaatctctctgctgatcgagatgcaggagagaggcacattttttgttacctttactcctgcttccagagagccaaggaagagattaccaaagttccagagaacctgctaccctttgcagtgcagtgcagaaacctcactgtgtccaatacccgaacagttcttctcaccccagagatctatgttgaccaaaacatccatgagcaactggtagatttgatgttagaagccatccagggagcccgtgagtacatgaacaagatctattttgaagatgtaactgagtttctggaagaggtcattgaagccttgatattggatgaggaagttagaacatttccagaagtcatgattccagtgtttgatattttattgggccgaataaaagatctagagctctgtcagatccttttgtatgcatatctggatattcttctctatttcactaggcaaaaagatatggcaaaggtttttgtagaatacattcagcccaaggaccctaccaatgggcaaatgtaccagaagaccttgctgggagtaattctgagtatctcctgcttattaaagactccgggtgttgtagaaaatcatggctactttttgaatccatctcgttccagcccccaggagatcaaagtacaggaggccaacatccatcagttcatggctcagttccacgaaaagatctaccagatgctgaagaacttactccagctctctccagaaaccaaacactgtatcttgtcctggcttggaaactgtttgcatgcaaatgcaggccgcaccaagatttgggccaatcagatgccagaaatctttttccaaatgtatgcctcagatgctttctttctgaatctgggtgctgctctcctgaagctatgccagccattttgcaaacccagatcctctcggctcctcacctttaatcccacatactgtgccctcaaggagttgaatgatgaagaacgaaaaattaaaaatgtacacatgagaggtttggacaaagaaacctgtttgatcccagctgtgcaggagccgaagtttccacagaactacaaccttgtaacagagaaccttgctctgacagagtacaccttgtacttgggatttcacaggttgcatgatcagatggtaaaaatcaaccaaaatctgcatcggctgcaggttgcctggcgggatgctcagcaaagttctagccctgctgctgacaatcttcgtgagcagtttgaacgactgatgaccatctatctttctaccaagactgccatgacagagccacaaatgctacaaaactgcctaaacttgcaggtgtccatggctgttctactggttcaactggccataggcaatgagggctcacagccaatagagctaacctttcctttgccagatggctacagctctttggcttatgtgccagaattttttgcagataacctgggtgattttctcatttttctccgccgctttgccgatgacattttggagacatcagcagattccctggagcatgtccttcactttatcaccattttcactggaagcatagaaagaatgaagaatccccacctgagggccaaactagcagaggtgttggaagcagtgatgccccacctggatcagaccccaaatcccttggtatccagtgtgttccaccggaaacgtgtgttctgcaactttcagtatgcaccccaacttgcagaggctctaatcaaggtttttgtggacatcgaatttacaggagacccccatcaatttgaacagaagtttaattaccgccgtcccatgtatcctatcctaagatacatgtgggggacagatacctatcgggagagcattaaggatttggctgactatgcctctaagaatttagaagccatgaatcccccacttttcctccgctttcttaacctgctaatgaatgatgccatcttccttttggatgaagccatacagtatttgagcaagataaagattcagcaaattgagaaggatcgaggtgaatgggatagtctgactccagaagcccgccgagaaaaggaggctggcctacagatgtttggacagctggcacgtttccataacatcatgtccaatgaaacaatcggtacccttgcctttctcacatcagagatcaagtcactctttgtgcatcccttcctggctgagcgcatcatctccatgttgaactacttcctgcaacacctggttggccccaagatgggtgccttaaaagtcaaggacttcagcgaatttgacttcaaaccccagcagcttgtatcagatatctgcactatctacttaaatcttggggatgaggagaatttctgtgccactgtgcccaaggatggacgttcctattccccaactctctttgcacagacagttcgagtcttgaagaaaataaataagcctgggaatatgattatggctttcagcaacttggcagagagaatcaagtctcttgcagacctccaacaacaggaagaggaaacctatgcagatgcctgtgatgagttcctggatcccattatgagcacactgatgtgtgaccctgtggtgctgccatcttccagagtcactgtggatagatccaccattgcaagacatttgctcagtgaccaaacagatccctttaaccgtagtcccctcaccatggaccagatccggccaaacacagaactaaaagaaaaaatccaacggtggcttgcagagaggaaacaacaaaaggagcaacttgaatagatactgtgaactaaccaaaccaaaaccaaccccagagtgcagataaacaattgtttgtggtttctctctttctggttctgttccttttctttcttcttttctttttcttttttttttttttttttactaaattagagaactgctcttgctgaaattatgatagttaagattcctaagaacttgacaatgctcccctggcttgcaggaaattatacttattatagcatcaccaagtttagaaatcatcactaattttcaccctctgttgtctcttcatattcttcttccttttcctaaatgaaattatattatttcaactactaaaacttcccgccaccctgctatttctcttccaattactgttcaaacatttttggtgagtgctgcttttataaatatgtgatgtcacatatttcagtgacagctgatgttatcagaaaaatcctgttatcctgtgtatttactagtcctcatgatctagacttaaccccttttctgtgttacagagtaacttcacataaaagcagatacctttaagtttgtgtagacttctgaataagatgatagacgagaattttttttaaaaaaggaatttaaaggaatcttgtgcaacttctgttgatagctcttaattttgttatacagtctttttaatgaggattggtagggcaatcctaccaattgatgggggtgaggagactgttgggcccttattctcttatgaaaatctgtttctacaaggactaggcctaagtagatttaggcaacgggtatcatatccatgaaaaatgtcattttaagacactaatatcaacagtatatctcagtgtgtgagatatataaatacacatacaccccatgtgcttttttgttggtttagtgtaaactgagtaccactttatattttctcttccatagtgagatgtatgcagtatgtggccatgtttactaacatactcattcttcacaaaattctgagattataaaatgtatatagttaatatttgtttgagcttgtgacctgacttctaagagctacttctaacacagccttaggtcttcaattaacaaagtaggaagttgagcacaaccttgtccacagccattttaaatatccacttagccctgtgtagttggtaggtggacaccactttcataagtgaacttgagctcactactcaattgtgcagcttaatatgctgactagggacattcccctatggattatctttatatcactgtctttctaagcccagagatgtcataagtgacaagaaaagtgataggatcaagaaatgggtgtcactgcttcatttggaacatgttattaactatggtctctttcaaataaatagtagttttatatttcaacacaagttgctataagcagtccttgatgggtttttgattgcatcagctggaaagcctcaaatctaagagggcttcccatcctagatataaaataggtgttgcctattgctgtgcttataaaatgaaaaaggaaattgaggacacttttgcaaatgccagaatgtaagattcattcagtgtgctccctgggcctttatggcatgggttgacaggatttgtttattttctaaaattagcttcattcaatatttatcatcctcctttccctctctgagaatgaactatgtataaaataagcttctgcctatttgcatttatcttccaaacccaatctagtaggatgttctcattttaaaaacgaggggaaaagaccagagtttttcaggagaaaactggaggaaaatgggcacaaaaactcagaaggcagctattcccagcagcttcctagttaacaacccccatgctgcctccagtctttgtctgtattcttctgtatttaaccttcagattgtaagccttttctggcaagcttttcttctttttttaaactcttttcctgaaactttttatgaatggctatggcaccattaatgctgctgaatatctttaaactctgcacaagcaagtgtgtagcttaaggccactactggtaaggaaaccaagtgtcctctgtgccttttttctttctgtgaagtaatttaagaatatccaaaaaaattagactttaaaaagttatcttggtacaacaccgtgtgtatatacacttggaagcttaaaaaggtgttttgtctggaacttagaagcagctctaaatctagtagagcagactttctaacatacctagttttgtgtattggctttgctggagtatgatagcaaaatgaagactcttttactcagctctggtattgctcataacttaccaagaggctaatactaaacttggaaaattgtttaagtatgttttatcaagcagtctgggttttgttttttaatatactttttaatggatatgtgaaaactgaaggaaatgttaaaggttttttaatggtgcaagtgaaggtgccagttgctatttgatatcacactctacaaaagcttcattactttatttgatggtggttgctaagcagccattgcacagagcataagtctactgggtgcctttacatgccagaggctgatgctgcactgttgatgtcatgtgaggaaataatgcacatgctctaactgctcaacaggaaatgaacctagaaacagaaaatgaaaaggttgattgaaataaaacttgatcaacgcgactgtattttgaaacattccaggaaggttacttcttgtcaaacttgcctggcagtgtttgttcaaaacttgtatttaataaatgaacatctgactt

SEQ ID NO: 33581 - DNA, 2149 bp, Homo sapiens
gtataagtagaggaagaaaacagcaactcagtcatagaaagggacactaagaatagcaatttttaatgccttctcaagatacctgaattgatgcagagcatttttcaaaactactcagtcaacacattgccggaagaaggaaattatgtctttagagagaaatctccatcatagacattttaaataagacagtagataaaagttcagcatgtgcttaagctgctcagctgcctagattcaaacaaaaaatgaatatcatctagtttcccaatattagctagctcaagacattatctacagggccaaaggaaatgattttggactattatccataactttgaattatgtgtcttcctttcagtagagaatattaggctgaccttttctgaagaataatttaatttaatattgaacaacagagagctggaagctgctcttagattgcatctcaggttgcatgatcagatggtaaaaatcaaccaaaatctgcatcggctgcaggttgcctggcgggatgctcagcaaagttctagccctgctgctgacaatcttcgtgagcagtttgaacgactgatgaccatctatctttctaccaagactgccatgacagagccacaaatgctacaaaactgcctaaacttgcaggtgtccatggctgttctactggttcaactggccataggcaatgagggctcacagccaatagagctaacctttcctttgccagatggctacagctctttggcttatgtgccagaattttttgcagataacctgggtgattttctcatttttctccgccgctttgccgatgacattttggagacatcagcagattccctggagcatgtccttcactttatcaccattttcactggaagcatagaaagaatgaagaatccccacctgagggccaaactagcagaggtgttggaagcagtgatgccccacctggatcagaccccaaatcccttggtatccagtgtgttccaccggaaacgtgtgttctgcaactttcagtatgcaccccaacttgcagaggctctaatcaaggtttttgtggacatcgaatttacaggagacccccatcaatttgaacagaagtttaattaccgccgtcccatgtatcctatcctaagatacatgtgggggacagatacctatcgggagagcattaaggatttggctgactatgcctctaagaatttagaagccatgaatcccccacttttcctccgctttcttaacctgctaatgaatgatgccatcttccttttggatgaagccatacagtatttgagcaagataaagattcagcaaattgagaaggatcgaggtgaatgggatagtctgactccagaagcccgccgagaaaaggaggctggcctacagatgtttggacagctggcacgtttccataacatcatgtccaatgaaacaatcggtacccttgcctttctcacatcagagatcaagtcactctttgtgcatcccttcctggctgagcgcatcatctccatgttgaactacttcctgcaacacctggttggccccaagatgggtgccttaaaagtcaaggacttcagcgaatttgacttcaaaccccagcagcttgtatcagatatctgcactatctacttaaatcttggggatgaggagaatttctgtgccactgtgcccaaggatggacgttcctattccccaactctctttgcacagacagttcgagtcttgaagaaaataaataagcctgggaatatgattatggctttcagcaacttggcagagagaatcaagtctcttgcagacctccaacaacaggaagaggaaacctatgcagatgcctgtgatgagttcctggatcccattatgagcacactgatgtgtgaccctgtggtgctgccatcttccagagtcactgtggatagatccaccattgcaagacatttgctcagtgaccaaacagatccctttaaccgtagtcccctcaccatggaccagatccggccaaacacagaactaaaagaaaaaatccaacggtggcttgcagagaggaaacaacaaaaggagcaacttgaatagatactgtgaactaaccaaaccaaaaccaaccccagagtgcagataaacaattgtttgtggtttctct

SEQ ID NO: 33582 - DNA, 4772 bp, Homo sapiens
gacggggtgggacggaggcggggagaggacgcaggcgagaggaactcggcggcgcggcgcccgcggcctattggctgccacgtcccggcgccagaagccccgcctccctgacgggggtcacgtgatccctttcaaagatggccgccctgttgttttgatgaataatacttggtggggcgagggggaaagagtaggggtggaggggtaggaggatttactcttccagcgagagctacgcgcatcccatcctccccctcccccctacccgggctccggcgtggaggcggggcgtggccggcctgctttgggaggggaggggcttcccttacagtgctgggctctgccaggacggctgtggggtcgccttacctcggggtatccactctgcagtcgaccagttcccgccaggagcaaagggtaggaaggagagcaggatctgctgtaggaacgcagctaccgcgccactatcacgaagaaacagcaggctcggggcacgagacgaactggagaccgcgctgcctagctgggtaacctgggaagcagagggtaataagtggcgccttaagacaaccctgtagcagcagcagtggcggccaaaggaggctgctcagggaacaagcggctgtagtagtctgtggggcgactggagtgaccgaagccaaggcagtttagtgcctctcgtgttcttattttttaacctctgactatgcaattctgaaacctcccccattcgggggaccagacagcctgatagacaccttccactctccttcctcccgccgtggtctcgagaacagaaggatctctccttaacgcctttcaccattaagaggaaagcgatggaggagctgagcgctgatgagattcgacggaggcgccttgcacgacttgctggtggacagacctctcagccaaccaccccactcacctctccccagagggagaaccctccggggcctcccatagcggcatcagccccaggaccctctcagagtcttggtctcaatgtccacaacatgaccccagctacctccccaataggtgcatcaggagtagcccatcgaagccagagcagtgaaggagtcagttctctcagcagctcgccctctaatagccttgaaacgcaatctcagtctctctcacgttcccagagcatggatatcgatggtgtctcatgtgagaaaagcatgtcccaggtggatgtggattcaggaattgaaaacatggaggttgatgaaaatgatcgaagagaaaagcggagcctcagtgataaggagccttcctcgggccctgaagtgtctgaagagcaggccttacagctggtctgtaagatcttccgtgtctcttggaaggaccgggacagagatgtcatctttctttcttctctttctgcacagtttaagcagaacccaaaagaagtattctccgattttaaggacttgattggccagattttaatggaagtgctaatgatgtccactcagaccagagatgaaaacccatttgccagtctgacagccacatcacagccaattgctgcagcagcacggtcaccagacagaaatctcttgctaaacactggctccaatccaggaacaagccccatgttctgcagcgtggcttcctttggtgccagctctttgtctagtttgggagcctctggtggagcaagtaattgggattcctacagtgaccatttcaccattgaaacctgcaaagagacagatatgctgaactacctcatcgagtgtttcgaccgagttggaatagaggaaaaaaaagcaccaaagatgtgcagccagccagcagtcagccagcttctgagcaacatccgctcacagtgcatatcccatactgctttagtactacaaggctccctaacacagcccaggtccttgcagcagccgtccttcctagtgccgtatatgctgtgtaggaatctcccatatggcttcattcaggaactggtgagaaccactcaccaggatgaagaagtgttcaagcagatatttatccccattttacaaggcctggctcttgctgccaaagagtgctccctcgacagtgactactttaaataccccctcatggcactaggtgagctctgtgaaaccaagtttgggaagacacaccctgtgtgcaatttggttgcttctttgcggttgtggttgccgaaatccttaagtcctggctgtgggcgggagctgcagagactctcttacttaggggctttctttagcttctcagtctttgcagaagatgatgttaaagtggttgaaaaatacttctcagggcctgccattaccctggaaaacactcgtgtggttagccaatcattgcagcattacttagagctcggaaggcaagagctttttaagattctgcatagtattttgttaaatggcgaaacccgtgaggctgctctcagttacatggcggctgtcgtcaatgccaatatgaagaaagcacagatgcagacagatgatagattggtgtctacagatggatttatgctgaatttcctttgggtactgcagcagctaagtacaaaaatcaagttagaaacagttgatcccacgtatatttttcacccaagatgtcggattactcttcccaatgatgagacgcgtgtgaatgcaacgatggaagatgtgaatgactggctgactgaactctatggcgatcagcctccattttctgagccgaaattccctacggagtgcttctttctcaccctgcatgctcaccacctctctattctgcctagttgccgtcgctatatccgcagactccgggctatccgggagctcaatagaactgtagaagatttgaaaaataatgaaagccaatggaaagattccccactggcaactagacaccgcgaaatgctgaagcgctgtaaaactcagcttaagaaactggtacggtgcaaggcctgtgctgatgctggcctacttgacgagagcttcctgagaagatgtctgaatttttatggccttctcattcagctgctgctccgcatcctggaccccgcatatcccgatataacactgcctttaaattcagatgtccccaaggtatttgcagcgttgcctgagttttatgtagaagatgttgcagaatttttattttttattgtacaatactctccccaggcgctttatgagccctgtactcaggatattgtgatgttccttgttgtgatgttgtgcaaccagaactacatccgaaacccatatttggtggccaaactggtagaagtcatgtttatgaccaaccctgctgttcagccacgaacccagaagttttttgaaatgattgagaaccatcctctctccaccaagttgttggtaccttccctgatgaagttttatacagatgttgagcataccggagccaccagtgagttttatgacaagttcacaattcgctatcatattagcaccatttttaaaagcctttggcaaaacatagctcaccatggcacctttatggaggagttcaactccgggaagcagtttgttcgctatataaacatgttgataaacgacacgacgtttttgctcgatgaaagtctggagtctctgaagcgaatccatgaagtgcaggaagagatgaagaacaaagaacagtgggaccagttgccccgggatcagcagcaggctcgtcagtctcagcttgctcaggatgagcgtgtgtcccgctcttacctcgccctggccaccgaaaccgtggacatgttccacatcctcacgaagcaggtccagaagcccttcctcagaccggagcttggaccccgattggctgcaatgctgaactttaatcttcagcaactttgtggccccaagtgccgtgacctgaaagttgaaaaccctgagaaatacggctttgaaccaaagaagctgttggaccaactgacggatatttacttacagctggactgtgctcggttcgcgaaagccattgctgacgaccagagatcctacagtaaggaattgtttgaagaagttatttcaaagatgcggaaggcagggatcaaatccacaatagcaatagaaaaatttaagctgctcgccgagaaagtggaggagatagtggccaagaacgcacgcgcagaaatcgactacagcgacgctcctgatgagttcagagaccctctgatggacaccctcatgacagaccccgtgcggctgccctctggcaccatcatggaccgctccatcatcctgcggcacctgctcaactcccccacggaccccttcaaccggcagacgctgacagagagcatgctggaaccagtgccagaactgaaagagcagattcaggcgtggatgagagagaaacagaacagcgatcactaaaccgttccgccgcccaccctctgctagacacagccaaggccaacgaggcaagcagaagcagcggccgcagcgaagctgccgttcatgtgttggaggccaaatgtggcaaaccaaccccaggcccacccagagcgagcaaacgctgagacctgaaaggacatggatgagaagaggagcccgcttcctgtacatatatttaagtgacaaacacggtcaaaagcttaagggacaggttttatggttgcttgtgtaataaagcatgtccttcgtatgtcacagtttggggcaacggaagtcttttagtgatggctaatgggtctgggcagcatcccttcatgaatttttttttaatccaatatccgttgatttgattgtgattagagaaccttggacattttgctgctaaagaat

SEQ ID NO: 33583 - DNA, 5267 bp, Homo sapiens
ctctccttcctcccgccgtggtctcgagaacagaaggatctctccttaacgcctttcaccattaagaggaaagcgatggaggagctgagcgctgatgagattcgacggaggcgccttgcacgacttgctggtggacagacctctcagccaaccaccccactcacctctccccagagggagaaccctccggggcctcccatagcggcatcagccccaggaccctctcagagtcttggtctcaatgtccacaacatgaccccagctacctccccaataggtgcatcaggagtagcccatcgaagccagagcagtgaaggagtcagttctctcagcagctcgccctctaatagccttgaaacgcaatctcagtctctctcacgttcccagagcatggatatcgatggtgtctcatgtgagaaaagcatgtcccaggtggatgtggattcaggaattgaaaacatggaggttgatgaaaatgatcgaagagaaaagcggagcctcagtgataaggagccttcctcgggccctgaagtgtctgaagagcaggccttacagctggtctgtaagatcttccgtgtctcttggaaggaccgggacagagatgtcatctttctttcttctctttctgcacagtttaagcagaacccaaaagaagtattctccgattttaaggacttgattggccagattttaatggaagtgctaatgatgtccactcagaccagagatgaaaacccatttgccagtctgacagccacatcacagccaattgctgcagcagcacggtcaccagacagaaatctcttgctaaacactggctccaatccaggaacaagccccatgttctgcagcgtggcttcctttggtgccagctctttgtctagcctctatgaaagtagtccggctcccactcccagtttctggagctctgttcccgtgatgggcccgtctcttgcctcaccttcccgtgcagccagccagttggctgtgccttccactcccctcagtcctcacagtgcagcctctggaactgctgcgggaagccagccttcatccccgcggtatcgcccctacactgtcactcacccatgggcgtcctcaggcgtctccattctgtcgagctccccaagtccccctgccctcgccagtagcccccaagcagtgcccgccagcagttccagacagaggcccagcagcacgggtccacccctaccacccgcctcacccagtgccacgagcagacgcccctcctccctgaggatctctcctagtttgggagcctctggtggagcaagtaattgggattcctacagtgaccatttcaccattgaaacctgcaaagagacagatatgctgaactacctcatcgagtgtttcgaccgagttggaatagaggaaaaaaaagcaccaaagatgtgcagccagccagcagtcagccagcttctgagcaacatccgctcacagtgcatatcccatactgctttagtactacaaggctccctaacacagcccaggtccttgcagcagccgtccttcctagtgccgtatatgctgtgtaggaatctcccatatggcttcattcaggaactggtgagaaccactcaccaggatgaagaagtgttcaagcagatatttatccccattttacaaggcctggctcttgctgccaaagagtgctccctcgacagtgactactttaaataccccctcatggcactaggtgagctctgtgaaaccaagtttgggaagacacaccctgtgtgcaatttggttgcttctttgcggttgtggttgccgaaatccttaagtcctggctgtgggcgggagctgcagagactctcttacttaggggctttctttagcttctcagtctttgcagaagatgatgttaaagtggttgaaaaatacttctcagggcctgccattaccctggaaaacactcgtgtggttagccaatcattgcagcattacttagagctcggaaggcaagagctttttaagattctgcatagtattttgttaaatggcgaaacccgtgaggctgctctcagttacatggcggctgtcgtcaatgccaatatgaagaaagcacagatgcagacagatgatagattggtgtctacagatggatttatgctgaatttcctttgggtactgcagcagctaagtacaaaaatcaagttagaaacagttgatcccacgtatatttttcacccaagatgtcggattactcttcccaatgatgagacgcgtgtgaatgcaacgatggaagatgtgaatgactggctgactgaactctatggcgatcagcctccattttctgagccgaaattccctacggagtgcttctttctcaccctgcatgctcaccacctctctattctgcctagttgccgtcgctatatccgcagactccgggctatccgggagctcaatagaactgtagaagatttgaaaaataatgaaagccaatggaaagattccccactggcaactagacaccgcgaaatgctgaagcgctgtaaaactcagcttaagaaactggtacggtgcaaggcctgtgctgatgctggcctacttgacgagagcttcctgagaagatgtctgaatttttatggccttctcattcagctgctgctccgcatcctggaccccgcatatcccgatataacactgcctttaaattcagatgtccccaaggtatttgcagcgttgcctgagttttatgtagaagatgttgcagaatttttattttttattgtacaatactctccccaggcgctttatgagccctgtactcaggatattgtgatgttccttgttgtgatgttgtgcaaccagaactacatccgaaacccatatttggtggccaaactggtagaagtcatgtttatgaccaaccctgctgttcagccacgaacccagaagttttttgaaatgattgagaaccatcctctctccaccaagttgttggtaccttccctgatgaagttttatacagatgttgagcataccggagccaccagtgagttttatgacaagttcacaattcgctatcatattagcaccatttttaaaagcctttggcaaaacatagctcaccatggcacctttatggaggagttcaactccgggaagcagtttgttcgctatataaacatgttgataaacgacacgacgtttttgctcgatgaaagtctggagtctctgaagcgaatccatgaagtgcaggaagagatgaagaacaaagaacagtgggaccagttgccccgggatcagcagcaggctcgtcagtctcagcttgctcaggatgagcgtgtgtcccgctcttacctcgccctggccaccgaaaccgtggacatgttccacatcctcacgaagcaggtccagaagcccttcctcagaccggagcttggaccccgattggctgcaatgctgaactttaatcttcagcaactttgtggccccaagtgccgtgacctgaaagttgaaaaccctgagaaatacggctttgaaccaaagaagctgttggaccaactgacggatatttacttacagctggactgtgctcggttcgcgaaagccattgctgacgaccagagatcctacagtaaggaattgtttgaagaagttatttcaaagatgcggaaggcagggatcaaatccacaatagcaatagaaaaatttaagctgctcgccgagaaagtggaggagatagtggccaagaacgcacgcgcagaaatcgactacagcgacgctcctgatgagttcagagaccctctgatggacaccctcatgacagaccccgtgcggctgccctctggcaccatcatggaccgctccatcatcctgcggcacctgctcaactcccccacggaccccttcaaccggcagacgctgacagagagcatgctggaaccagtgccagaactgaaagagcagattcaggcgtggatgagagagaaacagaacagcgatcactaaaccgttccgccgcccaccctctgctagacacagccaaggccaacgaggcaagcagaagcagcggccgcagcgaagctgccgttcatgtgttggaggccaaatgtggcaaaccaaccccaggcccacccagagcgagcaaacgctgagacctgaaaggacatggatgagaagaggagcccgcttcctgtacatatatttaagtgacaaacacggtcaaaagcttaagggacaggttttatggttgcttgtgtaataaagcatgtccttcgtatgtcacagtttggggcaacggaagtcttttagtgatggctaatgggtctgggcagcatcccttcatgaatttttttttaatccaatatccgttgatttgattgtgattagagaaccttggacattttgctgctaaagaatcttttttcccctctcccccttcctgaccctacttgcactgctgtggatttttttaagagaagcaaaaacaaaagtaaactcctttccctggccctccaaacatatattctgtgagataactgtgcctgctaccaagtgttaatcctgggatcgtatttttatatcatattcacatatttgtttttttaattggtgttagatgacatgattaataaaaaaggcaagatattttcagaatttgaatttcagttttttttttcttttgaaatgtccctttaagatttttttattctaaacaaaataaagaaaatcctgctgctctggtccttgtgataagcctctcttcggcatctgaggagcagctgcagcaaaatctaggggtgtaagtgtatcaggacttatgtgacttatattttggggagatgagggttgggttttttttttaatgctacgtgacagtttgaaaccttcacagttatcctctgggggtaaatcaattcttcaacccttgggtgtgtgagtttgaggcagggtcatttgtgtgatgtgtttggccttaccaaagcaaaagagggtgcaagaatgtgggagtatgtctgccggtttcaacacacacagacaaacacagccacacgcgcacacaagtataagactttttgtattactgctccctacttaacatacttgaattctcaaatttcctttggggtaaaaaaaaaaaaaggatttgaaaccataaagtgttctgaagaaattaagtctataaaaagcatactttcttttttcttttccttttttccctccacagacaatgtcctctgttcaattcctaacgcaaactacaataaatggtgacacacgttcagaagaaa

SEQ ID NO: 33584 - DNA, 1273 bp, Homo sapiens
taggaacgcagctaccgcgccactatcacgaagaaacagcaggctcggggcacgagacgaactggagaccgcgctgcctagctgggtaacctgggaagcagagggtaataagtggcgccttaagacaaccctgtagcagcagcagtggcggccaaaggaggctgctcagggaacaagcggctgtagtagtctgtggggcgactggagtgaccgaagccaaggcagtttagtgcctctcgtgttcttattttttaacctctgactatgcaattctgaaacctcccccattcgggggaccagacagcctgatagacaccttccactctccttcctcccgccgtggtctcgagaacagaaggatctctccttaacgcctttcaccattaagaggaaagcgatggaggagctgagcgctgatgagattcgacggaggcgccttgcacgacttgctggtggacagacctctcagccaaccaccccactcacctctccccagagggagaaccctccggggcctcccatagcggcatcagccccaggaccctctcagagtcttggtctcaatgtccacaacatgaccccagctacctccccaataggtgcatcaggtttaggtattatctctgatgacaagatgattaagactgaatttggttctgctgattttatgaatttggttgatggttttaagataaaataatctgaaaatgcaagattaaaataatggtcaaaatgaacacctctaattgcagatttcctcgtcttcattctgcattggcacagaactttttctttaacttttcagaggataaaactacctgataggatgtttagaactatctcattaaaaagtaaaagtttatttctttataataaatgagctgatgcttgatatccaggactgtctttgttgggaaatgatatttctcatactgtgtatttgaaaatatctctcttttgtctgtgaacttttctatcaaatatagtattattgtcatataataataattactattttataattaggattctagttgcgtaaagggggtgctaagagaactgcattgatcataatatcatctaataatttgatagccttctgaatcatctgtcttcttgatctagaatcgtgtcaattaaaagtatttgcagagtttttgttgctgtacttctcgttaggtatcagtgtagactatagatatatataaatgtttatacctaatgtggttcaaccaaaacatctgttagtaataaagaagatccttgcctataa

SEQ ID NO: 33585 - DNA, 5522 bp, Homo sapiens
ccctttcaaagatggccgccctgttgttttgatgaataatacttggtggggcgagggggaaagagtaggggtggaggggtaggaggatttactcttccagcgagagctacgcgcatcccatcctccccctcccccctacccgggctccggcgtggaggcggggcgtggccggcctgctttgggaggggaggggcttcccttacagtgctgggctctgccaggacggctgtggggtcgccttacctcggggtatccactctgcagtcgaccagttcccgccaggagcaaagggtaggaaggagagcaggatctgctgtaggaacgcagctaccgcgccactatcacgaagaaacagcaggctcggggcacgagacgaactggagaccgcgctgcctagctgggtaacctgggaagcagagggtaataagtggcgccttaagacaaccctgtagcagcagcagtggcggccaaaggaggctgctcagggaacaagcggctgtagtagtctgtggggcgactggagtgaccgaagccaaggcagtttagtgcctctcgtgttcttattttttaacctctgactatgcaattctgaaacctcccccattcgggggaccagacagcctgatagacaccttccactctccttcctcccgccgtggtctcgagaacagaaggatctctccttaacgcctttcaccattaagaggaaagcgatggaggagctgagcgctgatgagattcgacggaggcgccttgcacgacttgctggtggacagacctctcagccaaccaccccactcacctctccccagagggagaaccctccggggcctcccatagcggcatcagccccaggaccctctcagagtcttggtctcaatgtccacaacatgaccccagctacctccccaataggtgcatcaggagtagcccatcgaagccagagcagtgaaggagtcagttctctcagcagctcgccctctaatagccttgaaacgcaatctcagtctctctcacgttcccagagcatggatatcgatggtgtctcatgtgagaaaagcatgtcccaggtggatgtggattcaggaattgaaaacatggaggttgatgaaaatgatcgaagagaaaagcggagcctcagtgataaggagccttcctcgggccctgaagtgtctgaagagcaggccttacagctggtctgtaagatcttccgtgtctcttggaaggaccgggacagagatgtcatctttctttcttctctttctgcacagtttaagcagaacccaaaagaagtattctccgattttaaggacttgattggccagattttaatggaagtgctaatgatgtccactcagaccagagatgaaaacccatttgccagtctgacagccacatcacagccaattgctgcagcagcacggtcaccagacagaaatctcttgctaaacactggctccaatccaggaacaagccccatgttctgcagcgtggcttcctttggtgccagctctttgtctagtttgggagcctctggtggagcaagtaattgggattcctacagtgaccatttcaccattgaaacctgcaaagagacagatatgctgaactacctcatcgagtgtttcgaccgagttggaatagaggaaaaaaaagcaccaaagatgtgcagccagccagcagtcagccagcttctgagcaacatccgctcacagtgcatatcccatactgctttagtactacaaggctccctaacacagcccaggtccttgcagcagccgtccttcctagtgccgtatatgctgtgtaggaatctcccatatggcttcattcaggaactggtgagaaccactcaccaggatgaagaagtgttcaagcagatatttatccccattttacaaggcctggctcttgctgccaaagagtgctccctcgacagtgactactttaaataccccctcatggcactaggtgagctctgtgaaaccaagtttgggaagacacaccctgtgtgcaatttggttgcttctttgcggttgtggttgccgaaatccttaagtcctggctgtgggcgggagctgcagagactctcttacttaggggctttctttagcttctcagtctttgcagaagatgatgttaaagtggttgaaaaatacttctcagggcctgccattaccctggaaaacactcgtgtggttagccaatcattgcagcattacttagagctcggaaggcaagagctttttaagattctgcatagtattttgttaaatggcgaaacccgtgaggctgctctcagttacatggcggctgtcgtcaatgccaatatgaagaaagcacagatgcagacagatgatagattggtgtctacagatggatttatgctgaatttcctttgggtactgcagcagctaagtacaaaaatcaagttagaaacagttgatcccacgtatatttttcacccaagatgtcggattactcttcccaatgatgagacgcgtgtgaatgcaacgatggaagatgtgaatgactggctgactgaactctatggcgatcagcctccattttctgagccgaaattccctacggagtgcttctttctcaccctgcatgctcaccacctctctattctgcctagttgccgtcgctatatccgcagactccgggctatccgggagctcaatagaactgtagaagatttgaaaaataatgaaagccaatggaaagattccccactggcaactagacaccgcgaaatgctgaagcgctgtaaaactcagcttaagaaactggtacggtgcaaggcctgtgctgatgctggcctacttgacgagagcttcctgagaagatgtctgaatttttatggccttctcattcagctgctgctccgcatcctggaccccgcatatcccgatataacactgcctttaaattcagatgtccccaaggtatttgcagcgttgcctgagttttatgtagaagatgttgcagaatttttattttttattgtacaatactctccccaggcgctttatgagccctgtactcaggatattgtgatgttccttgttgtgatgttgtgcaaccagaactacatccgaaacccatatttggtggccaaactggtagaagtcatgtttatgaccaaccctgctgttcagccacgaacccagaagttttttgaaatgattgagaaccatcctctctccaccaagttgttggtaccttccctgatgaagttttatacagatgttgagcataccggagccaccagtgagttttatgacaagttcacaattcgctatcatattagcaccatttttaaaagcctttggcaaaacatagctcaccatggcacctttatggaggagttcaactccgggaagcagtttgttcgctatataaacatgttgataaacgacacgacgtttttgctcgatgaaagtctggagtctctgaagcgaatccatgaagtgcaggaagagatgaagaacaaagaacagtgggaccagttgccccgggatcagcagcaggctcgtcagtctcagcttgctcaggatgagcgtgtgtcccgctcttacctcgccctggccaccgaaaccgtggacatgttccacatcctcacgaagcaggtccagaagcccttcctcagaccggagcttggaccccgattggctgcaatgctgaactttaatcttcagcaactttgtggccccaagtgccgtgacctgaaagttgaaaaccctgagaaatacggctttgaaccaaagaagctgttggaccaactgacggatatttacttacagctggactgtgctcggttcgcgaaagccattgctgacgaccagagatcctacagtaaggaattgtttgaagaagttatttcaaagatgcggaaggcagggatcaaatccacaatagcaatagaaaaatttaagctgctcgccgagaaagtggaggagatagtggccaagaacgcacgcgcagaaatcgactacagcgacgctcctgatgagttcagaggcaagtggactcaccctctgatggacaccctcatgacagaccccgtgcggctgccctctggcaccatcatggaccgctccatcatcctgcggcacctgctcaactcccccacggaccccttcaaccggcagacgctgacagagagcatgctggaaccagtgccagaactgaaagagcagattcaggcgtggatgagagagaaacagaacagcgatcactaaaccgttccgccgcccaccctctgctagacacagccaaggccaacgaggcaagcagaagcagcggccgcagcgaagctgccgttcatgtgttggaggccaaatgtggcaaaccaaccccaggcccacccagagcgagcaaacgctgagacctgaaaggacatggatgagaagaggagcccgcttcctgtacatatatttaagtgacaaacacggtcaaaagcttaagggacaggttttatggttgcttgtgtaataaagcatgtccttcgtatgtcacagtttggggcaacggaagtcttttagtgatggctaatgggtctgggcagcatcccttcatgaatttttttttaatccaatatccgttgatttgattgtgattagagaaccttggacattttgctgctaaagaatcttttttcccctctcccccttcctgaccctacttgcactgctgtggatttttttaagagaagcaaaaacaaaagtaaactcctttccctggccctccaaacatatattctgtgagataactgtgcctgctaccaagtgttaatcctgggatcgtatttttatatcatattcacatatttgtttttttaattggtgttagatgacatgattaataaaaaaggcaagatattttcagaatttgaatttcagttttttttttcttttgaaatgtccctttaagatttttttattctaaacaaaataaagaaaatcctgctgctctggtccttgtgataagcctctcttcggcatctgaggagcagctgcagcaaaatctaggggtgtaagtgtatcaggacttatgtgacttatattttggggagatgagggttgggttttttttttaatgctacgtgacagtttgaaaccttcacagttatcctctgggggtaaatcaattcttcaacccttgggtgtgtgagtttgaggcagggtcatttgtgtgatgtgtttggccttaccaaagcaaaagagggtgcaagaatgtgggagtatgtctgccggtttcaacacacacagacaaacacagccacacgcgcacacaagtataagactttttgtattactgctccctacttaacatacttgaattctcaaatttcctttggggtaaaaaaaaaaaaaggatttgaaaccataaagtgttctgaagaaattaagtctataaaaagcatactttcttttttcttttccttttttccctccacagacaatgtcctctgttcaattcctaacgcaaactacaataaatggtgacacacgttc

SEQ ID NO: 33586 - DNA, 2536 bp, Homo sapiens
gcctaacctcttcctgcgatgagctcggcacgggaattattattgtcaattttacttgcaagaagtttcctacaagagccaaggaatccatgcgagtaaacatttacgggcaccatagataaaaggcttgtgttttaatcctcatcctctccacctgttagctctgagtctcagttttctcatctctaaaaatggggatattcacaggagttgctgcatcgagttgtgaggattaaaagttggatgtaacggcttggtaattatgagctcttctagtgtcccttcctcttccctgtgcccaaggggttttaggaaagcattttatctccacagcaatcctatgaggttgatactactatcctcatagaaggggaaactgatgccaggagaggttcaagcgtcttacctgaagtcacaaagcaaactgagtgatgaaggaagacttgaacctagaaaatttcactgcaaaggagtaaaagtccctcgcaatttccgactgttggaagaactcgaagaaggccagaaaggagtaggagatggcacagttagctggggtctagaagatgacgaagacatgacacttacaagatggacagggatgataattgggcctccaagaacaatttatgaaaaccgaatatacagccttaaaatagaatgtggacctaaatacccagaagcacccccctttgtaagatttgtaacaaaaattaatatgaatggagtaaatagttctaatggagtggtggacccaagagccatatcagtgctagcaaaatggcagaattcatatagcatcaaagttgtcctgcaagagcttcggcgcctaatgatgtctaaagaaaatatgaaactccctcagccgcccgaaggacagtgttacagcaattaatcaaaaagaaaaaccacaggcccttccccttccccccaattcgatttaatcagtcttcattttccacagtagtaaattttctagatacgtcttgtagacctcaaagtaccggaaaggaagctcccattcaaaggaaatttatcttaagatactgtaaatgatactaattttttgtccatttgaaatatataagttgtgctataacaaatcatcctgtcaagtgtaaccactgtccacgtagttgaacttctgggatcaagaaagtctatttaaattgattcccatcataactggtggggcacatctaactcaactgtgaaaagacacatcacacaatcaccttgctgctgattacacggcctggggtctctgccttctccccttaccctcccgcctcccaccctccctgcaacaacagccctctagcctggggggcttgttagagtagatgtgaaggtttcaggtcgcagcctgtgggactactgctaggtgtgtggggtgtttcgcctgcacccctggtttctttaagtcttaagtgatgccccttccaaaccatcatcctgtccccacgctcctccactcccgcccttggccgaagcatagattgtaacccctccactcccctctgagattggccttcggtgaggaattcagggctttccccatatcttctctcccccacctttatcgaggggtgctgctttttctccctcctcctcaagttcctttttgcaccgtcaccacccaacaccttccatgacacttccttgctttggccagaagccatcaggtaaggttggaaagagcctctgacctcccttgtttagttttggaaccatactcactcactctccaccagcctgggaaatgaatattgggtcctcagccctgccaccctctgctgtcatcagctgatgcattgtttttagctcaggttttgataaggtgaaaagaatagtcaccagggttactcagacctgccagctctcggagtccttggtggttgaacttggagaaagaccgcatgaagatacttgtaagcacacatgatccctctgaattgttttactttcctgtaactgcttttgcttttaaaaattgaagaagttttaaacagggctttcatttggtcatccttgcaatccattggggtctagtttggaatctgacaactggaacaaaaagaaccttgaatccggtgcatgccttggttttggtgctgctgctgcttcccaagatcctcagcagggattaagaaggaacccggtgtgcacagcagatccccgaaattggtgggcttgacctcctggcaaattgctgcgtctttccacttgctgttcaggaccactaaatgctgaaatgtggatgcataccgaaataaaagcaattcattgtgtactaaaggttttttttttttttttaatttagtatttgtgtaaaaccaccttttgaagcagcaactatcaagtctgaaaagcaattgatgtttccattaatctttttctggggggaaaaccttagttctaaggatttaacatcctgtaagtgaagtttaacataacagtattccataagcagcctttttattgtcagaccattgcctgattttaatataataaaaaaaaagtgtgcgttaatatttaa

SEQ ID NO: 33587 - DNA, 1954 bp, Homo sapiens
atggagaagggacttaatactaaaaacttcactgaacaaacaatttatgaaaaccgaatatacagccttaaaatagaatgtggacctaaatacccagaagcacccccctttgtaagatttgtaacaaaaattaatatgaatggagtaaatagttctaatggagtggtggacccaagagccatatcagtgctagcaaaatggcagaattcatatagcatcaaagttgtcctgcaagagcttcggcgcctaatgatgtctaaagaaaatatgaaactccctcagccgcccgaaggacagtgttacagcaattaatcaaaaagaaaaaccacaggcccttccccttccccccaattcgatttaatcagtcttcattttccacagtagtaaattttctagatacgtcttgtagacctcaaagtaccggaaaggaagctcccattcaaaggaaatttatcttaagatactgtaaatgatactaattttttgtccatttgaaatatataagttgtgctataacaaatcatcctgtcaagtgtaaccactgtccacgtagttgaacttctgggatcaagaaagtctatttaaattgattcccatcataactggtggggcacatctaactcaactgtgaaaagacacatcacacaatcaccttgctgctgattacacggcctggggtctctgccttctccccttaccctcccgcctcccaccctccctgcaacaacagccctctagcctggggggcttgttagagtagatgtgaaggtttcaggtcgcagcctgtgggactactgctaggtgtgtggggtgtttcgcctgcacccctggtttctttaagtcttaagtgatgccccttccaaaccatcatcctgtccccacgctcctccactcccgcccttggccgaagcatagattgtaacccctccactcccctctgagattggccttcggtgaggaattcagggctttccccatatcttctctcccccacctttatcgaggggtgctgctttttctccctcctcctcaagttcctttttgcaccgtcaccacccaacaccttccatgacacttccttgctttggccagaagccatcaggtaaggttggaaagagcctctgacctcccttgtttagttttggaaccatactcactcactctccaccagcctgggaaatgaatattgggtcctcagccctgccaccctctgctgtcatcagctgatgcattgtttttagctcaggttttgataaggtgaaaagaatagtcaccagggttactcagacctgccagctctcggagtccttggtggttgaacttggagaaagaccgcatgaagatacttgtaagcacacatgatccctctgaattgttttactttcctgtaactgcttttgcttttaaaaattgaagaagttttaaacagggctttcatttggtcatccttgcaatccattggggtctagtttggaatctgacaactggaacaaaaagaaccttgaatccggtgcatgccttggttttggtgctgctgctgcttcccaagatcctcagcagggattaagaaggaacccggtgtgcacagcagatccccgaaattggtgggcttgacctcctggcaaattgctgcgtctttccacttgctgttcaggaccactaaatgctgaaatgtggatgcataccgaaataaaagcaattcattgtgtactaaaggttttttttttttttttaatttagtatttgtgtaaaaccaccttttgaagcagcaactatcaagtctgaaaagcaattgatgtttccattaatctttttctggggggaaaaccttagttctaaggatttaacatcctgtaagtgaagtttaacataacagtattccataagcagcctttttattgtcagaccattgcctgattttaatataataaaaaaaaagtgtgcgttaatattt

SEQ ID NO: 33588 - DNA, 2133 bp, Homo sapiens
gggggggtgaagaaggggccggccttcaagcaagagcgacgcaagatggcagccaccacgggctcgggagtaaaagtccctcgcaatttccgactgttggaagaactcgaagaaggccagaaaggagtaggagatggcacagttagctggggtctagaagatgacgaagacatgacacttacaagatggacagggatgataattgggcctccaagaacaatttatgaaaaccgaatatacagccttaaaatagaatgtggacctaaatacccagaagcacccccctttgtaagatttgtaacaaaaattaatatgaatggagtaaatagttctaatggagtggtggacccaagagccatatcagtgctagcaaaatggcagaattcatatagcatcaaagttgtcctgcaagagcttcggcgcctaatgatgtctaaagaaaatatgaaactccctcagccgcccgaaggacagtgttacagcaattaatcaaaaagaaaaaccacaggcccttccccttccccccaattcgatttaatcagtcttcattttccacagtagtaaattttctagatacgtcttgtagacctcaaagtaccggaaaggaagctcccattcaaaggaaatttatcttaagatactgtaaatgatactaattttttgtccatttgaaatatataagttgtgctataacaaatcatcctgtcaagtgtaaccactgtccacgtagttgaacttctgggatcaagaaagtctatttaaattgattcccatcataactggtggggcacatctaactcaactgtgaaaagacacatcacacaatcaccttgctgctgattacacggcctggggtctctgccttctccccttaccctcccgcctcccaccctccctgcaacaacagccctctagcctggggggcttgttagagtagatgtgaaggtttcaggtcgcagcctgtgggactactgctaggtgtgtggggtgtttcgcctgcacccctggtttctttaagtcttaagtgatgccccttccaaaccatcatcctgtccccacgctcctccactcccgcccttggccgaagcatagattgtaacccctccactcccctctgagattggccttcggtgaggaattcagggctttccccatatcttctctcccccacctttatcgaggggtgctgctttttctccctcctcctcaagttcctttttgcaccgtcaccacccaacaccttccatgacacttccttgctttggccagaagccatcaggtaaggttggaaagagcctctgacctcccttgtttagttttggaaccatactcactcactctccaccagcctgggaaatgaatattgggtcctcagccctgccaccctctgctgtcatcagctgatgcattgtttttagctcaggttttgataaggtgaaaagaatagtcaccagggttactcagacctgccagctctcggagtccttggtggttgaacttggagaaagaccgcatgaagatacttgtaagcacacatgatccctctgaattgttttactttcctgtaactgcttttgcttttaaaaattgaagaagttttaaacagggctttcatttggtcatccttgcaatccattggggtctagtttggaatctgacaactggaacaaaaagaaccttgaatccggtgcatgccttggttttggtgctgctgctgcttcccaagatcctcagcagggattaagaaggaacccggtgtgcacagcagatccccgaaattggtgggcttgacctcctggcaaattgctgcgtctttccacttgctgttcaggaccactaaatgctgaaatgtggatgcataccgaaataaaagcaattcattgtgtactaaaggttttttttttttttttaatttagtatttgtgtaaaaccaccttttgaagcagcaactatcaagtctgaaaagcaattgatgtttccattaatctttttctggggggaaaaccttagttctaaggatttaacatcctgtaagtgaagtttaacataacagtattccataagcagcctttttattgtcagaccattgcctgattttaatataataaaaaaaaagtgtgcgttaatatttaa

SEQ ID NO: 33589 - DNA, 2459 bp, Homo sapiens
gcctaacctcttcctgcgatgagctcggcacgggaattattattgtcaattttacttgcaagaagtttcctacaagagccaaggaatccatgcgagtaaacatttacgggcaccatagataaaaggcttgtgttttaatcctcatcctctccacctgttagctctgagtctcagttttctcatctctaaaaatggggatattcacaggagttgctgcatcgagttgtgaggattaaaagttggatgtaacggcttgcaatcctatgaggttgatactactatcctcatagaaggggaaactgatgccaggagaggttcaagcgtcttacctgaagtcacaaagcaaactgagtgatgaaggaagacttgaacctagaaaatttcactgcaaaggagtaaaagtccctcgcaatttccgactgttggaagaactcgaagaaggccagaaaggagtaggagatggcacagttagctggggtctagaagatgacgaagacatgacacttacaagatggacagggatgataattgggcctccaagaacaatttatgaaaaccgaatatacagccttaaaatagaatgtggacctaaatacccagaagcacccccctttgtaagatttgtaacaaaaattaatatgaatggagtaaatagttctaatggagtggtggacccaagagccatatcagtgctagcaaaatggcagaattcatatagcatcaaagttgtcctgcaagagcttcggcgcctaatgatgtctaaagaaaatatgaaactccctcagccgcccgaaggacagtgttacagcaattaatcaaaaagaaaaaccacaggcccttccccttccccccaattcgatttaatcagtcttcattttccacagtagtaaattttctagatacgtcttgtagacctcaaagtaccggaaaggaagctcccattcaaaggaaatttatcttaagatactgtaaatgatactaattttttgtccatttgaaatatataagttgtgctataacaaatcatcctgtcaagtgtaaccactgtccacgtagttgaacttctgggatcaagaaagtctatttaaattgattcccatcataactggtggggcacatctaactcaactgtgaaaagacacatcacacaatcaccttgctgctgattacacggcctggggtctctgccttctccccttaccctcccgcctcccaccctccctgcaacaacagccctctagcctggggggcttgttagagtagatgtgaaggtttcaggtcgcagcctgtgggactactgctaggtgtgtggggtgtttcgcctgcacccctggtttctttaagtcttaagtgatgccccttccaaaccatcatcctgtccccacgctcctccactcccgcccttggccgaagcatagattgtaacccctccactcccctctgagattggccttcggtgaggaattcagggctttccccatatcttctctcccccacctttatcgaggggtgctgctttttctccctcctcctcaagttcctttttgcaccgtcaccacccaacaccttccatgacacttccttgctttggccagaagccatcaggtaaggttggaaagagcctctgacctcccttgtttagttttggaaccatactcactcactctccaccagcctgggaaatgaatattgggtcctcagccctgccaccctctgctgtcatcagctgatgcattgtttttagctcaggttttgataaggtgaaaagaatagtcaccagggttactcagacctgccagctctcggagtccttggtggttgaacttggagaaagaccgcatgaagatacttgtaagcacacatgatccctctgaattgttttactttcctgtaactgcttttgcttttaaaaattgaagaagttttaaacagggctttcatttggtcatccttgcaatccattggggtctagtttggaatctgacaactggaacaaaaagaaccttgaatccggtgcatgccttggttttggtgctgctgctgcttcccaagatcctcagcagggattaagaaggaacccggtgtgcacagcagatccccgaaattggtgggcttgacctcctggcaaattgctgcgtctttccacttgctgttcaggaccactaaatgctgaaatgtggatgcataccgaaataaaagcaattcattgtgtactaaaggttttttttttttttttaatttagtatttgtgtaaaaccaccttttgaagcagcaactatcaagtctgaaaagcaattgatgtttccattaatctttttctggggggaaaaccttagttctaaggatttaacatcctgtaagtgaagtttaacataacagtattccataagcagcctttttattgtcagaccattgcctgattttaatataataaaaaaaaagtgtgcgttaatatttaa

SEQ ID NO: 33590 - DNA, 2387 bp, Homo sapiens
gcctaacctcttcctgcgatgagctcggcacgggaattattattgtcaattttacttgcaagaagtttcctacaagagccaaggaatccatgcgagtaaacatttacgggcaccatagataaaaggcttgtgttttaatcctcatcctctccacctgttagctctgagtctcagttttctcatctctaaaaatggggatattcacaggagttgctgcatcgagttgtgaggattaaaagttggatgtaacggcttggtaattatgagctcttctagtgtcccttcctcttccctgtgcccaaggggttttaggaaagcattttatctccacagcaatcctatgaggttgatactactatcctcatagaaggggaaactgatgccaggagaggttcaagcgtcttacctgaagtcacaaagcaaactgagtgatgaaggaagacttgaacctagaaaatttcactgcaaagacaatttatgaaaaccgaatatacagccttaaaatagaatgtggacctaaatacccagaagcacccccctttgtaagatttgtaacaaaaattaatatgaatggagtaaatagttctaatggagtggtggacccaagagccatatcagtgctagcaaaatggcagaattcatatagcatcaaagttgtcctgcaagagcttcggcgcctaatgatgtctaaagaaaatatgaaactccctcagccgcccgaaggacagtgttacagcaattaatcaaaaagaaaaaccacaggcccttccccttccccccaattcgatttaatcagtcttcattttccacagtagtaaattttctagatacgtcttgtagacctcaaagtaccggaaaggaagctcccattcaaaggaaatttatcttaagatactgtaaatgatactaattttttgtccatttgaaatatataagttgtgctataacaaatcatcctgtcaagtgtaaccactgtccacgtagttgaacttctgggatcaagaaagtctatttaaattgattcccatcataactggtggggcacatctaactcaactgtgaaaagacacatcacacaatcaccttgctgctgattacacggcctggggtctctgccttctccccttaccctcccgcctcccaccctccctgcaacaacagccctctagcctggggggcttgttagagtagatgtgaaggtttcaggtcgcagcctgtgggactactgctaggtgtgtggggtgtttcgcctgcacccctggtttctttaagtcttaagtgatgccccttccaaaccatcatcctgtccccacgctcctccactcccgcccttggccgaagcatagattgtaacccctccactcccctctgagattggccttcggtgaggaattcagggctttccccatatcttctctcccccacctttatcgaggggtgctgctttttctccctcctcctcaagttcctttttgcaccgtcaccacccaacaccttccatgacacttccttgctttggccagaagccatcaggtaaggttggaaagagcctctgacctcccttgtttagttttggaaccatactcactcactctccaccagcctgggaaatgaatattgggtcctcagccctgccaccctctgctgtcatcagctgatgcattgtttttagctcaggttttgataaggtgaaaagaatagtcaccagggttactcagacctgccagctctcggagtccttggtggttgaacttggagaaagaccgcatgaagatacttgtaagcacacatgatccctctgaattgttttactttcctgtaactgcttttgcttttaaaaattgaagaagttttaaacagggctttcatttggtcatccttgcaatccattggggtctagtttggaatctgacaactggaacaaaaagaaccttgaatccggtgcatgccttggttttggtgctgctgctgcttcccaagatcctcagcagggattaagaaggaacccggtgtgcacagcagatccccgaaattggtgggcttgacctcctggcaaattgctgcgtctttccacttgctgttcaggaccactaaatgctgaaatgtggatgcataccgaaataaaagcaattcattgtgtactaaaggttttttttttttttttaatttagtatttgtgtaaaaccaccttttgaagcagcaactatcaagtctgaaaagcaattgatgtttccattaatctttttctggggggaaaaccttagttctaaggatttaacatcctgtaagtgaagtttaacataacagtattccataagcagcctttttattgtcagaccattgcctgattttaatataataaaaaaaaagtgtgcgttaatatttaa

SEQ ID NO: 33591 - DNA, 2179 bp, Homo sapiens
gcctaacctcttcctgcgatgagctcggcacgggaattattattgtcaattttacttgcaagaagtttcctacaagagccaaggaatccatgcgagtaaacatttacgggcaccatagataaaagcaatcctatgaggttgatactactatcctcatagaaggggaaactgatgccaggagaggttcaagcgtcttacctgaagtcacaaagcaaactgagtgatgaaggaagacttgaacctagaaaatttcactgcaaagacaatttatgaaaaccgaatatacagccttaaaatagaatgtggacctaaatacccagaagcacccccctttgtaagatttgtaacaaaaattaatatgaatggagtaaatagttctaatggagtggtggacccaagagccatatcagtgctagcaaaatggcagaattcatatagcatcaaagttgtcctgcaagagcttcggcgcctaatgatgtctaaagaaaatatgaaactccctcagccgcccgaaggacagtgttacagcaattaatcaaaaagaaaaaccacaggcccttccccttccccccaattcgatttaatcagtcttcattttccacagtagtaaattttctagatacgtcttgtagacctcaaagtaccggaaaggaagctcccattcaaaggaaatttatcttaagatactgtaaatgatactaattttttgtccatttgaaatatataagttgtgctataacaaatcatcctgtcaagtgtaaccactgtccacgtagttgaacttctgggatcaagaaagtctatttaaattgattcccatcataactggtggggcacatctaactcaactgtgaaaagacacatcacacaatcaccttgctgctgattacacggcctggggtctctgccttctccccttaccctcccgcctcccaccctccctgcaacaacagccctctagcctggggggcttgttagagtagatgtgaaggtttcaggtcgcagcctgtgggactactgctaggtgtgtggggtgtttcgcctgcacccctggtttctttaagtcttaagtgatgccccttccaaaccatcatcctgtccccacgctcctccactcccgcccttggccgaagcatagattgtaacccctccactcccctctgagattggccttcggtgaggaattcagggctttccccatatcttctctcccccacctttatcgaggggtgctgctttttctccctcctcctcaagttcctttttgcaccgtcaccacccaacaccttccatgacacttccttgctttggccagaagccatcaggtaaggttggaaagagcctctgacctcccttgtttagttttggaaccatactcactcactctccaccagcctgggaaatgaatattgggtcctcagccctgccaccctctgctgtcatcagctgatgcattgtttttagctcaggttttgataaggtgaaaagaatagtcaccagggttactcagacctgccagctctcggagtccttggtggttgaacttggagaaagaccgcatgaagatacttgtaagcacacatgatccctctgaattgttttactttcctgtaactgcttttgcttttaaaaattgaagaagttttaaacagggctttcatttggtcatccttgcaatccattggggtctagtttggaatctgacaactggaacaaaaagaaccttgaatccggtgcatgccttggttttggtgctgctgctgcttcccaagatcctcagcagggattaagaaggaacccggtgtgcacagcagatccccgaaattggtgggcttgacctcctggcaaattgctgcgtctttccacttgctgttcaggaccactaaatgctgaaatgtggatgcataccgaaataaaagcaattcattgtgtactaaaggttttttttttttttttaatttagtatttgtgtaaaaccaccttttgaagcagcaactatcaagtctgaaaagcaattgatgtttccattaatctttttctggggggaaaaccttagttctaaggatttaacatcctgtaagtgaagtttaacataacagtattccataagcagcctttttattgtcagaccattgcctgattttaatataataaaaaaaaagtgtgcgttaatatttaa

SEQ ID NO: 33592 - DNA, 1973 bp, Homo sapiens
agcgacgcaagatggcagccaccacgggctcgggagtaaaagtccctcgcaatttccgactgttggaagaactcgaagaaggccagaaaggagtaggagatggcacagttagctggggtctagaagatgacgaagacatgacacttacaagatggacagggatgataattgggcctccaagagtggacccaagagccatatcagtgctagcaaaatggcagaattcatatagcatcaaagttgtcctgcaagagcttcggcgcctaatgatgtctaaagaaaatatgaaactccctcagccgcccgaaggacagtgttacagcaattaatcaaaaagaaaaaccacaggcccttccccttccccccaattcgatttaatcagtcttcattttccacagtagtaaattttctagatacgtcttgtagacctcaaagtaccggaaaggaagctcccattcaaaggaaatttatcttaagatactgtaaatgatactaattttttgtccatttgaaatatataagttgtgctataacaaatcatcctgtcaagtgtaaccactgtccacgtagttgaacttctgggatcaagaaagtctatttaaattgattcccatcataactggtggggcacatctaactcaactgtgaaaagacacatcacacaatcaccttgctgctgattacacggcctggggtctctgccttctccccttaccctcccgcctcccaccctccctgcaacaacagccctctagcctggggggcttgttagagtagatgtgaaggtttcaggtcgcagcctgtgggactactgctaggtgtgtggggtgtttcgcctgcacccctggtttctttaagtcttaagtgatgccccttccaaaccatcatcctgtccccacgctcctccactcccgcccttggccgaagcatagattgtaacccctccactcccctctgagattggccttcggtgaggaattcagggctttccccatatcttctctcccccacctttatcgaggggtgctgctttttctccctcctcctcaagttcctttttgcaccgtcaccacccaacaccttccatgacacttccttgctttggccagaagccatcaggtaaggttggaaagagcctctgacctcccttgtttagttttggaaccatactcactcactctccaccagcctgggaaatgaatattgggtcctcagccctgccaccctctgctgtcatcagctgatgcattgtttttagctcaggttttgataaggtgaaaagaatagtcaccagggttactcagacctgccagctctcggagtccttggtggttgaacttggagaaagaccgcatgaagatacttgtaagcacacatgatccctctgaattgttttactttcctgtaactgcttttgcttttaaaaattgaagaagttttaaacagggctttcatttggtcatccttgcaatccattggggtctagtttggaatctgacaactggaacaaaaagaaccttgaatccggtgcatgccttggttttggtgctgctgctgcttcccaagatcctcagcagggattaagaaggaacccggtgtgcacagcagatccccgaaattggtgggcttgacctcctggcaaattgctgcgtctttccacttgctgttcaggaccactaaatgctgaaatgtggatgcataccgaaataaaagcaattcattgtgtactaaaggttttttttttttttttaatttagtatttgtgtaaaaccaccttttgaagcagcaactatcaagtctgaaaagcaattgatgtttccattaatctttttctggggggaaaaccttagttctaaggatttaacatcctgtaagtgaagtttaacataacagtattccataagcagcctttttattgtcagaccattgcctgattttaatataataaaaaaaaagtgtgcgttaatatttaa

SEQ ID NO: 33593 - DNA, 612 bp, Homo sapiens
ccagtgtatgccccacccctgaccccgctcgcgacatgtccaccccggctcggcggcgcctcatgcgggacttcaagaggttgcaggaggatcctccagccggagtcagcggggctccgtccgagaacaacataatggtgtggaacgcggtcattttcgggcctgaagggaccccgtttgaggatgtctatgcagatggtagtatatgtctggacatacttcagaaccgttggagtccaacctatgatgtgtcttccattctaacatccatacagtctctgttggatgaacccaatcccaatagtccagcaaacagccaggctgctcagctgtaccaggagaacaaacgggaatatgaaaagcgtgtttctgcaatagtagaacaaagctggcgtgattgttgaccccgggtacagtttaaagaagctggccataagaaaaatatatattgatgtgtttgtcacctccctactcctgtcattacatttactttattaaaagcaaaataactgttgtgctgtttccatcttccttgccaagttttcctaccccttctaccctctccttaaacatcagaaaacaccctctatgaaatcaaatgtactgtacctg

SEQ ID NO: 33594 - DNA, 1796 bp, Homo sapiens
actggggtggtgcttagccggcgccagaccgaccctcgacttcggagaggcagcgcggttcctctgggtgcttccgcctccccttctcctgcttctccagcctcttcggcctcctcgcccgccgcgggaacccgagaccccagtgtatgccccacccctgaccccgctcgcgacatgtccaccccggctcggcggcgcctcatgcgggacttcaagaggttgcaggaggatcctccagccggagtcagcggggctccgtccgagaacaacataatggtgtggaacgcggtcattttcgggcctgaagggaccccgtttgaggatggaacatttaaacttacaatagaattcactgaagaatatccaaataaaccacctacagttagatttgtctctaagatgttccatccaaatgtctatgcagatggtagtatatgtctggacatacttcagaaccgttggagtccaacctatgatgtgtcttccattctaacatccatacagtctctgttggatgaacccaatcccaatagtccagcaaacagccaggctgctcagctgtaccaggagaacaaacgggaatatgaaaagcgtgtttctgcaatagtagaacaaagctggcgtgattgttgaccccgggtacagtttaaagaagctggccataagaaaaatatatattgatgtgtttgtcacctccctactcctgtcattacatttactttattaaaagcaaaataactgttgtgctgtttccatcttccttgccaagttttcctaccccttctaccctctccttaaacatcagaaaacaccctctatgaaatcaaatgtactgtacctgggttacttgcaaaaattactaatgcttcagtttttctgttgtatttcatttccagttttcaggcagttatttttattattgtactttaagcttttaagatgaattgttatacaagaggtgcttatgcttagcttgatgaccaggatgttatttttaacaaaatgattgctgaagtgtttcatcctggctggtccttcacttgtgttggatttagaagtgaatgtgtttggaatatggcctacagagaatagaaacaaatccatgtaaacaattttgaaggaggcatgggagctaaaaatcctgtgatactaagatctcagtcatatgaattacaacgtagtatttactggcaagaaggagaaagttgaaggactcagctaaaggagtacagcaattgtagtaactgacacatcctctctttgcaagctgctgactgggcacactcatgccaagtttcagaattattggtcttctgggtttttgctttttaaaagaggtgtgggagcagaggaatggaaacaatcgtgagtttttgagctagggaaagttggagctcctttaatctttttaaaggatcagtgctgccctaagtgaataaactcaattgtccatctttattttagagttttaatgaattcaaggaagggagcatagcatatctgtggcaaactattttccactcaaatcctgagttattgctgcatgctttaatttcttccctttcagcatctgagaaccttaaagccaatgtctgcgatctttttttggatatttatacttttagatatatagtacctttaagtagcagtatgggacaaggcttgtaaatgttttgtctaatgttctattgtcaccttttatgcatttatcacttccaaatctaactttgcacaagtaacccatgtaaaaaaaaatgtacatttttcaaaagttgtaaataaaaataaccttaaaa

SEQ ID NO: 33595 - DNA, 2643 bp, Homo sapiens
tagtcttctctctttcttaagcagtgataaaccttttaatgagaacaaaaaggaaataaattgctaactctgaaggaaccagtaagaaatacactgaagtatggtctgttgttttagaataatttgttaaatggaccagagtaatatagtggaacatgcatcaccttataccatatagtaactgattcttctaagtttacttgaacagatttcagtcaggaaaaaacattgctcaattgtgttcttcaatttattcaacaaacaattgaaaataatattttaaaggacataatctcttcatatcacatcttaacaattcttgaatgagatccagtttgtccatgccttgtaagtaagtttataacctactatgctttagggcctcctgctaccttaggttgacatatatttaagaaaaataatttcatttcaatagtagcataaacattagaaaaataaatttgctggaaacatgaatgcaatctaaaccaaatgtgattttaaaattatttctgccattaattccctccatatgtgtgaataattgagttgattttatagtgaagtaccttatgagccatacttaagggtttctgagagggactatgaagtttttcctggcttaaattcaattaagttttcattatagggtcactatgacatgaaaaggaaccagtatgaacacttttatacttattcccttctattttaaaaataacttgattatggatttgtattctggcattggtttttgaaccattgtgctttcattctttctagtctgtctaaaaatcactggagcgtttaagatggcagctgactaacataggcctttgaggtcttttggtcttctaaaggaagaaggccaaattttgggcccagtttcttaaggatgttttcaaaatgtacagtggctaaaatcttgtaagcagtaattttgtgtttatgatggctgtctccaagtttgggggaaaataatggcaaaacaaaaaatcacatttgagtagttcttagagcaattcctagagatgtatttcttacctggcctttcctctctaccctgtatctttgcattatttaatacttggaaaaacccacatagcattaaaaacaaagtactactgaacaaagtgataaatacattttcttaaatctttcttttctaaccacaggaacatttaaacttacaatagaattcactgaagaatatccaaataaaccacctacagttagatttgtctctaagatgttccatccaaatgtctatgcagatggtagtatatgtctggacatacttcagaaccgttggagtccaacctatgatgtgtcttccattctaacatccatacagtctctgttggatgaacccaatcccaatagtccagcaaacagccaggctgctcagctgtaccaggagaacaaacgggaatatgaaaagcgtgtttctgcaatagtagaacaaagctggcgtgattgttgaccccgggtacagtttaaagaagctggccataagaaaaatatatattgatgtgtttgtcacctccctactcctgtcattacatttactttattaaaagcaaaataactgttgtgctgtttccatcttccttgccaagttttcctaccccttctaccctctccttaaacatcagaaaacaccctctatgaaatcaaatgtactgtacctgggttacttgcaaaaattactaatgcttcagtttttctgttgtatttcatttccagttttcaggcagttatttttattattgtactttaagcttttaagatgaattgttatacaagaggtgcttatgcttagcttgatgaccaggatgttatttttaacaaaatgattgctgaagtgtttcatcctggctggtccttcacttgtgttggatttagaagtgaatgtgtttggaatatggcctacagagaatagaaacaaatccatgtaaacaattttgaaggaggcatgggagctaaaaatcctgtgatactaagatctcagtcatatgaattacaacgtagtatttactggcaagaaggagaaagttgaaggactcagctaaaggagtacagcaattgtagtaactgacacatcctctctttgcaagctgctgactgggcacactcatgccaagtttcagaattattggtcttctgggtttttgctttttaaaagaggtgtgggagcagaggaatggaaacaatcgtgagtttttgagctagggaaagttggagctcctttaatctttttaaaggatcagtgctgccctaagtgaataaactcaattgtccatctttattttagagttttaatgaattcaaggaagggagcatagcatatctgtggcaaactattttccactcaaatcctgagttattgctgcatgctttaatttcttccctttcagcatctgagaaccttaaagccaatgtctgcgatctttttttggatatttatacttttagatatatagtacctttaagtagcagtatgggacaaggcttgtaaatgttttgtctaatgttctattgtcaccttttatgcatttatcacttccaaatctaactttgcacaagtaacccatgtaaaaaaaaatgtacatttttcaaaagttgtaaataaaaataaccttaaaa

SEQ ID NO: 33596 - DNA, 2515 bp, Homo sapiens
cgtccctctttctccaccccgccgagcctaaactagtgacggggagggagacgggatagtgtttctgtttcgtggtctttgaatccacaacctctagtctgaacacagagaacacaaatttgtctattacttcaggaagcccagggggaaccgcgccccgctgaagggctcggggaaggcgcgctcccgcgtcccgccccctcctcccccagcactcacactgtggtagcggcggagggcggagggatccggaggcggcggagggagacgtcattgcagggttgtttgtcagtctcggcggcggcggcggcggcggcggcggcggcgatccacagtgattcggccgccgcgccggggggtgggggggctgcgcgggactttttttttttcagactgaccgcggggcagctgcggagcatgtcgaccccggcccggaggaggctcatgcgggatttcaagcggttacaagaggacccacctgtgggtgtcagtggcgcaccatctgaaaacaacatcatgcagtggaatgcagttatatttggaccagaagggacaccttttgaagatggtacttttaaactagtaatagaattttctgaagaatatccaaataaaccaccaactgttaggtttttatccaaaatgtttcatccaaatgtgtatgctgatggtagcatatgtttagatatccttcagaatcgatggagtccaacatatgatgtatcttctatcttaacatcaattcagtctctgctggatgaaccgaatcctaacagtccagccaatagccaggcagcacagctttatcaggaaaacaaacgagaatatgagaaaagagtttcggccattgttgaacaaagctggaatgattcataatagacaactggtctgttaatctttttcatcattgttgtgtataatttacctctcattagaaaggctaacaaattttaagtgccacaggttttaaggattctgcagaaaaaaaagaaaaaagtccttcagtttagaacctacaaaagcttgtgtatcttgattaatgtactttttattgcatggtgtgaactaagttattgctgcataaatttgtaatatatcctgtttgtatttttttccaagtgtataatgttggtgtggagttttcatgacagaatatacacattttgtaaatctgtacttttttcaaatattgaatgccttatttttgaattctttagatttttaaattggagaaaagcacttaaagttttttatatatgaatattacatgtaaagctgttaaaatacataacttcagtgcaagagactttgtcacttatttccttatgtgtgtaggaggggttaataagtctctagctctccatctattgatagtttcatttacaatttcaaaagaacattcttatattttatcaaggaagtcttcaaatttgattctaaatagcgattataatctccaactttattttgaatgtacctctattagtttcaattgagtaattctagacataactggtttgactctgtccaactctgtatttaggccatttgttacagtttcttcatgcattacttactgttaaaactgtaccttttgcgatttcacagttggcacttctgccatgagcagagaactgatgcgacttgttttgctgcttggtagcactttaaaaaattttttgattaatgaagaaagtaaaaccataaacatttgccaaaaattcatgccccagtattagcaatgaattagttgcattggtttgagaaaggcacatattggagggaaatcttggtgtaacttaaatatttgaaaattacctttaatgcaatgcatatctgtttattctgggaaatgttttaatgccagggcctgctgagttgcttcttcttgtggagattttttttttaatctcctgagttgtataaaagttgtactgcatcttagtttactggataaatttaaaacacagtattgtagaaagctaatacaaaactatcctatgccttcaaatagtatagaaaatggaaaatatacaagtaaattctgttgaaccacctgtgtagtctctctagtagttaaaacagctattttagtaaccccaagagtttcttctcatatccataaaattggattacagtatggcaatatctacagcttctattcattatgcaacgtttaacattgattggataaatgcttataggctgggccaggtggctcccacctgtagtcccagcactttgggaggcaaaggcgggaggatcacttgaggccaggactttgagaccagccagggcaacataataagacttttctctactttaaattttttaaaaaattagttgggcatagtggcacttgcctgtagtctcagctacttaggaggctgaggtggcagaatagcttatgcctaggaggttgaggctgcagtgagctgtgattatgccattgcactccagcctgggtgacagagcaataccctgtctttaaaaataaaagctattacttggcaaa

SEQ ID NO: 33597 - DNA, 476 bp, Homo sapiens
gttctccgagttcctgtctctctgccaacgccgcccggatggcttcccaaaaccgcgacccagccgccactagcgtcgccgccgcccgtaaaggagctgagccgagcgggggcgccgcccggggtccggtgggcaaaaggctacagcaggagctgatgaccctcatgaacccaacattgatagtcccttgaacacacatgctgccgagctctggaaaaaccccacagcttttaagaagtacctgcaagaaacctactcaaagcaggtcaccagccaggagccctgacccaggctgcccagcctgtccttgtgtcgtctttttaatttttccttagatggtctgtcctttttgtgatttctgtataggactctttatcttgagctgtggtatttttgttttgtttttgtcttttaaattaagcctcggttgagcccttgtatattaaataaatgcatttttgtccttttttagacaa

SEQ ID NO: 33598 - DNA, 737 bp, Homo sapiens
cgcagtcctgcagttgcagtcgtgttctccgagttcctgtctctctgccaacgccgcccggatggcttcccaaaaccgcgacccagccgccactagcgtcgccgccgcccgtaaaggagctgagccgagcgggggcgccgcccggggtccggtgggcaaaaggctacagcaggagctgatgaccctcatgatgtctggcgataaagggatttctgccttccctgaatcagacaaccttttcaaatgggtagggaccatccatggagcagctggaacagcagtggggagcatcagaaccagctcaacagtttgtctactgtccggtcccagagaaactcaagattctagcaagccccttgtgtggggcttgggttgggacatgaggctgctgctggagcttactctgcaactgtttctccaaatgccagaacccaacattgatagtcccttgaacacacatgctgccgagctctggaaaaaccccacagcttttaagaagtacctgcaagaaacctactcaaagcaggtcaccagccaggagccctgacccaggctgcccagcctgtccttgtgtcgtctttttaatttttccttagatggtctgtcctttttgtgatttctgtataggactctttatcttgagctgtggtatttttgttttgtttttgtcttttaaattaagcctcggttgagcccttgtatattaaataaatgcatttttgtccttttttagacaa

SEQ ID NO: 33599 - DNA, 665 bp, Homo sapiens
tctctctgccaacgccgcccggatggcttcccaaaaccgcgacccagccgccactagcgtcgccgccgcccgtaaaggagctgagccgagcgggggcgccgcccggggtccggtgggcaaaaggctacagcaggagctgatgaccctcatggtatatgaagacctgaggtataagctctcgctagagttccccagtggctacccttacaatgcgcccacagtgaagttcctcacgccctgctatcaccccaacgtggacacccagggtaacatatgcctggacatcctgaaggaaaagtggtctgccctgtatgatgtcaggaccattctgctctccatccagagccttctaggagaacccaacattgatagtcccttgaacacacatgctgccgagctctggaaaaaccccacagcttttaagaagtacctgcaagaaacctactcaaagcaggtcaccagccaggagccctgacccaggctgcccagcctgtccttgtgtcgtctttttaatttttccttagatggtctgtcctttttgtgatttctgtataggactctttatcttgagctgtggtatttttgttttgtttttgtcttttaaattaagcctcggttgagcccttgtatattaaataaatgcatttttgtccttttttagacaa

SEQ ID NO: 33600 - DNA, 850 bp, Homo sapiens
gagccattgattggtcgacgcccccagagggttacaattcaaacgcgggcgggcgggcccgcagtcctgcagttgcagtcgtgttctccgagttcctgtctctctgccaacgccgcccggatggcttcccaaaaccgcgacccagccgccactagcgtcgccgccgcccgtaaaggagctgagccgagcgggggcgccgcccggggtccggtgggcaaaaggctacagcaggagctgatgaccctcatgatgtctggcgataaagggatttctgccttccctgaatcagacaaccttttcaaatgggtagggaccatccatggagcagctggaacagtatatgaagacctgaggtataagctctcgctagagttccccagtggctacccttacaatgcgcccacagtgaagttcctcacgccctgctatcaccccaacgtggacacccagggtaacatatgcctggacatcctgaaggaaaagtggtctgccctgtatgatgtcaggaccattctgctctccatccagagccttctaggagaacccaacattgatagtcccttgaacacacatgctgccgagctctggaaaaaccccacagcttttaagaagtacctgcaagaaacctactcaaagcaggtcaccagccaggagccctgacccaggctgcccagcctgtccttgtgtcgtctttttaatttttccttagatggtctgtcctttttgtgatttctgtataggactctttatcttgagctgtggtatttttgttttgtttttgtcttttaaattaagcctcggttgagcccttgtatattaaataaatgcatttttgtccttttttagacaa

SEQ ID NO: 33601 - DNA, 914 bp, Homo sapiens
ggtgagattcgagagatgggggacaggccaggagctcagaccgctctttgagactctcccgaaggagaatgggagggtaggggcgctgccagactccttccctggtgggcctagatgaagacgctcaaggaccctcgtgacttggccgagacaggggaagggagaagttgagtcgggcaaggaagagatgctaaagcctggggaattaagaacatgccagaatcatcccgagggagtctggaattagggagggtgaggactcgctaggatcgtcctgtggatctggctacagcaggagctgatgaccctcatgatgtctggcgataaagggatttctgccttccctgaatcagacaaccttttcaaatgggtagggaccatccatggagcagctggaacagtatatgaagacctgaggtataagctctcgctagagttccccagtggctacccttacaatgcgcccacagtgaagttcctcacgccctgctatcaccccaacgtggacacccagggtaacatatgcctggacatcctgaaggaaaagtggtctgccctgtatgatgtcaggaccattctgctctccatccagagccttctaggagaacccaacattgatagtcccttgaacacacatgctgccgagctctggaaaaaccccacagcttttaagaagtacctgcaagaaacctactcaaagcaggtcaccagccaggagccctgacccaggctgcccagcctgtccttgtgtcgtctttttaatttttccttagatggtctgtcctttttgtgatttctgtataggactctttatcttgagctgtggtatttttgttttgtttttgtcttttaaattaagcctcggttgagcccttgtatattaaataaatgcatttttgtccttttttagacaa

SEQ ID NO: 33602 - DNA, 1446 bp, Homo sapiens
aaacgcgggcgggcgggcccgcagtcctgcagttgcagtcgtgttctccgagttcctgtctctctgccaacgccgcccggatggcttcccaaaaccgcgacccagccgccactagcgtcgccgccgcccgtaaaggagctgagccgagcgggggcgccgcccggggtccggtgggcaaaaggtgagtgatgcggcctaccactcgccgggcctgccatgccctaggcattggtacccagagcaaagatttctaggaccaccccccgccgccacctcctggagcgggagatctgcgggtgcaggagaacacaccaggagctcggggcctggcattcccctgggcatgggtgtcgagggcggagacttccgggactcccacctccttgcgcgggtgagattcgagagatgggggacaggccaggagctcagaccgctctttgagactctcccgaaggagaatgggagggtaggggcgctgccagactccttccctggtgggcctagatgaagacgctcaaggaccctcgtgacttggccgagacaggggaagggagaagttgagtcgggcaaggaagagatgctaaagcctggggaattaagaacatgccagaatcatcccgagggagtctggaattagggagggtgaggactcgctaggatcgtcctgtggatctggtgagtataccctgagctgagcctgaccttggtgatgtggggagcctccatgacggctccccctgagattcaggtgggagaagatgcaccgtctggaggcctggcccatccagactcccaggtaaccccgaatactcttttttcaggctacagcaggagctgatgaccctcatgatgtctggcgataaagggatttctgccttccctgaatcagacaaccttttcaaatgggtagggaccatccatggagcagctggaacagtatatgaagacctgaggtataagctctcgctagagttccccagtggctacccttacaatgcgcccacagtgaagttcctcacgccctgctatcaccccaacgtggacacccagggtaacatatgcctggacatcctgaaggaaaagtggtctgccctgtatgatgtcaggaccattctgctctccatccagagccttctaggagaacccaacattgatagtcccttgaacacacatgctgccgagctctggaaaaaccccacagcttttaagaagtacctgcaagaaacctactcaaagcaggtcaccagccaggagccctgacccaggctgcccagcctgtccttgtgtcgtctttttaatttttccttagatggtctgtcctttttgtgatttctgtataggactctttatcttgagctgtggtatttttgttttgtttttgtcttttaaattaagcctcggttgagcccttgtatattaaataaatgcatttttgtccttttttag

SEQ ID NO: 33603 - DNA, 155 bp, Homo sapiens
ggaacctccagcttggtccggtctgggactggaagcctgccatggcggcttctgcggcggagacgcgcgtgtttctggaggtgcggggacagctgcagagcgcgcttctgatcctgggagatagggtttcaccatattgcccatgctggtcttga

SEQ ID NO: 33604 - DNA, 1917 bp, Homo sapiens
acaggcgcctgcgccgcagcggggctgccgctggttggtccgcacgtggaacctctcctggtcctgttgacccgggcccctcggaacctccagcttggtccggtctgggactggaagcctgccatggcggcttctgcggcggagacgcgcgtgtttctggaggtgcggggacagctgcagagcgcgcttctgatcctgggagaaccgaaagaaggaggtatgcccatgaatatttccataatgccatcttcactccagatgaaaacccctgaaggctgcacagaaatccagcttccagcagaggtcaggcttgtaccttcctcttgccgtgggctacagtttgttgttggagatggactgcacctgcgactgcagacgcaagcaaaattaggcacaaaactgatttcaatgtttaatcaaagctcgcaaacccaagaatgttgcacgttttattgccaatcctgcggtgaagtcataataaaagacaggaagctcctcagggtgctcccactgccgagtgagaactggggagctctagttggagaatggtgttgtcatcctgacccctttgctaataaatcacttcatccgcaagagaatgactgttttattggagactctttcttcttggtgaatttaagaaccagtttgtggcagcaaagacctgaactatccccagtggagatgtgctgtgtttcttctgacaaccattgtaaattggaaccaaaggcaaataccaaagtaatttgtaagcgttgcaaggtaatgttgggagagaccgtgtcatcagaaaccaccaagttttatatgacagagataattattcagtcatctgagaggagttttcctatcataccaaggtcttggtttgtccagagcgtgatcgcccagtgtctggtgcagctctcctctgctagaagcacttttagattcacgattcaaggtcaggatgacaaagtgtatatcttgctatggcttttaaattcagacagtttggtgattgaatctttgagaaattccaaatatatcaaaaaattccccttgttggaaaacacattcaaagccgattctagttctgcctggagtgctgtcaaggtcctctaccagccatgcatcaaaagcaggaatgaaaaacttgtcagcttgtgggaaagtgacatcagcgtccacccgctaaccctgccctctgcaacctgcttggagctgctgttgatattgtcaaagagtaatgccaatctgccttcatcccttcgccgtgtgaattcctttcaggtggcctttttgaagatgtaactattagagctgggcattctcctcccccggcagacagctctcaagcaggagcacaccgaggccagcagtcagctcaggaggcatcaattacaaagacaagaaccagagctatgggataagagcattgcattgaagttttaagtttacttgtttgcatgtattctctaagagaagagttaactttagatctttgaaaacccaggactgtgaagaaagtcatagtagcaggttgaggcaagtgtagaagttacatctctatttcccacagagaggaatattcacatatgtgcagtgtcagcaccacctggaaggttattacctaatggagatccatctgtcctgtgtggaatccagtgaggaattttattggtggaactgaatgttaactgctgtaaatcctaggaaataaacttttaaagagtttctcaggatgatttaaaacaaattttaaaaaagaaaagtagaaaacattttatactttattcagaggagatgctcaatagatgtttgttgaatgaatgattatcaaattaaaggatttcctatttatgcaaatctgcatgtttcttttgttatttcctttaccatacattattgcaaattaataaatatacctcactagca

SEQ ID NO: 33605 - DNA, 1549 bp, Homo sapiens
aaacaaaagagtctcgccggcgtccccgcccgcacactcgcgcacactcgcgctcgggcgcacacggagcagggaccggcgcccggagcgagccagggagcggctaaccggggacccaccgcgcggagccagcctagctgccagcgagcccaacccgcgacgacccacgcccctgagccccgcagccgacccctgccggccggtgtccccaccgccatccctgacccatggcgctgaagaggattcagaaagaattgagtgatctacagcgcgatccacctgctcactgttcagctggacctgtgggagatgacttgttccactggcaagccactattatggggcctcctgatagcgcatatcaaggtggagtcttctttctcactgtacattttccgacagattatccttttaaaccaccaaagattgctttcacaacaaaaatttaccatccaaacataaacagtaatggaagtatttgtctcgatattctgaggtcacaatggtcaccagctctgactgtatcaaaagttttattgtccatatgttctctactttgtgatcctaatccagatgaccccttagtaccagatattgcacaaatctataaatcagacaaagaaaaatacaacagacatgcaagagaatggactcagaaatatgcaatgtaaaaatcaaaaacattttcatatataccagagtactgtaaaatctaggtttttttcaacattagcagtaaattgagcactgtttactgtttcattgtaccatgaaaccatttgatttttacccattttaaatgtgtttctgaagcaagacaaaacaaacttccaaaaatacccttaagactgtgatgagagcatttatcattttgtatgcattgagaaagacatttattatggtttttaagatacttggacatctgcatcttcagcttacaagatctacaatgcagctgaaaagcaaccaaattattttttgctgaaactagatgtttttacatgagaaatactgtatgtgttgtctaagatgtcagttttataaatctgtattcagatttcattctttgttagctcactttataatttgtatttttttactgtatagactaaatatattctatttacatgtatgtcaactcattacttttttcctgtgaacagtattgaaaaaccccaacggctgataattaagtgaattaactgtgtctcccttgtcttaggatattctgtagattgattgcagatttcttaaatctgaaatgatctttacactgtaattctcagcatactgattatggagaaacacttgttttgattttgttatacttgacttaactttattgcaatgtgaattaattgcactgctaagtaggaagatgtgtaacttttatttgttgctattcacatttgaattttttcctgtataggcaatattatattgacaccttttacagatcttactgtagctttttccatataaataaaatgctttttctactatttgtcttgattacttaaaaaaataaaaatataagtaaggatcaaaa

SEQ ID NO: 33606 - DNA, 2748 bp, Homo sapiens
gacaggcgtggtcgggtgcgtggtgcgtgggtccggctttcggtgactagacggtccgcaggggacatcccgtccctggggcctccccagtctccctccccctcgcgcctgggcagctctctcccagggcttcggctcgagcctgcgacctgcacggacacccccccctcaggatctaaaatgtccactgaggcacaaagagttgatgacagtccaagcactagtggaggaagttccgatggagatcaacgtgaaagtgttcagcaagaaccagaaagagaacaagttcagcccaagaaaaaggagggaaaaatatccagcaaaaccgctgctaaattgtcaactagtgctaaaagaattcagaaggaacttgcagaaatcacattggaccctcctcccaactgtagtgctggacccaaaggagacaacatttatgaatggaggtcaactatattgggacccccaggatctgtctatgaaggaggggtgttctttcttgacattaccttttcaccagactatccgtttaaaccccctaaggttaccttccgaacaagaatctatcactgtaatattaacagccaaggtgtgatctgtctggacatcttaaaggacaactggagtccggctttaactatttctaaagttctcctctccatctgctcacttcttacagattgcaaccctgctgaccctctggtgggcagcatcgccacacagtacatgaccaacagagcagagcatgaccggatggccagacagtggaccaagcggtacgccacataggggcctgctgcctgccgccccgcgggacctgtgcaagcacattcaccaagtgcatcggtagccctgcccacccctccagacctcggttcttattttcctatttttattaaatttggaaccattttgtgatggtatgttgtccatcttcccatcccagttcttcctgccccccttcctctctcccacgctctcttttatctctcattttattcccttgttgatttctgttaacttgaaagatttgggattttttcccacctcatcatagatgggaacttttgttttcagtgcaaacaatgttggagctgtaatagtaagagctttcttacaaagctttgtattactgtgtggttttgttttttttgttgttgtttatttgattttgatttttttttcttttatgtgatctttgggaaaacacattcagaattatatctcgtttctacttaaatgtagtgcttagggttaattttttgtactgaagtctttattggtgggtgcatgctactgggaacaagtttttgtacaaaagcttcaatcagaatcactgtgcattactgagactctgtttatcactagccttctgtccctcccgcagaagactgttggattgaacaaaataatatgtattttgatttacttaaagtgcttgtaaatttcttagggacctgccacttttgactgtggatcagttgatgtacacttgtattattaaagcactcaataaatcactgtggctgataactgcacttctggtaacccgacatttgctttgtgtcctggtgaccgctgtagccctacgtgcagtgaggcttgtctaattcaattacaggttcaagtgtatttttcatctcaaacctctaatatttctttggagttgagttgcttagcatgtggaatttctccagctgtcagtagcctgatgattttatggttgttatagtaaattgctatcattttacatattgactgggcattctttctgttacagccttctttatcaacaattaaaatatgtaactccaaaaatagccttcttgtgaaagtgaagtctgagctaatcattgtgttcagccactttcaactttatttctctcaaaattgttacagtgattgccctcaagctttgtattgttcatttttgttgttgttgttgttgttgttgctgctcttttttctccatgattttagcaaaagaagtaaactcaactgtattggtcacggtcagcccattcaatgacaagggtgtctgtctggcttcaccttcaggctattttagtgtgcagctataggaggcagaggaaacgtgggtggtgtagtttctaaaacacgctgacttgctgattgataattcagggttattagtgtaacaaagcgtagtggaaactcctactcctgctgcaccatacagttacagaccctaccatactcttggtctcatttaaggaaccattaacaccttcactgctgaaaagcaggatttataagcataagtcatccacctctaaatattttaacatttaaaatgcctgattcaaaagatacagtttttgttgtttttaactagttaaaaataaatcctaagaaaatatatttaaatattgcaaatgccacttctaaaccaaaatacctgagaatattttttgtctttttaataacgattttaccattcattttatttaaaaacatttctcagcatagcagggcactgtatggtctctgatgcactactcaaccctctagttgtagtagagggagccacagacagtacataaatgcattgggcagagctatattccagtgaaactttatttaccaccataggcatgggatttggcccatgggttgtagtttgccaatccctgacacagaccaacatagactgggggctggatgaaaaacaaataacgatgtgtcatttctttctttaacataaaataaattcaatatggtacaacactg

SEQ ID NO: 33607 - DNA, 1248 bp, Homo sapiens
gaggagggaggcgcgcggcgccgcatggccgacgtggggctcgcgctctcgcggtctctcccgggcgggcgcgcaggcacgcgcactcgcgggtgcgcgcgcggacggccgggcggcggcggctcccggaggtggtggcttcactttccaggactcaggggcagccacagcgacagccgcgggcagcagcctcaggagccggagctggaacggccgggggcggcggcagcggcggcgctgagggatctaaaatgtccactgaggcacaaagagttgatgacagtccaagcactagtggaggaagttccgatggagatcaacgtgaaagtgttcagcaagaaccagaaagagaacaagttcagcccaagaaaaaggagggaaaaatatccagcaaaaccgctgctaaattgtcaactagtgctaaaagaattcagaaggaacttgcagaaatcacattggaccctcctcccaactgtagtgctggacccaaaggagacaacatttatgaatggaggtcaactatattgggacccccaggatctgtctatgaaggaggggtgttctttcttgacattaccttttcaccagactatccgtttaaaccccctaaggttaccttccgaacaagaatctatcactgtaatattaacagccaaggtgtgatctgtctggacatcttaaaggacaactggagtccggctttaactatttctaaagttctcctctccatctgctcacttcttacagattgcaaccctgctgaccctctggtgggcagcatcgccacacagtacatgaccaacagagcagagcatgaccggatggccagacagtggaccaagcggtacgccacataggggcctgctgcctgccgccccgcgggacctgtgcaagcacattcaccaagtgcatcggtagccctgcccacccctccagacctcggttcttattttcctatttttattaaatttggaaccattttgtgatggtatgttgtccatcttcccatcccagttcttcctgccccccttcctctctcccacgctctcttttatctctcattttattcccttgttgatttctgttaacttgaaagatttgggattttttcccacctcatcatagatgggaacttttgttttcagtgcaaacaatgttggagctgtaatagtaagagctttcttacaaagctttgtattactgtgtggttttgttttttttgttgttgtttatttgattttgattttt

SEQ ID NO: 33608 - DNA, 1377 bp, Homo sapiens
gcaggggccagcccgccgggtccccgccgcgctctttgtcctggccgcgcgcgggcggacgcgtgcacccccagggtgaggggaggtgtggagagcgcgcacgggagcgcgcgggaacagctcgcgcccgccgggcgtcggcggcgcgcgcccctccgccaggcaagcagcgagcacgcgcgtcgccgccgagttttccaagagataacttcaccaagatgtccagtgataggcaaaggtccgatgatgagagccccagcaccagcagtggcagttcagatgcggaccagcgagacccagccgctccagagcctgaagaacaagaggaaagaaaaccttctgccacccagcagaagaaaaacaccaaactctctagcaaaaccactgctaagttatccactagtgctaaaagaattcagaaggagctagctgaaataacccttgatcctcctcctaattgcagtgctgggcctaaaggagataacatttatgaatggagatcaactatacttggtccaccgggttctgtatatgaaggtggtgtgttttttctggatatcacattttcatcagattatccatttaagccaccaaaggttactttccgcaccagaatctatcactgcaacatcaacagtcagggagtcatctgtctggacatccttaaagacaactggagtcccgctttgactatttcaaaggttttgctgtctatttgttcccttttgacagactgcaaccctgcggatcctctggttggaagcatagccactcagtatttgaccaacagagcagaacacgacaggatagccagacagtggaccaagagatacgcaacataattcacataatttgtatgcagtgtgaaggagcagaaggcatcttctcactgtgctgcaaatctttatagcctttacaatacggacttctgtgtatatgttatactgattctactctgcttttatcctttggagcctgggagactccccaaaaaggtaaatgctatcaagagtagaactttgtagctgtagattagttatgtttaaaacgcctacttgcaagtcttgcttctttgggatatcaaaatgtattttgtgatgtactaaggatactggtcctgaagtctaccaaatattatagtgcattttagcctaattcattatctgtatgaagttataaaagtagctgtagatggctaggaattatgtcatttgtattaaacccagatctatttctgagtatgtggttcatgctgttgtgaaaaatgttttaccttttacctttgtcagtttgtaatgagaggatttccttttaccctttgtagctcagagagcacctgatgtatcatctcaaacacaataaacatgctcctgaagg

SEQ ID NO: 33609 - DNA, 1556 bp, Homo sapiens
tcacttggcgcccggcgcggcgagcgctacccgcggcccccgcgcggccctccccacaaagggccgcggagctgcgtggccgccgccgccggccgtggctcgcctccgcgggcgcggaaatttgttgcacttcttggggctttgtttatttgtttgttttttctctgggtttcttatttttttcgttattttggacaaaatgtcggtccgtgatataaaaattgagcgaggaaccttggtggcattgggagctttgcagaaggtgcagtttgaattctgcttttcccagggtggcagctcggtcttggccggatgaatcttcgctgctggccgtggaaacagctagagcagctcttttccaagagataacttcaccaagatgtccagtgataggcaaaggtccgatgatgagagccccagcaccagcagtggcagttcagatgcggaccagcgagacccagccgctccagagcctgaagaacaagaggaaagaaaaccttctgccacccagcagaagaaaaacaccaaactctctagcaaaaccactgctaagttatccactagtgctaaaagaattcagaaggagctagctgaaataacccttgatcctcctcctaattgcagtgctgggcctaaaggagataacatttatgaatggagatcaactatacttggtccaccgggttctgtatatgaaggtggtgtgttttttctggatatcacattttcatcagattatccatttaagccaccaaaggttactttccgcaccagaatctatcactgcaacatcaacagtcagggagtcatctgtctggacatccttaaagacaactggagtcccgctttgactatttcaaaggttttgctgtctatttgttcccttttgacagactgcaaccctgcggatcctctggttggaagcatagccactcagtatttgaccaacagagcagaacacgacaggatagccagacagtggaccaagagatacgcaacataattcacataatttgtatgcagtgtgaaggagcagaaggcatcttctcactgtgctgcaaatctttatagcctttacaatacggacttctgtgtatatgttatactgattctactctgcttttatcctttggagcctgggagactccccaaaaaggtaaatgctatcaagagtagaactttgtagctgtagattagttatgtttaaaacgcctacttgcaagtcttgcttctttgggatatcaaaatgtattttgtgatgtactaaggatactggtcctgaagtctaccaaatattatagtgcattttagcctaattcattatctgtatgaagttataaaagtagctgtagatggctaggaattatgtcatttgtattaaacccagatctatttctgagtatgtggttcatgctgttgtgaaaaatgttttaccttttacctttgtcagtttgtaatgagaggatttccttttaccctttgtagctcagagagcacctgatgtatcatctcaaacacaataaacatgctcctgaaggcatagtttcctgtcgtaa

SEQ ID NO: 33610 - DNA, 1570 bp, Homo sapiens
gaacttgctgactgcgcggccgggaggagccgagccgggcggcggcggcgggaggctacagcgcgcgggggtctcccgcgtcccctccgcctcgccgggagctcgcgccctcgcccagccgagctcccacccccgcttttttccgaaggcgctgggcggcgccaccctccggccggagcccggcactgcacaaccccctccgactttcaatgttccacactccccggccagagcctcctcggcttctttttttccctccccccccttcccccccccacagctgcctccatttccttaaggaagggtttttttctctctccctcccccacaccgtagcggcgcgcgagcgggccgggcgggcggccgagttttccaagagataacttcaccaagatgtccagtgataggcaaaggtccgatgatgagagccccagcaccagcagtggcagttcagatgcggaccagcgagacccagccgctccagagcctgaagaacaagaggaaagaaaaccttctgccacccagcagaagaaaaacaccaaactctctagcaaaaccactgctaagttatccactagtgctaaaagaattcagaaggagctagctgaaataacccttgatcctcctcctaattgcagtgctgggcctaaaggagataacatttatgaatggagatcaactatacttggtccaccgggttctgtatatgaaggtggtgtgttttttctggatatcacattttcatcagattatccatttaagccaccaaaggttactttccgcaccagaatctatcactgcaacatcaacagtcagggagtcatctgtctggacatccttaaagacaactggagtcccgctttgactatttcaaaggttttgctgtctatttgttcccttttgacagactgcaaccctgcggatcctctggttggaagcatagccactcagtatttgaccaacagagcagaacacgacaggatagccagacagtggaccaagagatacgcaacataattcacataatttgtatgcagtgtgaaggagcagaaggcatcttctcactgtgctgcaaatctttatagcctttacaatacggacttctgtgtatatgttatactgattctactctgcttttatcctttggagcctgggagactccccaaaaaggtaaatgctatcaagagtagaactttgtagctgtagattagttatgtttaaaacgcctacttgcaagtcttgcttctttgggatatcaaaatgtattttgtgatgtactaaggatactggtcctgaagtctaccaaatattatagtgcattttagcctaattcattatctgtatgaagttataaaagtagctgtagatggctaggaattatgtcatttgtattaaacccagatctatttctgagtatgtggttcatgctgttgtgaaaaatgttttaccttttacctttgtcagtttgtaatgagaggatttccttttaccctttgtagctcagagagcacctgatgtatcatctcaaacacaataaacatgctcctgaaggcatagtttcctgtcgtaa

SEQ ID NO: 33611 - DNA, 909 bp, Homo sapiens
cggccaagggcggcaggggccagcccgccgggtccccgccgcgctctttgtcctggccgcgcgcgggcggacgcgtgcacccccaggcggcgcgcgagcgggccgggcgggcggccgagttttccaagagataacttcaccaagatgtccagtgataggcaaaggtccgatgatgagagccccagcaccagcagtggcagttcagatgcggaccagcgagacccagccgctccagagcctgaagaacaagaggaaagaaaaccttctgccacccagcagaagaaaaacaccaaactctctagcaaaaccactgctaagttatccactagtgctaaaagaattcagaaggagctagctgaaataacccttgatcctcctcctaattgcagtgctgggcctaaaggagataacatttatgaatggagatcaactatacttggtccaccgggttctgtatatgaaggtggtgtgttttttctggatatcacattttcatcagattatccatttaagccaccaaaggttactttccgcaccagaatctatcactgcaacatcaacagtcagggagtcatctgtctggacatccttaaagacaactggagtcccgctttgactatttcaaaggttttgctgtctatttgttcccttttgacagactgcaaccctgcggatcctctggttggaagcatagccactcagtatttgaccaacagagcagaacacgacaggatagccagacagtggaccaagagatacgcaacataattcacataatttgtatgcagtgtgaaggagcagaaggcatcttctcactgtgctgcaaatctttatagcctttacaatacggacttctgtgtatatgttatactgattctactctgcttttatcctttggagcctgggaga

SEQ ID NO: 33612 - DNA, 752 bp, Homo sapiens
ccaagggcggcaggggccagcccgccgggtccccgccgcgctctttgtcctggccgcgcgcgggcggacgcgtgcacccccagggtgaggggaggtgtggagagcgcgcacgggagcgcgcgggaacagctcgcgcccgccgggcgtcggcggcgcgcgcccctccgccagcggcgcgcgagcgggccgggcgggcggccgagttttccaagagataacttcaccaagatgtccagtgataggcaaaggtccgatgatgagagccccagcaccagcagtggcagttcagatgcggaccagcgagacccagccgctccagagcctgaagaacaagaggaaagaaaaccttctgccacccagcagaagaaaaacaccaaactctctagcaaaaccactgctaagttatccactagtgctaaaagaattcagaaggagctagctgaaataacccttgatcctcctcctaattgcagtgctgggcctaaaggagataacatttatgaatggagatcaactatacttggtccaccgggttctgtatatgaaggtggtgtgttttttctggatatcacattttcatcagattatccatttaagccaccaaaggttactttccgcaccagaatctatcactgcaacatcaacagtcagggagtcatctgtctggacatccttaaagacaactggagtcccgctttgactatttcaaaggttttgctgtctatttgttcccttttgacagactgcaaccc

SEQ ID NO: 33613 - DNA, 766 bp, Homo sapiens
gccagcccgccgggtccccgccgcgctctttgtcctggccgcgcgcgggcggacgcgtgcacccccagggtgaggggaggtgtggagagcgcgcacgggagcgcgcgggaacagctcgcgcccgccgggcgtcggcggcgcgcgcccctccgccagttttccaagagataacttcaccaagatgtccagtgataggcaaaggtccgatgatgagagccccagcaccagcagtggcagttcagatgcggaccagcgagacccagccgctccagagcctgaagaacaagaggaaagaaaaccttctgccacccagcagaagaaaaacaccaaactctctagcaaaaccactgctaagttatccactagtgctaaaagaattcagaaggagctagctgaaataacccttgatcctcctcctaattgcagtgctgggcctaaaggagataacatttatgaatggagatcaactatacttggtccaccgggttctgtatatgaaggtggtgtgttttttctggatatcacattttcatcagattatccatttaagccaccaaaggttactttccgcaccagaatctatcactgcaacatcaacagtcagggagtcatctgtctggacatccttaaagacaactggagtcccgctttgactatttcaaaggttttgctgtctatttgttcccttttgacagactgcaaccctgcggatcctctggttggaagcatagccactcagtatttgaccaacagagcagaacacgac

SEQ ID NO: 33614 - DNA, 654 bp, Homo sapiens
caatatgaagagctacggccaagttcatgcagtcacaggcaatgacaactatatcaccaatgctgcctggctgagagtgatttaagacatcattgattggaagttttccaagagataacttcaccaagatgtccagtgataggcaaaggtccgatgatgagagccccagcaccagcagtggcagttcagatgcggaccagcgagacccagccgctccagagcctgaagaacaagaggaaagaaaaccttctgccacccagcagaagaaaaacaccaaactctctagcaaaaccactgctaagttatccactagtgctaaaagaattcagaaggagctagctgaaataacccttgatcctcctcctaattgcagtgctgggcctaaaggagataacatttatgaatggagatcaactatacttggtccaccgggttctgtatatgaaggtggtgtgttttttctggatatcacattttcatcagattatccatttaagccaccaaaggttactttccgcaccagaatctatcactgcaacatcaacagtcagggagtcatctgtctggacatccttaaagacaactggagtcccgctttgactatttcaaaggttttgctgtctatttgttcccttttgacagactgcaaccctg

SEQ ID NO: 33615 - DNA, 721 bp, Homo sapiens
tcgctcggcgcagctgttgcggggccatggcggggaccgcgctcaagaggctgatggccgagtacaaacccttgagaacgtgcagtgagagcttgaggaagaaggcctgacttgctgctgcggaattaggagggaaaagtgtatgcgttaaaaggggaaaggctcgttggtggagctttgaaagaattaacactgaatcctccggaaggaattgtagcaggccccatgaatgaagagaacttttttgaatgggaggcattgatcatgggcccagaagacacctgctttgagtttggtgtttttcctgccatcctgagtttcccacttgattacccgttaagtcccccaaagatgagatttacctgtgagatgtttcatcccaacatctaccctgatgggagagtctgcatttccatcctccacgcgccaggcgatgaccccatgggctacgagagcagcgcggagcggtggagtcctgtgcagagtgtggagaagatcctgctgtcggtggtgagcatgctggcagagcccaatgacgaaagtggagctaacgtggatgcgtccaaaatgtggcgcgatgaccgggagcagttctataagattgccaagcagatcgtccagaagtctctgggactgtgagacctggcctcgcacaggcgcgcacacaccgccaagcagctcagcattctcccccggcacacttagtgacagtgatgctctg

SEQ ID NO: 33616 - DNA, 3106 bp, Homo sapiens
acaagaccaggaccctgaggcctctggaagtgccgggaccgaaccaaccccgcagagcgactaaggcgagggcaggagccaagagaatcgtagccgcggtcgcgggttgagctcccaccacccggacagcgcgcctcggcgatcgcgcacgcgccacgccccggaagagttcctgggcccgcgacggtggcccggaagcagtccccggtgtcggggcaggaggcacgcgcgcggctgaggcgaggtcgctcggcgcagctgttgcggggccatggcggggaccgcgctcaagaggctgatggccgagtacaaacaattaacactgaatcctccggaaggaattgtagcaggccccatgaatgaagagaacttttttgaatgggaggcattgatcatgggcccagaagacacctgctttgagtttggtgtttttcctgccatcctgagtttcccacttgattacccgttaagtcccccaaagatgagatttacctgtgagatgtttcatcccaacatctaccctgatgggagagtctgcatttccatcctccacgcgccaggcgatgaccccatgggctacgagagcagcgcggagcggtggagtcctgtgcagagtgtggagaagatcctgctgtcggtggtgagcatgctggcagagcccaatgacgaaagtggagctaacgtggatgcgtccaaaatgtggcgcgatgaccgggagcagttctataagattgccaagcagatcgtccagaagtctctgggactgtgagacctggcctcgcacaggcgcgcacacaccgccaagcagctcagcattctcccccggcacacttagtgacagtgatgctctgtgctggtaccaaacaaggcagacttgcaagaaccatggcatcttttttttttttcaaacctttcctacttcaaacaggcttctcttctgaaatgatgacttaatgtcgaatattgacagcttactgcagttttacagtattcctcacaaagggcttcaggtagattatcagagctgtcagcactacctctccccgctgaaaccagcagttcatggcttcctgtggattccctccctccctggagtgttgagggggttgtacctgccagacttccaggggacgatggaatacccagaacgctccttctgaagaaatggggccctgtagctgcagcacaggggaagggcccggcaccctttctgggtccttcctggttccctgtgggccccatgaggagtccattacttcctttcttccttcatattttacaggcagatgcttttcttataatctaattacatcttttcatttgttatatattacaaaccatcacacttagaaatacttccaggaaatgcttttttgaagtgtgaattaataagaaatggggtaaatagaaaagaaatttattgctgattggccaggtgcggtggttcgtgcctgtaatcccagctctttgggaggccaaggcaggtagatcacaaggtcaggaaattgagaccatcctggctaatacagtgaaaccccatgtctgctaaaattacaaaaaattagctgggcgtggtggtgcacgcctgtagtctcagctactcaggaggctgaggcaggagaatcgcttgaacccgggaggcagaggtagcagtgagctgaagtcccgccactgcactccagcctgggcaacagagcgagactcagtctcaaaaagaaaaaagaaatttattgctgatcacaaggacagacagttttttcccgaccatactcatcaaagatttacgtttgtatattagtaactagtgcattactagagcaggtgcaggtgaggtctttaaagtttcaatgaaagtttcttctggatctacagaaaaaatttttttttttcaatctaaaaactggaaattctagggtttttgtacattttggatgcactgggaatttattagcacaaaatcattctttgcaactcaaaattcagaagggactctaccatatcttagctcagagcacagaggagtgccttatccccacacttgactgggctgtggaggtgggcatgtgggcccctgggcccaggctggggacagagcccttgttttgtgacttaggattttgatgtggttcccatgttctctaacagggccagctgagcagcacaggccaggaggccacagtgtaagcaataacagatctgccacatgcagaagcaaatatcaggcctgtcgcacacgggcggcatttaaataggaatttctatttttgaaataagggatggtctatgaggcatacagtagatttgatgtgatccttttctccctcccttccataatggatcgtggtctgtgtgactgaacccacacagagtgtcatgggtgacagtttctggttgaagtagctccacgcctggcttctgtggacagcagattcttttccttctcacaaggggctcatttaaaatttggaggctgggtgctgtggctcacgcctgcaatcccagcactttgggagactgaggcgggcggatcatgaggtcaggagatcgcgaccatcctggctaacagtgaaaccctgtctccactaaaaatacaaaaaattagccgggcgtggtggcgggcgcctgtagtcccagctactctgaagactgaggcaggagaatggcgtgaacccaggaggcggagcttgcagtgagctgagatcacgccactgcactccagcctgggcaacagagtgagactctgtctcaaaaaaaaaaaaaaaaaaaatggaacgcagggcaagaactcgtatttggaaggagatgggggaaaggagcggtattatacctatgttgtatttgcaggcaaatgagatggagccctctctgtaaagaagagtcatttgtgcaagtagacggggtctgtgggtgcaggccctggaggggcacacaattgcctggaggcttctgtgagatcgggagagggaggagaggcagtctcttgacaaaataaagtatttttattcatttgtatttattaaatgaaaaaacaatcccatggtgtccctgttgtgtggtggaacctaatgactgttgaaataaagttctgtgttttccctgccctgca

SEQ ID NO: 33617 - DNA, 5151 bp, Homo sapiens
ggggtagggaggccgactgagcaggagtcgtccgcttatagtggaggctgctaggagccggtcagagggtgagtggggagcaggcgagcgagccacagcaggcaggagggagcgtcgcgcggcgcagaggagcgccggggcagggccgcggcggaaccacagccggagaggggcagcccgagccgggcgccgcagggtccccacccccacccggccggacagtgcccggtgttcccccgtgcggggggcggcggcggcggctgacgggaccgccgggaccgcgggggtgttgccacctccaccgaggagccggcgcggccgcgggctcctcagagccggggccccgggcccgtgacagacgggccgaggaagggagagaggcggcggcgacaccatgtcatctcccagtccgggcaagaggcggatggacacggacgtggtcaagctcatcgagagtaaacatgaggttacgatcctgggaggacttaatgaatttgtagtgaagttttatggaccacaaggaacaccatatgaaggcggagtatggaaagttagagtggacctacctgataaataccctttcaaatctccatctataggattcatgaataaaattttccatcccaacattgatgaagcgtcaggaactgtgtgtctagatgtaattaatcaaacttggacagctctctatgatcttaccaatatatttgagtccttcctgcctcagttattggcctatcctaaccccatagatcctctcaatggtgacgctgcagccatgtacctccaccgaccagaagaatacaagcagaaaattaaagagtacatccagaaatacgccacggaggaggcgctgaaagaacaggaagagggtaccggggacagctcatcggagagctctatgtctgacttttccgaagatgaggcccaggatatggagttgtagtagaaaaagcacctgcttttcagaaagactattatttcctaaccatgagaagcagactataatattcatatttaaacaaagcaattttttttattactaaacaaggtttttatgaataatagcattgatatatatatattatatatcaccctttagatcttgatttcttggtcatttctcaacctgaggtgcatagcatattcccacattccatttggtagcaatatgcggtctgaatgcatgcattcatgagtccatgtggccaagtcagcctgtgtgctactgaactgtcgaaggaaatagccgctctgataggtagatgtgagtaaaaagaacaggaaaaaattgcttcttttattggtttccaaagaaacaaaccaaaccaaccagctcttggatgtgaagataaaatagtgcttttttgaaatggagaggaaaaacttggggaggaagaggcctgctgtgggggcatcggagccagccatgtaagaatcagagctgctccttcctgtgaatcctaggtggccctatgtcttctgtggagttacagtataaagcagggagctaattaagagtattaaaacttaaaaccattttttgactctgattttaagtacatttttatatgtcagttgctgcccttcacactaccaggccctgcagccacagtgttctgttggagaaacttggggaagtgttttctgaaccagttctttttcttggggtagagcgtgaaatccagacctgtttttgaaaggacagcacaggaggagaaaagtgactgggacgatgcttcctctcatccaaaacacatgcagagtcacatcctcatcctagtgtttggcagtttgagaccgctaccctgaacttaagagctttaaatatgagggttgtgtttctgggggggttatttttttggtgtgtgtgtgtgtgtattgtgcttagaaaggttgcagatttcatcttcacctaccaagaggcggccgcctccttggacaagccgctcatggaccattagacttgagaagacgacccacgtggtgactgcaaagccctgggtacttgccttcatgttctggtttggttttccctttttctgctgctcttggcagcagcctggtcatcatctgcttgtgggagtgggaaatgggtattttagacccaacacaggttctaaatttaaaacaaataataattggaacaaataaaggttcttgtacccagagtgattctacatgggaaaaacaaaccagcttttttcagagagtgaccgaataggaagaagggattcagaaatatgatgtagtagaacatgccctgcaggaagaaaatgttttctctcctgcgtatgttaagaggaaatcagtttaaaatgcctgctaatcaaatgtcgactcagctaaccatatgtccaggttgctgcagagtttctttcaaatctgagtgttgcctgctgaactcggaggggagtttggagaaattttagacagcagctctgtgttctttttttgccgcagccaataagataatagcagaattagccaatcctaaaaccttctaaagacgatttttgagcatcccactgggattatttaatttttctttttgacgtgtgtttttagtttagaagtgctgtattccacaaggtttaagtcagtgaggttggaagataccctatcttttttattcaaaaagcacaatcaatcttttgtttgaaaatctatataaagtacaacttgcttttagcatgattattttcctaaataaaaagacaaagaatttacttactttatgttaattacgggcatgaagcaaaaggttttctttaaaaaaaaaaaaaagtgcagtgatgtagggctgtggttagttaaccgtactgagttatccatctagcatctgtggcttgctggaagggtagtattaactatttaacatgtaatggtgtacttcactcttacctagcacgctgtcttctcattgctttgggggagggagggtctctctgctggcactgtctaacttgcttacctgctgactttgcagtttgcttgtgctatgacatttattgtaggtgctatttagggtaggcttaaagtgctgggtggtgatttgagttcaaacaataaaaaattgtattttttcaatattgtataaacaatagtgttctaattaccttaaaaaaaaataatgaccagttaagaattgcttttgatcttgtcaaaaaactgaatagaccccagtttcgggaaggtgtgtgagcagtgccatgactctgccccttacctaatcccacatctctctaatgataagacattggctcgcctctgaccagagccccagcaccagagagcggaagatgcagaattgtcaaatgacctgctgggggaggttgtaggagtttagcagatttgagtgtggctgcagagagagagagtgtgtgtatgtgtgcacatgtgtgagagtgtgagcgagagtgtgtgtgtgtccatctaagtgtgtgtgatgaaggtgggataaggctcctctgttagtgctggaagctcctgtaattgccgcatggatcccactgtgccctcttgttctgtgcaagtctgtcctgtctgggcactaaccttggtcccatgcatgtttatgttctgggtggggctttgcctctccactgggaaactgacttttgctgggttgaacagagtcccttatgctttttgtcctctccctgcgcctgggagaggtgggagtaggagcccaaacacacaggtacagaaagatctggaagaaggcctggcagtgaatccaaggactctgggcccccaacaatagatggtagcgtaagtctggagcagcggtgtttcaccaccaaatgcctttccaggctgcccttccaacactcaggagagcatccagatccctgggcagaggctctacattcttggctttagaggtggtggcagcggcagcaggtcagagccacttctggcggtttccctcccctttttagtgcccatagtttttggatcctcccttgagttttaccagcacaagccattctttgcccctgttcacataactgagctcaagctcttgccaaacaccaacaagcaagatggttgcaacctggcaacattgaatccaccacccttgggctccctctggaagccccagcaccggggggcttttgggcacagggtcagtggtagccatcttagacactgacatttggctttgtcgtcaatttcatcaccctccttgaggttactgtgcagtttcaaccagcattttatcctagtgaggtcattatcaggagttgccatatcatctctccagtacctaacatttctcatccacttcaaaagctgttctgactgccagctggctgatctaagctcctgaggaatgtctcctctcaaaggaatttttccctccaaaggccccctgaagtcctagttggcattggcctggcacatgctttatgttaggcctcccgttgggatggctgagaatcatgaaagacagatcctccgctagcctctgtgggtcaagtttctggacaccaagtctctgggaactagtgtttgattttaaatggcatgtggcccttccttgtttcagtgacttagaaaagtaaaagccatttaaaaaagttagcaagattttttatcgacttcccaactgggcttccagccttgttgaatgaaatcatctatctctgattgggcgcaacgaactgcatttctttggacttctgaatccatgtttgtgctttctctggcccgtgaacacctcggcgattctgttagggatgggatgagtgggaggaagccctttgagaagggggagccggccctgtcatgcgcaggttttccactcatctgaggaagagccagggctctgaatttagcctaacactcatcttggctgtgggcttgggaagaaatggccattatttacagattgtatttggtacatattgtgtgatacttgaaaagataaaagggactgccagcccctaactgaaatctgaagctttttatcgcttatttttcctcgccctgtctcctcccttccacctttctccttgcattgtgatgatctagtaggcacgtctgtcaacaggacacatgcctcctctgactataacctcttaatagttgtgtataatgaaaactgtaaacttttttaaataaacgtgtatataccttggcaaa

SEQ ID NO: 33618 - DNA, 535 bp, Homo sapiens
ccgcgggctcctcagagccggggccccgggcccgtgacagacgggccgaggaagggagagaggcggcggcgacaccatgtcatctcccagtccgggcaagaggcggatggacacggacgtggtcaagctcatcgagagtaaacatgaggttacgatcctgggaggacttaatgaatttgtagtgaagttttatggaccacaaggaacaccatatgaaggcggagtatggaaagttagagtggacctacctgataaataccctttcaaatctccatctatagatcttaccaatatatttgagtccttcctgcctcagttattggcctatcctaaccccatagatcctctcaatggtgacgctgcagccatgtacctccaccgaccagaagaatacaagcagaaaattaaagagtacatccagaaatacgccacggaggaggcgctgaaagaacaggaagagggtaccggggacagctcatcggagagctctatgtctgacttttccgaagatgaggcccaggatatggagttgtag

SEQ ID NO: 33619 - DNA, 2822 bp, Homo sapiens
agcgtcaccgtcctgcgacgcttcagaggatccttaggcctcagtggtctttgacccccggccccaggacctgaccccaaggaaacctccgggacctgtggctggagagggactttgaacatgtcggggatcgccctcagcagactcgcccaggagaggaaagcatggaggaaagaccacccatttggtttcgtggctgtcccaacaaaaaatcccgatggcacgatgaacctcatgaactgggagtgcgccattccaggaaagaaagggactccgtgggaaggaggcttgtttaaactacggatgcttttcaaagatgattatccatcttcgccaccaaaatgtaaattcgaaccaccattatttcacccgaatgtgtacccttcggggacagtgtgcctgtccatcttagaggaggacaaggactggaggccagccatcacaatcaaacagatcctattaggaatacaggaacttctaaatgaaccaaatatccaagacccagctcaagcagaggcctacacgatttactgccaaaacagagtggagtacgagaaaagggtccgagcacaagccaagaagtttgcgccctcataagcagcgaccttgtggcatcgtcaaaaggaagggattggtttggcaagaacttgtttacaacatttttgcaaatctaaagttgctccatacaatgactagtcacctgggggggttgggcgggcgccatcttccattgccgccgcgggtgtgcggtctcgattcgctgaattgcccgtttccatacagggtctcttccttcggtcttttgtatttttgattgttatgtaaaactcgcttttattttaatattgatgtcagtatttcaactgctgtaaaattataaacttttatacttgggtaagtcccccaggggcgagttcctcgctctgggatgcaggcatgcttctcaccgtgcagagctgcacttggcctcagctggctgtatggaaatgcaccctccctcctgccgctcctctctagaaccttctagaacctgggctgtgctgcttttgagcctcagaccccaggtcagcatctcggttctgcgccacttcctttgtgtttatatggcgttttgtctgtgttgctgtttagagtaaataaactgtttatataaaggttttggttgcattattatcattgaaagtgagaggaggcggcctcccagtgcccggccctccccacccacctgcagccccaccgcgggccaggaccaggctctccatctgcttcggatgcacgcaggctgtgaggctctgtcttgccctggatctttgtaaacagggctgtgtacaaagtgctgctgaggtttctgtgctccccgcatctgcgggctgtagagcgctgggcagctaagatctgcataggtcgggattggcatcgagaccctggcaactgcaccggtgccagctgtcttgggggccacaaggccaggtccagaccagggctgggggctgcctgaggactcctatccgggcagcctgctggcgggggttcccctcttcagtggccaggtcacagggatggagctgcgctgtgcatagggtgccacctcaggtgtctgtcccttgtgtcctcaggaggcagccttgctaccacccgtggcaaacgccaggtgctttttctgggagagcccacagccgtggccctccagggcttccccgacccttagcgccaggtagagggccctgggcagcctgtgtctggaattcttcgtcctgaggccacctgagtgtggtctgtcctggggaggctgtgcgcctcagcagccgtcctgacgctgagccctctgcaaaggttgggccggccaggcctcttggggctgcctgagccactgcaggaagtggcctggctgggaagttgggtgccggtcacctcccagcaggaaggcacagtggacagagatgggaagccctgggggacacagcccggtgctcccagccctccaacctctggctcccaacccagtctccccatcctagcgagcttggccctcctcagtttcgtttcaagccttggggctggagctggccctgctgccctggcaccccccggtggctggagctgggtccccgtggcccaagtgcagggtcccaagagggcagggcggggctccccaaaggagcaaagaatgcagggagggcggtccagggccctgggaaggggagctcggcaccctccaggtccgtgtgggactccagccgctgttggctgggaatcgaagttagaggtgacttccaaaggccccccgagccggcagtgccccccaccacccctccagcgactctgcggtgccagtgccttgttggcttttccggctacgcaccctgcagtcactgagctctcggtctgacgtctgatgtttgtggtttgtttataacacggggccttacctggggaattcagctggtttgaatatttgtagcccgctcccagaatgtcttattttgtaatgactgaactacatttagtaatagttacacatgtatatggttaatacatatggaaattcaatatattttgtagttaacgtattctgaagtaacggatgtttctcgccaatcgtagtgacttcagctaacgaaatgttcttttgtagtaccacggtcctcggcctaacgaaggacgtgaaccttgtaagaggagagctctgaaacgcggtcacctttgtttagtggaagggaaagtgtgttcccggcatgaggtgcctcggaattagtaaagaattgtgggcaatggattaaccactgtatctaagaatccaccattaaagcatttgcacagac

SEQ ID NO: 33620 - DNA, 2967 bp, Homo sapiens
gtcaccgtcctgcgacgcttcagaggatccttaggcctcagtggtctttgacccccggccccaggacctgaccccaaggaaacctccgggacctgtggctggagaggtgaccgccaggcatccggggagcctttggagatctcggcttcctttttcccccgctgcttgccggcgtgtcctcgggtggacgcgggcagcccgaaggggagtttacagacgctccctcacatcggggacgcggctcctttaagggcggactttgaacatgtcggggatcgccctcagcagactcgcccaggagaggaaagcatggaggaaagaccacccatttggtttcgtggctgtcccaacaaaaaatcccgatggcacgatgaacctcatgaactgggagtgcgccattccaggaaagaaagggactccgtgggaaggaggcttgtttaaactacggatgcttttcaaagatgattatccatcttcgccaccaaaatgtaaattcgaaccaccattatttcacccgaatgtgtacccttcggggacagtgtgcctgtccatcttagaggaggacaaggactggaggccagccatcacaatcaaacagatcctattaggaatacaggaacttctaaatgaaccaaatatccaagacccagctcaagcagaggcctacacgatttactgccaaaacagagtggagtacgagaaaagggtccgagcacaagccaagaagtttgcgccctcataagcagcgaccttgtggcatcgtcaaaaggaagggattggtttggcaagaacttgtttacaacatttttgcaaatctaaagttgctccatacaatgactagtcacctgggggggttgggcgggcgccatcttccattgccgccgcgggtgtgcggtctcgattcgctgaattgcccgtttccatacagggtctcttccttcggtcttttgtatttttgattgttatgtaaaactcgcttttattttaatattgatgtcagtatttcaactgctgtaaaattataaacttttatacttgggtaagtcccccaggggcgagttcctcgctctgggatgcaggcatgcttctcaccgtgcagagctgcacttggcctcagctggctgtatggaaatgcaccctccctcctgccgctcctctctagaaccttctagaacctgggctgtgctgcttttgagcctcagaccccaggtcagcatctcggttctgcgccacttcctttgtgtttatatggcgttttgtctgtgttgctgtttagagtaaataaactgtttatataaaggttttggttgcattattatcattgaaagtgagaggaggcggcctcccagtgcccggccctccccacccacctgcagccccaccgcgggccaggaccaggctctccatctgcttcggatgcacgcaggctgtgaggctctgtcttgccctggatctttgtaaacagggctgtgtacaaagtgctgctgaggtttctgtgctccccgcatctgcgggctgtagagcgctgggcagctaagatctgcataggtcgggattggcatcgagaccctggcaactgcaccggtgccagctgtcttgggggccacaaggccaggtccagaccagggctgggggctgcctgaggactcctatccgggcagcctgctggcgggggttcccctcttcagtggccaggtcacagggatggagctgcgctgtgcatagggtgccacctcaggtgtctgtcccttgtgtcctcaggaggcagccttgctaccacccgtggcaaacgccaggtgctttttctgggagagcccacagccgtggccctccagggcttccccgacccttagcgccaggtagagggccctgggcagcctgtgtctggaattcttcgtcctgaggccacctgagtgtggtctgtcctggggaggctgtgcgcctcagcagccgtcctgacgctgagccctctgcaaaggttgggccggccaggcctcttggggctgcctgagccactgcaggaagtggcctggctgggaagttgggtgccggtcacctcccagcaggaaggcacagtggacagagatgggaagccctgggggacacagcccggtgctcccagccctccaacctctggctcccaacccagtctccccatcctagcgagcttggccctcctcagtttcgtttcaagccttggggctggagctggccctgctgccctggcaccccccggtggctggagctgggtccccgtggcccaagtgcagggtcccaagagggcagggcggggctccccaaaggagcaaagaatgcagggagggcggtccagggccctgggaaggggagctcggcaccctccaggtccgtgtgggactccagccgctgttggctgggaatcgaagttagaggtgacttccaaaggccccccgagccggcagtgccccccaccacccctccagcgactctgcggtgccagtgccttgttggcttttccggctacgcaccctgcagtcactgagctctcggtctgacgtctgatgtttgtggtttgtttataacacggggccttacctggggaattcagctggtttgaatatttgtagcccgctcccagaatgtcttattttgtaatgactgaactacatttagtaatagttacacatgtatatggttaatacatatggaaattcaatatattttgtagttaacgtattctgaagtaacggatgtttctcgccaatcgtagtgacttcagctaacgaaatgttcttttgtagtaccacggtcctcggcctaacgaaggacgtgaaccttgtaagaggagagctctgaaacgcggtcacctttgtttagtggaagggaaagtgtgttcccggcatgaggtgcctcggaattagtaaagaattgtgggcaatggattaaccactgtatctaagaatccaccattaaagcatttgcacagac

SEQ ID NO: 33621 - DNA, 2977 bp, Homo sapiens
gcgggcaacggggagcgctcggcggcgcgggaggcgctcggggccgggcggcaggagcggcgcgcgaggcaggcgtgcagagggcagccccgcgttaggccccgccccgcgcgccccgcccgcgccagggtcctcggagctgctctggctgcgcgcggagcgggctccggagggaagtcccgagacaaagggaagcgccgccgccgccgccccgctcggtcctccacctgtccgctacgctcgccggggctgcggccgcccgagggactttgaacatgtcggggatcgccctcagcagactcgcccaggagaggaaagcatggaggaaagaccacccatttggtttcgtggctgtcccaacaaaaaatcccgatggcacgatgaacctcatgaactgggagtgcgccattccaggaaagaaagggactccgtgggaaggaggcttgtttaaactacggatgcttttcaaagatgattatccatcttcgccaccaaaatgtaaattcgaaccaccattatttcacccgaatgtgtacccttcggggacagtgtgcctgtccatcttagaggaggacaaggactggaggccagccatcacaatcaaacagatcctattaggaatacaggaacttctaaatgaaccaaatatccaagacccagctcaagcagaggcctacacgatttactgccaaaacagagtggagtacgagaaaagggtccgagcacaagccaagaagtttgcgccctcataagcagcgaccttgtggcatcgtcaaaaggaagggattggtttggcaagaacttgtttacaacatttttgcaaatctaaagttgctccatacaatgactagtcacctgggggggttgggcgggcgccatcttccattgccgccgcgggtgtgcggtctcgattcgctgaattgcccgtttccatacagggtctcttccttcggtcttttgtatttttgattgttatgtaaaactcgcttttattttaatattgatgtcagtatttcaactgctgtaaaattataaacttttatacttgggtaagtcccccaggggcgagttcctcgctctgggatgcaggcatgcttctcaccgtgcagagctgcacttggcctcagctggctgtatggaaatgcaccctccctcctgccgctcctctctagaaccttctagaacctgggctgtgctgcttttgagcctcagaccccaggtcagcatctcggttctgcgccacttcctttgtgtttatatggcgttttgtctgtgttgctgtttagagtaaataaactgtttatataaaggttttggttgcattattatcattgaaagtgagaggaggcggcctcccagtgcccggccctccccacccacctgcagccccaccgcgggccaggaccaggctctccatctgcttcggatgcacgcaggctgtgaggctctgtcttgccctggatctttgtaaacagggctgtgtacaaagtgctgctgaggtttctgtgctccccgcatctgcgggctgtagagcgctgggcagctaagatctgcataggtcgggattggcatcgagaccctggcaactgcaccggtgccagctgtcttgggggccacaaggccaggtccagaccagggctgggggctgcctgaggactcctatccgggcagcctgctggcgggggttcccctcttcagtggccaggtcacagggatggagctgcgctgtgcatagggtgccacctcaggtgtctgtcccttgtgtcctcaggaggcagccttgctaccacccgtggcaaacgccaggtgctttttctgggagagcccacagccgtggccctccagggcttccccgacccttagcgccaggtagagggccctgggcagcctgtgtctggaattcttcgtcctgaggccacctgagtgtggtctgtcctggggaggctgtgcgcctcagcagccgtcctgacgctgagccctctgcaaaggttgggccggccaggcctcttggggctgcctgagccactgcaggaagtggcctggctgggaagttgggtgccggtcacctcccagcaggaaggcacagtggacagagatgggaagccctgggggacacagcccggtgctcccagccctccaacctctggctcccaacccagtctccccatcctagcgagcttggccctcctcagtttcgtttcaagccttggggctggagctggccctgctgccctggcaccccccggtggctggagctgggtccccgtggcccaagtgcagggtcccaagagggcagggcggggctccccaaaggagcaaagaatgcagggagggcggtccagggccctgggaaggggagctcggcaccctccaggtccgtgtgggactccagccgctgttggctgggaatcgaagttagaggtgacttccaaaggccccccgagccggcagtgccccccaccacccctccagcgactctgcggtgccagtgccttgttggcttttccggctacgcaccctgcagtcactgagctctcggtctgacgtctgatgtttgtggtttgtttataacacggggccttacctggggaattcagctggtttgaatatttgtagcccgctcccagaatgtcttattttgtaatgactgaactacatttagtaatagttacacatgtatatggttaatacatatggaaattcaatatattttgtagttaacgtattctgaagtaacggatgtttctcgccaatcgtagtgacttcagctaacgaaatgttcttttgtagtaccacggtcctcggcctaacgaaggacgtgaaccttgtaagaggagagctctgaaacgcggtcacctttgtttagtggaagggaaagtgtgttcccggcatgaggtgcctcggaattagtaaagaattgtgggcaatggattaaccactgtatctaagaatccaccattaaagcatttgcacagac

SEQ ID NO: 33622 - DNA, 3109 bp, Homo sapiens
cagggtcctcggagctgctctggctgcgcgcggagcgggctccggagggaagtcccgagacaaagggaagcgccgccgccgccgccccgctcggtcctccacctgtccgctacgctcgccggggctgcggccgcccgaggctgccctgaggatctgtgtttggtgaaaaggagccaaattcacctgcagggcaggcggctctagcagcttcagaagcctggtgccctggcgacactggacctgccttggcttctttgatcccaaccccacccccgatttctgctctgctgactggggaagtcatcgtgccacccagaacctgagtgcgggcctctcagagctccttcgtccgtgggtctgccggggactgggccttgtctccctaacgagtgccagggactttgaacatgtcggggatcgccctcagcagactcgcccaggagaggaaagcatggaggaaagaccacccatttggtttcgtggctgtcccaacaaaaaatcccgatggcacgatgaacctcatgaactgggagtgcgccattccaggaaagaaagggactccgtgggaaggaggcttgtttaaactacggatgcttttcaaagatgattatccatcttcgccaccaaaatgtaaattcgaaccaccattatttcacccgaatgtgtacccttcggggacagtgtgcctgtccatcttagaggaggacaaggactggaggccagccatcacaatcaaacagatcctattaggaatacaggaacttctaaatgaaccaaatatccaagacccagctcaagcagaggcctacacgatttactgccaaaacagagtggagtacgagaaaagggtccgagcacaagccaagaagtttgcgccctcataagcagcgaccttgtggcatcgtcaaaaggaagggattggtttggcaagaacttgtttacaacatttttgcaaatctaaagttgctccatacaatgactagtcacctgggggggttgggcgggcgccatcttccattgccgccgcgggtgtgcggtctcgattcgctgaattgcccgtttccatacagggtctcttccttcggtcttttgtatttttgattgttatgtaaaactcgcttttattttaatattgatgtcagtatttcaactgctgtaaaattataaacttttatacttgggtaagtcccccaggggcgagttcctcgctctgggatgcaggcatgcttctcaccgtgcagagctgcacttggcctcagctggctgtatggaaatgcaccctccctcctgccgctcctctctagaaccttctagaacctgggctgtgctgcttttgagcctcagaccccaggtcagcatctcggttctgcgccacttcctttgtgtttatatggcgttttgtctgtgttgctgtttagagtaaataaactgtttatataaaggttttggttgcattattatcattgaaagtgagaggaggcggcctcccagtgcccggccctccccacccacctgcagccccaccgcgggccaggaccaggctctccatctgcttcggatgcacgcaggctgtgaggctctgtcttgccctggatctttgtaaacagggctgtgtacaaagtgctgctgaggtttctgtgctccccgcatctgcgggctgtagagcgctgggcagctaagatctgcataggtcgggattggcatcgagaccctggcaactgcaccggtgccagctgtcttgggggccacaaggccaggtccagaccagggctgggggctgcctgaggactcctatccgggcagcctgctggcgggggttcccctcttcagtggccaggtcacagggatggagctgcgctgtgcatagggtgccacctcaggtgtctgtcccttgtgtcctcaggaggcagccttgctaccacccgtggcaaacgccaggtgctttttctgggagagcccacagccgtggccctccagggcttccccgacccttagcgccaggtagagggccctgggcagcctgtgtctggaattcttcgtcctgaggccacctgagtgtggtctgtcctggggaggctgtgcgcctcagcagccgtcctgacgctgagccctctgcaaaggttgggccggccaggcctcttggggctgcctgagccactgcaggaagtggcctggctgggaagttgggtgccggtcacctcccagcaggaaggcacagtggacagagatgggaagccctgggggacacagcccggtgctcccagccctccaacctctggctcccaacccagtctccccatcctagcgagcttggccctcctcagtttcgtttcaagccttggggctggagctggccctgctgccctggcaccccccggtggctggagctgggtccccgtggcccaagtgcagggtcccaagagggcagggcggggctccccaaaggagcaaagaatgcagggagggcggtccagggccctgggaaggggagctcggcaccctccaggtccgtgtgggactccagccgctgttggctgggaatcgaagttagaggtgacttccaaaggccccccgagccggcagtgccccccaccacccctccagcgactctgcggtgccagtgccttgttggcttttccggctacgcaccctgcagtcactgagctctcggtctgacgtctgatgtttgtggtttgtttataacacggggccttacctggggaattcagctggtttgaatatttgtagcccgctcccagaatgtcttattttgtaatgactgaactacatttagtaatagttacacatgtatatggttaatacatatggaaattcaatatattttgtagttaacgtattctgaagtaacggatgtttctcgccaatcgtagtgacttcagctaacgaaatgttcttttgtagtaccacggtcctcggcctaacgaaggacgtgaaccttgtaagaggagagctctgaaacgcggtcacctttgtttagtggaagggaaagtgtgttcccggcatgaggtgcctcggaattagtaaagaattgtgggcaatggattaaccactgtatctaagaatccaccattaaagcatttgcacagac

SEQ ID NO: 33623 - DNA, 1137 bp, Homo sapiens
gcctgctttttctcaggctgccctgaggatctgtgtttggtgaaaaggagccaaattcacctgcagggcaggcggctctagcagcttcagaagcctggtgccctggcgacactggacctgccttggcttctttgatcccaaccccacccccgatttctgctctgctgactggggaagtcatcgtgccacccagaacctgagtgcgggcctctcagagctccttcgtccggactttgaacatgtcggggatcgccctcagcagactcgcccaggagaggaaagcatggaggaaagaccacccatttggtttcgtggctgtcccaacaaaaaatcccgatggcacgatgaacctcatgaactgggagtgcgccattccaggaaagaaagggactccgtgggaaggaggcttgtttaaactacggatgcttttcaaagatgattatccatcttcgccaccaaaatgtaaattcgaaccaccattatttcacccgaatgtgtacccttcggggacagtgtgcctgtccatcttagaggaggacaaggactggaggccagccatcacaatcaaacagatcctattaggaatacaggaacttctaaatgaaccaaatatccaagacccagctcaagcagaggcctacacgatttactgccaaaacagagtggagtacgagaaaagggtccgagcacaagccaagaagtttgcgccctcataagcagcgaccttgtggcatcgtcaaaaggaagggattggtttggcaagaacttgtttacaacatttttgcaaatctaaagttgctccatacaatgactagtcacctgggggggttgggcgggcgccatcttccattgccgccgcgggtgtgcggtctcgattcgctgaattgcccgtttccatacagggtctcttccttcggtcttttgtatttttgattgttatgtaaaactcgcttttattttaatattgatgtcagtatttcaactgctgtaaaattataaacttttatacttgggtaagtcccccaggggcgagttcctcgctctgggatgcaggcatgcttctcaccgtgcagagctgcacttggcctcagctggctgtatggaaatgcaccctccctcctgccgctcctctctaga

SEQ ID NO: 33624 - DNA, 1842 bp, Homo sapiens
gggaagcgagagctgtgagtcctcaagtcgcagctgggctgctccacgtgggagtggagggtggaggaacgtgtggagtttcggagtccagcccagtgcggagacagccttgaaaccgtggttggcgggcgctccactccgctctgggctcgaaccctgcctgaccatagctgtgccccccactttctccctgtctggcccctggctccccccccctcacttagaggagggcacggggaagggcaaacggtccagagggcgggcggcctgcgggctcctctgcatcatgtgaggagggcgtggggaaggacatcccggtggggcccggtctggggctgcctccagcccgggctgcctgtcttggacttagtcgtggacctggaggccagtgcccggctggcccctgtcaccctctcgctgtgacgccagcgcctgctgactggaggacccaggttccttcgcctgctttttctcaggctgccctgaggatctgtgtttggtgaaaaggagccaaattcacctgcagggcaggcggctctagcagcttcagaagcctggtgccctggcgacactggacctgccttggcttctttgatcccaaccccacccccgatttctgctctgctgactggggaagtcatcgtgccacccagaacctgagtgcgggcctctcagagctccttcgtccgtgggtctgccggggactgggccttgtctccctaacgagtgccaggtgaggctgcggcggctccgacgcaggtggagctgctgacctggcccctttctgcggctgcgagggactttgaacatgtcggggatcgccctcagcagactcgcccaggagaggaaagcatggaggaaagaccacccatttggtttcgtggctgtcccaacaaaaaatcccgatggcacgatgaacctcatgaactgggagtgcgccattccaggaaagaaagggactccgtgggaaggaggcttgtttaaactacggatgcttttcaaagatgattatccatcttcgccaccaaaatgtaaattcgaaccaccattatttcacccgaatgtgtacccttcggggacagtgtgcctgtccatcttagaggaggacaaggactggaggccagccatcacaatcaaacagatcctattaggaatacaggaacttctaaatgaaccaaatatccaagacccagctcaagcagaggcctacacgatttactgccaaaacagagtggagtacgagaaaagggtccgagcacaagccaagaagtttgcgccctcataagcagcgaccttgtggcatcgtcaaaaggaagggattggtttggcaagaacttgtttacaacatttttgcaaatctaaagttgctccatacaatgactagtcacctgggggggttgggcgggcgccatcttccattgccgccgcgggtgtgcggtctcgattcgctgaattgcccgtttccatacagggtctcttccttcggtcttttgtatttttgattgttatgtaaaactcgcttttattttaatattgatgtcagtatttcaactgctgtaaaattataaacttttatacttgggtaagtcccccaggggcgagttcctcgctctgggatgcaggcatgcttctcaccgtgcagagctgcacttggcctcagctggctgtatggaaatgcaccctccctcctgccgctcctctctagaaccttctagaacctgggctgtgctgcttttgagcctcagaccccaggtcagcatctcggttctgcgccacttcctttgtgtttatatggcgttttgtctgtgttgctgtttagagtaaataaactgtttatataaa

SEQ ID NO: 33625 - DNA, 3028 bp, Homo sapiens
aaacgctgaggcccagtctgtgcggttcacttgcgttcctccacgcgccccccagcacagtgggaagcacacagtaggtgctccgctctgctcctgtgccccgccccgcggcccctcccccgctccaggaagtgcgggggctccagccgcccggccggccgcgatgcattctggggaaggagcagcaccaaatccaagatggcggccagcaggaggctgatgaaggagcttgaagaaatccgcaaatgtgggatgaaaaacttccgtaacatccaggttgatgaagctaatttattgacttggcaagggcttattgttcctgacaaccctccatatgataagggagccttcagaatcgaaatcaactttccagcagagtacccattcaaaccaccgaagatcacatttaaaacaaagatctatcacccaaacatcgacgaaaaggggcaggtctgtctgccagtaattagtgccgaaaactggaagccagcaaccaaaaccgaccaagtaatccagtccctcatagcactggtgaatgacccccagcctgagcacccgcttcgggctgacctagctgaagaatactctaaggaccgtaaaaaattctgtaagaatgctgaagagtttacaaagaaatatggggaaaagcgacctgtggactaaaatctgccacgattggttccagcaagtgtgagcagagaccccgtgcagtgcattcagacaccccgcaaagcaggactctgtggaaattgacacgtgccaccgcctggcgttcgcttgtggcagttactaactttctacagttttcttaatcaaaagtggtctaggtaacctgtaaagaaaggattaaaaatttaagatgttctagttctgctctctttgttttaaaaatcactgcttcaatctacttcaaaagaatggtgtttcttttcttgtccaattttatccaaaatcttcaagttacatttaacccataaggtttaaaaaaaaggaaaaaaaacggttgtggttccctttcttccctacccttgccactcccactttctggcaccgagtttatttttcacttacttacttccccagaccccgggctcgcctccacaaaggagaaaagactgccctggcggtcctggtggcttttcttagcatgtgtggcactgttgcccagtgtgggagttggtttaaattctcctgactccagtttataacatccttttaaaaaatttaaaaacaaacagccacacccctcctccagtccttctcctcagttcttgtgtgaaactccagctgatgttaccacagtaacatcagttaattgggcaagccctgatgtcagtgtgtgtaactgacctctggcctggcctgcacagagaagccctataatcacaggtctgtggtggccccgaaatggggggcctgctagtcaggaggatgctgtgcacactgtgtgtgatgaatctcgccagaaaggctcctgaggtcccaggttggcacttctccctgcagccattgtagaagatctgctggtccttgcaggcaaagctacagccagaatgtccgtttgaaactcctagctcatctgtcaccgagcttcatccgaatgtgccacggagcttgctctccacttcctccgtgcagtggccctgccacagccctccctcggcacactttgaccctttgtaggattggaattagcaggactcggctatttaaagcaccagtctggggtcgcctgggcccctgctgaccccctcctccagagcagccagcccagcccgggaacaagacggacttcctctcccttcggactcacagcctttgcagagtcaagctccacttgaagctcactcagtaatatcctttcaatgtgttttatattgttttgactgcctttttttgtagaaataaaaattgaccttagaatttatcgtcagataaacttgtaaagatttgaatattaatgtcttttcaaggcaaatgggattgtccccgcactagtagagaatccatgtcgctctgacaccccaaggaagccgacgatccaaatgccgtgtgtcaccaaccccgcttctgccactggcggcttcccttcttggctcttgggggggactagatcctgtggagaagatgacttaaactttgctttttgttttaattttaattctataacttgagatctttccggggcctacaggcgtgtaagacagcttggtctggtctgtgcagaagtggggagtgatgggcaggttcggcagcctaacattgttcaggcgcatggcccctgcggtgtgtacacgaactcggcttcttttgtcctaggtacgccaagggcaggtttctggagactcccttgtgcccgggatggcaagggcaccgggctggcgtttccacatctgtcttcattagcagaaaagtgatgatggattttatttcactcacactccagtttgtaataaaatgccaaattctgtcagctatccaaacaagccaccatttgttcttgttgcttctctggatccagaaatgttgccattcttggaaactgtcccattgcttcgtatttctgccaacgtagctctgcctgcctgtcaacccctcactgcactctgctcatcacgggaggatacctgtgtgccggcagcccctcagggactctcagccctggcactggcaccccagggttggccccgtcagcagaggcttggctttcgagccagtgggtgtctctcctttgggcctgggcggcttgctcctgccagccatgccttcagggtaggctctgagcaagctggcgaacagccctggctgctccaaaaccaaaaagctgggtcctctggaggaggggcgagctgtggagcagccacccactgctgccccaagctcactcaggaattcacacccgcctggtttcttgaagtgtgctgggtccttccctctgctccctactccccaccacggcagagaataggctttctaagatgctgcgatcccgttctgctgcccgtaataaaaatgctctcagacactg

SEQ ID NO: 33626 - DNA, 1225 bp, Homo sapiens
agtatgcaggtcgctgcagggacccgaggcgacacgcgcctgcaggaggtggcactcctgccgcagctcttcgatctgcttgtccttggccagcggcgcgctcgcctgctccgacaggtcccgagcgcgctggcgggcaaagacttggcacagctccaggccggcgcaactctcgccgggtataggcgcgctcacggcccggaggagcttgaagaaatccgcaaatgtgggatgaaaaacttccgtaacatccaggttgatgaagctaatttattgacttggcaagggcttattgttcctgacaaccctccatatgataagggagccttcagaatcgaaatcaactttccagcagagtacccattcaaaccaccgaagatcacatttaaaacaaagatctatcacccaaacatcgacgaaaaggggcaggtctgtctgccagtaattagtgccgaaaactggaagccagcaaccaaaaccgaccaagtaatccagtccctcatagcactggtgaatgacccccagcctgagcacccgcttcgggctgacctagctgaagaatactctaaggaccgtaaaaaattctgtaagaatgctgaagagtttacaaagaaatatggggaaaagcgacctgtggactaaaatctgccacgattggttccagcaagtgtgagcagagaccccgtgcagtgcattcagacaccccgcaaagcaggactctgtggaaattgacacgtgccaccgcctggcgttcgcttgtggcagttactaactttctacagttttcttaatcaaaagtggtctaggtaacctgtaaagaaaggattaaaaatttaagatgttctagttctgctctctttgttttaaaaatcactgcttcaatctacttcaaaagaatggtgtttcttttcttgtccaattttatccaaaatcttcaagttacatttaacccataaggtttaaaaaaaaggaaaaaaaacggttgtggttccctttcttccctacccttgccactcccactttctggcaccgagtttatttttcacttacttacttccccagaccccgggctcgcctccacaaaggagaaaagactgccctggcggtcctggtggcttttcttagcatgtgtggcactgttgcccagtgtgggagttggtttaaattctcctgactccagtttataacatccttttaaaaaatttaaaaacaaacagccacaccc

SEQ ID NO: 33627 - DNA, 1057 bp, Homo sapiens
aatccaagatggcggccagcaggaggctgatgaaggacaaccctccatatgataagggagccttcagaatcgaaatcaactttccagcagagtacccattcaaaccaccgaagatcacatttaaaacaaagatctatcacccaaacatcgacgaaaaggggcaggtctgtctgccagtaattagtgccgaaaactggaagccagcaaccaaaaccgaccaagtaatccagtccctcatagcactggtgaatgacccccagcctgagcacccgcttcgggctgacctagctgaagaatactctaaggaccgtaaaaaattctgtaagaatgctgaagagtttacaaagaaatatggggaaaagcgacctgtggactaaaatctgccacgattggttccagcaagtgtgagcagagaccccgtgcagtgcattcagacaccccgcaaagcaggactctgtggaaattgacacgtgccaccgcctggcgttcgcttgtggcagttactaactttctacagttttcttaatcaaaagtggtctaggtaacctgtaaagaaaggattaaaaatttaagatgttctagttctgctctctttgttttaaaaatcactgcttcaatctacttcaaaagaatggtgtttcttttcttgtccaattttatccaaaatcttcaagttacatttaacccataaggtttaaaaaaaaggaaaaaaaacggttgtggttccctttcttccctacccttgccactcccactttctggcaccgagtttatttttcacttacttacttccccagaccccgggctcgcctccacaaaggagaaaagactgccctggcggtcctggtggcttttcttagcatgtgtggcactgttgcccagtgtgggagttggtttaaattctcctgactccagtttataacatccttttaaaaaatttaaaaacaaacagccacacccctcctccagtccttctcctcagttcttgtgtgaaactccagctgatgttaccacagtaacatcagttaattgggcaagccctgatgtcagtgtgtgt

SEQ ID NO: 33628 - DNA, 1354 bp, Homo sapiens
ttgtccggcgggtcgtccttcgacggcctcctggcctcgccggagcgggtgcggggaggcccacgcagcgacggctggaggaggggtgggcggggctgccgggggtggggtccccggggcggggcggggcgcgctgtgtcgcgggtcggagctcggtcctgctggaggccacgggtgccacacactcggtcccgacatgatggcgagcatgcgagtggtgaaggagctggaggatcttcagaagaagcctcccccatacctgcggaacctgtccagcgatgatgccaatgtcctggtgtggcacgctctcctcctacccgaccaacctccctaccacctgaaagccttcaacctgcgcatcagcttcccgccggagtatccgttcaagcctcccatgatcaaattcacaaccaagatctaccaccccaacgtggacgagaacggacagatttgcctgcccatcatcagcagtgagaactggaagccttgcaccaagacttgccaagtcctggaggccctcaatgtgctggtgaatagaccgaatatcagggagcccctgcggatggacctcgctgacctgctgacacagaatccggagctgttcagaaagaatgccgaagagttcaccctccgattcggagtggaccggccctcctaactcatgttctgaccctctgtgcactggatcctcggcatagcggacggacacacctcatggactgaggccagagccccctgtggcccattccccattcatttttcccttcttaggttgttagtcattagtttgtgtgtgtgtgtggtggagggaagggagctatgagtgtgtgtgttgtgtatggactcactcccaggttcacctggccacaggtgcacccttcccacaccctttacattccccagagccaagggagtttaagtttgcagttacaggccagttctccagctctccatcttagagagacaggtcaccttgcaggcctgcttgcaggaaatgaatccagcagccaactcgaatccccctagggctcaggcactgagggcctggggacagtggagcatatgggtgggagacagatggagggtaccctatttacaactgagtcagccaagccactgatgggaatatacagatttaggtgctaaaccatttattttccacggatgagtcacaatctgaagaatcaaacttccatcctgaaaatctatatgtttcaaaaccacttgccatcctgttagattgccagttcctgggaccaggcctcagactgtgaagtatatatcctccagcattcagtccagggggagccacggaaaccatgttcttgcttaagccattaaagtcagagatgaa

SEQ ID NO: 33629 - DNA, 1573 bp, Homo sapiens
acaaaggatccccgactgccggggagcggtgctcggagggcacaggtctacgccatcccccacgcagtttcggagatggagcgctgggcccatggagggaaggcggcaggctcggcggctccggcagcttgctggggcaggggctcaaggcggcagtccgatagtggaggccgctgagaactgtcacggagctgcgtctgtacagcgagcatcccttatttattcagggcgagtgtgtatttggggcggcgtgcagggggctgacaaagaccggagagctcccggtgcggccgccggcggagcgaagactggaacccgtatgagcgccccccagcgcccctgagcgctcgccgccggtgcacggcgcaccccgcgggaggcagggatcagcaaagccgtgcgccccgaggcccgcccccgtctccgcacaaagaccgagctggaggatcttcagaagaagcctcccccatacctgcggaacctgtccagcgatgatgccaatgtcctggtgtggcacgctctcctcctacccgaccaacctccctaccacctgaaagccttcaacctgcgcatcagcttcccgccggagtatccgttcaagcctcccatgatcaaattcacaaccaagatctaccaccccaacgtggacgagaacggacagatttgcctgcccatcatcagcagtgagaactggaagccttgcaccaagacttgccaagtcctggaggccctcaatgtgctggtgaatagaccgaatatcagggagcccctgcggatggacctcgctgacctgctgacacagaatccggagctgttcagaaagaatgccgaagagttcaccctccgattcggagtggaccggccctcctaactcatgttctgaccctctgtgcactggatcctcggcatagcggacggacacacctcatggactgaggccagagccccctgtggcccattccccattcatttttcccttcttaggttgttagtcattagtttgtgtgtgtgtgtggtggagggaagggagctatgagtgtgtgtgttgtgtatggactcactcccaggttcacctggccacaggtgcacccttcccacaccctttacattccccagagccaagggagtttaagtttgcagttacaggccagttctccagctctccatcttagagagacaggtcaccttgcaggcctgcttgcaggaaatgaatccagcagccaactcgaatccccctagggctcaggcactgagggcctggggacagtggagcatatgggtgggagacagatggagggtaccctatttacaactgagtcagccaagccactgatgggaatatacagatttaggtgctaaaccatttattttccacggatgagtcacaatctgaagaatcaaacttccatcctgaaaatctatatgtttcaaaaccacttgccatcctgttagattgccagttcctgggaccaggcctcagactgtgaagtatatatcctccagcattcagtccagggggagccacggaaaccatgttcttgcttaagccattaaagtcagagatgaattctgg

SEQ ID NO: 33630 - DNA, 668 bp, Homo sapiens
ggtttcaatttcgcttttcctgcctgaaacttgtgataacaactgggtgcatctccagtgcaggaaaagtccttggcatcttggtgccaggcattctgctactgctggtggtgggttatgaacacagatgaccaggatgaagtccttgccttggaataagcccatagcccatcccataatttgatgcctgtattactagagtcctgagaaacacggaatgctgattagaatttgggacaaagttccctgagtattctctggaggaaaagatgcggaggtggacctggaaggcctcctggagagctggaggatcttcagaagaagcctcccccatacctgcggaacctgtccagcgatgatgccaatgtcctggtgtggcacgctctcctcctacccgaccaacctccctaccacctgaaagccttcaacctgcgcatcagcttcccgccggagtatccgttcaagcctcccatgatcaaattcacaaccaagatctaccaccccaacgtggacgagaacggacagatttgcctgcccatcatcagcagtgagaactggaagccttgcaccaagacttgccaagtcctggaggccctcaatgtgctggtgaatagaccgaatatcagggagcccctgcggatggacctcgctgacctgctgacacagaa

SEQ ID NO: 33631 - DNA, 3130 bp, Homo sapiens
cgggcgcgcgcgctctggcctcgtgcacgcgctgaaaccggagcgcgcagggcgcgccagggtgagggggacgggggcggggtgggggcagccctttcccaggcggtagcgggggcggcgtcgctgttgcccttttaagccgcggggccgccgcctcctgccgctggagtcggttacaaaggaagcgccacccaggccgccacacgccgaggcttccgcgcccctcgccattttccagcagcgctcgacgaggcggagccgcgagagcgcggcccaggccggccccgcggggcggtcgcggccgtgacggcggctccgggcccggctccccttccgcgcccggctccccttccgcgcccctcccgccggagatgaggggaagatgtccgtgtcagggctcaaggccgagctgaagttcctggcgtccatcttcgacaagaaccacgagcgattccgcatcgtcagttggaagctggacgagctgcactgccagttcctggtgccgcagcagggcagcccgcactcgctgccgccgccactcacgctccactgcaacatcacggaatcctatccatcttcttcaccgatatggtttgtggattctgaagacccaaatctgacatcagttctggaacgtctagaagatactaagaacaacaatttgcttcgtcagcaattgaagtggttgatatgtgaactctgcagtttatataaccttcctaagcacctggatgttgagatgctagatcaaccactacccacgggtcagaatgggacaacagaagaagtgacttcagaagaagaggaagaagaagaagagatggctgaagatatagaagacttagatcactatgagatgaaggaagaagagcctattagtgggaaaaagtcagaggatgaaggaattgaaaaagaaaatttggcaatattagagaaaattaggaagactcaaaggcaagaccatttaaatggtgcagtgtctgggtcagtgcaagcttcagatagacttatgaaagagctcagggacatatacagatcacagagttataaaacagggatttattcagtggaactcataaatgacagtttatatgactggcatgttaaactgcagaaggttgaccctgatagtcctttgcacagtgatcttcagatcttaaaagaaaaagaaggcatagaatatattttgcttaacttctcttttaaggataactttccatttgatcctccatttgttcgagtggtgttacctgttctctcaggagggtatgtattgggtggaggagcattatgtatggaacttctcacaaaacagggctggagcagtgcctactcaatagaatcggtcatcatgcaaataaatgccaccttagtcaaaggcaaagccagagtgcagtttggagcaaataagaatcaatataatctagcaagagcccaacaatcctataattccattgtacagatacatgagaaaaatggctggtacacccctccaaaggaagatggctaaatgtgttgactgttgtatgtttggactaatgttgctttaaagaaaatctttctaacatgcagacaaaagctttgagtgcccctattacagcagtaccgaagatgttagttaatagatattttagtggataatctgtcatctgacatccagtataagttacagcctttgcattttgctcattttagatatcttggactgagcagtggggcctttactgtatttttcctgataaatacacatactggccactccttatctctttttcttgaaaagtgaactttttaaagcagccaagtcaacatcaggctactgaagttgaggctttagggtaactttcctatattgagcccatgggttacaaggatttgcaatatattgttccatttacagccaatacaggtttaatcgatgttcaatattggtttaggaaatttaaggccttctaaatcataatagctctttcatgtctaaaaccattttatgatattgccaaaatgtgataggaaacctactcattaaattgttaaactttttaatgactatgtgaagatatgaattgtttcctgaagataatactcttaattgagttgtattgtacttcttaggcaaagcagtgtaaaactgtatcaattaaggcttgtgagtagtgatttccactggggcatcagagtcttggctgggctgaatctgctgcttgttggttcagtgtttcttatgaacaagagccacagtacagagcttcaagttatttaaaatactaagtcatcttacgtttccattttattaacgggatgttgcaatcgtttgtaaactaataaacttataaagtgattggcacaaagactccttgagcaaaagctgtgcagttaagtacaaaaagatacttaatttggagactcttacagtaatttttgccatgtcaaaacaatggcttttacattgaaagattaatagaaactctacatatgttaatttttttatagaacctgactcaaatcaaggtactctccattttattgccttacctgaatcagtcctttttggttggtaatagatttttttatacacccacgtttgatttaaaagtaaattctagttcttaagcacttttaacaaatccagaagcacatttttctgcacaaacaagttacaaagttcaaaagtgtttcttgtgcattagctttgagattcagtttttaactttgtaaaccacatctgagagacttgtcatttctacattgtgtgtgtttaatttcttttgattccattttggttaagagagcagtaaatagattttctggtattcttgttcacttgattacatttgtataaagttctgattgccagttgctcagataacaagtgacaaggcagaattctttaaatcagtaaagttccttaagcctaaggctaaatcttgaatacattgttgaattctttaatatcctgatggcaagcagactgatagctgcacatttggcatgctttgtttaatggattttatttttaattgcagatttatttggcaatgtacagtaaattttgtaaacttgcatcaagtttatgaataaagaaccatttaaaaattttgtttgtgctgatcatggcaagcaaaaaaaa

SEQ ID NO: 33632 - DNA, 2883 bp, Homo sapiens
cggccgggcgcgcgcgctctggcctcgtgcacgcgctgaaaccggagcgcgcagggcgcgccagggtgagggggacgggggcggggtgggggcagccctttcccaggcggtagcgggggcggcgtcgctgttgcccttttaagccgcggggccgccgcctcctgccgctggagtcggttacaaaggaagcgccacccaggccgccacacgccgaggcttccgcgcccctcgccattttccagcagcgctcgacgaggcggagccgcgagagcgcggcccaggccggccccgcggggcggtcgcggccgtgacggcggctccgggcccggctccccttccgcgcccggctccccttccgcgcccctcccgccggagatgaggggaagatgtccgtgtcagggctcaaggccgagctgaagttcctggcgtccatcttcgacaagaaccacgagcgattccgcatcgtcagttggaagctggacgagctgcactgccagttcctggtgccgcagcagggcagcccgcactcgctgccgccgccactcacgctccactgcaacatcacggaatcctatccatcttcttcaccgatatggtttgtggattctgaagacccaaatctgacatcagttctggaacgtctagaagatactaagaacaacaatttgcttcgtcagcaattgaagtggttgatatgtgaactctgcagtttatataaccttcctaagcacctggatgttgagatgctagatcaaccactacccacgggtcagaatgggacaacagaagaagtgacttcagaagaagaggaagaagaagaagagatggctgaagatatagaagacttagatcactatgagatgaaggaagaagagcctattagtgggaaaaagtcagaggatgaaggaattgaaaaagaaaatttggcaatattagagaaaattaggaagactcaaaggcaagaccatttaaatggtgcagtgtctgggtcagtgcaagcttcagatagacttatgaaagagctcagggacatatacagatcacagagttataaaacagggatttattcagtggaactcataaatgacagtttatatgactggcatgttaaactgcagaaggttgaccctgatagtcctttgcacagtgatcttcagatcttaaaagaaaaagaaggcatagaatatattttgcttaacttctcttttaaggataactttccatttgatcctccatttgttcgagtggtgttacctgttctctcaggagggctggtacacccctccaaaggaagatggctaaatgtgttgactgttgtatgtttggactaatgttgctttaaagaaaatctttctaacatgcagacaaaagctttgagtgcccctattacagcagtaccgaagatgttagttaatagatattttagtggataatctgtcatctgacatccagtataagttacagcctttgcattttgctcattttagatatcttggactgagcagtggggcctttactgtatttttcctgataaatacacatactggccactccttatctctttttcttgaaaagtgaactttttaaagcagccaagtcaacatcaggctactgaagttgaggctttagggtaactttcctatattgagcccatgggttacaaggatttgcaatatattgttccatttacagccaatacaggtttaatcgatgttcaatattggtttaggaaatttaaggccttctaaatcataatagctctttcatgtctaaaaccattttatgatattgccaaaatgtgataggaaacctactcattaaattgttaaactttttaatgactatgtgaagatatgaattgtttcctgaagataatactcttaattgagttgtattgtacttcttaggcaaagcagtgtaaaactgtatcaattaaggcttgtgagtagtgatttccactggggcatcagagtcttggctgggctgaatctgctgcttgttggttcagtgtttcttatgaacaagagccacagtacagagcttcaagttatttaaaatactaagtcatcttacgtttccattttattaacgggatgttgcaatcgtttgtaaactaataaacttataaagtgattggcacaaagactccttgagcaaaagctgtgcagttaagtacaaaaagatacttaatttggagactcttacagtaatttttgccatgtcaaaacaatggcttttacattgaaagattaatagaaactctacatatgttaatttttttatagaacctgactcaaatcaaggtactctccattttattgccttacctgaatcagtcctttttggttggtaatagatttttttatacacccacgtttgatttaaaagtaaattctagttcttaagcacttttaacaaatccagaagcacatttttctgcacaaacaagttacaaagttcaaaagtgtttcttgtgcattagctttgagattcagtttttaactttgtaaaccacatctgagagacttgtcatttctacattgtgtgtgtttaatttcttttgattccattttggttaagagagcagtaaatagattttctggtattcttgttcacttgattacatttgtataaagttctgattgccagttgctcagataacaagtgacaaggcagaattctttaaatcagtaaagttccttaagcctaaggctaaatcttgaatacattgttgaattctttaatatcctgatggcaagcagactgatagctgcacatttggcatgctttgtttaatggattttatttttaattgcagatttatttggcaatgtacagtaaattttgtaaacttgcatcaagtttatgaataaagaaccattt

SEQ ID NO: 33633 - DNA, 2971 bp, Homo sapiens
gcgtctttccggcttctcgccaggggctggcttgggggcttctggcccatctcggtccccgtctcctagccccgaggggggagtccgcggcggcccaagcccttgtggggtccatggccgccctcagccggcctgctcccgggaccggggcggggcggggcggggcggcgcagctccggctgttgtttgagcccaggccggcaaggggaacggcccttaagttttaacgcctcatttttcagtcggattttccttcttcccgcttgttcagccaattgtttttaagtttgcgtttaaggagaaactgacaatgagaatggactcgttgacggaggaaaagttggaatgcagactctggtgctgtttgagcgacccctctcccccgggcctggctgcgcgctgctgtgttctggaaaggagcatagtaccgtcgttgcggcaggaatcctatccatcttcttcaccgatatggtttgtggattctgaagacccaaatctgacatcagttctggaacgtctagaagatactaagaacaacaatttgcttcgtcagcaattgaagtggttgatatgtgaactctgcagtttatataaccttcctaagcacctggatgttgagatgctagatcaaccactacccacgggtcagaatgggacaacagaagaagtgacttcagaagaagaggaagaagaagaagagatggctgaagatatagaagacttagatcactatgagatgaaggaagaagagcctattagtgggaaaaagtcagaggatgaaggaattgaaaaagaaaatttggcaatattagagaaaattaggaagactcaaaggcaagaccatttaaatggtgcagtgtctgggtcagtgcaagcttcagatagacttatgaaagagctcagggacatatacagatcacagagttataaaacagggatttattcagtggaactcataaatgacagtttatatgactggcatgttaaactgcagaaggttgaccctgatagtcctttgcacagtgatcttcagatcttaaaagaaaaagaaggcatagaatatattttgcttaacttctcttttaaggataactttccatttgatcctccatttgttcgagtggtgttacctgttctctcaggagggtatgtattgggtggaggagcattatgtatggaacttctcacaaaacagggctggagcagtgcctactcaatagaatcggtcatcatgcaaataaatgccaccttagtcaaaggcaaagccagagtgcagtttggagcaaataagaatcaatataatctagcaagagcccaacaatcctataattccattgtacagatacatgagaaaaatggctggtacacccctccaaaggaagatggctaaatgtgttgactgttgtatgtttggactaatgttgctttaaagaaaatctttctaacatgcagacaaaagctttgagtgcccctattacagcagtaccgaagatgttagttaatagatattttagtggataatctgtcatctgacatccagtataagttacagcctttgcattttgctcattttagatatcttggactgagcagtggggcctttactgtatttttcctgataaatacacatactggccactccttatctctttttcttgaaaagtgaactttttaaagcagccaagtcaacatcaggctactgaagttgaggctttagggtaactttcctatattgagcccatgggttacaaggatttgcaatatattgttccatttacagccaatacaggtttaatcgatgttcaatattggtttaggaaatttaaggccttctaaatcataatagctctttcatgtctaaaaccattttatgatattgccaaaatgtgataggaaacctactcattaaattgttaaactttttaatgactatgtgaagatatgaattgtttcctgaagataatactcttaattgagttgtattgtacttcttaggcaaagcagtgtaaaactgtatcaattaaggcttgtgagtagtgatttccactggggcatcagagtcttggctgggctgaatctgctgcttgttggttcagtgtttcttatgaacaagagccacagtacagagcttcaagttatttaaaatactaagtcatcttacgtttccattttattaacgggatgttgcaatcgtttgtaaactaataaacttataaagtgattggcacaaagactccttgagcaaaagctgtgcagttaagtacaaaaagatacttaatttggagactcttacagtaatttttgccatgtcaaaacaatggcttttacattgaaagattaatagaaactctacatatgttaatttttttatagaacctgactcaaatcaaggtactctccattttattgccttacctgaatcagtcctttttggttggtaatagatttttttatacacccacgtttgatttaaaagtaaattctagttcttaagcacttttaacaaatccagaagcacatttttctgcacaaacaagttacaaagttcaaaagtgtttcttgtgcattagctttgagattcagtttttaactttgtaaaccacatctgagagacttgtcatttctacattgtgtgtgtttaatttcttttgattccattttggttaagagagcagtaaatagattttctggtattcttgttcacttgattacatttgtataaagttctgattgccagttgctcagataacaagtgacaaggcagaattctttaaatcagtaaagttccttaagcctaaggctaaatcttgaatacattgttgaattctttaatatcctgatggcaagcagactgatagctgcacatttggcatgctttgtttaatggattttatttttaattgcagatttatttggcaatgtacagtaaattttgtaaacttgcatcaagtttatgaataaagaaccattt

SEQ ID NO: 33634 - DNA, 1582 bp, Homo sapiens
gcgtctttccggcttctcgccaggggctggcttgggggcttctggcccatctcggtccccgtctcctagccccgaggggggagtccgcggcggcccaagcccttgtggggtccatggccgccctcagccggcctgctcccgggaccggggcggggcggggcggggcggcgcagctccggctgttgtttgagcccaggccggcaaggggaacggcccttaagttttaacgcctcatttttcagtcggattttccttcttcccgcttgttcagccaattgtttttaagtttgcgtttaaggagaaactgacaatgagaatggactcgttgacggaggaaaagttggaatgcagactctggtgctgtttgagcgacccctctcccccgggcctggctgcgcgctgctgtgttctggaaaggagcatagtaccgtcgttgcggcaggaatcctatccatcttcttcaccgatatggtttgtggattctgaagacccaaatctgacatcagttctggaacgtctagaagatactaagaacaacaatttgcttcgtcagcaattgaagtggttgatatgtgaactctgcagtttatataaccttcctaagcacctggatgttgagatgctagatcaaccactacccacgggtcagaatgggacaacagaagaagtgacttcagaagaagaggaagaagaagaagagatggctgaagatatagaagacttagatcactatgagatgaaggaagaagagcctattagtgggaaaaagtcagaggatgaaggaattgaaaaagaaaatttggcaatattagagaaaattaggaagactcaaaggcaagaccatttaaatggtgcagtgtctgggtcagtgcaagcttcagatagacttatgaaagagctcagggacatatacagatcacagagttataaaacagggatttattcagtggaactcataaatgacagtttatatgactggcatgttaaactgcagaaggttgaccctgatagtcctttgcacagtgatcttcagatcttaaaagaaaaagaaggcatagaatatattttgcttaacttctcttttaaggataactttccatttgatcctccatttgttcgagtggtgttacctgttctctcaggagggtatgtattgggtggaggagcattatgtatggaacttctcacaaaacagggctggagcagtgcctactcaatagaatcggtcatcatgcaaataaatgccaccttagtcaaaggcaaagccagagtgcagtttggagcaaataagaatcaatataatctagcaagagcccaacaatcctataattccattgtacagatacatgagaaaaatggctggtacacccctccaaaggaagatggctaaatgtgttgactgttgtatgtttggactaatgttgctttaaagaaaatctttctaacatgcagacaaaagctttgagtgcccctattacagcagtaccgaagatgttagttaatagatattttagtggataatctgtcatctgacatccagtataagttacagcctttgcattttgctcattttagatatctt

SEQ ID NO: 33635 - DNA, 4075 bp, Homo sapiens
tcgtgtgtgaggaggaccccgggcgggcccacgggccgtgtggggcctggtctggcccgccgggtgtgtgaagaccggggcccggtgctgcccggccggagggcgagcggaggggaggggcctggtccggcccggccggtgcgtgaggactggggcccgggcccggcgccgccgccgccgccgccgccgcgatggcccagcagcagatgaccagctcgcagaaggccctgatgctcgagctgaaatccctgcaggaggaaccggtggagggcttccggatcaccctggtggacgagtccgacctctacaactgggaggtggccatcttcggaccccccaacaccctctacgaaggcggctacttcaaggcgcatattaaatttcctattgactacccctattcaccacctaccttcagattcttgaccaaaatgtggcaccccaacatttatgagaatggagatgtatgcatttcgattcttcatccgcctgtagatgacccacagagtggagaactgccttctgaaaggtggaatcctactcagaatgtgaggactatcctattaagtgtaatctcactgcttaatgagcccaacaccttctccccagccaatgtcgatgcttcagttatgttcaggaaatggagagacagtaaaggaaaagacaaagaatatgctgaaattattaggaaacaagtttcagccactaaggccgaagcagaaaaggatggagtgaaggtccccacaaccctggcggaatactgcatcaaaactaaagtgccttccaatgacaacagctcagatttgctttacgacgacttgtatgatgacgacattgatgatgaagatgaggaggaggaagatgccgactgttatgatgatgatgattctgggaatgaggagtcgtgacgtgctccttcagtgcccctgtactgccctgccatctcaggccaaagggaggggagcaagtggggacctggccatggcccctcagcaaaaacctattcacagcgggtggggaaacacacacagctcctgctgactccccttatggatctcagtttgctcctttttatggacctttaatggagagagagtaaccctccacagaatgtctgaattcttgcattctttacccttccatcactatattgattctttttttaaaaaatatgaacccaaactcccgcctcacttcgtctctacagaatgttcacagcaaaacacgtttggtctgtttttagattcttgaagaattcaatagtctttcaagatgtttaatgtgtttaaagctgggaacctgttgggagttcacaagtgctgcatatactgggtagcaaaagaaaatggaaaaaaacccacaaaacaaactttaaaaaaaaaaaaaaacaaatttgccaaggtttagctgctcatttacattagtgtgtgtgcattcgttcagccccatggtggtgaattctgtttctttcctttcctaaggctgggacatggtgggcatcagggactttgtgctaagcctgatgaaatgtgctccttcaatctccatgaaaccatcgtaacatggaggcctcagctgctctgaggagagaaatcagactttgttttttgaaatcgattgggatcgaaagcctgaaataaatattcatactttccatagaactgagcacttggttgctatttattttaaaggcagggttatttccccccagggagtggggcaagcggggaagttgggatgagtgcgtgtgggagcaaagagttaaaaatcactatgctaagtttggttgatgctactggggggaaaaagttgaaactactggtgaccactgttgggagaggaaacatctgttttatagatttagcatggccttcccatcaaaaatacactcgtaccatgacgttttgtttttgttttttaagtagccacttttaattactcagtattaatcctaggtgcatgtgttaagatttcggttttcatcgagctgcttatactgatagtgaaaaacttggatgtgtgtgagacgagttaccgccttcttcattggatgtgatctgaactttttttctcctttcaacatacttaggctgtggagtgcaagcagaattatgcatagaaattgtggcagggctgagggagttgactgcaggcagtttttaggccagataaggctagatcttcctgcaatgcacttgctgcagctttgattttccagatctcaatcgtgttgcttcaatcaatattgagatccagcagccttcaccatccaggagacttcagaacttgaaggtaatttttggttgttatgggggtgcaccagatcataggagggcattatttggaggaaaccgctataatgtaaaatcagatttcagaaggaaaatgcagcaaggactgactgtagtcctatttcagacccctgggcactagtgtcaactcctcctttggctcgtaactcagaaagaaccaaagggcagattagggacggggcaggagggatcctaggatggccagagtaggtgacgcttacttccttagctcctccttccattctgatctcagggttttcactcttcaaactcccaaacacatgacttcttcccagcagcccttcccggcctctaaagtttggtcccagcagcccttcccagcctctaaagtttggtctggtatgaaatgggactgtttaacaagcaaggctcttaggggacactgttgagcctggtcccagaatctgtgatctccacagggccagggttgctacttgcacccagaatctagtgattttagtcagatccatggaacagagcagcttcgtaatacattgtcaagttacctgattacaaactctcatagatgttggaactacctttttactccccatactttgtaagtaatgcttccagattaacctgcaaatcttgtggagccaaagcctctcacagtgctgatttacctcccccaaaatgcccccaaacccccatgcaagtttacagccagtagcttggtcttattctcttggagccctaaaattaagcctttcattcccctttgctaaagcatctcactcccagggcagccccagcaccctggcattgcgggaggtgctctgctgcacagctgttccatcaggccctattggcctctgttagacattgactcagggagccggagcgccaagtggaggttgtacctttcagccctttggggtgttaaaagtgtcaagggctgggtttgcctctgatgagtacaatcagttccagaagactgggtaagtctcttgctagcaggtggacattctggtattttagactgactgaacgaaacccagaggctggttccagagctctgtccctgagaacacatccctgtggaaaatacttgagtttgtaattttttttcccccttctgggagtggaggtctcaggctcaatccggaaccatgtacgtacagttttgcttattatttgatgtgacatgaactcaaaatcctgcatttttagattccttttagttctaattgaggcctcactagatgctcttcagttctgtgtattttgaggctgggtggagaagtatatgattctgctgttgattctttcagtcttccccccttctccttttatcaatcattccagagttattttctattagtcaaacttttttgtagaaccttctttcccttaccctggcaaattgcttctttacttgctggtttccttacgtttggggcacatgttgtaagaaactgattggaaggggaaatgtgcagctctccactggaaaggaactctccacccctcccatcctgataaaacaaacaaggtttacatttacaactaaaaggattcagatgcaattttcaactattctgaaaccagcaggacacacctgactttaatagttttagctgaaattgtagatgttttgcttcagtttaacttatgagaaaagattatctgacggattttgtgttgacttcccctttagtggtttattttgtctttttctgcccatctgtctactaataaaatgtgaaataaaatacctgtattgctacttccccatgaaa

SEQ ID NO: 33636 - DNA, 1189 bp, Homo sapiens
cctctccgccacttccctcgcttctgaccatagtttgcggggaagggagcgagcgcgtcgaaaaccaaggaacgtgcgcgctgacgtcacggttgaggctcggagctgaggggccgcggagggcgtggcctgcgggcggttataaagaggcagtggtgcgcgcgcggccggctcagtgctgccgggcaccggggcggcgggttggtctacgctgtgcgcggcggacgtcggaggcagcggggagcggagcggggccgccggggcctctccagggccgcagcggcagcagttgggccccccgccccggccggcggaccgaagaacgcaggaagggggccggggggacccgcccccggccggccgcagccatgaactccaacgtggagaacctacccccgcacatcatccgcctggtgtacaaggaggtgacgacactgaccgcagacccacccgatggcatcaaggtctttcccaacgaggaggacctcaccgacctccaggtcaccatcgagggccctgaggggaccccatatgctggaggtctgttccgcatgaaactcctgctggggaaggacttccctgcctccccacccaagggctacttcctgaccaagatcttccacccgaacgtgggcgccaatggcgagatctgcgtcaacgtgctcaagagggactggacggctgagctgggcatccgacacgtactgctgaccatcaagtgcctgctgatccaccctaaccccgagtctgcactcaacgaggaggcgggccgcctgctcttggagaactacgaggagtatgcggctcgggcccgtctgctcacagagatccacgggggcgccggcgggcccagcggcagggccgaagccggtcgggccctggccagtggcactgaagcttcctccaccgaccctggggccccagggggcccgggaggggctgagggtcccatggccaagaagcatgctggcgagcgcgataagaagctggcggccaagaaaaagacggacaagaagcgggcgctgcggcggctgtagtgggctctcttcctccttccaccgtgaccccaacctctcctgtcccctccctccaactctgtctctaagttatttaaattatggctggggtcggggagggtacagggggcactgggacctggatttgtttttctaaataaagttggaaaagc

SEQ ID NO: 33637 - DNA, 922 bp, Homo sapiens
ggagccacgccaacagtcagaggtcgcgcaggcgctggtaccccgttggtccgcgcgttgctgcgttgtgaggggtgtcagctcagtgcatcccaggcagctcttagtgtggagcagtgaactgtgtgtggttccttctacttggggatcatgcagagagcttcacgtctgaagagagagctgcacatgttagccacagagccacccccaggcatcacatgttggcaagataaagaccaaatggatgacctgcgagctcaaatattaggtggagccaacacaccttatgagaaaggtgtttttaagctagaagttatcattcctgagaggtacccatttgaacctcctcagatccgatttctcactccaatttatcatccaaacattgattctgctggaaggatttgtctggatgttctcaaattgccaccaaaaggtgcttggagaccatccctcaacatcgcaactgtgttgacctctattcagctgctcatgtcagaacccaaccctgatgacccgctcatggctgacatatcctcagaatttaaatataataagccagccttcctcaagaatgccagacagtggacagagaagcatgcaagacagaaacaaaaggctgatgaggaagagatgcttgataatctaccagaggctggtgactccagagtacacaactcaacacagaaaaggaaggccagtcagctagtaggcatagaaaagaaatttcatcctgatgtttaggggacttgtcctggttcatcttagttaatgtgttctttgccaaggtgatctaagttgcctaccttgaatttttttttaaatatatttgatgacataatttttgtgtagtttatttatcttgtacatatgtattttgaaatcttttaaacctgaaaaataaatagtcatttaatgttga

SEQ ID NO: 33638 - DNA, 2281 bp, Homo sapiens
agctcctccccctgcgtctctggcctcgccggtcttggggggatggttccatcatggcgtcaatgcagaccacaggaaggagggtggaagtatggtttccaaaacgactacagaaagaactgttggctttgcaaaatgacccacctcctggaatgaccttaaatgagaagagtgttcaaaattcaattacacagtggattgtagacatggaaggtgcaccaggtaccttatatgaaggggaaaaatttcaacttctatttaaatttagtagtcgatatccttttgactctcctcaggtcatgtttactggtgaaaatattcctgttcatcctcatgtttatagcaatggtcatatctgtttatccattctaacagaagactggtccccagcgctctcagtccaatcagtttgtcttagcattattagcatgctttccagctgcaaggaaaagagacgaccaccggataattctttttatgtgcgaacatgtaacaagaatccaaagaaaacaaaatggtggtatcatgatgatacttgttgatgccactgttatcatcctcctagcagaagatagtcctactgagaaaatgagcactttgatcattcagtctttgaactttaacctttgactggaagtgacctataggcaatgaagactacttccttttactgcatttttactcgtgtgcattctgggcgcatgttgatcgctggttcagtccaggcaactgacatgcttttattagtcatacagtattaatgcaggtgtcaggaaatgtcaaatataattccattttttatttttatttttttaagcttttggaaaagctccaggtcctcatgtattgtgcaataacaatgacttccttggcggttttggtacgttcattgccggcaatgggcgttgtaacaggaaaagttttcattaactcctgccattcaatgattaatgcatgatagggcctatgaaatgaacttactggttatagtgggaatataaataaagtgagggatccaacattactttaaaagtcaccccaactgtttatatttggattctatgcactgtgatcctaaggttaacagcatgaattaacatgcgtctttaaaggactgtaatgaaagatcattgcatatttattgaattgtttatatctactgtcaagttgttttgacatggaagattttcaagtaacattggcagagaggtacagtatgttatccctatggtgaaaataaattaatttgttgtatatagttcctcaatctctgaagtaaaggtatgagtaatatagggtatgaatggtttaatcaaggctttattttggaagtaagaaaaatggcagtgatgattaaattgctgcagtccataatttgggcttgttatttgtacattaaagattttttccaagtaagttacactctgttaacttcctgctagccatcagcatgagccctactgcctaaacactatttcatttatttatgtttggaaaccccgtaaacatttttgtttgcaatcttgtttcttttgttataagtcaagtttgaatgttacaatacttttattgaaacttttgttaagttttttcttgtaaattttctttacttgtgagtatcatcttgtcctttaatcctgtaccctaaaataagaaatacatttttgacagaggcttaatgttttaacaaaagagtgtggacatttttattttaaaatttaggcaaaagtcactatcaaatggttgcttatttgtctcacacagccatatagtttttcctggagggttttgttttgttgttgttgaaaagactttgcttacagctagatgaaactttctatagaaaaaaaaaattgttgaaaggtccagttctcagtaccatgtgagttaatgatactacaactaagttctttttaaaaagtgattaatgtattttataaattaccttttcacatatgcaaaatctgtttctactacaatgttatttttactaatgccttattgttgcactctttttgaaatatcctgcagtgaatatatgaatcaatttgggcttaaaactgaaagccagttggctgaaaggtttgaaatacgtaccccagtaaaaccattcaatcaataattggtaaataatattttaaaattgtttttaatctgtatagatgacattttgtagctttgtacatgttgttaattaagggcatataattttacactcaaagtataattgctgaactcaggggtgggtagacttcaaaaatatgtctgctatagaaataac

SEQ ID NO: 33639 - DNA, 866 bp, Homo sapiens
atcatggcgtcaatgcagaaacgactacagaaagaactgttggctttgcaaaatgacccacctcctggaatgaccttaaatgagaagagtgttcaaaattcaattacacagtggattgtagacatggaaggtgcaccaggtaccttatatgaaggggaaaaatttcaacttctatttaaatttagtagtcgatatccttttgactctcctcaggtcatgtttactggtgaaaatattcctgttcatcctcatgtttatagcaatggtcatatctgtttatccattctaacagaagactggtccccagcgctctcagtccaatcagtttgtcttagcattattagcatgctttccagctgcaaggaaaagagacgaccaccggataattctttttatgtgcgaacatgtaacaagaatccaaagaaaacaaaatggtggtatcatgaactgaaatctgccttcatactatctattacggattgaatcatgtcctccaataagatgtgttgaagtcttaactcccagtacctcaaattgtgaccctatttggaaatagagtcattgcagatgtcattagttgaggtgaggttataccgaagtagaatgtggccttaatccaatataactggtgtcctaagaattggagaagagactcagacacatggggagaagaccatgcagtcatggggtgatgtatcaacaagccagcaaatgccagggattgctgggaacatcagaggctggaagaggcagggaaatgttcttccctagagctgtgggagagaacatgattctgctgacaccttgatcatggacttccagcctccagaactgtgagacaataaatgtctggtttcttttaagtc

SEQ ID NO: 33640 - DNA, 8426 bp, Homo sapiens
gatgttgagcccccgcggcgtgacgcgagcacggcagctcctccccctgcgtctctggcctcgccggtcttggggggatggttccatcatggcgtcaatgcagaaacgactacagaaagaactgttggctttgcaaaatgacccacctcctggaatgaccttaaatgagaagagtgttcaaaattcaattacacagtggattgtagacatggaaggtgcaccaggtaccttatatgaaggggaaaaatttcaacttctatttaaatttagtagtcgatatccttttgactctcctcaggtcatgtttactggtgaaaatattcctgttcatcctcatgtttatagcaatggtcatatctgtttatccattctaacagaagactggtccccagcgctctcagtccaatcagtttgtcttagcattattagcatgctttccagctgcaaggaaaagagacgaccaccggataattctttttatgtgcgaacatgtaacaagaatccaaagaaaacaaaatggtggtatcatgatgatacttgttgatgccactgttatcatcctcctagcagaagatagtcctactgagaaaatgagcactttgatcattcagtctttgaactttaacctttgactggaagtgacctataggcaatgaagactacttccttttactgcatttttactcgtgtgcattctgggcgcatgttgatcgctggttcagtccaggcaactgacatgcttttattagtcatacagtattaatgcaggtgtcaggaaatgtcaaatataattccattttttatttttatttttttaagcttttggaaaagctccaggtcctcatgtattgtgcaataacaatgacttccttggcggttttggtacgttcattgccggcaatgggcgttgtaacaggaaaagttttcattaactcctgccattcaatgattaatgcatgatagggcctatgaaatgaacttactggttatagtgggaatataaataaagtgagggatccaacattactttaaaagtcaccccaactgtttatatttggattctatgcactgtgatcctaaggttaacagcatgaattaacatgcgtctttaaaggactgtaatgaaagatcattgcatatttattgaattgtttatatctactgtcaagttgttttgacatggaagattttcaagtaacattggcagagaggtacagtatgttatccctatggtgaaaataaattaatttgttgtatatagttcctcaatctctgaagtaaaggtatgagtaatatagggtatgaatggtttaatcaaggctttattttggaagtaagaaaaatggcagtgatgattaaattgctgcagtccataatttgggcttgttatttgtacattaaagattttttccaagtaagttacactctgttaacttcctgctagccatcagcatgagccctactgcctaaacactatttcatttatttatgtttggaaaccccgtaaacatttttgtttgcaatcttgtttcttttgttataagtcaagtttgaatgttacaatacttttattgaaacttttgttaagttttttcttgtaaattttctttacttgtgagtatcatcttgtcctttaatcctgtaccctaaaataagaaatacatttttgacagaggcttaatgttttaacaaaagagtgtggacatttttattttaaaatttaggcaaaagtcactatcaaatggttgcttatttgtctcacacagccatatagtttttcctggagggttttgttttgttgttgttgaaaagactttgcttacagctagatgaaactttctatagaaaaaaaaaattgttgaaaggtccagttctcagtaccatgtgagttaatgatactacaactaagttctttttaaaaagtgattaatgtattttataaattaccttttcacatatgcaaaatctgtttctactacaatgttatttttactaatgccttattgttgcactctttttgaaatatcctgcagtgaatatatgaatcaatttgggcttaaaactgaaagccagttggctgaaaggtttgaaatacgtaccccagtaaaaccattcaatcaataattggtaaataatattttaaaattgtttttaatctgtatagatgacattttgtagctttgtacatgttgttaattaagggcatataattttacactcaaagtataattgctgaactcaggggtgggtagacttcaaaaatatgtctgctatagaaataacttgaaaaaaaaaattaaaaccgtggccagccaccaaattgtggacactgtttatatactgctagttaacaattaccacttttaaaaaattataaccgtttttgttctatcttgactagataaattctcacaatgatctctgtcagttttattagttggcctgtttaaccaagacagaaagtctttgaattactcatagttttaaactgcttttaatatgaaaattgcagctgtaaattatgtattttcatattttgcgtaactgctctacactactgtttgacttgatcttcttctgggggttagggagaaatctgtctccatattgctggttctcttaccaaaatgcttttataaagaaatgaccggtgacatttattcaccaaaggaattaatatactgagtcaaagattaacaatgctatactatagagtaataggtcatatatagcctcaattgagttttttatgacaatattttaacatacctctctctctacatataaataccataaagtaaactaaaatgacacagaggaaagtagaggaaaatgaaataatttcggtacatcttatggtttaaagagtagaaaataagatgaaatatcctaaaatataggagcacagacatttaaaattcataatcaggctaacaacactctcttgaatttaggaatcattgaaaactccttgcacttagatttaatttatatgttagttacattattaaaagtcataaggcatttatctgagtcattgctctacagagagcaattaatggcttgtaataataaaaagaatatttctctgtaatgcattgttgaaagacaaccagaatatcaagaaaatgtatataggaatatgctacttgcctcctccctgcatttcctcgtggggcactatttgcgacataggcctacagaattagactttcatacttagaagataaggtacactcttcttcttttatttatttatttatttatttttaggccattcttctggtttgccaaattctattaagacagtgatacatttgcttccttatttatgcatgcttagatcatgaacatgatgcccttcttttttttttttttctttggtcaagtagggattaatgccataggtttagagagaaggattgttttcagtttttaagagaattttttaaaaatacattttatggttctcttaaggaattaatattcacttctgaaggacttacttgtaatatataatttatcattttagccagcagggaaataaatcatttttaatccccagaagaaagtgctggaaatagcttctatatagtcagcagttcacctggagaaagatcttaattccttgttgttttgactaggaatatcaatatttggtataaaataactagaatagtttattaccttttccctcatgaaattttaaatatatgcaaatatatatatcattagattcctgtggtggataataatttcttcagattctaaaacaggtgtctagtgactgcttaattgtttccaagttgcatcaaagatgaattggtaaataatggaaatgagtagtgatatgaaaatggttatgtaactacatattacttgtttctggtaatcaagtcttattttttaaaagcctattgtttttcagaattgagatatttaaaacttgttataacttcttcctaaaaatagaagagaagaggaggtactgtgtgttacaaaaatttttttaaataaagaattcagtgtcactagttctaagcctttatggttactgctgcttatatttcttgatctcactttcattaatttttttgtacatatcttagctgaatgcttaaaatttacaattatttgtaattgtgtatgtaaattgcttttcaaaaagaactgaagcttaaccatattcttcttttctgaggattcattatcagaatcagctactatactgttctgtgttatagtaatgccgttactgcctgtgcatgattgaggtctgtgaagaaggtgtcttttaatctgcaccaactggccccaatcctctttgtagtcctttttaaattgttttaaatctgtcctttatttttcttcctatttttctgcctcttcccactgatgtccaatgtgtcagtcttccgcagtttccttttctcacttctaatttattctctcttttttttttctgaggttagggattctacagaaggacgattattaaaattatgccatgaatttttgaaaaatttaaaatgctctcctacaaataaaatacatggagtttctgatactaatttcagtttgtcagtagatggctaaatttgttgaataattgactacttggtaaatgagctgttagctgtaattagttctttagtactaatattaaggaaattttgttattttcggatgaggactctcccaaagccaaattattgtccaagcaaattatttattttttccatttaaatttctaagtcattttgagatgtggaatgattatttttattatttatttatttatttatttttgagacggagtcttgctctgtcacccgggctttagtgcagtgcacgatcttggctcatttcaatctccacctcctgggtctaagcgattctcctgcctcagcctcttgagtagctgggattacaggcatgtgctgccacacctgactaatttttagtagagacaaggtttcaccgtgttggccaggctggtgttgaactcctgacttcaagtgatctgcccacctcagcctcccaaagtgctgcgattacaggcatgacccaccacacccagcctggaatcattttttaaaaataatttgtgggagacttgctttctcaacataaattgtgtgtgggttgttttttgttttttgagacggtcttcctctgttgcccaggctggagtgtgcagtggaacagtcattgcagccttgaccaccttggctcaagcaatcctcctgcctcccgggtagctgagtctacaggtgtgtgccaccatgcctggatggatagaatttttttttttttttttttttttttttttttttttaaagacacgaggtctcaccatgttgcccaggctgatcttgaattcctgggctcaagcattcctcctgcctcagcctcccaaaatgctgggattacaggtgcaagccaccatgcctcgtctgtttgccgatttaagacaggtttatgtacatcattatcattagaggcacatagaatctagacatgtacttgaaacttagctctctatcctgaaagttgaagttagggttctttgatcctggtgagatgttaattgtaattttaattttcatatgttaatattgtgacttgtattttgtgatgagtctctagaatgattaaatgactatttttttatgaaaaattttttgttaataaaatatctgagggtattttgagtatgtggaaggaatgcctgaatagaagctgatctatcttaacatacctcaagaactccagttttaatatggtgagtgaggagttgactgggaaaaggagagatccaattcttgttctagtccttggcacatacactctctgggttttgagaaaaggatggtcctacaacgattctaagttgttttctcattggtcctacaacaattctaagttgttttctcaaaggcaaaagcatgatttcaaaatgacatcacttgtcagattttctggtgtatggaaagatttaataatcctgcctcttttgaagcctgaaacttacaatttaaagcctgaaatctaccataaggaacttggtaaattgtgtcagataccatgaaaatgcatcttttcatagttaaccacagattgtttatgtaaaggcaaattggtggtcaggttcaaggtaaaatggattattgggttgattagtagccaaaaactaaatgcatgttcaggtcaaaatgaatttgtttgttttagttggtgccattttccttttattattcagaactacagagtgtgcattttattaataggaatgaaagctcatgcttgaggatttgaatagggtggatgtatatattttataaactcaagttgcaaaatatgtaaagtcactactttttaaatagaatataaatgttaaaacagacaaatctatgttatatattttttaatacatgtatcagacttgttagttgaatgcagattactttgctttatggaatttcataacttttaataataaagcagttgttattggattttttctgtagacttgaatactaaatgggatagataccagacctctttttggtttatgacgtaaaagtatttgtacagtagtttctcttcacaaaagactgaattttaaaggattatagaaacaggaacatgtccatttccaaaatgagtgcaacagaatgaagatagtcacttaaaccatctatttaacacatcacctttatgtaatatgtagctagttttagtgttttaataagtcccaactaaagactgagtgttttcagtgaagatggaaatggagacccaggcacttgcttagagttatcgtgagtccgatgttcctgaacttcaagttgtacaattaagggcatactctaagaacttctggatgctttctggagtatacaaacagatcaactaatgacttaaatgagtgactcttgaagctgcaagaagaggaaagaaataaccacaagaaggggctatctcagcatctgttattcctgacaggaggaattaaatatgctctgctggtaattctaagcttttctgcaggggatctgcttgccccaggagcaccttagtcctcattgaggcagccattctgccataaaaacgatcatgtctcaagctgttcctgccgtcctacacaactatgttagtagatggttagataaatatatgaaccatcttttgtactttgatgatgcccttttcctttattataatccttaatttctactttccatagtaggatttgacttttctccattagtttaagctaccctggataagtgactctgtttatgtcctccctatatttcttactcattttcacactaacataacacgtaacaaaattaaacataagctaaattgaagaagcaagtgagacagctaagagttttgtgtacttggacaacaaagctcaaagccactgtggttatctgtcctgttgggagcccctttcaaccatttttttagttgcctgtaagatttatttttaatgtttgcctgcataatgcaaaatacataagtgggaatccctacgccctttacagttaagtggattatggaaataataaggaaagtttatcaactaaggtaggaaatatcttctcatgtctgtatctggccttcagggacttaatgtgggtgaatatatgtcattagacaagatcctaatatagatggctgtatcctgcagatagccaattcaacattaaaattttatgtttccatacctcaatgaaaacatatttcttttatcctgttataatttaatgacattcccatccaacttaatcaagcaatgatactcagtagtcctctccttgcatttttcaagtcctgttgagtgtaactttaaaatgtctctgagatttctaccttctctccagtctccttaccattagggcctttcactacctggccttggtgtccctaggctgctcttcagctgtccacaaaccttgtttcataagcagtagcaatgcaagcttccactgccgtctgctaatgttcttccctcctagaatgttcatgatctgcgtttctacctgaaaggtctagttcaaaggtagctgaaaggttatcatccttgtcctttcttctctccctaccagtcatctatcctgaactttttaacagtagggacagtgttgcaattgtgtttgtgtccccagcacgtagcacacagtacctagtatacagtacctgtagcacataggcatttaataagtgtgtattgaattaacttggttatgcttgtatttttatcctagctttctcaaagaaacttaggtgctagctattttgaaacatatatccagaaccaccacctgagtaaaatgtataacaggaccctgctctttctatcccagagagtttgagaaaactacttttaaataaatcattaatcattcttc

SEQ ID NO: 33641 - DNA, 4384 bp, Homo sapiens
ggagggaggacgaggacgggggcggcggctgctgcgagggggggcccgtgctctccccgtttcccttagtcgcactcaggcagccgccgccgccgccgctgccgccatgttggtttgagaggcgatgacaggaggcggccgcggcgtgtgggactgaaaagtgaaggaggaggaggagaaacaaagctctgagaggaaaccattcccgggctgaggagaaggaggacccggcctcttccggggaccagccgaagtcggcgtcgcccggagctcgcgaggccggggaggggaggggaagggaaggcggagaccggggaggcggcggcggggaaggcggaggcagaagaggagtggcgaggagccggagacgatgcgccccgaccccagctgctgtccggaggcgcccgcggcctgagcccagaggggctgtggagtgtcccggccggccccgagcacccccgcgctgtcggtcccccgctccggtctttcgctttggcttccaactagttaaatgcccttgagcgcgggtttccgcggcccggctcttcgcccccgcggcgcgagttgagccgtttccccgcgctgtccgcgcgggcgctccgacagcggctctgcagggtccgcggccagcgtccggccaccgctcggccgccactcaaggctcacgcgtcgatgtgtagctacatagttatctgtgtacatccacgctggggcatttttctcctgcttaatgaggacttgactcgggagcaagtgtgaatcattgccggggctgggaaaggaggaaggcgcatttaaccccctcccacccctctccatgtccgtgtgtcactcggctcggtccacctggcgcggccggtcctggggctgctgctgctgttgacgacgacgacgacgacgggggctgcctctgctgtcccgggagtttcctcctgctccggccacacagctcctggggattgttcctcttcgaaccagaacctcggcctgaccggcactttggctccaaaataactttatttttgggggagaaagcacatcacgaaccagtcaaaatcgtggtttatttctgtaacgtgaagacttctgctcttttttctttgtttgtttttttcgtaaacatctgggtgtatatcaaacggcaagatgtccagtaatgtcccggcggatatgataaatttgcgcctcattttggtaagcggaaaaacaaaagagttcctgttttctcctaacgattctgcttctgacattgcaaagcatgtatatgacaattggccaatggactgggaagaagagcaggtcagcagtccaaatattctacgacttatttatcaaggacgatttctacatggaaatgtcacattaggagcattaaaacttccttttggcaaaacaacagtgatgcatttggtggccagagagacattaccagagccaaactctcaaggtcagaggaatcgtgagaagactggagagagtaattgttgtgtaatcctgtaaacactgtctgcctagtgtgatgtgatatagtctttgtctttcatgctgctgggacagaaaagacccgacattgcttcagaaaccgttcagaacagtctgcctgtaaacacatggaactgaattaccacatgaacactgtcatcttttctcatgaaagtaaaaagaaccaagaacatttttcactctgattttttatttcttgtattttttgttgagctgttttaacacatattggtttttgaatgcagtcaatctccaggggaaaagttaacaagttatctttcgtagcagaaaccattttgctgccacaaaattttcatcatcagaactaataaatcaagtgttccaaatacaatttgcattaaaaagattggcattattttcctcatcagcagaatttataacagtgtgtggtatctagaaatacttatatatacaattccacactggaagacactcagcaattaatgaagttaattactgggccaacttgagaggaaaaaatggaaaagaaactaaaatgttgggtgaattctaccaaagtcagccgtggtggctgcactggcacagaatactaaactgagtgtgactattttcactgcaacaaatgaaaaaacaaaatgtgcctgtttaaagcactcagtagagggctgatgaaactaattttttttcctttaagacatgcactcttgagtcctacagtaactgagtgtttgtttagacagcacaagaaggggtgagagtgcgtctcctagccttaatgtgggagggtagtttcagtcactcatcggctttcattattgtgcagaaatattagaaaacctcattgatcaattttatgtatttgaatatcagcaaattgaaattttccataattatcattaatttgtaaccacatccagtgtcatgcttactccttagagttcagatgaattcttaaaattaaaaaaaaactccatagtactaattttgtttctttatatagtttgcgtttgatattagtgcttgcaattgtattaaagtcaaaagctgatttttatggcatacacaagaatgccactttttcttttatttcataccaataatttaaagattgatatgctaaaaacaatttgcacagcactaaagcatgagctactttcatctaaacctgtaaaaatatgaaagatttttatattttttcactgggaagaaattcttcctggatgaaattacaaatatgtgtagaatatatttaataaaagacttataaaatacctaactacaggacttaaaatatagattggcgcgtagtatacagaacaatattccatataaataagtttagcctttataaaaatgaagttgcaggctgacattacattctgtactaagtgtcaacagcccttacaaacattaaatgtaaatggtttcaaatggtcagcgttgtttaaatgtaatcatgttattttattcattgttaatgctttgatgaaaaggctttatatgcagtagatctacgaaaatattgttcatactgatcagaattaaatttgtatagagcagagttttaaaatgaatgtaaatagcactaaacgttttctttctgcaacctgtacttacagattcttcctgtaaactaaataaaaaaaaaatgatagtgcattttggtggtaattttaaaggtcttgattaggtcaataattgtttaagcaccgtctcattcatgttttctactttcatttcttaagcttttaaaattcatttaattaatattctgttgttgttttggggagtattcccaatgtatctttgatatttaacctggttaatttgtggacagtcacaacaatggatagaattatgtagtctccgttatcactaaaatgttatcttcaagagatgttaaatatttatatgctttgttgactagctgaaatgtgaattctgttagtgttgactaaagaatctggtagttgcttaattgggcaattaaacaatttatggctctattttgtaaaacaaactactggtaattatttttaatacctattttcattctgattactctttttttaagttaaagactatcagttaattaagattgagtttttatgatggttaaaaataattctctattggtttttcaatatatttttctgtgtgttctcagattatatatttccctcaatttagagtttgctaagtgaaataaactggttcactagtagagaaagaattacgtcgcttaatacctaatatcatagttgtacaatatgaaaaaaaagaataaaaagtagcagtaaaattatatactgaaaacaccaaaaatttagatgccttaatagtatatacgtgaaatactcagctgtccctttaaaaataattccttggactgcctggtggttaaaatacgattcctcatatccaaggctacttttgaagatccctctgccaaaaatatagctcacttatctaaaggtgagagctgcatagatccagtaatgtacataaagcctgaatgatgagcctatgtccctgcctaacgctggtgtctcactcatctcttttacctaaattgtcctgaactttgttaagtgttctggacaaggccaagcttttctttattaaaacctcagcatgtctccctgatctgaactatttgctttctcttcaagataagttgtattttaccatggaaaaatacagtatctaacattaccattcacgttaaatgaagtttcctcataacatttatctttagttttatgaagtcatcgtgaccaatgttacagtaatttctgttagctgattgtggtaaacaatgtttaatgtgaaaagaaattaaaactttcttcatctgttgtagaatatttctcttctttaaaatggcttctattcataa

SEQ ID NO: 33642 - DNA, 2382 bp, Homo sapiens
ggttccagcgcgcgcccggggcggcggcgcgcggcggggggtggttggggtgcgcgccggcccgagtggacgccgtcgcgaccgccatgcagctgacggtgaaggcgctgcagggccgcgagtgcagcctgcaggtgccagaggacgagctggtgtccacgctgaagcagctggtctccgagaagctgaacgtcccagtgcgccagcagcggctgctgttcaagggcaaggccctggcagatgggaaacgactctcggattatagcatcgggcccaactccaagctcaacctagtggtcaaacccctggagaaggtgctactagaagaaggcgaggcccagaggctggccgactccccacccccgcaggtctggcagctgatctccaaagtcttggcccgccacttcagtgcggcagatgccagcagggtcctggaacagctacagagggattacgagaggtccctgagtcgcctgacgctggacgacatcgaacggttggccagccgcttcctgcaccctgaagtgactgagacaatggagaagggcttctccaaatagaattctcggagcatggggaggtgcccaacgccaggctaccgctgcatgtcgcactaagtgtgttctcctgttgcagttgggctcatcatcgtcatagctggcatgtacctggctctggccaggtgctaggcactcctcacagcttgacctgggtttgcttccacaccctcagaagaggagagccggcacagcagaggcaccggcgatgaagtggcacagccccagtcggaatccagcggcttctgaaagtgccttggtgtgagaaggaggaaggggccgcttggagagctgggctctcgcatgtcatgtttagcccactgagaatataccctcaggtgactccctcccgatcctgaaagggaaagcagctgtcacctgacttctggcgggtccaacatagccctcagcttacctctgcaggaggccgagtgacagccagccctggaaccccccgacccccgcagctgctgcagccagtgtgccagtgtgcgttcgacaaatggaaaagcagattggggccagggagtcagcaaggcaccccagctctgtgatgtgactttgggcgagtctcagtgccacttggtccccagccatggactctatacagtgagggccactcaccgacctgagtcagtgtcctctgtctcacagggcccctctcccttctgttcagtaaacaaactgaagccaaaaatgaagccgtggccaagcgtgacccagagatggggtgtcctggcccttagtgacacagctcctctctggggcaccctatctgcttgtctcgtccaggaagcgttagggctgatgggtgactcagcaaggcagtgtcagagctgggactgggcgtaggcctttgtcctcatccccagcactggcctccctgtggaagatgaacatatcccagccacctgtgtacaggggctcactttgtgtgctccttgttgcctgagaagaaaccttggggtgccagggtgggggcagaagcatgggctgggttccggttcatcctcctccaccctgccgtgtgtgtgggcacaagaggacatctaaccacctgctccttggaggaggcccccaggggtggtagaggctggaaggaagccacatcaggaggacgccactccggcccttcacccttgccaagtgagctgctcacagtgtggtcagggctgcgcgtgctggaggccctcctgcctgggccttgtggggcaaatattgggtccccaggctggaaagatggacagaggcccaatgggtgaaggctttgaagagcacacagaagcccctggccccccacgagagctggagagccatgtatatggcttcaaagccacctacggcagggacacactcgtgagcatgtgtggcctgcagttcaggtgatacatttaccagtgttcttgtttgtgtggtgccaggaaattgattttggaaaaagtgaaataacattaaaggtgaatgtgaggcttctacttttatccaaaaggagctatattagctaggctgtttctgatatccaatcattggtttaacaataaaggcaatttgtttaatcagttaacggaaatttcttggcttatgaaagtgaaaagtccagtggtattggcattggcagcaggtgagcaatttcacccagtgtcttctgcctccctctgcgttggtatctgctacatcccaggccaccacctccgaggatgaaaagatggctgcctgcagcttccacggaatccctccctcactgccagagcagcatcttctctgtgtaccacctctgctgtctcagatgcccccagcaaataaacactcttctcgttggtcagaa

SEQ ID NO: 33643 - DNA, 1508 bp, Homo sapiens
tttgttgatagggagaagccaacatctcccgcaggaccccctaatcttcagggcagctcccagagcatggatccctcctgattccactcagcccgatgttcctcacagtcaagctgctcctgggccagagatgcagtctgaaggtgtcagggcaagagagtgtagccacgctgaagagactggtgtccaggcggctgaaggtgcctgaggagcagcagcacctgcttttccgtggccagctcctggaggatgacaagcacctctctgactactgcattgggcccaatgcctctatcaatgtcatcatgcagcccttggagaagatggcgctaaaggaggcccaccagccgcagacccagcccctgtggcaccagctgggactggtcctagctaaacactttgaaccacaggatgccaaggccgtgctgcagctgctaaggcaggagcacgaggagcgcctgcagaagataagcctggagcacctggagcagctggcccagtacctcctggcagaggagcctcacgtggagccagctggagagagggagcttgaggcgaaggcacggcctcagagctcctgtgacatggaggagaaggaggaggcagcagctgatcagtaaacgggccatcctacccatttgcatgctaaaattctcccggcctcatccttacgtgttccctggtgacttttcctactacttcctgctgatgtggatgcgtccacacccctttttgaaccttccaagcagctggagggtttttggatccctgtcccctcttgggcctgaggtcctccctctgaaatgcagagtgaaccaaccctcatcaccatgcttcccctagaagggttctgatcaccggagggcagccccaaaggccacagtcccctcctgtgctggcagctttgcccacacatacccagcagctccccaggctgaaagcagccctggcccagggtctccatggttctaggcagaccctctttctccttcgggacagaaagacaatgtgagttcattttcctccatcctcagaccgtgacatctcccctaggctccccagcagccaagaggagaggaatgtcaggtagctgccccttgccttctgggtgaggctgcccctgctgttctcctgcttgtgcttccagcttaagggacaggcacagcagaggtgagagtgggaggagggcacgtaccgggtgccagccctggagccctcagggagacagacacagaccaagaatagcaggaaactgagcctcaggcagaaaaaaagttcagcaaagtcatacactccctgtggccagcgtgaacagagccatgccccaccctcccagactgatcagtcagtaggtatcacagctcacattacctgcccagcgctgcccaaggctccctggaaggaaaaatggtatctgtcaatgaggatccttgccctcacagagcacgcagcctagatgcagagagctgctatacatgtgaaaagtaaagtggtgacatgaaactaga

SEQ ID NO: 33644 - DNA, 519 bp, Homo sapiens
aacttccgcttccggttcctagcgttaactgcgaccggggttcagcgctcgggtgaggagctggtggcgtcggcaggttcgaggcgattcgaggtgagggggtcaagcggagaggctcggagtcggagaaagctgtcgcgacccagccacccagggtctggggtcggtgggagctccagctaggatgatcgaggttgtttgcaacgaccgtctggggaagaaggtccgcgttaaatgcaacacggatgataccatcggggaccttaagaagctgattgcagcccaaactggtacccgttggaacaagattgtcctgaagaagtggtacacgatttttaaggaccacgtgtctctgggggactatgaaatccacgatgggatgaacctggagctttattatcaatagatgagaatcctcatcttcctgccccgctttcctctcccatcctcatcccccacactgggatagatgcttgtttgtaaaaactcaccttaataaagacttagatgttgctttgt

SEQ ID NO: 33645 - DNA, 432 bp, Homo sapiens
aacttccgcttccggttcctagcgttaactgcgaccggggttcagcgctcgggtgaggagctggtggcgtcggcaggttcgaggcgattcgagctccagctaggatgatcgaggttgtttgcaacgaccgtctggggaagaaggtccgcgttaaatgcaacacggatgataccatcggggaccttaagaagctgattgcagcccaaactggtacccgttggaacaagattgtcctgaagaagtggtacacgatttttaaggaccacgtgtctctgggggactatgaaatccacgatgggatgaacctggagctttattatcaatagatgagaatcctcatcttcctgccccgctttcctctcccatcctcatcccccacactgggatagatgcttgtttgtaaaaactcaccttaataaagacttagatgtt

SEQ ID NO: 33646 - DNA, 1360 bp, Homo sapiens
tccggtttccggcgagagggccagagtgagtgtttacaccggcggcagtgcggccgggttccttccgcgggacggggagaaagagagagcgcgaaagagagaggatgtctctctcagactggcacctggcggtgaagctggctgaccagccacttactccaaagtctattcttcggttgccagagacagaactgggagaatactcgctagggggctatagtatttcatttctgaagcagcttattgctggcaaactccaggagtctgttccagaccctgagctgattgatctgatctactgtggtcggaagctaaaagatgaccagacacttgacttctatggcattcaacctgggtccactgtccatgttctgcgaaagtcctggcctgaacctgatcagaaaccggaacctgtggacaaagtggctgccatgagagagttccgggtgttgcacactgccctgcacagcagctcctcttacagggaggcggtctttaagatgctcagcaataaggagtctctggatcagatcattgtggccaccccaggcctcagcagtgaccctattgctcttggggttctccaggacaaggacctcttctctgtcttcgctgatcccaatatgcttgatacgttggtgcctgctcacccagccctcgtcaatgccattgtcctggttctgcactccgtagcaggcagtgccccaatgcctgggactgactcctcttcccggagcatgccctccagctcataccgggatatgccaggtggcttcctgtttgaagggctctcagatgatgaggatgactttcacccaaacaccaggtccacaccctctagcagtactcccagctcccgcccagcctccctggggtacagtggagctgctgggccccggcccatcacccagagtgagctggccaccgccttggccctggccagcactccggagagcagctctcacacaccgactcctggcacccagggtcattcctcagggacctcaccaatgtcctctggtgtccagtcagggacgcccatcaccaatgatctcttcagccaagccctacagcatgcccttcaggcctctgggcagcccagccttcagagccagtggcagccccagctgcagcagctacgtgacatgggcatccaggacgatgagctgagcctgcgggccctgcaggccaccggtggggacatccaagcagccctggagctcatctttgctggaggagccccatgaactccctgcttcccctgaacccccagcaagttgcagaggctactgcccttgggaggcactcatgaaggtgcctccatctctcccttccccaatatacctgatggtcaactctc

SEQ ID NO: 33647 - DNA, 1427 bp, Homo sapiens
gtttccggcgagagggccagagtgagtgtttacaccggcggcagtgcggccgggttccttccgcgggacgggtgagggcgctggggccctgggcagcgcgggctcgatgtgtgtcagccaagtagctggtcccactggagcgggagaaagagagagcgcgaaagagagaggatgtctctctcagactggcacctggcggtgaagctggctgaccagccacttactccaaagtctattcttcggttgccagagacagaactgggagaatactcgctagggggctatagtatttcatttctgaagcagcttattgctggcaaactccaggagtctgttccagaccctgagctgattgatctgatctactgtggtcggaagctaaaagatgaccagacacttgacttctatggcattcaacctgggtccactgtccatgttctgcgaaagtcctggcctgaacctgatcagaaaccggaacctgtggacaaagtggctgccatgagagagttccgggtgttgcacactgccctgcacagcagctcctcttacagggaggcggtctttaagatgctcagcaataaggagtctctggatcagatcattgtggccaccccaggcctcagcagtgaccctattgctcttggggttctccaggacaaggacctcttctctgtcttcgctgatcccaatatgcttgatacgttggtgcctgctcacccagccctcgtcaatgccattgtcctggttctgcactccgtagcaggcagtgccccaatgcctgggactgactcctcttcccggagcatgccctccagctcataccgggatatgccaggtggcttcctgtttgaagggctctcagatgatgaggatgactttcacccaaacaccaggtccacaccctctagcagtactcccagctcccgcccagcctccctggggtacagtggagctgctgggccccggcccatcacccagagtgagctggccaccgccttggccctggccagcactccggagagcagctctcacacaccgactcctggcacccagggtcattcctcagggacctcaccaatgtcctctggtgtccagtcagggacgcccatcaccaatgatctcttcagccaagccctacagcatgcccttcaggcctctgggcagcccagccttcagagccagtggcagccccagctgcagcagctacgtgacatgggcatccaggacgatgagctgagcctgcgggccctgcaggccaccggtggggacatccaagcagccctggagctcatctttgctggaggagccccatgaactccctgcttcccctgaacccccagcaagttgcagaggctactgcccttgggaggcactcatgaaggtgcctccatctctcccttccccaatatacctgatggtcaactctc

SEQ ID NO: 33648 - DNA, 2388 bp, Homo sapiens
agagcggccacccagggatcggcgctatctgcacagcggttacagtctcggaaaggcctggcttcttcgtggctttgtggagatcccttacagcggccatttgattagcacccgaagagattcaaaggaagcagttgttccgtccccaacatatttccgtttcaaaccacccacttccggtttttcagccggttccggtcccgcccttcacttccggtcgctttcggtctctcagcggccggtttctgcgtccgctgccgcaggttccaccgcgctccaggtatttttttttctgaaggaaagctgcttcctcatatgtttcaagaatggctctccctatcattgtaaaatggggtggacaggagtattcagtgaccacactttcagaagatgatactgtgctcgatctcaaacagtttctcaagacccttacaggagttcttccagaacgccaaaagttacttggactcaaagttaaaggcaaacctgcagaaaatgatgttaagcttggagctctcaaactgaaaccaaatactaaaatcatgatgatgggaactcgtgaggagagcttggaagatgtcttaggtccaccccctgacaatgatgatgttgttaatgactttgatattgaagatgaagtagttgaagtagaaaatagggaagaaaacctactgaaaatttctcgcagagtgaaagagtacaaagtggaaattttgaatcctcccagggaagggaaaaagcttttggtgctagatgttgattatacattatttgaccacaggtcttgtgcagagactggggtagaattaatgcggccatatcttcatgaatttctaacatctgcctatgaagattatgacattgttatttggtctgcaacaaatatgaagtggattgaagctaaaatgaaagagctgggagtgagcacaaatgcaaattataagattactttcatgttggatagtgctgctatgataacagtacatactccaaggagaggattaatagacgtaaagcctcttggtgttatatggggaaagttttcggagttttacagcaagaaaaacaccattatgtttgatgacatagggagaaattttctaatgaacccacagaatggactaaagataaggccttttatgaaagcgcacctaaatcgtgataaagacaaagaacttttaaaattaactcagtacctcaaggagatagcaaaattagatgactttttggatctaaatcacaaatattgggaaagatatctctcaaagaagcaaggacagtagttacaagttatactggcagttattgaagatacttaagatccaagaacttcttgcttttatgctagaaatcattatgatagtgctggacactgaagcaaataccatactgcttatacttggtcttccagttttttgtaaatttaattttatattttttgaagatgatagcaatatgctaaaaaatgcttgtcccctatatgaatattctgttacgcttgaaaaatattttctccagcgttggttactgaccaccccaccctcccaccacacacacacacacacacacacacacacacacacacacacacacacaaagtggagaaaaatgtatactcaacaatgtcattttgtgactttggaaacaagttatgttttgtgtttttgtctcattgtgttattgtctgactaaatctaaaaccaaacccatgttgaaactagtacttttccctttaaaaacaaaccaaaaaaaaaaacaaaaaaaaactttttaattaaagaacctagtttgctatgcttaaaattaccaagaattttttatttctttgtcatagacacaatttctcttctgtatgccactagttacatttctaaattctgagcggtctcagttaggcctgtatgtgtgtacatgtccaagtaaagctggaaaatgtcagtcttgacacagctgtgtcttagtatgagaaacagaagactgaagaataaaaactaaggaacaagaatgagtctctttttggtggctaagtagaatcttcctaaaaccattgtcataaaagcagttaaaggcaataaatttttaaaagggacatatcactgattcattcctaaaaagcatgaacaaaaagtttttgttctgttccagctatatcttgtctaagtgctaacactgtttcagtgaaaatatctagccataagattaaaaaaatatattatttgcaatgcttaagcctgcagatacgtaatgtgaccactgttttgtgttgacaatattgctttatacagttcttgtatttgaaaggaattgatccttttaaagaaacatggtgtatattgttcttacaggactaatttcagtggtgtaaataataaatatcttttcttaaaa

SEQ ID NO: 33649 - DNA, 2662 bp, Homo sapiens
ccccacccgcttccggccgcggctcggttctcccgcctccgcctccgccgcggctcgtggttgtcccgccatggcactgtcgcgggggctgccccgggagctggctgaggcggtggccgggggccgggtgctggtggtgggggcgggcggcatcggctgcgagctcctcaagaatctcgtgctcaccggtttctcccacatcgacctgattgatctggatactattgatgtaagcaacctcaacagacagtttttgtttcaaaagaaacatgttggaagatcaaaggcacaggttgccaaggaaagtgtactgcagttttacccgaaagctaatatcgttgcctaccatgacagcatcatgaaccctgactataatgtggaatttttccgacagtttatactggttatgaatgctttagataacagagctgcccgaaaccatgttaatagaatgtgcctggcagctgatgttcctcttattgaaagtggaacagctgggtatcttggacaagtaactactatcaaaaagggtgtgaccgagtgttatgagtgtcatcctaagccgacccagagaacctttcctggctgtacaattcgtaacacaccttcagaacctatacattgcatcgtttgggcaaagtacttgttcaaccagttgtttggggaagaagatgctgatcaagaagtatctcctgacagagctgaccctgaagctgcctgggaaccaacggaagccgaagccagagctagagcatctaatgaagatggtgacattaaacgtatttctactaaggaatgggctaaatcaactggatatgatccagttaaactttttaccaagctttttaaagatgacatcaggtatctgttgacaatggacaaactatggcggaaaaggaaacctccagttccgttggactgggctgaagtacaaagtcaaggagaagaaacgaatgcatcagatcaacagaatgaaccccagttaggcctgaaagaccagcaggttctagatgtaaagagctatgcacgtcttttttcaaagagcatcgagactttgagagttcatttagcagaaaagggggatggagctgagctcatatgggataaggatgacccatctgcaatggattttgtcacctctgctgcaaacctcaggatgcatattttcagtatgaatatgaagagtagatttgatatcaaatcaatggcagggaacattattcctgctattgctactactaatgcagtaattgctgggttgatagtattggaaggattgaagattttatcaggaaaaatagaccagtgcagaacaatttttttgaataaacaaccaaacccaagaaagaagcttcttgtgccttgtgcactggatcctcccaaccccaattgttatgtatgtgccagcaagccagaggtgactgtgcggctgaatgtccataaagtgactgttctcaccttacaagacaagatagtgaaagaaaaatttgctatggtagcaccagatgtccaaattgaagatgggaaaggaacaatcctaatatcttccgaagagggagagacggaagctaataatcacaagaagttgtcagaatttggaattagaaatggcagccggcttcaagcagatgacttcctccaggactatactttattgatcaacatccttcatagtgaagacctaggaaaggacgttgaatttgaagttgttggtgatgccccggaaaaagtggggcccaaacaagctgaagatgctgccaaaagcataaccaatggcagtgatgatggagctcagccctccacctccacagctcaagagcaagatgacgttctcatagttgattcagatgaagaagattcttcaaataatgccgacgtcagtgaagaagagagaagccgcaagaggaaattagatgagaaagagaatctcagtgcaaagaggtcacgtatagaacagaaggaagagcttgatgatgtcatagcattagattgaacagaaatgcctctaaacagaaccctcttactatttagtttatctgggcagaaccagattgttatgtcctttgttccaaagggaaaaaattgacagcagtgacttgaaaatgattctgctccctttgaaagcattcattttgctagaactgttagacacattgcagtatgctgtattgaaagtaggaatatagttttaaaaaccctttgaacaaagtgtgtgcataaccagtcatgagataaaacaacacaatgcatgttgcctttttaatgtaaatacccgtaggtatcattaatagtttcaaaatattgtggtttagtaaagttgatacctggttataaatattatgcctttatttttggctagaagaagaattatttttagcctagatctaaccattttcatactcttaactgattgaaacagattcaaagaagtatcgagtgctatgcattgaaacttgtttttaaatgttagatggcactatgtatattaatgtaaaacaatgttaatttactcaagttttcagtttgtaccgcctggtatgtctgtgtaagaagccaatttttgtgtattgttacagtttcaggttatttatattcgatgttttgtaaaactcaaataacgactatacttatggaccaaataaatggcatctgcattcttgtt

SEQ ID NO: 33650 - DNA, 2802 bp, Homo sapiens
aaaacaaattcccggctgttaggagatgcgggagaggattgagtccctcgcggatgttgtgactttaattttgaggtccctgtcgtaactccgaagtaacgacgcggggcggaggatggcaatgatagcgaccaacgcgtcccgagcgctggtcacgagcgggtttacacacggaacgcgcaccatcttcataccacccgaggagtgcaaacgctatttccaccctgctttatttttaacagatgaggaaagggagacgcaatggggttgagtaacttaccctgggtcacggagcgagtggcagggctcccgcaggctgcgtgactgtcattgctctcacagtagacgattgatctggatactattgatgtaagcaacctcaacagacagtttttgtttcaaaagaaacatgttggaagatcaaaggcacaggttgccaaggaaagtgtactgcagttttacccgaaagctaatatcgttgcctaccatgacagcatcatgaaccctgactataatgtggaatttttccgacagtttatactggttatgaatgctttagataacagagctgcccgaaaccatgttaatagaatgtgcctggcagctgatgttcctcttattgaaagtggaacagctgggtatcttggacaagtaactactatcaaaaagggtgtgaccgagtgttatgagtgtcatcctaagccgacccagagaacctttcctggctgtacaattcgtaacacaccttcagaacctatacattgcatcgtttgggcaaagtacttgttcaaccagttgtttggggaagaagatgctgatcaagaagtatctcctgacagagctgaccctgaagctgcctgggaaccaacggaagccgaagccagagctagagcatctaatgaagatggtgacattaaacgtatttctactaaggaatgggctaaatcaactggatatgatccagttaaactttttaccaagctttttaaagatgacatcaggtatctgttgacaatggacaaactatggcggaaaaggaaacctccagttccgttggactgggctgaagtacaaagtcaaggagaagaaacgaatgcatcagatcaacagaatgaaccccagttaggcctgaaagaccagcaggttctagatgtaaagagctatgcacgtcttttttcaaagagcatcgagactttgagagttcatttagcagaaaagggggatggagctgagctcatatgggataaggatgacccatctgcaatggattttgtcacctctgctgcaaacctcaggatgcatattttcagtatgaatatgaagagtagatttgatatcaaatcaatggcagggaacattattcctgctattgctactactaatgcagtaattgctgggttgatagtattggaaggattgaagattttatcaggaaaaatagaccagtgcagaacaatttttttgaataaacaaccaaacccaagaaagaagcttcttgtgccttgtgcactggatcctcccaaccccaattgttatgtatgtgccagcaagccagaggtgactgtgcggctgaatgtccataaagtgactgttctcaccttacaagacaagatagtgaaagaaaaatttgctatggtagcaccagatgtccaaattgaagatgggaaaggaacaatcctaatatcttccgaagagggagagacggaagctaataatcacaagaagttgtcagaatttggaattagaaatggcagccggcttcaagcagatgacttcctccaggactatactttattgatcaacatccttcatagtgaagacctaggaaaggacgttgaatttgaagttgttggtgatgccccggaaaaagtggggcccaaacaagctgaagatgctgccaaaagcataaccaatggcagtgatgatggagctcagccctccacctccacagctcaagagcaagatgacgttctcatagttgattcagatgaagaagattcttcaaataatgccgacgtcagtgaagaagagagaagccgcaagaggaaattagatgagaaagagaatctcagtgcaaagaggtcacgtatagaacagaaggaagagcttgatgatgtcatagcattagattgaacagaaatgcctctaaacagaaccctcttactatttagtttatctgggcagaaccagattgttatgtcctttgttccaaagggaaaaaattgacagcagtgacttgaaaatgattctgctccctttgaaagcattcattttgctagaactgttagacacattgcagtatgctgtattgaaagtaggaatatagttttaaaaaccctttgaacaaagtgtgtgcataaccagtcatgagataaaacaacacaatgcatgttgcctttttaatgtaaatacccgtaggtatcattaatagtttcaaaatattgtggtttagtaaagttgatacctggttataaatattatgcctttatttttggctagaagaagaattatttttagcctagatctaaccattttcatactcttaactgattgaaacagattcaaagaagtatcgagtgctatgcattgaaacttgtttttaaatgttagatggcactatgtatattaatgtaaaacaatgttaatttactcaagttttcagtttgtaccgcctggtatgtctgtgtaagaagccaatttttgtgtattgttacagtttcaggttatttatattcgatgttttgtaaaactcaaataacgactatacttatggaccaaataaatggcatctgcattcttgtt

SEQ ID NO: 33651 - DNA, 1459 bp, Homo sapiens
cttcccccacccgcttccggccgcggctcggttctcccgcctccgcctccgccgcggctcgtggttgtcccgccatggcactgtcgcgggggctgccccgggagctggctgaggcggtggccgggggccgggtgctggtggtgggggcgggcggcatcggctgcgagctcctcaagaatctcgtgctcaccggtttctcccacatcgacctgctgcccgaaaccatgttaatagaatgtgcctggcagctgatgttcctcttattgaaagtggaacagctgggtatcttggacaagtaactactatcaaaaagggtgtgaccgagtgttatgagtgtcatcctaagccgacccagagaacctttcctggctgtacaattcgtaacacaccttcagaacctatacattgcatcgtttgggcaaagtacttgttcaaccagttgtttggggaagaagatgctgatcaagaagtatctcctgacagagctgaccctgaagctgcctgggaaccaacggaagccgaagccagagctagagcatctaatgaagatggtgacattaaacgtatttctactaaggaatgggctaaatcaactggatatgatccagttaaactttttaccaagctttttaaagatgacatcaggtatctgttgacaatggacaaactatggcggaaaaggaaacctccagttccgttggactgggctgaagtacaaagtcaaggagaagaaacgaatgcatcagatcaacagaatgaaccccagttaggcctgaaagaccagcaggttctagatgtaaagagctatgcacgtcttttttcaaagagcatcgagactttgagagttcatttagcagaaaagggggatggagctgagctcatatgggataaggatgacccatctgcaatggattttgtcacctctgctgcaaacctcaggatgcatattttcagtatgaatatgaagagtagatttgatatcaaatcaatggcagggaacattattcctgctattgctactactaatgcagtaattgctgggttgatagtattggaaggattgaagattttatcaggaaaaatagaccagtgcagaacagatttttttgaataaacaaccaaacccaagaaagaagcttcttgtgccttgtgcactggatcctcccaaccccaattgttatgtatgtgccagcaagccagaggtgactgtgcggctgaatgtccataaagtgactgttctcaccttacaagacaagatagtgaaagaaaaatttgctatggtagcaccagatgtccaaattgaagatgggaaaggaacaatcctaatatcttccgaagagggagagacggaagctaataatcacaagaagttgtcagaatttggaattagaaatggcagccggcttcaagcagatgacttcctccaggactatactttattgatcaacatccttcatag

SEQ ID NO: 33652 - DNA, 2850 bp, Homo sapiens
gaggtgataagatagcatctgctgtggccaggcatccctgacacctgacaagaaagtaaagccaaaagtcagctgaagataatggccatggagatgtctgtggagagccgtaaaagccaatcatggctgagatgcctgcagaatctctgcccatgagaactctgaggcctcctttcctttggctgtggtaagccctctgggaaaagagcagctacccaccaccagccgcttgatggcattgaaacgaatgggaattgtaagcgactatgagaaaatccgtacctttgccgtagcaatagtaggtgttggtggagtaggtagtgtgactgctgaaatgctgacaagatgtggcattggtaagttgctactctttgattatgacaaggtggaactagccaatatgaatagacttttcttccaacctcatcaagcaggattaagtaaagttcaagcagcagaacatactctgaggaacattaatcctgatgttctttttgaagtacacaactataatataaccacagtggaaaactttcaacatttcatggatagaataagtaatggtgggttagaagaaggaaaacctgttgatctagttcttagctgtgtggacaattttgaagctcgaatgacaataaatacagcttgtaatgaacttggacaaacatggatggaatctggggtcagtgaaaatgcagtttcagggcatatacagcttataattcctggagaatctgcttgttttgcgtgtgctccaccacttgtagttgctgcaaatattgatgaaaagactctgaaacgagaaggtgtttgtgcagccagtcttcctaccactatgggtgtggttgctgggatcttagtacaaaacgtgttaaagtttctgttaaattttggtactgttagtttttaccttggatacaatgcaatgcaggatttttttcctactatgtccatgaagccaaatcctcagtgtgatgacagaaattgcaggaagcagcaggaggaatataagaaaaaggtagcagcactgcctaaacaagaggttatacaagaagaggaagagataatccatgaagataatgaatggggtattgagctggtatctgaggtttcagaagaggaactgaaaaatttttcaggtccagttccagacttacctgaaggaattacagtggcatacacaattccaaaaaagcaagaagattctgtcactgagttaacagtggaagattctggtgaaagcttggaagacctcatggccaaaatgaagaatatgtagataatggactgggatatattgtatttctcatgttaaagcctcttcccttgaaattaaaaaaaaattttaactgataaaacttagggcaacattaattaatgtatattcttacctgaattgttatactttttgaaaatcctgtgacttgcctgtttctccccgctccaacgaaatcattaactctcctaaaatgtgtttcattctagtaagaaaacctcaaaggatattgtaggatataaatcttacttgaaaacatagctgttgaaatgttttggccttttggagtgggggaaggacaaatctgatcctgtaatctttttctttccagtaatcccttgtgtctgttgcatgaggacatggacaataaagtagtatatgatcctcagatacagggagaaggacaaggcatacagcttattgattagagctggcaagcatctgctcattatgtttggaattgctttctataagaaaattgcccactactactaacttgatcaacaatgaattcaaaatagttaacctatgaaataacatcctctcaaatgtttgctgatgaagtacaagttgaaatgtagttattggaaaagtctgtaacctgtggatcatatatattcaaagtgagacaaaggcaaataaaaagcagctattttcatgaatagacaaagttgatttcaggaagtataaattatattctgcaccgaacaaggaacagaaattattgcatctgtggaacatatatctggagttactatactttactgaagagcaaggcataaatttagactaaaatccatccagattacactcattctttaggctactcctggatacttcatttaaatttgattttcgaggtagtgagatgtcggcaaggtttgtcctgtatattaggaataaaggaaaagttctaaactgcctctgcaatgacttgtagtcagtggaagagtatcactttcccctgatcatgaccactaaactgtaaattgatataaattagttttctctcgagttacacccaagtaatgaagacttaagagaaccttggttgaaataaatttccaatagtttggagactcataaataccatgcaggtgtaaccactgccaataggctgtttctatgcttatttcctattttgatttttactttgaagataggaatatctaaattatatctctagggagaaaatgttgtaaaaaattaaaagtacatccctgattgtaaaataaagttcaaaaaactgatttcagaaagtctcaactaccaaatgttttcaatatattagttttgagatgctaggattatactgtgattcttatgtttatagtaaagtctggaaagcagaaggatagtttttttagcctggaaacttatttatgttgccttggtgagtcttctatcattttttaaaaatttagcttattgaactgtaaaatagcttttctagtatgagagatgttttgaatttaaaaaatgaaatgcagtttttcaaaaataaatttcctttggaaattcttgcatatcaatttagtaaggttttataaaattttacaatttgataaagtatc

SEQ ID NO: 33653 - DNA, 3705 bp, Homo sapiens
atgcctgtagggtgcgtccactgactgcaggaaaagcaatcagggtgggagaaacttaggaaaccacccagggccaaaggaaggaaaactcaatgtacaaatttttttccgctggaggcaaaggctgacatccatacctgtactgggcaatggtcagcgtagcctcacgttcggccccaaagccagacaagtgctggtttaggtaggcctccagggacttgctgtcgaacttgtgctggggcagcacttcggccaaatcggactcgccagtagcacctggcttcatgatcacccccgcaggccacagcaacgcggcatccacaggtctcgagtgccgaagtccttcaggattggggcaacgtcccctctagagcatgggccgaggccggggtggggtctggctccagccaaccgcacacagcctacgcgccgttgctgagcaacgcttgcccgctgaatcccgaggttttagctctagtcaagtgccaaaagagcccaatgtgtgttcgggtttcaattctccagtcagcgtcagagttggaggcctcaattttaaagaaggcaaagccatggtcatcgttgcgggtaaggaacaacgcagaagcctcttccacccccaaatttaatgcaacagcaggcggaagacctgcagggtcccgttcagaaaaagggccgtcagactgtcgagcctaagaataaaaagaccctgtttctcttagatacccggttagcaaggcaacatcgctggcctcctgccctggacacttatcaccccggtgctgctgcggccgggtttagccggcccagcgaggaaggaagccgaaagagccaggtttttgatgagggggagcgatgtctgcgacgcaccggaagcggctccgaggaaggcctgtgggagtctcggagacgtgtctgtctgtgaggcgctgggtgcacgtccccagggctctgggctaggaaggcagcggcgaggtgcctccccacgtacccctcgcgggcccagccgagcaacgtggggcgaaggcggcggcgaaggcccgggctgggagcgttggcggccggagtcccagccatggcggagtctgtggagcgcctgcagcagcgggtccaggagctggagcgggaacttgcccaggagaggagtctgcaggtcccgaggagcggcgacggagggggcggccgggtccgcatcgagaagatgagctcagaggtggtggattcgaatccctacagccgcttgatggcattgaaacgaatgggaattgtaagcgactatgagaaaatccgtacctttgccgtagcaatagtaggtgttggtggagtaggtagtgtgactgctgaaatgctgacaagatgtggcattggtaagttgctactctttgattatgacaaggtggaactagccaatatgaatagacttttcttccaacctcatcaagcaggattaagtaaagttcaagcagcagaacatactctgaggaacattaatcctgatgttctttttgaagtacacaactataatataaccacagtggaaaactttcaacatttcatggatagaataagtaatggtgggttagaagaaggaaaacctgttgatctagttcttagctgtgtggacaattttgaagctcgaatgacaataaatacagcttgtaatgaacttggacaaacatggatggaatctggggtcagtgaaaatgcagtttcagggcatatacagcttataattcctggagaatctgcttgttttgcgtgtgctccaccacttgtagttgctgcaaatattgatgaaaagactctgaaacgagaaggtgtttgtgcagccagtcttcctaccactatgggtgtggttgctgggatcttagtacaaaacgtgttaaagtttctgttaaattttggtactgttagtttttaccttggatacaatgcaatgcaggatttttttcctactatgtccatgaagccaaatcctcagtgtgatgacagaaattgcaggaagcagcaggaggaatataagaaaaaggtagcagcactgcctaaacaagaggttatacaagaagaggaagagataatccatgaagataatgaatggggtattgagctggtatctgaggtttcagaagaggaactgaaaaatttttcaggtccagttccagacttacctgaaggaattacagtggcatacacaattccaaaaaagcaagaagattctgtcactgagttaacagtggaagattctggtgaaagcttggaagacctcatggccaaaatgaagaatatgtagataatggactgggatatattgtatttctcatgttaaagcctcttcccttgaaattaaaaaaaaattttaactgataaaacttagggcaacattaattaatgtatattcttacctgaattgttatactttttgaaaatcctgtgacttgcctgtttctccccgctccaacgaaatcattaactctcctaaaatgtgtttcattctagtaagaaaacctcaaaggatattgtaggatataaatcttacttgaaaacatagctgttgaaatgttttggccttttggagtgggggaaggacaaatctgatcctgtaatctttttctttccagtaatcccttgtgtctgttgcatgaggacatggacaataaagtagtatatgatcctcagatacagggagaaggacaaggcatacagcttattgattagagctggcaagcatctgctcattatgtttggaattgctttctataagaaaattgcccactactactaacttgatcaacaatgaattcaaaatagttaacctatgaaataacatcctctcaaatgtttgctgatgaagtacaagttgaaatgtagttattggaaaagtctgtaacctgtggatcatatatattcaaagtgagacaaaggcaaataaaaagcagctattttcatgaatagacaaagttgatttcaggaagtataaattatattctgcaccgaacaaggaacagaaattattgcatctgtggaacatatatctggagttactatactttactgaagagcaaggcataaatttagactaaaatccatccagattacactcattctttaggctactcctggatacttcatttaaatttgattttcgaggtagtgagatgtcggcaaggtttgtcctgtatattaggaataaaggaaaagttctaaactgcctctgcaatgacttgtagtcagtggaagagtatcactttcccctgatcatgaccactaaactgtaaattgatataaattagttttctctcgagttacacccaagtaatgaagacttaagagaaccttggttgaaataaatttccaatagtttggagactcataaataccatgcaggtgtaaccactgccaataggctgtttctatgcttatttcctattttgatttttactttgaagataggaatatctaaattatatctctagggagaaaatgttgtaaaaaattaaaagtacatccctgattgtaaaataaagttcaaaaaactgatttcagaaagtctcaactaccaaatgttttcaatatattagttttgagatgctaggattatactgtgattcttatgtttatagtaaagtctggaaagcagaaggatagtttttttagcctggaaacttatttatgttgccttggtgagtcttctatcattttttaaaaatt

SEQ ID NO: 33654 - DNA, 3895 bp, Homo sapiens
atcagagcagctggcagcgcggcgggcagcgtttgccgagcgggcgctccgggtcgcacgcaagtccgcgcggggtccgggccacgcacgcggtttcatcgccatccccagccgggccacgcgcgcaggcagacaagctgttcgcggcgaccggagagcgccgacaccatgtggatccaggttcggaccatggacgggaggcagacccacacggtggactcgctgtccaggctgaccaaggtggaggagctgaggcggaagatccaggagctgttccacgtggagccaggcctgcagaggctgttctacaggggcaaacagatggaggacggccataccctcttcgactacgaggtccgcctgaatgacaccatccagctcctggtccgccagagcctcgtgctcccccacagcaccaaggagcgggactccgagctctccgacaccgactccggctgctgcctgggccagagtgagtcagacaagtcctccacccacggtgaggcggccgccgagactgacagcaggccagccgatgaggacatgtgggatgagacggaattggggctgtacaaggtcaatgagtacgtcgatgctcgggacacgaacatgggggcgtggtttgaggcgcaggtggtcagggtgacgcggaaggccccctcccgggacgagccctgcagctccacgtccaggccggcgctggaggaggacgtcatttaccacgtgaaatacgacgactacccggagaacggcgtggtccagatgaactccagggacgtccgagcgcgcgcccgcaccatcatcaagtggcaggacctggaggtgggccaggtggtcatgctcaactacaaccccgacaaccccaaggagcggggcttctggtacgacgcggagatctccaggaagcgcgagaccaggacggcgcgggaactctacgccaacgtggtgctgggggatgattctctgaacgactgtcggatcatcttcgtggacgaagtcttcaagattgagcggccgggtgaagggagccccatggttgacaaccccatgagacggaagagcgggccgtcctgcaagcactgcaaggacgacgtgaacagactctgccgggtctgcgcctgccacctgtgcgggggccggcaggaccccgacaagcagctcatgtgcgatgagtgcgacatggccttccacatctactgcctggacccgcccctcagcagtgttcccagcgaggacgagtggtactgccctgagtgccggaatgatgccagcgaggtggtactggcgggagagcggctgagagagagcaagaagaaggcgaagatggcctcggccacatcgtcctcacagcgggactggggcaagggcatggcctgtgtgggccgcaccaaggaatgtaccatcgtcccgtccaaccactacggacccatcccggggatccccgtgggcaccatgtggcggttccgagtccaggtcagcgagtcgggtgtccatcggccccacgtggctggcatacacggccggagcaacgacggagcgtactccctagtcctggcggggggctatgaggatgatgtggaccatgggaattttttcacatacacgggtagtggtggtcgagatctttccggcaacaagaggaccgcggaacagtcttgtgatcagaaactcaccaacaccaacagggcgctggctctcaactgctttgctcccatcaatgaccaagaaggggccgaggccaaggactggcggtcggggaagccggtcagggtggtgcgcaatgtcaagggtggcaagaatagcaagtacgcccccgctgagggcaaccgctacgatggcatctacaaggttgtgaaatactggcccgagaaggggaagtccgggtttctcgtgtggcgctaccttctgcggagggacgatgatgagcctggcccttggacgaaggaggggaaggaccggatcaagaagctggggctgaccatgcagtatccagaaggctacctggaagccctggccaaccgagagcgagagaaggagaacagcaagagggaggaggaggagcagcaggaggggggcttcgcgtcccccaggacgggcaagggcaagtggaagcggaagtcggcaggaggtggcccgagcagggcgggtccccgccggacatccaagaaaaccaaggtggagccctacagtctcacggcccagcagagcagcctcatcagagaggacaagagcaacgccaagctgtggaatgaggtcctggcgtcactcaaggaccggccggcgagcggcagcccgttccagttgttcctgagtaaagtggaggagacgttccagtgtatctgctgtcaggagctggtgttccggcccatcacgaccgtgtgccagcacaacgtgtgcaaggactgcctggacagatcctttcgggcacaggtgttcagctgccctgcctgccgctacgacctgggccgcagctatgccatgcaggtgaaccagcctctgcagaccgtcctcaaccagctcttccccggctacggcaatggccggtgatctccaagcacttctcgacaggcgttttgctgaaaacgtgtcggagggctcgttcatcggcactgattttgttcttagtgggcttaacttaaacaggtagtgtttcctccgttccctaaaaaggtttgtcttcctttttttttttatttttatttttcaaatctatacattttcaggaatttatgtattctggctaaaagttggacttctcagtattgtgtttagttctttgaaaacataaaagcctgcaatttctcgacaaaacaacacaagattttttaaagatggaatcagaaactacgtggtgtggaggctgttgatgtttctggtgtcaagttctcagaagttgctgccaccaactctttaagaaggcgacaggatcagtccttctctcgggttctggcccccaaggtcagagcaagcatcttcctgacagcattttgtcatctaaagtccagtgacatggttccccgtggtggcccgtggcagcccgtggcatggcgtggctcagctgtctgttgaagttgttgcaaggaaaagaggaaacatctcgggcctagttcaaacctttgcctcaaagccatcccccaccagactgcttagcgtctgagatccgcgtgaaaagtcctctgcccacgagagcagggagttggggccacgcagaaatggcctcaaggggactctgctccacgtggggccaggcgtgtgactgacgctgtccgacgaaggcggccacggacggacgccagcacacgaagtcacgtgcaagtgcctttgattcgttccttctttctaaagacgacagtctttgttgttagcactgaattattgaaaatgtcaaccagattctagaaactgcggtcatccagttcttcctgacaccggatgggtgcttgggaaccgtttgagccttatagatcatttacattcaatttttttaactcagcaagtgagaacttacaagagggtttttttaaaatttttttttctcttaatgaacacattttctaaatgaattttttttgtagttactgtatatgtaccaagaaagatataacgttagggtttggttgtttttgtttttgtattttttttcttttgaaagggtttgttaatttttctaattttaccaaagtttgcagcctatacctcaataaaacagggatattttaaatcacatacctgcagacaaactggagcaatgttatttttaaagggtttttttcacctccttattcttagattattaatgtattagggaagaatgagacaattttgtgtaggctttttctaaagtccagtactttgtccagattttagattctcagaataaatgtttttcacagat

SEQ ID NO: 33655 - DNA, 1856 bp, Homo sapiens
atcagagcagctggcagcgcggcgggcagcgtttgccgagcgggcgctccgggtcgcacgcaagtccgcgcggggtccgggccacgcacgcggtttcatcgccatccccagccgggccacgcgcgcaggcagacaagctgttcgcggcgaccggagagcagtgttcccagcgaggacgagtggtactgccctgagtgccggaatgatgccagcgaggtggtactggcgggagagcggctgagagagagcaagaagaaggcgaagatggcctcggccacatcgtcctcacagcgggactggggcaagggcatggcctgtgtgggccgcaccaaggaatgtaccatcgtcccgtccaaccactacggacccatcccggggatccccgtgggcaccatgtggcggttccgagtccaggtcagcgagtcgggtgtccatcggccccacgtggctggcatacacggccggagcaacgacggagcgtactccctagtcctggcggggggctatgaggatgatgtggaccatgggaattttttcacatacacgggtagtggtggtcgagatctttccggcaacaagaggaccgcggaacagtcttgtgatcagaaactcaccaacaccaacagggcgctggctctcaactgctttgctcccatcaatgaccaagaaggggccgaggccaaggactggcggtcggggaagccggtcagggtggtgcgcaatgtcaagggtggcaagaatagcaagtacgcccccgctgagggcaaccgctacgatggcatctacaaggttgtgaaatactggcccgagaaggggaagtccgggtttctcgtgtggcgctaccttctgcggagggacgatgatgagcctggcccttggacgaaggaggggaaggaccggatcaagaagctggggctgaccatgcagtatccagaaggctacctggaagccctggccaaccgagagcgagagaaggagaacagcaagagggaggaggaggagcagcaggaggggggcttcgcgtcccccaggacgggcaagggcaagtggaagcggaagtcggcaggaggtggcccgagcagggcgggtccccgccggacatccaagaaaaccaaggtggagccctacagtctcacggcccagcagagcagcctcatcagagaggacaagagcaacgccaagctgtggaatgaggtcctggcgtcactcaaggaccggccggcgagcggcagcccgttccagttgttcctgagtaaagtggaggagacgttccagtgtatctgctgtcaggagctggtgttccggcccatcacgaccgtgtgccagcacaacgtgtgcaaggactgcctggacagatcctttcgggcacaggtgttcagctgccctgcctgccgctacgacctgggccgcagctatgccatgcaggtgaaccagcctctgcagaccgtcctcaaccagctcttccccggctacggcaatggccggtgatctccaagcacttctcgacaggcgttttgctgaaaacgtgtcggagggctcgttcatcggcactgattttgttcttagtgggcttaacttaaacaggtagtgtttcctccgttccctaaaaaggtttgtcttcctttttttttttatttttatttttcaaatctatacattttcaggaatttatgtattctggctaaaagttggacttctcagtattgtgtttagttctttgaaaacataaaagcctgcaatttctcgacaaaacaacacaagattttttaaagatggaatcagaaactacgtggtgtggaggctgttgatgtttctggtgtcaagttctcagaagttgctgccaccaactctttaag

SEQ ID NO: 33656 - DNA, 4059 bp, Homo sapiens
ggccacttggcccgggcctcctttctcctctggtcgtggggaaggagggatgggttggaccttctgcttttctttcaattccctcttttcattctccttcctcctcaatcttcaacacttggctagtcgttaatgccttaagtgcttaatttgttgtgtctggtcctggccagggtctggctgtacaggaggactggaagggcatcctgggagtttcctggtgtccacaggccggacaaaagcaaccccgactccttagagcatggcatggctcagaggtgctggtaaaactgatgggggtttttgctgtccctcccctcagcgccgacaccatgtggatccaggttcggaccatggacgggaggcagacccacacggtggactcgctgtccaggctgaccaaggtggaggagctgaggcggaagatccaggagctgttccacgtggagccaggcctgcagaggctgttctacaggggcaaacagatggaggacggccataccctcttcgactacgaggtccgcctgaatgacaccatccagctcctggtccgccagagcctcgtgctcccccacagcaccaaggagcgggactccgagctctccgacaccgactccggctgctgcctgggccagagtgagtcagacaagtcctccacccacggtgaggcggccgccgagactgacagcaggccagccgatgaggacatgtgggatgagacggaattggggctgtacaaggtcaatgagtacgtcgatgctcgggacacgaacatgggggcgtggtttgaggcgcaggtggtcagggtgacgcggaaggccccctcccgggacgagccctgcagctccacgtccaggccggcgctggaggaggacgtcatttaccacgtgaaatacgacgactacccggagaacggcgtggtccagatgaactccagggacgtccgagcgcgcgcccgcaccatcatcaagtggcaggacctggaggtgggccaggtggtcatgctcaactacaaccccgacaaccccaaggagcggggcttctggtacgacgcggagatctccaggaagcgcgagaccaggacggcgcgggaactctacgccaacgtggtgctgggggatgattctctgaacgactgtcggatcatcttcgtggacgaagtcttcaagattgagcggccgggtgaagggagccccatggttgacaaccccatgagacggaagagcgggccgtcctgcaagcactgcaaggacgacgtgaacagactctgccgggtctgcgcctgccacctgtgcgggggccggcaggaccccgacaagcagctcatgtgcgatgagtgcgacatggccttccacatctactgcctggacccgcccctcagcagtgttcccagcgaggacgagtggtactgccctgagtgccggaatgatgccagcgaggtggtactggcgggagagcggctgagagagagcaagaagaaggcgaagatggcctcggccacatcgtcctcacagcgggactggggcaagggcatggcctgtgtgggccgcaccaaggaatgtaccatcgtcccgtccaaccactacggacccatcccggggatccccgtgggcaccatgtggcggttccgagtccaggtcagcgagtcgggtgtccatcggccccacgtggctggcatacacggccggagcaacgacggagcgtactccctagtcctggcggggggctatgaggatgatgtggaccatgggaattttttcacatacacgggtagtggtggtcgagatctttccggcaacaagaggaccgcggaacagtcttgtgatcagaaactcaccaacaccaacagggcgctggctctcaactgctttgctcccatcaatgaccaagaaggggccgaggccaaggactggcggtcggggaagccggtcagggtggtgcgcaatgtcaagggtggcaagaatagcaagtacgcccccgctgagggcaaccgctacgatggcatctacaaggttgtgaaatactggcccgagaaggggaagtccgggtttctcgtgtggcgctaccttctgcggagggacgatgatgagcctggcccttggacgaaggaggggaaggaccggatcaagaagctggggctgaccatgcagtatccagaaggctacctggaagccctggccaaccgagagcgagagaaggagaacagcaagagggaggaggaggagcagcaggaggggggcttcgcgtcccccaggacgggcaagggcaagtggaagcggaagtcggcaggaggtggcccgagcagggcgggtccccgccggacatccaagaaaaccaaggtggagccctacagtctcacggcccagcagagcagcctcatcagagaggacaagagcaacgccaagctgtggaatgaggtcctggcgtcactcaaggaccggccggcgagcggcagcccgttccagttgttcctgagtaaagtggaggagacgttccagtgtatctgctgtcaggagctggtgttccggcccatcacgaccgtgtgccagcacaacgtgtgcaaggactgcctggacagatcctttcgggcacaggtgttcagctgccctgcctgccgctacgacctgggccgcagctatgccatgcaggtgaaccagcctctgcagaccgtcctcaaccagctcttccccggctacggcaatggccggtgatctccaagcacttctcgacaggcgttttgctgaaaacgtgtcggagggctcgttcatcggcactgattttgttcttagtgggcttaacttaaacaggtagtgtttcctccgttccctaaaaaggtttgtcttcctttttttttttatttttatttttcaaatctatacattttcaggaatttatgtattctggctaaaagttggacttctcagtattgtgtttagttctttgaaaacataaaagcctgcaatttctcgacaaaacaacacaagattttttaaagatggaatcagaaactacgtggtgtggaggctgttgatgtttctggtgtcaagttctcagaagttgctgccaccaactctttaagaaggcgacaggatcagtccttctctcgggttctggcccccaaggtcagagcaagcatcttcctgacagcattttgtcatctaaagtccagtgacatggttccccgtggtggcccgtggcagcccgtggcatggcgtggctcagctgtctgttgaagttgttgcaaggaaaagaggaaacatctcgggcctagttcaaacctttgcctcaaagccatcccccaccagactgcttagcgtctgagatccgcgtgaaaagtcctctgcccacgagagcagggagttggggccacgcagaaatggcctcaaggggactctgctccacgtggggccaggcgtgtgactgacgctgtccgacgaaggcggccacggacggacgccagcacacgaagtcacgtgcaagtgcctttgattcgttccttctttctaaagacgacagtctttgttgttagcactgaattattgaaaatgtcaaccagattctagaaactgcggtcatccagttcttcctgacaccggatgggtgcttgggaaccgtttgagccttatagatcatttacattcaatttttttaactcagcaagtgagaacttacaagagggtttttttaaaatttttttttctcttaatgaacacattttctaaatgaattttttttgtagttactgtatatgtaccaagaaagatataacgttagggtttggttgtttttgtttttgtattttttttcttttgaaagggtttgttaatttttctaattttaccaaagtttgcagcctatacctcaataaaacagggatattttaaatcacatacctgcagacaaactggagcaatgttatttttaaagggtttttttcacctccttattcttagattattaatgtattagggaagaatgagacaattttgtgtaggctttttctaaagtccagtactttgtccagattttagattctcagaataaatgtttttcacagat

SEQ ID NO: 33657 - DNA, 2614 bp, Homo sapiens
agtgcgggagggacgccgagggtccagggtttggaggggcgcgagctgccgggggttggaggtcgagcgccgacaccatgtggatccaggttcggaccatggacgggaggcagacccacacggtggactcgctgtccaggctgaccaaggtggaggagctgaggcggaagatccaggagctgttccacgtggagccaggcctgcagaggctgttctacaggggcaaacagatggaggacggccataccctcttcgactacgaggtccgcctgaatgacaccatccagctcctggtccgccagagcctcgtgctcccccacagcaccaaggagcgggactccgagctctccgacaccgactccggctgctgcctgggccagagtgagtcagacaagtcctccacccacggtgaggcggccgccgagactgacagcaggccagccgatgaggacatgtgggatgagacggaattggggctgtacaaggtcaatgagtacgtcgatgctcgggacacgaacatgggggcgtggtttgaggcgcaggtggtcagggtgacgcggaaggccccctcccgggacgagccctgcagctccacgtccaggccggcgctggaggaggacgtcatttaccacgtgaaatacgacgactacccggagaacggcgtggtccagatgaactccagggacgtccgagcgcgcgcccgcaccatcatcaagtggcaggacctggaggtgggccaggtggtcatgctcaactacaaccccgacaaccccaaggagcggggcttctggtacgacgcggagatctccaggaagcgcgagaccaggacggcgcgggaactctacgccaacgtggtgctgggggatgattctctgaacgactgtcggatcatcttcgtggacgaagtcttcaagattgagcggccgggtgaagggagccccatggttgacaaccccatgagacggaagagcgggccgtcctgcaagcactgcaaggacgacgtgaacagactctgccgggtctgcgcctgccacctgtgcgggggccggcaggaccccgacaagcagctcatgtgcgatgagtgcgacatggccttccacatctactgcctggacccgcccctcagcagtgttcccagcgaggacgagtggtactgccctgagtgccggaatgatgccagcgaggtggtactggcgggagagcggctgagagagagcaagaagaaggcgaagatggcctcggccacatcgtcctcacagcgggactggggcaagggcatggcctgtgtgggccgcaccaaggaatgtaccatcgtcccgtccaaccactacggacccatcccggggatccccgtgggcaccatgtggcggttccgagtccaggtcagcgagtcgggtgtccatcggccccacgtggctggcatacacggccggagcaacgacggagcgtactccctagtcctggcggggggctatgaggatgatgtggaccatgggaattttttcacatacacgggtagtggtggtcgagatctttccggcaacaagaggaccgcggaacagtcttgtgatcagaaactcaccaacaccaacagggcgctggctctcaactgctttgctcccatcaatgaccaagaaggggccgaggccaaggactggcggtcggggaagccggtcagggtggtgcgcaatgtcaagggtggcaagaatagcaagtacgcccccgctgagggcaaccgctacgatggcatctacaaggttgtgaaatactggcccgagaaggggaagtccgggtttctcgtgtggcgctaccttctgcggagggacgatgatgagcctggcccttggacgaaggaggggaaggaccggatcaagaagctggggctgaccatgcagtatccagaaggctacctggaagccctggccaaccgagagcgagagaaggagaacagcaagagggaggaggaggagcagcaggaggggggcttcgcgtcccccaggacgggcaagggcaagtggaagcggaagtcggcaggaggtggcccgagcagggcgggtccccgccggacatccaagaaaaccaaggtggagccctacagtctcacggcccagcagagcagcctcatcagagaggacaagagcaacgccaagctgtggaatgaggtcctggcgtcactcaaggaccggccggcgagcggcagcccgttccagttgttcctgagtaaagtggaggagacgttccagtgtatctgctgtcaggagctggtgttccggcccatcacgaccgtgtgccagcacaacgtgtgcaaggactgcctggacagatcctttcgggcacaggtgttcagctgccctgcctgccgctacgacctgggccgcagctatgccatgcaggtgaaccagcctctgcagaccgtcctcaaccagctcttccccggctacggcaatggccggtgatctccaagcacttctcgacaggcgttttgctgaaaacgtgtcggagggctcgttcatcggcactgattttgttcttagtgggcttaacttaaacaggtagtgtttcctccgttccctaaaaaggtttgtcttcctttttttttttatttttatttttc

SEQ ID NO: 33658 - DNA, 2660 bp, Homo sapiens
gaggggtcccggggtccgcggatctcgggtggggtttttccctctcagtggcacttggttgagttcccccgggacttctgaagttccggcccgcgctggacttctgggattccctcttcccgccgacaccatgtggatccaggttcggaccatggacgggaggcagacccacacggtggactcgctgtccaggctgaccaaggtggaggagctgaggcggaagatccaggagctgttccacgtggagccaggcctgcagaggctgttctacaggggcaaacagatggaggacggccataccctcttcgactacgaggtccgcctgaatgacaccatccagctcctggtccgccagagcctcgtgctcccccacagcaccaaggagcgggactccgagctctccgacaccgactccggctgctgcctgggccagagtgagtcagacaagtcctccacccacggtgaggcggccgccgagactgacagcaggccagccgatgaggacatgtgggatgagacggaattggggctgtacaaggtcaatgagtacgtcgatgctcgggacacgaacatgggggcgtggtttgaggcgcaggtggtcagggtgacgcggaaggccccctcccgggacgagccctgcagctccacgtccaggccggcgctggaggaggacgtcatttaccacgtgaaatacgacgactacccggagaacggcgtggtccagatgaactccagggacgtccgagcgcgcgcccgcaccatcatcaagtggcaggacctggaggtgggccaggtggtcatgctcaactacaaccccgacaaccccaaggagcggggcttctggtacgacgcggagatctccaggaagcgcgagaccaggacggcgcgggaactctacgccaacgtggtgctgggggatgattctctgaacgactgtcggatcatcttcgtggacgaagtcttcaagattgagcggccgggtgaagggagccccatggttgacaaccccatgagacggaagagcgggccgtcctgcaagcactgcaaggacgacgtgaacagactctgccgggtctgcgcctgccacctgtgcgggggccggcaggaccccgacaagcagctcatgtgcgatgagtgcgacatggccttccacatctactgcctggacccgcccctcagcagtgttcccagcgaggacgagtggtactgccctgagtgccggaatgatgccagcgaggtggtactggcgggagagcggctgagagagagcaagaagaaggcgaagatggcctcggccacatcgtcctcacagcgggactggggcaagggcatggcctgtgtgggccgcaccaaggaatgtaccatcgtcccgtccaaccactacggacccatcccggggatccccgtgggcaccatgtggcggttccgagtccaggtcagcgagtcgggtgtccatcggccccacgtggctggcatacacggccggagcaacgacggagcgtactccctagtcctggcggggggctatgaggatgatgtggaccatgggaattttttcacatacacgggtagtggtggtcgagatctttccggcaacaagaggaccgcggaacagtcttgtgatcagaaactcaccaacaccaacagggcgctggctctcaactgctttgctcccatcaatgaccaagaaggggccgaggccaaggactggcggtcggggaagccggtcagggtggtgcgcaatgtcaagggtggcaagaatagcaagtacgcccccgctgagggcaaccgctacgatggcatctacaaggttgtgaaatactggcccgagaaggggaagtccgggtttctcgtgtggcgctaccttctgcggagggacgatgatgagcctggcccttggacgaaggaggggaaggaccggatcaagaagctggggctgaccatgcagtatccagaaggctacctggaagccctggccaaccgagagcgagagaaggagaacagcaagagggaggaggaggagcagcaggaggggggcttcgcgtcccccaggacgggcaagggcaagtggaagcggaagtcggcaggaggtggcccgagcagggcgggtccccgccggacatccaagaaaaccaaggtggagccctacagtctcacggcccagcagagcagcctcatcagagaggacaagagcaacgccaagctgtggaatgaggtcctggcgtcactcaaggaccggccggcgagcggcagcccgttccagttgttcctgagtaaagtggaggagacgttccagtgtatctgctgtcaggagctggtgttccggcccatcacgaccgtgtgccagcacaacgtgtgcaaggactgcctggacagatcctttcgggcacaggtgttcagctgccctgcctgccgctacgacctgggccgcagctatgccatgcaggtgaaccagcctctgcagaccgtcctcaaccagctcttccccggctacggcaatggccggtgatctccaagcacttctcgacaggcgttttgctgaaaacgtgtcggagggctcgttcatcggcactgattttgttcttagtgggcttaacttaaacaggtagtgtttcctccgttccctaaaaaggtttgtcttcctttttttttttattttt

SEQ ID NO: 33659 - DNA, 4325 bp, Homo sapiens
gctcatcgtttgttgtttagataatatcatgaactgataaatgcagttgccacgttgattccctagggcctggcttaccgactgaggtcataagatattatgccttctctttagacttggtcagtggagaggaaatgggcaaagaaccagcctatggaggtgacaaggccttagggccaaaagtcttgagggtgaaggtttagggcctgcgcagcttccctgccatgccccgcaaggtctcgcattcgcaaggcttgtgacagtgggagcctcattacggactctcctaaagtccatggtgtcctcttttcgcatttgcgccccgtgggtgatgcccgatgccgcccttcccatcgctctcttccccttcaagcgtatcgcaactgcaaaaacacccagcacagacactccattttctatcttaatgcatttaactagcacaacctacaggttgttccatcccagagactacccttttctccatagacgtgaccatcaaccaaccagcggtcagaatcagtcagcctctgtcatgttcctaggtccttggcgaactggctgggcggggtcccagcagcctaggagtacagtggagcaatgcctgacgtaagtcaacaaagatcacgtgagacgaatcagtcgcctagattggctacaactaagtggttgggagcggggaggtcgcggcggctgcgtggggttcgcccgtgacacaattacaactttgtgctggtgctggcaaagtttgtgattttaagaaattctgctgtgctctccagcactgcgagcttctgccttccctgtagtttcccagatgtgatccaggtagccgagttccgctgcccgtgcttcggtagcttaagtctttgcctcagcttttttccttgcagccgctgaggaggcgataaaattggcgtcacagtctcaagcagcgattgaaggcgtcttttcaactactcgattaaggttgggtatcgtcgtgggacttggaaatttgttgtttccatgaaatcctgcgcagtgtcgctcactaccgccgctgttgccttcggtgatgaggcaaagaaaatggcggaaggaaaagcgagccgcgagagtgaagaggagtctgttagcctgacagtcgaggaaagggaggcgcttggtggcatggacagccgtctcttcgggttcgtgaggcttcatgaagatggcgccagaacgaagaccctactaggcaaggctgttcgctgctacgaatctttaatcttaaaagctgaaggaaaagtggagtctgacttcttttgccaattaggtcacttcaacctcttgttggaagattattcaaaagcattatctgcatatcagagatattacagtttacaggctgactactggaagaatgctgcgtttttatatggccttggtttggtctacttctactacaatgcatttcattgggcaattaaagcatttcaagatgtcctttatgttgaccccagcttttgtcgagccaaggaaattcatttacgacttgggctcatgttcaaagtgaacacagactacaagtctagtttaaagcattttcagttagccttgattgactgtaatccatgtactttgtccaatgctgaaattcaatttcatattgcccatttgtatgaaacccagaggaagtatcattctgcaaaggaggcatatgaacaacttttgcagacagaaaaccttcctgcacaagtaaaagcaactgtattgcaacagttaggttggatgcatcataatatggatctagtaggagacaaagccacaaaggaaagctatgctattcagtatctccaaaagtctttggaggcagatcctaattctggccaatcgtggtattttcttggaaggtgttattcaagtattgggaaagttcaggatgcctttatatcttacaggcaatctattgataaatcagaagcaagtgcagatacatggtgttcaataggtgtgttgtatcagcagcaaaatcagcctatggatgctttacaggcatatatttgtgctgtacaattggaccatgggcatgccgcagcctggatggacctaggtactctctatgaatcctgcaatcaacctcaagatgccattaaatgctacctaaatgcagctagaagcaaacgttgtagtaatacctctacgcttgctgcaagaattaaatttctacagaatggttctgataactggaatggtggccagagtctttcacatcatccagtacagcaagtttattcgttgtgtttgacaccacagaaattacagcacttggaacaactgcgagcaaatagagataatttaaatccagcacagaagcatcagctggaacagttagaaagtcagtttgtcttaatgcagcaaatgagacacaaagaagttgctcaggtacgaactactggaattcataacggggccataactgattcatcactgcctacaaactctgtctctaatcgacaaccacatggtgctctgaccagagtatctagcgtctctcagcctggagttcgccctgcttgtgttgaaaaacttttgtccagtggagctttttctgcaggctgtattccttgtggcacatcaaaaattctaggaagtacagacactatcttgctaggcagtaattgtatagcaggaagtgaaagtaatggaaatgtgccttacctgcagcaaaatacacacactctacctcataatcatacagacctgaacagcagcacagaagagccatggagaaaacagctatctaactccgctcaggggcttcataaaagtcagagttcatgtttgtcaggacctaatgaagaacaacctctgttttccactgggtcagcccagtatcaccaggcaactagcactggtattaagaaggcgaatgaacatctcactctgcctagtaattcagtaccacagggggatgctgacagtcacctctcctgtcatactgctacctcaggtggacaacaaggcattatgtttaccaaagagagcaagccttcaaaaaatagatccttggtgcctgaaacaagcaggcatactggagacacatctaatggctgtgctgatgtcaagggactttctaatcatgttcatcagttgatagcagatgctgtttccagtcctaaccatggagattcaccaaatttattaattgcagacaatcctcagctctctgctttgttgattggaaaagccaatggcaatgtgggtactggaacctgtgacaaagtgaataatattcacccagctgttcatacaaagactgatcattctgttgcctcttcaccctcttcagccatttccacagcaacaccttctcctaaatccactgagcagagaagcataaacagtgttaccagccttaacagtcctcacagtggattacacacagtcaatggagaggggctggggaagtcacagagctctacaaaagtagacctgcctttagctagccacagatctacttctcagatcttaccatcaatgtcagtgtctatatgccccagttcaacagaagttctgaaagcatgcaggaatccaggtaaaaatggcttgtctaatagctgcattttgttagataaatgtccacctccaagaccaccaacttcaccatacccacccttgccaaaggacaagttgaatccacccacacctagtatttacttggaaaataaacgtgatgctttctttcctccattacatcaattttgtacaaatccaaaaaaccctgttacagtaatacgtggccttgctggagctcttaaattagatcttggacttttctctaccaaaactttggtagaagctaacaatgaacatatggtagaagtgaggacacagttgctgcaaccagcagatgaaaactgggatcccactggaacaaagaaaatctggcgttgtgaaagcaatagatctcatactacaattgccaaatacgcacaataccaggcttcctccttccaggaatcattgagagctggaatgcaatggtgtgatctcagctcactgcagcctccgcctcctgggttcaagcgattctcccacctcagcctcccgaatagctggaattacaggcacctgccatcatgcccaactaatttttgtatttttgtagagacagggtttcaccatgttggccaggcttgtcttgaactcctgacctcaggtggtctgcttgcctcagcatcccaaagtgctgggattacaggtgtgagccaccatgcccggtaaacttttaaaaatgtaagcaaaattacagtatgtaaaacacacattgctaatggagaaataaagttcctactttacatcta

SEQ ID NO: 33660 - DNA, 6529 bp, Homo sapiens
tttgctcatcgtttgttgtttagataatatcatgaactgataaatgcagttgccacgttgattccctagggcctggcttaccgactgaggtcataagatattatgccttctctttagacttggtcagtggagaggaaatgggcaaagaaccagcctatggaggtgacaaggccttagggccaaaagtcttgagggtgaaggtttagggcctgcgcagcttccctgccatgccccgcaaggtctcgcattcgcaaggcttgtgacagtgggagcctcattacggactctcctaaagtccatggtgtcctcttttcgcatttgcgccccgtgggtgatgcccgatgccgcccttcccatcgctctcttccccttcaagcgtatcgcaactgcaaaaacacccagcacagacactccattttctatcttaatgcatttaactagcacaacctacaggttgttccatcccagagactacccttttctccatagacgtgaccatcaaccaaccagcggtcagaatcagtcagcctctgtcatgttcctaggtccttggcgaactggctgggcggggtcccagcagcctaggagtacagtggagcaatgcctgacgtaagtcaacaaagatcacgtgagacgaatcagtcgcctagattggctacaactaagtggttgggagcggggaggtcgcggcggctgcgtggggttcgcccgtgacacaattacaactttgtgctggtgctggcaaagtttgtgattttaagaaattctgctgtgctctccagcactgcgagcttctgccttccctgtagtttcccagatgtgatccaggtagccgagttccgctgcccgtgcttcggtagcttaagtctttgcctcagcttttttccttgcagccgctgaggaggcgataaaattggcgtcacagtctcaagcagcgattgaaggcgtcttttcaactactcgattaaggttgggtatcgtcgtgggacttggaaatttgttgtttccatgaaatcctgcgcagtgtcgctcactaccgccgctgttgccttcggtgatgaggcaaagaaaatggcggaaggaaaagcgagccgcgagagtgaagaggagtctgttagcctgacagtcgaggaaagggaggcgcttggtggcatggacagccgtctcttcgggttcgtgaggcttcatgaagatggcgccagaacgaagaccctactaggcaaggctgttcgctgctacgaatctttaatcttaaaagctgaaggaaaagtggagtctgacttcttttgccaattaggtcacttcaacctcttgttggaagattattcaaaagcattatctgcatatcagagatattacagtttacaggctgactactggaagaatgctgcgtttttatatggccttggtttggtctacttctactacaatgcatttcattgggcaattaaagcatttcaagatgtcctttatgttgaccccagcttttgtcgagccaaggaaattcatttacgacttgggctcatgttcaaagtgaacacagactacaagtctagtttaaagcattttcagttagccttgattgactgtaatccatgtactttgtccaatgctgaaattcaatttcatattgcccatttgtatgaaacccagaggaagtatcattctgcaaaggaggcatatgaacaacttttgcagacagaaaaccttcctgcacaagtaaaagcaactgtattgcaacagttaggttggatgcatcataatatggatctagtaggagacaaagccacaaaggaaagctatgctattcagtatctccaaaagtctttggaggcagatcctaattctggccaatcgtggtattttcttggaaggtgttattcaagtattgggaaagttcaggatgcctttatatcttacaggcaatctattgataaatcagaagcaagtgcagatacatggtgttcaataggtgtgttgtatcagcagcaaaatcagcctatggatgctttacaggcatatatttgtgctgtacaattggaccatgggcatgccgcagcctggatggacctaggtactctctatgaatcctgcaatcaacctcaagatgccattaaatgctacctaaatgcagctagaagcaaacgttgtagtaatacctctacgcttgctgcaagaattaaatttctacagaatggttctgataactggaatggtggccagagtctttcacatcatccagtacagcaagtttattcgttgtgtttgacaccacagaaattacagcacttggaacaactgcgagcaaatagagataatttaaatccagcacagaagcatcagctggaacagttagaaagtcagtttgtcttaatgcagcaaatgagacacaaagaagttgctcaggtacgaactactggaattcataacggggccataactgattcatcactgcctacaaactctgtctctaatcgacaaccacatggtgctctgaccagagtatctagcgtctctcagcctggagttcgccctgcttgtgttgaaaaacttttgtccagtggagctttttctgcaggctgtattccttgtggcacatcaaaaattctaggaagtacagacactatcttgctaggcagtaattgtatagcaggaagtgaaagtaatggaaatgtgccttacctgcagcaaaatacacacactctacctcataatcatacagacctgaacagcagcacagaagagccatggagaaaacagctatctaactccgctcaggggcttcataaaagtcagagttcatgtttgtcaggacctaatgaagaacaacctctgttttccactgggtcagcccagtatcaccaggcaactagcactggtattaagaaggcgaatgaacatctcactctgcctagtaattcagtaccacagggggatgctgacagtcacctctcctgtcatactgctacctcaggtggacaacaaggcattatgtttaccaaagagagcaagccttcaaaaaatagatccttggtgcctgaaacaagcaggcatactggagacacatctaatggctgtgctgatgtcaagggactttctaatcatgttcatcagttgatagcagatgctgtttccagtcctaaccatggagattcaccaaatttattaattgcagacaatcctcagctctctgctttgttgattggaaaagccaatggcaatgtgggtactggaacctgtgacaaagtgaataatattcacccagctgttcatacaaagactgatcattctgttgcctcttcaccctcttcagccatttccacagcaacaccttctcctaaatccactgagcagagaagcataaacagtgttaccagccttaacagtcctcacagtggattacacacagtcaatggagaggggctggggaagtcacagagctctacaaaagtagacctgcctttagctagccacagatctacttctcagatcttaccatcaatgtcagtgtctatatgccccagttcaacagaagttctgaaagcatgcaggaatccaggtaaaaatggcttgtctaatagctgcattttgttagataaatgtccacctccaagaccaccaacttcaccatacccacccttgccaaaggacaagttgaatccacccacacctagtatttacttggaaaataaacgtgatgctttctttcctccattacatcaattttgtacaaatccaaaaaaccctgttacagtaatacgtggccttgctggagctcttaaattagatcttggacttttctctaccaaaactttggtagaagctaacaatgaacatatggtagaagtgaggacacagttgctgcaaccagcagatgaaaactgggatcccactggaacaaagaaaatctggcgttgtgaaagcaatagatctcatactacaattgccaaatacgcacaataccaggcttcctccttccaggaatcattgagagaagaaaatgagaaaagaacacaacacaaagatcattcagataacgaatccacatcttcagagaattctggaaggagaaggaaaggaccttttaaaaccataaaatttgggaccaacattgacctctctgataacaaaaagtggaagttgcagttacatgaactgactaaacttcctgcttttgcgcgtgtggtgtcagcaggaaatcttctaacccatgttgggcataccattctgggcatgaatacagtacaactgtatatgaaagttccagggagtcggacaccaggtcaccaagaaaataacaacttctgctctgttaacataaatattggtccaggagattgtgaatggtttgttgtacctgaagattattggggtgttctgaatgacttctgtgaaaaaaataatttgaattttttaatgagttcttggtggcccaaccttgaagatctttatgaagcaaatgtccctgtgtatagatttattcagcgacctggagatttggtctggataaatgcaggcactgtgcattgggttcaagctgttggctggtgcaataacattgcctggaatgttggtccacttacagcctgccagtataaattggcagtggaacggtatgaatggaacaaattgaaaagtgtgaagtcaccagtacccatggtgcatctttcctggaatatggcacgaaatatcaaagtctcagatccaaagctttttgaaatgattaagtattgtcttttgaaaattctgaagcaatatcagacattgagagaagctcttgttgcagcaggaaaagaggttatatggcatgggcggacaaatgatgaaccagctcattactgtagcatttgtgaggtggaggtttttaatctgctttttgtcactaatgaaagcaatactcaaaaaacctacatagtacattgccatgattgtgcacgaaaaacaagcaaaagtttggaaaattttgtggtgctcgaacagtacaaaatggaggacctaatccaagtttatgatcaatttacactagctctttcattatcatcctcatcttgatatagttccatgaatattaaatgagattatttctgctcttcaggaaatttctgcaccactggttttgtagctgtttcataaaactgttgactaaaagctatgtctatgcaaccttccaagaatagtatgtcaagcaactggacacagtgctgcctctgcttcaggacttaacatgctgatccagctgtacttcagaaaaataatattaatcatatgttttgtgtacgtatgacaaactgtcaaagtgacacagaatactgatttgaagatagccttttttatgtttctctatttctgggctgatgaattaatattcatttgtattttaaccctgcagaattttccttagttaaaaacactttcctagctggtcatttcttcataagatagcaaatttaaatctctcctcgatcagcttttaaaaaatgtgtactattatctgaggaagttttttactgctttatgtttttgtgtgttttgaggccatgatgattacatttgtggttccaaaataatttttttaaatattaatagcccatatacaaagataatggattgcacatagacaaagaaataaacttcagatttgtgatttttgtttctaaacttgatacagatttacactatttataaatacgtatttattgcctgaaaatatttgtgaatggaatgttgtttttttccagacgtaactgccattaaatactaaggagttctgtagttttaaacactactcctattacattttatatgtgtagataaaactgcttagtattatacagaaatttttattaaaattgttaaatgtttaaagggtttcccaatgtttgagtttaaaaaagactttctgaaaaaatccactttttgttcattttcaaacctaatgattatatgtattttatatgtgtgtgtatgtgtacacacatgtataatatatacagaaacctcgatatataattgtatagattttaaaagttttattttttacatctatggtagtttttgaggtgcctattataaagtattacggaagtttgctgtttttaaagtaaatgtcttttagtgtgatttattaagttgtagtcaccatagtgatagcccataaataattgctggaaaattgtattttataacagtagaaaacatatagtcagtgaagtaaatattttaaaggaaacattatatagatttgataaatgttgtttataattaagagtttcttatggaaaagagattcagaatgataacctcttttagagaacaaataagtgacttatttttttaaagctagatgactttgaaatgctatactgtcctgcttgtacaacatggtttggggtgaaggggaggaaagtattaaaaaatctatatcgctagtaaattgtaataagttctattaaaacttgtatttcatatgaaaaatttgctaatttaatattaactcatttgataataatacttgtcttttctacctctc

SEQ ID NO: 33661 - DNA, 4990 bp, Homo sapiens
gctcatcgtttgttgtttagataatatcatgaactgataaatgcagttgccacgttgattccctagggcctggcttaccgactgaggtcataagatattatgccttctctttagacttggtcagtggagaggaaatgggcaaagaaccagcctatggaggtgacaaggccttagggccaaaagtcttgagggtgaaggtttagggcctgcgcagcttccctgccatgccccgcaaggtctcgcattcgcaaggcttgtgacagtgggagcctcattacggactctcctaaagtccatggtgtcctcttttcgcatttgcgccccgtgggtgatgcccgatgccgcccttcccatcgctctcttccccttcaagcgtatcgcaactgcaaaaacacccagcacagacactccattttctatcttaatgcatttaactagcacaacctacaggttgttccatcccagagactacccttttctccatagacgtgaccatcaaccaaccagcggtcagaatcagtcagcctctgtcatgttcctaggtccttggcgaactggctgggcggggtcccagcagcctaggagtacagtggagcaatgcctgacgtaagtcaacaaagatcacgtgagacgaatcagtcgcctagattggctacaactaagtggttgggagcggggaggtcgcggcggctgcgtggggttcgcccgtgacacaattacaactttgtgctggtgctggcaaagtttgtgattttaagaaattctgctgtgctctccagcactgcgagcttctgccttccctgtagtttcccagatgtgatccaggtagccgagttccgctgcccgtgcttcggtagcttaagtctttgcctcagcttttttccttgcagccgctgaggaggcgataaaattggcgtcacagtctcaagcagcgattgaaggcgtcttttcaactactcgattaaggttgggtatcgtcgtgggacttggaaatttgttgtttccatgaaatcctgcgcagtgtcgctcactaccgccgctgttgccttcggtgatgaggcaaagaaaatggcggaaggaaaagcgagccgcgagagtgaagaggagtctgttagcctgacagtcgaggaaagggaggcgcttggtggcatggacagccgtctcttcgggttcgtgaggcttcatgaagatggcgccagaacgaagaccctactaggcaaggctgttcgctgctacgaatctttaatcttaaaagctgaaggaaaagtggagtctgacttcttttgccaattaggtcacttcaacctcttgttggaagattattcaaaagcattatctgcatatcagagatattacagtttacaggctgactactggaagaatgctgcgtttttatatggccttggtttggtctacttctactacaatgcatttcattgggcaattaaagcatttcaagatgtcctttatgttgaccccagcttttgtcgagccaaggaaattcatttacgacttgggctcatgttcaaagtgaacacagactacaagtctagtttaaagcattttcagttagccttgattgactgtaatccatgtactttgtccaatgctgaaattcaatttcatattgcccatttgtatgaaacccagaggaagtatcattctgcaaaggaggcatatgaacaacttttgcagacagaaaaccttcctgcacaagtaaaagcaactgtattgcaacagttaggttggatgcatcataatatggatctagtaggagacaaagccacaaaggaaagctatgctattcagtatctccaaaagtctttggaggcagatcctaattctggccaatcgtggtattttcttggaaggtgttattcaagtattgggaaagttcaggatgcctttatatcttacaggcaatctattgataaatcagaagcaagtgcagatacatggtgttcaataggtgtgttgtatcagcagcaaaatcagcctatggatgctttacaggcatatatttgtgctgtacaattggaccatgggcatgccgcagcctggatggacctaggtactctctatgaatcctgcaatcaacctcaagatgccattaaatgctacctaaatgcagctagaagcaaacgttgtagtaatacctctacgcttgctgcaagaattaaatttctacagaatggttctgataactggaatggtggccagagtctttcacatcatccagtacagcaagtttattcgttgtgtttgacaccacagaaattacagcacttggaacaactgcgagcaaatagagataatttaaatccagcacagaagcatcagctggaacagttagaaagtcagtttgtcttaatgcagcaaatgagacacaaagaagttgctcaggtacgaactactggaattcataacggggccataactgattcatcactgcctacaaactctgtctctaatcgacaaccacatggtgctctgaccagagtatctagcgtctctcagcctggagttcgccctgcttgtgttgaaaaacttttgtccagtggagctttttctgcaggctgtattccttgtggcacatcaaaaattctaggaagtacagacactatcttgctaggcagtaattgtatagcaggaagtgaaagtaatggaaatgtgccttacctgcagcaaaatacacacactctacctcataatcatacagacctgaacagcagcacagaagagccatggagaaaacagctatctaactccgctcaggggcttcataaaagtcagagttcatgtttgtcaggacctaatgaagaacaacctctgttttccactgggtcagcccagtatcaccaggcaactagcactggtattaagaaggcgaatgaacatctcactctgcctagtaattcagtaccacagggggatgctgacagtcacctctcctgtcatactgctacctcaggtggacaacaaggcattatgtttaccaaagagagcaagccttcaaaaaatagatccttggtgcctgaaacaagcaggcatactggagacacatctaatggctgtgctgatgtcaagggactttctaatcatgttcatcagttgatagcagatgctgtttccagtcctaaccatggagattcaccaaatttattaattgcagacaatcctcagctctctgctttgttgattggaaaagccaatggcaatgtgggtactggaacctgtgacaaagtgaataatattcacccagctgttcatacaaagactgatcattctgttgcctcttcaccctcttcagccatttccacagcaacaccttctcctaaatccactgagcagagaagcataaacagtgttaccagccttaacagtcctcacagtggattacacacagtcaatggagaggggctggggaagtcacagagctctacaaaagtagacctgcctttagctagccacagatctacttctcagatcttaccatcaatgtcagtgtctatatgccccagttcaacagaagttctgaaagcatgcaggaatccaggtaaaaatggcttgtctaatagctgcattttgttagataaatgtccacctccaagaccaccaacttcaccatacccacccttgccaaaggacaagttgaatccacccacacctagtatttacttggaaaataaacgtgatgctttctttcctccattacatcaattttgtacaaatccaaaaaaccctgttacagtaatacgtggccttgctggagctcttaaattagatcttggacttttctctaccaaaactttggtagaagctaacaatgaacatatggtagaagtgaggacacagttgctgcaaccagcagatgaaaactgggatcccactggaacaaagaaaatctggcgttgtgaaagcaatagatctcatactacaattgccaaatacgcacaataccaggcttcctccttccaggaatcattgagagaagaaaatgagaaaagaacacaacacaaagatcattcagataacgaatccacatcttcagagaattctggaaggagaaggaaaggaccttttaaaaccataaaatttgggaccaacattgacctctctgataacaaaaagtggaagttgcagttacatgaactgactaaacttcctgcttttgcgcgtgtggtgtcagcaggaaatcttctaacccatgttgggcataccattctgggcatgaatacagtacaactgtatatgaaagttccagggagtcggacaccaggtcaccaagaaaataacaacttctgctctgttaacataaatattggtccaggagattgtgaatggtttgttgtacctgaagattattggggtgttctgaatgacttctgtgaaaaaaataatttgaattttttaatgagttcttggtggcccaaccttgaagatctttatgaagcaaatgtccctgtgtatagatttattcagcgacctggagatttggtctggataaatgcaggcactgtgcattgggttcaagctgttggctggtgcaataacattgcctggaatgttggtccacttacagcctgccagtataaattggcagtggaacggtatgaatggaacaaattgaaaagtgtgaagtcaccagtacccatggtgcatctttcctggaatatggcacgaaatatcaaagtctcagatccaaagctttttgaaatgattaagtaagtgccttctgaaactgctgcagtttctctttgggggtattggtagccattcagtatttttttcaaaagaattctgttgacattaaatgatatcagcagtccagaagtcttggcaaaatgtaataagatgtaaataatcttatatattcataagtgttataaaatctcataagattaaaatattgccttcccttacagatagtcacttgtgtttattacaatttagagaggaataaagatgtacatgaatatacactggtaaa

SEQ ID NO: 33662 - DNA, 1539 bp, Homo sapiens
gcgtggggttcgcccgtgacacaattacaactttgtgctggtgctggcaaagtttgtgattttaagaaattctgctgtgctctccagcactgcgagcttctgccttccctgtagtttcccagatgtgatccaggtagccgagttccgctgcccgtgcttcggtagcttaagtctttgcctcagcttttttccttgcagccgctgaggaggcgataaaattggcgtcacagtctcaagcagcgattgaaggcgtcttttcaactactcgattaaggttgggtatcgtcgtgggacttggaaatttgttgtttccatgaaatcctgcgcagtgtcgctcactaccgccgctgttgccttcggtgatgaggcaaagaaaatggcggaaggaaaagcgagccgcgagagtgaagaggagtctgttagcctgacagtcgaggaaagggaggcgcttggtggcatggacagccgtctcttcgggttcgtgaggcttcatgaagatggcgccagaacgaagaccctactaggcaaggctgttcgctgctacgaatctttaatcttaaaagctgaaggaaaagtggagtctgacttcttttgccaattaggtcacttcaacctcttgttggaagattattcaaaagcattatctgcatatcagagatattacagtttacaggctgactactggaagaatgctgcgtttttatatggccttggtttggtctacttctactacaatgcatttcattgggcaattaaagcatttcaagatgtcctttatgttgaccccagcttttgtcgagccaaggaaattcatttacgacttgggctcatgttcaaagtgaacacagactacaagtctagtttaaagcattttcagttagccttgattgactgtaatccatgtactttgtccaatgctgaaagtaagtatttttaaatgaaatacttttgagtaaagaatattaatgatacctttttttctactgatacctttgtttctgttcattcttgagaagagaagtgagaaggcatgtgcctgattcagagagtttaaatcactggagttgagttgatttgggtactatttttcttgctcaaagacagtcagtattattatttgataactgtagaaatgattggtatgtcacagagcactaacaaatagtgattacctactttagtagtttttctccctttatggtgtctatgttttcatattaatgaattacttcaccttttaatattttaggatttgcacataccgtaagcttgactattttttgaaacttttttgtgtacttggtgatgttgcaaaaatcaaaagttttcaaagccaattttaaacaaaacctgaataagttaaaaatgtgtagtttaaaaaataaatactgttttttgaactctttcagatgaatgactacagttaatattttgggaaaaaaacatgtttaaaaagaatatgaaactttaaattatgtgattttcctttgtgataaaaatgttagaatattaaagaccttttatgtcaattttttacct

SEQ ID NO: 33663 - DNA, 4179 bp, Homo sapiens
atgaaatcctgcgcagtgtcgctcactaccgccgctgttgccttcggtgatgaggcaaagaaaatggcggaaggaaaagcgagccgcgagagtgaagaggagtctgttagcctgacagtcgaggaaagggaggcgcttggtggcatggacagccgtctcttcgggttcgtgaggcttcatgaagatggcgccagaacgaagaccctactaggcaaggctgttcgctgctacgaatctttaatcttaaaagctgaaggaaaagtggagtctgacttcttttgccaattaggtcacttcaacctcttgttggaagattattcaaaagcattatctgcatatcagagatattacagtttacaggctgactactggaagaatgctgcgtttttatatggccttggtttggtctacttctactacaatgcatttcattgggcaattaaagcatttcaagatgtcctttatgttgaccccagcttttgtcgagccaaggaaattcatttacgacttgggctcatgttcaaagtgaacacagactacaagtctagtttaaagcattttcagttagccttgattgactgtaatccatgtactttgtccaatgctgaaattcaatttcatattgcccatttgtatgaaacccagaggaagtatcattctgcaaaggaggcatatgaacaacttttgcagacagaaaaccttcctgcacaagtaaaagcaactgtattgcaacagttaggttggatgcatcataatatggatctagtaggagacaaagccacaaaggaaagctatgctattcagtatctccaaaagtctttggaggcagatcctaattctggccaatcgtggtattttcttggaaggtgttattcaagtattgggaaagttcaggatgcctttatatcttacaggcaatctattgataaatcagaagcaagtgcagatacatggtgttcaataggtgtgttgtatcagcagcaaaatcagcctatggatgctttacaggcatatatttgtgctgtacaattggaccatgggcatgccgcagcctggatggacctaggtactctctatgaatcctgcaatcaacctcaagatgccattaaatgctacctaaatgcagctagaagcaaacgttgtagtaatacctctacgcttgctgcaagaattaaatttctacaggctcagttgtgtaaccttccacaaagtagtctacagaataaaactaaattacttcctagtattgaggaggcatggagcctaccaatccccgcagagcttacctccaggcagggtgccatgaacacagcacagcagaatggttctgataactggaatggtggccagagtctttcacatcatccagtacagcaagtttattcgttgtgtttgacaccacagaaattacagcacttggaacaactgcgagcaaatagagataatttaaatccagcacagaagcatcagctggaacagttagaaagtcagtttgtcttaatgcagcaaatgagacacaaagaagttgctcaggtacgaactactggaattcataacggggccataactgattcatcactgcctacaaactctgtctctaatcgacaaccacatggtgctctgaccagagtatctagcgtctctcagcctggagttcgccctgcttgtgttgaaaaacttttgtccagtggagctttttctgcaggctgtattccttgtggcacatcaaaaattctaggaagtacagacactatcttgctaggcagtaattgtatagcaggaagtgaaagtaatggaaatgtgccttacctgcagcaaaatacacacactctacctcataatcatacagacctgaacagcagcacagaagagccatggagaaaacagctatctaactccgctcaggggcttcataaaagtcagagttcatgtttgtcaggacctaatgaagaacaacctctgttttccactgggtcagcccagtatcaccaggcaactagcactggtattaagaaggcgaatgaacatctcactctgcctagtaattcagtaccacagggggatgctgacagtcacctctcctgtcatactgctacctcaggtggacaacaaggcattatgtttaccaaagagagcaagccttcaaaaaatagatccttggtgcctgaaacaagcaggcatactggagacacatctaatggctgtgctgatgtcaagggactttctaatcatgttcatcagttgatagcagatgctgtttccagtcctaaccatggagattcaccaaatttattaattgcagacaatcctcagctctctgctttgttgattggaaaagccaatggcaatgtgggtactggaacctgtgacaaagtgaataatattcacccagctgttcatacaaagactgatcattctgttgcctcttcaccctcttcagccatttccacagcaacaccttctcctaaatccactgagcagagaagcataaacagtgttaccagccttaacagtcctcacagtggattacacacagtcaatggagaggggctggggaagtcacagagctctacaaaagtagacctgcctttagctagccacagatctacttctcagatcttaccatcaatgtcagtgtctatatgccccagttcaacagaagttctgaaagcatgcaggaatccaggtaaaaatggcttgtctaatagctgcattttgttagataaatgtccacctccaagaccaccaacttcaccatacccacccttgccaaaggacaagttgaatccacccacacctagtatttacttggaaaataaacgtgatgctttctttcctccattacatcaattttgtacaaatccaaaaaaccctgttacagtaatacgtggccttgctggagctcttaaattagatcttggacttttctctaccaaaactttggtagaagctaacaatgaacatatggtagaagtgaggacacagttgctgcaaccagcagatgaaaactgggatcccactggaacaaagaaaatctggcgttgtgaaagcaatagatctcatactacaattgccaaatacgcacaataccaggcttcctccttccaggaatcattgagagaagaaaatgagaaaagaacacaacacaaagatcattcagataacgaatccacatcttcagagaattctggaaggagaaggaaaggaccttttaaaaccataaaatttgggaccaacattgacctctctgataacaaaaagtggaagttgcagttacatgaactgactaaacttcctgcttttgcgcgtgtggtgtcagcaggaaatcttctaacccatgttgggcataccattctgggcatgaatacagtacaactgtatatgaaagttccagggagtcggacaccaggtcaccaagaaaataacaacttctgctctgttaacataaatattggtccaggagattgtgaatggtttgttgtacctgaagattattggggtgttctgaatgacttctgtgaaaaaaataatttgaattttttaatgagttcttggtggcccaaccttgaagatctttatgaagcaaatgtccctgtgtatagatttattcagcgacctggagatttggtctggataaatgcaggcactgtgcattgggttcaagctgttggctggtgcaataacattgcctggaatgttggtccacttacagcctgccagtataaattggcagtggaacggtatgaatggaacaaattgaaaagtgtgaagtcaccagtacccatggtgcatctttcctggaatatggcacgaaatatcaaagtctcagatccaaagctttttgaaatgattaagtattgtcttttgaaaattctgaagcaatatcagacattgagagaagctcttgttgcagcaggaaaagaggttatatggcatgggcggacaaatgatgaaccagctcattactgtagcatttgtgaggtggaggtttttaatctgctttttgtcactaatgaaagcaatactcaaaaaacctacatagtacattgccatgattgtgcacgaaaaacaagcaaaagtttggaaaattttgtggtgctcgaacagtacaaaatggaggacctaatccaagtttatgatcaatttacactagctctttcattatcatcctcatcttga

SEQ ID NO: 33664 - DNA, 3636 bp, Homo sapiens
atgaaatcctgcgcagtgtcgctcactaccgccgctgttgccttcggtgatgaggcaaagaaaatggcggaaggaaaagcgagccgcgagagtgaagaggagtctgttagcctgacagtcgaggaaagggaggcgcttggtggcatggacagccgtctcttcgggttcgtgaggcttcatgaagatggcgccagaacgaagaccctactaggcaaggctgttcgctgctacgaatctttaatcttaaaagctgaaggaaaagtggagtctgacttcttttgccaattaggtcacttcaacctcttgttggaagattattcaaaagcattatctgcatatcagagatattacagtttacaggctgactactggaagaatgctgcgtttttatatggccttggtttggtctacttctactacaatgcatttcattgggcaattaaagcatttcaagatgtcctttatgttgaccccagcttttgtcgagccaaggaaattcatttacgacttgggctcatgttcaaagtgaacacagactacaagtctagtttaaagcattttcagttagccttgattgactgtaatccatgtactttgtccaatgctgaaattcaatttcatattgcccatttgtatgaaacccagaggaagtatcattctgcaaaggaggcatatgaacaacttttgcagacagaaaaccttcctgcacaagtaaaagcaactgtattgcaacagttaggttggatgcatcataatatggatctagtaggagacaaagccacaaaggaaagctatgctattcagtatctccaaaagtctttggaggcagatcctaattctggccaatcgtggtattttcttggaaggtgttattcaagtattgggaaagttcaggatgcctttatatcttacaggcaatctattgataaatcagaagcaagtgcagatacatggtgttcaataggtgtgttgtatcagcagcaaaatcagcctatggatgctttacaggcatatatttgtgctgtacaattggaccatgggcatgccgcagcctggatggacctaggtactctctatgaatcctgcaatcaacctcaagatgccattaaatgctacctaaatgcagctagaagcaaacgttgtagtaatacctctacgcttgctgcaagaattaaatttctacaggctcagttgtgtaaccttccacaaagtagtctacagaataaaactaaattacttcctagtattgaggaggcatggagcctaccaatccccgcagagcttacctccaggcagggtgccatgaacacagcacagcagaatggttctgataactggaatggtggccagagtctttcacatcatccagtacagcaagtttattcgttgtgtttgacaccacagaaattacagcacttggaacaactgcgagcaaatagagataatttaaatccagcacagaagcatcagctggaacagttagaaagtcagtttgtcttaatgcagcaaatgagacacaaagaagttgctcaggggcttcataaaagtcagagttcatgtttgtcaggacctaatgaagaacaacctctgttttccactgggtcagcccagtatcaccaggcaactagcactggtattaagaaggcgaatgaacatctcactctgcctagtaattcagtaccacagggggatgctgacagtcacctctcctgtcatactgctacctcaggtggacaacaaggcattatgtttaccaaagagagcaagccttcaaaaaatagatccttggtgcctgaaacaagcaggcatactggagacacatctaatggctgtgctgatgtcaagggactttctaatcatgttcatcagttgatagcagatgctgtttccagtcctaaccatggagattcaccaaatttattaattgcagacaatcctcagctctctgctttgttgattggaaaagccaatggcaatgtgggtactggaacctgtgacaaagtgaataatattcacccagctgttcatacaaagactgatcattctgttgcctcttcaccctcttcagccatttccacagcaacaccttctcctaaatccactgagcagagaagcataaacagtgttaccagccttaacagtcctcacagtggattacacacagtcaatggagaggggctggggaagtcacagagctctacaaaagtagacctgcctttagctagccacagatctacttctcagatcttaccatcaatgtcagtgtctatatgccccagttcaacagaagttctgaaagcatgcaggaatccaggtaaaaatggcttgtctaatagctgcattttgttagataaatgtccacctccaagaccaccaacttcaccatacccacccttgccaaaggacaagttgaatccacccacacctagtatttacttggaaaataaacgtgatgctttctttcctccattacatcaattttgtacaaatccaaaaaaccctgttacagtaatacgtggccttgctggagctcttaaattagatcttggacttttctctaccaaaactttggtagaagctaacaatgaacatatggtagaagtgaggacacagttgctgcaaccagcagatgaaaactgggatcccactggaacaaagaaaatctggcgttgtgaaagcaatagatctcatactacaattgccaaatacgcacaataccaggcttcctccttccaggaatcattgagagaagaaaatgagaaaagaacacaacacaaagatcattcagataacgaatccacatcttcagagaattctggaaggagaaggaaaggaccttttaaaaccataaaatttgggaccaacattgacctctctgataacaaaaagtggaagttgcagttacatgaactgactaaacttcctgcttttgcgcgtgtggtgtcagcaggaaatcttctaacccatgttgggcataccattctgggcatgaatacagtacaactgtatatgaaagttccagggagtcggacaccaggtcaccaagaaaataacaacttctgctctgttaacataaatattggtccaggagattgtgaatggtttgttgtacctgaagattattggggtgttctgaatgacttctgtgaaaaaaataatttgaattttttaatgagttcttggtggcccaaccttgaagatctttatgaagcaaatgtccctgtgtatagatttattcagcgacctggagatttggtctggataaatgcaggcactgtgcattgggttcaagctgttggctggtgcaataacattgcctggaatgttggtccacttacagcctgccagtataaattggcagtggaacggtatgaatggaacaaattgaaaagtgtgaagtcaccagtacccatggtgcatctttcctggaatatggcacgaaatatcaaagtctcagatccaaagctttttgaaatgattaagtattgtcttttgaaaattctgaagcaatatcagacattgagagaagctcttgttgcagcaggaaaagaggttatatggcatgggcggacaaatgatgaaccagctcattactgtagcatttgtgaggctctttcattatcatcctcatcttga

SEQ ID NO: 33665 - DNA, 3214 bp, Homo sapiens
gtttccatgaaatcctgcgcagtgtcgctcactaccgccgctgttgccttcggtgatgaggcaaagaaaatggcggaaggaaaagcgagccgcgagagtgaagaggagtctgttagcctgacagtcgaggaaagggaggcgcttggtggcatggacagccgtctcttcgggttcgtgaggcttcatgaagatggcgccagaacgaagaccctactaggcaaggctgttcgctgctacgaatctttaatcttaaaagctgaaggaaaagtggagtctgacttcttttgccaattaggtcacttcaacctcttgttggaagattattcaaaagcattatctgcatatcagagatattacagtttacaggctgactactggaagaatgctgcgtttttatatggccttggtttggtctacttctactacaatgcatttcattgggcaattaaagcatttcaagatgtcctttatgttgaccccagcttttgtcgagccaaggaaattcatttacgacttgggctcatgttcaaagtgaacacagactacaagtctagtttaaagcattttcagttagccttgattgactgtaatccatgtactttgtccaatgctgaaattcaatttcatattgcccatttgtatgaaacccagaggaagtatcattctgcaaaggaggcatatgaacaacttttgcagacagaaaaccttcctgcacaagtaaaagcaactgtattgcaacagttaggttggatgcatcataatatggatctagtaggagacaaagccacaaaggaaagctatgctattcagtatctccaaaagtctttggaggcagatcctaattctggccaatcgtggtattttcttggaagtgtgttgtatcagcagcaaaatcagcctatggatgctttacaggcatatatttgtgctgtacaattggaccatgggcatgccgcagcctggatggacctaggtactctctatgaatcctgcaatcaacctcaagatgccattaaatgctacctaaatgcagctagaagcaaacgttgtagtaatacctctacgcttgctgcaagaattaaatttctacagaatggttctgataactggaatggtggccagagtctttcacatcatccagtacagcaagtttattcgttgtgtttgacaccacagaaattacagcacttggaacaactgcgagcaaatagagataatttaaatccagcacagaagcatcagctggaacagttagaaagtcagtttgtcttaatgcagcaaatgagacacaaagaagttgctcaggtacgaactactggaattcataacggggccataactgattcatcactgcctacaaactctgtctctaatcgacaaccacatggtgctctgaccagagtatctagcgtctctcagcctggagttcgccctgcttgtgttgaaaaacttttgtccagtggagctttttctgcaggctgtattccttgtggcacatcaaaaattctaggaagtacagacactatcttgctaggcagtaattgtatagcaggaagtgaaagtaatggaaatgtgccttacctgcagcaaaatacacacactctacctcataatcatacagacctgaacagcagcacagaagagccatggagaaaacagctatctaactccgctcaggggcttcataaaagtcagagttcatgtttgtcaggacctaatgaagaacaacctctgttttccactgggtcagcccagtatcaccaggcaactagcactggtattaagaaggcgaatgaacatctcactctgcctagtaattcagtaccacagggggatgctgacagtcacctctcctgtcatactgctacctcaggtggacaacaaggcattatgtttaccaaagagagcaagccttcaaaaaatagatccttggtgcctgaaacaagcaggcatactggagacacatctaatggctgtgctgatgtcaagggactttctaatcatgttcatcagttgatagcagatgctgtttccagtcctaaccatggagattcaccaaatttattaattgcagacaatcctcagctctctgctttgttgattggaaaagccaatggcaatgtgggtactggaacctgtgacaaagtgaataatattcacccagctgttcatacaaagactgatcattctgttgcctcttcaccctcttcagccatttccacagcaacaccttctcctaaatccactgagcagagaagcataaacagtgttaccagccttaacagtcctcacagtggattacacacagtcaatggagaggggctggggaagtcacagagctctacaaaagtagacctgcctttagctagccacagatctacttctcagatcttaccatcaatgtcagtgtctatatgccccagttcaacagaagttctgaaagcatgcaggaatccaggtaaaaatggcttgtctaatagctgcattttgttagataaatgtccacctccaagaccaccaacttcaccatacccacccttgccaaaggacaagttgaatccacccacacctagtatttacttggaaaataaacgtgatgctttctttcctccattacatcaattttgtacaaatccaaaaaaccctgttacagtaatacgtggccttgctggagctcttaaattagatcttggacttttctctaccaaaactttggtagaagctaacaatgaacatatggtagaagtgaggacacagttgctgcaaccagcagatgaaaactgggatcccactggaacaaagaaaatctggcgttgtgaaagcaatagatctcatactacaattgccaaatacgcacaataccaggcttcctccttccaggaatcattgagagctggaatgcaatggtgtgatctcagctcactgcagcctccgcctcctgggttcaagcgattctcccacctcagcctcccgaatagctggaattacaggcacctgccatcatgcccaactaatttttgtatttttgtagagacagggtttcaccatgttggccaggcttgtcttgaactcctgacctcaggtggtctgcttgcctcagcatcccaaagtgctgggattacaggtgtgagccaccatgcccggtaaacttttaaaaatgtaagcaaaattacagtatgtaaaacacacattgctaatggagaaataaagttcc

SEQ ID NO: 33666 - DNA, 3299 bp, Homo sapiens
atgaaatcctgcgcagtgtcgctcactaccgccgctgttgccttcggtgatgaggcaaagaaaatggcggaaggaaaagcgagccgcgagagtgaagaggagtctgttagcctgacagtcgaggaaagggaggcgcttggtggcatggacagccgtctcttcgggttcgtgaggcttcatgaagatggcgccagaacgaagaccctactaggcaaggctgttcgctgctacgaatctttaatcttaaaagctgaaggaaaagtggagtctgacttcttttgccaattaggtcacttcaacctcttgttggaagattattcaaaagcattatctgcatatcagagatattacagtttacaggctgactactggaagaatgctgcgtttttatatggccttggtttggtctacttctactacaatgcatttcattgggcaattaaagcatttcaagatgtcctttatgttgaccccagcttttgtcgagccaaggaaattcatttacgacttgggctcatgttcaaagtgaacacagactacaagtctagtttaaagcattttcagttagccttgattgactgtaatccatgtactttgtccaatgctgaaattcaatttcatattgcccatttgtatgaaacccagaggaagtatcattctgcaaaggaggcatatgaacaacttttgcagacagaaaaccttcctgcacaagtaaaagcaactgtattgcaacagttaggttggatgcatcataatatggatctagtaggagacaaagccacaaaggaaagctatgctattcagtatctccaaaagtctttggaggcagatcctaattctggccaatcgtggtattttcttggaagtgtgttgtatcagcagcaaaatcagcctatggatgctttacaggcatatatttgtgctgtacaattggaccatgggcatgccgcagcctggatggacctaggtactctctatgaatcctgcaatcaacctcaagatgccattaaatgctacctaaatgcagctagaagcaaacgttgtagtaatacctctacgcttgctgcaagaattaaatttctacagcaatccttgtcactacacatgattacttctagccaagtagaaggcctgtccagtcctgccaagaagaaaagaacatctagtccaacaaagaatggttctgataactggaatggtggccagagtctttcacatcatccagtacagcaagtttattcgttgtgtttgacaccacagaaattacagcacttggaacaactgcgagcaaatagagataatttaaatccagcacagaagcatcagctggaacagttagaaagtcagtttgtcttaatgcagcaaatgagacacaaagaagttgctcaggtacgaactactggaattcataacggggccataactgattcatcactgcctacaaactctgtctctaatcgacaaccacatggtgctctgaccagagtatctagcgtctctcagcctggagttcgccctgcttgtgttgaaaaacttttgtccagtggagctttttctgcaggctgtattccttgtggcacatcaaaaattctaggaagtacagacactatcttgctaggcagtaattgtatagcaggaagtgaaagtaatggaaatgtgccttacctgcagcaaaatacacacactctacctcataatcatacagacctgaacagcagcacagaagagccatggagaaaacagctatctaactccgctcaggggcttcataaaagtcagagttcatgtttgtcaggacctaatgaagaacaacctctgttttccactgggtcagcccagtatcaccaggcaactagcactggtattaagaaggcgaatgaacatctcactctgcctagtaattcagtaccacagggggatgctgacagtcacctctcctgtcatactgctacctcaggtggacaacaaggcattatgtttaccaaagagagcaagccttcaaaaaatagatccttggtgcctgaaacaagcaggcatactggagacacatctaatggctgtgctgatgtcaagggactttctaatcatgttcatcagttgatagcagatgctgtttccagtcctaaccatggagattcaccaaatttattaattgcagacaatcctcagctctctgctttgttgattggaaaagccaatggcaatgtgggtactggaacctgtgacaaagtgaataatattcacccagctgttcatacaaagactgatcattctgttgcctcttcaccctcttcagccatttccacagcaacaccttctcctaaatccactgagcagagaagcataaacagtgttaccagccttaacagtcctcacagtggattacacacagtcaatggagaggggctggggaagtcacagagctctacaaaagtagacctgcctttagctagccacagatctacttctcagatcttaccatcaatgtcagtgtctatatgccccagttcaacagaagttctgaaagcatgcaggaatccaggtaaaaatggcttgtctaatagctgcattttgttagataaatgtccacctccaagaccaccaacttcaccatacccacccttgccaaaggacaagttgaatccacccacacctagtatttacttggaaaataaacgtgatgctttctttcctccattacatcaattttgtacaaatccaaaaaaccctgttacagtaatacgtggccttgctggagctcttaaattagatcttggacttttctctaccaaaactttggtagaagctaacaatgaacatatggtagaagtgaggacacagttgctgcaaccagcagatgaaaactgggatcccactggaacaaagaaaatctggcgttgtgaaagcaatagatctcatactacaattgccaaatacgcacaataccaggcttcctccttccaggaatcattgagaagtctcattctctctcacccaggctggaatgcaatggtgtgatctcagctcactgcagcctccgcctcctgggttcaagcgattctcccacctcagcctcccgaatagctggaattacaggcacctgccatcatgcccaactaatttttgtatttttgtagagacagggtttcaccatgttggccaggcttgtcttgaactcctgacctcaggtggtctgcttgcctcagcatcccaaagtgctgggattacaggtgtgagccaccatgcccggtaaacttttaaaaatgtaagcaaaattacagtatgtaaaacacacattg

SEQ ID NO: 33667 - DNA, 3210 bp, Homo sapiens
atgaaatcctgcgcagtgtcgctcactaccgccgctgttgccttcggtgatgaggcaaagaaaatggcggaaggaaaagcgagccgcgagagtgaagaggagtctgttagcctgacagtcgaggaaagggaggcgcttggtggcatggacagccgtctcttcgggttcgtgaggcttcatgaagatggcgccagaacgaagaccctactaggcaaggctgttcgctgctacgaatctttaatcttaaaagctgaaggaaaagtggagtctgacttcttttgccaattaggtcacttcaacctcttgttggaagattattcaaaagcattatctgcatatcagagatattacagtttacaggctgactactggaagaatgctgcgtttttatatggccttggtttggtctacttctactacaatgcatttcattgggcaattaaagcatttcaagatgtcctttatgttgaccccagcttttgtcgagccaaggaaattcatttacgacttgggctcatgttcaaagtgaacacagactacaagtctagtttaaagcattttcagttagccttgattgactgtaatccatgtactttgtccaatgctgaaattcaatttcatattgcccatttgtatgaaacccagaggaagtatcattctgcaaaggaggcatatgaacaacttttgcagacagaaaaccttcctgcacaagtaaaagcaactgtattgcaacagttaggttggatgcatcataatatggatctagtaggagacaaagccacaaaggaaagctatgctattcagtatctccaaaagtctttggaggcagatcctaattctggccaatcgtggtattttcttggaaggtgttattcaagtattgggaaagttcaggatgcctttatatcttacaggcaatctattgataaatcagaagcaagtgcagatacatggtgttcaataggtgtgttgtatcagcagcaaaatcagcctatggatgctttacaggcatatatttgtgctgtacaattggaccatgggcatgccgcagcctggatggacctaggtactctctatgaatcctgcaatcaacctcaagatgccattaaatgctacctaaatgcagctagaagcaaacgttgtagtaatacctctacgcttgctgcaagaattaaatttctacaggctcagttgtgtaaccttccacaaagtagtctacagaataaaactaaattacttcctagtattgaggaggcatggagcctaccaatccccgcagagcttacctccaggcagggtgccatgaacacagcacagcagcaatccttgtcactacacatgattacttctagccaagtagaaggcctgtccagtcctgccaagaagaaaagaacatctagtccaacaaagaatggttctgataactggaatggtggccagagtctttcacatcatccagtacagcaagtttattcgttgtgtttgacaccacagaaattacagcacttggaacaactgcgagcaaatagagataatttaaatccagcacagaagcatcagctggaacagttagaaagtcagtttgtcttaatgcagcaaatgagacacaaagaagttgctcaggtacgaactactggaattcataacggggccataactgattcatcactgcctacaaactctgtctctaatcgacaaccacatggtgctctgaccagagtatctagcgtctctcagcctggagttcgccctgcttgtgttgaaaaacttttgtccagtggagctttttctgcaggctgtattccttgtggcacatcaaaaattctaggaagtacagacactatcttgctaggcagtaattgtatagcaggaagtgaaagtaatggaaatgtgccttacctgcagcaaaatacacacactctacctcataatcatacagacctgaacagcagcacagaagagccatggagaaaacagctatctaactccgctcaggggcttcataaaagtcagagttcatgtttgtcaggacctaatgaagaacaacctctgttttccactgggtcagcccagtatcaccaggcaactagcactggtattaagaaggcgaatgaacatctcactctgcctagtaattcagtaccacagggggatgctgacagtcacctctcctgtcatactgctacctcaggtggacaacaaggcattatgtttaccaaagagagcaagccttcaaaaaatagatccttggtgcctgaaacaagcaggcatactggagacacatctaatggctgtgctgatgtcaagggactttctaatcatgttcatcagttgatagcagatgctgtttccagtcctaaccatggagattcaccaaatttattaattgcagacaatcctcagctctctgctttgttgattggaaaagccaatggcaatgtgggtactggaacctgtgacaaagtgaataatattcacccagctgttcatacaaagactgatcattctgttgcctcttcaccctcttcagccatttccacagcaacaccttctcctaaatccactgagcagagaagcataaacagtgttaccagccttaacagtcctcacagtggattacacacagtcaatggagaggggctggggaagtcacagagctctacaaaagtagacctgcctttagctagccacagatctacttctcagatcttaccatcaatgtcagtgtctatatgccccagttcaacagaagttctgaaagcatgcaggaatccaggtaaaaatggcttgtctaatagctgcattttgttagataaatgtccacctccaagaccaccaacttcaccatacccacccttgccaaaggacaagttgaatccacccacacctagtatttacttggaaaataaacgtgatgctttctttcctccattacatcaattttgtacaaatccaaaaaaccctgttacagtaatacgtggccttgctggagctcttaaattagatcttggacttttctctaccaaaactttggtagaagctaacaatgaacatatggtagaagtgaggacacagttgctgcaaccagcagatgaaaactgggatcccactggaacaaagaaaatctggcgttgtgaaagcaatagatctcatactacaattgccaaatacgcacaataccaggcttcctccttccaggaatcattgaga

SEQ ID NO: 33668 - DNA, 1128 bp, Homo sapiens
gggaccgccctcagcagtgtggttagcaggcagggccagtgtgaccctccctttctgggcctcagttgagaaacctgaagctcaggagaggagtcactcccctggcagatgggtggctgggccagaagcagataccaggctttctgactcctgctctaggattctcaccacgtactggctagacttatacttctcaaatcttaatttcctaaaggccggtcatgcccaacatggtcttcattggaggtatcaactgtaagaagaggaaagacttgtctcaggaatttgaagcctacattaatgcttctggagaacatggaattgtggttttctctttgggatcaatggtctcagaaattccagagaagaaagctatggcaattgctgatgctttgggcaaaatccctcagacagtcctgtggcggtacactggaacccgaccatcgaatcttgcgaacaacacgatacttgttaagtggctaccccaaaacgatctgcttggtcacccgatgacccgtgcctttatcacccatgctggttcccatggtgtttatgaaagcatatgcaatggcgttcccatggtgatgatgcccttgtttggtgatcagatggacaatgcaaagcgcatggagactaagggagctggagtgaccctgaatgttctggaaatgacttctgaagatttagaaaatgctctaaaagcagtcatcaatgacaaaagttacaaggagaacatcatgcgcctctccagccttcacaaggaccgcccggtggagccgctggacctggccgtgttctgggtggagtttgtgatgaggcacaagggcgcgccacacctgcgccccgcagcccacgacctcacctggtaccagtaccattccttggacgtgattggtttcctcttggccgtcgtgctgacagtggccttcatcacctttaaatgttgtgcttatggctaccggaaatgcttggggaaaaaagggcgagttaagaaagcccacaaatccaagacccattgagaagtgggtgggaaataaggtaaaattttgaaccattccctagtcatttccaaacttgaaaacagaatcagtgttaaattcattttattcttattaaggaaatactttg

SEQ ID NO: 33669 - DNA, 2345 bp, Homo sapiens
atggccacaggactccaggttcccctgccgcagctggccacaggactgctgcttctcctcagtgtccagccctgggctgagagtgggaaggtgctggtggtgcccactgatggcagccactggctcagcatgcgggaggccttgcgggacctccatgcgagaggccaccaggtggtggtcctcaccctggaggtgaatatgtacatcaaagaagagaactttttcaccctgacaacgtatgccatttcatggacccaggacgaatttgatcgccttttgctgggtcacactcaatcgttctttgaaacagaacatcttctgatgaaattttctagaagaatggcaattatgaacaatatgtctttgatcatacataggtcttgtgtggagctactgcataatgaggccctgatcaggcacctgcatgctacttcctttgatgtggttctaacagacccctttcacctctgcgcggcggtgctggctaagtacctgtcgattcctgctgtgtttttcttgaggaacattccatgtgatttagactttaagggcacacagtgtccaaacccttcctcctatattcctagattactaacgaccaattcagaccacatgacattcctgcaaagggtcaagaacatgctctaccctctggccctgtcctacctttgccatgctgtttctgctccttatgcaagccttgcctctgagctttttcagagagaggtgtcagtggtggatcttgtcagccatgcatctgtgtggctgttccgaggggactttgtgatggattaccccaggccgatcatgcccaacatggtcttcattgggggcatcaactgtgccaacgggaagccactatctcaggaatttgaagcctacattaatgcttctggagaacatggaattgtggttttctctttgggatcaatggtctcagaaattccagagaagaaagctatggcaattgctgatgctttgggcaaaatccctcagacagtcctgtggcggtacactggaacccgaccatcgaatcttgcgaacaacacgatacttgttaagtggctaccccaaaacgatctgcttggtcacccgatgacccgtgcctttatcacccatgctggttcccatggtgtttatgaaagcatatgcaatggcgttcccatggtgatgatgcccttgtttggtgatcagatggacaatgcaaagcgcatggagactaagggagctggagtgaccctgaatgttctggaaatgacttctgaagatttagaaaatgctctaaaagcagtcatcaatgacaaaagttacaaggagaacatcatgcgcctctccagccttcacaaggaccgcccggtggagccgctggacctggccgtgttctgggtggagtttgtgatgaggcacaagggcgcgccacacctgcgccccgcagcccacgacctcacctggtaccagtaccattccttggacgtgattggtttcctcttggccgtcgtgctgacagtggccttcatcacctttaaatgttgtgcttatggctaccggaaatgcttggggaaaaaagggcgagttaagaaagcccacaaatccaagacccattgagaagtgggtgggaaataaggtaaaattttgaaccattccctagtcatttccaaacttgaaaacagaatcagtgttaaattcattttattcttattaaggaaatactttgcataaattaatcagccccagagtgctttaaaaaattctcttaaataaaaataatagactcgctagtcagtaaagatatttgaatatgtatcgtgccccctctggtgtctttgatcaggatgacatgtgccatttttcagaggacgtgcagacaggctggcattctagattacttttcttactctgaaacatggcctgtttgggagtgcgggattcaaaggtggtcccacggctgcccctactgcaaatggcagttttaatcttatcttttggcttctgcagatggttgcaattgatccttaaccaataatggtcagtcctcatctctgtcgtgcttcataggtgccaccttgtgtgtttaaagaagggaagctttgtacctttagagtgtaggtgaaatgaatgaatggcttggagtgcactgagaacagcatatgatttcttgctttggggaaaaagaatgatgctatgaaattggtgggtggtgtatttgagaagataatcattgcttatgtcaaatggagctgaatttgataaaaacccaaaatacagctatgaagtgctgggcaagtttactttttttctgatgtttcctacaactaaaaataaattaataaatttatataaattct

SEQ ID NO: 33670 - DNA, 2479 bp, Homo sapiens
aaagggtaaaattcagagcaagggagaggtagacaggacctgtgaaaagcagtggttagtttagggaaaatacctaggagccctgtgatttggagagtgaaaactctttattaccgttgttactttaactctttccaggatggcctgcctccttcgctcatttcagagaatttctgcaggggttttcttcttagcactttggggcatggttgtaggtgacaagctgctggtggtccctcaggacggaagccactggcttagtatgaaggatatagttgaggttctcagtgaccggggtcatgagattgtagtggtggtgcctgaagttaatttgcttttgaaagaatccaaatactacacaagaaaaatctatccagtgccgtatgaccaagaagagctgaagaaccgttaccaatcatttggaaacaatcactttgctgagcgatcattcctaactgctcctcagacagagtacaggaataacatgattgttattggcctgtacttcatcaactgccagagcctcctgcaggacagggacaccctgaacttctttaaggagagcaagtttgatgctcttttcacagacccagccttaccctgtggggtgatcctggctgagtatttgggcctaccatctgtgtacctcttcaggggttttccgtgttccctggagcatacattcagcagaagcccagaccctgtgtcctacattcccaggtgctacacaaagttttcagaccacatgactttttcccaacgagtggccaacttccttgttaatttgttggagccctatctattttattgtctgttttcaaagtatgaagaactcgcatcagctgtcctcaagagagatgtggatataatcaccttatatcagaaggtctctgtttggctgttaagatatgactttgtgcttgaatatcctaggccggtcatgcccaacatggtcttcattggaggtatcaactgtaagaagaggaaagacttgtctcaggaatttgaagcctacattaatgcttctggagaacatggaattgtggttttctctttgggatcaatggtctcagaaattccagagaagaaagctatggcaattgctgatgctttgggcaaaatccctcagacagtcctgtggcggtacactggaacccgaccatcgaatcttgcgaacaacacgatacttgttaagtggctaccccaaaacgatctgcttggtcacccgatgacccgtgcctttatcacccatgctggttcccatggtgtttatgaaagcatatgcaatggcgttcccatggtgatgatgcccttgtttggtgatcagatggacaatgcaaagcgcatggagactaagggagctggagtgaccctgaatgttctggaaatgacttctgaagatttagaaaatgctctaaaagcagtcatcaatgacaaaagttacaaggagaacatcatgcgcctctccagccttcacaaggaccgcccggtggagccgctggacctggccgtgttctgggtggagtttgtgatgaggcacaagggcgcgccacacctgcgccccgcagcccacgacctcacctggtaccagtaccattccttggacgtgattggtttcctcttggccgtcgtgctgacagtggccttcatcacctttaaatgttgtgcttatggctaccggaaatgcttggggaaaaaagggcgagttaagaaagcccacaaatccaagacccattgagaagtgggtgggaaataaggtaaaattttgaaccattccctagtcatttccaaacttgaaaacagaatcagtgttaaattcattttattcttattaaggaaatactttgcataaattaatcagccccagagtgctttaaaaaattctcttaaataaaaataatagactcgctagtcagtaaagatatttgaatatgtatcgtgccccctctggtgtctttgatcaggatgacatgtgccatttttcagaggacgtgcagacaggctggcattctagattacttttcttactctgaaacatggcctgtttgggagtgcgggattcaaaggtggtcccacggctgcccctactgcaaatggcagttttaatcttatcttttggcttctgcagatggttgcaattgatccttaaccaataatggtcagtcctcatctctgtcgtgcttcataggtgccaccttgtgtgtttaaagaagggaagctttgtacctttagagtgtaggtgaaatgaatgaatggcttggagtgcactgagaacagcatatgatttcttgctttggggaaaaagaatgatgctatgaaattggtgggtggtgtatttgagaagataatcattgcttatgtcaaatggagctgaatttgataaaaacccaaaatacagctatgaagtgctgggcaagtttactttttttctgatgtttcctacaactaaaaataaattaataaatttatataaattcta

SEQ ID NO: 33671 - DNA, 745 bp, Homo sapiens
agtgtgaccctccctttctgggcctcagttgagaaacctgaagctcaggagaggagtcactcccctggcagatgggtggctgggccagaagcagataccaggctttctgactcctgctctaggattctcaccacgtactggctagacttatacttctcaaatcttaatttcctaaaggatggcctgcctccttcgctcatttcagagaatttctgcaggggttttcttcttagcactttggggcatggttgtaggtgacaagctgctggtggtccctcaggacggaagccactggcttagtatgaaggatatagttgaggttctcagtgaccggggtcatgagattgtagtggtggtgcctgaagttaatttgcttttgaaagaatccaaatactacacaagaaaaatctatccagtgccgtatgaccaagaagagctgaagaaccgttaccaatcatttggaaacaatcactttgctgagcgatcattcctaactgctcctcagacagagtacaggaataacatgattgttattggcctgtacttcatcaactgccagagcctcctgcaggacagggacaccctgaacttctttaaggagagcaagtttgatgctcttttcacagacccagccttaccctgtggggtgatcctggctgagtatttgggcctaccatctgtgtacctcttcaggggttttccgtgttccctggagcatacattcagcagaagcccagaccctgtg

SEQ ID NO: 33672 - DNA, 2333 bp, Homo sapiens
atggctcgtgcagggtggactggcctccttcccctatatgtgtgtctactgctgacctgtggctttgccaaggcagggaagctgctggtagtgcccatggatgggagccactggttcaccatgcagtcggtggtggagaaactcatcctcagggggcatgaggtggtcgtagtcatgccagaggtgagttggcaactgggaagatcactgaattgcacagtgaagacttactcaacctcatacactctggaggatcaggaccgggagttcatggtttttgccgatgctcgctggacggcaccattgcgaagtgcattttctctattaacaagttcatccaatggtatttttgacttatttttttcaaattgcaggagtttgtttaatgaccgaaaattagtagaatacttaaaggagagttgttttgatgcagtgtttctcgatccttttgatgcctgtggcttaattgttgccaaatatttctccctcccctctgtggtcttcgccaggggaatattttgccactatcttgaagaaggtgcacagtgccctgctcctctttcctatgtccccagacttctcttagggttctcagacgccatgactttcaaggagagagtatggaaccacatcatgcacttggaggaacatttattttgcccctattttttcaaaaatgtcttagaaatagcctctgaaattctccaaacccctgtcacggcatatgatctctacagccacacatcaatttggttgttgcgaactgactttgttttggagtatcccaaacccgtgatgcccaatatgatcttcattggtggtatcaactgtcatcagggaaagccagtgcctatggaatttgaagcctacattaatgcttctggagaacatggaattgtggttttctctttgggatcaatggtctcagaaattccagagaagaaagctatggcaattgctgatgctttgggcaaaatccctcagacagtcctgtggcggtacactggaacccgaccatcgaatcttgcgaacaacacgatacttgttaagtggctaccccaaaacgatctgcttggtcacccgatgacccgtgcctttatcacccatgctggttcccatggtgtttatgaaagcatatgcaatggcgttcccatggtgatgatgcccttgtttggtgatcagatggacaatgcaaagcgcatggagactaagggagctggagtgaccctgaatgttctggaaatgacttctgaagatttagaaaatgctctaaaagcagtcatcaatgacaaaagttacaaggagaacatcatgcgcctctccagccttcacaaggaccgcccggtggagccgctggacctggccgtgttctgggtggagtttgtgatgaggcacaagggcgcgccacacctgcgccccgcagcccacgacctcacctggtaccagtaccattccttggacgtgattggtttcctcttggccgtcgtgctgacagtggccttcatcacctttaaatgttgtgcttatggctaccggaaatgcttggggaaaaaagggcgagttaagaaagcccacaaatccaagacccattgagaagtgggtgggaaataaggtaaaattttgaaccattccctagtcatttccaaacttgaaaacagaatcagtgttaaattcattttattcttattaaggaaatactttgcataaattaatcagccccagagtgctttaaaaaattctcttaaataaaaataatagactcgctagtcagtaaagatatttgaatatgtatcgtgccccctctggtgtctttgatcaggatgacatgtgccatttttcagaggacgtgcagacaggctggcattctagattacttttcttactctgaaacatggcctgtttgggagtgcgggattcaaaggtggtcccacggctgcccctactgcaaatggcagttttaatcttatcttttggcttctgcagatggttgcaattgatccttaaccaataatggtcagtcctcatctctgtcgtgcttcataggtgccaccttgtgtgtttaaagaagggaagctttgtacctttagagtgtaggtgaaatgaatgaatggcttggagtgcactgagaacagcatatgatttcttgctttggggaaaaagaatgatgctatgaaattggtgggtggtgtatttgagaagataatcattgcttatgtcaaatggagctgaatttgataaaaacccaaaatacagctatgaagtgctgggcaagtttactttttttctgatgtttcctacaactaaaaataaattaataaatttatataaattct

SEQ ID NO: 33673 - DNA, 2407 bp, Homo sapiens
cttccgcctactgtatcatagcagcttagaatcccagctgctggctcgggctgcagttctctcatggctcgcacagggtggaccagccccattcccctatgtgtttctctgctgctgacctgtggctttgctgaggcagggaagctgctggtagtgcccatggatgggagtcactggttcaccatgcagtcggtggtggagaaacttatcctcagggggcatgaggtggttgtagtcatgccagaggtgagttggcaactgggaaaatcactgaattgcacagtgaagacttactcaacctcatacactctggaggatctggaccgggaattcatggatttcgccgatgctcaatggaaagcacaagtacgaagtttgttttctctatttctgagttcatccaatggtttttttaacttatttttttcgcattgcaggagtttgtttaatgaccgaaaattagtagaatacttaaaggagagttcttttgatgcggtgtttcttgatccttttgatgcctgtggcttaattgttgccaaatatttctccctcccctctgtggtcttcgccaggggaatagcttgccactatcttgaagaaggtgcacagtgccctgctcctctttcctatgtccccagaattctcttagggttctcagatgccatgactttcaaggagagagtacggaaccacatcatgcacttggaggaacatttattttgccagtatttttccaaaaatgccctagaaatagcctctgaaattctccaaacacctgtcacagcatatgatctctacagccacacatcaatttggttgttgcgaacagactttgttttggactatcccaaacccgtgatgcccaatatgatcttcattggtggtatcaactgccatcagggaaagccattgcctatggaatttgaagcctacattaatgcttctggagaacatggaattgtggttttctctttgggatcaatggtctcagaaattccagagaagaaagctatggcaattgctgatgctttgggcaaaatccctcagacagtcctgtggcggtacactggaacccgaccatcgaatcttgcgaacaacacgatacttgttaagtggctaccccaaaacgatctgcttggtcacccgatgacccgtgcctttatcacccatgctggttcccatggtgtttatgaaagcatatgcaatggcgttcccatggtgatgatgcccttgtttggtgatcagatggacaatgcaaagcgcatggagactaagggagctggagtgaccctgaatgttctggaaatgacttctgaagatttagaaaatgctctaaaagcagtcatcaatgacaaaagttacaaggagaacatcatgcgcctctccagccttcacaaggaccgcccggtggagccgctggacctggccgtgttctgggtggagtttgtgatgaggcacaagggcgcgccacacctgcgccccgcagcccacgacctcacctggtaccagtaccattccttggacgtgattggtttcctcttggccgtcgtgctgacagtggccttcatcacctttaaatgttgtgcttatggctaccggaaatgcttggggaaaaaagggcgagttaagaaagcccacaaatccaagacccattgagaagtgggtgggaaataaggtaaaattttgaaccattccctagtcatttccaaacttgaaaacagaatcagtgttaaattcattttattcttattaaggaaatactttgcataaattaatcagccccagagtgctttaaaaaattctcttaaataaaaataatagactcgctagtcagtaaagatatttgaatatgtatcgtgccccctctggtgtctttgatcaggatgacatgtgccatttttcagaggacgtgcagacaggctggcattctagattacttttcttactctgaaacatggcctgtttgggagtgcgggattcaaaggtggtcccacggctgcccctactgcaaatggcagttttaatcttatcttttggcttctgcagatggttgcaattgatccttaaccaataatggtcagtcctcatctctgtcgtgcttcataggtgccaccttgtgtgtttaaagaagggaagctttgtacctttagagtgtaggtgaaatgaatgaatggcttggagtgcactgagaacagcatatgatttcttgctttggggaaaaagaatgatgctatgaaattggtgggtggtgtatttgagaagataatcattgcttatgtcaaatggagctgaatttgataaaaacccaaaatacagctatgaagtgctgggcaagtttactttttttctgatgtttcctacaactaaaaataaattaataaatttatataaattctatttaagtgtt

SEQ ID NO: 33674 - DNA, 2416 bp, Homo sapiens
ggttttgtgctggtatttctcccacctactgtatcataggagcttagattcccagctgcttgctctcagctgcagttctctgatggcttgcacagggtggaccagcccccttcctctatgtgtgtgtctgctgctgacctgtggctttgccgaggcagggaagctactggtagtgcccatggatgggagccactggttcaccatgaggtcggtggtggagaaactcattctcagggggcatgaggtggttgtagtcatgccagaggtgagttggcaactgggaagatcactgaattgcacagtgaagacttattcaacttcatataccctggaggatctggaccgggagttcaaggcttttgcccatgctcaatggaaagcacaagtacgaagtatatattctctattaatgggttcatacaatgacatttttgacttatttttttcaaattgcaggagtttgtttaaagacaaaaaattagtagaatacttaaaggagagttcttttgatgcagtgtttctcgatccttttgataactgtggcttaattgttgccaaatatttctccctcccctccgtggtcttcgccaggggaatactttgccactatcttgaagaaggtgcacagtgccctgctcctctttcctatgtccccagaattctcttagggttctcagatgccatgactttcaaggagagagtacggaaccacatcatgcacttggaggaacatttattatgccaccgttttttcaaaaatgccctagaaatagcctctgaaattctccaaacacctgttacggagtatgatctctacagccacacatcaatttggttgttgcgaacggactttgttttggactatcccaaacccgtgatgcccaacatgatcttcattggtggtatcaactgccatcagggaaagccgttgcctatggaatttgaagcctacattaatgcttctggagaacatggaattgtggttttctctttgggatcaatggtctcagaaattccagagaagaaagctatggcaattgctgatgctttgggcaaaatccctcagacagtcctgtggcggtacactggaacccgaccatcgaatcttgcgaacaacacgatacttgttaagtggctaccccaaaacgatctgcttggtcacccgatgacccgtgcctttatcacccatgctggttcccatggtgtttatgaaagcatatgcaatggcgttcccatggtgatgatgcccttgtttggtgatcagatggacaatgcaaagcgcatggagactaagggagctggagtgaccctgaatgttctggaaatgacttctgaagatttagaaaatgctctaaaagcagtcatcaatgacaaaagttacaaggagaacatcatgcgcctctccagccttcacaaggaccgcccggtggagccgctggacctggccgtgttctgggtggagtttgtgatgaggcacaagggcgcgccacacctgcgccccgcagcccacgacctcacctggtaccagtaccattccttggacgtgattggtttcctcttggccgtcgtgctgacagtggccttcatcacctttaaatgttgtgcttatggctaccggaaatgcttggggaaaaaagggcgagttaagaaagcccacaaatccaagacccattgagaagtgggtgggaaataaggtaaaattttgaaccattccctagtcatttccaaacttgaaaacagaatcagtgttaaattcattttattcttattaaggaaatactttgcataaattaatcagccccagagtgctttaaaaaattctcttaaataaaaataatagactcgctagtcagtaaagatatttgaatatgtatcgtgccccctctggtgtctttgatcaggatgacatgtgccatttttcagaggacgtgcagacaggctggcattctagattacttttcttactctgaaacatggcctgtttgggagtgcgggattcaaaggtggtcccacggctgcccctactgcaaatggcagttttaatcttatcttttggcttctgcagatggttgcaattgatccttaaccaataatggtcagtcctcatctctgtcgtgcttcataggtgccaccttgtgtgtttaaagaagggaagctttgtacctttagagtgtaggtgaaatgaatgaatggcttggagtgcactgagaacagcatatgatttcttgctttggggaaaaagaatgatgctatgaaattggtgggtggtgtatttgagaagataatcattgcttatgtcaaatggagctgaatttgataaaaacccaaaatacagctatgaagtgctgggcaagtttactttttttctgatgtttcctacaactaaaaataaattaataaatttatataaattcta

SEQ ID NO: 33675 - DNA, 1698 bp, Homo sapiens
acattcggcttcttcctaatgtcaaatgagtgctgttaaagttcctccaggaaacttcagcagagaaaaacatttgcttcacatctcatcaaatcttctgcatcaagccacatcatgttaaacaaccttctgctgttctcccttcagataagtctcataggaaccactcttggtgggaatgttttgatttggccaatggaaggtagtcattggctaaatgttaagataattatagatgagctcattaaaaaggagcataatgtgactgtcctagttgcctctggtgcacttttcatcacaccaacctctaacccatctctgacatttgaaatatatagggtgccctttggcaaagaaagaatagaaggagtaattaaggacttcgttttgacatggctggaaaatagaccatctccttcaaccatttggagattctatcaggagatggccaaagtaatcaaggacttccacatggtgtctcaggagatctgtgatggcgttcttaaaaaccaacagctgatggcaaagctaaagaaaagcaagtttgaagtcctggtgtctgatccagtatttccttgtggcgatatagtagctttaaaacttggaattccatttatgtactccttgaggttttctccagcctcaacagtggaaaagcactgtgggaaggtaccataccctccttcctatgttcctgctgttttatcagaactcaccgaccaaatgtctttcactgacagaataagaaatttcatctcctaccacctacaggactacatgtttgaaactctttggaaatcatgggattcatactatagtaaagctttaggtggactcttactctgttgcccaggctggagtgcagtggcggatcttggctcactgcaacctctgcttcccgggttcaagcgattctcccgcctcagcctccattgtagttgggattacaggctgccagcaggaagacccactacgttatgtgagactatggggaaagctgaaatttggttaatccgaacatattgggattttgaatttcctcgtccatacttacctaattttgagtttgttggaggattgcactgcaaacctgccaaacctttacctaaggttttatggagatacaaaggaaagaaaccagccacattaggaaacaatactcagctctttgattggataccccagaatgatcttcttggacatcccaaaaccaaagcttttatcactcatggtggaactaatgggatctacgaagctatttaccacggagtccctatggtgggagttcccatgtttgctgatcagcctgataacattgctcacatgaaggccaaaggagcagctgtggaagtgaacctaaacacaatgacaagtgtggatttgcttagcgctttgagaacagtcattaatgaaccttcttataaagagaatgctatgaggttatcaagaattcaccatgatcaacctgtaaagcccctggatcgagcagtcttctggatcgagtttgtcatgcgccacaaaggagccaagcaccttcgggttgcagcccatgacctcacctggttccagtaccactctttggatgtaattgggttcttgctggtctgtgtgacaacggctatatttttggtcatacaatgttgtttgttttcctgtcaaaaatttggtaagataggaaagaagaaaaaaagagaatag

SEQ ID NO: 33676 - DNA, 2376 bp, Homo sapiens
ttacattcggcttcttcctaatgtcaaatgagtgctgttaaagttcctccaggaaacttcagcagagaaaaacatttgcttcacatctcatcaaatcttctgcatcaagccacatcatgttaaacaaccttctgctgttctcccttcagataagtctcataggaaccactcttggtgggaatgttttgatttggccaatggaaggtagtcattggctaaatgttaagataattatagatgagctcattaaaaaggagcataatgtgactgtcctagttgcctctggtgcacttttcatcacaccaacctctaacccatctctgacatttgaaatatatagggtgccctttggcaaagaaagaatagaaggagtaattaaggacttcgttttgacatggctggaaaatagaccatctccttcaaccatttggagattctatcaggagatggccaaagtaatcaaggacttccacatggtgtctcaggagatctgtgatggcgttcttaaaaaccaacagctgatggcaaagctaaagaaaagcaagtttgaagtcctggtgtctgatccagtatttccttgtggcgatatagtagctttaaaacttggaattccatttatgtactccttgaggttttctccagcctcaacagtggaaaagcactgtgggaaggtaccataccctccttcctatgttcctgctgttttatcagaactcaccgaccaaatgtctttcactgacagaataagaaatttcatctcctaccacctacaggactacatgtttgaaactctttggaaatcatgggattcatactatagtaaagctttagatggtagccattggttaaatattaagattattctagaagagttgattcaaagaaatcacaatgtgactgtactggcttcatcagcaactctattcatcaactccaatcccgattctcctgtgaattttgaagtgatacctgtttcctacaagaagagcaatatagattccttaattgagcatatgataatgctgtggattgaccatagaccaactcctctcacaatatgggctttctacaaagaactaggaaaacttctagacactttctttcaaattaacatacaactctgtgatggtgtactaaagaacccaaagttgatggcaagacttcagaaaggtggttttgatgtgttggtagcagacccagtaacaatctgtggtgatcttgttgctctgaaattaggaattccatttatgtacacattgaggttctctccagcatcaacagtggagagacactgtgggaaaatcccagcaccagtctcctatgtaccggcagccttatcagagctcactgaccagatgacctttggtgaaaggattaaaaataccatatcttattctctgcaagactatatatttcagtcctactggggagaatggaattcatactatagcaaaattttaggaagacccactacgttatgtgagactatggggaaagctgaaatttggttaatccgaacatattgggattttgaatttcctcgtccatacttacctaattttgagtttgttggaggattgcactgcaaacctgccaaacctttacctaaggttttatggagatacaaaggaaagaaaccagccacattaggaaacaatactcagctctttgattggataccccagaatgatcttcttggacatcccaaaaccaaagcttttatcactcatggtggaactaatgggatctacgaagctatttaccacggagtccctatggtgggagttcccatgtttgctgatcagcctgataacattgctcacatgaaggccaaaggagcagctgtggaagtgaacctaaacacaatgacaagtgtggatttgcttagcgctttgagaacagtcattaatgaaccttcttataaagagaatgctatgaggttatcaagaattcaccatgatcaacctgtaaagcccctggatcgagcagtcttctggatcgagtttgtcatgcgccacaaaggagccaagcaccttcgggttgcagcccatgacctcacctggttccagtaccactctttggatgtaattgggttcttgctggtctgtgtgacaacggctatatttttggtcatacaatgttgtttgttttcctgtcaaaaatttggtaagataggaaagaagaaaaaaagagaataggtcaagaaaaagaggaaatatatatatttttaagtttggcaaaatcctgagtagtgtagtcctattaattccagacaaaaggagtttaacaaaaacacgtctcccatcctgtttccaaattttctatttctctacctgcgataagcctactgataaagcctagattttggcatgatta

SEQ ID NO: 33677 - DNA, 2566 bp, Homo sapiens
atggtttccataagggattttaccatgcctaagaagtttgtccagatgctggtttttaatttgactctgactgaagttgttctaagtgggaatgtgttaatttggcctacagatggtagccattggttaaatattaagattattctagaagagttgattcaaagaaatcacaatgtgactgtactggcttcatcagcaactctattcatcaactccaatcccgattctcctgtgaattttgaagtgatacctgtttcctacaagaagagcaatatagattccttaattgagcatatgataatgctgtggattgaccatagaccaactcctctcacaatatgggctttctacaaagaactaggaaaacttctagacactttctttcaaattaacatacaactctgtgatggtgtactaaagaacccaaagttgatggcaagacttcagaaaggtggttttgatgtgttggtagcagacccagtaacaatctgtggtgatcttgttgctctgaaattaggaattccatttatgtacacattgaggttctctccagcatcaacagtggagagacactgtgggaaaatcccagcaccagtctcctatgtaccggcagccttatcagagctcactgaccagatgacctttggtgaaaggattaaaaataccatatcttattctctgcaagactatatatttcagtcctactggggagaatggaattcatactatagcaaaattttaggaagacccactacgttatgtgagactatggggaaagctgaaatttggttaatccgaacatattgggattttgaatttcctcgtccatacttacctaattttgagtttgttggaggattgcactgcaaacctgccaaacctttacctaaggaaatggaagaatttatccagagctcaggtaaaaatggtgttgtggtgttttctctgggatcaatggtcaaaaaccttacagaagaaaaggccaatcttattgcctcagcccttgcccagattccacagaaggttttatggagatacaaaggaaagaaaccagccacattaggaaacaatactcagctctttgattggataccccagaatgatcttcttggacatcccaaaaccaaagcttttatcactcatggtggaactaatgggatctacgaagctatttaccacggagtccctatggtgggagttcccatgtttgctgatcagcctgataacattgctcacatgaaggccaaaggagcagctgtggaagtgaacctaaacacaatgacaagtgtggatttgcttagcgctttgagaacagtcattaatgaaccttcttataaagagaatgctatgaggttatcaagaattcaccatgatcaacctgtaaagcccctggatcgagcagtcttctggatcgagtttgtcatgcgccacaaaggagccaagcaccttcgggttgcagcccatgacctcacctggttccagtaccactctttggatgtaattgggttcttgctggtctgtgtgacaacggctatatttttggtcatacaatgttgtttgttttcctgtcaaaaatttggtaagataggaaagaagaaaaaaagagaataggtcaagaaaaagaggaaatatatatatttttaagtttggcaaaatcctgagtagtgtagtcctattaattccagacaaaaggagtttaacaaaaacacgtctcccatcctgtttccaaattttctatttctctacctgcgataagcctactgataaagcctagattttggcatgattattattaacttgtgagttatagtcttctatttttcctttgtctctccctgctgactataccctcttcctgtcacttttctgacacaaggatactacctaattttaaatatgttctattcatagtatcaaattattttatcgttaaccttaattaatgattaacaatatgctgaatcctggtaatgcatacagtgtagatggaatttgataggtgtaaggaagagtcaaattcacaaatttccatataccaaacaaatcagggagccaccgtaggagagtagtgtgttatgagaaaggtaatgatttccttttttaataaaaacaaactcttctgcttgctcaatgtttcaggagttagagaatgaattttaagtgtgacgtgcgtccctattaaatgtctacaaaattttcattaagcatatctagaaaatcacggcataacttgcctgcctttcttcaacatatattcttatataacctgtagtggaagatttgggtactgtctttaataaatcaatcaatcgactcttttatttcaaggagaaagttctatgttatatgttgaaggtgaacagatcatatttagaggatataacaattagaaatctagaaaataattatcatttttataaaatttttagtcaactgtacaaataattacataaaacatcaattaattatgcttaaaaatcactaatgttcataatatataatcactatttgtaatcaaaagtttaattttatgccaaaaaataaaaaatgcttacttggaatttga

SEQ ID NO: 33678 - DNA, 2595 bp, Homo sapiens
agcagagaaaaacatttgcttcacatctcatcaaatcttctgcatcaagccacatcatgttaaacaaccttctgctgttctcccttcagataagtctcataggaaccactcttggtgggaatgttttgatttggccaatggaaggtagtcattggctaaatgttaagataattatagatgagctcattaaaaaggagcataatgtgactgtcctagttgcctctggtgcacttttcatcacaccaacctctaacccatctctgacatttgaaatatatagggtgccctttggcaaagaaagaatagaaggagtaattaaggacttcgttttgacatggctggaaaatagaccatctccttcaaccatttggagattctatcaggagatggccaaagtaatcaaggacttccacatggtgtctcaggagatctgtgatggcgttcttaaaaaccaacagctgatggcaaagctaaagaaaagcaagtttgaagtcctggtgtctgatccagtatttccttgtggcgatatagtagctttaaaacttggaattccatttatgtactccttgaggttttctccagcctcaacagtggaaaagcactgtgggaaggtaccataccctccttcctatgttcctgctgttttatcagaactcaccgaccaaatgtctttcactgacagaataagaaatttcatctcctaccacctacaggactacatgtttgaaactctttggaaatcatgggattcatactatagtaaagctttaggaagacccactacgttatgtgagactatggggaaagctgaaatttggttaatccgaacatattgggattttgaatttcctcgtccatacttacctaattttgagtttgttggaggattgcactgcaaacctgccaaacctttacctaaggaaatggaagaatttatccagagctcaggtaaaaatggtgttgtggtgttttctctgggatcaatggtcaaaaaccttacagaagaaaaggccaatcttattgcctcagcccttgcccagattccacagaaggttttatggagatacaaaggaaagaaaccagccacattaggaaacaatactcagctctttgattggataccccagaatgatcttcttggacatcccaaaaccaaagcttttatcactcatggtggaactaatgggatctacgaagctatttaccacggagtccctatggtgggagttcccatgtttgctgatcagcctgataacattgctcacatgaaggccaaaggagcagctgtggaagtgaacctaaacacaatgacaagtgtggatttgcttagcgctttgagaacagtcattaatgaaccttcttataaagagaatgctatgaggttatcaagaattcaccatgatcaacctgtaaagcccctggatcgagcagtcttctggatcgagtttgtcatgcgccacaaaggagccaagcaccttcgggttgcagcccatgacctcacctggttccagtaccactctttggatgtaattgggttcttgctggtctgtgtgacaacggctatatttttggtcatacaatgttgtttgttttcctgtcaaaaatttggtaagataggaaagaagaaaaaaagagaataggtcaagaaaaagaggaaatatatatatttttaagtttggcaaaatcctgagtagtgtagtcctattaattccagacaaaaggagtttaacaaaaacacgtctcccatcctgtttccaaattttctatttctctacctgcgataagcctactgataaagcctagattttggcatgattattattaacttgtgagttatagtcttctatttttcctttgtctctccctgctgactataccctcttcctgtcacttttctgacacaaggatactacctaattttaaatatgttctattcatagtatcaaattattttatcgttaaccttaattaatgattaacaatatgctgaatcctggtaatgcatacagtgtagatggaatttgataggtgtaaggaagagtcaaattcacaaatttccatataccaaacaaatcagggagccaccgtaggagagtagtgtgttatgagaaaggtaatgatttccttttttaataaaaacaaactcttctgcttgctcaatgtttcaggagttagagaatgaattttaagtgtgacgtgcgtccctattaaatgtctacaaaattttcattaagcatatctagaaaatcacggcataacttgcctgcctttcttcaacatatattcttatataacctgtagtggaagatttgggtactgtctttaataaatcaatcaatcgactcttttatttcaaggagaaagttctatgttatatgttgaaggtgaacagatcatatttagaggatataacaattagaaatctagaaaataattatcatttttataaaatttttagtcaactgtacaaataattacataaaacatcaattaattatgcttaaaaatcactaatgttcataatatataatcactatttgtaatcaaaagtttaattttatgccaaaaaataaaaaatgcttacttggaatttga

SEQ ID NO: 33679 - DNA, 586 bp, Homo sapiens
acattcggcttcttcctaatgtcaaatgagtgctgttaaagttcctccaggaaacttcagagaaaaacatttgcttcacatctcatcaaatcttctgcatcaagccacatcatgttaaacaaccttctgctgttctcccttcagataagtctcataggaaccactcttggtgggaatgttttgatttggccaatggaaggtagtcattggctaaatgttaagataattatagatgagctcattaaaaaggagcataatgtgactgtcctagttgcctctggtgcacttttcatcacaccaacctctaacccatctctgacatttgaaatatatagggtgccctttggcaaagaaagaatagaaggagtaattaaggacttcgttttgacatggctggaaaatagaccatctccttcaaccatttggagattctatcaggagatggccaaagtaatcaaggacttccacatggtgtctcaggagatctgtgatggcgttcttaaaaaccaacagctgatggcaaagctaaagaaaagcaagtttgaagtcctggtgtctgatccagtatttccttgtggcgatatag

SEQ ID NO: 33680 - DNA, 2088 bp, Homo sapiens
tgcaccaggatgactctgaaatggacttcagttcttctgctgatacatctcagttgttactttagctctgggagttgtggaaaagtgctggtgtgggccgcagaatacagccattggatgaatatgaagacaatcctgaaagagcttgttcagagaggtcatgaggtgactgtactggcatcttcagcttccattctttttgatcccaatgatgcatccactcttaaatttgaagtttatcctacatctttaactaaaactgaatttgagaatatcatcatgcaacaggttaagagatggtcagacattcgaaaagatagcttttggttatatttttcacaagaacaagaaatcctgtgggaattatatgacatatttagaaacttctgtaaagatgtagtttcaaataagaaagttatgaaaaaactacaagagtcaagatttgacatcgtttttgcagatgctgtttttccctgtggtgagctgctggctgcgctacttaacatacggtttgtgtacagtctccgctttactcctggctacacaattgaaaggcacagtggaggactgattttccctccttcctacatacctattgttatgtcaaaattaagtgatcaaatgactttcatggagagggtaaaaaatatgatctatgtgctttattttgacttttggttccaaatgtctgatatgaagaagtgggatcagttttacagtgaagttttaggaagacccactaccttatttgagacaatgggaaaagctgacatatggcttatgcgaaactcctggagttttcaatttcctcatccattcttaccaaacgttgattttgttggaggattccactgcaaacctgccaaacccctacctaaggaaatggaggagtttgtacagagctctggagaaaatggtgttgtggtgttttctctggggtcagtgataagtaacatgacagcagaaagggccaatgtaattgcaacagcccttgccaagatcccacaaaaggttctgtggagatttgacgggaataaaccagatgccttaggtctcaatactcggctgtacaagtggataccccagaatgaccttctaggtcatccaaaaaccagagcttttataactcatggtggagccaatggcatctatgaggcaatctaccatgggatccctatggtgggcattccattgttttttgatcaacctgataacattgctcacatgaaggccaagggagcagctgttagattggacttcaacacaatgtcgagtacagacctgctgaatgcactgaagacagtaattaatgatcctttatataaagagaatattatgaaattatcaagaattcaacatgatcaaccagtaaagcccctggatcgagcagtcttctggattgaatttgtcatgccccacaaaggagccaaacaccttcgagttgcagcccatgacctcacctggttccagtaccactctttggatgtgattgggtttctgctggcctgtgtggcaactgtgatatttatcatcacaaagttttgtctgttttgtttctggaagtttgctagaaaagggaagaagggaaaaagagattagttatgtctgacatttgaagctggaaaaccagatagataggacaacttcagtttattccagcaagaaagaaaagattgttatgcaagatttctttcttcctgtgacaaaaaaaaaaaaaaaaaaaaaattttcaaatctaccttgtcaagtaaaaatttgtttttcagagatttaccacccaggtaatggttagaaatattttgtggcaatgaagaaaatactaggaaaattaaaaaataatataaagccatttgagctcatattgaaatttgttgcacttatattgagatttgttgtttgaattcacaagttacatgaaaaaatttactcagcttaactatatttcacacattttacataaacacaagaacattaagaagtctactgacagtatcagtagtcacatcctcagaataatttggcttcattttgaacaggattctgttgttttaactgttgctaaagaaactattacatagttaaattgta

SEQ ID NO: 33681 - DNA, 2077 bp, Homo sapiens
taagaccaggatgtctctgaaatggacgtcagtctttctgctgatacagctcagttgttactttagctctggaagctgtggaaaggtgctagtgtggcccacagaatacagccattggataaatatgaagacaatcctggaagagcttgttcagaggggtcatgaggtgactgtgttgacatcttcggcttctactcttgtcaatgccagtaaatcatctgctattaaattagaagtttatcctacatctttaactaaaaattatttggaagattctcttctgaaaattctcgatagatggatatatggtgtttcaaaaaatacattttggtcatatttttcacaattacaagaattgtgttgggaatattatgactacagtaacaagctctgtaaagatgcagttttgaataagaaacttatgatgaaactacaagagtcaaagtttgatgtcattctggcagatgcccttaatccctgtggtgagctactggctgaactatttaacataccctttctgtacagtcttcgattctctgttggctacacatttgagaagaatggtggaggatttctgttccctccttcctatgtacctgttgttatgtcagaattaagtgatcaaatgattttcatggagaggataaaaaatatgatacatatgctttattttgacttttggtttcaaatttatgatctgaagaagtgggaccagttttatagtgaagttctaggaagacccactacattatttgagacaatggggaaagctgaaatgtggctcattcgaacctattgggattttgaatttcctcgcccattcttaccaaatgttgattttgttggaggacttcactgtaaaccagccaaacccctgcctaaggaaatggaagagtttgtgcagagctctggagaaaatggtattgtggtgttttctctggggtcgatgatcagtaacatgtcagaagaaagtgccaacatgattgcatcagcccttgcccagatcccacaaaaggttctatggagatttgatggcaagaagccaaatactttaggttccaatactcgactgtacaagtggttaccccagaatgaccttcttggtcatcccaaaaccaaagcttttataactcatggtggaaccaatggcatctatgaggcgatctaccatgggatccctatggtgggcattcccttgtttgcggatcaacatgataacattgctcacatgaaagccaagggagcagccctcagtgtggacatcaggaccatgtcaagtagagatttgctcaatgcattgaagtcagtcattaatgaccctgtctataaagagaatgtcatgaaattatcaagaattcatcatgaccaaccaatgaagcccctggatcgagcagtcttctggattgagtttgtcatgcgccacaaaggagccaagcaccttcgagtcgcagctcacaacctcacctggatccagtaccactctttggatgtgatagcattcctgctggcctgcgtggcaactgtgatatttatcatcacaaaattttgcctgttttgtttccgaaagcttgccaaaaaaggaaagaagaagaaaagagattagttatatcaaaagcctgaagtggaatgactgaaagatgggactcctcctttatttcagcatggagggttttaaatggaggatttcctttttcctgtgacaaaacatcttttcacaacttaccttgttaagacaaaatttattttccagggatttaatacgtactttagctgaattattctatgtcaatgatttttaagctatgaaaaatacaatggggggaaggatagcatttggagatatacctaatgttaaatgacgagttactggatgcagcacgccaacatggcacatgtatacatatgtagctaacctgcacgttgtgcacatgtaccctaaaacttaaagtataatttaaaaaaagcaaaaaaaaaaaatacaactcttttttttaaaccaggaaggaaaatgtgaacatggaaacaacttctagtattggatctgaaaataaagtgtcatccaagccataaaaaaaaa

SEQ ID NO: 33682 - DNA, 2077 bp, Homo sapiens
gaaagaaacaacaactggaaaagaagcactgcataagaccaggatgtctctgaaatggatgtcagtctttctgctgatgcagctcagttgttactttagctctgggagttgtggaaaggtgctggtgtggcccacagaatacagccattggataaatatgaagacaatcctggaagagcttgttcagaggggtcatgaggtgattgtgttgacatcttcggcttctattcttgtcaatgccagtaaatcatctgctattaaattagaagtttatcctacatctttaactaaaaatgatttggaagatttttttatgaaaatgttcgatagatggacatatagtatttcaaaaaatacattttggtcatatttttcacaactacaagaattgtgttgggaatattctgactataatataaagctctgtgaagatgcagttttgaacaagaaacttatgagaaaactacaagagtcaaaatttgatgtccttctggcagatgccgttaatccctgtggtgagctgctggctgagctacttaacataccctttctgtacagtctccgcttctctgttggctacacagttgagaagaatggtggaggatttctgttccctccttcctatgtacctgttgttatgtcagaattaagtgatcaaatgattttcatggagaggataaaaaatatgatatatatgctttattttgacttttggtttcaagcatatgatctgaagaagtgggaccagttttatagtgaagttctaggaagacccactacattatttgagacaatggggaaagctgaaatgtggctcattcgaacctattgggattttgaatttcctcgcccattcttaccaaatgttgattttgttggaggacttcactgtaaaccagccaaacccttgcctaaggaaatggaagagtttgtgcagagctctggagaaaatggtattgtggtgttttctctggggtcgatgatcagtaacatgtcagaagaaagtgccaacatgattgcatcagcccttgcccagatcccacaaaaggttctatggagatttgatggcaagaagccaaatactttaggttccaatactcgactgtataagtggttaccccagaatgaccttcttggtcatcccaaaaccaaagcttttataactcatggtggaaccaatggcatctatgaggcaatctaccatgggatccctatggtgggcattcccttgtttgcggatcaacatgataacattgctcacatgaaagccaagggagcagccctcagtgtggacatcaggaccatgtcaagtagagatttgctcaatgcattgaagtcagtcattaatgaccctatctataaagagaatatcatgaaattatcaagaattcatcatgatcaaccggtgaagcccctggatcgagcagtcttctggattgagtttgtcatgcgccataaaggagccaagcaccttcgggtcgcagcccacaacctcacctggatccagtaccactctttggatgtgatagcattcctgctggcctgcgtggcaactatgatatttatgatcacaaaatgttgcctgttttgtttccgaaagcttgccaaaacaggaaagaagaagaaaagggattagttatatcaaaagcctgaagtggaatgaccaaaagatgggactcctcctttattccagcatggagggttttaaatggaggatttcctttttcctgcgacaaaacgtcttttcacaacttaccctgttaagtcaaaatttattttccaggaatttaatatgtactttagttggaattattctatgtcaatgatttttaagctatgaaaaataataatataaaaccttatgggcttatattgaaatttattattctaatccaaaagttaccccacacaaaagttactgagcttccttatgtttcacacattgtatttgaacacaaaacattaacaactccactcatagtatcaacattgttttgcaaatactcagaatattttggcttcattttgagcagaatttttgtttttaattttgccaatgaaatcttcaataattaaa

SEQ ID NO: 33683 - DNA, 1833 bp, Homo sapiens
ggatggctctgaagtggacttcagttcttctgctgatacatctcggttgttactttagctctgggagttgtggaaaggtgctggtgtggaccggtgaatacagccattggatgaatatgaagacaatcctgaaagagcttgttcagagaggtcatgaggtgactgtactggcatcttcagcttccattctttttgatcccaatgacgcattcactcttaaactcgaagtttatcctacatctttaactaaaactgaatttgagaatatcatcatgcaacaggttaagagatggtcagacattcaaaaagatagcttttggttatatttttcacaagaacaagaaatcctgtgggaatttcatgacatatttagaaacttctgtaaagatgtagtttcaaataagaaagttatgaaaaaactacaagagtcaagatttgacatcatttttgcagatgctttttttccttgtggtgagctgctggctgcgctacttaacataccgtttgtgtacagtctctgcttcactcctggctacacaattgaaaggcacagtggaggactgattttccctccttcctacatacctgttgttatgtcaaaattaagtgatcaaatgactttcatggagagggtaaaaaacatgatctatgtgctttattttgacttttggttccaaatgtgtgatatgaagaagtgggatcagttttacagtgaagttttaggaagacccactaccttatttgagacaatggggaaagctgacatatggcttatgcgaaactcctggagttttcaatttcctcatccattcttaccaaacattgattttgttggaggactccactgcaaacctgccaaacccctacctaaggaaatggaggaatttgtacagagctctggtgaaaatggtgttgtggtgttttctctggggtcagtgataagtaacatgacagcagaaagggccaacgtaattgcaacagcccttgccaagatcccacaaaaggttctgtggagatttgatgggaataaaccagatgccttaggtctcaatactcggctgtataagtggataccccagaatgaccttctaggtcttccaaaaaccagagcttttataactcatggtggagccaatggcatctatgaggcaatctaccatgggatccctatggtaggcattccattgttttgggatcaacctgataacattgctcacatgaaggccaagggagcagctgttagactggacttccacacaatgtcgagtacagacctgctgaatgcactgaagacagtaattaatgatccttcatataaagagaatgttatgaaattatcaataattcaacatgatcaaccagtaaagcccctgcatcgagcagtcttctggattgaatttgtgatgtgccacaaaggagccaaacaccttcgagttgcagcccgtgacctcacctggttccagtaccactctttggatgtgattgggtttctgctggcctgtgtggcaactgtgatatttgtcgtcacaaagttttgtctgttttgtttctggaagtttgctagaaaagggaagaagggaaaaagagattagttatgtctgacatttgaagctggaaaaccagatagatgggttgacatcagtttattccagcaagaaagaaaagattgttatgcaagatttctttcttcctgtgacaaaaaaaaaaacttttcaaaatctaccttgtcaagtaaaaatttgtttttcagagatttaccacccaggtaatggttagaaatattctgtggcaatgaagaaaacactagggaaaataaaaaataatataaagcca

SEQ ID NO: 33684 - DNA, 1525 bp, Homo sapiens
ggatggctctgaagtggacttcagttcttctgctgatacatctcggttgttactttagctctgggagttgtggaaaggtgctggtgtggaccggtgaatacagccattggatgaatatgaagacaatcctgaaagagcttgttcagagaggtcatgaggtgactgtactggcatcttcagcttccattctttttgatcccaatgacgcattcactcttaaactcgaagtttatcctacatctttaactaaaactgaatttgagaatatcatcatgcaacaggttaagagatggtcagacattcaaaaagatagcttttggttatatttttcacaagaacaagaaatcctgtgggaatttcatgacatatttagaaacttctgtaaagatgtagtttcaaataagaaagttatgaaaaaactacaagagtcaagatttgacatcatttttgcagatgctttttttccttgtggtgagctgctggctgcgctacttaacataccgtttgtgtacagtctctgcttcactcctggctacacaattgaaaggcacagtggaggactgattttccctccttcctacatacctgttgttatgtcaaaattaagtgatcaaatgactttcatggagagggtaaaaaacatgatctatgtgctttattttgacttttggttccaaatgtgtgatatgaagaagtgggatcagttttacagtgaagttttaggaagacccactaccttatttgagacaatggggaaagctgacatatggcttatgcgaaactcctggagttttcaatttcctcatccattcttaccaaacattgattttgttggaggactccactgcaaacctgccaaacccctacctaaggaaatggaggaatttgtacagagctctggtgaaaatggtgttgtggtgttttctctggggtcagtgataagtaacatgacagcagaaagggccaacgtaattgcaacagcccttgccaagatcccacaaaagatataaagagaatgttatgaaattatcaataattcaacatgatcaaccagtaaagcccctgcatcgagcagtcttctggattgaatttgtgatgtgccacaaaggagccaaacaccttcgagttgcagcccgtgacctcacctggttccagtaccactctttggatgtgattgggtttctgctggcctgtgtggcaactgtgatatttgtcgtcacaaagttttgtctgttttgtttctggaagtttgctagaaaagggaagaagggaaaaagagattagttatgtctgacatttgaagctggaaaaccagatagatgggttgacatcagtttattccagcaagaaagaaaagattgttatgcaagatttctttcttcctgtgacaaaaaaaaaaacttttcaaaatctaccttgtcaagtaaaaatttgtttttcagagatttaccacccaggtaatggttagaaatattctgtggcaatgaagaaaacactagggaaaataaaaaataatataaagcca

SEQ ID NO: 33685 - DNA, 2103 bp, Homo sapiens
gacagaaaggagcagcaactggaaaacaagcattgcattgcatcaggatgtctatgaaatggacttcagctcttctgctgatacagctgagctgttactttagctctgggagttgtggaaaggtgctggtgtggcccacagaattcagccactggatgaatataaagacaatcctggatgaacttgtccagagaggtcatgaggtgactgtattggcatcttcagcttccatttctttcgatcccaacagcccatctactcttaaatttgaagtttatcctgtatctttaactaaaactgagtttgaggatattatcaagcagctggttaagagatgggcagaacttccaaaagacacattttggtcatatttttcacaagtacaagaaatcatgtggacatttaatgacatacttagaaagttctgtaaggatatagtttcaaataagaaacttatgaagaaactacaggagtcaagatttgatgttgttcttgcagatgctgttttcccctttggtgagctgctggccgagttacttaaaataccctttgtctacagcctccgcttctctcctggctacgcaattgaaaagcatagtggaggacttctgttccctccttcctatgtgcctgttgttatgtcagaactaagtgaccaaatgactttcatagagagggtaaaaaatatgatctatgtgctttattttgaattttggttccaaatatttgacatgaagaagtgggatcagttctacagtgaagttctaggaagacccactacgttatctgagacaatggcaaaagctgacatatggcttattcgaaactactgggattttcaatttcctcacccactcttaccaaatgttgagttcgttggaggactccactgcaaacctgccaaacccctaccgaaggaaatggaagagtttgtccagagctctggagaaaatggtgttgtggtgttttctctggggtcgatggtcagtaacacatcagaagaaagggccaatgtaattgcatcagcccttgccaagatcccacaaaaggttctgtggagatttgatgggaataaaccagatactttaggactcaatactcggctgtacaagtggataccccagaatgatcttcttggtcacccaaaaaccagagcttttataactcatggtggagccaatggcatctatgaggcaatctaccatggaatccctatggtgggcgttccattgtttgcagatcaacctgataacattgcacacatgaaggccaagggagcagctgttagtttggacttccacacaatgtcgagtacagacttactcaatgcactgaagacagtaattaatgatcctttatataaagagaatgctatgaaattatcaagaattcatcatgatcaaccagtgaagccccttgatcgagcagtcttctggattgaatttgtcatgcgccataaaggagccaagcaccttcgggttgcagcccacgacctcacctggttccagtaccactctttggatgtgactgggttcctgctggcctgtgtggcaactgtgatattcatcatcacaaaatgtctgttttgtgtctggaagtttgttagaacaggaaagaaggggaaaagagattaattacgtctgaggctggaagctgggaaacccaataaatgaactcctttagtttattacaacaagaagacgttgtgatacaagagattcctttcttcttgtgacaaaacatctttcaaaacttaccttgtcaagtcaaaatttgttttagtacctgtttaaccattagaaatatttcatgtcaaggaggaaaacattagggaaaacaaaaatgatataaagccatatgaggttatattgaaatgtattgagcttatattgaaatttattgttccaattcacaggttacatgaaaaaaaatttactaagcttaactacatgtcacacattgtacatggaaacaagaacattaagaagtccactgacagtatcagtactgttttgcaaatactcagcatactttggatccatttcatgcaggattgtgttgttttaactgttgttgaggaagctaataaataattaaattgta

SEQ ID NO: 33686 - DNA, 1932 bp, Homo sapiens
attctcctgcctcagactccggagtagctgggactacaggcgccggccaccaagcctggctaattttttgtatttttagtagagatggggtttcaccgtgttagccaggatggtctggatctcctgacctcttgatccacccgccttggcctcccaaagtgctgggattaacggtgtgagccacctcgcccagcctggagccctttctttaatataaacataaatgttagtcaacttgtttaaatataaacatgtgagctgcttgagcacagggactacatcataatgttttttgctctcttacatgtctcatcaacgaatggattagatgctgttttcccctttggtgagctgctggccgagttacttaaaataccctttgtctacagcctccgcttctctcctggctacgcaattgaaaagcatagtggaggacttctgttccctccttcctatgtgcctgttgttatgtcagaactaagtgaccaaatgactttcatagagagggtaaaaaatatgatctatgtgctttattttgaattttggttccaaatatttgacatgaagaagtgggatcagttctacagtgaagttctaggaagacccactacgttatctgagacaatggcaaaagctgacatatggcttattcgaaactactgggattttcaatttcctcacccactcttaccaaatgttgagttcgttggaggactccactgcaaacctgccaaacccctaccgaaggaaatggaagagtttgtccagagctctggagaaaatggtgttgtggtgttttctctggggtcgatggtcagtaacacatcagaagaaagggccaatgtaattgcatcagcccttgccaagatcccacaaaaggttctgtggagatttgatgggaataaaccagatactttaggactcaatactcggctgtacaagtggataccccagaatgatcttcttggtcacccaaaaaccagagcttttataactcatggtggagccaatggcatctatgaggcaatctaccatggaatccctatggtgggcgttccattgtttgcagatcaacctgataacattgcacacatgaaggccaagggagcagctgttagtttggacttccacacaatgtcgagtacagacttactcaatgcactgaagacagtaattaatgatcctttatataaagagaatgctatgaaattatcaagaattcatcatgatcaaccagtgaagccccttgatcgagcagtcttctggattgaatttgtcatgcgccataaaggagccaagcaccttcgggttgcagcccacgacctcacctggttccagtaccactctttggatgtgactgggttcctgctggcctgtgtggcaactgtgatattcatcatcacaaaatgtctgttttgtgtctggaagtttgttagaacaggaaagaaggggaaaagagattaattacgtctgaggctggaagctgggaaacccaataaatgaactcctttagtttattacaacaagaagacgttgtgatacaagagattcctttcttcttgtgacaaaacatctttcaaaacttaccttgtcaagtcaaaatttgttttagtacctgtttaaccattagaaatatttcatgtcaaggaggaaaacattagggaaaacaaaaatgatataaagccatatgaggttatattgaaatgtattgagcttatattgaaatttattgttccaattcacaggttacatgaaaaaaaatttactaagcttaactacatgtcacacattgtacatggaaacaagaacattaagaagtccactgacagtatcagtactgttttgcaaatactcagcatactttggatccatttcatgcaggattgtgttgttttaactgttgttgaggaagctaataaataattaaattgt

SEQ ID NO: 33687 - DNA, 596 bp, Homo sapiens
attctcctgcctcagactccggagtagctgggactacaggcgccggccaccaagcctggctaattttttgtatttttagtagagatggggtttcaccgtgttagccaggatggtctggatctcctgacctcttgatccacccgccttggcctcccaaagtgctgggattaacggtgtgagccacctcgcccagcctggagccctttctttaatataaacataaatgttagtcaacttgtttaaatataaacatgtgagctgcttgagcacagggactacatcataatgttttttgctctcttacatgtctcatcaacgaatggattagtgtaaaagttacattttaacttcttgactgatttatactggatgtcaccatgagaaatgacagaaaggagcagcaactggaaaacaagcattgcattgcatcaggatgtctatgaaatggacttcagctcttctgctgatacagctgagctgttactttagctctgggagttgtggaaaggtgctggtgtggcccacagaattcagccactggatgaatataaagacaatcctggatgaacttgtccagagaggtcatgaggtgactg

SEQ ID NO: 33688 - DNA, 1887 bp, Homo sapiens
acagaaaggaacagcaactggaaaacaagcattgcattgcaccaggatgtctgtgaaatggacttcagtaattttgctaatacaactgagcttttgctttagctctgggaattgtggaaaggtgctggtgtgggcagcagaatacagccattggatgaatataaagacaatcctggatgagcttattcagagaggtcatgaggtgactgtactggcatcttcagcttccattctttttgatcccaacaactcatccgctcttaaaattgaaatttatcccacatctttaactaaaactgagttggagaatttcatcatgcaacagattaagagatggtcagaccttccaaaagatacattttggttatatttttcacaagtacaggaaatcatgtcaatatttggtgacataactagaaagttctgtaaagatgtagtttcaaataagaaatttatgaaaaaagtacaagagtcaagatttgacgtcatttttgcagatgctatttttccctgtagtgagctgctggctgagctatttaacataccctttgtgtacagtctcagcttctctcctggctacacttttgaaaagcatagtggaggatttattttccctccttcctacgtacctgttgttatgtcagaattaactgatcaaatgactttcatggagagggtaaaaaatatgatctatgtgctttactttgacttttggttcgaaatatttgacatgaagaagtgggatcagttttatagtgaagttctaggaagacccactacattatctgagacaatggggaaagctgacgtatggcttattcgaaactcctggaattttcagtttccatatccactcttaccaaatgttgattttgttggaggactccactgcaaacctgccaaacccctgcctaaggaaatggaagactttgtacagagctctggagaaaatggtgttgtggtgttttctctggggtcaatggtcagtaacatgacagaagaaagggccaacgtaattgcatcagccctggcccagatcccacaaaaggttctgtggagatttgatgggaataaaccagataccttaggtctcaatactcggctctacaagtggataccccagaatgaccttctaggtcatccaaagaccagagcttttataactcatggtggagccaatggcatctacgaggcaatctaccatgggatccctatggtggggattccattgtttgccgatcaacctgataacattgctcacatgaaggccaggggagcagctgttagagtggacttcaacacaatgtcgagtacagacttgctgaatgcattgaagagagtaattaatgatccttcatataaagagaatgttatgaaattatcaagaattcaacatgatcaaccagtgaagcccctggatcgagcagtcttctggattgaatttgtcatgcgccacaaaggagctaaacaccttcgggttgcagcccacgacctcacctggttccagtaccactctttggatgtgattgggttcctgctggtctgtgtggcaactgtgatatttatcgtcacaaaatgttgtctgttttgtttctggaagtttgctagaaaagcaaagaagggaaaaaatgattagttatatctgagatttgaagctggaaaacctgataggtgagactacttcagtttattccagcaagaaagattgtgatgcaagatttctttcttcctgagacaaaaaaaaaaaaagaaaaaaaaatcttttcaaaatttactttgtcaaataaaaatttgtttttcagagatttaccacccagttcatggttagaaatattttgtggcaatgaagaaaacactacggaaaataaaaaataagataaagcctta

SEQ ID NO: 33689 - DNA, 3274 bp, Homo sapiens
cgttaaattctgctctgtcagagagagcatctgtcaagcccacatttaaactgctgcctgcctgtgcagcagctgaggaaccgtggatttcatattatagactaaaaccccattaaaactgctcaaaatccttcctgcagctgccaggcaacaacgaaagaagagaggtaaatcctattcttttccaatacaactgaagcactacattttagctctggctgctttacattgcagctcagtgttattagtagaaatatggatactgagacgagaacacagcactgcattgtccagccaggaaaatagcagatgtaaaaagcttcaatgcatcaactgtcgggaagagtcaacagtgctacaagcagaacgggcaactacagctcttttgtttaacgaaagagagaaaatgaaagaaagggaaaatttcagaagactaggacccatatgaacaaggagggtaactcgaagacaagcagacagatggacactttggatactgtgaaaagcaatcgcaggaggcagactgttgggggatgtgcgcatgttcgatagcatcttttttgctgaagtgatggcgtgccaaaagtattttcagtgggcataatcctcttcacataaatggcctgaccaaggaagaatgactacaagagagacaatgtgactgaattagaaaatgattgccaaagaatagtattaaggagaagaaaacatttttggtcaccaatctctcatataccactactggatatttacaacatgcttcagtggaggagaagacactgctgctttgcaaagatgacctggaatgccaaaaggtctctgttccgcactcatcttattggagtactttctctagtgtttctttttgctatgtttttgtttttcaatcatcatgactggctgccaggcagagctggattcaaagaaaaccctgtgacatacactttccgaggatttcggtcaacaaaaagtgagacaaaccacagctcccttcggaacatttggaaagaaacagtccctcaaaccctgaggcctcaaacagcaactaactctaataacacagacctgtcaccacaaggagttacaggcctggagaatacacttagtgccaatggaagtatttacaatgaaaaaggtactggacatccaaattcttaccatttcaaatatattattaatgagcctgaaaaatgccaagagaaaagtccttttttaatactactaatagctgcagagcctggacaaatagaagctagaagagctattcggcaaacttggggcaatgaaagtctagcacctggtattcaaatcacaagaatatttttgttgggcttaagtattaagctaaatggctaccttcaacgtgcaatactggaagaaagcagacaatatcatgatataattcaacaggaatacttagatacgtactataatttgaccattaaaacactaatgggcatgaactgggttgcaacatactgtccacatattccatatgttatgaaaactgacagtgacatgtttgtcaacactgaatatttaatcaataagttactgaagccagatctgcctcccagacataactatttcactggttacctaatgcgaggatatgcacccaatcgaaacaaagatagcaagtggtacatgccaccagacctctacccaagtgagcgttatcctgtcttctgttctggaactggttatgttttttctggagatctggcagaaaagatttttaaagtttctttaggtatccgccgtttgcacttggaagatgtatatgtagggatctgtcttgccaagttgagaattgatcctgtaccccctcccaatgagtttgtgttcaatcactggcgagtctcttattcgagctgtaaatacagccacctaattacctctcatcagttccagcctagtgaactgataaaatactggaaccatttacaacaaaataagcacaatgcctgtgccaacgcagcaaaagaaaaggcaggcaggtatcgccaccgtaaactacattagaaaagacaattttttttcaaatgtgcaatttgtaaatattgctaaaagcatgtatagttagaactgattacatccgtaggacaagttttagttaaaactcatcacataaagaaattcaagaagtatttttttaatttctgaagaagttaattcttaaaactataacattatataacaaaaaaggtttcccaaaacaatctatttaaaaaactgtataaggagattctgtgtattaacatgcaataacaagcatgcataaatcaatggttcaagtcttctgttaggggccaataaaatgtatctgcatatgttttccacataaattttaattcaagaaatgacagtcaaaagatccttcattttagattaagcttttcattttaatatataatttaatgtaaataaaacatcactatcaattttaaggaaactttttaattgtgcaaaggataaattttttgacctattttagggttctaaatgcaataagatttagttgagttattccacaaacacattataaagttcagatgtttcatcaatgcagttctcacgaaagtatttactttttaaaaataactgagatattattttaaatttcttttattaatactttcttttattaatatatgggggaaaattattttgacatgacgtggtaaaatgtgaaaaactaatgtgtctcaggctcaagtttttatagttattaaatgtttcaaaatagacaagttttgtttcctcattgatgttaagaaccaaactcctatttcaatgagttattggattagaccaattactgcactcttaaacagcaccaccatttaatttcatgtatatctaacttcgaatatatctgtaaagataatcgaagcaaaagtaatcacttaaaggcacaaataggatgtactgttgaaaaagataaagagtgcaggtgcagtttcattcaacacatttttaagatgcatgtctgccaaaatgcaacatacgggaagtttatttcctgacagcaggtgtacacatgccaacacttaatcattttatggcacctatttctttcttggagtgccaagtttgcaaacctgcagtttttaatttggtagatgacaaatattctgaatcaccaattaaaaacctttttgggagggatggggaaaactacaaacgtttgacaaacacaattctaggatgaacaatgtatacaatgcacttttatgaagtttttaaaaataaaggaaaacaaaaaacttta

SEQ ID NO: 33690 - DNA, 1686 bp, Homo sapiens
gaggcgggggaggggccgtgagtgccgcagtcggccagccatggagcggagcttgctggcggcgaggccgcggcgacaaggtagccacccccgcagcatgcctcgaccgcggtccgcagctgcaccgcctctccccgccccccagggtgcgctggtcccggtcgcgcgctcagacctccgcatcccgggcgtggtcggttaagtccccggccgtgacccaggcccggggagctagtctccgcccttcgctcttacggatcccctcggagtacgccgcaccatgcagctcaggctcttccggcgcctccttctcgccgctttgctgctggtgatcgtctggaccctcttcgggccttcggggttgggggaggagctgctgagcctctcactagcctccctgctcccagcccccgcctcaccggggccgcccctggccctgccccgcctcttgatccccaaccaggaagcttgcagtggtcccggggcccctcccttcctgctcatcctggtgtgcacggctccggagaacctgaaccagagaaacgccattcgggcttcgtggggcgggctgcgcgaggcccgggggctcagggtacagacgctattcttgctgggagagccgaacgcacagcaccccgtgtggggttcccaggggagtgacctggcctcggagtcagcagcccagggggatatcttgcaggccgccttccaggactcctaccgcaacctcaccctaaagaccctcagcgggctgaactgggctgagaaacactgccccatggcccgatacgtcctcaagacggacgatgatgtgtatgtcaacgtccctgaactggtatcagagctggtcttgcgagggggccgttgggggcaatgggagagaagcacggaaccccagagagaggctgagcaggaaggaggccaggttttgcacagcgaggaagtgcctcttctgtacttgggccgggtgcactggcgcgtgaacccctctcggacaccggggggcaggcaccgcgtatcagaggagcagtggcctcacacctggggcccctttccaccctatgcctcaggcacggggtatgtgctgtcagcgtctgctgtgcagctcattctcaaggtggccagccgggcaccccttctcccattagaggatgtctttgtgggggtaagtgcccgacgaggaggcctcgccccaacacagtgtgtcaagctggctggtgccacccactacccgctagaccggtgctgctatgggaaattcctgctgacgtcccacaggctggacccctggaagatgcaggaagcctggaagctggtgggtggctctgacggggaaaggactgcgcccttttgctcctggttccagggagtcctgggcatcctgcggtgtcgagcaatagcctggcttcagagctgagagtgcctggggccacaggaaaggcaggaacaggaccttctctctcccaggcccaacgcaggggccctcactggctgcagctgatctgtttccttataccagatcctcagtctcactaaagacagcgatatgggagacacccaggggcctggcccgccagcccaaaagatggtcatcgggaagaaaaaaagaaaaaaatgctgcagttgttctctcaagctagggcagaagaggggtgtcaagctcctcaataaacttgtctccacttc

SEQ ID NO: 33691 - DNA, 1686 bp, Homo sapiens
gaggcgggggaggggccgtgagtgccgcagtcggccagccatggagcggagcttgctggcggcgaggccgcggcgacaaggtagccacccccgcagcatgcctcgaccgcggtccgcagctgcaccgcctctccccgccccccagggtgcgctggtcccggtcgcgcgctcagacctccgcatcccgggcgtggtcggttaagtccccggccgtgacccaggcccggggagctagtctccgcccttcgctcttacggatcccctcggagtacgccgcaccatgcagctcaggctcttccggcgcctccttctcgccgctttgctgctggtgatcgtctggaccctcttcgggccttcggggttgggggaggagctgctgagcctctcactagcctccctgctcccagcccccgcctcaccggggccgcccctggccctgccccgcctcttgatccccaaccaggaagcttgcagtggtcccggggcccctcccttcctgctcatcctggtgtgcacggctccggagaacctgaaccagagaaacgccattcgggcttcgtggggcgggctgcgcgaggcccgggggctcagggtacagacgctattcttgctgggagagccgaacgcacagcaccccgtgtggggttcccaggggagtgacctggcctcggagtcagcagcccagggggatatcttgcaggccgccttccaggactcctaccgcaacctcaccctaaagaccctcagcgggctgaactgggctgagaaacactgccccatggcccgatacgtcctcaagacggacgatgatgtgtatgtcaacgtccctgaactggtatcagagctggtcttgcgagggggccgttgggggcaatgggagagaagcacggaaccccagagagaggctgagcaggaaggaggccaggttttgcacagcgaggaagtgcctcttctgtacttgggccgggtgcactggcgcgtgaacccctctcggacaccggggggcaggcaccgcgtatcagaggagcagtggcctcacacctggggcccctttccaccctatgcctcaggcacggggtatgtgctgtcagcgtctgctgtgcagctcattctcaaggtggccagccgggcaccccttctcccattagaggatgtctttgtgggggtaagtgcccgacgaggaggcctcgccccaacacagtgtgtcaagctggctggtgccacccactacccgctagaccggtgctgctatgggaaattcctgctgacgtcccacaggctggacccctggaagatgcaggaagcctggaagctggtgggtggctctgacggggaaaggactgcgcccttttgctcctggttccagggagtcctgggcatcctgcggtgtcgagcaatagcctggcttcagagctgagagtgcctggggccacaggaaaggcaggaacaggaccttctctctcccaggcccaacgcaggggccctcactggctgcagctgatctgtttccttataccagatcctcagtctcactaaagacagcgatatgggagacacccaggggcctggcccgccagcccaaaagatggtcatcgggaagagaaaaagaaaaaaatgctgcagttgttctctcaagctagggcagaagaggggtgtcaagctcctcaataaacttgtctccacttc

SEQ ID NO: 33692 - DNA, 1686 bp, Homo sapiens; identical to SEQ ID NO: 33691

SEQ ID NO: 33693 - DNA, 1686 bp, Homo sapiens; identical to SEQ ID NO: 33691

SEQ ID NO: 33694 - DNA, 1686 bp, Homo sapiens; identical to SEQ ID NO: 33691

SEQ ID NO: 33695 - DNA, 2606 bp, Homo sapiens
ctctctagagaaccctgactaatacacctggagtgcagaatctgctggagaaactgccattccgttattgactggctggtcaggccatacagcctggtggtctagatgtgtttggagtgattcctgtcagaatcaccatttttggtaaacaaaccaagcccagaacctgataattatggagcattctacactgacagttctttgagacaaatttcctcttggcatttacactgtggctttagctttcaaaccagaggttcctcttacccagcaaaaaatggctttcccgaagatgagattgatgtatatttgccttctggttctgggggctctttgtttgtattttagcatgtacagtctaaatcctttcaaagaacagtcctttgtttacaagaaagacgggaacttccttaagctcccagatacagactgcaggcagacacctcccttcctcgtcctgctggtgacctcatcccacaaacagttggctgagcgcatggccatccggcagacgtgggggaaagagaggatggtgaagggaaagcagctgaagacattcttcctcctggggaccaccagcagtgcagcggaaacgaaagaggtggaccaggagagccagcgacacggggacattatccagaaggatttcctagacgtctattacaatctgaccctgaagaccatgatgggcatagaatgggtccatcgcttttgtcctcaggcggcgtttgtgatgaaaacagactcagacatgttcatcaatgttgactatctgactgaactgcttctgaagaaaaacagaacaaccaggtttttcactggcttcttgaaactcaatgagtttcccatcaggcagccattcagcaagtggtttgtcagtaaatctgaatatccgtgggacaggtacccaccattctgctccggcaccggctacgtgttttctggcgacgtggcgagtcaggtgtacaatgtctccaagagcgtcccatacattaaactggaagacgtgtttgtggggctctgcctcgaaaggctgaacatcagattggaggagctccactcccagccgaccttttttccagggggcttacgcttctccgtatgcctcttcaggaggatcgtggcctgccacttcatcaagcctcggactctcttggactactggcaggctctagagaattcccggggggaagattgtccgcctgtctgaggggagcccagaggcacatccggacaagtttcagataacccgtggggatagtttttgctagattttggaagagggggcgggacagaggatgctgttcttcagtgctgaaatccacgccagaatgtcggtgttcatgaagtcactgattagttcccacttggtgccccaggcaataataggcccgtctcttgggcacgcacactcttcatactaagtgtttgacatacacctggatttttgcatttcaggggtcagtatcctatgacatgatgggtgttaccatcctaattttacaggcaaggacacagcagctgcgagaggtacagaaacttgtcccaaggctcacagccagtaggcataggagcgggaatgaaaatcgagcactgtcagaatctggtgggcagcccctgacttgaaccactcccacgtgctgcctcccttaggaggggacactgatgatgaggtctcggagccggcatccttccatccctgtcgagtcccctccacctcagctcccagtccttgtgctttttggagctaagcctgggatgaccaaattcaccccagctccttcattcacagggctggatgtagctgggattgagtccatgttatcggctcggtactcaacacaacccaagtttcatccgaggaaatgtccccgcagtggatgcagctcacatgctgaggaacacccagctctggacagagttcttataaatgtataaattaggctcagaaaccactgcattctgacctgctgtacagactgcccacactgctgacctgcctagcgagcaggacatcccttctgagccatctgctgctctctcatttcatcaccccaactgtcccttgtttttgatcaatggggaccagccactgccccaggagcactttagggctctcagttcaaactgaaggacagttgaactcagatggggttcatgtgggattctgggagctttctgggaattcagttggagtcaagtcaggatgctctcaaggacccctcgggctcagagccctaaagtgggccctggtgaagcagggtggtcctgcgtccacttcccaagcctgagccaagctcatcttcattgaatgtctcatttggccgaggaacaactgaactttgtggtttgctgtttagccttcagtttgctccgctgcctcctacccagaggtttgtgcgagcctgtgttgcagggttgtataaaaccaaggtacttcgttagttttgcccattcagccatggtcacgtgacatgcaaagtaatcttgctcctaattatagaaatgatttttcttttaattttttactttaccagactttactttgtactcagagaagaggcctcacatggctgtgtcacatataaatgttggactaaactctt

SEQ ID NO: 33696 - DNA, 2763 bp, Homo sapiens
gggcccagatagaacaagaaggcagaagaaatgtgaattcctctttctctgctggagctgggatattcttcttctcctgcccttggacatcagagctgcaggctctctggcctttggacccgaggatttataccaagcaggtttctgggttctcaggcctttggccttggactgatagttacaccattggcatatctggttctgaggctcttggtcttggactgagccacactcctggcatcccagcgtctccagcttgcatggcctgtcacgtgattcctgtcagaatcaccatttttggtaaacaaaccaagcccagaacctgataattatggagcattctacactgacagttctttgagacaaatttcctcttggcatttacactgtggctttagctttcaaaccagaggttcctcttacccagcaaaaaatggctttcccgaagatgagattgatgtatatttgccttctggttctgggggctctttgtttgtattttagcatgtacagtctaaatcctttcaaagaacagtcctttgtttacaagaaagacgggaacttccttaagctcccagatacagactgcaggcagacacctcccttcctcgtcctgctggtgacctcatcccacaaacagttggctgagcgcatggccatccggcagacgtgggggaaagagaggatggtgaagggaaagcagctgaagacattcttcctcctggggaccaccagcagtgcagcggaaacgaaagaggtggaccaggagagccagcgacacggggacattatccagaaggatttcctagacgtctattacaatctgaccctgaagaccatgatgggcatagaatgggtccatcgcttttgtcctcaggcggcgtttgtgatgaaaacagactcagacatgttcatcaatgttgactatctgactgaactgcttctgaagaaaaacagaacaaccaggtttttcactggcttcttgaaactcaatgagtttcccatcaggcagccattcagcaagtggtttgtcagtaaatctgaatatccgtgggacaggtacccaccattctgctccggcaccggctacgtgttttctggcgacgtggcgagtcaggtgtacaatgtctccaagagcgtcccatacattaaactggaagacgtgtttgtggggctctgcctcgaaaggctgaacatcagattggaggagctccactcccagccgaccttttttccagggggcttacgcttctccgtatgcctcttcaggaggatcgtggcctgccacttcatcaagcctcggactctcttggactactggcaggctctagagaattcccggggggaagattgtccgcctgtctgaggggagcccagaggcacatccggacaagtttcagataacccgtggggatagtttttgctagattttggaagagggggcgggacagaggatgctgttcttcagtgctgaaatccacgccagaatgtcggtgttcatgaagtcactgattagttcccacttggtgccccaggcaataataggcccgtctcttgggcacgcacactcttcatactaagtgtttgacatacacctggatttttgcatttcaggggtcagtatcctatgacatgatgggtgttaccatcctaattttacaggcaaggacacagcagctgcgagaggtacagaaacttgtcccaaggctcacagccagtaggcataggagcgggaatgaaaatcgagcactgtcagaatctggtgggcagcccctgacttgaaccactcccacgtgctgcctcccttaggaggggacactgatgatgaggtctcggagccggcatccttccatccctgtcgagtcccctccacctcagctcccagtccttgtgctttttggagctaagcctgggatgaccaaattcaccccagctccttcattcacagggctggatgtagctgggattgagtccatgttatcggctcggtactcaacacaacccaagtttcatccgaggaaatgtccccgcagtggatgcagctcacatgctgaggaacacccagctctggacagagttcttataaatgtataaattaggctcagaaaccactgcattctgacctgctgtacagactgcccacactgctgacctgcctagcgagcaggacatcccttctgagccatctgctgctctctcatttcatcaccccaactgtcccttgtttttgatcaatggggaccagccactgccccaggagcactttagggctctcagttcaaactgaaggacagttgaactcagatggggttcatgtgggattctgggagctttctgggaattcagttggagtcaagtcaggatgctctcaaggacccctcgggctcagagccctaaagtgggccctggtgaagcagggtggtcctgcgtccacttcccaagcctgagccaagctcatcttcattgaatgtctcatttggccgaggaacaactgaactttgtggtttgctgtttagccttcagtttgctccgctgcctcctacccagaggtttgtgcgagcctgtgttgcagggttgtataaaaccaaggtacttcgttagttttgcccattcagccatggtcacgtgacatgcaaagtaatcttgctcctaattatagaaatgatttttcttttaattttttactttaccagactttactttgtactcagagaagaggcctcacatggctgtgtcacatataaatgttggactaaactctta

SEQ ID NO: 33697 - DNA, 2922 bp, Homo sapiens
acaggaaagccgctggttgtgatggtggctatgacaaaccttcagcctgaagacccgggagggaaaaatgaagctgacaagaagcacgttgctgagtgatcctgggttcccatcctccgcacccgtgcatccacgcgtgggcccagccagcaaggagaagtctaacaggcaggaggaggggagacacaaggagcccccgcatttcatctggaagagaggccattgaaaccaagcatttgtgttcaagtaagaaaatgtatccaagtcacaaagaaacataatttggcttttggagacatgagcagcttcatttctcatttgttcattcgaaagtctccactgggcttctgagtgccacatcctgtccagaatgatgaaagatacagaaaatggtgcctgctgaccttctggagttattggctagtaagaaagtgattcctgtcagaatcaccatttttggtaaacaaaccaagcccagaacctgataattatggagcattctacactgacagttctttgagacaaatttcctcttggcatttacactgtggctttagctttcaaaccagaggttcctcttacccagcaaaaaatggctttcccgaagatgagattgatgtatatttgccttctggttctgggggctctttgtttgtattttagcatgtacagtctaaatcctttcaaagaacagtcctttgtttacaagaaagacgggaacttccttaagctcccagatacagactgcaggcagacacctcccttcctcgtcctgctggtgacctcatcccacaaacagttggctgagcgcatggccatccggcagacgtgggggaaagagaggatggtgaagggaaagcagctgaagacattcttcctcctggggaccaccagcagtgcagcggaaacgaaagaggtggaccaggagagccagcgacacggggacattatccagaaggatttcctagacgtctattacaatctgaccctgaagaccatgatgggcatagaatgggtccatcgcttttgtcctcaggcggcgtttgtgatgaaaacagactcagacatgttcatcaatgttgactatctgactgaactgcttctgaagaaaaacagaacaaccaggtttttcactggcttcttgaaactcaatgagtttcccatcaggcagccattcagcaagtggtttgtcagtaaatctgaatatccgtgggacaggtacccaccattctgctccggcaccggctacgtgttttctggcgacgtggcgagtcaggtgtacaatgtctccaagagcgtcccatacattaaactggaagacgtgtttgtggggctctgcctcgaaaggctgaacatcagattggaggagctccactcccagccgaccttttttccagggggcttacgcttctccgtatgcctcttcaggaggatcgtggcctgccacttcatcaagcctcggactctcttggactactggcaggctctagagaattcccggggggaagattgtccgcctgtctgaggggagcccagaggcacatccggacaagtttcagataacccgtggggatagtttttgctagattttggaagagggggcgggacagaggatgctgttcttcagtgctgaaatccacgccagaatgtcggtgttcatgaagtcactgattagttcccacttggtgccccaggcaataataggcccgtctcttgggcacgcacactcttcatactaagtgtttgacatacacctggatttttgcatttcaggggtcagtatcctatgacatgatgggtgttaccatcctaattttacaggcaaggacacagcagctgcgagaggtacagaaacttgtcccaaggctcacagccagtaggcataggagcgggaatgaaaatcgagcactgtcagaatctggtgggcagcccctgacttgaaccactcccacgtgctgcctcccttaggaggggacactgatgatgaggtctcggagccggcatccttccatccctgtcgagtcccctccacctcagctcccagtccttgtgctttttggagctaagcctgggatgaccaaattcaccccagctccttcattcacagggctggatgtagctgggattgagtccatgttatcggctcggtactcaacacaacccaagtttcatccgaggaaatgtccccgcagtggatgcagctcacatgctgaggaacacccagctctggacagagttcttataaatgtataaattaggctcagaaaccactgcattctgacctgctgtacagactgcccacactgctgacctgcctagcgagcaggacatcccttctgagccatctgctgctctctcatttcatcaccccaactgtcccttgtttttgatcaatggggaccagccactgccccaggagcactttagggctctcagttcaaactgaaggacagttgaactcagatggggttcatgtgggattctgggagctttctgggaattcagttggagtcaagtcaggatgctctcaaggacccctcgggctcagagccctaaagtgggccctggtgaagcagggtggtcctgcgtccacttcccaagcctgagccaagctcatcttcattgaatgtctcatttggccgaggaacaactgaactttgtggtttgctgtttagccttcagtttgctccgctgcctcctacccagaggtttgtgcgagcctgtgttgcagggttgtataaaaccaaggtacttcgttagttttgcccattcagccatggtcacgtgacatgcaaagtaatcttgctcctaattatagaaatgatttttcttttaattttttactttaccagactttactttgtactcagagaagaggcctcacatggctgtgtcacatataaatgttggactaaactctta

SEQ ID NO: 33698 - DNA, 2446 bp, Homo sapiens
ctctctagagaaccctgactaatacacctggagtgcagaatctgctggagaaactgccattccgttattgactggctggtcaggccatacagcctggtggtctagatgtgtttggagatggctttcccgaagatgagattgatgtatatttgccttctggttctgggggctctttgtttgtattttagcatgtacagtctaaatcctttcaaagaacagtcctttgtttacaagaaagacgggaacttccttaagctcccagatacagactgcaggcagacacctcccttcctcgtcctgctggtgacctcatcccacaaacagttggctgagcgcatggccatccggcagacgtgggggaaagagaggatggtgaagggaaagcagctgaagacattcttcctcctggggaccaccagcagtgcagcggaaacgaaagaggtggaccaggagagccagcgacacggggacattatccagaaggatttcctagacgtctattacaatctgaccctgaagaccatgatgggcatagaatgggtccatcgcttttgtcctcaggcggcgtttgtgatgaaaacagactcagacatgttcatcaatgttgactatctgactgaactgcttctgaagaaaaacagaacaaccaggtttttcactggcttcttgaaactcaatgagtttcccatcaggcagccattcagcaagtggtttgtcagtaaatctgaatatccgtgggacaggtacccaccattctgctccggcaccggctacgtgttttctggcgacgtggcgagtcaggtgtacaatgtctccaagagcgtcccatacattaaactggaagacgtgtttgtggggctctgcctcgaaaggctgaacatcagattggaggagctccactcccagccgaccttttttccagggggcttacgcttctccgtatgcctcttcaggaggatcgtggcctgccacttcatcaagcctcggactctcttggactactggcaggctctagagaattcccggggggaagattgtccgcctgtctgaggggagcccagaggcacatccggacaagtttcagataacccgtggggatagtttttgctagattttggaagagggggcgggacagaggatgctgttcttcagtgctgaaatccacgccagaatgtcggtgttcatgaagtcactgattagttcccacttggtgccccaggcaataataggcccgtctcttgggcacgcacactcttcatactaagtgtttgacatacacctggatttttgcatttcaggggtcagtatcctatgacatgatgggtgttaccatcctaattttacaggcaaggacacagcagctgcgagaggtacagaaacttgtcccaaggctcacagccagtaggcataggagcgggaatgaaaatcgagcactgtcagaatctggtgggcagcccctgacttgaaccactcccacgtgctgcctcccttaggaggggacactgatgatgaggtctcggagccggcatccttccatccctgtcgagtcccctccacctcagctcccagtccttgtgctttttggagctaagcctgggatgaccaaattcaccccagctccttcattcacagggctggatgtagctgggattgagtccatgttatcggctcggtactcaacacaacccaagtttcatccgaggaaatgtccccgcagtggatgcagctcacatgctgaggaacacccagctctggacagagttcttataaatgtataaattaggctcagaaaccactgcattctgacctgctgtacagactgcccacactgctgacctgcctagcgagcaggacatcccttctgagccatctgctgctctctcatttcatcaccccaactgtcccttgtttttgatcaatggggaccagccactgccccaggagcactttagggctctcagttcaaactgaaggacagttgaactcagatggggttcatgtgggattctgggagctttctgggaattcagttggagtcaagtcaggatgctctcaaggacccctcgggctcagagccctaaagtgggccctggtgaagcagggtggtcctgcgtccacttcccaagcctgagccaagctcatcttcattgaatgtctcatttggccgaggaacaactgaactttgtggtttgctgtttagccttcagtttgctccgctgcctcctacccagaggtttgtgcgagcctgtgttgcagggttgtataaaaccaaggtacttcgttagttttgcccattcagccatggtcacgtgacatgcaaagtaatcttgctcctaattatagaaatgatttttcttttaattttttactttaccagactttactttgtactcagagaagaggcctcacatggctgtgtcacatataaatgttggactaaactctt

SEQ ID NO: 33699 - DNA, 4201 bp, Homo sapiens
gcctcgggcggcttctcgccgctcccaggtctggctggctggaggagtctcagctctcagccgctcgcccgcccccgctccgggccctcccctagtcgccgctgtggggcagcgcctggcgggcggcccgcgggcgggtcgcctcccctcctgtagcccacacccttcttaaagcggcggcgggaagatgaggcttcgggagccgctcctgagcggcagcgccgcgatgccaggcgcgtccctacagcgggcctgccgcctgctcgtggccgtctgcgctctgcaccttggcgtcaccctcgtttactacctggctggccgcgacctgagccgcctgccccaactggtcggagtctccacaccgctgcagggcggctcgaacagtgccgccgccatcgggcagtcctccggggagctccggaccggaggggcccggccgccgcctcctctaggcgcctcctcccagccgcgcccgggtggcgactccagcccagtcgtggattctggccctggccccgctagcaacttgacctcggtcccagtgccccacaccaccgcactgtcgctgcccgcctgccctgaggagtccccgctgcttgtgggccccatgctgattgagtttaacatgcctgtggacctggagctcgtggcaaagcagaacccaaatgtgaagatgggcggccgctatgcccccagggactgcgtctctcctcacaaggtggccatcatcattccattccgcaaccggcaggagcacctcaagtactggctatattatttgcacccagtcctgcagcgccagcagctggactatggcatctatgttatcaaccaggcgggagacactatattcaatcgtgctaagctcctcaatgttggctttcaagaagccttgaaggactatgactacacctgctttgtgtttagtgacgtggacctcattccaatgaatgaccataatgcgtacaggtgtttttcacagccacggcacatttccgttgcaatggataagtttggattcagcctaccttatgttcagtattttggaggtgtctctgctctaagtaaacaacagtttctaaccatcaatggatttcctaataattattggggctggggaggagaagatgatgacatttttaacagattagtttttagaggcatgtctatatctcgcccaaatgctgtggtcgggaggtgtcgcatgatccgccactcaagagacaagaaaaatgaacccaatcctcagaggtttgaccgaattgcacacacaaaggagacaatgctctctgatggtttgaactcactcacctaccaggtgctggatgtacagagatacccattgtatacccaaatcacagtggacatcgggacaccgagctagcgttttggtacacggataagagacctgaaattagccagggacctctgctgtgtgtctctgccaatctgctgggctggtccctctcatttttaccagtctgagtgacaggtccccttcgctcatcattcagatggctttccagatgaccaggacgagtgggatattttgcccccaacttggctcggcatgtgaattcttagctctgcaaggtgtttatgcctttgcgggtttcttgatgtgttcgcagtgtcaccccagagtcagaactgtacacatcccaaaatttggtggccgtggaacacattcccggtgatagaattgctaaattgtcgtgaaataggttagaatttttctttaaattatggttttcttattcgtgaaaattcggagagtgctgctaaaattggattggtgtgatctttttggtagttgtaatttaacagaaaaacacaaaatttcaaccattcttaatgttacgtcctccccccacccccttctttcagtggtatgcaaccactgcaatcactgtgcatatgtcttttcttagcaaaaggattttaaaacttgagccctggaccttttgtcctatgtgtgtggattccagggcaactctagcatcagagcaaaagccttgggtttctcgcattcagtggcctatctccagattgtctgatttctgaatgtaaagttgttgtgtttttttttaaatagtagtttgtagtattttaaagaaagaacagatcgagttctaattatgatctagcttgattttgtgttgatccaaatttgcatagctgtttaatgttaagtcatgacaatttatttttcttggcatgctatgtaaacttgaatttcctatgtatttttattgtggtgttttaaatatggggaggggtattgagcattttttagggagaaaaataaatatatgctgtagtggccacaaataggcctatgatttagctggcaggccaggttttctcaagagcaaaatcaccctctggccccttggcaggtaaggcctcccggtcagcattatcctgccagacctcggggaggatacctgggagacagaagcctctgcacctactgtgcagaactctccacttccccaaccctccccaggtgggcagggcggagggagcctcagcctccttagactgacccctcaggcccctaggctggggggttgtaaataacagcagtcaggttgtttaccagccctttgcacctccccaggcagagggagcctctgttctggtgggggccacctccctcagaggctctgctagccacactccgtggcccaccctttgttaccagttcttcctccttcctcttttcccctgcctttctcattccttccttcgtctccctttttgttcctttgcctcttgcctgtcccctaaaacttgactgtggcactcagggtcaaacagactatccattccccagcatgaatgtgccttttaattagtgatctagaaagaagttcagccgaacccacaccccaactccctcccaagaacttcggtgcctaaagcctcctgttccacctcaggttttcacaggtgctcccaccccagttgaggctcccacccacagggctgtctgtcacaaacccacctctgttgggagctattgagccacctgggatgagatgacacaaggcactcctaccactgagcgcctttgccaggtccagcctgggctcaggttccaagactcagctgcctaatcccagggttgagccttgtgctcgtggcggaccccaaaccactgccctcctgggtaccagccctcagtgtggaggctgagctggtgcctggccccagtcttatctgtgcctttactgctttgcgcatctcagatgctaacttggttctttttccagaagcctttgtattggttaaaaattattttccattgcagaagcagctggactatgcaaaaagtatttctctgtcagttccccactctataccaaggatattattaaaactagaaatgactgcattgagagggagttgtgggaaataagaagaatgaaagcctctctttctgtccgcagatcctgacttttccaaagtgccttaaaagaaatcagacaaatgccctgagtggtaacttctgtgttattttactcttaaaaccaaactctaccttttcttgttgttttttttttttttttttttttttttttggttaccttctcattcatgtcaagtatgtggttcattcttagaaccaagggaaatactgctccccccatttgctgacgtagtgctctcatgggctcacctgggcccaaggcacagccagggcacagttaggcctggatgtttgcctggtccgtgagatgccgcgggtcctgtttccttactggggatttcagggctgggggttcagggagcatttccttttcctgggagttatgaccgcgaagttgtcatgtgccgtgcccttttctgtttctgtgtatcctattgctggtgactctgtgtgaactggcctttgggaaagatcagagagggcagaggtggcacaggacagtaaaggagatgctgtgctggccttcagcctggacagggtctctgctgactgccaggggcgggggctctgcatagccaggatgacggctttcatgtcccagagacctgttgtgctgtgtattttgatttcctgtgtatgcaaatgtgtgtatttaccattgtgtagggggctgtgtctgatcttggtgttcaaaacagaactgtatttttgcctttaaaattaaataatataacgtgaataaatgaccctatctttgtaactgca

SEQ ID NO: 33700 - DNA, 1535 bp, Homo sapiens
gcctcgggcggcttctcgccgctcccaggtctggctggctggaggagtctcagctctcagccgctcgcccgcccccgctccgggccctcccctagtcgccgctgtggggcagcgcctggcgggcggcccgcgggcgggtcgcctcccctcctgtagcccacacccttcttaaagcggcggcgggaagatgaggcttcgggagccgctcctgagcggcagcgccgcgatgccaggcgcgtccctacagcgggcctgccgcctgctcgtggccgtctgcgctctgcaccttggcgtcaccctcgtttactacctggctggccgcgacctgagccgcctgccccaactggtcggagtctccacaccgctgcagggcggctcgaacagtgccgccgccatcgggcagtcctccggggagctccggaccggaggggcccggccgccgcctcctctaggcgcctcctcccagccgcgcccgggtggcgactccagcccagtcgtggattctggccctggccccgctagcaacttgacctcggtcccagtgccccacaccaccgcactgtcgctgcccgcctgccctgaggagtccccgctgcttgtgggccccatgctgattgagtttaacatgcctgtggacctggagctcgtggcaaagcagaacccaaatgtgaagatgggcggccgctatgcccccagggactgcgtctctcctcacaaggtggccatcatcattccattccgcaaccggcaggagcacctcaagtactggctatattatttgcacccagtcctgcagcgccagcagctggactatggcatctatgttatcaaccagtatgaaaaaataagaagactcctgtggtgaaggcttcgcctggtctgttctgctctggaggtggcagcgcatggtggttagtcccagcatcttcctggagatttgagcgtgagacgtgctggctgtgtgggctgtgccacctgaggaggattggccagtcataaggactcagcctggttgctgaatccagctggggaccttgaccccagtgactggcttttcagcggctacctgttctcgagacaaatgctgtcctcccctaaggagtctgggctgtggcaaagctatgacataggtacaaccgtccttttgccaggtggggcttaggtggagaagttgaagcctggactcagtcaagatctcaggactgggagcaaggagcctcttactcccagggtgcccacttggttcccactgactgttggtggaaactaggggctgagctggaggctttttagaggaagaaatgacaagctgggggctggattatccctgggggtgaaaatggagtcagctagataggttatgtcttgaaggagaggagggtcccctggtgtcaggaagcagagcctgaactccatgttagaccctggattggagagtgggcaggacacttgggagagacaggacttggtactggcgagggtactaccacacccattctgggagtggactatagagaaataaatcctaaaagtgg

SEQ ID NO: 33701 - DNA, 1633 bp, Homo sapiens
aaagcggcggcgggaagatgaggcttcgggagccgctcctgagcggcagcgccgcgatgccaggcgcgtccctacagcgggcctgccgcctgctcgtggccgtctgcgctctgcaccttggcgtcaccctcgtttactacctggctggccgcgacctgagccgcctgccccaactggtcggagtctccaccccagtcgtggattctggccctggccccgctagcaacttgacctcggtcccagtgccccacaccaccgcactgtcgctgcccgcctgccctgaggagtccccgctgcttgtgggccccatgctgattgagtttaacatgcctgtggacctggagctcgtggcaaagcagaacccaaatgtgaagatgggcggccgctatgcccccagggactgcgtctctcctcacaaggtggccatcatcattccattccgcaaccggcaggagcacctcaagtactggctatattatttgcacccagtcctgcagcgccagcagctggactatggcatctatgttatcaaccaggcgggagacactatattcaatcgtgctaagctcctcaatgttggctttcaagaagccttgaaggactatgactacacctgctttgtgtttagtgacgtggacctcattccaatgaatgaccataatgcgtacaggtgtttttcacagccacggcacatttccgttgcaatggataagtttggattcagcctaccttatgttcagtattttggaggtgtctctgctctaagtaaacaacagtttctaaccatcaatggatttcctaataattattggggctggggaggagaagatgatgacatttttaacagattagtttttagaggcatgtctatatctcgcccaaatgctgtggtcgggaggtgtcgcatgatccgccactcaagagacaagaaaaatgaacccaatcctcagaggtttgaccgaattgcacacacaaaggagacaatgctctctgatggtttgaactcactcacctaccaggtgctggatgtacagagatacccattgtatacccaaatcacagtggacatcgggacaccgagctagcgttttggtacacggataagagacctgaaattagccagggacctctgctgtgtgtctctgccaatctgctgggctggtccctctcatttttaccagtctgagtgacaggtccccttcgctcatcattcagatggctttccagatgaccaggacgagtgggatattttgcccccaacttggctcggcatgtgaattcttagctctgcaaggtgtttatgcctttgcgggtttcttgatgtgttcgcagtgtcaccccagagtcagaactgtacacatcccaaaatttggtggccgtggaacacattcccggtgatagaattgctaaattgtcgtgaaataggttagaatttttctttaaattatggttttcttattcgtgaaaattcggagagtgctgctaaaattggattggtgtgatctttttggtagttgtaatttaacagaaaaacacaaaatttcaaccattcttaatgttacgtcctccccccacccccttctttcagtggtatgcaaccactgcaatcactgtgcatatgtcttttcttagc

SEQ ID NO: 33702 - DNA, 799 bp, Homo sapiens
agcaaagcaagtggaaggaggagttcctctctgatctgcttcttattctccacctaccttctcttctgtactttccgcctcctagagagagagagagagagaggaatgccgacctaactaccgctgccactgctgctgccaccaccgctgccaccaccaccctggcgggagacactatattcaatcgtgctaagctcctcaatgttggctttcaagaagccttgaaggactatgactacacctgctttgtgtttagtgacgtggacctcattccaatgaatgaccataatgcgtacaggtgtttttcacagccacggcacatttccgttgcaatggataagtttggattcagcctaccttatgttcagtattttggaggtgtctctgctctaagtaaacaacagtttctaaccatcaatggatttcctaataattattggggctggggaggagaagatgatgacatttttaacagattagtttttagaggcatgtctatatctcgcccaaatgctgtggtcgggaggtgtcgcatgatccgccactcaagagacaagaaaaatgaacccaatcctcagaggtttgaccgaattgcacacacaaaggagacaatgctctctgatggtttgaactcactcacctaccaggtgctggatgtacagagatacccattgtatacccaaatcacagtggacatcgggacaccgagctagcgttttggtacacggataagagacctgaaattagccagggacctctgctgtgtgtctctgccaatctgctgggctggtccctctca

SEQ ID NO: 33703 - DNA, 1262 bp, Homo sapiens
gtgagctgtctgagagtctggatgtatggctgtggaagtccaggagcagtggccttgtttgccagcagccggatgcccgggcccactgggcgggccagtggccgcctgcgggatgagcagactgctgggggggacgctggagcgcgtctgcaaggctgtgctccttctctgcctgctgcacttcctcgtggccgtcatcctctactttgacgtctacgcccagcacctggccttcttcagccgcttcagtgcccgaggccctgcccatgccctccacccagctgctagcagcagcagcagcagcagcaactgctcccggcccaacgccaccgcctctagctccgggctccctgaggtccccagtgccctgcccggtcccacggctcccacgctgccaccctgtcctgactcgccacctggtcttgtgggcagactgctgatcgagttcacctcacccatgcccctggagcgggtgcagagggagaacccaggcgtgctcatgggcggccgatacacaccgcccgactgcaccccagcccagacggtggcggtcatcatcccctttagacaccgggaacaccacctgcgctactggctccactatctacaccccatcttgaggcggcagcggctgcgctacggcgtctatgtcatcaaccagcatggtgaggacaccttcaaccgggccaagctgcttaacgtgggcttcctagaggcgctgaaggaggatgccgcctatgactgcttcatcttcagcgatgtggacctggtccccatggatgaccgcaacctataccgctgcggcgaccaaccccgccactttgccattgccatggacaagtttggcttccggcttccctatgctggctactttggaggtgtgtcaggcctgagtaaggctcagtttctgagaatcaatggcttccccaatgagtactggggctggggtggcgaggatgatgacatcttcaaccggatctccctgactgggatgaagatctcacgcccagacatccgaatcggccgctaccgcatgatcaagcacgaccgcgacaagcataacgaacctaaccctcagaggtttaccaagattcaaaacacgaagctgaccatgaagcgggacggcattgggtcagtgcggtaccaggtcttggaggtgtctcggcaaccactcttcaccaatatcacagtggacattgggcggcctccgtcgtggccccctcggggctgacactaatggacagaggctctcggtgccgaag

SEQ ID NO: 33704 - DNA, 2629 bp, Homo sapiens
gtgttcagcctgccagccccgcccaaacgcacccctcagcctggccgccagcctgacccagaacccctgcgccggagggagggtgggaatgtctgcacgtgggtctgggtgtgagctgtctgagagtctggatgtatggctgtggaagtccaggagcagtggccttgtttgtgagtgtgggacttagtgtgttactgtcacccgggtgtgtctgtgactgtagttctctgtgtgtctgagtgtgggtgaccagctgggaccagggtgtccctgtgattctgtgtgcctgtgagactcaccctgctccctgaagcactgccagaagtggctgccgctctcttggaaccacagctggagccatcgcccaggcaagacccccttcctgccatgcccagtgctgtgcccatctccaggcccaagcatcccgttccgggaatcagaaccagctgtgctgggcaggacccagagtcttggtcccagtcccaaggggctggctttgaggtcttaagtgaggggtgtcccctgccttgccccgtattttgacgttttgctccagtgggaagggattctgtaaacatccagtctgtatttgggccccccggatgctgagggcaacttcccagcctggtcccagttggcctggcctgcttgtcgctgggatctgaatgaccaaaccacttcccaccatggctcctggaaggactaaatgaagtcatgagtataaagtgctcctgcatggccagcagccggatgcccgggcccactgggcgggccagtggccgcctgcgggatgagcagactgctgggggggacgctggagcgcgtctgcaaggctgtgctccttctctgcctgctgcacttcctcgtggccgtcatcctctactttgacgtctacgcccagcacctggccttcttcagccgcttcagtgcccgaggccctgcccatgccctccacccagctgctagcagcagcagcagcagcagcaactgctcccggcccaacgccaccgcctctagctccgggctccctgaggtccccagtgccctgcccggtcccacggctcccacgctgccaccctgtcctgactcgccacctggtcttgtgggcagactgctgatcgagttcacctcacccatgcccctggagcgggtgcagagggagaacccaggcgtgctcatgggcggccgatacacaccgcccgactgcaccccagcccagacggtggcggtcatcatcccctttagacaccgggaacaccacctgcgctactggctccactatctacaccccatcttgaggcggcagcggctgcgctacggcgtctatgtcatcaaccagcatggtgaggacaccttcaaccgggccaagctgcttaacgtgggcttcctagaggcgctgaaggaggatgccgcctatgactgcttcatcttcagcgatgtggacctggtccccatggatgaccgcaacctataccgctgcggcgaccaaccccgccactttgccattgccatggacaagtttggcttccggcttccctatgctggctactttggaggtgtgtcaggcctgagtaaggctcagtttctgagaatcaatggcttccccaatgagtactggggctggggtggcgaggatgatgacatcttcaaccggatctccctgactgggatgaagatctcacgcccagacatccgaatcggccgctaccgcatgatcaagcacgaccgcgacaagcataacgaacctaaccctcagaggtttaccaagattcaaaacacgaagctgaccatgaagcgggacggcattgggtcagtgcggtaccaggtcttggaggtgtctcggcaaccactcttcaccaatatcacagtggacattgggcggcctccgtcgtggccccctcggggctgacactaatggacagaggctctcggtgccgaagattgcctgccagaggactgaccacagcctggctggcagctgctctgtggaggacctccaggactgagactgggctctgttttccaagggtcttcactaggccccctagctacacctggaagtttcagaacccactttggggggcctcctgcctgggcaggctcttcaagtgtggccctctttggagtcaaccctccttcccgaccccctccccctagcccagccccagtcactgtcagggtcgggccagcccctgcactgcctcgcagagtggcctgggctaggtcactccacctctctgtgcctcagtttcccccccttgagtcccctagggcctggaagggtgggaggtatgtctagggggcagtgtctcttccagggggaattctcagctcttgggaacccccttgctcccaggggaggggaaacctttttcattcaacattgtagggggcaagctttggtgcgccccctgctgaggagcagccccaggaggggaccagaggggatgctgtgtcgctgcctgggatcttggggttggcctttgcatgggaggcaggtggggcttggatcagtaagtctggttcccgcctccctgtctgagagaggaggcaggagccccagggccggcttgtgtttgtacattgcacagaaacttgtgtgggtgctttagtaaaaaacgtgaatgga

SEQ ID NO: 33705 - DNA, 2208 bp, Homo sapiens
cgcgcgggccgggcctgcccctccgaggcgccgtagcgcgggagggaggcggcggcgctgtggtccgtgggtccgccggtccgtgggtctgcccggccgcccggccccgccctgccccccggggcggctcggctccatggcccgcggcggcggcggcggcggcggcggcgggaggcgacccgggggccgcggtggccgctgaccgggcggcgggaggcggcggggccgggccatgggggacggaaccgtccgcagccgccggagccgggagccctgcccaagtcggagcggcgtcccctgctgagccccgagcgccgggccagcagccggatgcccgggcccactgggcgggccagtggccgcctgcgggatgagcagactgctgggggggacgctggagcgcgtctgcaaggctgtgctccttctctgcctgctgcacttcctcgtggccgtcatcctctactttgacgtctacgcccagcacctggccttcttcagccgcttcagtgcccgaggccctgcccatgccctccacccagctgctagcagcagcagcagcagcagcaactgctcccggcccaacgccaccgcctctagctccgggctccctgaggtccccagtgccctgcccggtcccacggctcccacgctgccaccctgtcctgactcgccacctggtcttgtgggcagactgctgatcgagttcacctcacccatgcccctggagcgggtgcagagggagaacccaggcgtgctcatgggcggccgatacacaccgcccgactgcaccccagcccagacggtggcggtcatcatcccctttagacaccgggaacaccacctgcgctactggctccactatctacaccccatcttgaggcggcagcggctgcgctacggcgtctatgtcatcaaccagcatggtgaggacaccttcaaccgggccaagctgcttaacgtgggcttcctagaggcgctgaaggaggatgccgcctatgactgcttcatcttcagcgatgtggacctggtccccatggatgaccgcaacctataccgctgcggcgaccaaccccgccactttgccattgccatggacaagtttggcttccggcttccctatgctggctactttggaggtgtgtcaggcctgagtaaggctcagtttctgagaatcaatggcttccccaatgagtactggggctggggtggcgaggatgatgacatcttcaaccggatctccctgactgggatgaagatctcacgcccagacatccgaatcggccgctaccgcatgatcaagcacgaccgcgacaagcataacgaacctaaccctcagaggtttaccaagattcaaaacacgaagctgaccatgaagcgggacggcattgggtcagtgcggtaccaggtcttggaggtgtctcggcaaccactcttcaccaatatcacagtggacattgggcggcctccgtcgtggccccctcggggctgacactaatggacagaggctctcggtgccgaagattgcctgccagaggactgaccacagcctggctggcagctgctctgtggaggacctccaggactgagactgggctctgttttccaagggtcttcactaggccccctagctacacctggaagtttcagaacccactttggggggcctcctgcctgggcaggctcttcaagtgtggccctctttggagtcaaccctccttcccgaccccctccccctagcccagccccagtcactgtcagggtcgggccagcccctgcactgcctcgcagagtggcctgggctaggtcactccacctctctgtgcctcagtttcccccccttgagtcccctagggcctggaagggtgggaggtatgtctagggggcagtgtctcttccagggggaattctcagctcttgggaacccccttgctcccaggggaggggaaacctttttcattcaacattgtagggggcaagctttggtgcgccccctgctgaggagcagccccaggaggggaccagaggggatgctgtgtcgctgcctgggatcttggggttggcctttgcatgggaggcaggtggggcttggatcagtaagtctggttcccgcctccctgtctgagagaggaggcaggagccccagggccggcttgtgtttgtacattgcacagaaacttgtgtgggtgctttagtaaaaaacgtgaatgg

SEQ ID NO: 33706 - DNA, 1923 bp, Homo sapiens
gaaccgtccgcagccgccggagccgggagccctgcccaagtcggagcggcgtcccctgctgagccccgagcgccgggccagcagccggatgcccgggcccactgggcgggccagtggccgcctgcgggatgagcagactgctgggggggacgctggagcgcgtctgcaaggctgtgctccttctctgcctgctgcacttcctcgtggccgtcatcctctactttgacgtctacgcccagcacctggccttcttcagccgcttcagtgcccgaggccctgcccatgccctccacccagctgctagcagcagcagcagcagcagcaactgctcccggcccaacgccaccgcctctagctccgggctccctgaggtccccagtgccctgcccggtcccacggctcccacgctgccaccctgtcctgactcgccacctggtcttgcgggtgcagagggagaacccaggcgtgctcatgggcggccgatacacaccgcccgactgcaccccagcccagacggtggcggtcatcatcccctttagacaccgggaacaccacctgcgctactggctccactatctacaccccatcttgaggcggcagcggctgcgctacggcgtctatgtcatcaaccagcatggtgaggacaccttcaaccgggccaagctgcttaacgtgggcttcctagaggcgctgaaggaggatgccgcctatgactgcttcatcttcagcgatgtggacctggtccccatggatgaccgcaacctataccgctgcggcgaccaaccccgccactttgccattgccatggacaagtttggcttccggcttccctatgctggctactttggaggtgtgtcaggcctgagtaaggctcagtttctgagaatcaatggcttccccaatgagtactggggctggggtggcgaggatgatgacatcttcaaccggatctccctgactgggatgaagatctcacgcccagacatccgaatcggccgctaccgcatgatcaagcacgaccgcgacaagcataacgaacctaaccctcagaggtttaccaagattcaaaacacgaagctgaccatgaagcgggacggcattgggtcagtgcggtaccaggtcttggaggtgtctcggcaaccactcttcaccaatatcacagtggacattgggcggcctccgtcgtggccccctcggggctgacactaatggacagaggctctcggtgccgaagattgcctgccagaggactgaccacagcctggctggcagctgctctgtggaggacctccaggactgagactgggctctgttttccaagggtcttcactaggccccctagctacacctggaagtttcagaacccactttggggggcctcctgcctgggcaggctcttcaagtgtggccctctttggagtcaaccctccttcccgaccccctccccctagcccagccccagtcactgtcagggtcgggccagcccctgcactgcctcgcagagtggcctgggctaggtcactccacctctctgtgcctcagtttcccccccttgagtcccctagggcctggaagggtgggaggtatgtctagggggcagtgtctcttccagggggaattctcagctcttgggaacccccttgctcccaggggaggggaaacctttttcattcaacattgtagggggcaagctttggtgcgccccctgctgaggagcagccccaggaggggaccagaggggatgctgtgtcgctgcctgggatcttggggttggcctttgcatgggaggcaggtggggcttggatcagtaagtctggttcccgcctccctgtctgagagaggaggcaggagccccagggccggcttgtgtttgtacattgcacagaaacttgtgtgggtgctttagtaaaaaacgtgaatgga

SEQ ID NO: 33707 - DNA, 1619 bp, Homo sapiens
atgttgcggaggctgctggagcggccttgcacgctggccctgcttgtgggctcccagctggctgtcatgatgtacctgtcactggggggcttccgaagtctcagtgccctatttggccgagatcagggaccgacatttgactattctcaccctcgtgatgtctacagtaacctcagtcacctgcctggggccccagggggtcctccagctcctcaaggtctgccctactgtccagaacgatctcctctcttagtgggtcctgtgtcggtgtcctttagcccagtgccatcactggcagagattgtggagcggaatccccgggtagaaccagggggccggtaccgccctcctgctgctctaccacctgcaccccttcttgcagcgccagcagcttgcttatggcatctatgtcatccaccaggctggaaatggaacatttaacagggcaaaactgttgaacgttggggtgcgagaggccctgcgtgatgaagagtgggactgcctgttcttgcacgatgtggacctcttgccagaaaatgaccacaatctgtatgtgtgtgacccccggggaccccgccatgttgccgttgctatgaacaagtttggatacagcctcccgtacccccagtacttcggaggagtctcagcacttactcctgaccagtacctgaagatgaatggcttccccaatgaatactggggctggggtggtgaggatgacgacattgctaccagggtgcgcctggctgggatgaagatctctcggccccccacatctgtaggacactataagatggtgaagcaccgaggagataagggcaatgaggaaaatccccacagatttgacctcctggtccgtacccagaattcctggacgcaagatgggatgaactcactgacataccagttgctggctcgagagctggggcctctttataccaacatcacagcagacattgggactgaccctcggggtcctcgggctccttctgggccacgttacccacctggttcctcccaagccttccgtcaagagatgctgcaacgccggcccccagccaggcctgggcctctatctactgccaaccacacagccctccgaggttcacactgactcctccttcctgtctaccttaatcatgaaaccgaattcatggggttgtattctccccaccctcagctcctcactgttctcagagggatgtgagggaactgaactctggtgccgtgctagggggtaggggcctctccctcactgctggactggagctgggctcctgtagacctgaggggtccctctctctagggtctcctgtagggcttatgactgtgaatccttgatgtcatgattttatgtgacgattcctaggagtccctgcccctagagtaggagcagggctggaccccaagcccctccctcttccatggagagaagagtgatctggcttctcctcggacctctgtgaatatttattctatttatggttcccgggaagttgtttggtgaaggaagcccctccctgggcattttctgcctatgctggaatagctccctcttctggtcctggctcagggggctgggattttgatatattttctaataaaggactttgtctcgc

SEQ ID NO: 33708 - DNA, 1911 bp, Homo sapiens
atggcggcagcgatgcctgcccggctgttggggtggcggtgacgacaggcagcaaaagaccagctggtcccagattcgctgctggagtgctggatggagcctttctctgccctctgtgacatttccaattttagataatgcctcacatctctgtccccccgggaccccctggagcccccatgatccctaagaagacagcttgaacctagatctcacccccaggatgttgcggaggctgctggagcggccttgcacgctggccctgcttgtgggctcccagctggctgtcatgatgtacctgtcactggggggcttccgaagtctcagtgccctatttggccgagatcagggaccgacatttgactattctcaccctcgtgatgtctacagtaacctcagtcacctgcctggggccccagggggtcctccagctcctcaaggtctgccctactgtccagaacgatctcctctcttagtgggtcctgtgtcggtgtcctttagcccagtgccatcactggcagagattgtggagcggaatccccgggtagaaccagggggccggtaccgccctgcaggttgtgagccccgctcccgaacagccatcattgtgcctcatcgtgcccgggagcaccacctgcgcctgctgctctaccacctgcaccccttcttgcagcgccagcagcttgcttatggcatctatgtcatccaccaggctggaaatggaacatttaacagggcaaaactgttgaacgttggggtgcgagaggccctgcgtgatgaagagtgggactgcctgttcttgcacgatgtggacctcttgccagaaaatgaccacaatctgtatgtgtgtgacccccggggaccccgccatgttgccgttgctatgaacaagtttggatacagcctcccgtacccccagtacttcggaggagtctcagcacttactcctgaccagtacctgaagatgaatggcttccccaatgaatactggggctggggtggtgaggatgacgacattgctaccagggtgcgcctggctgggatgaagatctctcggccccccacatctgtaggacactataagatggtgaagcaccgaggagataagggcaatgaggaaaatccccacagatttgacctcctggtccgtacccagaattcctggacgcaagatgggatgaactcactgacataccagttgctggctcgagagctggggcctctttataccaacatcacagcagacattgggactgaccctcggggtcctcgggctccttctgggccacgttacccacctggttcctcccaagccttccgtcaagagatgctgcaacgccggcccccagccaggcctgggcctctatctactgccaaccacacagccctccgaggttcacactgactcctccttcctgtctaccttaatcatgaaaccgaattcatggggttgtattctccccaccctcagctcctcactgttctcagagggatgtgagggaactgaactctggtgccgtgctagggggtaggggcctctccctcactgctggactggagctgggctcctgtagacctgaggggtccctctctctagggtctcctgtagggcttatgactgtgaatccttgatgtcatgattttatgtgacgattcctaggagtccctgcccctagagtaggagcagggctggaccccaagcccctccctcttccatggagagaagagtgatctggcttctcctcggacctctgtgaatatttattctatttatggttcccgggaagttgtttggtgaaggaagcccctccctgggcattttctgcctatgctggaatagctccctcttctggtcctggctcagggggctgggattttgatatattttctaataaaggactttgtctcgca

SEQ ID NO: 33709 - DNA, 1402 bp, Homo sapiens
atggcggcagcgatgcctgcccggctgttggggtggcggtgacgacaggcagcaaaagaccagctggtcccagattcgctgctggagtgctggatggagcctttctctgccctctgtgacatttccaattttagataatgcctcacatctctgtccccccgggaccccctggagcccccatgatccctaagaagacagcttgaacctagatctcacccccaggatgttgcggaggctgctggagcggccttgcacgctggccctgcttgtgggctcccagctggctgtcatgatgtacctgtcactggggggcttccgaagtctcagtgccctatttggccgagatcagggaccgacatttgactattctcaccctcgtgatgtctacagtaacctcagtcacctgcctggggccccagggggtcctccagctcctcaaggtctgccctactgtccagaacgatctcctctcttagtgggtcctgtgtcggtgtcctttagcccagtgccatcactggcagagattgtggagcggaatccccgggtagaaccagggggccggtaccgccctgcaggttgtgagccccgctcccgaacagccatcattgtgcctcatcgtgcccgggagcaccacctgcgcctgctgctctaccacctgcaccccttcttgcagcgccagcagcttgcttatggcatctatgtcatccaccaggctggaaatggaacatttaacagggcaaaactgttgaacgttggggtgcgagaggccctgcgtgatgaagagtgggactgcctgttcttgcacgatgtggacctcttgccagaaaatgaccacaatctgtatgtgtgtgacccccggggaccccgccatgttgccgttgctatgaacaagtttggatacagcctcccgtacccccagtacttcggaggagtctcagcacttactcctgaccagtacctgaagatgaatggcttccccaatgaatactggggctggggtggtgaggatgacgacattgctaccagggtgcgcctggctgggatgaagatctctcggccccccacatctgtaggacactataagatggtgaagcaccgaggagataagggcaatgaggaaaatccccacagatttgacctcctggtccgtacccagaattcctggacgcaagatgggatgaactcactgacataccagttgctggctcgagagctggggcctctttataccaacatcacagcagacattgggactgaccctcggggtcctcgggctccttctgggccacgttacccacctggttcctcccaagccttccgtcaagagatgctgcaacgccggcccccagccaggcctgggcctctatctactgccaaccacacaccctccgaggttcacact

SEQ ID NO: 33710 - DNA, 1871 bp, Homo sapiens
cccgcttccaagatggcggcagcgatgcctgcccggctgttggggtggcggtgacgacaggcagcaaaagaccagataatgcctcacatctctgtccccccgggaccccctggagcccccatgatccctaagaagacagcttgaacctagaattcccctctccctccctagatctcacccccaggatgttgcggaggctgctggagcggccttgcacgctggccctgcttgtgggctcccagctggctgtcatgatgtacctgtcactggggggcttccgaagtctcagtgccctatttggccgagatcagggaccgacatttgactattctcaccctcgtgatgtctacagtaacctcagtcacctgcctggggccccagggggtcctccagctcctcaaggtctgccctactgtccagaacgatctcctctcttagtgggtcctgtgtcggtgtcctttagcccagtgccatcactggcagagattgtggagcggaatccccgggtagaaccagggggccggtaccgccctgcaggttgtgagccccgctcccgaacagccatcattgtgcctcatcgtgcccgggagcaccacctgcgcctgctgctctaccacctgcaccccttcttgcagcgccagcagcttgcttatggcatctatgtcatccaccaggctggaaatggaacatttaacagggcaaaactgttgaacgttggggtgcgagaggccctgcgtgatgaagagtgggactgcctgttcttgcacgatgtggacctcttgccagaaaatgaccacaatctgtatgtgtgtgacccccggggaccccgccatgttgccgttgctatgaacaagtttggatacagcctcccgtacccccagtacttcggaggagtctcagcacttactcctgaccagtacctgaagatgaatggcttccccaatgaatactggggctggggtggtgaggatgacgacattgctaccagggtgcgcctggctgggatgaagatctctcggccccccacatctgtaggacactataagatggtgaagcaccgaggagataagggcaatgaggaaaatccccacagatttgacctcctggtccgtacccagaattcctggacgcaagatgggatgaactcactgacataccagttgctggctcgagagctggggcctctttataccaacatcacagcagacattgggactgaccctcggggtcctcgggctccttctgggccacgttacccacctggttcctcccaagccttccgtcaagagatgctgcaacgccggcccccagccaggcctgggcctctatctactgccaaccacacagccctccgaggttcacactgactcctccttcctgtctaccttaatcatgaaaccgaattcatggggttgtattctccccaccctcagctcctcactgttctcagagggatgtgagggaactgaactctggtgccgtgctagggggtaggggcctctccctcactgctggactggagctgggctcctgtagacctgaggggtccctctctctagggtctcctgtagggcttatgactgtgaatccttgatgtcatgattttatgtgacgattcctaggagtccctgcccctagagtaggagcagggctggaccccaagcccctccctcttccatggagagaagagtgatctggcttctcctcggacctctgtgaatatttattctatttatggttcccgggaagttgtttggtgaaggaagcccctccctgggcattttctgcctatgctggaatagctccctcttctggtcctggctcagggggctgggattttgatatattttctaataaaggactttgtctcg

SEQ ID NO: 33711 - DNA, 1875 bp, Homo sapiens
gcgagaccccgcccccgcagcgcccgcttccaagatggcggcagcgatgcctgcccggctgttggggtggcggtgacgacaggcagcaaaagaccagctggtcccagattcgctgctggagtgctggatggagcctttctctgccctctgtgacatttccaattttagataatgcctcacatctctgtccccccgggaccccctggagcccccatgatccctaagaagacagcttgaacctagatctcacccccaggatgttgcggaggctgctggagcggccttgcacgcttgccctatttggccgagatcagggaccgacatttgactattctcaccctcgtgatgtctacagtaacctcagtcacctgcctggggccccagggggtcctccagctcctcaaggtctgccctactgtccagaacgatctcctctcttagtgggtcctgtgtcggtgtcctttagcccagtgccatcactggcagagattgtggagcggaatccccgggtagaaccagggggccggtaccgccctgcaggttgtgagccccgctcccgaacagccatcattgtgcctcatcgtgcccgggagcaccacctgcgcctgctgctctaccacctgcaccccttcttgcagcgccagcagcttgcttatggcatctatgtcatccaccaggctggaaatggaacatttaacagggcaaaactgttgaacgttggggtgcgagaggccctgcgtgatgaagagtgggactgcctgttcttgcacgatgtggacctcttgccagaaaatgaccacaatctgtatgtgtgtgacccccggggaccccgccatgttgccgttgctatgaacaagtttggatacagcctcccgtacccccagtacttcggaggagtctcagcacttactcctgaccagtacctgaagatgaatggcttccccaatgaatactggggctggggtggtgaggatgacgacattgctaccagggtgcgcctggctgggatgaagatctctcggccccccacatctgtaggacactataagatggtgaagcaccgaggagataagggcaatgaggaaaatccccacagatttgacctcctggtccgtacccagaattcctggacgcaagatgggatgaactcactgacataccagttgctggctcgagagctggggcctctttataccaacatcacagcagacattgggactgaccctcggggtcctcgggctccttctgggccacgttacccacctggttcctcccaagccttccgtcaagagatgctgcaacgccggcccccagccaggcctgggcctctatctactgccaaccacacagccctccgaggttcacactgactcctccttcctgtctaccttaatcatgaaaccgaattcatggggttgtattctccccaccctcagctcctcactgttctcagagggatgtgagggaactgaactctggtgccgtgctagggggtaggggcctctccctcactgctggactggagctgggctcctgtagacctgaggggtccctctctctagggtctcctgtagggcttatgactgtgaatccttgatgtcatgattttatgtgacgattcctaggagtccctgcccctagagtaggagcagggctggaccccaagcccctccctcttccatggagagaagagtgatctggcttctcctcggacctctgtgaatatttattctatttatggttcccgggaagttgtttggtgaaggaagcccctccctgggcattttctgcctatgctggaatagctccctcttctggtcctggctcagggggctgggattttgatatattttctaataaaggactttgtctcgc

SEQ ID NO: 33712 - DNA, 3081 bp, Homo sapiens
atgtgcgctgggaatgcgtcgacacggaggcctgggataaaggtttgggcattcgagagagtgagaagttttgggtaacgcctggagacgagcctgagcagggacggggtcctaggtggaagtatggacgggggccgggcgggctcacgttgctagtaggtagggcaaaagcaagagactgtctctgcccctgctctccctctccctttctcttcagcagtaaccctcctccccacccccgctagaagaggggaaaggtagaaaaggtagaggacgccacccccaccctactctccgccgagctccggggctgttcgcttacagcccccaggtggtcacggtccctgcacctgaggagttggcacccaggcacatgaagaatagaaggagcctgtttcctacttcgccctgggtactccttaggccactccacggtcctgtcatgactctgtcgccacttcaactggttcttggtctgggggaaaacaatgtttccattagctgtcctgtccccactccccaatctgtcctgttggggtgggggtacgggggtggttaagtatgaacctgacacttatcattccagggtagcacgggagataggcgagggacctaccatctcctgctcctcctcttcctttccaaccactttccttcacttcgcctgctgggaaaccagcttcaccctgatcctgatctctggcggtgcaggtagctagttatcctttaccacttctgttccagctggtcccagattcgctgctggagtgctggatggagcctttctctgccctctgtgacatttccaattttagataatgcctcacatctctgtccccccgggaccccctggagcccccatgatccctaagaagacagcttgaacctaggtgagtctatctcttcccttctaaaattggaagagggggttctctagagactttctgaaatgaacatgagatttgaatgatgtaaacatttttgggggtgaggactgacagtagatggtgggagtggtttggggggaggtagaggagagcgaaacttgggctgaagtgacaggtggtagggttactggtggttacattctgtttccttgcgtgactgtgcacctgtgtgctcccttctgtgactttgttttctgctttttcctctttacccctggcatcaccttcaaccctacctactgacctctctgctggcttgctctcttcctgcctacccccagaattcccctctccctccctagatctcacccccaggatgttgcggaggctgctggagcggccttgcacgctggccctgcttgtgggctcccagctggctgtcatgatgtacctgtcactggggggcttccgaagtctcagtgccctatttggccgagatcagggaccgacatttgactattctcaccctcgtgatgtctacagtaacctcagtcacctgcctggggccccagggggtcctccagctcctcaaggtctgccctactgtccagaacgatctcctctcttagtgggtcctgtgtcggtgtcctttagcccagtgccatcactggcagagattgtggagcggaatccccgggtagaaccagggggccggtaccgccctgcaggttgtgagccccgctcccgaacagccatcattgtgcctcatcgtgcccgggagcaccacctgcgcctgctgctctaccacctgcaccccttcttgcagcgccagcagcttgcttatggcatctatgtcatccaccaggctggaaatggaacatttaacagggcaaaactgttgaacgttggggtgcgagaggccctgcgtgatgaagagtgggactgcctgttcttgcacgatgtggacctcttgccagaaaatgaccacaatctgtatgtgtgtgacccccggggaccccgccatgttgccgttgctatgaacaagtttggatacaggtagagggcatggaagggtactgggaaacagggaagcctactatcctgtggaaggaggagagccaagcggattgtggttggggatgtgtccccagaagactcggggtatgcaaggatctttctctccctagcctcccgtacccccagtacttcggaggagtctcagcacttactcctgaccagtacctgaagatgaatggcttccccaatgaatactggggctggggtggtgaggatgacgacattgctaccagggtgcgcctggctgggatgaagatctctcggccccccacatctgtaggacactataagatggtgaagcaccgaggagataagggcaatgaggaaaatccccacagatttgacctcctggtccgtacccagaattcctggacgcaagatgggatgaactcactgacataccagttgctggctcgagagctggggcctctttataccaacatcacagcagacattgggactgaccctcggggtcctcgggctccttctgggccacgttacccacctggttcctcccaagccttccgtcaagagatgctgcaacgccggcccccagccaggcctgggcctctatctactgccaaccacacagccctccgaggttcacactgactcctccttcctgtctaccttaatcatgaaaccgaattcatggggttgtattctccccaccctcagctcctcactgttctcagagggatgtgagggaactgaactctggtgccgtgctagggggtaggggcctctccctcactgctggactggagctgggctcctgtagacctgaggggtccctctctctagggtctcctgtagggcttatgactgtgaatccttgatgtcatgattttatgtgacgattcctaggagtccctgcccctagagtaggagcagggctggaccccaagcccctccctcttccatggagagaagagtgatctggcttctcctcggacctctgtgaatatttattctatttatggttcccgggaagttgtttggtgaaggaagcccctccctgggcattttctgcctatgctggaatagctccctcttctggtcctggctcagggggctgggattttgatatattttctaataaaggactttgtctcgc

SEQ ID NO: 33713 - DNA, 2385 bp, Homo sapiens
aagagccgcctcccgggcggctggggcggtccccgagctgctttccgcgttctcccctctccgcgggcagtgctagctcgccgcggccgcctccggggaccacctggcttcatgtgtggatttccacggctcttgcccagaggcgggtacactgtgttccaatgtgccacggaactcacgcagtggcactttgtggcttcatgaaggaagaggcaggccacgcaacacttcctccccaagccaaggagaagtatcacttttagaggcagaggagcggaaggcagtgggtgtgaccaaaagtgccatttgttaaagcttatcttccttgccagattttaaaaactattatggaaaatctcaagcattcacaaaagtagagagaaagaaaggactctcagactgttggagcagaactactgagaaaaaccaggcattgtatcttcagttgtcatcaagttcgcaatcagattggaaaagctcaacttgaagctttcttgcctgcagtgaagcagagagatagatattattcacgtaataaaaaacatgggcttcaacctgactttccacctttcctacaaattccgattactgttgctgttgactttgtgcctgacagtggttgggtgggccaccagtaactacttcgtgggtgccattcaagagattcctaaagcaaaggagttcatggctaatttccataagaccctcattttggggaagggaaaaactctgactaatgaagcatccacgaagaaggtagaacttgacaactgcccttctgtgtctccttacctcagaggccagagcaagctcattttcaaaccagatctcactttggaagaggtacaggcagaaaatcccaaagtgtccagaggccggtatcgccctcaggaatgtaaagctttacagagggtcgccatcctcgttccccaccggaacagagagaaacacctgatgtacctgctggaacatctgcatcccttcctgcagaggcagcagctggattatggcatctacgtcatccaccaggctgaaggtaaaaagtttaatcgagccaaactcttgaatgtgggctatctagaagccctcaaggaagaaaattgggactgctttatattccacgatgtggacctggtacccgagaatgactttaacctttacaagtgtgaggagcatcccaagcatctggtggttggcaggaacagcactgggtacaggttacgttacagtggatattttgggggtgttactgccctaagcagagagcagtttttcaaggtgaatggattctctaacaactactggggatggggaggcgaagacgatgacctcagactcagggttgagctccaaagaatgaaaatttcccggcccctgcctgaagtgggtaaatatacaatggtcttccacactagagacaaaggcaatgaggtgaacgcagaacggatgaagctcttacaccaagtgtcacgagtctggagaacagatgggttgagtagttgttcttataaattagtatctgtggaacacaatcctttatatatcaacatcacagtggatttctggtttggtgcatgaccctgggtcttttggtgatgtttggaagaactgattctttgtttgcaataattttggcctagagacttcaaatagtagcacacattaagaacctgttacagctcattgttgagctgaatttttcctttttgtattttcttagcagagctcctggtgatgtagagtataaaacagttgtaacaagacagctttcttagtcattttgatcatgagggttaaatattgtaatatggatacttgaaggactttatataaaaggatgactcaaaggataaaatgaacgctatttgaggactctggttgaaggagatttatttaaatttgaagtaatatattatgggataaaaggccacaggaaataagactgctgaatgtctgagagaaccagagttgttctcgtccaaggtagaaaggtacgaagatacaatactgttattcatttatcctgtacaatcatctgtgaagtggtggtgtcaggtgagaaggcgtccacaaaagaggggagaaaaggcgacgaatcaggacacagtgaacttgggaatgaagaggtagcaggagggtggagtgtcggctgcaaaggcagcagtagctgagctggttgcagctgctgatagccttcaggggaggacctgcccaggtatgccttccagtgatgcccaccagagaatacattctctattagtttttaaagagtttttgtaaaatgattttgtacaagtaggatatgaattagcagtttacaagtttacatattaactaataataaatatgtctatcaaatacctctgtagtaaaatgtgaaaaagc

SEQ ID NO: 33714 - DNA, 2459 bp, Homo sapiens
aaagccacccagaggccgaggcgtcaaccctccgtttccctcccggtgctccttccagcgcccggtgtggtcgatttggcgggggtggagcgccaggcgcgtgcagagccgggcggaccagcctctccggccaaggcgggaggcggagctcgtactcaagagccgcctcccgggcggctggggcggtccccgagctgctttccgcgttctcccctctccgcgggcagtgctagctcgccgcggccgcctccggggaccacctggcttcatgtgtggatttccacggctcttgcccagaggcgggtacactgtgttccaatgtgccacggaactcacgcagtggcactttgtggcttcatgaaggaagaggcaggccacgcaacacttcctccccaagccaaggagaagtatcacttttagaggcagaggagcggaaggcagtgggtgtgaccaaaagtgccatttgttaaagactgttggagcagaactactgagaaaaaccaggcattgtatcttcagttgtcatcaagttcgcaatcagattggaaaagctcaacttgaagctttcttgcctgcagtgaagcagagagatagatattattcacgtaataaaaaacatgggcttcaacctgactttccacctttcctacaaattccgattactgttgctgttgactttgtgcctgacagtggttgggtgggccaccagtaactacttcgtgggtgccattcaagagattcctaaagcaaaggagttcatggctaatttccataagaccctcattttggggaagggaaaaactctgactaatgaagcatccacgaagaaggtagaacttgacaactgcccttctgtgtctccttacctcagaggccagagcaagctcattttcaaaccagatctcactttggaagaggtacaggcagaaaatcccaaagtgtccagaggccggtatcgccctcaggaatgtaaagctttacagagggtcgccatcctcgttccccaccggaacagagagaaacacctgatgtacctgctggaacatctgcatcccttcctgcagaggcagcagctggattatggcatctacgtcatccaccaggctgaaggtaaaaagtttaatcgagccaaactcttgaatgtgggctatctagaagccctcaaggaagaaaattgggactgctttatattccacgatgtggacctggtacccgagaatgactttaacctttacaagtgtgaggagcatcccaagcatctggtggttggcaggaacagcactgggtacaggttacgttacagtggatattttgggggtgttactgccctaagcagagagcagtttttcaaggtgaatggattctctaacaactactggggatggggaggcgaagacgatgacctcagactcagggttgagctccaaagaatgaaaatttcccggcccctgcctgaagtgggtaaatatacaatggtcttccacactagagacaaaggcaatgaggtgaacgcagaacggatgaagctcttacaccaagtgtcacgagtctggagaacagatgggttgagtagttgttcttataaattagtatctgtggaacacaatcctttatatatcaacatcacagtggatttctggtttggtgcatgaccctgggtcttttggtgatgtttggaagaactgattctttgtttgcaataattttggcctagagacttcaaatagtagcacacattaagaacctgttacagctcattgttgagctgaatttttcctttttgtattttcttagcagagctcctggtgatgtagagtataaaacagttgtaacaagacagctttcttagtcattttgatcatgagggttaaatattgtaatatggatacttgaaggactttatataaaaggatgactcaaaggataaaatgaacgctatttgaggactctggttgaaggagatttatttaaatttgaagtaatatattatgggataaaaggccacaggaaataagactgctgaatgtctgagagaaccagagttgttctcgtccaaggtagaaaggtacgaagatacaatactgttattcatttatcctgtacaatcatctgtgaagtggtggtgtcaggtgagaaggcgtccacaaaagaggggagaaaaggcgacgaatcaggacacagtgaacttgggaatgaagaggtagcaggagggtggagtgtcggctgcaaaggcagcagtagctgagctggttgcagctgctgatagccttcaggggaggacctgcccaggtatgccttccagtgatgcccaccagagaatacattctctattagtttttaaagagtttttgtaaaatgattttgtacaagtaggatatgaattagcagtttacaagtttacatattaactaataataaatatgtctatcaaatacctctgtagtaaaatgtgaaaaagc

SEQ ID NO: 33715 - DNA, 611 bp, Homo sapiens
gctttccgcgttctcccctctccgcgggcagtgctagctcgccgcggccgcctccggggtcacgattccggggtcgcccccagcacttctccgccgggtgcatcaacctgaaaaagccccttcttcctggaaaccctccttctccagcgtttcaacggggaaactgatcagctgacaccagccccagtcctgcgaggggccggcgacctttgacctttctccaaaggggaccacctggcttcatgtgtggatttccacggctcttgcccagaggcgggtacactgtgttccaatgtgccacggaactcacgcagtggcactttgtggcttcatgaaggaagaggcaggccacgcaacacttcctccccaagccaaggagaagtatcacttttagaggcagaggagcggaaggcagtgggtgtgaccaaaagtgccatttgttaaagactgttggagcagaactactgagaaaaaccaggcattgtatcttcagttgtcatcaagttcgcaatcagattggaaaagctcaacttgaagctttcttgcctgcagtgaagcagagagatagatattattcacgtaataaaaaacatgggcttcaacctgacttt

SEQ ID NO: 33716 - DNA, 582 bp, Homo sapiens
agtgctagctcgccgcggccgcctccggggaccacctggcttcatgtgtggatttccacggctcttgcccagaggcgggtacactgtgttccaatgtgccacggaactcacgcagtggcactttgtggcttcatgaaggaagaggcaggccacgcaacacttcctccccaagccaaggagaagtatcacttttagaggcagaggagcggaaggcagtgggtgtgaccaaaagtgccatttgttaaagtctcctccaatctgaaatagttcctcagtttttcctcgtctttcatgattttgattcttcgaagagtaccagttaggtatatcgtggaatgaacttgtgcttatcttccttgccagattttaaaaactattatggaaaatctcaagcattcacaaaagtagagagaaagaaaggactctcagactgttggagcagaactactgagaaaaaccaggcattgtatcttcagttgtcatcaagttcgcaatcagattggaaaagctcaacttgaagctttcttgcctgcagtgaagcagagagatagatattattcacgtaataaaaaacatgggctt

SEQ ID NO: 33717 - DNA, 641 bp, Homo sapiens
agtgctagctcgccgcggccgcctccggggtgagtacgctggctccgccggcgcccgggaaatgcagttccctggacacgggcgccgtgcgagggtagccgggcgacggccggggaccacctggcttcatgtgtggatttccacggctcttgcccagaggcgggtacactgtgttccaatgtgccacggaactcacgcagtggcactttgtggcttcatgaaggaagaggcaggccacgcaacacttcctccccaagccaaggagaagtatcacttttagaggcagaggagcggaaggcagtgggtgtgaccaaaagtgccatttgttaaagactgttggagcagaactactgagaaaaaccaggcattgtatcttcagttgtcatcaagttcgcaatcagattggaaaagctcaacttgaagctttcttgcctgcagtgaagcagagagatagatattattcacgtaataaaaaacatgggcttcaacctgactttccacctttcctacaaattccgattactgttgctgttgactttgtgcctgacagtggttgggtgggccaccagtaactacttcgtgggtgccattcaagagattcctaaagcaaaggagttcatggctaatttccataagaccct

SEQ ID NO: 33718 - DNA, 560 bp, Homo sapiens
gtgcacactgttgcaaagtgttccagagtgggtgagggatggggacgtggcggtggtgagggtactggtagacctcctcagccgtttggtgatgaaaaggaggaaaaagaaaatggtaatctgagcgtggaggaccacctggcttcatgtgtggatttccacggctcttgcccagaggcgggtacactgtgttccaatgtgccacggaactcacgcagtggcactttgtggcttcatgaaggaagaggcaggccacgcaacacttcctccccaagccaaggagaagtatcacttttagaggcagaggagcggaaggcagtgggtgtgaccaaaagtgccatttgttaaagactgttggagcagaactactgagaaaaaccaggcattgtatcttcagttgtcatcaagttcgcaatcagattggaaaagctcaacttgaagctttcttgcctgcagtgaagcagagagatagatattattcacgtaataaaaaacatgggcttcaacctgactttccacctttcctacaaattccgattactgttgctgttgactttgtg

SEQ ID NO: 33719 - DNA, 884 bp, Homo sapiens
agtgctagctcgccgcggccgcctccggggaccacctggcttcatgtgtggatttccacggctcttgcccagaggcgggtacactgtgttccaatgtgccacggaactcacgcagtggcactttgtggcttcatgaaggaagaggcaggccacgcaacacttcctccccaagccaaggagaagtatcacttttagaggcagaggagcggaaggcagtgggtgtgaccaaaagtgccatttgttaaagcttatcttccttgccagattttaaaaactattatggaaaatctcaagcattcacaaaagtagagagaaagaaaggactctcagactgttggagcagaactactgagaaaaaccaggcattgtatcttcagttgtcatcaagttcgcaatcagattggaaaagctcaacttgaagctttcttgcctgcagtgaagcagagagatagatattattcacgtaataaaaaacatgggcttcaacctgactttccacctttcctacaaattccgattactgttgctgttgactttgtgcctgacagtggttgggtgggccaccagtaactacttcgtgggtgccattcaagagattcctaaagcaaaggagttcatggctaatttccataagaccctcattttggggaagggaaaaactctgactaatgaagcatccacgaagaaggtagaacttgacaactgcccttctgtgtctccttacctcagaggccagagcaagctcattttcaaaccagatctcactttggaagaggtacaggcagaaaatcccaaagtgtccagaggccggtatcgccctcaggaatgtaaagctttacagagggtcgccatcctcgttccccaccggaacagagagaaacacc

SEQ ID NO: 33720 - DNA, 615 bp, Homo sapiens
agtgctagctcgccgcggccgcctccggggtgagtacgctggctccgccggcgcccgggaaatgcagttccctggacacgggcgccgtgcgagggtagccgggcgacggccgggactgttggagcagaactactgagaaaaaccaggcattgtatcttcagttgtcatcaagttcgcaatcagattggaaaagctcaacttgaagctttcttgcctgcagtgaagcagagagatagatattattcacgtaataaaaaacatgggcttcaacctgactttccacctttcctacaaattccgattactgttgctgttgactttgtgcctgacagtggttgggtgggccaccagtaactacttcgtgggtgccattcaagagattcctaaagcaaaggagttcatggctaatttccataagaccctcattttggggaagggaaaaactctgactaatgaagcatccacgaagaaggtagaacttgacaactgcccttctgtgtctccttacctcagaggccagagcaagctcattttcaaaccagatctcactttggaagaggtacaggcagaaaatcccaaagtgtccagaggccggtatcgccctcaggaatgtaa

SEQ ID NO: 33721 - DNA, 2494 bp, Homo sapiens
accggctcaggtgctggcgttccgcgcggcgccgcctctgctgcgggccgggggagccagacgaggtgctgccgggtaggaaaaaatccagggctcattcataccccaggtcacgattccggggtcgcccccagcacttctccgccgggtgcatcaacctgaaaaagccccttcttcctggaaaccctccttctccagcgtttcaacggggaaactgatcagctgacaccagccccagtcctgcgaggggccggcgacctttgacctttctccaaaggggaccacctggcttcatgtgtggatttccacggctcttgcccagaggcgggtacactgtgttccaatgtgccacggaactcacgcagtggcactttgtggcttcatgaaggaagaggcaggccacgcaacacttcctccccaagccaaggagaagtatcacttttagaggcagaggagcggaaggcagtgggtgtgaccaaaagtgccatttgttaaagactgttggagcagaactactgagaaaaaccaggcattgtatcttcagttgtcatcaagttcgcaatcagattggaaaagctcaacttgaagctttcttgcctgcagtgaagcagagagatagatattattcacgtaataaaaaacatgggcttcaacctgactttccacctttcctacaaattccgattactgttgctgttgactttgtgcctgacagtggttgggtgggccaccagtaactacttcgtgggtgccattcaagagattcctaaagcaaaggagttcatggctaatttccataagaccctcattttggggaagggaaaaactctgactaatgaagcatccacgaagaaggtagaacttgacaactgcccttctgtgtctccttacctcagaggccagagcaagctcattttcaaaccagatctcactttggaagaggtacaggcagaaaatcccaaagtgtccagaggccggtatcgccctcaggaatgtaaagctttacagagggtcgccatcctcgttccccaccggaacagagagaaacacctgatgtacctgctggaacatctgcatcccttcctgcagaggcagcagctggattatggcatctacgtcatccaccaggctgaaggtaaaaagtttaatcgagccaaactcttgaatgtgggctatctagaagccctcaaggaagaaaattgggactgctttatattccacgatgtggacctggtacccgagaatgactttaacctttacaagtgtgaggagcatcccaagcatctggtggttggcaggaacagcactgggtacaggttacgttacagtggatattttgggggtgttactgccctaagcagagagcagtttttcaaggtgaatggattctctaacaactactggggatggggaggcgaagacgatgacctcagactcagggttgagctccaaagaatgaaaatttcccggcccctgcctgaagtgggtaaatatacaatggtcttccacactagagacaaaggcaatgaggtgaacgcagaacggatgaagctcttacaccaagtgtcacgagtctggagaacagatgggttgagtagttgttcttataaattagtatctgtggaacacaatcctttatatatcaacatcacagtggatttctggtttggtgcatgaccctgggtcttttggtgatgtttggaagaactgattctttgtttgcaataattttggcctagagacttcaaatagtagcacacattaagaacctgttacagctcattgttgagctgaatttttcctttttgtattttcttagcagagctcctggtgatgtagagtataaaacagttgtaacaagacagctttcttagtcattttgatcatgagggttaaatattgtaatatggatacttgaaggactttatataaaaggatgactcaaaggataaaatgaacgctatttgaggactctggttgaaggagatttatttaaatttgaagtaatatattatgggataaaaggccacaggaaataagactgctgaatgtctgagagaaccagagttgttctcgtccaaggtagaaaggtacgaagatacaatactgttattcatttatcctgtacaatcatctgtgaagtggtggtgtcaggtgagaaggcgtccacaaaagaggggagaaaaggcgacgaatcaggacacagtgaacttgggaatgaagaggtagcaggagggtggagtgtcggctgcaaaggcagcagtagctgagctggttgcagctgctgatagccttcaggggaggacctgcccaggtatgccttccagtgatgcccaccagagaatacattctctattagtttttaaagagtttttgtaaaatgattttgtacaagtaggatatgaattagcagtttacaagtttacatattaactaataataaatatgtctatcaaatacctctgtagtaaaatgtgaaaaagctttgagtgtt

SEQ ID NO: 33722 - DNA, 588 bp, Homo sapiens
acggaggccgagcctggcgggaggcaccggctcaggtgctggcgttccgcgcggcgccgcctctgctgcgggccgggggagccagacgaggtgctgccgggaccacctggcttcatgtgtggatttccacggctcttgcccagaggcgggtacactgtgttccaatgtgccacggaactcacgcagtggcactttgtggcttcatgaaggaagaggcaggccacgcaacacttcctccccaagccaaggagaagtatcacttttagaggcagaggagcggaaggcagtgggtgtgaccaaaagtgccatttgttaaagactgttggagcagaactactgagaaaaaccaggcattgtatcttcagttgtcatcaagttcgcaatcagattggaaaagctcaacttgaagctttcttgcctgcagtgaagcagagagatagatattattcacgtaataaaaaacatgggcttcaacctgactttccacctttcctacaaattccgattactgttgctgttgactttgtgcctgacagtggttgggtgggccaccagtaactacttcgtgggtgccattcaagagattcc

SEQ ID NO: 33723 - DNA, 4722 bp, Homo sapiens
atgtggcccggcccgcgacggccggcggctgggagcggcgaggcggcggcggcggcgagtggcggcccgcgaggcccgggaggcggtggccgaggcccaggcggtggcggcggcggcccaggaggcggcggacggggagctgcgggagcaggcccggcctggctctctagcggccgcctggctgcagcatgcgcgcccgccgggggctgctgcggctgccgcgccgctcgctgctcgccgcgctcttcttcttttctctctcgtcctcgctgctgtacttcgtctatgtggcgcccggcatagtgaacacctacctcttcatgatgcaagcccaaggcattctgatccgggacaacgtgagaacaatcggtgctcaggtttatgagcaggtgcttcggagtgcttatgccaagaggaacagcagtgtaaatgactcagattatcctcttgacttgaaccacagtgaaaccttcctgcaaactacaacatttcttcctgaagacttcacctactttgcaaaccatacctgccctgaaagactcccttccatgaagggcccaatagacataaacatgagtgaaattggaatggattacattcatgaactcttctccaaagacccaaccatcaagctcggaggtcactggaagccttctgattgcatgcctcggtggaaggtggcgatccttatccccttccggaaccgccacgagcacctcccagtcctgttcagacacctgcttcccatgctccagcgccagcgcttgcagtttgcattttatgtggttgaacaagttggtacccaaccctttaatcgagccatgcttttcaacgttggctttcaagaggcaatgaaagacttggattgggactgtttgatttttcatgatgtagatcacataccggaaagtgatcgcaactattatggatgtggacagatgccgaggcattttgcaaccaaattggataagtatatgtatctgcttccttataccgagttctttggcggagtgagtggcttaacagtggaacaatttcggaaaatcaatggctttcctaatgctttctggggttggggtggagaagatgacgacctctggaacagagtacagaatgcaggctattctgtgagccggccagagggtgacacaggaaagtacaagtccattcctcatcaccatcgaggagaagtccagtttcttggaaggtatgctctgctgaggaagtcaaaagaacggcaagggctggatggcctcaacaacctgaactactttgcaaacatcacatacgacgccttgtataaaaacataactgtcaacctgacacccgagctggctcaggtgaacgagtactgagaggagagaatgtacgtttgctttacccaccgccaccaagaaagcagtccgatgagatttttttttggaggggggagggtctacacagcaagagaacagaaatactgtgtctcatgaaggatcacagagttcagggggaaaatgtgacagcacacgcacaaacgccttcactggatcagccgctggaactgagggagtgagcttggggacttccttcgtcagcactggctttctgttttcacaagacagacgtctgtcccgctgctctctccccatctcctaccccacatcctgtcttagccgcagtctccagaacccatgatgaactgtgatctgccgtggtcctgccgtggtcctgccgtggagcctgtccctacacatgaccttggagcctcttggccttcagagcagaggcaaacccaccacagggcagctgcgttttaggaagagcaaatgaaactccacaccattcttctagatctctggtgttctctttggtttcatttttttaaaaaattaccttctttgggtggggattgagggtggaggggagggtgtttgggaaagataaatagacataaatatataacaatcacttcttgaagaagtataattgtaaataagccatgtaaaatgcctttttaaaatttaattttctagctggctccaattcaaattgaggatttatgtattaggccacttacttggttggcaagtgcaggaactcagttaaaatgcagttgaagaatgtcatctcccgaattgctgtcactttggcgagggagtggatatagggcatgtcacaaaagaacaaaataacccgacctttattgctgggagctggcttctgtccctttcttcccccccccacgagtcttgcccttgacttctgctctggattcactcttccctgtcggccgcgcatgtgctcatcccactctccgctaagcgggaggctgctgttagagcaggctgcttcctgcctaaagcaggcccttcggggctcgctgcacacacatctctggctctccaggcttcgtgttctgtcttttcatcagcatggcggggcggggggcggggggcgggggtgtgtatgggaatccctccccctcttactttttctcttgtggaacttggccacagtttctgaacaatgtgcctacattaccagctggcttcagtgattcctctgtgtccctttttggtttctggaaagattctttgtcaacattagtaactgatacatagaaccaaggagcactcaaatagggagccaggagccagggagctggtgacacttgtgtgctgtggggcagctgggatccaggtaagaccggattgaagctttgaaattagactaacaaagctccagacagcaagagcccaggtgcactgctcacacccccacctgcattttgaagtcatattattttttgttttgttttttaagacggtctggctctgtcgcctaagctggagtgtggtggcacgatcacagctcactgcagcctccatctcctaggctcaagccattttcccacctcagcctcccgagtagctgggactacaggtgcacaccaccacacctggctaattttttgtatttttagtagagacaggggtttcttccatgttgcccaggctggtctcgaactcctggactcaagcaatccgcccaccttgacttcccaaagtgctgggattatgggcgggtgtgagccattgcgcccagccttgaagtcatgttctaaattgtatttgaatttgtgcctctttgtttttccccaaaccaaagccctcaaattgtagtctctgtcggcttctgcagaattctggaaaatgccagttttcctcccccgcccttgttttccataaaacatatttatatattgtgatgaggagtactttctgaagagtacttcgtatttttttttaattgccttgtttgccttcaacttccttgattttcatagtttacatgggtgtgtgtaggggtgtgtgtgtgtatgtgtgtgggttagggcttttttcgttgcatgtgatggttctgtggacatatgatccccacaaactgtgggagtgattggccaggccttgttttgtttgtttgtttgtttgtgtttttgttcttttgaagaatagagtggtatttagaaaataaattgcattgcaaagctcttatcggctcatatgagagagcaggttcctgcccttgaaaatgccggtaagctatagcatatgttttttaagacttaagcatttcatgctttaaaataccttcacaagtgaacattacacacagaagttcatttggttttcctttgttttatggtgcatatagcaataaagacccccctccaccctgcaacccccatcccccaccgggcctttgtccctgccttggcttttctccccttctcattctcctctcccctttcctcactgaaggctgtgagttgctttcaatgtgacaacactatgatgtcatttggaaggatttgccaggacagactgattctgagtcctgggtgccgtatgtgtatgcggcagtgttgtcaggcgatcttgtttgaagctctatgttgccataattaccatcaagtacacactgttggcaaaaggctaacacctgactttagaaaatgctgatttgagaacaaaaggaaaggtcttttttcactgcttaaagtggggtcactttgatacctttgcggtcatgtctgtgtctgatgagtgtagaatctctggatgtgcactgtcagtcatgtgtccaccaggcctcgaatatcatatgggaaatgtcatagttaaaaacgtacagccaggcccgtgtgctgttaatagtgtgaaattgtcatgttaaaaaaaaaaacaggaaccaaatgtgaccttgtgcatatattggtagctgaaaatcttcaaggctactgatgggtggccccttaatcttgtctttgattgctgtgtgcagggaaaggtgtccccgtttgttcatgctgttttggggggtgggggggtatttgcaagaatactcattttgacataataggtcctcttgtcagagatcctctaccacagacattaatagctgagcaggagccacatggattgattgtatccactcaccattgacgatggcattgagcgtagctagcttatttccatcactacgtgtttttgagcttgctcttacgttttaagaggtgccaggggtacatttttgcactgaaatctaaagatgttttaaaaaacacttttcacaaaaatagtcctttgtcattacattatttactcatgtgtttgtacatttttgtatgttaatttatgaatgattttttcagtaaaaaatacatattcaagaaccaaa

SEQ ID NO: 33724 - DNA, 2120 bp, Homo sapiens
ctcgggccctctccccagagcctccccgcgcggaccccgctgcagtctcggggttctcagcacatttatggaagtttagggcctggacagtggccccgagtccggcctgagagcgcagcctgggctgctggcagggaagaggaagatgtctgtgctcaggcggatgatgcgggtttccaatcgctctctcctcgccttcatcttcttcttctccctctcttcgtcctgtctgtacttcatctatgtggccccaggcatcgattatcccgaaggcaataattcaagtgattatcttgttcaaacaacaacgtatctcccggaaaacttcacatactcaccatacctcccctgtccagaaaagctgccttatatgcgaggattcctcaatgtcaatgtaagcgaagtcagttttgatgaaattcatcaactcttctccaaggatttagatattgagccagggggtcattggaggccaaaagactgtaaacccagatggaaggtggcagttctcattcctttccgtaatcgccatgaacatcttccaatttttttcttacatctgattccaatgctccagaagcagcggctggaatttgcgttttatgtcattgaacagactggcacacaaccttttaaccgtgcgatgcttttcaatgtgggcttcaaagaggccatgaaagacagtgtctgggactgtgtaatcttccacgatgtggatcatctacctgaaaatgaccggaactattacggatgtggagaaatgccacgtcattttgctgcaaagctggataaatacatgtatattcttccatataaagaattttttggtggtgtaagtgggctgacagtggaacaatttagaaagatcaatggttttcctaatgccttctggggatggggaggagaagatgatgacctttggaacagagttcactatgctggatataatgtaaccagaccagagggagacttaggaaaatacaagtcaattcctcatcaccatagaggtgaagtccagtttttaggacggtataaattactaaggtattccaaggagcgtcagtacatcgatggactgaacaatttaatatataggccaaaaatactggttgataggttgtatacaaacatatctgtaaacctcatgccagagttagctccaatcgaagactattaaaagaagtggctgtcgtggcaaggtagaccacaatgctggatcataaacttggagcgcgctcttagtggaggtcagtgattggctgtgtcacagtgcccttttctctgagaagagccagcagtccacagtgtttacagagtgggactatatacagtcacccttctctcacccgtcctccctgctctgagacacacccctgtggcgagcaccgcagaaacgggaagccactacttaagatcggaagttaagagagctccctccgaagagaaaatttttatactaaaatctataatttaattcaagagaatgcttttatttccgtttaaacatattttgtatatatgtgatataaattaatgtgtgcaaattgtttaaaaattagatgtgttgcagttttgcatgtaatcggttatacctttattggacttttatagacattttttatttgcatgaaaaaaactcactaaatttacatcactaaacaaaggttaacccttgtgtgaaatgaaggaactgtcaataattgacagccaactaatacagtaaactgttatactagttttgagctttagacctcagccttttgtgtggaagaagtcacagctttcttaggctttaaaggaaaagaaggaaggacttaaatagcttttcttcctaccgggattacctatgtttttccttgcttgcaatctcatctgattttgctagaaatcacaaccatattgtttatgcatattgcatgagtattaccaagaaaaatcttaaaagttgtgatgtgacatgatataaaggatctctttatgttaaatgtctttccatgtacctctggtgtgtcagggattttgtgcctcaaaaaatgtttccaaggttgtgtgtttatactgtgtattttttttaaattcacggtgaacagcacttttattatttccagttcagaagagcc

SEQ ID NO: 33725 - DNA, 4814 bp, Homo sapiens
ccggctttcttccgtcctgccgtccccgggcccctagcccccagtcccctctcccccctccacctcttgtccctcggcctccgcgcctcccctcccccgactctctggcctcccattcattccgtccgctccctcccatttcctcttttccgctcgggccctctccccagagcctccccgcgcggaccccgctgcagtctcggggttctcagcacatttatggaagtttagggcctggacagtggccccgagtccggcctgagagcgcagcctgggctgctggcagggaagaggaagatgtctgtgctcaggcggatgatgcgggtttccaatcgctctctcctcgccttcatcttcttcttctccctctcttcgtcctgtctgtacttcatctatgtggccccaggcatcgccaacacatatctctttatggtacaagctcgaggtataatgttgagagaaaatgtgaaaacaataggtcatatgatcaggctgtacacaaataaaaacagtacgctcaacggtacagattatcccgaaggcaataattcaagtgattatcttgttcaaacaacaacgtatctcccggaaaacttcacatactcaccatacctcccctgtccagaaaagctgccttatatgcgaggattcctcaatgtcaatgtaagcgaagtcagttttgatgaaattcatcaactcttctccaaggatttagatattgagccagggggtcattggaggccaaaagactgtaaacccagatggaaggtggcagttctcattcctttccgtaatcgccatgaacatcttccaatttttttcttacatctgattccaatgctccagaagcagcggctggaatttgcgttttatgtcattgaacagactggcacacaaccttttaaccgtgcgatgcttttcaatgtgggcttcaaagaggccatgaaagacagtgtctgggactgtgtaatcttccacgatgtggatcatctacctgaaaatgaccggaactattacggatgtggagaaatgccacgtcattttgctgcaaagctggataaatacatgtatattcttccatataaagaattttttggtggtgtaagtgggctgacagtggaacaatttagaaagatcaatggttttcctaatgccttctggggatggggaggagaagatgatgacctttggaacagagttcactatgctggatataatgtaaccagaccagagggagacttaggaaaatacaagtcaattcctcatcaccatagaggtgaagtccagtttttaggacggtataaattactaaggtattccaaggagcgtcagtacatcgatggactgaacaatttaatatataggccaaaaatactggttgataggttgtatacaaacatatctgtaaacctcatgccagagttagctccaatcgaagactattaaaagaagtggctgtcgtggcaaggtagaccacaatgctggatcataaacttggagcgcgctcttagtggaggtcagtgattggctgtgtcacagtgcccttttctctgagaagagccagcagtccacagtgtttacagagtgggactatatacagtcacccttctctcacccgtcctccctgctctgagacacacccctgtggcgagcaccgcagaaacgggaagccactacttaagatcggaagttaagagagctccctccgaagagaaaatttttatactaaaatctataatttaattcaagagaatgcttttatttccgtttaaacatattttgtatatatgtgatataaattaatgtgtgcaaattgtttaaaaattagatgtgttgcagttttgcatgtaatcggttatacctttattggacttttatagacattttttatttgcatgaaaaaaactcactaaatttacatcactaaacaaaggttaacccttgtgtgaaatgaaggaactgtcaataattgacagccaactaatacagtaaactgttatactagttttgagctttagacctcagccttttgtgtggaagaagtcacagctttcttaggctttaaaggaaaagaaggaaggacttaaatagcttttcttcctaccgggattacctatgtttttccttgcttgcaatctcatctgattttgctagaaatcacaaccatattgtttatgcatattgcatgagtattaccaagaaaaatcttaaaagttgtgatgtgacatgatataaaggatctctttatgttaaatgtctttccatgtacctctggtgtgtcagggattttgtgcctcaaaaaatgtttccaaggttgtgtgtttatactgtgtattttttttaaattcacggtgaacagcacttttattatttccagttcagaagagccaaaaaaaagtatcttcatttaaaaagaaatcaagtcagtttttttaaaagaatgatctatggaagaaaacccaatagtacttataatatacaaatgaattatactattagataagaattaaatattctatttttataaagataaatacttagtagataaaaacaaattttaagtttagttttcagacatagaatttcacttttggaggggacccttgaatgttagtttcattcaaactatattttgtttttttcacttttaagagattatatctctggtgttaattactaaaattttctttctaaaagtataatttaatagaattatcttaaaatacatgatcagtattcagtgcgctgatattataatgtcttctatatgtagtatctaaaagcataatttaatagcattgtcttaaaatacgtgatgagttatttggtgcactgatgccataatgtcttctatatgtaatatcttacatgtttgcatgagtgtcagggctttgtccagttatcttcatatgactgttctctgaaaaaaggtcttactacctgatatcaagtacatatcttaattttggatgaatttttccacagtaaagccgaacagtattcttttttgaaaattagcaattataaagattgtttaaaatatcttgatattttcacaaattttaaacaaaaaattaaatatctataaagtgaatgttcaacaacaatgatgagcaatagaaatctatatatgagaaacgtttggataatatttgcctcaaggattgtttacctaaaacagaactatggttatttatctcagattgtaagttttattttgaagtgtcatttttatggcaatattgataacacaaatgaccacaaactaaatcataaaataattgaatccttacactttgagaaaatggatagcttctgtgttatgataccaaacaaaatattttcatatttatttcttagaactatttccaaaatatttatatttcagtttttttatggtactcgaaaaatcaaaccttctgaaaattatgatatttgtacttcatttgtgtattagttcattttctgtttctattacatagtttttaaagtcaatgaaagagattgagaatgttaacatttgttgatcaatgtggagctgtccacattcggtatcttttcatttttatatatattttacagtttcaagaaaacttagtactactagtatctgccttattttcttaagtctgatgttaatttttgtttcaggagtgagatataaacattttgctttttttcagttttgaaatatagtttgtcatcctgtgaaaaccacctcgtttgctttttgtttgtttgttttgcttttttagtgtagacctaaaattatttttgcctataaacagtgaacttaatatgtttctgtgagagtgacagagctgtgcccgtttatcttcattgtattaattattacataaagattaacaaatacattgcaaatgcaaattataggatgtttggaggatttattaatgagcatgtattgattgcctattccatatccagtgcaatgctaggtatgtctatggaaggagtattattacttcatttctaaacaaatgaagtcaagcaaattgagatctttctgaaattatgaagacatcttctgataacttatctgttgtatttcctagtctcaaagtcaagaaacccgtatatgtggacctagggctaataggaggtccctatggcactaactgggaaaattacatggtgcttttcaactacagaaagaagtaatgactaatgggcctgtctgtagagaagaaaaggagaagagtacacatttgctggaactatatataattcacagtggagatagttaattctttgctaaaactagggttttatgagtattttttaaatctacatttaagtttttgtttttgtgaaaagttattcagtaagaaaactttataatattaagtagatacagttatgtattaaaaatttccttatatacccttttgccagccaagatactgatattttaaaacaaaatggaaaaatgtccaatacaatattctctttctggaggcttcctacaagtgaaagcagattttgtcattttatttggcctttgcttgtctttgatatatttctttatgtgtttttcaaatacatactgttgtagatttattgtcttgtatttgcaagtatgccggttgagagaactaaaatggttatagtattgtttatcagaaagaggaagtgtacttaagattattttatttatttagatgaaaggcttctacataaatgcactgaaataaatgctagtaatttcttgtatcccacttctttttttgcttctcatggaaatgtttgtacttttttatcattgtcttttatgaaatataatgttctaaaga

SEQ ID NO: 33726 - DNA, 1239 bp, Homo sapiens
atggaagtttagggcctggacagtggccccgagtccggcctgagagcgcagcctgggctgctggcagggaagaggaagatgtctgtgctcaggcggatgatgcgggtttccaatcgctctctcctcgccttcatcttcttcttctccctctcttcgtcctgtctgtacttcatctatgtggccccaggcatcgccaacacatatctctttatggtacaagctcgaggtataatgttgagagaaaatgtgaaaacaataggtcatatgatcaggctgtacacaaataaaaacagtacgctcaacggtacagattatcccgaaggcaataattcaagtgattatcttgttcaaacaacaacgtatctcccggaaaacttcacatactcaccatacctcccctgtccagaaaagctgccttatatgcgaggattcctcaatgtcaatgtaagcgaagtcagttttgatgaaattcatcaactcttctccaaggatttagatattgagccagggggtcattggaggccaaaagactgtaaacccagatggaagactggcacacaaccttttaaccgtgcgatgcttttcaatgtgggcttcaaagaggccatgaaagacagtgtctgggactgtgtaatcttccacgatgtggatcatctacctgaaaatgaccggaactattacggatgtggagaaatgccacgtcattttgctgcaaagctggataaatacatgtatattcttccatataaagaattttttggtggtgtaagtgggctgacagtggaacaatttagaaagatcaatggttttcctaatgccttctggggatggggaggagaagatgatgacctttggaacagagttcactatgctggatataatgtaaccagaccagagggagacttaggaaaatacaagtcaattcctcatcaccatagaggtgaagtccagtttttaggacggtataaattactaaggtattccaaggagcgtcagtacatcgatggactgaacaatttaatatataggccaaaaatactggttgataggttgtatacaaacatatctgtaaacctcatgccagagttagctccaatcgaagactattaaaagaagtggctgtcgtggcaaggtagaccacaatgctggatcataaacttggagcgcgctcttagtggaggtcagtgattggctgtgtcacagtgcccttttctctgagaagagccagcagtccacagt

SEQ ID NO: 33727 - DNA, 1488 bp, Homo sapiens
gcgacggctgagcaaggactctccagtcctcagtcaccttggacaaagaagtgtggatcctcagattccatcttttccaactccaaggtgccatggcagagaaggtgctggtaacaggtggggctggctacattggcagccacacggtgctggagctgctggaggctggctacttgcctgtggtcatcgataacttccataatgccttccgtggagggggctccctgcctgagagcctgcggcgggtccaggagctgacaggccgctctgtggagtttgaggagatggacattttggaccagggagccctacagcgtctcttcaaaaagtacagctttatggcggtcatccactttgcggggctcaaggccgtgggcgagtcggtgcagaagcctctggattattacagagttaacctgaccgggaccatccagcttctggagatcatgaaggcccacggggtgaagaacctggtgttcagcagctcagccactgtgtacgggaacccccagtacctgccccttgatgaggcccaccccacgggtggttgtaccaacccttacggcaagtccaagttcttcatcgaggaaatgatccgggacctgtgccaggcagacaagacttggaacgcagtgctgctgcgctatttcaaccccacaggtgcccatgcctctggctgcattggtgaggatccccagggcatacccaacaacctcatgccttatgtctcccaggtggcgatcgggcgacgggaggccctgaatgtctttggcaatgactatgacacagaggatggcacaggtgtccgggattacatccatgtcgtggatctggccaagggccacattgcagccttaaggaagctgaaagaacagtgtggctgccggatctacaacctgggcacgggcacaggctattcagtgctgcagatggtccaggctatggagaaggcctctgggaagaagatcccgtacaaggtggtggcacggcgggaaggtgatgtggcagcctgttacgccaaccccagcctggcccaagaggagctggggtggacagcagccttagggctggacaggatgtgtgaggatctctggcgctggcagaagcagaatccttcaggctttggcacgcaagcctgaggaccctcccctaccaaggaccaggaaaagcagcagctgcctgctctccagcctctggcaggaactcagggccctggagctgctggggccaagccaaggcctcccctacctcaaaccccagctgggcccgcttagcccaccaggcatgaggccaagggctccactgaccaggaggccgaggtctctaactcttatcttccacagggtccaagagttcatcaggacccccaagagtgagtgagggggcaaggctctggcacaaaacctcctcctcccaggcactcatttatattgctctgaaagagctttccaaagtatttaaaaataaaaacaagttttcttacactgg

SEQ ID NO: 33728 - DNA, 1412 bp, Homo sapiens
cgcgggaacccgagcaggactctccagtcctcagtcaccttggacaaagaagtgtggatcctcagattccatcttttccaactccaaggtgccatggcagagaaggtgctggtaacaggtggggctggctacattggcagccacacggtgctggagctgctggaggctggctacttgcctgtggtcatcgataacttccataatgccttccgtggagggggctccctgcctgagagcctgcggcgggtccaggagctgacaggccgctctgtggagtttgaggagatggacattttggaccagggagccctacagcgtctcttcaaaaagtacagctttatggcggtcatccactttgcggggctcaaggccgtgggcgagtcggtgcagaagcctctggattattacagagttaacctgaccgggaccatccagcttctggagatcatgaaggcccacggggtgaagaacctggtgttcagcagctcagccactgtgtacgggaacccccagtacctgccccttgatgaggcccaccccacgggtggttgtaccaacccttacggcaagtccaagttcttcatcgaggaaatgatccgggacctgtgccaggcagacaagacttggaacgcagtgctgctgcgctatttcaaccccacaggtgcccatgcctctggctgcattggtgaggatccccagggcatacccaacaacctcatgccttatgtctcccaggtggcgatcgggcgacgggaggccctgaatgtctttggcaatgactatgacacagaggatggcacaggtgtccgggattacatccatgtcgtggatctggccaagggccacattgcagccttaaggaagctgaaagaacagtgtggctgccggatcccgtacaaggtggtggcacggcgggaaggtgatgtggcagcctgttacgccaaccccagcctggcccaagaggagctggggtggacagcagccttagggctggacaggatgtgtgaggatctctggcgctggcagaagcagaatccttcaggctttggcacgcaagcctgaggaccctcccctaccaaggaccaggaaaagcagcagctgcctgctctccagcctctggcaggaactcagggccctggagctgctggggccaagccaaggcctcccctacctcaaaccccagctgggcccgcttagcccaccaggcatgaggccaagggctccactgaccaggaggccgaggtctctaactcttatcttccacagggtccaagagttcatcaggacccccaagagtgagtgagggggcaaggctctggcacaaaacctcctcctcccaggcactcatttatattgctctgaaagagctttccaaagtatttaaaaataaaaacaagttttcttacactggg

SEQ ID NO: 33729 - DNA, 882 bp, Homo sapiens
ggctcgggcgtaggaggcggtgcctctgcagcaagcgtggggcgcgggaacccgagcaggactctccagtcctcagtcaccttggacaaagaagtgtggatcctcagattccatcttttccaactccaaggagggggctccctgcctgagagcctgcggcgggtccaggagctgacaggccgctctgtggagtttgaggagatggacattttggaccagggagccctacagcgtctcttcaaaaagtacagctttatggcggtcatccactttgcggggctcaaggccgtgggcgagtcggtgcagaagcctctggattattacagagttaacctgaccgggaccatccagcttctggagatcatgaaggcccacggggtgaagaacctggtgttcagcagctcagccactgtgtacgggaacccccagtacctgccccttgatgaggcccaccccacgggtggttgtaccaacccttacggcaagtccaagttcttcatcgaggaaatgatccgggacctgtgccaggcagacaagacttggaacgcagtgctgctgcgctatttcaaccccacaggtgcccatgcctctggctgcattggtgaggatccccagggcatacccaacaacctcatgccttatgtctcccaggtggcgatcgggcgacgggaggccctgaatgtctttggcaatgactatgacacagaggatggcacaggtgtccgggattacatccatgtcgtggatctggccaagggccacattgcagccttaaggaagctgaaagaacagtgtggctgccggatctacaacctgggcacgggcacaggctattcagtgctgcagatggtccaggctatggagaaggcctctgggaagaag

SEQ ID NO: 33730 - DNA, 876 bp, Homo sapiens
actcctagctcggccccgctccgcgctacagcccaaagcccagcctgagacccagccgccctcgtatgcccacggcctagctccccttccctccaacagacagactgggaaaaccgagtgggcgacggctgagcaaggtcactccgctgtcgggggcgcagccggcctcagaccagctttcgtgcttcccagggcctctctgcgaccactttcggggactctccagtcctcagtcaccttggacaaagaagtgtggatcctcagattccatcttttccaactccaaggtgccatggcagagaaggtgctggtaacaggtggggctggctacattggcagccacacggtgctggagctgctggaggctggctacttgcctgtggtcatcgataacttccataatgccttccgtggagggggctccctgcctgagagcctgcggcgggtccaggagctgacaggccgctctgtggagtttgaggagatggacattttggaccagggagccctacagcgtctcttcaaaaagtacagctttatggcggtcatccactttgcggggctcaaggccgtgggcgagtcggtgcagaagcctctggattattacagagttaacctgaccgggaccatccagcttctggagatcatgaaggcccacggggtgaagaacctggtgttcagcagctcagccactgtgtacgggaacccccagtacctgccccttgatgaggcccaccccacgggtggttgtaccaacccttacggcaagtccaagttcttcatcgaggaaatgatccgggacctgtgccaggcagacaagacttggaacgcagtgctgctgcgctatttcaaccccacaggtgcccatgcctctgg

SEQ ID NO: 33731 - DNA, 957 bp, Homo sapiens
gaaggcggaggcattggacaagcctgggtctgagcagacagaaccccttcctgcgaccctggagtcccaatcgtgctgccattttccttctgcccaggactctccagtcctcagtcaccttggacaaagaagtgtggatcctcagattccatcttttccaactccaaggagggggctccctgcctgagagcctgcggcgggtccaggagctgacaggccgctctgtggagtttgaggagatggacattttggaccagggagccctacagcgtctcttcaaaaagtacagctttatggcggtcatccactttgcggggctcaaggccgtgggcgagtcggtgcagaagcctctggattattacagagttaacctgaccgggaccatccagcttctggagatcatgaaggcccacggggtgaagaacctggtgttcagcagctcagccactgtgtacgggaacccccagtacctgccccttgatgaggcccaccccacgggtggttgtaccaacccttacggcaagtccaagttcttcatcgaggaaatgatccgggacctgtgccaggcagacaagacttggaacgcagtgctgctgcgctatttcaaccccacaggtgcccatgcctctggctgcattggtgaggatccccagggcatacccaacaacctcatgccttatgtctcccaggtggcgatcgggcgacgggaggccctgaatgtctttggcaatgactatgacacagaggatggcacaggtgtccgggattacatccatgtcgtggatctggccaagggccacattgcagccttaaggaagctgaaagaacagtgtggctgccggatcccgtacaaggtggtggcacggcgggaaggtgatgtggcagcctgttacgccaaccccagcctggcccaagaggagctggggtggacagcagccttagggctggacaggatgt

SEQ ID NO: 33732 - DNA, 792 bp, Homo sapiens
attagtcactgcgcccaggagccagtttacacctagcgaaggcggaggcattggacaagcctgggtctgagcagacagaaccccttcctgcgaccctggagtcccaatcgtgctgccattttccttctgcccaggactctccagtcctcagtcaccttggacaaagaagtgtggatcctcagattccatcttttccaactccaaggtgccatggcagagaaggtgctggtaacaggtggggctggctacattggcagccacacggtgctggagctgctggaggctggctacttgcctgtggtcatcgataacttccataatgccttccgtggagggggctccctgcctgagagcctgcggcgggtccaggagctgacaggccgctctgtggagtttgaggagatggacattttggaccagggagccctacagcgtctcttcaaaaagtacagctttatggcggtcatccactttgcggggctcaaggccgtgggcgagtcggtgcagaagcctctggattattacagagttaacctgaccgggaccatccagcttctggagatcatgaaggcccacggggtgaagaacctggtgttcagcagctcagccactgtgtacgggaacccccagtacctgccccttgatgaggcccaccccacgggtggttgtaccaacccttacggcaagtccaagttcttcatcgaggaaatgatccgggacctgtgccaggcagacaagacttggaacgcagtgctgctgcgctatttcaaccccacaggtgcccatgcctct

SEQ ID NO: 33733 - DNA, 672 bp, Homo sapiens
gtggcgatcgggcgacgggaggccctgaatgtctttggcaatgactatgacacagaggatggcacaggtgtccgggattacatccatgtcgtggatctggccaagggccacattgcagccttaaggaagctgaaagaacagtgtggctgccggatcccgtacaaggtggtggcacggcgggaaggtgatgtggcagcctgttacgccaaccccagcctggcccaagaggagctggggtggacagcagccttagggctggacaggatgtgtgaggatctctggcgctggcagaagcagaatccttcaggctttggcacgcaagcctgaggaccctcccctaccaaggaccaggaaaagcagcagctgcctgctctccagcctctggcaggaactcagggccctggagctgctggggccaagccaaggcctcccctacctcaaaccccagctgggcccgcttagcccaccaggcatgaggccaagggctccactgaccaggaggccgaggtctctaactcttatcttccacagggtccaagagttcatcaggacccccaagagtgagtgagggggcaaggctctggcacaaaacctcctcctcccaggcactcatttatattgctctgaaagagctttccaaagtatttaaaaataaaaacaagttttcttaca

SEQ ID NO: 33734 - DNA, 2720 bp, Homo sapiens
agaggggcgggagctctggctcaggtaaaaactctttcttcggctcgcgagctgagaggagcaggtagaggggcagaggcgggactgtcgtctgggggagccgcccaggaggctcctcaggccgaccccagaccctggctggccaggatgaagtatctccggcaccggcggcccaatgccaccctcattctggccatcggcgctttcaccctcctcctcttcagtctgctagtgtcaccacccacctgcaaggtccaggagcagccaccggcgatccccgaggccctggcctggcccactccacccacccgcccagccccggccccgtgccatgccaacacctctatggtcacccacccggacttcgccacgcagccgcagcacgttcagaacttcctcctgtacagacactgccgccactttcccctgctgcaggacgtgcccccctctaagtgcgcgcagccggtcttcctgctgctggtgatcaagtcctcccctagcaactatgtgcgccgcgagctgctgcggcgcacgtggggccgcgagcgcaaggtacggggtttgcagctgcgcctcctcttcctggtgggcacagcctccaacccgcacgaggcccgcaaggtcaaccggctgctggagctggaggcacagactcacggagacatcctgcagtgggacttccacgactccttcttcaacctcacgctcaagcaggtcctgttcttacagtggcaggagacaaggtgcgccaacgccagcttcgtgctcaacggggatgatgacgtctttgcacacacagacaacatggtcttctacctgcaggaccatgaccctggccgccacctcttcgtggggcaactgatccaaaacgtgggccccatccgggctttttggagcaagtactatgtgccagaggtggtgactcagaatgagcggtacccaccctattgtgggggtggtggcttcttgctgtcccgcttcacggccgctgccctgcgccgtgctgcccatgtcttggacatcttccccattgatgatgtcttcctgggtatgtgtctggagcttgagggactgaagcctgcctcccacagcggcatccgcacgtctggcgtgcgggctccatcgcaacgcctgtcctcctttgacccctgcttctaccgagacctgctgctggtgcaccgcttcctaccttatgagatgctgctcatgtgggatgcgctgaaccagcccaacctcacctgcggcaatcagacacagatctactgagtcagcatcagggtccccagcctctgggctcctgtttccataggaaggggcgacaccttcctcccaggaagctgagacctttgtggtctgagcataagggagtgccagggaaggtttgaggtttgatgagtgaatattctggctggcgaactcctacacatccttcaaaacccacctggtactgttccagcatcttccctggatggctggaggaactccagaaaatatccatcttctttttgtggctgctaatggcagaagtgcctgtgctagagttccaactgtggatgcatccgtcccgtttgagtcaaagtcttacttccctgctctcacctactcacagacgggatgctaagcagtgcacctgcagtggtttaatggcagataagctccgtctgcagttccaggccagccagaaactcctgtgtccacatagagctgacgtgagaaatatctttcagcccaggagagaggggtcctgatcttaaccctttcctgggtctcagacaactcagaaggttggggggataccagagaggtggtggaataggaccgccccctccttacttgtgggatcaaatgctgtaatggtggaggtgtgggcagaggagggaggcaagtgtcctttgaaagttgtgagagctcagagtttctggggtcctcattaggagcccccatccctgtgttccccaagaattcagagaacagcactggggctggaatgatctttaatgggcccaaggccaacaggcatatgcctcactactgcctggagaagggagagattcaggtcctccagcagcctccctcacccagtatgttttacagattacggggggaccgggtgagccagtgaccccctgtagcccccagcttcaggcctcagtgtctgccagtcaagcttcacaggcattgtgatggggcagccttggggaatataaaattttgtgaagacttggagatctttttttttttttaagcaaatttacaagtttcaacagacaagtccacattcatccctaaaagtctcattttccagtagaaaatatacactggtaaaaacggggcatggggccgtggctcagggctgtaattctagcacattgggagaccaaagtgggaggatcacttgagcccaggagttctggatcctgtctctgcacaaaataaaaaattactcaggcgtggtggtgctcacatgcctgtagtcccagctatacttgggaggctgaggcgagaggatcgcttgagcccaggagttggaggctgcagtgaaccatgattgcgccactgtactccactgggcggcaataagaagacaaaaacataaaacaggacatgtgtgaggcaaaagctgcaggaatttctatcaggcagatctgacctcatcccacccaccccctgctcagatacccttcatagctccttattgctttcagctcataaccccacat

SEQ ID NO: 33735 - DNA, 1642 bp, Homo sapiens
agcagcctctgcccgacccggctcgtgcggaccccaggaccgggcgcgggacgcgtgcgtccagcctccggcgctgcggagacccgcggctgggtccggggaggccccaaacccgcccccgccagaaccccgccccaaattcccacctcctccagaagccccgcccactcccgagccccgagagctccgcgcacctgggcgccatccgccctggctccgctgcacgagctccacgcccgtaccccggcgtcacgctcagcccgcggtgctcgcacacctgagactcatctcgcttcgaccccgccgccgccgccgcccggcatcctgagcacggagacagtctccagctgccgttcatgcttcctccccagccttccgcagcccaccagggaaggggcggtaggagtggccttttaccaaagggaccggcgatgctctgcaggctgtgctggctggtctcgtacagcttggctgtgctgttgctcggctgcctgctcttcctgaggaaggcggccaagcccgcaggagaccccacggcccaccagcctttctgggctcccccaacaccccgtcacagccggtgtccacccaaccacacagtgtctagcgcctctctgtccctgcctagccgtcaccgtctcttcttgacctatcgtcactgccgaaatttctctatcttgctggagccttcaggctgttccaaggataccttcttgctcctggccatcaagtcacagcctggtcacgtggagcgacgtgcggctatccgcagcacgtggggcagggtggggggatgggctaggggccggcagctgaagctggtgttcctcctaggggtggcaggatccgctcccccagcccagctgctggcctatgagagtagggagtttgatgacatcctccagtgggacttcactgaggacttcttcaacctgacgctcaaggagctgcacctgcagcgctgggtggtggctgcctgcccccaggcccatttcatgctaaagggagatgacgatgtctttgtccacgtccccaacgtgttagagttcctggatggctgggacccagcccaggacctcctggtgggagatgtcatccgccaagccctgcccaacaggaacactaaggtcaaatacttcatcccaccctcaatgtacagggccacccactacccaccctatgctggtgggggaggatatgtcatgtccagagccacagtgcggcgcctccaggctatcatggaagatgctgaactcttccccattgatgatgtctttgtgggtatgtgcctgaggcggctggggctgagccctatgcaccatgctggcttcaagacatttggaatccggcggcccctggaccccttagacccctgcctgtatagggggctcctgctggttcaccgcctcagccccctcgagatgtggaccatgtgggcactggtgacagatgaggggctcaagtgtgcagctggccccataccccagcgctgaagggtgggttgggcaacagcctgagagtggactcagtgttgattctctatcgtgatgcgaaattgatgcctgctgctctacagaaaatgccaacttggttttttaactcctctcaccctgttagctctgattaaaaacactgcaaccca

SEQ ID NO: 33736 - DNA, 2938 bp, Homo sapiens
cagtctccagctgccgttcatgcttcctccccagccttccgcagcccaccagggaaggggcggtaggagtggccttttaccaaaggtcagattctttcaccgcctctgccagacccccttgtcccccacccccgcatagatctccagggggctcagaaaactctggccggtggctcacgcctgtagtcccaacgctttgggaggccaaggcgggaggatcgcttgaggccaggagttccagaccagcccaggcaacaaaagataccacatctctacaaaaaataaattagccgggccctgcacgcctgtagtcccagctactggggaggccgaggccggaggatcgcttgaacccaggagttccaggctgcagtgagctataattgtgccactgcactagagtctgggtgacagagacactgtctcaaaaaaaaccaacaaaacccttagctctttcactagccgggctggcctcttcctactgtaaacctgctgggcccccgtctcccttctttctcccctctctcctgccctggagctgcctgactctgcccacggcctgcagagaccccaggtcttcacgcaaggtgccattcctcactcagttcttgctcaaacgtccctccatcaaggagggctttttagctacccttggctatgggatccgtcctccgcgtcagccaattctctgcattagactgtaacttctcaacatacctggttcctatgcgttttgtgctcccctctgagagggcagcgaccctgtcttgcttgccactgcatccctagcacctagcagttgcttttctggtgacggcggctgtggcagtggccaatgcggcagactggtcagaagtgaagggacaggatgacttggcagtggaggtcaaggggaggggactggggcagagggagacaccagagggacaaaaatgagaaactgaagacaggctttgctacgtggagctcgggcaggccacactggtggattctgtctcctcatccttcttttcaggtccctgggagaaatcagcacttagaacgtggtgggaaggcggggcggggtgcctcggaagccatccctgatacaagtccccagctttcctgcttcccctcttgtggtgtgtggctttgtctccctccctccctcctggaagccccgacctctgaggcaggtgtaaagggtgtgtgctttggtggccacggccaccctgtggtgctggttctcctccgagggaagcagtgcactcctggtcatcttggagacgcccaacacaggaccccacaggcaccaagctttttttgggaaatggtttcacttcccacttgaaaagccctgaatgtcagttccacacttagtgaatttgatccaagctaaactgagtctgtgcctaaaactcatcaggtgctcgagtttcctggaagaatggctgggaacgtttatggtgtcagctgtaaagtggctgcaagtccttttgggaaaaacagacccaggagtcctcagatgatggcagaggagggcaagggctggcaaagcagctgtgcttagcccatcctcaggggagggaggactctggaaagagcctgaggatacgctgagaataaaaagtccagaggccagcagggacttagcggctggggtgcaggttaactcctgcccaactcttggggacagggacccggggctgggccctgctcaggtggctctctccttgcagggaccggcgatgctctgcaggctgtgctggctggtctcgtacagcttggctgtgctgttgctcggctgcctgctcttcctgaggaaggcggccaagcccgcaggagaccccacggcccaccagcctttctgggctcccccaacaccccgtcacagccggtgtccacccaaccacacagtgtctagcgcctctctgtccctgcctagccgtcaccgtctcttcttgacctatcgtcactgccgaaatttctctatcttgctggagccttcaggctgttccaaggataccttcttgctcctggccatcaagtcacagcctggtcacgtggagcgacgtgcggctatccgcagcacgtggggcagggtggggggatgggctaggggccggcagctgaagctggtgttcctcctaggggtggcaggatccgctcccccagcccagctgctggcctatgagagtagggagtttgatgacatcctccagtgggacttcactgaggacttcttcaacctgacgctcaaggagctgcacctgcagcgctgggtggtggctgcctgcccccaggcccatttcatgctaaagggagatgacgatgtctttgtccacgtccccaacgtgttagagttcctggatggctgggacccagcccaggacctcctggtgggagatgtcatccgccaagccctgcccaacaggaacactaaggtcaaatacttcatcccaccctcaatgtacagggccacccactacccaccctatgctggtgggggaggatatgtcatgtccagagccacagtgcggcgcctccaggctatcatggaagatgctgaactcttccccattgatgatgtctttgtgggtatgtgcctgaggcggctggggctgagccctatgcaccatgctggcttcaagacatttggaatccggcggcccctggaccccttagacccctgcctgtatagggggctcctgctggttcaccgcctcagccccctcgagatgtggaccatgtgggcactggtgacagatgaggggctcaagtgtgcagctggccccataccccagcgctgaagggtgggttgggcaacagcctgagagtggactcagtgttgattctctatcgtgatgcgaaattgatgcctgctgctctacagaaaatgccaacttggttttttaactcctctcaccctgttagctctgattaaaaacactgcaaccca

SEQ ID NO: 33737 - DNA, 2749 bp, Homo sapiens
attcccacctcctccagaagccccgcccactcccgagccccgagagctccgcgcacctgggcgccatccgccctggctccgctgcacgagctccacgcccgtaccccggcgtcacgctcagggaccggcgatgctctgcaggctgtgctggctggtctcgtacagcttggctgtgctgttgctcggctgcctgctcttcctgaggaaggcggccaagcccgcaggagaccccacggcccaccagcctttctgggctcccccaacaccccgtcacagccggtgtccacccaaccacacagtgtctagcgcctctctgtccctgcctagccgtcaccgtctcttcttgacctatcgtcactgccgaaatttctctatcttgctggagccttcaggctgttccaaggataccttcttgctcctggccatcaagtcacagcctggtcacgtggagcgacgtgcggctatccgcagcacgtggggcagggtggggggatgggctaggggccggcagctgaagctggtgttcctcctaggggtggcaggatccgctcccccagcccagctgctggcctatgagagtagggagtttgatgacatcctccagtgggacttcactgaggacttcttcaacctgacgctcaaggagctgcacctgcagcgctgggtggtggctgcctgcccccaggcccatttcatgctaaagggagatgacgatgtctttgtccacgtccccaacgtgttagagttcctggatggctgggacccagcccaggacctcctggtgggagatgtcatccgccaagccctgcccaacaggaacactaaggtcaaatacttcatcccaccctcaatgtacagggccacccactacccaccctatgctggtgggggaggatatgtcatgtccagagccacagtgcggcgcctccaggctatcatggaagatgctgaactcttccccattgatgatgtctttgtgggtatgtgcctgaggcggctggggctgagccctatgcaccatgctggcttcaagacatttggaatccggcggcccctggaccccttagacccctgcctgtatagggggctcctgctggttcaccgcctcagccccctcgagatgtggaccatgtgggcactggtgacagatgaggggctcaagtgtgcagctggccccataccccagcgctgaagggtgggttgggcaacagcctgagagtggactcagtgttgattctctatcgtgatgcgaaattgatgcctgctgctctacagaaaatgccaacttggttttttaactcctctcaccctgttagctctgattaaaaacactgcaacccagctaacttgtccagcatatgttgaatgggagccaaagtgtagcaaatgctgccaggaacctgtcggggcattccgggcgctgcctggggcgctgcagtctgggacctcaaggaaggaggctgcataggaccccaggagagacgcattttctctttcagatgcaaacaaaatcttacactcttctcctttggatacaatagagaaacggaaagaaaggaaggaacaagaggcctgtgttaagtcctgttgatgttaagtcctgttgagagcaccaggtaaacactctgcaccccttctcttagtagtaataggtttttcactccttggcctcagctgtcctcacaggacagtgggggcagatcagagaacacatcagaaatacatacaaagaaatcgtacaaactggacaggttcccctccccctgccacaactggcatcccaacagagggaacaagtactaaatcatttttgacgacgtaaataagactgaaaacaggttaaacagttgctgaacttaagggcatgacaaaaaggactcctctctctgacccaggtaggcaaaatgctttgggtgtgaggtaaaaaaaatgggtaagagcagctgtacagagtggggtgaaatgttaaacagggtgcagtgcccaagggctaagaaccaggtccagcgcaagcctgagaccacaggaggcactcacagctcacaaaggcgtctcgcctgattggccagggcaggatctgccgcctcttctcggtgcacagacagtcatgccaaccctgggcagggtggcatctgcccctgctttccccactgagtggggagacagggcagtgtgctcaggccctcaatcctcacgcaggtaggcctcctgctccgactcagcccgctcctccccttcctcctgtgttttctgacggagctcttctatctgtgcttctgccagcttggtttctgctttccgggagagctggtgcacctcttccacctgcagtttcaccagctgaatgtgattcctggcggttatagaggcctgatctgcgcctgccaaaagatgggacaatcgggttgagcagccgtgcagggcgcggaaggctcatgtggacgttggcctgggggtgctgtggctgtcatctgaacccctcttggggtcactttccttgacctccctgtcttctctctctgcaaagaaacttccacctctatgttcaggtctggatttaactgacactctgtcaaaaacagcatttttcttcagctgtcagcggccaacatcacaattattaaatgcaactctcacaatcatctttatagctacagagcttttagtacagacctttgattaatttttttaactacacatcttccatttctttttgacaaagagatcatgaataaaattgtcaaagatc

SEQ ID NO: 33738 - DNA, 3216 bp, Homo sapiens
agtctccccgcccctgagccgtgaaggaaatagggacctggccctgggccttgtgtagcgggagggggagctaggaagcagctgagggcagaatccaggagggcctggctgcgggggaatgaagcctccgccttcgcaggcaaaagcctttaaatacgggctcaggcccgggactcagagtgtaacgcgtggcagcctgagggaggggcgtgcgccgagagggagctcagatcgagcggggcgcgggtggagaagctgcggcggcgcggcccgtaggaaggtgctgtccgaacgatcgggataggagcggtccctgcgcttgctgctgggaagtggtacaatcatgtttgaaattaagaagatctgttgcatcggtgcaggctatgttggaggacccacatgtagtgtcattgctcatatgtgtcctgaaatcagggtaacggttgttgatgtcaatgaatcaagaatcaatgcgtggaattctcctacacttcctatttatgagccaggactaaaagaagtggtagaatcctgtcgaggaaaaaatctttttttttctaccaatattgatgatgccatcaaagaagctgatcttgtatttatttctgtgaatactccaacaaaaacctatggaatggggaaaggccgggcagcagatctgaagtatattgaagcttgtgctagacgcattgtgcaaaactcaaatgggtacaaaattgtgactgagaaaagcacagttccagtgcgggcagcagaaagtatccgtcgcatatttgatgcaaacacaaaacccaacttgaatttacaggtgctgtccaaccctgagtttctggcagagggaacagccatcaaggacctaaagaacccagacagagtactgattggaggggatgaaactccagagggccagagagctgtgcaggccctgtgtgctgtatatgagcactgggttcccagagaaaagatcctcaccactaatacttggtcttcagagctttccaaactggcagcaaatgcttttcttgcccagagaataagcagcattaactccataagtgctctgtgtgaagcaacaggagctgatgtagaagaggtagcaacagcgattggaatggaccagagaattggaaacaagtttctaaaagccagtgttgggtttggtgggagctgtttccaaaaggatgttctgaatttggtttatctctgtgaggctctgaatttgccagaagtagctcgttattggcagcaggtcatagacatgaatgactaccagaggaggaggtttgcttcccggatcatagatagtctgtttaatacagtaactgataagaagatagctattttgggatttgcattcaaaaaggacactggtgatacaagagaatcttctagtatatatattagcaaatatttgatggatgaaggtgcacatctacatatatatgatccaaaagtacctagggaacaaatagttgtggatctttctcatccaggtgtttcagaggatgaccaagtgtcccggctcgtgaccatttccaaggatccatatgaagcatgtgatggtgcccatgctgttgttatttgcactgagtgggacatgtttaaggaattggattatgaacgcattcataaaaaaatgctaaagccagcctttatcttcgatggacggcgtgtcctggatgggctccacaatgaactacaaaccattggcttccagattgaaacaattggcaaaaaggtgtcttcaaagagaattccatatgctccttctggtgaaattccgaagtttagtcttcaagatccacctaacaagaaacctaaagtgtagagattgccatttttatttgtgattttttttttttttttttggtacttcaggatagcaaatatctatctgctattaaatggtaaatgaaccaagtgtttttttttgttttttttttgagacagagtctcactgttgcccaggctggagtgcagtggtgcaatctcggctcactgcaagctctgcttcccaggttcacgccattctcctggctcagcctcccaagtagctgggactacaggcacccgccacagtgcctggctaattttttgtatttttagtagagacagggtttcaccatgtgagccaggatggtctcaatctcctgaccttgtgaaccacccgtctcggcctcccaaagtgctgggattacaggtgtgagccaccacgcctggcccatgaaccaagtgtttttaaggaaacaaaactatttttttaatcatcagatttatactagctatatggatattagcatatctggtaattatgaatctagaatttttttacatatttttataatactgttagctcagttattggatgagtgaaagataatcatgttggttttaatagtgtcaatttttgtaaaataaaaattaaacttcaaactctttactttataaattgtccataggccacactttaatatcacattataaagggaaggacagtcttcattcctcctggttattggtttgtttgtcattaaagatatattttgaatccatgaaattgctatgctaaacagcctttacatgtatggtctggttaaagttcctttgttccttttgttttaataaaatgtgtcactgattttttagctcaaaatcatcactgttaatttccagtcaccccaaatatggttaaaagattttttttttaatcatgaagagaaaattagtagcatttctttctctccccattatttattggttttcctcactaatctttttttttttagtccaaaagccaaaaatatttatcttggttttacattttaatttccattcttaattgtaatttttttctttaaataaggaaaccaatataatctcatgtataaaaacttaaatattttacaagttacatatagcatcattctaaaataagaattttttttgttttctgtctgcttttttcttatgtctcttgttgagttttatattttcagtggttatttttgcttgtgttagatcattattaaaatatatccaatgtccctttgatacttgtgctctgctgagaatgtacagtttgcattaaacatcccaggtctcatccttcaggaattttgcagttcaatgagaagagggagacaaatataaagatgaggacagaagcatctctacagatgaaaattacataaataaaacattctccatcaacaacta

SEQ ID NO: 33739 - DNA, 2826 bp, Homo sapiens
gtaacgcgtggcagcctgagggaggggcgtgcgccgagagggagctcagatcgagcggggcgcgggtggagaagctgcggcggcgcggcccgtaggaaggtgctgtccgaacgatcgggataggagcggtccctgcgcttgctgctgggaagtggtacaatcatgtttgaaattaagaagatctgttgcatcggtgcaggctatgttggaggacccacatgtagtgtcattgctcatatgtgtcctgaaatcagggtaacggttgttgatgtcaatgaatcaagaatcaatgcgtggaattctcctacacttcctatttatgagccaggactaaaagaagtggtagaatcctgtcgaggaaaaaatctttttttttctaccaatattgatgatgccatcaaagaagctgatcttgtatttatttctgtgctgtccaaccctgagtttctggcagagggaacagccatcaaggacctaaagaacccagacagagtactgattggaggggatgaaactccagagggccagagagctgtgcaggccctgtgtgctgtatatgagcactgggttcccagagaaaagatcctcaccactaatacttggtcttcagagctttccaaactggcagcaaatgcttttcttgcccagagaataagcagcattaactccataagtgctctgtgtgaagcaacaggagctgatgtagaagaggtagcaacagcgattggaatggaccagagaattggaaacaagtttctaaaagccagtgttgggtttggtgggagctgtttccaaaaggatgttctgaatttggtttatctctgtgaggctctgaatttgccagaagtagctcgttattggcagcaggtcatagacatgaatgactaccagaggaggaggtttgcttcccggatcatagatagtctgtttaatacagtaactgataagaagatagctattttgggatttgcattcaaaaaggacactggtgatacaagagaatcttctagtatatatattagcaaatatttgatggatgaaggtgcacatctacatatatatgatccaaaagtacctagggaacaaatagttgtggatctttctcatccaggtgtttcagaggatgaccaagtgtcccggctcgtgaccatttccaaggatccatatgaagcatgtgatggtgcccatgctgttgttatttgcactgagtgggacatgtttaaggaattggattatgaacgcattcataaaaaaatgctaaagccagcctttatcttcgatggacggcgtgtcctggatgggctccacaatgaactacaaaccattggcttccagattgaaacaattggcaaaaaggtgtcttcaaagagaattccatatgctccttctggtgaaattccgaagtttagtcttcaagatccacctaacaagaaacctaaagtgtagagattgccatttttatttgtgattttttttttttttttttggtacttcaggatagcaaatatctatctgctattaaatggtaaatgaaccaagtgtttttttttgttttttttttgagacagagtctcactgttgcccaggctggagtgcagtggtgcaatctcggctcactgcaagctctgcttcccaggttcacgccattctcctggctcagcctcccaagtagctgggactacaggcacccgccacagtgcctggctaattttttgtatttttagtagagacagggtttcaccatgtgagccaggatggtctcaatctcctgaccttgtgaaccacccgtctcggcctcccaaagtgctgggattacaggtgtgagccaccacgcctggcccatgaaccaagtgtttttaaggaaacaaaactatttttttaatcatcagatttatactagctatatggatattagcatatctggtaattatgaatctagaatttttttacatatttttataatactgttagctcagttattggatgagtgaaagataatcatgttggttttaatagtgtcaatttttgtaaaataaaaattaaacttcaaactctttactttataaattgtccataggccacactttaatatcacattataaagggaaggacagtcttcattcctcctggttattggtttgtttgtcattaaagatatattttgaatccatgaaattgctatgctaaacagcctttacatgtatggtctggttaaagttcctttgttccttttgttttaataaaatgtgtcactgattttttagctcaaaatcatcactgttaatttccagtcaccccaaatatggttaaaagattttttttttaatcatgaagagaaaattagtagcatttctttctctccccattatttattggttttcctcactaatctttttttttttagtccaaaagccaaaaatatttatcttggttttacattttaatttccattcttaattgtaatttttttctttaaataaggaaaccaatataatctcatgtataaaaacttaaatattttacaagttacatatagcatcattctaaaataagaattttttttgttttctgtctgcttttttcttatgtctcttgttgagttttatattttcagtggttatttttgcttgtgttagatcattattaaaatatatccaatgtccctttgatacttgtgctctgctgagaatgtacagtttgcattaaacatcccaggtctcatccttcaggaattttgcagttcaatgagaagagggagacaaatataaagatgaggacagaagcatctctacagatgaaaattacataaataaaacattctccatc

SEQ ID NO: 33740 - DNA, 575 bp, Homo sapiens
gtaacgcgtggcagcctgagggaggggcgtgcgccgagagggagctcagatcgagcggggcgcgggtggagaagctgcggcggcgcggcccgtaggaaggtgctgtccgaacgatcgggataggagcggtccctgcgcttgctgctgggaagtggtacaatcatgtttgaaattaagaagatctgttgcatcggtgcaggctatgttggaggacccacatgtagtgtcattgctcatatgtgtcctgaaatcagggtaacggttgttgatgtcaatgaatcaagaatcaatgcgtggaattctcctacacttcctatttatgaggactaaaagaagtggtagaatcctgtcgaggaaaaaatctttttttttctaccaatattgatgatgccatcaaagaagctgatcttgtatttatttctgtgaatactccaacaaaaacctatggaatggggaaaggccgggcagcagatctgaagtatattgaagcttgtgctagacgcattgtgcaaaactcaaatgggtacaaaattgtgactgagaaaagcacagttccagtgcgggcagcagaaagt

SEQ ID NO: 33741 - DNA, 433 bp, Homo sapiens
cgcacagacatcccaaatcccggattgggcctgaggaacatctctgcaaagagcgccaggagggcgtgggggtcccgcctctctcgccagggaccagggagtggacactcactggtccagtcatgaggaactcagcatcctcctgacgggaggcgcctctttcccagaagcgtacaatcatgtttgaaattaagaagatctgttgcatcggtgcaggctatgttggaggacccacatgtagtgtcattgctcatatgtgtcctgaaatcagggtaacggttgttgatgtcaatgaatcaagaatcaatgcgtggaattctcctacacttcctatttatgagccaggactaaaagaagtggtagaatcctgtcgaggaaaaaatctttttttttctaccaatattgatgatgccatcaaagaagctgatcttgt

SEQ ID NO: 33742 - DNA, 3021 bp, Homo sapiens
atacagagcagtagctgtctatcgacagacctcaaagacacagtgagcctttgagtttcttcaaatcccttaagaaatggagaacagtagtctttcttcaggggggttctggaaatgaaagagctgactgtctgctctgagatgtgcttattagtggccaggatccagtttaagtacaatcatgtttgaaattaagaagatctgttgcatcggtgcaggctatgttggaggacccacatgtagtgtcattgctcatatgtgtcctgaaatcagggtaacggttgttgatgtcaatgaatcaagaatcaatgcgtggaattctcctacacttcctatttatgagccaggactaaaagaagtggtagaatcctgtcgaggaaaaaatctttttttttctaccaatattgatgatgccatcaaagaagctgatcttgtatttatttctgtgaatactccaacaaaaacctatggaatggggaaaggccgggcagcagatctgaagtatattgaagcttgtgctagacgcattgtgcaaaactcaaatgggtacaaaattgtgactgagaaaagcacagttccagtgcgggcagcagaaagtatccgtcgcatatttgatgcaaacacaaaacccaacttgaatttacaggtgctgtccaaccctgagtttctggcagagggaacagccatcaaggacctaaagaacccagacagagtactgattggaggggatgaaactccagagggccagagagctgtgcaggccctgtgtgctgtatatgagcactgggttcccagagaaaagatcctcaccactaatacttggtcttcagagctttccaaactggcagcaaatgcttttcttgcccagagaataagcagcattaactccataagtgctctgtgtgaagcaacaggagctgatgtagaagaggtagcaacagcgattggaatggaccagagaattggaaacaagtttctaaaagccagtgttgggtttggtgggagctgtttccaaaaggatgttctgaatttggtttatctctgtgaggctctgaatttgccagaagtagctcgttattggcagcaggtcatagacatgaatgactaccagaggaggaggtttgcttcccggatcatagatagtctgtttaatacagtaactgataagaagatagctattttgggatttgcattcaaaaaggacactggtgatacaagagaatcttctagtatatatattagcaaatatttgatggatgaaggtgcacatctacatatatatgatccaaaagtacctagggaacaaatagttgtggatctttctcatccaggtgtttcagaggatgaccaagtgtcccggctcgtgaccatttccaaggatccatatgaagcatgtgatggtgcccatgctgttgttatttgcactgagtgggacatgtttaaggaattggattatgaacgcattcataaaaaaatgctaaagccagcctttatcttcgatggacggcgtgtcctggatgggctccacaatgaactacaaaccattggcttccagattgaaacaattggcaaaaaggtgtcttcaaagagaattccatatgctccttctggtgaaattccgaagtttagtcttcaagatccacctaacaagaaacctaaagtgtagagattgccatttttatttgtgattttttttttttttttttggtacttcaggatagcaaatatctatctgctattaaatggtaaatgaaccaagtgtttttttttgttttttttttgagacagagtctcactgttgcccaggctggagtgcagtggtgcaatctcggctcactgcaagctctgcttcccaggttcacgccattctcctggctcagcctcccaagtagctgggactacaggcacccgccacagtgcctggctaattttttgtatttttagtagagacagggtttcaccatgtgagccaggatggtctcaatctcctgaccttgtgaaccacccgtctcggcctcccaaagtgctgggattacaggtgtgagccaccacgcctggcccatgaaccaagtgtttttaaggaaacaaaactatttttttaatcatcagatttatactagctatatggatattagcatatctggtaattatgaatctagaatttttttacatatttttataatactgttagctcagttattggatgagtgaaagataatcatgttggttttaatagtgtcaatttttgtaaaataaaaattaaacttcaaactctttactttataaattgtccataggccacactttaatatcacattataaagggaaggacagtcttcattcctcctggttattggtttgtttgtcattaaagatatattttgaatccatgaaattgctatgctaaacagcctttacatgtatggtctggttaaagttcctttgttccttttgttttaataaaatgtgtcactgattttttagctcaaaatcatcactgttaatttccagtcaccccaaatatggttaaaagattttttttttaatcatgaagagaaaattagtagcatttctttctctccccattatttattggttttcctcactaatctttttttttttagtccaaaagccaaaaatatttatcttggttttacattttaatttccattcttaattgtaatttttttctttaaataaggaaaccaatataatctcatgtataaaaacttaaatattttacaagttacatatagcatcattctaaaataagaattttttttgttttctgtctgcttttttcttatgtctcttgttgagttttatattttcagtggttatttttgcttgtgttagatcattattaaaatatatccaatgtccctttgatacttgtgctctgctgagaatgtacagtttgcattaaacatcccaggtctcatccttcaggaattttgcagttcaatgagaagagggagacaaatataaagatgaggacagaagcatctctacagatgaaaa

SEQ ID NO: 33743 - DNA, 1712 bp, Homo sapiens
gtgtaacgcgtggcagcctgagggaggggcgtgcgccgagagggagctcagatcgagcggggcgcgggtggagaagctgcggcggcgcggcccgtaggaaggtgctgtccgaacgatcgggataggagcggtccctgcgcttgctgctgggaagtggccaggactaaaagaagtggtagaatcctgtcgaggaaaaaatctttttttttctaccaatattgatgatgccatcaaagaagctgatcttgtatttatttctgtgaatactccaacaaaaacctatggaatggggaaaggccgggcagcagatctgaagtatattgaagcttgtgctagacgcattgtgcaaaactcaaatgggtacaaaattgtgactgagaaaagcacagttccagtgcgggcagcagaaagtatccgtcgcatatttgatgcaaacacaaaacccaacttgaatttacaggtgctgtccaaccctgagtttctggcagagggaacagccatcaaggacctaaagaacccagacagagtactgattggaggggatgaaactccagagggccagagagctgtgcaggccctgtgtgctgtatatgagcactgggttcccagagaaaagatcctcaccactaatacttggtcttcagagctttccaaactggcagcaaatgcttttcttgcccagagaataagcagcattaactccataagtgctctgtgtgaagcaacaggagctgatgtagaagaggtagcaacagcgattggaatggaccagagaattggaaacaagtttctaaaagccagtgttgggtttggtgggagctgtttccaaaaggatgttctgaatttggtttatctctgtgaggctctgaatttgccagaagtagctcgttattggcagcaggtcatagacatgaatgactaccagaggaggaggtttgcttcccggatcatagatagtctgtttaatacagtaactgataagaagatagctattttgggatttgcattcaaaaaggacactggtgatacaagagaatcttctagtatatatattagcaaatatttgatggatgaaggtgcacatctacatatatatgatccaaaagtacctagggaacaaatagttgtggatctttctcatccaggtgtttcagaggatgaccaagtgtcccggctcgtgaccatttccaaggatccatatgaagcatgtgatggtgcccatgctgttgttatttgcactgagtgggacatgtttaaggaattggattatgaacgcattcataaaaaaatgctaaagccagcctttatcttcgatggacggcgtgtcctggatgggctccacaatgaactacaaaccattggcttccagattgaaacaattggcaaaaaggtgtcttcaaagagaattccatatgctccttctggtgaaattccgaagtttagtcttcaagatccacctaacaagaaacctaaagtgtagagattgccatttttatttgtgattttttttttttttttttggtacttcaggatagcaaatatctatctgctattaaatggtaaatgaaccaagtgtttttttttgttttttttttgagacagagtctcactgttgcccaggctggagtgcagtggtgcaatctcggctcactgcaagctctgcttcccaggttcacgccattctcctggctcagcctcccaagtagctggga

SEQ ID NO: 33744 - DNA, 577 bp, Homo sapiens
gtaacgcgtggcagcctgagggaggggcgtgcgccgagagggagctcagatcgagcggggcgcgggtggagaagctgcggcggcgcggcccgtaggaaggtgctgtccgaacgatcgggataggagcggtccctgcgcttgctgctgggaagtggaacagtcttactgttttccttctagtacaatcatgtttgaaattaagaagatctgttgcatcggtgcaggctatgttggaggacccacatgtagtgtcattgctcatatgtgtcctgaaatcagggtaacggttgttgatgtcaatgaatcaagaatcaatgcgtggaattctcctacacttcctatttatgagccaggactaaaagaagtggtagaatcctgtcgaggaaaaaatctttttttttctaccaatattgatgatgccatcaaagaagctgatcttgtatttatttctgtgaatactccaacaaaaacctatggaatggggaaaggccgggcagcagatctgaagtatattgaagcttgtgctagacgcattgtgcaaaactcaaatgggtacaaaattgtgactgagaaaagc

SEQ ID NO: 33745 - DNA, 534 bp, Homo sapiens
gtgaaggaaatagggacctggccctgggccttgtgtagcgggagggggagctaggaagcagctgagggcagaatccaggagggcctggctgcgggggaatgaagcctccgccttcgcaggcaaaagcctttaaatacgggctcaggcccgggactcagagtgtaacgcgtggcagcctgagggaggggcgtgcgccgagagggagctcagatcgagcggggcgcgggtggagaagctgcggcggcgcggcccgtaggaaggtgctgtccgaacgatcgggataggagcggtccctgcgcttgctgctgggaagtgggtaagcgccgctcccaggctggccccgccgcccgggcgggatgctcccagtacaatcatgtttgaaattaagaagatctgttgcatcggtgcaggctatgttggaggacccacatgtagtgtcattgctcatatgtgtcctgaaatcagggtaacggttgttgatgtcaatgaatcaagaatcaatgcgtggaattctcctacacttcctatttatga

SEQ ID NO: 33746 - DNA, 549 bp, Homo sapiens
gccctaaagcctggcagacgcggagcgcacgcggcctttgcctcggccaggacagggcagcggggagagggctgctagacaacaattcttgacccctcctcgacccacgaccgccagtacaatcatgtttgaaattaagaagatctgttgcatcggtgcaggctatgttggaggacccacatgtagtgtcattgctcatatgtgtcctgaaatcagggtaacggttgttgatgtcaatgaatcaagaatcaatgcgtggaattctcctacacttcctatttatgaggactaaaagaagtggtagaatcctgtcgaggaaaaaatctttttttttctaccaatattgatgatgccatcaaagaagctgatcttgtatttatttctgtgaatactccaacaaaaacctatggaatggggaaaggccgggcagcagatctgaagtatattgaagcttgtgctagacgcattgtgcaaaactcaaatgggtacaaaattgtgactgagaaaagcacagttccagtgcgggcagcagaaagtatccgtcgcata

SEQ ID NO: 33747 - DNA, 568 bp, Homo sapiens
agacgcggagcgcacgcggcctttgcctcggccaggacagggcagcggggagagggctgctagacaacaattcttgacccctcctcgacccacgaccgccagtacaatcatgtttgaaattaagaagatctgttgcatcggtgcaggctatgttggaggacccacatgtagtgtcattgctcatatgtgtcctgaaatcagggtaacggttgttgatgtcaatgaatcaagaatcaatgcgtggaattctcctacacttcctatttatgagccaggactaaaagaagtggtagaatcctgtcgaggaaaaaatctttttttttctaccaatattgatgatgccatcaaagaagctgatcttgtatttatttctgtgaatactccaacaaaaacctatggaatggggaaaggccgggcagcagatctgaagtatattgaagcttgtgctagacgcattgtgcaaaactcaaatgggtacaaaattgtgactgagaaaagcacagttccagtgcgggcagcagaaagtatccgtcgcatatttgatgcaaacacaaaacccaacttgaat

SEQ ID NO: 33748 - DNA, 861 bp, Homo sapiens
gtagcgggagggggagctaggaagcagctgagggcagaatccaggagggcctggctgcgggggaatgaagcctccgccttcgcaggcaaaagcctttaaatacgggctcaggcccgggactcagagtgtaacgcgtggcagcctgagggaggggcgtgcgccgagagggagctcagatcgagcggggcgcgggtggagaagctgcggcggcgcggcccgtaggaaggtgctgtccgaacgatcgggataggagcggtccctgcgcttgctgctgggaagtggggcgggaaccgcattttggaactgctgtcctggggatgtggtcgtctgggcttcttattcaagactctacaatcatgtttgaaattaagaagatctgttgcatcggtgcaggctatgttggaggacccacatgtagtgtcattgctcatatgtgtcctgaaatcagggtaacggttgttgatgtcaatgaatcaagaatcaatgcgtggaattctcctacacttcctatttatgagccaggactaaaagaagtggtagaatcctgtcgaggaaaaaatctttttttttctaccaatattgatgatgccatcaaagaagctgatcttgtatttatttctgtgaatactccaacaaaaacctatggaatggggaaaggccgggcagcagatctgaagtatattgaagcttgtgctagacgcattgtgcaaaactcaaatgggtacaaaattgtgactgagaaaagcacagttccagtgcgggcagcagaaagtatccgtcgcatatttgatgcaaacacaaaacccaacttgaatttacaggtgctgtccaaccctgagtttctggcagagggaacagcca

SEQ ID NO: 33749 - DNA, 4007 bp, Homo sapiens
gggggcgggacgcgccgaggagtggggcgcgagccgccggttttgattagtgcgcggagctgcggcggtggagctgctcggccgggagcccggcggcgagacggagaggcggcggaggtgcccgcgcgcagggtctggtgggcggccgcgaggctcgggagaggcgaaccggagcgcgggaccgcggtcgccccgaccagagccgggagaccgcagcacccgcagccgcccgcgagcgcgccgaagacagcgcgcaggcgagagcgcgcgggcgggggcgcgcaggccctgcccgccccttccgtccccacccccctccgccctttcctctccccaccttcctctcgcctcccgcgcccccgcaccgggcgcccaccctgtcctcctcctgcgggagcgttgtccgtgttggcggccgcagcgggccgggccggtccggcgggccgggggatggcgctgctggacctggccttggagggaatggccgtcttcgggttcgtcctcttcttggtgctgtggctgatgcatttcatggctatcatctacacccgattacacctcaacaagaaggcaactgacaaacagccttatagcaagctcccaggtgtctctcttctgaaaccactgaaaggggtagatcctaacttaatcaacaacctggaaacattctttgaattggattatcccaaatatgaagtgctcctttgtgtacaagatcatgatgatccagccattgatgtatgtaagaagcttcttggaaaatatccaaatgttgatgctagattgtttataggtggcaaaaaagttggcattaatcctaaaattaataatttaatgccaggatatgaagttgcaaagtatgatcttatatggatttgtgatagtggaataagagtaattccagatacgcttactgacatggtgaatcaaatgacagaaaaagtaggcttggttcacgggctgccttacgtagcagacagacagggctttgctgccaccttagagcaggtatattttggaacttcacatccaagatactatatctctgccaatgtaactggtttcaaatgtgtgacaggaatgtcttgtttaatgagaaaagatgtgttggatcaagcaggaggacttatagcttttgctcagtacattgccgaagattactttatggccaaagcgatagctgaccgaggttggaggtttgcaatgtccactcaagttgcaatgcaaaactctggctcatattcaatttctcagtttcaatccagaatgatcaggtggaccaaactacgaattaacatgcttcctgctacaataatttgtgagccaatttcagaatgctttgttgccagtttaattattggatgggcagcccaccatgtgttcagatgggatattatggtatttttcatgtgtcattgcctggcatggtttatatttgactacattcaactcaggggtgtccagggtggcacactgtgtttttcaaaacttgattatgcagtcgcctggttcatccgcgaatccatgacaatatacatttttttgtctgcattatgggacccaactataagctggagaactggtcgctacagattacgctgtgggggtacagcagaggaaatcctagatgtataactacagctttgtgactgtatataaaggaaaaaagagaagtattataaattatgtttatataaatgcttttaaaaatctaccttctgtagttttatcacatgtatgttttggtatctgttctttaatttatttttgcatggcacttgcatctgtgaaaaaaaaaaaaaacacatctgtagtcttggccaaatgatacactttattttgtggaagtagagaatcaagagaattggttctaggaacctgggttcgttcatcattgttgtttatttttttaaaataaataaataaatatatatatagatgctctgcaacaaactctgtgacagtatccttcagtagagaaagtttcttacttgtgagtacactcttttagaacatttacgggtggcagcagctttgctttagagtttagaagataatagaaggaatgactattcatgtccaaagtgaatggttttgtgcagtgaacaacacatggcgaggtactaactgagaaactttttcatgctttatgcctacctcttgtagttgttgcagagcaaatataaattgtaataagatagctaggccttgcagaaacaaacagaaaaacttaaaaaaaaatgatataagagctggagtctagtatttatatgaatctgtgagagataatttttttggtctcactgcaatgaaccaaaagcggctgagtttggtttttaattgtagccatgtattgaaggcatctttttgaccaactcttgttggttctgtcttgaaccattgttaatcactgtgctgtaattagtatagctaaatcttttccttccttgctcctcccccagcccaccccgtcttcccttaacattttttcagggggggttgggagtggtttcattttagtgtgagtggatgttttgatagttgtaaggaaaaaatgcatttcagacacatttcacacatgagctattttcttacacagtatgtcttattgttaataagaatgtaatttcatgatacaagtatttaataccttttttaagtcagtaaatattctagccatcaataaattgcagtagagtattaagaggggacaggatgagtttactcttaaaattaatcagtatcaaactaagtctactgtgtgtgttttttttttttgttttttgtttttgtttgtttactattatagtaagtctagtcttatttaaattggatttttgtattcaagtttatatgacaaaatagactagatcagcgctggttgtaaatgcatgctgtacctcactgttttctccccatcatgccgctaaacttgctcgccaggttgtgcttaacttgtggtgaactggacttgattctgttttgttttgtttttttaaaaaaaaaaaacaaaaatgtaagggacagtgcataagccttttctttgttaagtagtggtgttttgctttttcttcaggattggatggcatgttgtccacaggaatgcctactgcagggctaacactggcaatatggcagctttaaattctgagttactacagtctccatgtcaaagcataatgtgtagcatatcagcaataactacatatttatagaaaacactttttcactttactgagccaattcatttaattgtcaaatgtctatatccatggtttaaatggcaacatatctataagtatgtatacacattatatttaagcttttctctgggccaaactgcttcatccttttttctttctttttttttttttttagccttatgatgaatttgtttgaagggcattttctttatgaacaaaggcttggatgcatattcctttctttctgtgaatgggtattattccctgaggaaagttgcacagtgaaaaccagtctggttgtgacccactacatgttttgtttttaatcactattacctgagttgaactttgctcaccatgtttgtacttgttggtctgtttaatgaagtttggttgatgccatcctttgcactgccgaagcgtaatcttgtgtattacttagctctctgctgatctcagtatggacagtgtaacaacaaaaccaaaatggctggacagacttcttgtgttttgtaaatataaactaggacagttctgtaggtttgttcagtgtgctagtggagtatttccttaatgtaaaacttcacttaacagagagattctttgtttagcaagcttggagtgatgataaaatggtaagaaataatataaatgttgaagaaagcatcacaacagaactataggagtctaaatttaataaatctttaaaaaaaaccagtgtctagaatatataccatgttttattatttaaaatcattgtcttaaatttttgttcaaaaaataaaaatttgaatacaatcaaaa

SEQ ID NO: 33750 - DNA, 10650 bp, Homo sapiens
ccctggcgttgtctctggcactgtggcggactgaccacggcccgggcatgggctgcaagggagacgcgagcggtgcgtgtgccgcgggtgcgctgccggtgacaggagtttgctataaaatgggagttctggttgtactcactgttctgtggctgttctcctcagtaaaggccgactcaaaagccattacaacctctcttacaacaaaatggttttccactccattgttgttagaagccagtgagtttttagcagaagacagtcaagagaaattttggaattttgtagaagccagtcaaaatattggatcatcagatcatgacggtaccgattattcctactatcatgcaatattggaggctgcatttcagtttctgtcacccctccagcagaatttgtttaaattttgtctgtcccttcgttcttactcagctacaatccaagccttccagcagatagcagctgatgaacctccaccagaaggatgtaattcgtttttttcagtgcatggaaagaagacttgtgaatctgatacccttgaggctcttctactgacagcctctgaaagacccaaacctttattgttcaaaggagatcacagatatccctcgtctaatcctgaaagccctgtggtgattttctactctgagattggctctgaggaattttccaattttcaccgccagcttatatcaaaaagcaatgcaggcaaaatcaattatgtattcagacattatatatttaatcccaggaaggagcctgtttacctctctggctatggcgtggaattggccattaagagcactgagtacaaggccaaggatgatactcaggtgaaaggaactgaggtaaacaccacagtgattggtgaaaatgatcctattgatgaggttcaggggttcctctttggaaaattaagagatctgcaccccgacctggagggacagttgaaagaactcagaaagcatcttgtagagagcaccaatgaaatggcacctttaaaggtttggcagttgcaagatctcagtttccagactgctgctcgaatcttggcttctcctgttgagttggctttggttgtcatgaaggatcttagtcagaattttcctaccaaagccagagcaataacaaaaacagctgtgagctcagaacttagaaccgaagtggaagagaatcagaagtatttcaagggaactttaggattacaacctggagattcagccctcttcatcaatggacttcacatggatttagatacacaggatatattcagtctgtttgatgtgttgaggaatgaagctcgggtaatggagggtctgcatagattgggaatagaaggcctttctctgcataatgttttgaagctgaacatccagccctctgaggcagactatgccgtagacatccggagtcctgctatttcatgggtcaacaacctggaggttgatagcagatataattcgtggccttctagtttacaagagttgcttcgacccacctttcctggtgttattcggcagatcaggaaaaacttacataatatggttttcatagttgatcctgcacatgagaccacagcagagttgatgaacacagctgagatgttccttagtaatcatataccactaagaattggttttatctttgtggttaatgactctgaagatgttgatgggatgcaagatgctggagtggctgttcttagagcatataattatgttgcccaagaagtggatgattatcatgccttccagactctgacacatatctataacaaggtgaggactggagaaaaagtgaaagttgaacatgtggtcagtgtcctggagaagaaatatccgtatgtagaagtgaatagcattttggggattgattctgcttatgatcggaatcggaaggaagcaagaggctactatgagcagactggagttggacctctgcccgttgtgctgttcaatggaatgccctttgaaagggaacagctagaccctgatgagttagaaaccatcacaatgcataaaatcctggagaccaccaccttcttccaaagagcggtgtacttgggtgaactgccccatgatcaagatgtggtagagtatatcatgaatcagccaaatgttgttccacgaatcaattctaggattttgacagctgaacgagactacctggatttaacagcgagtaataacttctttgtggatgattatgctagatttactatcttggattcccaaggcaagactgctgctgtagccaatagtatgaactatctgacaaagaaaggaatgtcctccaaggaaatctatgatgattcttttattaggccagtaactttttggattgttggggattttgatagcccttctggacggcagttactgtatgatgccatcaaacatcagaaatccagtaacaatgttagaataagcatgatcaataatcctgccaaagagataagctatgagaacactcagatctccagagcaatctgggcagctctccaaactcagacttccaacgctgctaagaacttcatcaccaaaatggccaaggagggggctgcagaggccctggctgcaggagctgacattgcggagttctctgttgggggaatggatttcagtctttttaaagaggtctttgagtcttccaaaatggatttcattttgtctcatgccgtgtactgcagggatgttctgaagctgaagaagggacagagggcagtgatcagcaatggaaggatcattgggccactggaggatagtgagctctttaatcaagacgatttccacctcctcgaaaatatcatcttaaaaacctcaggacagaaaataaaatctcatattcaacagcttcgggtagaagaagatgtggcaagcgacttggtaatgaaggtggatgctcttctgtcagcgcaaccaaaaggagatccaagaatcgagtaccagttttttgaagacagacacagtgcaatcaaactgaggccgaaggaaggggagacatactttgatgttgtggctgtcgttgaccctgtcaccagagaagcacagagacttgctcctttgctcttggttttggctcagctgataaacatgaatctgagagtatttatgaactgccaatccaaactttctgacatgcctttaaaaagcttttaccgttatgtcttagaaccagagatttctttcacttcagacaatagttttgctaagggtccaatcgcaaaatttttggatatgcctcagtctccactgttcactctgaatttgaacacacctgagagctggatggtagaatctgtcagaacaccatatgatcttgataatatttatttagaagaggtggacagtgtagtggctgctgagtatgagctggaatacctgttactggaaggtcattgctacgacatcaccacaggccagcctccacggggactacagtttaccttaggaacttcagccaacccggtcattgtggacaccattgttatggccaatctgggctactttcagctgaaagccaacccaggagcttggatcctcagacttaggaagggacgctctgaagatatttatagaatttacagccacgatggcactgattctccccctgatgctgatgaggtggttatcgtcctcaacaacttcaaaagcaaaattattaaagtgaaggttcagaagaaggcagatatggtgaacgaagacttgctgagtgatggaacgagtgagaatgaatctggattttgggattccttcaaatggggctttacaggacagaagactgaggaagtgaagcaagataaagatgacataattaatattttctccgttgcatctggtcatctctacgaaagatttcttcgcataatgatgctatccgtgctgaagaataccaagactcctgtgaaattctggttcttgaagaattacttgtcccccacatttaaggagtttataccttacatggcaaatgaatacaatttccagtatgagcttgttcagtacaaatggccccggtggcttcatcaacaaactgaaaaacagcgtatcatctggggttacaagatcctcttcctggatgtacttttcccactagttgttgacaagttcctgtttgtggatgctgatcagattgtacgaacagatctgaaagagttaagagatttcaatttggatggtgctccttatggttacactcctttctgtgacagccgaagagaaatggacggctacaggttctggaagtcagggtactgggccagtcatttagccgggcgaaagtatcatatcagtgcactatatgttgtggatctgaagaagtttaggaaaatagctgctggtgacagactcaggggacagtaccaaggtctgagtcaggaccctaacagcctttcaaatcttgatcaagatctgcccaataacatgattcatcaggtgccaattaaatccctccctcaagaatggctttggtgtgaaacgtggtgtgatgacgcctctaagaaaagggcaaaaaccattgatttgtgtaataatccgatgaccaaagagccgaaactggaagcagctgtgcggattgtcccggagtggcaggactacgaccaagagatcaaacagctacagatccgctttcagaaggagaaagaaacgggagcactgtacaaagagaagacaaaagaaccaagccgagaaggtcctcagaaacgtgaagaattatgatctctggagaaggacaggaaatcaccccatttgaaaaacagtttttataataaatgctagttttttctgatctgtctatacaactgctgataagccggctgggcaggagtgccacaccttttgattctgagcatttgattctgacttctgtactctggtggccactggatctttgggattaaagctctgttggatttgtacctcagaggaagaccaagtggctgatcctttggactctgtaaagagcattcttctagtcagagggtggaatggcagcagcaactggaagaaaatgagttttttggtgcccacacccaagagcacacacatgctgcactgtctcggaaagcagggccagctagagccaccatgttcttccttacctcagtttacctgcggcctgcgctgcactgcagatgcccaccctgccctgggtctggccggcggaagctctgtccaaggtccacacacctccaggtttacgccaacatccttgtgccctccccaccttctcttccaacgcattaggtgcattgtttaattgaaatccaaccaacaattgtgtgtcaaggctggtttggtgcagtggctgggcaaattaattttgggccaggatgggggtgggttgcagtgagggtagggaaaatgtcaggagtaggaaggttcgggggttaagggaagggaaggaagaccagaactggccatcctcttttataatccattagtagcaccatggctcatttgaaatgaaaatattacacttattccccacccaaccgcagtgaactttctaggtaattgttttgaaaacaatttttgtatctgtgaaagtctttgctttttctttccaccttctagaaaagtctgctaccagtttccttactgaatacagccatactcagcccctctcgcatccagcccgtcagggtcagggtcagggtcaggctccctcaagacgagcaccgcattgtctgccctcttttgcgtaggatttttctctcagacccaggggacattgccttggacttttctctacaaatgccctcagatgtaagaccagaaatgattctgcttgtggaactcgtggctttctgtcctattttccttttatgtgagccctgcaggttgcctttggcgcccacaccagttctgtcttcatgtcgctgcatcgtgaagccccatttgcctttagtccctgctttgtgtgtcttcacttccacagccagtgttgcccctcagggcatactttgctggtgaacgggctgtagagtcttgagtatgttattggcctaagtgggcatgaggccccagcatccgactccatctgccaggctgcagggcacagcagcactggcatagacaggcacgctctgtcttccaacgtgcaccagccttttcttacatattttgcctgtttttaaaaaatacgaggagagggtgcagatggatactgtgccctcaccctcctaagccaggtaatatattgatgtgcagacttttaagaaatcttagtcttatcacaaatatcaagtaatttattttttccattttcaaatgcaaaagttagcctaggaagcctcccagtcatcctgaaggaccttttgactttgcttttataattctgttaaaaattgaggaggggattaatgagtacaatgaaaacaaaacaaaacaaaaaattaagaagaggaaagctcaaaagaggataagagactgaaaaggcacctcagaatggctgctgtgggcagagtctgtgacatgactttccccgccctgcccctctgttcagagcagctggaaagatgggatcagtaagattaaaaaacttttgttcggccaggcgtggtggctcacacctgtaatcccagcactttgggaggctgaggcggacggatcatgaggtcaggagttcaagaccagcctggccaatatggtgaaaccccgtctctactaaaaatacaaaaattagccgggtgttgtggctcaccctctattcccagctactcgggaggcagagacaggagaatcgcctgaacccaggaggcagaggttgcagtgagctgagatcgtgccactgcactccagcctgggtgacagagcgagactccatctcagaaaacaaacaaacaaaaagaaacttttgttcaagctgcatcttcacattgaatgaaagcattcagacgggtgactgctgctgtccacaactgtgggcggaagtgtgccttttcccagtttctcgtccaggaggttgcatagcaaatactcaagtcactgggatatatgctttccaaatgctggcccccatagcacctttccccatgtctttctaccaagcctcttatgtttaatctgtgcagggaagacaagagtagaccatattctctgtgtgctgtgcatgtcctggtgtcactcattgcctcttatctgtcgccattctaatataagtcagcttaatagttgactctgaataatgcaaaacccagcttgcttccagaatggcctaggaccctcctcctcctgccagtttttttttttttttttggttcatgtggcataatcatctttcaaaattaaccaaatgccccagaaaatgatgttaccactaaaatattttctccaagaaggcatactgtaacagaaaagataggtaagatatttttttcccaagaagtaagaattgattgtgctgaatgttcaaactctggaaactgttcacagtatgttgttcttagctgttatttatataaagtgaattattttctctctcaatcatgccatagtggagacttttgtttgtgagtaagtgacagagtaatatgaaataatgtgatatgtcagagtgacatgcagcatcctgagcctgtttttatgttctgtgtacagtggcatttgattgagatcaaagcctgtcacagcctgctgctgggggtgtggggatatgccagagtcctgtgtttggttttagaagtttactgaatgtttcccacatggagaataatggatggcatgttagtttctttaagagtggtaaagttgtacatctgtcattgttgcatttcgaattgaacacatagatgcttgcctgtctgcttgggtgaatgcctcttgggagagcgaagattacgtgcatgatgtatgttaagaaacagtttccggtcaggcacagtggcttacacctgtaatcccagcactttgggaagccgaggcgggcggattatgaggtcaagagatagagaccatcctggccaacacggtgaaaccccgtctctactaaaaatacaaaaattagctgggcatggtggcacacacctgtagtcccagctactcgggaggctgaggcaggagaatcacttgaacccgggaggtggaggttgcagtgagccgagatcatgccactgcactccagcctggcaatagagcgagactccgtctcaaaaaaaaaaaaaaaaaaaaaaaaaaaattaaaacagtttccataaatggagcttaatttgctctgctgtccttaagccctcgtgggtttttttttaagagagtctcattctgtcacccaggctggagtgcagtggtgcgatcttggctcacttcaacctctgcctcccaagttcaaacaattctcctgcctcagcctcctgagtagctgggattacaggcgcctgccaccatgcctggttaatttttgtatttttagtagagatggggttttaccatgttggttggccaggctgatctcaaactcctgacctcaggtggtgatctgcccacctcggcctcccaaagtgctgggattacaggcgtgagccactatgtccggtcaagccctcgtgttctgaaccttgtcaaggctctgcctgaatgagttttcatctgattgtggggaccaagtccctgagtagagggccaagagctagggacagggggaagagactggcccaggtggtagggaggaaagaactcccagagtttcctttagccaggaaacctgctctactgaccccgtgacttggacagtcagacatcaccctgagagtgacaagtgtaaaatgactcccttcctcccccgccctccggaagtatatttagatacttgaaagcagtccttttctaaaatggccttacctatgtggcctgaacgattaaaagaaagaactcagagttacaagggaaaaagaaaaagagttacaagggaattgtagtctttttctgaatagaatattagtactgtggtattgcatttcatgggaatggaaatgtattggtaaagctacctgatggaagctttctcttggtaacaaaaatggagggtgtattatgtgcagttatttaaatatatgtattccattgttgcgtggtttttttcccccctcaagacagagatttgctcttgttgcccagggtggagtacaatggtgtgaccttggctcactgcaacctctgcctcctgggttcaggtgattctcctgcctcagccttccgagtagctgggattacaggtgtgcgccaccacacccggctaatttttgctttttttttttttgagacagaatctcgctctgttgctcaggctggagtggagtgcagtggcacaatctcagctcactgcagcctctgcctcccgggttcaagagattctcctgactcaacctcctgagtagctgggattacaggtgcctgccactatgcctagctaatttttgtatttttagtagagacggggttttgccatgttggccagggtggtctcgaactcctgacctcaagtgatccacccgcatcggccccccaaagtgctgggattataggcgtgaaccaccgcgcctgtcccattgttgtgtaattttaataattagttttttaagtacttgattttatgggcacatttttgtgggatgattggagttaatcaaataaagcttgtcatgtgtgtagtttggtaagataacttctttaaattcatgttttctctgccttgaggtagtgagggaaagatcttaatcagtattttggtaattaactgattgaattcaagcaaatgagacatcatgaacttcagtggttattgatatttcagggtatatacctgaaatgcctagaggatacagatttctcatttcattctttggtctttcatttctctatatacagaaatgaaatgacacttctgggaggcagtagaagcaggaagtcaatgaattgagtagagggtcccattccctcaggctgtcattgatcagtgacaatttataaaaacaaactgcaaagtctgtggcaagtggctgcctgcttcctagaaggagcccatgaaggttaaactctgtggtcggtatttgcaagcgccgggcgtggtggctcacgcctgtaatcctagcaccttgggaggccaaggcaggcggatcacccgaggtcaggagtttgaggatttgcaagcaaaaggtcctctcctgagtctttcccagatacccagcagtgcagaggctagctgtggaaggttgcagtgggacaggaatgtattgtatgccttgccttacttgtcaccattgagatttccagagaaatgggcataacgtctcttaacaacaacagcagaaagcaaaatacattaacttaaggttgacaacaaaagattatcaagtaccatgttttccaaccaaccagttattcgtggtaataataaaataaaggtgggaaaatgttataatttttaaggaaactgtgtactttaaaaatcttctttatgaatatccaatgttactgtaatcctgctccattaaatgcagcattgttgtcaggtgctgcctcttgcttgggaacagcattgggcttttaaatgtctgcagaatctctgcgttcgaagggaattgagaatgaacttcctggtactgtaatgaaaataaggtctgctcaacacagtaaacgtttcctctcttctttaaaa

SEQ ID NO: 33751 - DNA, 10930 bp, Homo sapiens
aattgctttgcgaggctgggtgttgagtcgagccgcgggaaaggcgcgtgtcggcctctcactggcgcagcctgcactgccgctgccgcctcgccccgccctgccctggcgttgtctctggcactgtggcggactgaccacggcccgggcatgggctgcaagggagacgcgagcggtgcgtgtgccgcgggtgcgctgccggtgacaggtacccaggggtggcgtgaggaggcctcgtggacaaagagagggtttggggcacaaggcgaccctgtgcccctgtcacattgagcttccgcctctaccgtgactcagtttaccctctggtgtcctatcccttcccctattcgcgagcgccccgagttgccctcagtggtcttcttggcaaggagtttgctataaaatgggagttctggttgtactcactgttctgtggctgttctcctcagtaaaggccgactcaaaagccattacaacctctcttacaacaaaatggttttccactccattgttgttagaagccagtgagtttttagcagaagacagtcaagagaaattttggaattttgtagaagccagtcaaaatattggatcatcagatcatgacggtaccgattattcctactatcatgcaatattggaggctgcatttcagtttctgtcacccctccagcagaatttgtttaaattttgtctgtcccttcgttcttactcagctacaatccaagccttccagcagatagcagctgatgaacctccaccagaaggatgtaattcgtttttttcagtgcatggaaagaagacttgtgaatctgatacccttgaggctcttctactgacagcctctgaaagacccaaacctttattgttcaaaggagatcacagatatccctcgtctaatcctgaaagccctgtggtgattttctactctgagattggctctgaggaattttccaattttcaccgccagcttatatcaaaaagcaatgcaggcaaaatcaattatgtattcagacattatatatttaatcccaggaaggagcctgtttacctctctggctatggcgtggaattggccattaagagcactgagtacaaggccaaggatgatactcaggtgaaaggaactgaggtaaacaccacagtgattggtgaaaatgatcctattgatgaggttcaggggttcctctttggaaaattaagagatctgcaccccgacctggagggacagttgaaagaactcagaaagcatcttgtagagagcaccaatgaaatggcacctttaaaggtttggcagttgcaagatctcagtttccagactgctgctcgaatcttggcttctcctgttgagttggctttggttgtcatgaaggatcttagtcagaattttcctaccaaagccagagcaataacaaaaacagctgtgagctcagaacttagaaccgaagtggaagagaatcagaagtatttcaagggaactttaggattacaacctggagattcagccctcttcatcaatggacttcacatggatttagatacacaggatatattcagtctgtttgatgtgttgaggaatgaagctcgggtaatggagggtctgcatagattgggaatagaaggcctttctctgcataatgttttgaagctgaacatccagccctctgaggcagactatgccgtagacatccggagtcctgctatttcatgggtcaacaacctggaggttgatagcagatataattcgtggccttctagtttacaagagttgcttcgacccacctttcctggtgttattcggcagatcaggaaaaacttacataatatggttttcatagttgatcctgcacatgagaccacagcagagttgatgaacacagctgagatgttccttagtaatcatataccactaagaattggttttatctttgtggttaatgactctgaagatgttgatgggatgcaagatgctggagtggctgttcttagagcatataattatgttgcccaagaagtggatgattatcatgccttccagactctgacacatatctataacaaggtgaggactggagaaaaagtgaaagttgaacatgtggtcagtgtcctggagaagaaatatccgtatgtagaagtgaatagcattttggggattgattctgcttatgatcggaatcggaaggaagcaagaggctactatgagcagactggagttggacctctgcccgttgtgctgttcaatggaatgccctttgaaagggaacagctagaccctgatgagttagaaaccatcacaatgcataaaatcctggagaccaccaccttcttccaaagagcggtgtacttgggtgaactgccccatgatcaagatgtggtagagtatatcatgaatcagccaaatgttgttccacgaatcaattctaggattttgacagctgaacgagactacctggatttaacagcgagtaataacttctttgtggatgattatgctagatttactatcttggattcccaaggcaagactgctgctgtagccaatagtatgaactatctgacaaagaaaggaatgtcctccaaggaaatctatgatgattcttttattaggccagtaactttttggattgttggggattttgatagcccttctggacggcagttactgtatgatgccatcaaacatcagaaatccagtaacaatgttagaataagcatgatcaataatcctgccaaagagataagctatgagaacactcagatctccagagcaatctgggcagctctccaaactcagacttccaacgctgctaagaacttcatcaccaaaatggccaaggagggggctgcagaggccctggctgcaggagctgacattgcggagttctctgttgggggaatggatttcagtctttttaaagaggtctttgagtcttccaaaatggatttcattttgtctcatgccgtgtactgcagggatgttctgaagctgaagaagggacagagggcagtgatcagcaatggaaggatcattgggccactggaggatagtgagctctttaatcaagacgatttccacctcctcgaaaatatcatcttaaaaacctcaggacagaaaataaaatctcatattcaacagcttcgggtagaagaagatgtggcaagcgacttggtaatgaaggtggatgctcttctgtcagcgcaaccaaaaggagatccaagaatcgagtaccagttttttgaagacagacacagtgcaatcaaactgaggccgaaggaaggggagacatactttgatgttgtggctgtcgttgaccctgtcaccagagaagcacagagacttgctcctttgctcttggttttggctcagctgataaacatgaatctgagagtatttatgaactgccaatccaaactttctgacatgcctttaaaaagcttttaccgttatgtcttagaaccagagatttctttcacttcagacaatagttttgctaagggtccaatcgcaaaatttttggatatgcctcagtctccactgttcactctgaatttgaacacacctgagagctggatggtagaatctgtcagaacaccatatgatcttgataatatttatttagaagaggtggacagtgtagtggctgctgagtatgagctggaatacctgttactggaaggtcattgctacgacatcaccacaggccagcctccacggggactacagtttaccttaggaacttcagccaacccggtcattgtggacaccattgttatggccaatctgggctactttcagctgaaagccaacccaggagcttggatcctcagacttaggaagggacgctctgaagatatttatagaatttacagccacgatggcactgattctccccctgatgctgatgaggtggttatcgtcctcaacaacttcaaaagcaaaattattaaagtgaaggttcagaagaaggcagatatggtgaacgaagacttgctgagtgatggaacgagtgagaatgaatctggattttgggattccttcaaatggggctttacaggacagaagactgaggaagtgaagcaagataaagatgacataattaatattttctccgttgcatctggtcatctctacgaaagatttcttcgcataatgatgctatccgtgctgaagaataccaagactcctgtgaaattctggttcttgaagaattacttgtcccccacatttaaggagtttataccttacatggcaaatgaatacaatttccagtatgagcttgttcagtacaaatggccccggtggcttcatcaacaaactgaaaaacagcgtatcatctggggttacaagatcctcttcctggatgtacttttcccactagttgttgacaagttcctgtttgtggatgctgatcagattgtacgaacagatctgaaagagttaagagatttcaatttggatggtgctccttatggttacactcctttctgtgacagccgaagagaaatggacggctacaggttctggaagtcagggtactgggccagtcatttagccgggcgaaagtatcatatcagtgcactatatgttgtggatctgaagaagtttaggaaaatagctgctggtgacagactcaggggacagtaccaaggtctgagtcaggaccctaacagcctttcaaatcttgatcaagatctgcccaataacatgattcatcaggtgccaattaaatccctccctcaagaatggctttggtgtgaaacgtggtgtgatgacgcctctaagaaaagggcaaaaaccattgatttgtgtaataatccgatgaccaaagagccgaaactggaagcagctgtgcggattgtcccggagtggcaggactacgaccaagagatcaaacagctacagatccgctttcagaaggagaaagaaacgggagcactgtacaaagagaagacaaaagaaccaagccgagaaggtcctcagaaacgtgaagaattatgatctctggagaaggacaggaaatcaccccatttgaaaaacagtttttataataaatgctagttttttctgatctgtctatacaactgctgataagccggctgggcaggagtgccacaccttttgattctgagcatttgattctgacttctgtactctggtggccactggatctttgggattaaagctctgttggatttgtacctcagaggaagaccaagtggctgatcctttggactctgtaaagagcattcttctagtcagagggtggaatggcagcagcaactggaagaaaatgagttttttggtgcccacacccaagagcacacacatgctgcactgtctcggaaagcagggccagctagagccaccatgttcttccttacctcagtttacctgcggcctgcgctgcactgcagatgcccaccctgccctgggtctggccggcggaagctctgtccaaggtccacacacctccaggtttacgccaacatccttgtgccctccccaccttctcttccaacgcattaggtgcattgtttaattgaaatccaaccaacaattgtgtgtcaaggctggtttggtgcagtggctgggcaaattaattttgggccaggatgggggtgggttgcagtgagggtagggaaaatgtcaggagtaggaaggttcgggggttaagggaagggaaggaagaccagaactggccatcctcttttataatccattagtagcaccatggctcatttgaaatgaaaatattacacttattccccacccaaccgcagtgaactttctaggtaattgttttgaaaacaatttttgtatctgtgaaagtctttgctttttctttccaccttctagaaaagtctgctaccagtttccttactgaatacagccatactcagcccctctcgcatccagcccgtcagggtcagggtcagggtcaggctccctcaagacgagcaccgcattgtctgccctcttttgcgtaggatttttctctcagacccaggggacattgccttggacttttctctacaaatgccctcagatgtaagaccagaaatgattctgcttgtggaactcgtggctttctgtcctattttccttttatgtgagccctgcaggttgcctttggcgcccacaccagttctgtcttcatgtcgctgcatcgtgaagccccatttgcctttagtccctgctttgtgtgtcttcacttccacagccagtgttgcccctcagggcatactttgctggtgaacgggctgtagagtcttgagtatgttattggcctaagtgggcatgaggccccagcatccgactccatctgccaggctgcagggcacagcagcactggcatagacaggcacgctctgtcttccaacgtgcaccagccttttcttacatattttgcctgtttttaaaaaatacgaggagagggtgcagatggatactgtgccctcaccctcctaagccaggtaatatattgatgtgcagacttttaagaaatcttagtcttatcacaaatatcaagtaatttattttttccattttcaaatgcaaaagttagcctaggaagcctcccagtcatcctgaaggaccttttgactttgcttttataattctgttaaaaattgaggaggggattaatgagtacaatgaaaacaaaacaaaacaaaaaattaagaagaggaaagctcaaaagaggataagagactgaaaaggcacctcagaatggctgctgtgggcagagtctgtgacatgactttccccgccctgcccctctgttcagagcagctggaaagatgggatcagtaagattaaaaaacttttgttcggccaggcgtggtggctcacacctgtaatcccagcactttgggaggctgaggcggacggatcatgaggtcaggagttcaagaccagcctggccaatatggtgaaaccccgtctctactaaaaatacaaaaattagccgggtgttgtggctcaccctctattcccagctactcgggaggcagagacaggagaatcgcctgaacccaggaggcagaggttgcagtgagctgagatcgtgccactgcactccagcctgggtgacagagcgagactccatctcagaaaacaaacaaacaaaaagaaacttttgttcaagctgcatcttcacattgaatgaaagcattcagacgggtgactgctgctgtccacaactgtgggcggaagtgtgccttttcccagtttctcgtccaggaggttgcatagcaaatactcaagtcactgggatatatgctttccaaatgctggcccccatagcacctttccccatgtctttctaccaagcctcttatgtttaatctgtgcagggaagacaagagtagaccatattctctgtgtgctgtgcatgtcctggtgtcactcattgcctcttatctgtcgccattctaatataagtcagcttaatagttgactctgaataatgcaaaacccagcttgcttccagaatggcctaggaccctcctcctcctgccagtttttttttttttttttggttcatgtggcataatcatctttcaaaattaaccaaatgccccagaaaatgatgttaccactaaaatattttctccaagaaggcatactgtaacagaaaagataggtaagatatttttttcccaagaagtaagaattgattgtgctgaatgttcaaactctggaaactgttcacagtatgttgttcttagctgttatttatataaagtgaattattttctctctcaatcatgccatagtggagacttttgtttgtgagtaagtgacagagtaatatgaaataatgtgatatgtcagagtgacatgcagcatcctgagcctgtttttatgttctgtgtacagtggcatttgattgagatcaaagcctgtcacagcctgctgctgggggtgtggggatatgccagagtcctgtgtttggttttagaagtttactgaatgtttcccacatggagaataatggatggcatgttagtttctttaagagtggtaaagttgtacatctgtcattgttgcatttcgaattgaacacatagatgcttgcctgtctgcttgggtgaatgcctcttgggagagcgaagattacgtgcatgatgtatgttaagaaacagtttccggtcaggcacagtggcttacacctgtaatcccagcactttgggaagccgaggcgggcggattatgaggtcaagagatagagaccatcctggccaacacggtgaaaccccgtctctactaaaaatacaaaaattagctgggcatggtggcacacacctgtagtcccagctactcgggaggctgaggcaggagaatcacttgaacccgggaggtggaggttgcagtgagccgagatcatgccactgcactccagcctggcaatagagcgagactccgtctcaaaaaaaaaaaaaaaaaaaaaaaaaaaattaaaacagtttccataaatggagcttaatttgctctgctgtccttaagccctcgtgggtttttttttaagagagtctcattctgtcacccaggctggagtgcagtggtgcgatcttggctcacttcaacctctgcctcccaagttcaaacaattctcctgcctcagcctcctgagtagctgggattacaggcgcctgccaccatgcctggttaatttttgtatttttagtagagatggggttttaccatgttggttggccaggctgatctcaaactcctgacctcaggtggtgatctgcccacctcggcctcccaaagtgctgggattacaggcgtgagccactatgtccggtcaagccctcgtgttctgaaccttgtcaaggctctgcctgaatgagttttcatctgattgtggggaccaagtccctgagtagagggccaagagctagggacagggggaagagactggcccaggtggtagggaggaaagaactcccagagtttcctttagccaggaaacctgctctactgaccccgtgacttggacagtcagacatcaccctgagagtgacaagtgtaaaatgactcccttcctcccccgccctccggaagtatatttagatacttgaaagcagtccttttctaaaatggccttacctatgtggcctgaacgattaaaagaaagaactcagagttacaagggaaaaagaaaaagagttacaagggaattgtagtctttttctgaatagaatattagtactgtggtattgcatttcatgggaatggaaatgtattggtaaagctacctgatggaagctttctcttggtaacaaaaatggagggtgtattatgtgcagttatttaaatatatgtattccattgttgcgtggtttttttcccccctcaagacagagatttgctcttgttgcccagggtggagtacaatggtgtgaccttggctcactgcaacctctgcctcctgggttcaggtgattctcctgcctcagccttccgagtagctgggattacaggtgtgcgccaccacacccggctaatttttgctttttttttttttgagacagaatctcgctctgttgctcaggctggagtggagtgcagtggcacaatctcagctcactgcagcctctgcctcccgggttcaagagattctcctgactcaacctcctgagtagctgggattacaggtgcctgccactatgcctagctaatttttgtatttttagtagagacggggttttgccatgttggccagggtggtctcgaactcctgacctcaagtgatccacccgcatcggccccccaaagtgctgggattataggcgtgaaccaccgcgcctgtcccattgttgtgtaattttaataattagttttttaagtacttgattttatgggcacatttttgtgggatgattggagttaatcaaataaagcttgtcatgtgtgtagtttggtaagataacttctttaaattcatgttttctctgccttgaggtagtgagggaaagatcttaatcagtattttggtaattaactgattgaattcaagcaaatgagacatcatgaacttcagtggttattgatatttcagggtatatacctgaaatgcctagaggatacagatttctcatttcattctttggtctttcatttctctatatacagaaatgaaatgacacttctgggaggcagtagaagcaggaagtcaatgaattgagtagagggtcccattccctcaggctgtcattgatcagtgacaatttataaaaacaaactgcaaagtctgtggcaagtggctgcctgcttcctagaaggagcccatgaaggttaaactctgtggtcggtatttgcaagcgccgggcgtggtggctcacgcctgtaatcctagcaccttgggaggccaaggcaggcggatcacccgaggtcaggagtttgaggatttgcaagcaaaaggtcctctcctgagtctttcccagatacccagcagtgcagaggctagctgtggaaggttgcagtgggacaggaatgtattgtatgccttgccttacttgtcaccattgagatttccagagaaatgggcataacgtctcttaacaacaacagcagaaagcaaaatacattaacttaaggttgacaacaaaagattatcaagtaccatgttttccaaccaaccagttattcgtggtaataataaaataaaggtgggaaaatgttataatttttaaggaaactgtgtactttaaaaatcttctttatgaatatccaatgttactgtaatcctgctccattaaatgcagcattgttgtcaggtgctgcctcttgcttgggaacagcattgggcttttaaatgtctgcagaatctctgcgttcgaagggaattgagaatgaacttcctggtactgtaatgaaaataaggtctgctcaacacagtaaacgtttcctctcttcttt

SEQ ID NO: 33752 - DNA, 2240 bp, Homo sapiens
agcgggaagagccggccgaagcgtggcggccacagactgtgggtaccgggtccgagggactcgcgcttttctctccgtgccatggcgccagcgaaagccacgaacgtggtgcggctgctactaggctccacagcgctgtggctttcgcagctcggctccgggacggtcgccgcgtccaagtcggtgactgcccacttggccgcgaagtggcccgagaccccgctgctgctggaggcaagtgaatttatggcagaagaaagtaatgaaaaattttggcagtttttggaaactgtgcaagaattagcaatttataagcaaacagaatcagattattcttattacaacttaatcctgaagaaagctggacagtttctagacaatttacacatcaaccttttaaagtttgctttctctataagggcatactccccagctattcagatgtttcagcagattgcagctgatgagccaccaccagatggttgtaatgcatttgtggttattcataagaagcacacctgtaaaattaatgagattaaaaagctgctgaagaaagctgcttcaaggactagaccttatctatttaaaggagatcacaaatttcctacaaacaaagagaacttaccagtggtgattctctatgccgaaatgggtactagaacatttagtgcatttcacaaagtattgtctgaaaaagctcaaaatgaggaaattctgtatgttcttcgccattatattcagaaaccaagctcacggaaaatgtacttatctgggtatggtgtggagctagcaattaagagtacagaatacaaagcactggatgatacccaagttaaaactgtgactaatactactgtagaggatgagactgaaacaaatgaagttcaaggatttctctttgggaaactaaagcttgtctattgactattgaaaatacgtgttttcaatgagacaccatctcacaccagttagaatgacaatcattaaaaaggaaacgacagatgctggaggggatgtggagaaataggaaggcttttacactgttggtgtgtgtgtagatgagttcaaccgttgtggaagacagtgtggcaattcctcaaggatctagaaccagaaataccatttgacccagcaatgcccattactgggtgtatacccaaaggattataaatcattctactataaagacacatgcacacgtatgttgattgtagcactattcacaatagcaaagacttcgaaccaacccaaatgtccatcaatgatagactggataaagaaaatgtggcacatatacaccatagaatactctgcatccataaaaaaggataagttcatgtcctttgcagggacatggatgaagctggaaactatcattctcagcaaactaacacaggaacagaaaaccaaacaccacatgttcttactcaaaagtgggactcgaacagtgagaacacatggacacagggaggggaatatcacacaccgtggcttgtcgggggtggggagctaggagagggatagcattaggagaaatacctaatgtggataacgggttgatgggtgcagcagaccaccatgacacgtgtatacctgtgtaacaaacctgcacgttctacacatgtatcccagaacttaaagtataataaaatgaaaatatgtattttgtaagttgtgctgatagtaacttttttaaattgtatttctccatttaaatctgaaatggcaccatgtcttgatttcatgagtgatagaggaaagaagattacagtttagattgtgtgtatagtaaaataccattctactacatcattatttggctctctaaaagatgcctagagatgtttaacaatgggtaaaattatcttattttagttttttataagaatcaaagatggaacttttcagaaataaactctgattgtatgaggcatttttgactttccttatagtttttattttcaattataaaagcaaggcttgcaatttataaaatgttaaacaaaaagtatgtaatatgaaaacataagtctgccctcatccttgcatcgcttacagttgacactaacaattgagagtatattcctccagattttgttttgtttcatatatttaataaaagagacctgtatatcttcctcattatttttaagttccgtgaatatagctgtatcacaatttatgattatcttaatgatgaatgattcatttatgtctaattacatggaatatgtaatttc

SEQ ID NO: 33753 - DNA, 1233 bp, Homo sapiens
cgcgccggagcgggacacgcatgcgccggtctggacccggcacccagtaacggactcgagctcctcccaccggaagtgggcagccgcgcagcgggaagagccggccgaagcgtggcggccacagactgtgggtaccgggtccgagggactcgcgcttttctctccgtgccatggcgccagcgaaagccacgaacgtggtgcggctgctactaggctccacagcgctgtggctttcgcagctcggctccgggacggtcgccgcgtccaagtcggtgactgcccacttggccgcgaagtggcccgagaccccgctgctgctggaggcaagtgaatttatggcagaagaaagtaatgaaaaattttggcagtttttggaaactgtgcaagaattagcaatttataagcaaacagaatcagattattcttattacaacttaatcctgaagaaagctggacagtttctagacaatttacacatcaaccttttaaagtttgctttctctataagggcatactccccagctattcagatgtttcagcagattgcagctgatgagccaccaccagatggttgtaatgcatttgtggttattcataagaagcacacctgtaaaattaatgagattaaaaagctgctgaagaaagctgcttcaaggactagaccttatctatttaaaggagatcacaaatttcctacaaacaaagagaacttaccagtggtgattctctatgccgaaatgggtactagaacatttagtgcatttcacaaagtattgtctgaaaaagctcaaaatgaggaaattctgtatgttcttcgccattatattcagaaaccaagctcacggaaaatgtacttatctgggtatggtgtggagctagcaattaagagtacagaatacaaagcactggatgatacccaagttaaaactgtgactaatactactgtagaggatgagactgaaacaaatgaagttcaaggatttctctttgggaaactaaaatcttagttttcaagcagcttctcaaataatgtccgctccagtttatgattccattaaattaatgaaagacatttcacagaacttccccataaaagccagatctctaaccagaattgctgtaaatcaacatatgagagaagaaataaaggaaaatcaaaagtatattccagaatttcttccgaggtagtatggttttcttcataggataaagaataaaggctgtgagttaatt

SEQ ID NO: 33754 - DNA, 1945 bp, Homo sapiens
gggactcgcgcttttctctccgtgccatggcgccagcgaaagccacgaacgtggtgcggctgctactaggctccacagcgctgtggctttcgcagctcggctccgggacggtcgccgcgtccaagtcggtgactgcccacttggccgcgaagtggcccgagaccccgctgctgctggaggcaagtgaatttatggcagaagaaagtaatgaaaaattttggcagtttttggaaactgtgcaagaattagcaatttataagcaaacagaatcagattattcttattacaacttaatcctgaagaaagctggacagtttctagacaatttacacatcaaccttttaaagtttgctttctctataagggcatactccccagctattcagatgtttcagcagattgcagctgatgagccaccaccagatggttgtaatgcatttgtggttattcataagaagcacacctgtaaaattaatgagattaaaaagctgctgaagaaagctgcttcaaggactagaccttatctatttaaaggagatcacaaatttcctacaaacaaagagaacttaccagtggtgattctctatgccgaaatgggtactagaacatttagtgcatttcacaaagtattgtctgaaaaagctcaaaatgaggaaattctgtatgttcttcgccattatattcagaaaccaagctcacggaaaatgtacttatctgggtatggtgtggagctagcaattaagagtacagaatacaaagcactggatgatacccaagttaaagtgttccaagatccagaggcttttttttaagtcagttttctcaagtcagatgttaacaataaaagtatgggaacatttatcttccattaataagtttgttaaataatatagtgcacttatttttaatgacgttaaattatatagttttatttatacttgtgatttcatatttgttagcattttaatatttctcattaataagtatgttatagaagtagtatttagacatcttgcctattagtttataacaatttataggaagctttacctttttaatgttatttttttctctaaaacaaaactactttctcttgaacatattgtttgattttgtgtgtgtgtttttaggaagtaattcctcacatggctaaagagtatggattccgatatgaactagttcaatataggtggccccgttggcttcgtcaacagactgaaagacagaggattatttggggttacaaaattcttttccttgatgttcttttcccactagcagtggacaaaatcatttttgttgatgctgaccagattgtgagacatgatctaaaagaacttcgagatttcgatctggatggagctccttatgggtatactccattttgtgatagccgcagggaaatggatggatatcgtttctggaaaacaggatactgggcatcacatcttttaagacggaaataccatatcagtgctttatatgtagtggatctcaagaagttcaggagaattggagcaggtgacaggctcaggagccagtatcaagctctcagtcaagatccaaacagtctttcaaacctagatcaggatctccccaataatatgatttaccaagtcgccattaagtctcttcctcaagactggctgtggtgtgaaacctggtgtgatgatgaatccaaacaaagagccaaaacaattgatctgtgcaataatcccaaaacaaaagaatccaaactaaaagctgctgccagaattgtcccagaatgggtggagtatgatgctgagataagacaactattagatcatcttgaaaacaagaagcaagatacaattttgacacatgatgaactctagcactggtgtatatgagaaggaaggcgaaagcatgacaggaaacctgccgcctgctggggaagtctggagcccctgctgagacgatttgg

SEQ ID NO: 33755 - DNA, 4832 bp, Homo sapiens
gccggccgaagcgtggcggccacagactgtgggtaccgggtccgagggactcgcgcttttctctccgtgccatggcgccagcgaaagccacgaacgtggtgcggctgctactaggctccacagcgctgtggctttcgcagctcggctccgggacggtcgccgcgtccaagtcggtgactgcccacttggccgcgaagtggcccgagaccccgctgctgctggaggcaagtgaatttatggcagaagaaagtaatgaaaaattttggcagtttttggaaactgtgcaagaattagcaatttataagcaaacagaatcagattattcttattacaacttaatcctgaagaaagctggacagtttctagacaatttacacatcaaccttttaaagtttgctttctctataagggcatactccccagctattcagatgtttcagcagattgcagctgatgagccaccaccagatggttgtaatgcatttgtggttattcataagaagcacacctgtaaaattaatgagattaaaaagctgctgaagaaagctgcttcaaggactagaccttatctatttaaaggagatcacaaatttcctacaaacaaagagaacttaccagtggtgattctctatgccgaaatgggtactagaacatttagtgcatttcacaaagtattgtctgaaaaagctcaaaatgaggaaattctgtatgttcttcgccattatattcagaaaccaagctcacggaaaatgtacttatctgggtatggtgtggagctagcaattaagagtacagaatacaaagcactggatgatacccaagttaaaactgtgactaatactactgtagaggatgagactgaaacaaatgaagttcaaggatttctctttgggaaactaaaagaaatatattcagatcttagagataatctgacagcattccaaaaatacctgattgagagtaacaaacaaatgatgcctttgaaagtctgggaactacaagatcttagttttcaagcagcttctcaaataatgtccgctccagtttatgattccattaaattaatgaaagacatttcacagaacttccccataaaagccagatctctaaccagaattgctgtaaatcaacatatgagagaagaaataaaggaaaatcaaaaggatcttcaagttagatttaaaattcagccaggcgatgctcgtctatttataaatggccttcgtgttgatatggatgtttatgacgcttttagtattttggatatgctgaaattagaaggaaaaatgatgaatggccttcgcaatcttgggatcaatggggaagatatgagcaaatttttaaaattaaattcacacatttgggaatatacttatgtattagatattcgacattcttctataatgtggattaatgacttagaaaatgatgatttgtatattacatggcctacaagttgccagaaacttctgaagccagtatttcctggaagtgtaccttccataaggcgcaattttcataatttggttctgtttattgatccggcccaagaatataccttggattttataaaacttgctgatgttttctattctcacgaagttcctcttagaattggttttgtgttcattcttaatacagatgatgaagttgatggagcaaatgatgctggagttgctctctggcgagctttcaactatattgcagaagaatttgatatatcagaagcatttatttctatagtacacatgtaccaaaaagtgaagaaggatcaaaatatactcactgtggacaatgtgaagagtgttctccaaaatacatttcctcatgctaatatttgggatattttgggaattcattctaaatatgatgaagaaagaaaggctggagcaagcttttataagatgactggcctgggtcctttgcctcaagctctttataatggtgaaccctttaaacatgaagagatgaatattaaagaactaaaaatggctgttcttcaaagaatgatggatgcatctgtatatttacaaagagaagtttttttgggcacattaaatgatcgcacgaatgcaattgattttctaatggataggaataatgttgtaccccgtataaatactttgattttgcgtactaaccagcagtacctcaatttaatatctacatcagtaactgctgatgttgaagatttctctactttctttttcttggattcacaagataagagtgctgtaattgcaaagaacatgtattatttaacccaagacgatgagagtataatttctgcagtcactctctggattattgcagattttgataagccttctgggagaaaacttctttttaatgcattaaagcacatgaaaacaagtgttcatagtcggttggggattatttataatcctacatcaaaaataaatgaagagaacacagctatttctagaggaattttggcagcttttcttacacagaagaacatgtttttgagaagctttcttgggcaactggcaaaggaagaaattgctacagctatttactctggagataaaattaaaacattccttattgaggggatggataagaatgcttttgagaaaaaatataatactgttggagtgaatatttttcgaactcaccagttgttctgtcaagatgtacttaaattacgtcctggagaaatgggtattgtcagcaatgggagattcttaggacctttagatgaagatttttatgcagaagatttttacttgttggaaaagataacatttagtaatttaggagagaaaattaaaggcattgttgaaaatatgggaatcaacgcaaataacatgagtgactttattatgaaagttgatgcccttatgtcctctgtgcctaagcgtgcatctcgatatgatgtcacatttcttagggagaatcacagtgttataaagacgaatcctcaagagaatgatatgttcttcaatgtcattgctattgttgatccattaacaagagaagcacagaaaatggcacagttgttggttgtacttggcaagattatcaacatgaagataaagttgttcatgaactgtaggggcaggctttcagaagcccctttagaaagcttttaccgttttgttctggaaccagaactgatgtcaggggctaatgacgtttcttctcttggaccagtggcaaaatttttggatattcctgaatcacccctcctaatcctcaacatgattactccagaaggctggttggttgaaacagtgcacagcaactgtgaccttgataatattcacttaaaggatactgagaaaactgttacagcagaatatgaactagaatacttactactggaaggacaatgctttgataaagtgacagaacagcctcctcggggtctgcagttcacactaggcacaaaaaataaacctgctgtggttgatacaatagtgatggcacatcatgggtattttcaattaaaagcaaacccaggtgcttggatactgaggttacaccaaggaaaatctgaagatatttatcaaatagttgggcatgaaggaactgactctcaagcagacctagaagatatcattgttgtattaaacagcttcaaaagcaagatactcaaagtaaaagtgaaaaaagaaacagacaaaattaaggaagatatccttaccgatgaagatgaaaaaacaaaaggactgtgggattccattaaaagtttcacagtaagcttgcataaagaaaacaaaaaggaaaaagatgtcctaaacattttttcagttgcttctggtcatttatatgaacgttttttaagaattatgatgctttctgttttgcgtaacaccaaaacaccagtgaaattctggttgctaaaaaattatctctcaccgacatttaaagaagtaattcctcacatggctaaagagtatggattccgatatgaactagttcaatataggtggccccgttggcttcgtcaacagactgaaagacagaggattatttggggttacaaaattcttttccttgatgttcttttcccactagcagtggacaaaatcatttttgttgatgctgaccagattgtgagacatgatctaaaagaacttcgagatttcgatctggatggagctccttatgggtatactccattttgtgatagccgcagggaaatggatggatatcgtttctggaaaacaggatactgggcatcacatcttttaagacggaaataccatatcagtgctttatatgtagtggatctcaagaagttcaggagaattggagcaggtgacaggctcaggagccagtatcaagctctcagtcaagatccaaacagtctttcaaacctagatcaggatctccccaataatatgatttaccaagtcgccattaagtctcttcctcaagactggctgtggtgtgaaacctggtgtgatgatgaatccaaacaaagagccaaaacaattgatctgtgcaataatcccaaaacaaaagaatccaaactaaaagctgctgccagaattgtcccagaatgggtggagtatgatgctgagataagacaactattagatcatcttgaaaacaagaagcaagatacaattttgacacatgatgaactctagcactggtgtatatgagaaggaaggcgaaagcatgacaggaaacctgccgcctgctggggaagtctggagcccctgctgagacgatttggaagtctcgttaagatcagtgacatattctttaattttaaaaaattgtaattatttaaaacagttatttaatgtattgaatgagtttaagttatataataaatgaccattgagtatttaaaa

SEQ ID NO: 33756 - DNA, 1547 bp, Homo sapiens
gccgcgcagcgggaagagccggccgaagcgtggcggccacagactgtgggtaccgggtccgagggactcgcgcttttctctccgtgccatggcgccagcgaaagccacgaacgtggtgcggctgctactaggctccacagcgctgtggctttcgcagctcggctccgggacggtcgccgcgtccaagtcggtgactgcccacttggccgcgaagtggcccgagaccccgctgctgctggaggcaagtgaatttatggcagaagaaagtaatgaaaaattttggcagtttttggaaactgtgcaagaattagcaatttataagcaaacagaatcagattattcttattacaacttaatcctgaagaaagctggacagtttctagacaatttacacatcaaccttttaaagtttgctttctctataagggcatactccccagctattcagatgtttcagcagattgcagctgatgagccaccaccagatggttgtaatgcatttgtggttattcataagaagcacacctgtaaaattaatgagattaaaaagctgctgaagaaagctgcttcaaggactagaccttatctatttaaaggagatcacaaatttcctacaaacaaagagaacttaccagtggtgattctctatgccgaaatgggtactagaacatttagtgcatttcacaaagtattgtctgaaaaagctcaaaatgaggaaattctgtatgttcttcgccattatattcagaaaccaagctcacggaaaatgtacttatctgggtatggtgtggagctagcaattaagagtacagaatacaaagcactggatgatacccaagttaaaactgtgactaatactactgtagaggatgagactgaaacaaatgaagttcaaggatttctctttgggaaactaaaagaaatatattcagatcttagagataatctgacagcattccaaaaatacctgattgagagtaacaaacaaatgatgcctttgaaagtctgggaactacaagatcttagttttcaagcagcttctcaaataatgtccgctccagtttatgattccattaaattaatgaaagacatttcacagaacttccccataaaagccagattaagaatgaatatattgatatgcctctttcagtcaactttaaatgtcaagaatttgagaagtcgtcatttatataataaaacatgaaatatatatgggtgtgtataaatgtcatatctgtttagccataatattttaattaatggccgttataaaaattattagatcaaatacaaataaagtaaaataactttagtcttgatcagacagttgattagctctattgatgctaagtcagtataactgttcagaggttctgatgcaaaactctgctgttaatctgtaattaagaaaaaattataaaatatgctaacattgcttaatggctaaattgtaggcttgagcatatctctaaaaccacttggtagacaatctgtaaatgtttgttgaaatgaaatatttgctaaataaatgaaaaatttgcctt

SEQ ID NO: 33757 - DNA, 2338 bp, Homo sapiens
ggttttcgggggaggcgtttggggcctggacggcggcgcggggagggggcagctaggggcgcggcctgccagtgcctcctgcagtacagccctggagggcgtggggacttgggggcggtgaaatagccgctgtaggtccgcctctttcattgaagaaatttaagttcgtgtggttttaccttttccgggagtctccagctggccctcatttgtgtccggagctcaggagttcccaaaccgactcagtcgcaccaagtttccgtcttttggaattggggaaggagtttctttctttcttttcttttttcttgagccagttttaatcgctttgaataaatactcccttaagtagttaaatataggaggagaaagaatacatcggttgttaaagcaggagaggaagagagacctgccctgtagcgtgactcctctagaaaaaaaaaaaaaaagccggagtattttactaagcccctaaaatgtcgagatttgtacaagatcttagcaaagcaatgtctcaagatggtgcttctcagttccaagaagtcattcggcaagagctagaattatctgtgaagaaggaactagaaaaaatactcaccacagcatcatcacatgaatttgagcacaccaaaaaagacctggatggatttcggaagctatttcatagatttttgcaagaaaaggggccttctgtggattggggaaaaatccagagaccccctgaagattcgattcaaccctatgaaaagataaaggccaggggcttgcctgataatatatcttccgtgttgaacaaactagtggtggtgaaactcaatggtggtttgggaaccagcatgggctgcaaaggccctaaaagtctgattggtgtgaggaatgagaatacctttctggatctgactgttcagcaaattgaacatttgaataaaacctacaatacagatgttcctcttgttttaatgaactcttttaacacggatgaagataccaaaaaaatactacagaagtacaatcattgtcgtgtgaaaatctacactttcaatcaaagcaggtacccgaggattaataaagaatctttacttcctgtagcaaaggacgtgtcttactcaggggaaaatacagaagcttggtaccctccaggtcatggtgatatttacgccagtttctacaactctggattgcttgatacctttataggagaaggcaaagagtatatttttgtgtctaacatagataatctgggtgccacagtggatctgtatattcttaatcatctaatgaacccacccaatggaaaacgctgtgaatttgtcatggaagtcacaaataaaacacgtgcagatgtaaagggcgggacactcactcaatatgaaggcaaactgagactggtggaaattgctcaagtgccaaaagcacatgtagacgagttcaagtctgtatcaaagttcaaaatatttaatacaaacaacctatggatttctcttgcagcagttaaaagactgcaggagcaaaatgccattgacatggaaatcattgtgaatgcaaagactttggatggaggcctgaatgtcattcaattagaaactgcagtaggggctgccatcaaaagttttgagaattctctaggtattaatgtgccaaggagccgttttctgcctgtcaaaaccacatcagatctcttgctggtgatgtcaaacctctatagtcttaatgcaggatctctgacaatgagtgaaaagcgggaatttcctacagtgcccttggttaaattaggcagttcttttacgaaggttcaagattatctaagaagatttgaaagtataccagatatgcttgaattggatcacctcacagtttcaggagatgtgacatttggaaaaaatgtttcattaaagggaacggttatcatcattgcaaatcatggtgacagaattgatatcccacctggagcagtattagagaacaagattgtgtctggaaaccttcgcatcttggaccactgaaatgaaaaatactgtggacacttaaataatgggctagtttcttacaatgaaatgttctctaggattctaaaataggcaggtactttactatgttactgtaccctgcagtgttgatttttaaaatagagttttctgcagtatgcttttagtctaagaaaagcacagatggagcaatactttccttctttgaagagaatcccaaaagttagttcatcttaaagtgcaatattgtttaatcttaaaactgggcaactttggaagaacttttaacagaagcctcaatgatgatcactttgaattgcttgtgatttcaaaaataaagcagtgaagcaata

SEQ ID NO: 33758 - DNA, 2136 bp, Homo sapiens
ctgtcggtccgtgcggcagggacatttccgcattgaaggggctgctccgaatggagggggaggggaggtgtttaggagaaagtaggggctgtgggtgtcgggagccggctgacgggtggacaagggggggttagcagctgggctgcgaccgttagggaggggctcaaggtgtgcatgtgtgagggaagagagagagagagaagggcgcctcagaggtgactttcagcctgcgagccttcttcccggggcgccataaacgcccccaatttcccagctgctaaaggaagaggaagatcttagcaaagcaatgtctcaagatggtgcttctcagttccaagaagtcattcggcaagagctagaattatctgtgaagaaggaactagaaaaaatactcaccacagcatcatcacatgaatttgagcacaccaaaaaagacctggatggatttcggaagctatttcatagatttttgcaagaaaaggggccttctgtggattggggaaaaatccagagaccccctgaagattcgattcaaccctatgaaaagataaaggccaggggcttgcctgataatatatcttccgtgttgaacaaactagtggtggtgaaactcaatggtggtttgggaaccagcatgggctgcaaaggccctaaaagtctgattggtgtgaggaatgagaatacctttctggatctgactgttcagcaaattgaacatttgaataaaacctacaatacagatgttcctcttgttttaatgaactcttttaacacggatgaagataccaaaaaaatactacagaagtacaatcattgtcgtgtgaaaatctacactttcaatcaaagcaggtacccgaggattaataaagaatctttacttcctgtagcaaaggacgtgtcttactcaggggaaaatacagaagcttggtaccctccaggtcatggtgatatttacgccagtttctacaactctggattgcttgatacctttataggagaaggcaaagagtatatttttgtgtctaacatagataatctgggtgccacagtggatctgtatattcttaatcatctaatgaacccacccaatggaaaacgctgtgaatttgtcatggaagtcacaaataaaacacgtgcagatgtaaagggcgggacactcactcaatatgaaggcaaactgagactggtggaaattgctcaagtgccaaaagcacatgtagacgagttcaagtctgtatcaaagttcaaaatatttaatacaaacaacctatggatttctcttgcagcagttaaaagactgcaggagcaaaatgccattgacatggaaatcattgtgaatgcaaagactttggatggaggcctgaatgtcattcaattagaaactgcagtaggggctgccatcaaaagttttgagaattctctaggtattaatgtgccaaggagccgttttctgcctgtcaaaaccacatcagatctcttgctggtgatgtcaaacctctatagtcttaatgcaggatctctgacaatgagtgaaaagcgggaatttcctacagtgcccttggttaaattaggcagttcttttacgaaggttcaagattatctaagaagatttgaaagtataccagatatgcttgaattggatcacctcacagtttcaggagatgtgacatttggaaaaaatgtttcattaaagggaacggttatcatcattgcaaatcatggtgacagaattgatatcccacctggagcagtattagagaacaagattgtgtctggaaaccttcgcatcttggaccactgaaatgaaaaatactgtggacacttaaataatgggctagtttcttacaatgaaatgttctctaggattctaaaataggcaggtactttactatgttactgtaccctgcagtgttgatttttaaaatagagttttctgcagtatgcttttagtctaagaaaagcacagatggagcaatactttccttctttgaagagaatcccaaaagttagttcatcttaaagtgcaatattgtttaatcttaaaactgggcaactttggaagaacttttaacagaagcctcaatgatgatcactttgaattgcttgtgatttcaaaaataaagcagtgaagcaata

SEQ ID NO: 33759 - DNA, 1955 bp, Homo sapiens
cttttcgttgaattgtcatctgagctgccttgagctgctgggttgacgttccagacgcgtataatttatgctcctgtaccctgctgggtttagttttgcctccctgaaatcagatcttagcaaagcaatgtctcaagatggtgcttctcagttccaagaagtcattcggcaagagctagaattatctgtgaagaaggaactagaaaaaatactcaccacagcatcatcacatgaatttgagcacaccaaaaaagacctggatggatttcggaagctatttcatagatttttgcaagaaaaggggccttctgtggattggggaaaaatccagagaccccctgaagattcgattcaaccctatgaaaagataaaggccaggggcttgcctgataatatatcttccgtgttgaacaaactagtggtggtgaaactcaatggtggtttgggaaccagcatgggctgcaaaggccctaaaagtctgattggtgtgaggaatgagaatacctttctggatctgactgttcagcaaattgaacatttgaataaaacctacaatacagatgttcctcttgttttaatgaactcttttaacacggatgaagataccaaaaaaatactacagaagtacaatcattgtcgtgtgaaaatctacactttcaatcaaagcaggtacccgaggattaataaagaatctttacttcctgtagcaaaggacgtgtcttactcaggggaaaatacagaagcttggtaccctccaggtcatggtgatatttacgccagtttctacaactctggattgcttgatacctttataggagaaggcaaagagtatatttttgtgtctaacatagataatctgggtgccacagtggatctgtatattcttaatcatctaatgaacccacccaatggaaaacgctgtgaatttgtcatggaagtcacaaataaaacacgtgcagatgtaaagggcgggacactcactcaatatgaaggcaaactgagactggtggaaattgctcaagtgccaaaagcacatgtagacgagttcaagtctgtatcaaagttcaaaatatttaatacaaacaacctatggatttctcttgcagcagttaaaagactgcaggagcaaaatgccattgacatggaaatcattgtgaatgcaaagactttggatggaggcctgaatgtcattcaattagaaactgcagtaggggctgccatcaaaagttttgagaattctctaggtattaatgtgccaaggagccgttttctgcctgtcaaaaccacatcagatctcttgctggtgatgtcaaacctctatagtcttaatgcaggatctctgacaatgagtgaaaagcgggaatttcctacagtgcccttggttaaattaggcagttcttttacgaaggttcaagattatctaagaagatttgaaagtataccagatatgcttgaattggatcacctcacagtttcaggagatgtgacatttggaaaaaatgtttcattaaagggaacggttatcatcattgcaaatcatggtgacagaattgatatcccacctggagcagtattagagaacaagattgtgtctggaaaccttcgcatcttggaccactgaaatgaaaaatactgtggacacttaaataatgggctagtttcttacaatgaaatgttctctaggattctaaaataggcaggtactttactatgttactgtaccctgcagtgttgatttttaaaatagagttttctgcagtatgcttttagtctaagaaaagcacagatggagcaatactttccttctttgaagagaatcccaaaagttagttcatcttaaagtgcaatattgtttaatcttaaaactgggcaactttggaagaacttttaacagaagcctcaatgatgatcactttgaattgcttgtgatttcaaaaataaagcagtgaagcaat

SEQ ID NO: 33760 - DNA, 2057 bp, Homo sapiens
gcattgaaggggctgctccgaatggagggggaggggaggtgtttaggagaaagtaggggctgtgggtgtcgggagccggctgacgggtggacaagggggggttagcagctgggctgcgaccgttagggaggggctcaaggtgtgcatgtgtgagggaagagagagagagagaagggcgcctcagaggtgactttcagcctgcgagccttcttcccggggcgccataaacgcccccaatttcccagctgctaaaggaagaggaaggtacctgtgcgtgcacgcagacgggaagggctggggaagcgggaggactgagaaaagccggatcttagcaaagcaatgtctcaagatggtgcttctcagttccaagaagtcattcggcaagagctagaattatctgtgaagaaggaactagaaaaaatactcaccacagcatcatcacatgaatttgagcacaccaaaaaagacctggatggatttcggaagctatttcatagatttttgcaagaaaaggggccttctgtggattggggaaaaatccagagaccccctgaagattcgattcaaccctatgaaaagataaaggccaggggcttgcctgataatatatcttccgtgttgaacaaactagtggtggtgaaactcaatggtggtttgggaaccagcatgggctgcaaaggccctaaaagtctgattggtgtgaggaatgagaatacctttctggatctgactgttcagcaaattgaacatttgaataaaacctacaatacagatgttcctcttgttttaatgaactcttttaacacggatgaagataccaaaaaaatactacagaagtacaatcattgtcgtgtgaaaatctacactttcaatcaaagcaggtacccgaggattaataaagaatctttacttcctgtagcaaaggacgtgtcttactcaggggaaaatacagaagcttggtaccctccaggtcatggtgatatttacgccagtttctacaactctggattgcttgatacctttataggagaaggcaaagagtatatttttgtgtctaacatagataatctgggtgccacagtggatctgtatattcttaatcatctaatgaacccacccaatggaaaacgctgtgaatttgtcatggaagtcacaaataaaacacgtgcagatgtaaagggcgggacactcactcaatatgaaggcaaactgagactggtggaaattgctcaagtgccaaaagcacatgtagacgagttcaagtctgtatcaaagttcaaaatatttaatacaaacaacctatggatttctcttgcagcagttaaaagactgcaggagcaaaatgccattgacatggaaatcattgtgaatgcaaagactttggatggaggcctgaatgtcattcaattagaaactgcagtaggggctgccatcaaaagttttgagaattctctaggtattaatgtgccaaggagccgttttctgcctgtcaaaaccacatcagatctcttgctggtgatgtcaaacctctatagtcttaatgcaggatctctgacaatgagtgaaaagcgggaatttcctacagtgcccttggttaaattaggcagttcttttacgaaggttcaagattatctaagaagatttgaaagtataccagatatgcttgaattggatcacctcacagtttcaggagatgtgacatttggaaaaaatgtttcattaaagggaacggttatcatcattgcaaatcatggtgacagaattgatatcccacctggagcagtattagagaacaagattgtgtctggaaaccttcgcatcttggaccactgaaatgaaaaatactgtggacacttaaataatgggctagtttcttacaatgaaatgttctctaggattctaaaataggcaggtactttactatgttactgtaccctgcagtgttgatttttaaaatagagttttctgcagtatgcttttagtctaagaaaagcacagatggagcaatactttccttctttgaagagaatcccaaaagttagttcatcttaaagtgc

SEQ ID NO: 33761 - DNA, 558 bp, Homo sapiens
atttctcgagtttgatcctgtgtctgggattttttcaagtctgcctctgaaacttagacctgtgttgacagagagcacatgcaatattaaatatcttagcaaagcaatgtctcaagatggtgcttctcagttccaagaagtcattcggcaagagctagaattatctgtgaagaaggaactagaaaaaatactcaccacagcatcatcacatgaatttgagcacaccaaaaaagacctggatggatttcggaagctatttcatagatttttgcaagaaaaggggccttctgtggattggggaaaaatccagagaccccctgaagattcgattcaaccctatgaaaagataaaggccaggggcttgcctgataatatatcttccgtgttgaacaaactagtggtggtgaaactcaatggtggtttgggaaccagcatgggctgcaaaggccctaaaagtctgattggtgtgaggaatgagaatacctttctggatctgactgttcagcaaattgaacatttgaataaaacctacaatacagatgttcctcttgttttaat

SEQ ID NO: 33762 - DNA, 560 bp, Homo sapiens
gttagtagtaccgtcgctttcctggatagtggctatcttagcaaagcaatgtctcaagatggtgcttctcagttccaagaagtcattcggcaagagctagaattatctgtgaagaaggaactagaaaaaatactcaccacagcatcatcacatgaatttgagcacaccaaaaaagacctggatggatttcggaagctatttcatagatttttgcaagaaaaggggccttctgtggattggggaaaaatccagagaccccctgaagattcgattcaaccctatgaaaagataaaggccaggggcttgcctgataatatatcttccgtgttgaacaaactagtggtggtgaaactcaatggtggtttgggaaccagcatgggctgcaaaggccctaaaagtctgattggtgtgaggaatgagaatacctttctggatctgactgttcagcaaattgaacatttgaataaaacctacaatacagatgttcctcttgttttaatgaactcttttaacacggatgaagataccaaaaaaatactacagaagtacaatcattgtcg

SEQ ID NO: 33763 - DNA, 505 bp, Homo sapiens
agggggaggggaggtgtttaggagaaagtaggggctgtgggtgtcgggagccggctgacgggtggacaagggggggttagcagctgggctgcgaccgttagggaggggctcaaggtgtgcatgtgtgagggaagagagagagagagaagggcgcctcagaggtgactttcagcctgcgagccttcttcccggggcgccataaacgcccccaatttcccagctgctaaaggaagaggaaggtacctgtgcgtgcacgcagacgggaagggctggggaagcgggaggactgagaaaagccgggatctgcctctgtcacccaggctggagtgcggtggcgcgatctcgcctcactgcagcctctgcctcctcggctcaagatcttagcaaagcaatgtctcaagatggtgcttctcagttccaagaagtcattcggcaagagctagaattatctgtgaagaaggaactagaaaaaatactcaccacagcatcatcacatgaatttgag

SEQ ID NO: 33764 - DNA, 645 bp, Homo sapiens
gcattgaaggggctgctccgaatggagggggaggggaggtgtttaggagaaagtaggggctgtgggtgtcgggagccggctgacgggtggacaagggggggttagcagctgggctgcgaccgttagggaggggctcaaggtgtgcatgtgtgagggaagagagagagagagaagggcgcctcagaggtgactttcagcctgcgagccttcttcccggggcgccataaacgcccccaatttcccagctgctaaaggaagaggaagtctgcctctgaaacttagacctgtgttgacagagagcacatgcaatattaaatatcttagcaaagcaatgtctcaagatggtgcttctcagttccaagaagtcattcggcaagagctagaattatctgtgaagaaggaactagaaaaaatactcaccacagcatcatcacatgaatttgagcacaccaaaaaagacctggatggatttcggaagctatttcatagatttttgcaagaaaaggggccttctgtggattggggaaaaatccagagaccccctgaagattcgattcaaccctatgaaaagataaaggccaggggcttgcctgataatatatcttccgtgttgaacaaactagtggtggtgaaactcaatggtgg

SEQ ID NO: 33765 - DNA, 553 bp, Homo sapiens
ggcagggacatttccgcattgaaggggctgctccgaatggagggggaggggaggtgtttaggagaaagtaggggctgtgggtgtcgggagccggctgacgggtggacaagggggggttagcagctgggctgcgaccgttagggaggggctcaaggtgtgcatgtgtgagggaagagagagagagagaagggcgcctcagaggtgactttcagcctgcgagccttcttcccggggcgccataaacgcccccaatttcccagctgctaaaggaagaggaagtagttaaatataggaggagaaagaatacatcggttgttaaagcaggagaggaagagagacctgccctgtagcgtgactcctctagaaaaaaaaaaaaaaagccggagtattttactaagcccctaaaatgtcgagatttgtacaagatcttagcaaagcaatgtctcaagatggtgcttctcagttccaagaagtcattcggcaagagctagaattatctgtgaagaaggaactagaaaaaatactcaccacagcatcatcacatgaatttgag

SEQ ID NO: 33766 - DNA, 784 bp, Homo sapiens
ctccagctggccctcatttgtgtccggagctcaggagttcccaaaccgactcagtcgcaccaagtttccgtcttttggaattggggaaggagtttctttctttcttttcttttttcttgagccagttttaatcgctttgaataaatactcccttaagtagttaaatataggaggagaaagaatacatcggttgttaaagcaggagaggaagagagacctgccctgtagcgtgactcctctagaaaaaaaaaaaaaaagccggagtattttactaagcccctaaaatgtcgagatttgtacaaggtacctgtgcgtgcacgcagacgggaagggctggggaagcgggaggactgagaaaagccggatcttagcaaagcaatgtctcaagatggtgcttctcagttccaagaagtcattcggcaagagctagaattatctgtgaagaaggaactagaaaaaatactcaccacagcatcatcacatgaatttgagcacaccaaaaaagacctggatggatttcggaagctatttcatagatttttgcaagaaaaggggccttctgtggattggggaaaaatccagagaccccctgaagattcgattcaaccctatgaaaagataaaggccaggggcttgcctgataatatatcttccgtgttgaacaaactagtggtggtgaaactcaatggtggtttgggaaccagcatgggctgcaaaggccctaaaagtctgattggtgtgaggaatgagaatacctttctggatctgactgttcagcaaattg

SEQ ID NO: 33767 - DNA, 753 bp, Homo sapiens
gctattctgctgttgggtcaccttctgcctacttgtgacattccttctgctcttccttgctccagggattgttccagggcccccagttattctaaatggatatcttagcaaagcaatgtctcaagatggtgcttctcagttccaagaagtcattcggcaagagctagaattatctgtgaagaaggaactagaaaaaatactcaccacagcatcatcacatgaatttgagcacaccaaaaaagacctggatggatttcggaagctatttcatagatttttgcaagaaaaggggccttctgtggattggggaaaaatccagagaccccctgaagattcgattcaaccctatgaaaagataaaggccaggggcttgcctgataatatatcttccgtgttgaacaaactagtggtggtgaaactcaatggtggtttgggaaccagcatgggctgcaaaggccctaaaagtctgattggtgtgaggaatgagaatacctttctggatctgactgttcagcaaattgaacatttgaataaaacctacaatacagatgttcctcttgttttaatgaactcttttaacacggatgaagataccaaaaaaatactacagaagtacaatcattgtcgtgtgaaaatctacactttcaatcaaagcaggtacccgaggattaataaagaatctttacttcctgtagcaaaggacgtgtcttactcaggggaaaatacagaagcttggtaccctccaggtcatgg

SEQ ID NO: 33768 - DNA, 2099 bp, Homo sapiens
ggcggggctctcggggccgctgccgccgccgccgccgcgcattgtgcagcaggcgggcccccgcgcggtagggccctggacccgcgcggctcccggggatggtgagcaaggcgctgctgcgcctcgtgtctgccgtcaaccgcaggaggatgaagctgctgctgggcatcgccttgctggcctacgtcgcctctgtttggggcaacttcgttaatatgagctttctactcaacaggtctatccaggaaaatggtgaactaaaaattgaaagcaagattgaagagatggttgaaccactaagagagaaaatcagagatttagaaaaaagctttacccagaaatacccaccagtaaagtttttatcagaaaaggatcggaaaagaattttgataacaggaggcgcagggttcgtgggctcccatctaactgacaaactcatgatggacggccacgaggtgaccgtggtggacaatttcttcacgggcaggaagagaaacgtggagcactggatcggacatgagaacttcgagttgattaaccacgacgtggtggagcccctctacatcgaggttgaccagatataccatctggcatctccagcctcccctccaaactacatgtataatcctatcaagacattaaagaccaatacgattgggacattaaacatgttggggctggcaaaacgagtcggtgcccgtctgctcctggcctccacatcggaggtgtatggagatcctgaagtccaccctcaaagtgaggattactggggccacgtgaatccaataggacctcgggcctgctacgatgaaggcaaacgtgttgcagagaccatgtgctatgcctacatgaagcaggaaggcgtggaagtgcgagtggccagaatcttcaacacctttgggccacgcatgcacatgaacgatgggcgagtagtcagcaacttcatcctgcaggcgctccagggggagccactcacggtatacggatccgggtctcagacaagggcgttccagtacgtcagcgatctagtgaatggcctcgtggctctcatgaacagcaacgtcagcagcccggtcaacctggggaacccagaagaacacacaatcctagaatttgctcagttaattaaaaaccttgttggtagcggaagtgaaattcagtttctctccgaagcccaggatgacccacagaaaagaaaaccagacatcaaaaaagcaaagctgatgctggggtgggagcccgtggtcccgctggaggaaggtttaaacaaagcaattcactacttccgtaaagaactcgagtaccaggcaaataatcagtacatccccaaaccaaagcctgccagaataaagaaaggacggactcgccacagctgaactcctcacttttaggacacaagactaccattgtacacttgatgggatgtatttttggcttttttttgttgtcgtttaaagaaagactttaacaggtgtcatgaagaacaaactggaatttcattctgaagcttgctttaatgaaatggatgtgcctaaaagctcccctcaaaaaactgcagattttgccttgcactttttgaatctctctttttatgtaaaatagcgtagatgcatctctgcgtattttcaagtttttttatcttgctgtgagagcatatgttgtgactgtcgttgacagttttatttactggtttctttgtgaagctgaaaaggaacattaagcgggacaaaaaatgccgattttatttatgaaagtgggtacttaataaatgagtcgttatactatgcataaagaaaaatcctagcagtattgtcaggtggtggtgcgccggcattgattttagggcagataaaagaattctgtgtgagagctttatgtttctcttttaattcagagtttttccaaggtctacttttgagttgcaaacttgactttgaaatattcctgttggtcatgatcaaggatatttgaaatcactactgtgttttgctgcgtatctggggcgggggcaggttggggggcacaaagttaacatattcttggttaaccatggttaaatatgctattttaataaattattgaaactcaccagtcatgga

SEQ ID NO: 33769 - DNA, 1935 bp, Homo sapiens
aggataggaactggagttattgttaatgttacaggaagaacacattctcaaaggagaggggggtggtgggaaactttgattttcatagggttttcagtttcctctcaaatgggaggatgcagcagtgccgctacttaactgaacgtctcgacagtctgatggggcggccctcagccttccggagcagcagtgggactgacctgtccagtgaggaagaaacactgaaccagatggaatggcctttggggatggaaaaaccccagtttacgctcatctcttctctcagctaacttttgtggagccctgttcccaaactggcctgggccagagcaccgtggaggggtatttgttgtaaatggaaggtttccaggcccgcctggaaatcctgaagggtgagacctgcagtgggctcaggagtctgcatttgtgggtgaccgagggggcctcccctccctctagagtccacactgtggagagcatcaggaagggaaaggcctgcatcttgtgctcagtgagctcatcgtctagtgaggaaggcatgtgtgaatctctggacaaggcagcgctgagctgttgtggactagtggtgcaggcaagggattatttctgaccaaggatggtgagaaggtttcccatacagactgacgtctggattgagctttgaagaagaaagccaggactggagcagacgacgaggagggaagagtttgaccagatataccatctggcatctccagcctcccctccaaactacatgtataatcctatcaagacattaaagaccaatacgattgggacattaaacatgttggggctggcaaaacgagtcggtgcccgtctgctcctggcctccacatcggaggtgtatggagatcctgaagtccaccctcaaagtgaggattactggggccacgtgaatccaataggacctcgggcctgctacgatgaaggcaaacgtgttgcagagaccatgtgctatgcctacatgaagcaggaaggcgtggaagtgcgagtggccagaatcttcaacacctttgggccacgcatgcacatgaacgatgggcgagtagtcagcaacttcatcctgcaggcgctccagggggagccactcacggtatacggatccgggtctcagacaagggcgttccagtacgtcagcgatctagtgaatggcctcgtggctctcatgaacagcaacgtcagcagcccggtcaacctggggaacccagaagaacacacaatcctagaatttgctcagttaattaaaaaccttgttggtagcggaagtgaaattcagtttctctccgaagcccaggatgacccacagaaaagaaaaccagacatcaaaaaagcaaagctgatgctggggtgggagcccgtggtcccgctggaggaaggtttaaacaaagcaattcactacttccgtaaagaactcgagtaccaggcaaataatcagtacatccccaaaccaaagcctgccagaataaagaaaggacggactcgccacagctgaactcctcacttttaggacacaagactaccattgtacacttgatgggatgtatttttggcttttttttgttgtcgtttaaagaaagactttaacaggtgtcatgaagaacaaactggaatttcattctgaagcttgctttaatgaaatggatgtgcctaaaagctcccctcaaaaaactgcagattttgccttgcactttttgaatctctctttttatgtaaaatagcgtagatgcatctctgcgtattttcaagtttttttatcttgctgtgagagcatatgttgtgactgtcgttgacagttttatttactggtttctttgtgaagctgaaaaggaacattaagcgggacaaaaaatgccgattttatttatgaaagtgggtacttaataaatgagtcgttatactatgcataaagaaaaa

SEQ ID NO: 33770 - DNA, 1839 bp, Homo sapiens
attgtgcagcaggcgggcccccgcgcggtagggccctggacccgcgcggctcccggggatggtgagcaaggcgctgctgcgcctcgtgtctgccgtcaaccgcaggaggatgaagctgctgctgggcatcgccttgctggcctacgtcgcctctgtttggggcaacttcgttaatatgaggtctatccaggaaaatggtgaactaaaaattgaaagcaagattgaagagatggttgaaccactaagagagaaaatcagagatttagaaaaaagctttacccagaaatacccaccagtaaagtttttatcagaaaaggatcggaaaagaattttgataacaggaggcgcagggttcgtgggctcccatctaactgacaaactcatgatggacggccacgaggtgaccgtggtggacaatttcttcacgggcaggaagagaaacgtggagcactggatcggacatgagaacttcgagttgattaaccacgacgtggtggagcccctctacatcgaggttgaccagatataccatctggcatctccagcctcccctccaaactacatgtataatcctatcaagacattaaagaccaatacgattgggacattaaacatgttggggctggcaaaacgagtcggtgcccgtctgctcctggcctccacatcggaggtgtatggagatcctgaagtccaccctcaaagtgaggattactggggccacgtgaatccaataggacctcgggcctgctacgatgaaggcaaacgtgttgcagagaccatgtgctatgcctacatgaagcaggaaggcgtggaagtgcgagtggccagaatcttcaacacctttgggccacgcatgcacatgaacgatgggcgagtagtcagcaacttcatcctgcaggcgctccagggggagccactcacggtatacggatccgggtctcagacaagggcgttccagtacgtcagcgatctagtgaatggcctcgtggctctcatgaacagcaacgtcagcagcccggtcaacctggggaacccagaagaacacacaatcctagaatttgctcagttaattaaaaaccttgttggtagcggaagtgaaattcagtttctctccgaagcccaggatgacccacagaaaagaaaaccagacatcaaaaaagcaaagctgatgctggggtgggagcccgtggtcccgctggaggaaggtttaaacaaagcaattcactacttccgtaaagaactcgagtaccaggcaaataatcagtacatccccaaaccaaagcctgccagaataaagaaaggacggactcgccacagctgaactcctcacttttaggacacaagactaccattgtacacttgatgggatgtatttttggcttttttttgttgtcgtttaaagaaagactttaacaggtgtcatgaagaacaaactggaatttcattctgaagcttgctttaatgaaatggatgtgcctaaaagctcccctcaaaaaactgcagattttgccttgcactttttgaatctctctttttatgtaaaatagcgtagatgcatctctgcgtattttcaagtttttttatcttgctgtgagagcatatgttgtgactgtcgttgacagttttatttactggtttctttgtgaagctgaaaaggaacattaagcgggacaaaaaatgccgattttatttatgaaagtgggtacttaataaatgagtcgttatactatgcataaagaaaaatcctagcagtattgtcaggtggtggtgcgccggcattgattttagggcagataaaagaattctgtgtgagagctttatgtttctcttttaattcag

SEQ ID NO: 33771 - DNA, 701 bp, Homo sapiens
ttctaagctgacagcttggattaacatttgtttccatggccccggatgcacactccacagtcctgcgcctccgctcctcactgaattggttttctccctgcaccgcgttttcccatatgtagctatattcccattcccgagcggtcttgactctaaaatcatatacacggtagagaaggagccctgaagctttacccagaaatacccaccagtaaagtttttatcagaaaaggatcggaaaagaattttgttgaccagatataccatctggcatctccagcctcccctccaaactacatgtataatcctatcaagacattaaagaccaatacgattgggacattaaacatgttggggctggcaaaacgagtcggtgcccgtctgctcctggcctccacatcggaggtgtatggagatcctgaagtccaccctcaaagtgaggattactggggccacgtgaatccaataggacctcgggcctgctacgatgaaggcaaacgtgttgcagagaccatgtgctatgcctacatgaagcaggaaggcgtggaagtgcgagtggccagaatcttcaacacctttgggccacgcatgcacatgaacgatgggcgagtagtcagcaacttcatcctgcaggcgctccagggggagccactcacggtatacggatccgggtctcagacaagggcgttccagtacgtcag

SEQ ID NO: 33772 - DNA, 966 bp, Homo sapiens
attgtgcagcaggcgggcccccgcgcggtagggccctggacccgcgcggctcccggggatggtgagcaaggcgctgctgcgcctcgtgtctgccgtcaaccgcaggaggatgaagctgctgctgggcatcgccttgctggcctacgtcgcctggctggcaaaacgagtcggtgcccgtctgctcctggcctccacatcggaggtgtatggagatcctgaagtccaccctcaaagtgaggattactggggccacgtgaatccaataggacctcgggcctgctacgatgaaggcaaacgtgttgcagagaccatgtgctatgcctacatgaagcaggaaggcgtggaagtgcgagtggccagaatcttcaacacctttgggccacgcatgcacatgaacgatgggcgagtagtcagcaacttcatcctgcaggcgctccagggggagccactcacggtatacggatccgggtctcagacaagggcgttccagtacgtcagcgatctagtgaatggcctcgtggctctcatgaacagcaacgtcagcagcccggtcaacctggtgagtgctcctctccctccactctgcaggacagctcagactttcgttcatttgtgaaaccatgagcagcaccaggctttgcttcatttgccatcggcacacttaggacatttgtgtttgttgcttgctaaatactagaggaaaaacaaacaaacacaaagtaagagtatacaaagaagtaaaacatctgcaaggcacgggtgagtgatgtaatcagtccctccaccttctgaagggcctgggtctaagattgtgtgaagccttttggtggtagtaggtggacgtgtgtgtgcatctcgttctctatttaacaggcgggtcatcattataaggcctgattgcatttttagaagatggaggttgttcagagggaaaattttccggttgctgatgatgtctgtcattta

SEQ ID NO: 33773 - DNA, 502 bp, Homo sapiens
agtttcctctcaaatgggaggatgcagcagtgccgctacttaactgaacgtctcgacagtctgatggggcggccctcagccttccggagcagcagtgggactgacctgtccagtgaggaagaaacactgaaccagatggaatggcctttggggatggaaaaaccccagtttacgctcatctcttctctcagctaacttttgtggagccctgttcccaaactggcctgggccagagcaccgtggaggggtatttgttgtaaatggaaggtttccaggcccgcctggaaatcctgaaggttgaccagatataccatctggcatctccagcctcccctccaaactacatgtataatcctatcaagacattaaagaccaatacgattgggacattaaacatgttggggctggcaaaacgagtcggtgcccgtctgctcctggcctccacatcggaggtgtatggagatcctgaagtccaccctcaaagtgaggattactggggcca

SEQ ID NO: 33774 - DNA, 800 bp, Homo sapiens
ccggatgcacactccacagtcctgcgcctccgctcctcactgaattggttttctccctgcaccgcgttttcccatatgtagctatattcccattcccgagcggtcttgactctaaaatcatatacacggtagagaaggagccctgaagctttacccagaaatacccaccagtaaagtttttatcagaaaaggatcggaaaagaattttgataacaggaggcgcagggttcgtgggctcccatctaactgacaaactcatgatggacggccacgaggtgaccgtggtggacaatttcttcacgggcaggaagagaaacgtggagcactggatcggacatgagaacttcgagttgattaaccacgacgtggtggagcccctctacatcgaggttgaccagatataccatctggcatctccagcctcccctccaaactacatgtataatcctatcaagacattaaagaccaatacgattgggacattaaacatgttggggctggcaaaacgagtcggtgcccgtctgctcctggcctccacatcggaggtgtatggagatcctgaagtccaccctcaaagtgaggattactggggccacgtgaatccaataggacctcgggcctgctacgatgaaggcaaacgtgttgcagagaccatgtgctatgcctacatgaagcaggaaggcgtggaagtgcgagtggccagaatcttcaacacctttgggccacgcatgcacatgaacgatgggcgagtagtcagcaacttcatcctgcaggcgctccagggggagccactcacggta

SEQ ID NO: 33775 - DNA, 1987 bp, Homo sapiens
gcgcattgtgcagcaggcgggcccccgcgcggtagggccctggacccgcgcggctcccggggatggtgagcaaggcgctgctgcgcctcgtgtctgccgtcaaccgcaggaggatgaagctgctgctgggcatcgccttgctggcctacgtcgcctctgtttggggcaacttcgttaatatgagatggttgaaccactaagagagaaaatcagagatttagaaaaaagctttacccagaaatacccaccagtaaagtttttatcagaaaaggatcggaaaagaattttgataacaggaggcgcagggttcgtgggctcccatctaactgacaaactcatgatggacggccacgaggtgaccgtggtggacaatttcttcacgggcaggaagagaaacgtggagcactggatcggacatgagaacttcgagttgattaaccacgacgtggtggagcccctctacatcgaggttgaccagatataccatctggcatctccagcctcccctccaaactacatgtataatcctatcaagacattaaagaccaatacgattgggacattaaacatgttggggctggcaaaacgagtcggtgcccgtctgctcctggcctccacatcggaggtgtatggagatcctgaagtccaccctcaaagtgaggattactggggccacgtgaatccaataggacctcgggcctgctacgatgaaggcaaacgtgttgcagagaccatgtgctatgcctacatgaagcaggaaggcgtggaagtgcgagtggccagaatcttcaacacctttgggccacgcatgcacatgaacgatgggcgagtagtcagcaacttcatcctgcaggcgctccagggggagccactcacggtatacggatccgggtctcagacaagggcgttccagtacgtcagcgatctagtgaatggcctcgtggctctcatgaacagcaacgtcagcagcccggtcaacctggggaacccagaagaacacacaatcctagaatttgctcagttaattaaaaaccttgttggtagcggaagtgaaattcagtttctctccgaagcccaggatgacccacagaaaagaaaaccagacatcaaaaaagcaaagctgatgctggggtgggagcccgtggtcccgctggaggaaggtttaaacaaagcaattcactacttccgtaaagaactcgagtaccaggcaaataatcagtacatccccaaaccaaagcctgccagaataaagaaaggacggactcgccacagctgaactcctcacttttaggacacaagactaccattgtacacttgatgggatgtatttttggcttttttttgttgtcgtttaaagaaagactttaacaggtgtcatgaagaacaaactggaatttcattctgaagcttgctttaatgaaatggatgtgcctaaaagctcccctcaaaaaactgcagattttgccttgcactttttgaatctctctttttatgtaaaatagcgtagatgcatctctgcgtattttcaagtttttttatcttgctgtgagagcatatgttgtgactgtcgttgacagttttatttactggtttctttgtgaagctgaaaaggaacattaagcgggacaaaaaatgccgattttatttatgaaagtgggtacttaataaatgagtcgttatactatgcataaagaaaaatcctagcagtattgtcaggtggtggtgcgccggcattgattttagggcagataaaagaattctgtgtgagagctttatgtttctcttttaattcagagtttttccaaggtctacttttgagttgcaaacttgactttgaaatattcctgttggtcatgatcaaggatatttgaaatcactactgtgttttgctgcgtatctggggcgggggcaggttggggggcacaaagttaacatattcttggttaaccatggttaaatatgctattttaataaattattgaaactc

SEQ ID NO: 33776 - DNA, 3847 bp, Homo sapiens
ggtatgaacgtgatttctgatgaaactggattggaataattttcatgatctttgtatatttatatatatatatttttaaattttgcatttgacttaaagtgccatgagaaaatttgcatactgcaaggtggtcctagccacctccttgatttgggtactcttggatatgttcctgctgctttacttcagtgaatgcaacaaatgtgatgaaaaaaaggagagaggacttcctgctggagatgttctagagccagtacaaaagcctcatgaaggtcctggagaaatggggaaaccagtcgtcattcctaaagaggatcaagaaaagatgaaagagatgtttaaaatcaatcagttcaatttaatggcaagtgagatgattgcactcaacagatctttaccagatgttaggttagaagggtgtaaaacaaaggtgtatccagataatcttcctacaacaagtgtggtgattgttttccacaatgaggcttggagcacacttctgcgaactgtccatagtgtcattaatcgctcaccaagacacatgatagaagaaattgttctagtagatgatgccagtgaaagagactttttgaaaaggcctttagagagttatgtgaaaaaactaaaagtaccagttcatgtaattcgaatggaacaacgttctggattgatcagagctagattaaaaggagctgctgtgtctaaaggccaagtgatcaccttcctggatgcccattgtgagtgtacagtgggatggctggagcctctcttggccaggatcaaacatgacaggagaacagtggtgtgtcccatcatcgatgtgatcagtgatgatacttttgagtacatggcaggctctgatatgacctatggtgggttcaactggaagctcaattttcgctggtatcctgttccccaaagagaaatggacagaaggaaaggtgatcggactcttcctgtcaggacacctaccatggcaggaggccttttttcaatagacagagattactttcaggaaattggaacatatgatgctggaatggatatttggggaggagaaaacctagaaatttcctttaggatttggcagtgtggaggaactttggaaattgttacatgctcacatgttggacatgtgtttcggaaagctacaccttacacgtttccaggaggcacagggcagattatcaataaaaataacagacgacttgcagaagtgtggatggatgaattcaagaatttcttctatataatttctccaggtgttacaaaggtagattatggagatatatcgtcaagagttggtctaagacacaaactacaatgcaaacctttttcctggtacctagagaatatatatcctgattctcaaattccacgtcactatttctcattgggagagatacgaaatgtggaaacgaatcagtgtctagataacatggctagaaaagagaatgaaaaagttggaatttttaattgccatggtatggggggtaatcaggttttctcttatactgccaacaaagaaattagaacagatgacctttgcttggatgtttccaaacttaatggcccagttacaatgctcaaatgccaccacctaaaaggcaaccaactctgggagtatgacccagtgaaattaaccctgcagcatgtgaacagtaatcagtgcctggataaagccacagaagaggatagccaggtgcccagcattagagactgcaatggaagtcggtcccagcagtggcttcttcgaaacgtcaccctgccagaaatattctgagaccaaatttacaaaaaaacgaaaaaaataaggattgactgggctacctcagcatacatttctgccacattcttaagtagcaaaaaaggaaaagtgctttcctcctctgcaggatgtaaggtttatcagccattaaaacttagacttctctagcttttcactagctgtgaaccagccttcctgtccatggacgtgaaactgcatagtaatgagactgtgcacactgatgtttacaagattgaaagagtctttctccgaaaatcatggtaaagaatactgagacaatgaaaaaaaatcaacaaaatatgctttctggagaactgtaccttttatggtttgcttgcacatcagtagtttctgctgaacgtgctgtcataatgaagagatttccaagattttttttcctgattagaactggtagccagtatattaaatattgatataaaaataaaagaactggaaccagattcagaatcatgaaaacaacatttttacaacaacaaaaaaactatattaaacagggtttaaaggaaattaaaacagaactatgagaagtacaatttgttatagtatagtatcaaatttctatatagattttatacctcagtggggaaaaataactgattccaatgacattcattttgttttcatctgtgatagtcatggatgcttttattttccttggggtgctgaaattgagctgaaaaaaaaaggctctttgaatatagttttaatttctctctacagttttttttgtttggtttgtgggctgttggaattgtaatttttaattgccttctaaaaaatggaaatttaacaatgtctgatctcagctgaacaaattagatgtttcagttgctcttgggtcaactggcttacagatttacatgtgcacacacacacaaatttcttatcacattttcgacttcttcacttgacctaactgattatgcgaaatacccaagattcatgctactgtaccacagatttgttttcacagcaataaatcttcagttctttgtttatgattccacttaacaaaaggcctgcagaagtgatttattatttgggtatttggagataatacatttgatggttttttggaaaacctttttcactccatactcagatatgcttcattgtcaaatgcatatttagattagattattgaattgtaatgtttatctgctgctttttttaaataaaatttgactgaaaatgtttaattggcattttttaatgacttagccaaagaagtgcagctattattccatattaataggcttgcatttcttttcctaaatcttatttaggctaaatcagttttatttttctctgattttttttaataccacagaatcacctgagtgtcaattgaaagttgtcaattaaaaggtaaccttttaatctcgtaggaggaatctcattaagacatttttcctgatatgtagagcagtctgttggcaaaaatgcatatattttctttcatatttgtaaaattatatttaatggaattcttttctttgattatcaaggactttcactgcaggcagtgctatttcttgtgcctaagaatgtttccaaaagtcgcatcgctaatgatatttgccaagttgagtgtacacaaagtttctcatatcctgttcaagttaatcaacatcaagcacatggggatgctttagggtgagtctatagtacaaaatgcataaaccatgtccccaggaaatttgaaaggaagcaggtgctgaatggaatttttttccttttccatgagctgtgttaattctatctccagtaggcctaatgcttgaataagcaagatgtctaatcaataaattattttcatgctcagaatttcaggtttttgtactccagcatagcttggtcttatttcttactgtatgaaagcttaacagcaatgtgatttaaggttttgttttaaatgggagatgtaagtgatttaattcatgggtacttttagaacctgatagataatcccattgcctttatttttctaattaaagaattcctaaatactttgaaaatacaaaatattcctgaata

SEQ ID NO: 33777 - DNA, 1770 bp, Homo sapiens
aagtgccatgagaaaatttgcatactgcaaggtggtcctagccacctccttgatttgggtactcttggatatgttcctgctgctttacttcagtgaatgcaacaaatgtgatgaaaaaaaggagagaggacttcctgctggagatgcgcaggtaaattgaacatgaaattggaaattgacaaggatgttgaagtagcagaaagttaccagtgagttaagttctagagccagtacaaaagcctcatgaaggtcctggagaaatggggaaaccagtcgtcattcctaaagaggatcaagaaaagatgaaagagatgtttaaaatcaatcagttcaatttaatggcaagtgagatgattgcactcaacagatctttaccagatgttaggttagaagggtgtaaaacaaaggtgtatccagataatcttcctacaacaagtgtggtgattgttttccacaatgaggcttggagcacacttctgcgaactgtccatagtgtcattaatcgctcaccaagacacatgatagaagaaattgttctagtagatgatgccagtgaaagagactttttgaaaaggcctttagagagttatgtgaaaaaactaaaagtaccagttcatgtaattcgaatggaacaacgttctggattgatcagagctagattaaaaggagctgctgtgtctaaaggccaagtgatcaccttcctggatgcccattgtgagtgtacagtgggatggctggagcctctcttggccaggatcaaacatgacaggagaacagtggtgtgtcccatcatcgatgtgatcagtgatgatacttttgagtacatggcaggctctgatatgacctatggtgggttcaactggaagctcaattttcgctggtatcctgttccccaaagagaaatggacagaaggaaaggtgatcggactcttcctgtcaggacacctaccatggcaggaggccttttttcaatagacagagattactttcaggaaattggaacatatgatgctggaatggatatttggggaggagaaaacctagaaatttcctttaggatttggcagtgtggaggaactttggaaattgttacatgctcacatgttggacatgtgtttcggaaagctacaccttacacgtttccaggaggcacagggcagattatcaataaaaataacagacgacttgcagaagtgtggatggatgaattcaagaatttcttctatataatttctccaggtgttacaaaggtagattatggagatatatcgtcaagagttggtctaagacacaaactacaatgcaaacctttttcctggtacctagagaatatatatcctgattctcaaattccacgtcactatttctcattgggagagatacgaaatgtggaaacgaatcagtgtctagataacatggctagaaaagagaatgaaaaagttggaatttttaattgccatggtatggggggtaatcaggttttctcttatactgccaacaaagaaattagaacagatgacctttgcttggatgtttccaaacttaatggcccagttacaatgctcaaatgccaccacctaaaaggcaaccaactctgggagtatgacccagtgaaattaaccctgcagcatgtgaacagtaatcagtgcctggataaagccacagaagaggatagccaggtgcccagcattagagactgcaatggaagtcggtcccagcagtggcttcttcgaaacgtcaccctgccagaaatattctgagaccaaattt

SEQ ID NO: 33778 - DNA, 2190 bp, Homo sapiens
atcgcggtcgccaggcgcaggctcagcgcggctgacagcgctccagctcccgcgctcgcggccgcctcaggcagccgaccgggttggggcggccccgcgctcggcccgggagccgatccgctgtgagggctcctccatctcctcccaccccgtgacctgctcgacgcgcaacagcccgagccggcccggaggacgcctgccgccgccgccgccgcgcgcctagcgaggtgccatgagaaaatttgcatactgcaaggtggtcctagccacctccttgatttgggtactcttggatatgttcctgctgctttacttcagtgaatgcaacaaatgtgatgaaaaaaaggagagaggacttcctgctggagatgttctagagccagtacaaaagcctcatgaaggtcctggagaaatggggaaaccagtcgtcattcctaaagaggatcaagaaaagatgaaagagatgtttaaaatcaatcagttcaatttaatggcaagtgagatgattgcactcaacagatctttaccagatgttaggttagaagggtgtaaaacaaaggtgtatccagataatcttcctacaacaagtgtggtgattgttttccacaatgaggcttggagcacacttctgcgaactgtccatagtgtcattaatcgctcaccaagacacatgatagaagaaattgttctagtagatgatgccagtgaaagagactttttgaaaaggcctttagagagttatgtgaaaaaactaaaagtaccagttcatgtaattcgaatggaacaacgttctggattgatcagagctagattaaaaggagctgctgtgtctaaaggccaagtgatcaccttcctggatgcccattgtgagtgtacagtgggatggctggagcctctcttggccaggatcaaacatgacaggagaacagtggtgtgtcccatcatcgatgtgatcagtgatgatacttttgagtacatggcaggctctgatatgacctatggtgggttcaactggaagctcaattttcgctggtatcctgttccccaaagagaaatggacagaaggaaaggtgatcggactcttcctgtcaggacacctaccatggcaggaggccttttttcaatagacagagattactttcaggaaattggaacatatgatgctggaatggatatttggggaggagaaaacctagaaatttcctttaggatttggcagtgtggaggaactttggaaattgttacatgctcacatgttggacatgtgtttcggaaagctacaccttacacgtttccaggaggcacagggcagattatcaataaaaataacagacgacttgcagaagtgtggatggatgaattcaagaatttcttctatataatttctccaggtgttacaaaggtagattatggagatatatcgtcaagagttggtctaagacacaaactacaatgcaaacctttttcctggtacctagagaatatatatcctgattctcaaattccacgtcactatttctcattgggagagatacgaaatgtggaaacgaatcagtgtctagataacatggctagaaaagagaatgaaaaagttggaatttttaattgccatggtatggggggtaatcaggttttctcttatactgccaacaaagaaattagaacagatgacctttgcttggatgtttccaaacttaatggcccagttacaatgctcaaatgccaccacctaaaaggcaaccaactctgggagtatgacccagtgaaattaaccctgcagcatgtgaacagtaatcagtgcctggataaagccacagaagaggatagccaggtgcccagcattagagactgcaatggaagtcggtcccagcagtggcttcttcgaaacgtcaccctgccagaaatattctgagaccaaatttacaaaaaaacgaaaaaaataaggattgactgggctacctcagcatacatttctgccacattcttaagtagcaaaaaaggaaaagtgctttcctcctctgcaggatgtaaggtttatcagccattaaaacttagacttctctagcttttcactagctgtgaaccagccttcctgtccatggacgtgaaactgcatagtaatgagactgtgcacactgatgtttacaagattgaaagagtctttctccgaaaatcatggtaaagaatact

SEQ ID NO: 33779 - DNA, 5961 bp, Homo sapiens
gcggagttggagcggggccggcgccgcagccgcttctgctggctgagctgctgccgccgccgggcggacgggcggacgcgcggagctgggggcggcgcggcggggccggcggggcgcggcggggctgaccggccccgatgaggcggaaggagaagcggctcctgcaggcggtggcgctggtgctggcggccctggtcctcctgcccaacgtggggctttgggcgctgtaccgcgagcggcagcccgacggcacccctgggggatcgggggcggcggtggcgccggcggcgggacagggctcacacagtcgacaaaagaaaacgtttttcttgggagatgggcagaagctgaaggactggcatgacaaggaggccatccggagggacgctcagcgcgtaggaaatggagaacaaggaagaccttaccccatgaccgatgctgagagagtggatcaggcataccgagaaaatggatttaacatctacgtcagtgataaaatctccttgaatcgctctctcccagatatccggcacccaaactgcaacagcaagcgctacctggagacacttcccaacacaagcatcatcatccccttccacaacgagggctggtcctccctcctccgcaccgtccacagtgtgctcaatcgctcgcctccagagctggtcgccgagattgtactggtcgacgacttcagtgatcgagagcacctgaagaagcctcttgaagactacatggcccttttccccagtgtgaggattcttcgaaccaagaaacgggaagggctgataaggacccgaatgctgggggcctcagtggcaactggggatgtcatcacattcttggattcacactgtgaagccaatgtcaactggcttccccccttgcttgaccgcattgctcggaaccgcaagaccattgtgtgcccgatgattgatgtaattgaccatgacgactttcggtacgagacacaggcaggggatgccatgcggggagcctttgactgggagatgtactacaagcggatcccgatccctccagaactgcagaaagctgaccccagcgacccatttgagtctcccgtgatggccggtggactgttcgccgtggatcggaagtggttctgggaactcggcgggtatgacccaggcttggagatctggggaggggagcagtatgaaatctccttcaaggtgtggatgtgtgggggccgcatggaggacatcccctgctccagggtgggccatatctacaggaagtatgtgccctacaaggtcccggccggagtcagcctggcccggaaccttaagcgggtggccgaagtgtggatggatgagtacgcagagtacatttaccagcgccggcctgaataccgccacctctccgctggggatgtcgcagtccagaaaaagctccgcagctcccttaactgcaagagtttcaagtggtttatgacgaagatagcctgggacctgcccaaattctacccacccgtggagcccccggctgcagcttggggggagatccgaaatgtgggcacagggctgtgtgcagacacaaagcacggggccttgggctccccactaaggctagagggctgcgtccgaggccgtggggaggctgcctggaacaacatgcaggtattcaccttcacctggagagaggacatccggcctggagacccccagcacaccaagaagttctgctttgatgccatttcccacaccagccctgtcacgctgtacgactgccacagcatgaagggcaaccagctgtggaaataccgcaaagacaagaccctgtaccaccctgtcagtggcagctgcatggactgcagtgaaagtgaccataggatcttcatgaacacctgcaacccatcctctctcacccagcagtggctgtttgaacacaccaactcaacagtcttggaaaaattcaataggaactgagccctcatgtccccttggcaggccccccagggtctggcactcactgcagacttcctctttcaagggaggcagggcccctgtgggcactaggtgtaaaaggtgctggccaaatggttcagggtgaagagggctcttgattcaggggctggggtctgcctggtccttgagcccctgagttgtgggggtagggtgaagagcatatcccacaagaggccccacagggagcagagactgctttaatccctgctgacatcacggaaaagcaacagagccttttcaactttgtcactatgtccccttgaacattatgtgggagaacaccaaggtagcctaggccacccaaaagtgagtcctgcgaggttgcccagccctcagatggctctcctacatgatggtgctttagaaacaaaggtaaaatttgcctgtttggggcagcttttagtatcgatgccactcatctgcagcagaagagaaagaagtcctcttggggctttttagtttctgccgtcctggggggaacattgcagttactgcacagcttctgttctctgtcacaaccccaggtgatttggtccggtcaaaggccatacttggggccctaagagtgttcagtattgaatgctgatcagctgccaggtgaggagtcagaagagggagcccccctagacatttctttgcagctatggacatgcgggatatctccccctgctctctgggtatttgaaatgtcaattttagcactctccaggcacaaggacagcccagcaccagctttacagggcagtgtttcagatggccctgagcccacggaaaaggccaggtagacctccaaactagaaatgctggctgatttgccctgatccatgcttccatttccctgtctctcttccccaggcaattactggcctcaaaagaggaacagaggtgctgcgaggtgctcacctcacagagtctggaggcctccaggatcaactgtgggcaaagtgcctgcctctgacctcatcatggttctagttctcatacagaactccagaatttttaaagaactctataattggattgcaaactaggatgctacataggattctggtattccacatccaatatggatttctagaatgctgtgattaaaggagccagccaggtgtaatacagtcaaggcagcccccagcctagagacaatctgtgaaatccaaagttggtggtgttgggaaagcagggggacatgtgtccctcagctcagcagaggctgtggtacaacatggtccttggtgaagacctgcacccctggaacctcccaccatcatcacaactgtagtctcatttgcagtggagaaaagaacccgacgtcccacagccagatatacacccagctccatgccagcccttcatgtttaccttttgctttgttaattacatgtcagactcctagagggcctccagactaataggaagcatttctgtaaccaacctgccacccactgattcagaaatggaaatcacattccacaatctatggcttccaccagctagcccaggaaatacttgaaatcagcattccaattagtgttgagtctcttgattgtgtcatttaccaattaaataactgagacctaagtctgggaacagagccacgaatctgcctttgagatgctggcagatctcaaggccatcaattattgggggagggagggacaaacactcccaatcatccaccagtcagactgaatgtgtagctggcgaggaattacttccacttctggcccagcacaagccctgctttggccacctgtctgcaagagaggcggcccctgtgcttgcaacgcttacgtgttgatcccagtgtccttttccaaatgagtgctgtagctttagaagtggccctctatagaaagaagtcaaaagatgaggccccttctagaatctaggataacaagagtgttgacagtttgaggagtcgaattgagattcatcatcaaagagcaatgcagcgtcgttaaaataaaaactgtgccttttaaaaagaaaaatgcaaatatagagcaaatccctaaacttgaaccatttcctagtgccttgctagacaaacataaaggggcagggttgtggggaggggaacgtttttggtggtgtgtgcagttcctactggatgagtgtgtgtttcttaatgtctcatttcaagcaggagatgttgggtctggagcaagatctgagactgagatgtcccccaagggtgacaggtcagatttatttcagtcagtgcaagtcacactccaaactaaaggctgggcagtgcgtttagtctgtggcctagaagacctcatcagcccccgagaggaggccttgcattacctcactgggacctgtttgggggccatccctgcggtccaccctctgaacccccagcatgtttgtcctgtttctcaccattgggttaaggggtgccgagcactagctagacttccacatagtcccaccccaagtgggcggcagtgttcctggcatgaccaggattcctgtgaaagcaggagcagcagcaagccgtcccgggcctgcctttcccatcctttggttctcctttccagtctgggttcacaccctgaaaagggatgggtgtgtcctctgagcactctggcatttgtcattgctgagcccatatcagtaggtcctgggacttgacaaagtatgtgggaggggaaggaaggacagaacttgactggctccatttcatggaccaactgatcaattgccagtactaagccactcattgttatggcttcctttttgaaaaccacctgtctcaaggattcaggtttctgctcacatccccagctgatgctcaataaaactcagccaggagcatatggagatgctgacagccaggtaatgggtgagactgtggggtcccttttcctctaaagcctttactctgaggataaggtcacaaagtagggtgtgacttgaaagtatcgtgaccatgtggcccaccagcagcctttccaaaggggaactccagagacatttcataatgcaaacagcactgttgctttaagaacaaggcctttggaggtggctaaacttgcacgcacgtgtgtgaaaagccatcccatcttctgcctccagttggagctttcagctgttaaaacagtcagaaactattgattcttccctttaggaaaaaatgctcaggcagaacggggtacatccacaggaggaatcggacgagaggatgtgacattcggtccaggagagaaagagcagtttctgttaaagatgtaacaaatggatttccaaagtctacatgacattcacttttcaaacttcccaccagttgaatttctttttttccttaagaaacaggtgatgtcttggaaaacagctccttatgtctctctgtgcatctccattttcctagtctctggagtctcaaaaagagtggcaaagcactttacagtagtaactgaggaatcagagtctctgcttcagcgatatctagtttgtacagttgggtgatcttttgtaattcctaggaggtaatgcatttttaatgttttctgaagctttgtaagtgtgagagagggacaagaagtgcagttctgttctggaattccttattgctttcaacggacactctttgtgaaaaatccaagtaatattttagttcaaacttgatcttgagccaaggcccactgccacctctgggatgggagtcggacctacataccaagtgacaagttcaccttaacatctgcttccagaatggctttgattcagccgtgccaggcaacagaacagggtcagactcctgctctgttattggcttgaagactaggatcccaaaggggttggaggcagggaatatttgaaaattcagactggaattccaggccaaaagctcaagaccaccagcctctcctcctgcctggaaaaataagcctttgtgaaagactgatttaccatgtacaattgtgattgtgaacgttgttgagtaaacctccagactttctctaaa

SEQ ID NO: 33780 - DNA, 4840 bp, Homo sapiens
atgctggcctggcgggatggtgaactggaagcagaaacgtcatcctctctcttccttcttgccatgcaggtgtggatgtgtgggggccgcatggaggacatcccctgctccagggtgggccatatctacaggaagtatgtgccctacaaggtcccggccggagtcagcctggcccgggtaaggaaccttaagcgggtggccgaagtgtggatggatgagtacgcagagtacatttaccagcgccggcctgaataccgccacctctccgctggggatgtcgcagtccagaaaaagctccgcagctcccttaactgcaagagtttcaagtggtttatgacgaagatagcctgggacctgcccaaattctacccacccgtggagcccccggctgcagcttggggggagatccgaaatgtgggcacagggctgtgtgcagacacaaagcacggggccttgggctccccactaaggctagagggctgcgtccgaggccgtggggaggctgcctggaacaacatgcaggtattcaccttcacctggagagaggacatccggcctggagacccccagcacaccaagaagttctgctttgatgccatttcccacaccagccctgtcacgctgtacgactgccacagcatgaagggcaaccagctgtggaaataccgcaaagacaagaccctgtaccaccctgtcagtggcagctgcatggactgcagtgaaagtgaccataggatcttcatgaacacctgcaacccatcctctctcacccagcagtggctgtttgaacacaccaactcaacagtcttggaaaaattcaataggaactgagccctcatgtccccttggcaggccccccagggtctggcactcactgcagacttcctctttcaagggaggcagggcccctgtgggcactaggtgtaaaaggtgctggccaaatggttcagggtgaagagggctcttgattcaggggctggggtctgcctggtccttgagcccctgagttgtgggggtagggtgaagagcatatcccacaagaggccccacagggagcagagactgctttaatccctgctgacatcacggaaaagcaacagagccttttcaactttgtcactatgtccccttgaacattatgtgggagaacaccaaggtagcctaggccacccaaaagtgagtcctgcgaggttgcccagccctcagatggctctcctacatgatggtgctttagaaacaaaggtaaaatttgcctgtttggggcagcttttagtatcgatgccactcatctgcagcagaagagaaagaagtcctcttggggctttttagtttctgccgtcctggggggaacattgcagttactgcacagcttctgttctctgtcacaaccccaggtgatttggtccggtcaaaggccatacttggggccctaagagtgttcagtattgaatgctgatcagctgccaggtgaggagtcagaagagggagcccccctagacatttctttgcagctatggacatgcgggatatctccccctgctctctgggtatttgaaatgtcaattttagcactctccaggcacaaggacagcccagcaccagctttacagggcagtgtttcagatggccctgagcccacggaaaaggccaggtagacctccaaactagaaatgctggctgatttgccctgatccatgcttccatttccctgtctctcttccccaggcaattactggcctcaaaagaggaacagaggtgctgcgaggtgctcacctcacagagtctggaggcctccaggatcaactgtgggcaaagtgcctgcctctgacctcatcatggttctagttctcatacagaactccagaatttttaaagaactctataattggattgcaaactaggatgctacataggattctggtattccacatccaatatggatttctagaatgctgtgattaaaggagccagccaggtgtaatacagtcaaggcagcccccagcctagagacaatctgtgaaatccaaagttggtggtgttgggaaagcagggggacatgtgtccctcagctcagcagaggctgtggtacaacatggtccttggtgaagacctgcacccctggaacctcccaccatcatcacaactgtagtctcatttgcagtggagaaaagaacccgacgtcccacagccagatatacacccagctccatgccagcccttcatgtttaccttttgctttgttaattacatgtcagactcctagagggcctccagactaataggaagcatttctgtaaccaacctgccacccactgattcagaaatggaaatcacattccacaatctatggcttccaccagctagcccaggaaatacttgaaatcagcattccaattagtgttgagtctcttgattgtgtcatttaccaattaaataactgagacctaagtctgggaacagagccacgaatctgcctttgagatgctggcagatctcaaggccatcaattattgggggagggagggacaaacactcccaatcatccaccagtcagactgaatgtgtagctggcgaggaattacttccacttctggcccagcacaagccctgctttggccacctgtctgcaagagaggcggcccctgtgcttgcaacgcttacgtgttgatcccagtgtccttttccaaatgagtgctgtagctttagaagtggccctctatagaaagaagtcaaaagatgaggccccttctagaatctaggataacaagagtgttgacagtttgaggagtcgaattgagattcatcatcaaagagcaatgcagcgtcgttaaaataaaaactgtgccttttaaaaagaaaaatgcaaatatagagcaaatccctaaacttgaaccatttcctagtgccttgctagacaaacataaaggggcagggttgtggggaggggaacgtttttggtggtgtgtgcagttcctactggatgagtgtgtgtttcttaatgtctcatttcaagcaggagatgttgggtctggagcaagatctgagactgagatgtcccccaagggtgacaggtcagatttatttcagtcagtgcaagtcacactccaaactaaaggctgggcagtgcgtttagtctgtggcctagaagacctcatcagcccccgagaggaggccttgcattacctcactgggacctgtttgggggccatccctgcggtccaccctctgaacccccagcatgtttgtcctgtttctcaccattgggttaaggggtgccgagcactagctagacttccacatagtcccaccccaagtgggcggcagtgttcctggcatgaccaggattcctgtgaaagcaggagcagcagcaagccgtcccgggcctgcctttcccatcctttggttctcctttccagtctgggttcacaccctgaaaagggatgggtgtgtcctctgagcactctggcatttgtcattgctgagcccatatcagtaggtcctgggacttgacaaagtatgtgggaggggaaggaaggacagaacttgactggctccatttcatggaccaactgatcaattgccagtactaagccactcattgttatggcttcctttttgaaaaccacctgtctcaaggattcaggtttctgctcacatccccagctgatgctcaataaaactcagccaggagcatatggagatgctgacagccaggtaatgggtgagactgtggggtcccttttcctctaaagcctttactctgaggataaggtcacaaagtagggtgtgacttgaaagtatcgtgaccatgtggcccaccagcagcctttccaaaggggaactccagagacatttcataatgcaaacagcactgttgctttaagaacaaggcctttggaggtggctaaacttgcacgcacgtgtgtgaaaagccatcccatcttctgcctccagttggagctttcagctgttaaaacagtcagaaactattgattcttccctttaggaaaaaatgctcaggcagaacggggtacatccacaggaggaatcggacgagaggatgtgacattcggtccaggagagaaagagcagtttctgttaaagatgtaacaaatggatttccaaagtctacatgacattcacttttcaaacttcccaccagttgaatttctttttttccttaagaaacaggtgatgtcttggaaaacagctccttatgtctctctgtgcatctccattttcctagtctctggagtctcaaaaagagtggcaaagcactttacagtagtaactgaggaatcagagtctctgcttcagcgatatctagtttgtacagttgggtgatcttttgtaattcctaggaggtaatgcatttttaatgttttctgaagctttgtaagtgtgagagagggacaagaagtgcagttctgttctggaattccttattgctttcaacggacactctttgtgaaaaatccaagtaatattttagttcaaacttgatcttgagccaaggcccactgccacctctgggatgggagtcggacctacataccaagtgacaagttcaccttaacatctgcttccagaatggctttgattcagccgtgccaggcaacagaacagggtcagactcctgctctgttattggcttgaagactaggatcccaaaggggttggaggcagggaatatttgaaaattcagactggaattccaggccaaaagctcaagaccaccagcctctcctcctgcctggaaaaataagcctttgtgaaagactgatttaccatgtacaattgtgattgtgaacgttgttgagtaaacctccagactttctct

SEQ ID NO: 33781 - DNA, 3778 bp, Homo sapiens
gagctgctgccgccgccgggcggacgggcggacgcgcggagctgggggcggcgcggcggggccggcggggcgcggcggggctgaccggccccgatgaggcggaaggagaagcggctcctgcaggcggtggcgctggtgctggcggccctggtcctcctgcccaacgtggggctttgggcgctgtaccgcgagcggcagcccgacggcacccctgggggatcgggggcggcggtggcgccggcggcgggacagggctcacacagtcgacaaaagaaaacgtttttcttgggagatgggcagaagctgaaggactggcatgacaaggaggccatccggagggacgctcagcgcgtaggaaatggagaacaaggaagaccttaccccatgaccgatgctgagagagtggatcaggcataccgagaaaatggatttaacatctacgtcagtgataaaatctccttgaatcgctctctcccagatatccggcacccaaactgcaacagcaagcgctacctggagacacttcccaacacaagcatcatcatccccttccacaacgagggctggtcctccctcctccgcaccgtccacagtgtgctcaatcgctcgcctccagagctggtcgccgagattgtactggtcgacgacttcagtgatcgagaccgcattgctcggaaccgcaagaccattgtgtgcccgatgattgatgtaattgaccatgacgactttcggtacgagacacaggcaggggatgccatgcggggagcctttgactgggagatgtactacaagcggatcccgatccctccagaactgcagaaagctgaccccagcgacccatttgagtctcccgtgatggccggtggactgttcgccgtggatcggaagtggttctgggaactcggcgggtatgacccaggcttggagatctggggaggggagcagtatgaaatctccttcaaggtgtggatgtgtgggggccgcatggaggacatcccctgctccagggtgggccatatctacaggaagtatgtgccctacaaggtcccggccggagtcagcctggcccggaaccttaagcgggtggccgaagtgtggatggatgagtacgcagagtacatttaccagcgccggcctgaataccgccacctctccgctggggatgtcgcagtccagaaaaagctccgcagctcccttaactgcaagagtttcaagtggtttatgacgaagatagcctgggacctgcccaaattctacccacccgtggagcccccggctgcagcttggggggagatccgaaatgtgggcacagggctgtgtgcagacacaaagcacggggccttgggctccccactaaggctagagggctgcgtccgaggccgtggggaggctgcctggaacaacatgcaggtattcaccttcacctggagagaggacatccggcctggagacccccagcacaccaagaagttctgctttgatgccatttcccacaccagccctgtcacgctgtacgactgccacagcatgaagggcaaccagctgtggaaataccgcaaagacaagaccctgtaccaccctgtcagtggcagctgcatggactgcagtgaaagtgaccataggatcttcatgaacacctgcaacccatcctctctcacccagcagtggctgtttgaacacaccaactcaacagtcttggaaaaattcaataggaactgagccctcatgtccccttggcaggccccccagggtctggcactcactgcagacttcctctttcaagggaggcagggcccctgtgggcactaggtgtaaaaggtgctggccaaatggttcagggtgaagagggctcttgattcaggggctggggtctgcctggtccttgagcccctgagttgtgggggtagggtgaagagcatatcccacaagaggccccacagggagcagagactgctttaatccctgctgacatcacggaaaagcaacagagccttttcaactttgtcactatgtccccttgaacattatgtgggagaacaccaaggtagcctaggccacccaaaagtgagtcctgcgaggttgcccagccctcagatggctctcctacatgatggtgctttagaaacaaaggtaaaatttgcctgtttggggcagcttttagtatcgatgccactcatctgcagcagaagagaaagaagtcctcttggggctttttagtttctgccgtcctggggggaacattgcagttactgcacagcttctgttctctgtcacaaccccaggtgatttggtccggtcaaaggccatacttggggccctaagagtgttcagtattgaatgctgatcagctgccaggtgaggagtcagaagagggagcccccctagacatttctttgcagctatggacatgcgggatatctccccctgctctctgggtatttgaaatgtcaattttagcactctccaggcacaaggacagcccagcaccagctttacagggcagtgtttcagatggccctgagcccacggaaaaggccaggtagacctccaaactagaaatgctggctgatttgccctgatccatgcttccatttccctgtctctcttccccaggcaattactggcctcaaaagaggaacagaggtgctgcgaggtgctcacctcacagagtctggaggcctccaggatcaactgtgggcaaagtgcctgcctctgacctcatcatggttctagttctcatacagaactccagaatttttaaagaactctataattggattgcaaactaggatgctacataggattctggtattccacatccaatatggatttctagaatgctgtgattaaaggagccagccaggtgtaatacagtcaaggcagcccccagcctagagacaatctgtgaaatccaaagttggtggtgttgggaaagcagggggacatgtgtccctcagctcagcagaggctgtggtacaacatggtccttggtgaagacctgcacccctggaacctcccaccatcatcacaactgtagtctcatttgcagtggagaaaagaacccgacgtcccacagccagatatacacccagctccatgccagcccttcatgtttaccttttgctttgttaattacatgtcagactcctagagggcctccagactaataggaagcatttctgtaaccaacctgccacccactgattcagaaatggaaatcacattccacaatctatggcttccaccagctagcccaggaaatacttgaaatcagcattccaattagtgttgagtctcttgattgtgtcatttaccaattaaataactgagacctaagtctgggaacagagccacgaatctgcctttgagatgctggcagatctcaaggccatcaattattgggggagggagggacaaacactcccaatcatccaccagtcagactgaatgtgtagctggcgaggaattacttccacttctggcccagcacaagccctgctttggccacctgtctgcaagagaggcggcccctgtgcttgcaacgcttacgtgttgatcccagtgtccttttccaaatgagtgctgtagctttagaagtggccctctatagaaagaagtcaaaagatgaggccccttctagaatctaggataacaagagtgttgacagtttgaggagtcgaattgagattcatcatcaaagagcaatgcagcgtcgttaaaataaaaactgtgccttttaaaaagaaaaatgcaaatatagagcaaatccctaaacttg

SEQ ID NO: 33782 - DNA, 4344 bp, Homo sapiens
gcggagttggagcggggccggcgccgcagccgcttctgctggctgagctgctgccgccgccgggcggacgggcggacgcgcggagctgggggcggcgcggcggggccggcggggcgcggcggggctgaccggccccgatgaggcggaaggagaagcggctcctgcaggcggtggcgctggtgctggcggccctggtcctcctgcccaacgtggggctttgggcgctgtaccgcgagcggcagcccgacggcacccctgggggatcgggggcggcggtggcgccggcggcgggacagggctcacacagtcgacaaaagaaaacgtttttcttgggagatgggcagaagctgaaggactggcatgacaaggaggccatccggagggacgctcagcgcgtaggaaatggagaacaaggaagaccttaccccatgaccgatgctgagagagtggatcaggcataccgagaaaatggatttaacatctacgtcagtgataaaatctccttgaatcgctctctcccagatatccggcacccaaactgcaacagcaagcgctacctggagacacttcccaacacaagcatcatcatccccttccacaacgagggctggtcctccctcctccgcaccgtccacagtgtgctcaatcgctcgcctccagagctggtcgccgagattgtactggtcgacgacttcagtgatcgagagcacctgaagaagcctcttgaagactacatggcccttttccccagtgtgaggattcttcgaaccaagaaacgggaagggctgataaggacccgaatgctgggggcctcagtggcaactggggatgtcatcacattcttggattcacactgtgaagccaatgtcaactggcttccccccttgcttgaccgcattgctcggaaccgcaagaccattgtgtgcccgatgattgatgtaattgaccatgacgactttcggtacgagacacaggcaggggatgccatgcggggagcctttgactgggagatgtactacaagcggatcccgatccctccagaactgcagaaagctgaccccagcgacccatttgagtctcccgtgatggccggtggactgttcgccgtggatcggaagtggttctgggaactcggcgggtatgacccaggcttggagatctggggaggggagcagtatgaaatctccttcaaggtgagccagctctccagacgccccgttcttggcacagcctcctgagtgcctgtcccagtaggtgtctcagcttctgcctgagcttggaaagactggaggcctcagggttctgtagcccttctgcccatcaggtgaagaagacaggggctcatgggccactctttgttgtggggtgggggggtgtgggagggaaggggagtactctccagctgccaaaggctggtcctcaccacagctctgactggcatttgccttgtgtcttcttaagatgttggaataaggtcttgcttctactcagatggcaggtctgagattgagatgtccagcaaataagcagtgggccagagaagctaggaaggccaaacaggatacgtaggcctagaggagtcctctcagtcaccccaagttttccctttgtacctgttgctctaggagtttgacaaagaccagtgagcataagctccagttgtaaagttacaaaggcctggattcagatcccagctccatcatcaggagctatctgactttgggcaagttagatcacccccccgagctttctttcctcatctgaaataagggaataataatactacctagcttacagagctatcgtgaagattaaatgagatcatgtctagaaagtgcttagcatacaacctgggaacatgaccagcaattaataattggtagaaattgttaaagtttcggtgagtaaatatttactgtaacctacttgaccagcctatggactctggaagctttctgacagtagtggtaaaggagttactagttaactaataactaattaagcacccaaacttccaaggctacattctccactttatttgtgggagtctgtcttgttctcaagtgaaagcttggaccttctgaggggagggttagcttgtcccatgcccttgtggcctgtcagagtcagcttctaacagcttagacccctggctaaggcatatccccagcccacaagggacagatagcaccattactgatctgacccctgtgaacacacaactctgatgccccctcatcgggcctcaactttcagtgcaaaggaccattgtcaggcacagtgaattaaggctttggtattggtgccagagtgccacgatcagatcctagctctgccgtgtcctgccagctgtgtgatcttgggcaaggaatcctcacctcactgagccttggtttctacttccataaagtgggtttaatgaaacgttaatcctcacagagttgttgagaggattaagtgagaccatgcttattaggtgcttcttaataaattatcctaaagattattatcaatacattaatattattatctgcaacagtggttgagtagttcagaactggagaacataaattcttgattagcccaaaaaaaaaaaaaacctacaattcttttgatgttatttaggtttgaaaagcagtttatatcctttttttttcttttcttttcttttgtttttttttttttgagatggagtttcactctgctgcccaggctggagtgcagtagtgcgatcttggctcactgcagcctccacctcctgggttcaagtgattctcctgcctcagcctcctgagtagctgggactacaggcgcccaccaccacgcccagctaatgtagagatagggtttcgacatgttgaccaggctggtcttgaccccctgacctcaggtgatccacccacctcggcctttcaaagtgctgggattacaggtgtgagccactgtgcctggccagtttatatctattttaaccaccagagttctgaagttgtctcccataaggagaccagccccctaaataaaattaatattcacataagggtaatgttcaaaatatgtaacaactgtgataacacaagcacatccagtcagaacagataccagctataaacaatggtgcatccactccagcgtgtaacaagtgaagttcggtcctgatcatagctaacaggacagtgtgccaagcccttcatacatgctgacttgtttaatcctcacaacaaccttaggagagttgtatcattattatacccgtttcaccaggaaggcaagcaaagctcagaccaaggcctcgcacagccggaagaagcagaactggggcccaaacgcaggtctgcttgactccaaagcccacgctctgacctgctatttttgttgttgtttaaatcatacccagactgttctgaaaacctgccatgttttatggacctctgcctcaccctttctgggattttttttttttttttgcctcttctggtattattcctagtttacttggatattctgcaatttcttagttaatggaattaataacaatctaagtcggaagtggcaaatagggccaggaatggtggccgagatgggaggatctcttgagcctaggagtttgagaccagcctggacaacacaacacgaccccatctcattaaaaaaaaaaaaaaaaagaaggaaagaaagagagagagagaaggagtggggagggagagagggagggggaaagggagagagagagacagagagagagacacagcaaataggtttctactccctgccaggccaactctgatccattggtaggggctgccccaggtgggtgttgatatgcattctgaggctgcttccaagcttatcagcaaagagtagtcagtgggggagggatctttttgtgtttcactcaccgccatatcccaagtacctaaagcctggtccaacacagaaaagacactatgagaccaatttttatgagtcataatttttattattgtattaaatcttttctaaaattatatttatataaatatcttataaatattctaaaaatatgtaaaatgtataaaagtctagtagttctgatataacactgtcagccataattctggttatcatgttaaaatactacatataataaaataactaaattcaagaccagcctggccaacattgtgaaaccccatctttactaaaaatacaaaaattagccaggcgtggtggtacatgcctgtaattccagctactcaggaggtggagacaggagaattgcttgaagctgggaggcagaggttgcagtgagccgagatcgtgccactgcactctaatctgggcgacaaagcgagactccatgtc

SEQ ID NO: 33783 - DNA, 2735 bp, Homo sapiens
atgtgggggcgcacggcgcggcggcgctgcccgcgggaactgcggcgcggccgggaggcgctgttggtgctcctggcgctactggcgttggccgggctgggctcggtgctgcgggcgcagcgtggggccggggccggggctgccgagccgggacccccgcgcaccccgcgccccgggcggcgcgagccggtcatgccgcggccgccggtgccggcgaacgcgctgggcgcgcggggcgaggcggtgcggctgcagctgcagggcgaggagctgcggctgcaggaggagagcgtgcggctgcaccagattaacatctacctcagcgaccgcatctcactgcaccgccgcctgcccgagcgctggaacccgctgtgcaaagagaagaaatatgattatgataatttgcccaggacatctgttatcatagcattttataatgaagcctggtcaactctccttcggacagtttacagtgtccttgagacatccccggatatcctgctagaagaagtgatccttgtagatgactacagtgatagagagcacctgaaggagcgcttggccaatgagctttcgggactgcccaaggtgcgcctgatccgcgccaacaagagagagggcctggtgcgagcccggctgctgggggcgtctgcggcgaggggcgatgttctgaccttcctggactgtcactgtgagtgccacgaagggtggctggagccgctgctgcagaggatccatgaagaggagtcggcagtggtgtgcccggtgattgatgtgatcgactggaacaccttcgaatacctggggaactccggggagccccagatcggcggtttcgactggaggctggtgttcacgtggcacacagttcctgagagggagaggatacggatgcaatcccccgtcgatgtcatcaggtctccaacaatggctggtgggctgtttgctgtgagtaagaaatattttgaatatctggggtcttatgatacaggaatggaagtttggggaggagaaaacctcgaattttcctttaggatctggcagtgtggtggggttctggaaacacacccatgttcccatgttggccatgttttccccaagcaagctccctactcccgcaacaaggctctggccaacagtgttcgtgcagctgaagtatggatggatgaatttaaagagctctactaccatcgcaacccccgtgcccgcttggaaccttttggggatgtgacagagaggaagcagctccgggacaagctccagtgtaaagacttcaagtggttcttggagactgtgtatccagaactgcatgtgcctgaggacaggcctggcttcttcgggatgctccagaacaaaggactaacagactactgctttgactataaccctcccgatgaaaaccagattgtgggacaccaggtcattctgtacctctgtcatgggatgggccagaatcagtttttcgagtacacgtcccagaaagaaatacgctataacacccaccagcctgagggctgcattgctgtggaagcaggaatggatacccttatcatgcatctctgcgaagaaactgccccagagaatcagaagttcatcttgcaggaggatggatctttatttcacgaacagtccaagaaatgtgtccaggctgcgaggaaggagtcgagtgacagtttcgttccactcttacgagactgcaccaactcggatcatcagaaatggttcttcaaagagcgcatgttatgaagcctcgtgtatcaaggagcccatcgaaggagactgtggagccaggactctgcccaacaaagacttagctaagcagtgaccagaacccaccaaaaactaggctgcattgctttgaagaggcaatcattttgccatttgtgaaagttgtgttggatttagtaaaaatgtgaataagctttgtacttattttgagaactttttaaatgttccaaaataccctattttcaaagggtaatcgtaagatgttaacccttggtatttagaaaattaaaaccttataatatttttctatcaagatgtatattttacagtcgtgccttttactctcattagcaaaaaagataaagattttattttggtatttacaagaattcccaggtacgaagatatctgcatgggtggaaatcaggttcaagcaacgtactttgcattaactgataatacctcagctgcggggttaaagttttcccagtatagagagactgtcactaggaacattgtattgatttattcaggtcattgagatcttctagatgtattttaaaaagaatgctttttggttatgtgttgctaccacagttaacactccataatgttcatgtcagccaaagaggactaaccaaagctgaaatctcagagaacaatttgctttactaagctgagtcaacttgagagcgaacttctaacaatgccgcactgtagtgtggctggttctaccactatgactttaaaacatgtttatatcatttttaatttttatgatacggtagtgtcagggagaaatgtaatgttctatatgaaattcctttttcaagtttgttcattaataacagttattaatttaaatcagcgttagagtttgtgctgctgcaactgctgtgaaaatttctctgagtaattctgatttgtgaatgatcccagaccaaccctgagattttgtcaacctgattaagtcaatatgaatgattaaaaagatgtgagaacactga

SEQ ID NO: 33784 - DNA, 5536 bp, Homo sapiens
gggagaagtgaccaggcggcggcggctctgctgaggtgacaacgtgctagcagccctcgctcgctctgggcgcctcctcggcctcagcgtccgctctggccgcgctcgaggagcccttcagcccgccgctgcgctatgaaggcccctctctggggctggccgaggctggagccggctccctctgctcgcgggcaagtgtgaagagagaggcgcgggcgggagccggggctgcgcgcggcgctcgcgggccggcgcgggttccaggtgagcgcggactcggcgagccccgcactcggcgcggccggccggcgcctgctgggcttgatctgaggctgaatcccgtgtgtggaccgccgttccctcttcgcgggatcgttggccaggatagcagatgcatttttgtagaagcattttgaggatgaatgtttgcaaatcattttgaaattgccaagtgccacatacatggaatgtatcctgctttcatcttggagttcacctgtgtggcttggatttatcacagtagcatttgtcttcaatctgtgtgttaactagaaatcaaggaaagacatgaggagatttgtctactgcaaggtggttctagccacttcgctgatgtgggttcttgttgatgtcttcttactgctgtacttcagtgaatgtaacaaatgtgatgacaagaaggagagatctctgctgcctgcattgagggctgttatttcaagaaaccaagaagggccaggagaaatgggaaaagctgtgttgattcctaaagatgaccaggagaaaatgaaagagctgtttaaaatcaatcagtttaaccttatggccagtgatttgattgcccttaatagaagtctgccagatgtaagattagaaggatgtaagacaaaagtctaccctgatgaacttccaaacacaagtgtagtcattgtgtttcataatgaagcttggagcactctccttagaactgtttacagtgtgataaatcgttccccacactatctactctcagaggtcatcttggtagatgatgccagtgaaagagattttctcaagttgacattagagaattacgtgaaaaatttagaagtgccagtaaaaattattaggatggaagaacgctctgggttaatacgtgcccgtcttcgaggagcagctgcttcaaaagggcaggtcataacttttcttgatgcacactgtgaatgcacgttaggatggctggagcctttgctggcaagaataaaggaagacaggaaaacggttgtctgccctatcattgatgtgattagtgatgatacttttgaatatatggctgggtcagacatgacttatgggggttttaactggaaactgaatttccgctggtatcctgttccccaaagagaaatggacaggaggaaaggagacagaacattacctgtcaggacccctactatggctggtggcctattttctattgacagaaactactttgaagagataggaacttacgatgcaggaatggatatctggggtggagagaatcttgaaatgtcttttaggatttggcaatgtggaggctccttggagattgttacttgctcccatgttggtcatgtttttcggaaggcaactccatacacttttcctggtggcactggtcatgtcatcaacaagaacaacaggagactggcagaagtttggatggatgaatttaaagatttcttctacatcatatccccaggtgttgtcaaagtggattatggagatgtgtcagtcagaaaaacactaagagaaaatctgaagtgtaagcccttttcttggtacctagaaaacatctatccggactcccagatcccaagacgttattactcacttggtgagataagaaatgttgaaaccaatcagtgtttagacaacatgggccgcaaggaaaatgaaaaagtgggtatattcaactgtcatggtatgggaggaaatcaggtattttcttacactgctgacaaagaaatccgaaccgatgacttgtgcttggatgtttctagactcaatggacctgtaatcatgttaaaatgccaccatatgagaggaaatcagttatgggaatatgatgctgagagactcacgttgcgacatgttaacagtaaccaatgtctcgatgaaccttctgaagaagacaaaatggtgcctacaatgcaggactgtagtggaagcagatcccaacagtggctgctaaggaacatgaccttgggcacatgaagatcatgtcctccaagccatgaaagtgtctacgcttttgtttttccattatttcaattgggggaaaatattaactttgctgaattgaaagttttaaaaatccttttagtattctaaaacacaattgtttctaattcgtttctagaaatgtttgcttatttccctactaaaatttgtatctgatcaaagcacataagaatataaataatagcaaactactattaaacaacagaacaacttgtaaaacaaattgtgtttgctttaagaaaaatgtttattgcactcatgtcatagggttaattggaggttattttatttttggttgtcatggtgattgaaagagataatgtaaatgccttataaaatcttcattatgaaatattatcagttgctttataaactcactctttttatggatccttcatggaaacatgtttgatttctgtgtctacaacagggccacatattaaattacttctgaatggtgaattcatcttacaaaatgttccaagttttggacaaggaaaaacattacattggatattgaattcatggagcctttacagaagcatcacatttaaaccaatgtgaattcaaaaaagagaaggaaactttttaaattcaatttagagtacataaaaaaagaaatccgcgaagcattgaggggaacaagatgagtctaatccgcagcacttcgatcactgtgagagaactcaaagtgggttgcaatcattcctaacacaggctgaaactaaacaatcttgctcctagagtttatgttggatactcaattcttaaccaaaatcttggtctccacaaactctaccatcccttttctcttcactctatagacagtggcatgccattgatgctgtacagaattgcaggtgaaagggagaattttagacttaatttttaactctattgcacttaaagattttagttaggttaccactgtcattttcattttctatgttaaagaatacctttcagtgctgtgctccagtatctaaaaattttatcaccaggggaataaactcaatacacattcattaaacttttgttgtaattaaactgctatatattgtttgccatatattatggcccaaggaatatagttataatcaggctacattcacattttcttttctcatcttaaaaccctttatgttcaaaatacattagcagaggccatgaaagtgaaaaaaaatcagatttttgctagtaagtttttatatttgacatcattttaaatgctcaaagagttgccctatatatgcatgttatccattataaatgcactcagcagctaagagaaatttgagaggaaaagtggaagaagtgttttctggagcagaagattccacttctttggtcctcatctttacttaaaaagctcttatagaaaggattaatcattttgactgcatacaaactatgtctctgacatgcacatacactgctttataatgaaaatgaggacactttctgatggtcagtaaaatcttaaatgatttttgccactggtattccttcctcttttgactttttattggtacaactgtagggaagaatctacaacctggagcatttcaggtttgctctttaaatatagacacccctcaccatgagctctctgtgaatccgtgaatttcctaaaattgtaagcaaaatgttgaatatcagggcatttttttttctgaggtgggagtatgtcactcacagcaaacttggaaagaaggctatgactcccaagaggcagtgaaccattgccttaaattaatagcagcctctcaagtccattgaggcctcatgtaaaattcccatttttcatctttacactccttttctcccctcatttcctcttctccttactaaggtaaaaagaccctgcacagcattattacttaagttgaaaaagcttcaactctcaaggactcatgtataccatatgttccacttattgctttgttagtcaaaatgcatgttatgtagaaaatggtcaatggcaaatttttataaatacagctaccccatcaaagctgaacttgaaacgttttagcagaattttaaatatgtgaaagttcattgtggtcatggtgagaaaactaaaactacatgagtttcatgttagaaaagaatttttaaacaatcttcagatggcttgaacacgtgccattatagtatctaacaaaaagtggcataaaatattacaaaacatccaacactagaaagcaatgactaacatttaatttgtttacaaaaatgtttattgtcttcagtacaaaaagttaaaaccatgattggattcataatgcacttgtcttatcccttatttatggagctagactgacatatttcaaaccaatctcttctgtggtcttctccatctcagttaatgcaacttcaaccttccagatgctcaggtcaaaaactgaaagttgcttttgactcctctatttctgtttcaactctcgtctaatccaacagcaaatccccttgatgctacctttgaaatataactagaaaagaatgacttgccaccatatccactaggtgtcactacctctaacctttttaatcgcaatatgcttattatttagttccctaatttcccagtccttgtcttgaacaatcttttctcagtacaacagccatagtgattctgttaaccatgaatttgattgtgtcacttccctgctcacaatcttccaatgacttctccctccggtggccttcaaggtcctttatgagtgttacccctctacacgtccacaccactcaccacacatacatacacatgcacacacacacacatgcaattctacctttttctaacaccatctcttatctctcattattctgcctcttacttaccctattatggctcccaagaaagttcctgctttagtgttttgttccctctgccccagagagctccccttagtgatctcagttcaaatattatcttatcagtaagacaaacccttctcccatctgccttccctatcccctgtacctgacaatctatgagtttgcttctttatttctgtctatacttccccctccccagccccaaacatgcccatcacatgccctagaaggtaagtcccatgaaggcaggggctttgtcagttttgttcatttggtatttctggcatatatattctctaaatatttcttgaattaatgaactgaaaaatgtgtgttaaagttgctaagtgtaactgtatcatactttttttgtattttaaattttaaaataaaggctaatatatttagacaggatttccaaaaa

SEQ ID NO: 33785 - DNA, 2591 bp, Homo sapiens
atgaggagatttgtctactgcaaggtggttctagccacttcgctgatgtgggttcttgttgatgtcttcttactgctgtacttcagtgaatgtaacaaatgtgatgacaagaaggagagatctctgctgcctgcattgagggctgttatttcaagaaaccaagaagggccaggagaaatgggaaaagctgtgttgattcctaaagatgaccaggagaaaatgaaagagctgtttaaaatcaatcagtttaaccttatggccagtgatttgattgcccttaatagaagtctgccagatgtaagattagaaggatgtaagacaaaagtctaccctgatgaacttccaaacacaagtgtagtcattgtgtttcataatgaagcttggagcactctccttagaactgtttacagtgtgataaatcgttccccacactatctactctcagaggtcatcttggtagatgatgccagtgaaagagattttctcaagttgacattagagaattacgtgaaaaatttagaagtgccagtaaaaattattaggatggaagaacgctctgggttaatacgtgcccgtcttcgaggagcagctgcttcaaaagggcaggtcataacttttcttgatgcacactgtgaatgcacgttaggatggctggagcctttgctggcaagaataaaggaagacaggaaaacggttgtctgccctatcattgatgtgattagtgatgatacttttgaatatatggctgggtcagacatgacttatgggggttttaactggaaactgaatttccgctggtatcctgttccccaaagagaaatggacaggaggaaaggagacagaacattacctgtcaggacccctactatggctggtggcctattttctattgacagaaactactttgaagagataggaacttacgatgcaggaatggatatctggggtggagagaatcttgaaatgtcttttaggatttggcaatgtggaggctccttggagattgttacttgctcccatgttggtcatgtttttcggaaggcaactccatacacttttcctggtggcactggtcatgtcatcaacaagaacaacaggagactggcagaagtttggatggatgaatttaaagatttcttctacatcatatccccaggtgttgtcaaagtggattatggagatgtgtcagtcagaaaaacactaagagaaaatctgaagtgtaagcccttttcttggtacctagaaaacatctatccggactcccagatcccaagacgttattactcacttggtgagataagaaatgttgaaaccaatcagtgtttagacaacatgggccgcaaggaaaatgaaaaagtgggtatattcaactgtcatggtatgggaggaaatcaggtattttcttacactgctgacaaagaaatccgaaccgatgacttgtgcttggatgtttctagactcaatggacctgtaatcatgttaaaatgccaccatatgagaggaaatcagttatgggaatatgatgctgagtcttgtctctcagtgaacaaagtagctgatggctcccagcatcctactgtggaaacctgtaatgatagcactttgcaaaaatggctactaagaaactatacaagaatggaaatttttagaaatatttttgggaattctactgattacattctctaatgatttttggagagactcacgttgcgacatgttaacagtaaccaatgtctcgatgaaccttctgaagaagacaaaatggtgcctacaatgcaggactgtagtggaagcagatcccaacagtggctgctaaggaacatgaccttgggcacatgaagatcatgtcctccaagccatgaaagtgtctacgcttttgtttttccattatttcaattgggggaaaatattaactttgctgaattgaaagttttaaaaatccttttagtattctaaaacacaattgtttctaattcgtttctagaaatgtttgcttatttccctactaaaatttgtatctgatcaaagcacataagaatataaataatagcaaactactattaaacaacagaacaacttgtaaaacaaattgtgtttgctttaagaaaaatgtttattgcactcatgtcatagggttaattggaggttattttatttttggttgtcatggtgattgaaagagataatgtaaatgccttataaaatcttcattatgaaatattatcagttgctttataaactcactctttttatggatccttcatggaaacatgtttgatttctgtgtctacaacagggccacatattaaattacttctgaatggtgaattcatcttacaaaatgttccaagttttggacaaggaaaaacattacattggatattgaattcatggagcctttacagaagcatcacatttaaaccaatgtgaattcaaaaaagagaaggaaactttttaaattcaatttagagtacataaaaaaagaaatccgcgaagcattgaggggaacaagatgagtctaatccgcagcacttcgatcactgtgagagaactcaaagtgggttgcaatcattcctaacacaggctgaaac

SEQ ID NO: 33786 - DNA, 510 bp, Homo sapiens
aacgtgctagcagccctcgctcgctctgggcgcctcctcggcctcagcgtccgctctggccgcgctcgaggagcccttcagcccgccgctgcgctatgaaggcccctctctggggctggccgaggctggagccggctccctctgctcgcgggcaagtgtgaagagagaggcgcgggcgggagccggggctgcgcgcggcgctcgcgggccggcgcgggttccagatgcatttttgtagaagcattttgaggatgaatgtttgcaaatcattttgaaattgccaagtgccacatacaatttaattggatttgagggaaatacaggctgcaatggtgggaatagttaaaatggaatgtatcctgctttcatcttggagttcacctgtgtggcttggatttatcacagtagcatttgtcttcaatctgtgtgttaactagaaatcaaggaaagacatgaggagatttgtctactgcaaggtggttctagccacttcgctgatgtgggttcttg

SEQ ID NO: 33787 - DNA, 2733 bp, Homo sapiens
ggcatcccgagtgcaccgctcccgccccgccccgccttgccccaacccacgatggtctgggagctgcgcccagggcttggcgctggcggccccgcaacagcaccgagcgtttcggtcggcgggcggcggtagcgccccctctcagagccccgctcactcccacctgggctcgctccgagtcggcctgtctgtcgggcccgccctccccgctcactccctccgccctcgtgctcctcccggggtgcttggcacagcctcggattcctccctctcgctgctcgagtcagtttccctatcggcggcagcgggcaaggcggcggcggcggcggcggcagccgcggtggcggcgtggggaacatctcggcagccaccgcgcttctcccgctggagcgggcgtccagcttggctgccctcggtccttccctgccacgtttcgggtcgccctgcaccccccacccaggctcgcttctcttcgaagcgggaagggcgccttgcaggatcctgccgcccctccaaccggatcctgggtctagagctccccagagcgaggcgctcgccaggactcctgccccgccaaccctgaccgccggggggtgcccccgggacgtagcgccgcggagaggaagcggcaaaggggaccatgcggcgcctgactcgtcggctggttctgccagtcttcggggtgctctggatcacggtgctgctgttcttctgggtaaccaagaggaagttggaggtgccgacgggacctgaagtgcagacccctaagccttcggacgctgactgggacgacctgtgggaccagtttgatgagcggcggtatctgaatgccaaaaagtggcgcgttggtgacgacccctataagctgtatgctttcaaccagcgggagagtgagcggatctccagcaatcgggccatcccggacactcgccatctgagatgcacactgctggtgtattgcacggaccttccacccactagcatcatcatcaccttccacaacgaggcccgctccacgctgctcaggaccatccgcagtgtattaaaccgcacccctacgcatctgatccgggaaatcatattagtggatgacttcagcaatgaccctgatgactgtaaacagctcatcaagttgcccaaggtgaaatgcttgcgcaataatgaacggcaaggtctggtccggtcccggattcggggcgctgacatcgcccagggcaccactctgactttcctcgacagccactgtgaggtgaacagggactggctccagcctctgttgcacagggtcaaagaggactacacgcgggtggtgtgccctgtgatcgatatcattaacctggacaccttcacctacatcgagtctgcctcggagctcagaggggggtttgactggagcctccacttccagtgggagcagctctccccagagcagaaggctcggcgcctggaccccacggagcccatcaggactcctatcatagctggagggctcttcgtgatcgacaaagcttggtttgattacctggggaaatatgatatggacatggacatctggggtggggagaactttgaaatctccttccgagtgtggatgtgcgggggcagcctagagatcgtcccctgcagccgagtggggcacgtcttccggaagaagcacccctacgttttccctgatggaaatgccaacacgtatataaagaacaccaagcggacagctgaagtgtggatggatgaatacaagcaatactattacgctgcccggccattcgccctggagaggcccttcgggaatgttgagagcagattggacctgaggaagaatctgcgctgccagagcttcaagtggtacctggagaatatctaccctgaactcagcatccccaaggagtcctccatccagaagggcaatatccgacagagacagaagtgcctggaatctcaaaggcagaacaaccaagaaaccccaaacctaaagttgagcccctgtgccaaggtcaaaggcgaagatgcaaagtcccaggtatgggccttcacatacacccagcagatcctccaggaggagctgtgcctgtcagtcatcaccttgttccctggcgccccagtggttcttgtcctttgcaagaatggagatgaccgacagcaatggaccaaaactggttcccacatcgagcacatagcatcccacctctgcctcgatacagatatgttcggtgatggcaccgagaacggcaaggaaatcgtcgtcaacccatgtgagtcctcactcatgagccagcactgggacatggtgagctcttgaggacccctgccagaagcagcaagggccatggggtggtgcttccctggaccagaacagactggaaactgggcagcaagcagcctgcaaccacctcagacatcctggactgggaggtggaggcagagccccccaggacaggagcaactgtctcagggaggacagaggaaaacatcacaagccaatggggctcaaagacaaatcccacatgttctcaaggccgttaagttccagtcctggccagtcattccctgattggtatctggagacagaaacctaatgggaagtgtttattgttccttttcctacaaaggaagcagtctctggaggccagaaagaaaagccttctttttcactaggccaggactacattgagagatgaagaatggaggttgtttccaaaagaaataaagagaaacttagaagttgtctctgga

SEQ ID NO: 33788 - DNA, 1996 bp, Homo sapiens
aaaggggaccatgcggcgcctgactcgtcggctggttctgccagtcttcggggtgctctggatcacggtgctgctgttcttctgggtaaccaagaggaagttggaggtgccgacgggacctgaagtgcagacccctaagccttcggacgctgactgggacgacctgtgggaccagtttgatgagcggcggtatctgaatgccaaaaagtggcgcgttggtgacgacccctataagctgtatgctttcaaccagcgggagagtgagcggatctccagcaatcgggccatcccggacactcgccatctgagtgtattaaaccgcacccctacgcatctgatccgggaaatcatattagtggatgacttcagcaatgaccctgatgactgtaaacagctcatcaagttgcccaaggtgaaatgcttgcgcaataatgaacggcaaggtctggtccggtcccggattcggggcgctgacatcgcccagggcaccactctgactttcctcgacagccactgtgaggtgaacagggactggctccagcctctgttgcacagggtcaaagaggactacacgcgggtggtgtgccctgtgatcgatatcattaacctggacaccttcacctacatcgagtctgcctcggagctcagaggggggtttgactggagcctccacttccagtgggagcagctctccccagagcagaaggctcggcgcctggaccccacggagcccatcaggactcctatcatagctggagggctcttcgtgatcgacaaagcttggtttgattacctggggaaatatgatatggacatggacatctggggtggggagaactttgaaatctccttccgagtgtggatgtgcgggggcagcctagagatcgtcccctgcagccgagtggggcacgtcttccggaagaagcacccctacgttttccctgatggaaatgccaacacgtatataaagaacaccaagcggacagctgaagtgtggatggatgaatacaagcaatactattacgctgcccggccattcgccctggagaggcccttcgggaatgttgagagcagattggacctgaggaagaatctgcgctgccagagcttcaagtggtacctggagaatatctaccctgaactcagcatccccaaggagtcctccatccagaagggcaatatccgacagagacagaagtgcctggaatctcaaaggcagaacaaccaagaaaccccaaacctaaagttgagcccctgtgccaaggtcaaaggcgaagatgcaaagtcccaggtatgggccttcacatacacccagcagatcctccaggaggagctgtgcctgtcagtcatcaccttgttccctggcgccccagtggttcttgtcctttgcaagaatggagatgaccgacagcaatggaccaaaactggttcccacatcgagcacatagcatcccacctctgcctcgatacagatatgttcggtgatggcaccgagaacggcaaggaaatcgtcgtcaacccatgtgagtcctcactcatgagccagcactgggacatggtgagctcttgaggacccctgccagaagcagcaagggccatggggtggtgcttccctggaccagaacagactggaaactgggcagcaagcagcctgcaaccacctcagacatcctggactgggaggtggaggcagagccccccaggacaggagcaactgtctcagggaggacagaggaaaacatcacaagccaatggggctcaaagacaaatcccacatgttctcaaggccgttaagttccagtcctggccagtcattccctgattggtatctggagacagaaacctaatgggaagtgtttattgttccttttcctacaaaggaagcagtctctggaggccagaaagaaaagccttctttttcactaggccaggactacattgagagatgaagaatggaggttgtttccaaaagaaataaagagaaacttagaagttg

SEQ ID NO: 33789 - DNA, 2496 bp, Homo sapiens
actgaaaaattagctggtgcctgtatttcaggcttattgtttcctaggatctcagggagatcaggccacgtggtctgtggattaattaaggcacccagataattggctattaatagatggccaattgatggctgccagctgggtgctgaattgactaatgtccttatggtgggcaggtggtctttatcagaagaggagctagctgaaagactttactaattaaagggtgaatcaggaaaagaagataagaggtagcttttttccccaccacttggtgtgatgttttacagtttacaaagcatttatatccacagttgcctcatttgatccttactgcgactttgtgaggtttggtccttgtttttcaaggtggctgggatgagcccttgggcgcctcaggtgcctgtatcacccactcctccctaccaaagagggcatcttcctacaggaggacaccttgctgtatgtcatttcccatgtctcttgcaagaagctcagttccatttgcagactcaggtctttcttcaagtcagccttcggacgctgactgggacgacctgtgggaccagtttgatgagcggcggtatctgaatgccaaaaagtggcgcgttggtgacgacccctataagctgtatgctttcaaccagcgggagagtgagcggatctccagcaatcgggccatcccggacactcgccatctgagatgcacactgctggtgtattgcacggaccttccacccactagcatcatcatcaccttccacaacgaggcccgctccacgctgctcaggaccatccgcagtgtattaaaccgcacccctacgcatctgatccgggaaatcatattagtggatgacttcagcaatgaccctgatgactgtaaacagctcatcaagttgcccaaggtgaaatgcttgcgcaataatgaacggcaaggtctggtccggtcccggattcggggcgctgacatcgcccagggcaccactctgactttcctcgacagccactgtgaggtgaacagggactggctccagcctctgttgcacagggtcaaagaggactacacgcgggtggtgtgccctgtgatcgatatcattaacctggacaccttcacctacatcgagtctgcctcggagctcagaggggggtttgactggagcctccacttccagtgggagcagctctccccagagcagaaggctcggcgcctggaccccacggagcccatcaggactcctatcatagctggagggctcttcgtgatcgacaaagcttggtttgattacctggggaaatatgatatggacatggacatctggggtggggagaactttgaaatctccttccgagtgtggatgtgcgggggcagcctagagatcgtcccctgcagccgagtggggcacgtcttccggaagaagcacccctacgttttccctgatggaaatgccaacacgtatataaagaacaccaagcggacagctgaagtgtggatggatgaatacaagcaatactattacgctgcccggccattcgccctggagaggcccttcgggaatgttgagagcagattggacctgaggaagaatctgcgctgccagagcttcaagtggtacctggagaatatctaccctgaactcagcatccccaaggagtcctccatccagaagggcaatatccgacagagacagaagtgcctggaatctcaaaggcagaacaaccaagaaaccccaaacctaaagttgagcccctgtgccaaggtcaaaggcgaagatgcaaagtcccaggtatgggccttcacatacacccagcagatcctccaggaggagctgtgcctgtcagtcatcaccttgttccctggcgccccagtggttcttgtcctttgcaagaatggagatgaccgacagcaatggaccaaaactggttcccacatcgagcacatagcatcccacctctgcctcgatacagatatgttcggtgatggcaccgagaacggcaaggaaatcgtcgtcaacccatgtgagtcctcactcatgagccagcactgggacatggtgagctcttgaggacccctgccagaagcagcaagggccatggggtggtgcttccctggaccagaacagactggaaactgggcagcaagcagcctgcaaccacctcagacatcctggactgggaggtggaggcagagccccccaggacaggagcaactgtctcagggaggacagaggaaaacatcacaagccaatggggctcaaagacaaatcccacatgttctcaaggccgttaagttccagtcctggccagtcattccctgattggtatctggagacagaaacctaatgggaagtgtttattgttccttttcctacaaaggaagcagtctctggaggccagaaagaaaagccttctttttcactaggccaggactacattgagagatgaagaatggaggttgtttccaaaagaaataaagagaaacttagaagttgtctctgg

SEQ ID NO: 33790 - DNA, 1831 bp, Homo sapiens
gttcttctgggtaaccaagaggaagttggaggtgccgacgggacctgaagtgcagacccctaagaattgaaaacagtttgcagctgacacctgagcctacccatttcgttctgaatgcaatttcagcagcccactgtagctcccctgctctccctcccaggcatggaacagccatggcccaagatgagtcgtgtccaccttcggacgctgactgggacgacctgtgggaccagtttgatgagcggcggtatctgaatgccaaaaagtggcgcgttggtgacgacccctataagctgtatgctttcaaccagcgggagagtgagcggatctccagcaatcgggccatcccggacactcgccatctgagatgcacactgctggtgtattgcacggaccttccacccactagcatcatcatcaccttccacaacgaggcccgctccacgctgctcaggaccatccgcagtgtattaaaccgcacccctacgcatctgatccgggaaatcatattagtggatgacttcagcaatgaccctgatgactgtaaacagctcatcaagttgcccaaggtgaaatgcttgcgcaataatgaacggcaaggtctggtccggtcccggattcggggcgctgacatcgcccagggcaccactctgactttcctcgacagccactgtgaggtgaacagggactggctccagcctctgttgcacagggtcaaagaggactacacgcgggtggtgtgccctgtgatcgatatcattaacctggacaccttcacctacatcgagtctgcctcggagctcagaggggggtttgactggagcctccacttccagtgggagcagctctccccagagcagaaggctcggcgcctggaccccacggagcccatcaggactcctatcatagctggagggctcttcgtgatcgacaaagcttggtttgattacctggggaaatatgatatggacatggacatctggggtggggagaactttgaaatctccttccgagtgtggatgtgcgggggcagcctagagatcgtcccctgcagccgagtggggcacgtcttccggaagaagcacccctacgttttccctgatggaaatgccaacacgtatataaagaacaccaagcggacagctgaagtgtggatggatgaatacaagcaatactattacgctgcccggccattcgccctggagaggcccttcgggaatgttgagagcagattggacctgaggaagaatctgcgctgccagagcttcaagtggtacctggagaatatctaccctgaactcagcatccccaaggagtcctccatccagaagggcaatatccgacagagacagaagtgcctggaatctcaaaggcagaacaaccaagaaaccccaaacctaaagttgagcccctgtgccaaggtcaaaggcgaagatgcaaagtcccaggtatgggccttcacatacacccagcagatcctccaggaggagctgtgcctgtcagtcatcaccttgttccctggcgccccagtggttcttgtcctttgcaagaatggagatgaccgacagcaatggaccaaaactggttcccacatcgagcacatagcatcccacctctgcctcgatacagatatgttcggtgatggcaccgagaacggcaaggaaatcgtcgtcaacccatgtgagtcctcactcatgagccagcactgggacatggtgagctcttgaggacccctgccagaagcagcaagggccatggggtggtgcttccctggaccagaacagactggaaactgggcagcaagcagcctgcaaccacctcagacatcctg

SEQ ID NO: 33791 - DNA, 2169 bp, Homo sapiens
ctgaccgccggggggtgcccccgggacgtagcgccgcggagaggaagcggcaaaggggaccatgcggcgcctgactcgtcggctggttctgccagtcttcggggtgctctggatcacggtgctgctgttcttctgggtaaccaagaggaagttggaggtgccgacgggacctgaagtgcagacccctaaggtttggtccttgtttttcaaggtggctgggatgagcccttgggcgcctcaggtgcctgtatcacccactcctccctaccaaagagggcatcttcctacaggaggacaccttgctgtatgtcatttcccatgtctcttgcaagaagctcagttccatttgcagactcaggtctttcttcaagtcagatgcacactgctggtgtattgcacggaccttccacccactagcatcatcatcaccttccacaacgaggcccgctccacgctgctcaggaccatccgcagtgtattaaaccgcacccctacgcatctgatccgggaaatcatattagtggatgacttcagcaatgaccctgatgactgtaaacagctcatcaagttgcccaaggtgaaatgcttgcgcaataatgaacggcaaggtctggtccggtcccggattcggggcgctgacatcgcccagggcaccactctgactttcctcgacagccactgtgaggtgaacagggactggctccagcctctgttgcacagggtcaaagaggactacacgcgggtggtgtgccctgtgatcgatatcattaacctggacaccttcacctacatcgagtctgcctcggagctcagaggggggtttgactggagcctccacttccagtgggagcagctctccccagagcagaaggctcggcgcctggaccccacggagcccatcaggactcctatcatagctggagggctcttcgtgatcgacaaagcttggtttgattacctggggaaatatgatatggacatggacatctggggtggggagaactttgaaatctccttccgagtgtggatgtgcgggggcagcctagagatcgtcccctgcagccgagtggggcacgtcttccggaagaagcacccctacgttttccctgatggaaatgccaacacgtatataaagaacaccaagcggacagctgaagtgtggatggatgaatacaagcaatactattacgctgcccggccattcgccctggagaggcccttcgggaatgttgagagcagattggacctgaggaagaatctgcgctgccagagcttcaagtggtacctggagaatatctaccctgaactcagcatccccaaggagtcctccatccagaagggcaatatccgacagagacagaagtgcctggaatctcaaaggcagaacaaccaagaaaccccaaacctaaagttgagcccctgtgccaaggtcaaaggcgaagatgcaaagtcccaggtatgggccttcacatacacccagcagatcctccaggaggagctgtgcctgtcagtcatcaccttgttccctggcgccccagtggttcttgtcctttgcaagaatggagatgaccgacagcaatggaccaaaactggttcccacatcgagcacatagcatcccacctctgcctcgatacagatatgttcggtgatggcaccgagaacggcaaggaaatcgtcgtcaacccatgtgagtcctcactcatgagccagcactgggacatggtgagctcttgaggacccctgccagaagcagcaagggccatggggtggtgcttccctggaccagaacagactggaaactgggcagcaagcagcctgcaaccacctcagacatcctggactgggaggtggaggcagagccccccaggacaggagcaactgtctcagggaggacagaggaaaacatcacaagccaatggggctcaaagacaaatcccacatgttctcaaggccgttaagttccagtcctggccagtcattccctgattggtatctggagacagaaacctaatgggaagtgtttattgttccttttcctacaaaggaagcagtctctggaggccagaaagaaaagccttctttttcactaggccaggactacattgagagatgaagaatggaggttgtttccaaaagaaataaagagaaacttagaagttgtctctgga

SEQ ID NO: 33792 - DNA, 4454 bp, Homo sapiens
ccaccgcgcccgcggccggcccaggcagcactcgcgagcagcggcggccccgccggcggccgagttgggagaatgcggcggcgctcgcggatgctgctctgcttcgccttcctgtgggtgctgggcatcgcctactacatgtactcggggggcggctctgcgctggccgggggcgcgggcggcggcgccggcaggaaggaggactggaatgaaattgaccccattaaaaagaaagaccttcatcacagcaatggagaagagaaagcacaaagcatggagaccctccctccagggaaagtacggtggccagactttaaccaggaagcttatgttggagggacgatggtccgctccgggcaggacccttacgcccgcaacaagttcaaccaggtggagagtgataagcttcgaatggacagagccatccctgacacccggcatgaccagtgtcagcggaagcagtggcgggtggatctgccggccaccagcgtggtgatcacgtttcacaatgaagccaggtcggccctactcaggaccgtggtcagcgtgcttaagaaaagcccgccccatctcataaaagaaatcatcttggtggatgactacagcaatgatcctgaggacggggctctcttggggaaaattgagaaagtgcgagttcttagaaatgatcgacgagaaggcctcatgcgctcacgggttcggggggccgatgctgcccaagccaaggtcctgaccttcctggacagtcactgcgagtgtaatgagcactggctggagcccctcctggaaagggtggcggaggacaggactcgggttgtgtcacccatcatcgatgtcattaatatggacaactttcagtatgtgggggcatctgctgacttgaagggcggttttgattggaacttggtattcaagtgggattacatgacgcctgagcagagaaggtcccggcaggggaacccagtcgcccctataaaaacccccatgattgctggtgggctgtttgtgatggataagttctattttgaagaactggggaagtacgacatgatgatggatgtgtggggaggagagaacctagagatctcgttccgcgtgtggcagtgtggtggcagcctggagatcatcccgtgcagccgtgtgggacacgtgttccggaagcagcacccctacacgttcccgggtggcagtggcactgtctttgcccgaaacacccgccgggcagcagaggtctggatggatgaatacaaaaatttctattatgcagcagtgccttctgctagaaacgttccttatggaaatattcagagcagattggagcttaggaagaaactcagctgcaagcctttcaaatggtaccttgaaaatgtctatccagagttaagggttccagaccatcaggatatagcttttggggccttgcagcagggaactaactgcctcgacactttgggacactttgctgatggtgtggttggagtttatgaatgtcacaatgctgggggaaaccaggaatgggccttgacgaaggagaagtcggtgaagcacatggatttgtgccttactgtggtggaccgggcaccgggctctcttataaagctgcagggctgccgagaaaatgacagcagacagaaatgggaacagatcgagggcaactccaagctgaggcacgtgggcagcaacctgtgcctggacagtcgcacggccaagagcgggggcctaagcgtggaggtgtgtggcccggccctttcgcagcagtggaagttcacgctcaacctgcagcagtaggagggtccgggaggccctgccgtcctgtctcctgcaccattgggtggagtctggtgatcacattattgattatgtttcttaaactttccgcgaaactaatatacctcagtattccatcatggtctgaaagtcaaacttcggcaaggcacggacgactgtgcagacacagcagcggcaagaagcgagaactgccctccccctcctctcggtgcagcccagccgggcccccttccccaggccggagcgcccctcttccttccagctttcacttctgccggctccgcaactgagtgacacccagcgacaaccgactggggagtggtagaagcaactgaacggatgcgtgcgagctgaggacagggcgggaggagggggcacacatgccccaggggagcgaggagaactcttgaaatctccattttcaatcccttcgaaatcacgtatggtttccacaaagccgagtcgtgtcacgtggcaggtttacgtcaatagtccctctctctgctcctccattcgcaagtgtcttcctgggccagactcccctccacctcatgtacttgctatattgaggatgaagttttctatggtgggacactaaatataaagctatatagagaaagaatgtacggtcagttccctatggtttctgtagatcatcgtcatcttgtatattccccacaaagccgttcgcagcttccgggagaaggggccagagcccggtggggccagtttctcacagagggaggaggtggcctttgtcccctggagcccgatcagccagttggtgctactgctgtggccagctggggggcttcctccagaccaccggcctcggccccggcatccctgttgggcgtcagcctgagagtccctactgtgcgtcagaatccaccttgcgtgctgtgcgtatctgtgaacctggagcggttacttattttgacagatatcactttgggtctttttacattaaatttcttttctctaaggaatataagacataccccatagctctgtgtgagccagcaataccgctgccccctggcgacagggcagaccaatgatgccaggcagctgtcacacgctagtattggcttcattgtgatctgagccctgcacgctgggccttcagaattaatggccagcagtgtcagggatgagcccgtcagccagggcacaggcctggctcacagtcctgcacacctgctggcctggggagctccagccaggcagcgagtcctgccccgcccgcagctccctcccacaccccgcctggccaagatgactgcttcagggggctttggggaaagaattaggaagggtcagaaccaaacaatacctgctcatttacactgaggattcagggcgggagacaggagccttggggtcctgttaaaccacagacagttatgaactgaaagtcataacggggagaggtgcctggcttctacctgggtgctcaggaatgttcctcgtcacccctgccactctgtggtcggtgccctgcttcctcctccactcctggccgccttctccagcgccgcacacacagatgctcagtctcagagaggctggcacggcctggcagtctgagaaaagcgtcagttaggcacacctgcaggcccctcggtgggacagcggcggccttggagttaggagccaccctgggaggttgtgccggtgccatgctcctccctgtgtcttgtatgaaaggggccactgtgtgtcttcctccccggcgggagccccacatgtgtgcactgtaggacagcggccccgaggtggaagcctggctggagggctgccctataggtcttctcttcccgcctcccctgccatgcaaccagatgtgttgtgagtgggcagcgtgcccccacgctggagtaactccgcacgcttctgtctttcacggtgggcgctcggggggagcctgaggaaaacccccttaggtacctgtgcgaggctgtggagtgcaggccagagcagggtgtgcgtagcccccagcacccaggttcttctgtcagaccctgtgacctgcgagctgctactactgtaaggagggaaatggatgaatctggctcgttttaaaatcacgttttctgacgaatcctttgccccttcacctttaccccgcccgcacccctaggccctctcagccttcctatcatcccacgtgtctacccagacccttgtgcggcccatgccctgggggcggcgtcctgtccctgagctgggaggcggctttggatggtccgggcgtcaagagcaggggtgggccggggaggggtcctttgcggtgagctatgtttacatgacacagtgtgccaaagtgacttactgcggttgcgttagtttttaatcatcaggactatctcaccctcccactcctgtttttaaaactcagaattctttcctaagagcccttcgagcaaagcgtgccgaagttagttgtcttctctgtgctggtcctttcttatgtcctcataaaagctcagatgatggtatctgtgagtatgttttgcaaattcaaaatatagtttggtaatttttttttccagttgatttttaaaaagaactgctgtacagagcttgtactttgtccattttatagatggaaaccatccttgaaaattgtttaacttaaataaagagaagatactttctagata

SEQ ID NO: 33793 - DNA, 1341 bp, Homo sapiens
agttgggagaatgcggcggcgctcgcggatgctgctctgcttcgccttcctgtgggtgctgggcatcgcctactacatgtactcggggggcggctctgcgctggccgggggcgcgggcggcggcgccggcaggaagggaaagtacggtggccagactttaaccaggaagcttatgttggagggacgatggtccgctccgggcaggacccttacgcccgcaacaagttcaaccaggtggagagtgataagcttcgaatggacagagccatccctgacacccggcatgaccagtgtcagcggaagcagtggcgggtggatctgccggccaccagcgtggtgatcacgtttcacaatgaagccaggtcggccctactcaggaccgtggtcagcgtgcttaagaaaagcccgccccatctcataaaagaaatcatcttggtggatgactacagcaatgatcctgaggacggggctctcttggggaaaattgagaaagtgcgagttcttagaaatgatcgacgagaaggcctcatgcgctcacgggttcggggggccgatgctgcccaagccaaggtcctgaccttcctggacagtcactgcgagtgtaatgagcactggctggagcccctcctggaaagggtggcggaggacaggactcgggttgtgtcacccatcatcgatgtcattaatatggacaactttcagtatgtgggggcatctgctgacttgaagggcggttttgattggaacttggtattcaagtgggattacatgacgcctgagcagagaaggtcccggcaggggaacccagtcgcccctataaaagatctcgttccgcgtgtggcagtgtggtggcagcctggagatcatcccgtgcagccgtgtgggacacgtgttccggaagcagcacccctacacgttcccgggtggcagtggcactgtctttgcccgaaacacccgccgggcagcagaggtctggatggatgaatacaaaaatttctattatgcagcagtgccttctgctagaaacgttccttatggaaatattcagagcagattggagcttaggaagaaactcagctgcaagcctttcaaatggtaccttgaaaatgtctatccagagttaagggttccagaccatcaggatatagcttttggggccttgcagcagggaactaactgcctcgacactttgggacactttgctgatggtgtggttggagtttatgaatgtcacaatgctgggggaaaccaggaatgggccttgacgaaggagaagtcggtgaagcacatggatttgtgccttactgtggtggaccgggcaccgggctctcttataaagct

SEQ ID NO: 33794 - DNA, 1167 bp, Homo sapiens
actcgcgagcagcggcggccccgccggcggccgagttgggagaatgcggcggcgctcgcggatgctgctctgcttcgccttcctgtgggtgctgggcatcgcctactacatgtactcggggggcggctctgcgctggccgggggcgcgggcggcggcgccggcaggaaggaggactggaatgaaattgaccccattaaaaagaaagaccttcatcacagcaatggagctgaggacggggctctcttggggaaaattgagaaagtgcgagttcttagaaatgatcgacgagaaggcctcatgcgctcacgggttcggggggccgatgctgcccaagccaaggtcctgaccttcctggacagtcactgcgagtgtaatgagcactggctggagcccctcctggaaagggtggcggaggacaggactcgggttgtgtcacccatcatcgatgtcattaatatggacaactttcagtatgtgggggcatctgctgacttgaagggcggttttgattggaacttggtattcaagtgggattacatgacgcctgagcagagaaggtcccggcaggggaacccagtcgcccctataaaaacccccatgattgctggtgggctgtttgtgatggataagttctattttgaagaactggggaagtacgacatgatgatggatgtgtggggaggagagaacctagagatctcgttccgcgtgtggcagtgtggtggcagcctggagatcatcccgtgcagccgtgtgggacacgtgttccggaagcagcacccctacacgttcccgggtggcagtggcactgtctttgcccgaaacacccgccgggcagcagaggtctggatggatgaatacaaaaatttctattatgcagcagtgccttctgctagaaacgttccttatggaaatattcagagcagattggagcttaggaagaaactcagctgcaagcctttcaaatggtaccttgaaaatgtctatccagagttaagggttccagaccatcaggatatagcttttggggccttgcagcagggaactaactgcctcgacactttgggacactttgctgatggtgtggttggagtttatgaatgtcacgtggcaggtttacgtcaatagtccctctctctgctcctccattcgcaagtgtcttcctg

SEQ ID NO: 33795 - DNA, 2239 bp, Homo sapiens
aggcacacaaggaactggctaccggaggagctgcggggcgtcttgagaagaagcttaccctaaaggaaggtagcaaccacaggcaggaggggtaggaaatgggaaggggcattgctggggttaggtaagtgtcgtccggggctaggaggattccgctggctcctttccccaggacgaagggaggaaagggctctgatacaagagtgtacacgaacgaaaagcactggctggagatcatctatgtggaatgtggacagggcaaggtgcccgtagcccctatggctgacagagaggactggaatgaaattgaccccattaaaaagaaagaccttcatcacagcaatggagaagagaaagcacaaagcatggagaccctccctccagggaaagtacggtggccagactttaaccaggaagcttatgttggagggacgatggtccgctccgggcaggacccttacgcccgcaacaagttcaaccaggtggagagtgataagcttcgaatggacagagccatccctgacacccggcatgaccagtgtcagcggaagcagtggcgggtggatctgccggccaccagcgtggtgatcacgtttcacaatgaagccaggtcggccctactcaggaccgtggtcagcgtgcttaagaaaagcccgccccatctcataaaagaaatcatcttggtggatgactacagcaatgatcctgaggacggggctctcttggggaaaattgagaaagtgcgagttcttagaaatgatcgacgagaaggcctcatgcgctcacgggttcggggggccgatgctgcccaagccaaggtcctgaccttcctggacagtcactgcgagtgtaatgagcactggctggagcccctcctggaaagggtggcggaggacaggactcgggttgtgtcacccatcatcgatgtcattaatatggacaactttcagtatgtgggggcatctgctgacttgaagggcggttttgattggaacttggtattcaagtgggattacatgacgcctgagcagagaaggtcccggcaggggaacccagtcgcccctataaaaacccccatgattgctggtgggctgtttgtgatggataagttctattttgaagaactggggaagtacgacatgatgatggatgtgtggggaggagagaacctagagatctcgttccgcgtgtggcagtgtggtggcagcctggagatcatcccgtgcagccgtgtgggacacgtgttccggaagcagcacccctacacgttcccgggtggcagtggcactgtctttgcccgaaacacccgccgggcagcagaggtctggatggatgaatacaaaaatttctattatgcagcagtgccttctgctagaaacgttccttatggaaatattcagagcagattggagcttaggaagaaactcagctgcaagcctttcaaatggtaccttgaaaatgtctatccagagttaagggttccagaccatcaggatatagcttttggggccttgcagcagggaactaactgcctcgacactttgggacactttgctgatggtgtggttggagtttatgaatgtcacaatgctgggggaaaccaggaatgggccttgacgaaggagaagtcggtgaagcacatggatttgtgccttactgtggtggaccgggcaccgggctctcttataaagctgcagggctgccgagaaaatgacagcagacagaaatgggaacagatcgagggcaactccaagctgaggcacgtgggcagcaacctgtgcctggacagtcgcacggccaagagcgggggcctaagcgtggaggtgtgtggcccggccctttcgcagcagtggaagttcacgctcaacctgcagcagtaggagggtccgggaggccctgccgtcctgtctcctgcaccattgggtggagtctggtgatcacattattgattatgtttcttaaactttccgcgaaactaatatacctcagtattccatcatggtctgaaagtcaaacttcggcaaggcacggacgactgtgcagacacagcagcggcaagaagcgagaactgccctccccctcctctcggtgcagcccagccgggcccccttccccaggccggagcgcccctcttccttccagctttcacttctgccggctccgcaactgagtgacacccagcgacaaccgactggggagtggtagaagcaactgaacggatgcgtgcgagctgaggaca

SEQ ID NO: 33796 - DNA, 3868 bp, Homo sapiens
gctgaaccctgcccgaagaaaccacatgagccagcagttgctgccctcccgaagtggtcctcggaggcagcgcaccccttcattttggcgaaccgaggaggaagggaggaaccgtgtgggggaaatctagaacttctggttccccaaggacccagcagactgtgttctggctacaaggtgatcactgccaccaggtcagtgcaggattcctccaatgtagatgggccgggagccacaacttgcgcggagcagcagcctcgccgaccactcagagagaagccgcgcgacagccaggcttggcccggacggcgcccccaccctgcgcgcgcgatccaaggttctcacctggagcgctcaggtagggctggggcggggcgggaggctggcgcgcaggcgcggaagtggggcctcgcccctgccgacgtcgcaggctggagctcacctgggagactccaagtggaagccgagcctcggttctgcctctccaggcaacgcgggaggcccagcgggaaggcaggaggcggcggcggaggaggagctctactgagccgcaactgtggcgacagcaaccggagtcgcagccgccgccacctgcacctggcgcctagcccacgtccagcgcctgcccggccgccgcttcccgccaccctgccctgcccacccgccaggtactaccattaaagataccttcttctcagcaaatctatgataaaaaatataagtaacagaagaagaaataactgttatttgtcaagtgacaagcttttaatgtcagaatggctcacctaaagcgactagtaaaattacacattaaaagacattaccataaaaagttctggaagcttggtgcagtaatttttttctttataatagttttggttttaatgcaaagagaagtaagtgttcaatattccaaagaggaatcaaggatggaaaggaacatgaaaaacaaaaacaagatgttggatttaatgctagaagctgtaaacaatattaaggatgccatgccaaaaatgcaaataggagcacctgtcaggcaaaacattgatgctggtgagagaccttgtttgcaaggatattatacagcagcagaattgaagcctgtccttgaccgtccacctcaggattcaaatgcacctggtgcttctggtaaagcattcaagacaaccaatttaagtgttgaagagcaaaaggaaaaggaacgtggggaagctaaacactgctttaatgctttcgcaagtgacaggatttctttgcaccgagatcttggaccagacactcgacctcctgaatgtattgaacaaaaatttaagcgctgccctcccctgcccaccaccagtgtcataatagtttttcataatgaagcgtggtccacgttgcttagaactgtccacagtgtgctctattcttcacctgcaatactgctgaaggaaatcattttggtggatgatgctagtgtagatgagtacttacatgataaactagatgaatatgtaaaacaattttctatagtaaaaatagtcagacaaagagaaagaaaaggtctgatcactgctcggttgctaggagcaacagtcgcaacagctgaaacgctcacatttttagatgctcactgtgagtgtttctatggttggctagaacctctgttggccagaatagctgagaactacacggctgtcgtaagtccagatattgcatccatagatctgaacacgtttgaattcaacaaaccttctccttatggaagtaaccataaccgtggaaattttgactggagtctttcatttggctgggagtcgcttcctgatcatgagaagcaaagaaggaaagatgaaacctacccaattaaaacacccacttttgcaggaggacttttttccatatcaaaagaatattttgagtatattggaagctatgatgaagaaatggaaatctggggaggtgaaaatatagaaatgtctttcagagtatggcaatgtggtgggcagttggagattatgccttgctctgttgttggacatgtttttcgcagcaaaagccctcatagctttccaaaaggcactcaggtgattgctagaaaccaagttcgccttgcagaagtctggatggatgaatacaaggaaatattttataggagaaatacagatgcagcaaaaattgttaaacaaaaagcatttggtgatctttcaaaaagatttgaaataaaacaccgccttcagtgtaaaaattttacatggtatctgaacaacatttatccagaggtgtatgtgccagaccttaatcctgttatatctggatacattaaaagcgttggtcagcctctatgtctggatgttggagaaaacaatcaaggaggcaaaccattaattatgtatacatgtcatggacttgggggaaaccagtactttgaatactctgctcaacatgaaattcggcacaacatccagaaggaattatgtcttcatgctgctcaaggtctcgttcagctgaaggcatgtacctacaaaggtcacaagacagttgtcactggagagcagatatgggagatccagaaggatcaacttctatacaatccattcttaaaaatgtgcctttcagcaaatggagagcatccaagtttagtgtcatgcaacccatcagatccactccaaaaatggatacttagccaaaatgattaagtgttccttaaaattaagttgaaaaaggaaatattctttctcataaaactgtgactaggcatacactgtagtttttgaaaattatgcaaaagcagctaaatgtaacttattccaagtgcatttttcttatttatatctttatgtagcactactacagaaattctgcaagtttctgtttcaaagcacaataactagtaataccaaagactatttcaaaatgtccagatgtaggggaagagatgtttacagtatgatgaaaataattttccaagtaaagtgatgtttgtgtgttttgtacacttagggatatatatatatagctacattcacacactcacaatttaaaatatttcccctagttttttggggggataggaagaaagatttgttactgtatttttttaactacataaaaatagatcaataaatgtcagcattggcctctgtgtacaaaccaagagcttttacagatccagaatttattagtttaaaatgcaggtgaacttttttttgcgtttggtttacttgtctgtcaaatgtttccttaaacatgaaactgaataaggagaagagtatttttaacacttaaatttcttggcaaattttaaaacattttttagtctgtaatacactccacttgaagcacttaagtcttccttaaatgacttttcttaagtaatgatactgtgtgttttcccaaagcacttttaaaaaaatttttataaattactatctgttgaaaaggtgtccttttcctttcttctagtatttttttcttaccaaaattcactaatcttgaatgtttgtgatattaaatttcaaatgcagaatacttgactcatttaaagctaaattttgttactgattcaattataattgtaatggatttttgactttgtaatggattcttttcatcaaaaagccttatttttttatctatgtggaaaacacaataaaaaatcctcaacactattgtaatcatttggttaagtttttttcctcttttgggtaaaatctgtaattgataataggtgggggaaaatgaattttgtatgctgaatttctaagcgcctattgtttgtaaaaccatcagatatttcttatggcacaaaaaatgaggaatagcaaaattcctgtgttcaatatttagaaaattttgtattaatttctgataaagttccttaagcatc

SEQ ID NO: 33797 - DNA, 1954 bp, Homo sapiens
acatgagccagcagttgctgccctcccgaagtggtcctcggaggcagcgcaccccttcattttggcgaaccgaggaggaagggaggaaccgtgtgggggaaatctagaacttctggttccccaaggacccagcagactgtgttctggctacaaggtgatcactgccaccaggtcagtgcaggattcctccaatgtagatgggccgggagccacaacttgcgcggagcagcagcctcgccgaccactcagagagaagccgcgcgacagccaggcttggcccggacggcgcccccaccctgcgcgcgcgatccaaggttctcacctggagcgctcaggggttccttcaggagtcacaagtactattgggttggaaaatctgggagaataatagtttacttactgatgaaactgctgtattatcattcattaagctggagcagatcacagtttgagggtactaccattaaagataccttcttctcagcaaatctatgataaaaaatataagtaacagaagaagaaataactgttatttgtcaagtgacaagcttttaatgtcagaatggctcacctaaagcgactagtaaaattacacattaaaagacattaccataaaaagttctggaagcttggtgcagtaatttttttctttataatagttttggttttaatgcaaagagaagtaagtgttcaatattccaaagaggaatcaaggatggaaaggaacatgaaaaacaaaaacaagatgttggatttaatgctagaagctgtaaacaatattaaggatgccatgccaaaaatgcaaataggagcacctgtcaggcaaaacattgatgctggtgagagaccttgtttgcaaggatattatacagcagcagaattgaagcctgtccttgaccgtccacctcaggattcaaatgcacctggtgcttctggtaaagcattcaagacaaccaatttaagtgttgaagagcaaaaggaaaaggaacgtggggaagctaaacactgctttaatgctttcgcaagtgacaggatttctttgcaccgagatcttggaccagacactcgacctcctgaatgtattgaacaaaaatttaagcgctgccctcccctgcccaccaccagtgtcataatagtttttcataatgaagcgtggtccacgttgcttagaactgtccacagtgtgctctattcttcacctgcaatactgctgaaggaaatcattttggtggatgatgctagtgtagatgagtacttacatgataaactagatgaatatgtaaaacaattttctatagtaaaaatagtcagacaaagagaaagaaaaggtctgatcactgctcggttgctaggagcaacagtcgcaacagctgaaacgctcacatttttagatgctcactgtgagtgtttctatggttggctagaacctctgttggccagaatagctgagaactacacggctgtcgtaagtccagatattgcatccatagatctgaacacgtttgaattcaacaaaccttctccttatggaagtaaccataaccgtggaaattttgactggagtctttcatttggctgggagtcgcttcctgatcatgagaagcaaagaaggaaagatgaaacctacccaattaaaacacccacttttgcaggaggacttttttccatatcaaaagaatattttgagtatattggaagctatgatgaagaaatggaaatctggggaggtgaaaatatagaaatgtctttcagagtatggcaatgtggtgggcagttggagattatgccttgctctgttgttggacatgtttttcgcagcaaaagccctcatagctttccaaaaggcactcaggtgattgctagaaaccaagttcgccttgcagaagtctggatggatgaatacaaggaaatattttataggagaaatacagatgcagcaaaaattgttaaacaa

SEQ ID NO: 33798 - DNA, 559 bp, Homo sapiens
agtgtgtcggttgcccctggagagatcccgaaaggggcgccctgggccaaggggcaggtggcgcctcgggggggagcccggtcacaccctctcgcccacggtgcccccgccagtccctatggggcggcccctgaggagctggacggagaccaaagacctggggttccttcaggagtcacaagtactattgggttggaaaatctgggagaataatagtttacttactgatgaaactgctgtattatcattcattaagctggagcagatcacagtttgagggtactaccattaaagataccttcttctcagcaaatctatgataaaaaatataagtaacagaagaagaaataactgttatttgtcaagtgacaagcttttaatgtcagaatggctcacctaaagcgactagtaaaattacacattaaaagacattaccataaaaagttctggaagcttggtgcagtaatttttttctttataatagttttggttttaatgcaaagagaagtaagtgttcaatattccaaagaggaatcaaggatggaaaggaacatgaaaa

SEQ ID NO: 33799 - DNA, 536 bp, Homo sapiens
agctcacctgggagactccaagtggaagccgagcctcggttctgcctctccaggcaacgcgggaggcccagcgggaaggcaggaggcggcggcggaggaggagctctactgagccgcaactgtggcgacagcaaccggagtcgcagccgccgccacctgcacctggcgcctagcccacgtccagcgcctgcccggccgccgcttcccgccaccctgccctgcccacccgccaggggttccttcaggagtcacaagtactattgggttggaaaatctgggagaataatagtttacttactgatgaaactgctgtattatcattcattaagctggagcagatcacagtttgagggtactaccattaaagataccttcttctcagcaaatctatgataaaaaatataagtaacagaagaagaaataactgttatttgtcaagtgacaagcttttaatgtcagaatggctcacctaaagcgactagtaaaattacacattaaaagacattaccataaaaagttctggaagcttggtgcag

SEQ ID NO: 33800 - DNA, 540 bp, Homo sapiens
agcagttgctgccctcccgaagtggtcctcggaggcagcgcaccccttcattttggcgaaccgaggaggaagggaggaaccgtgtgggggaaatctagaacttctggttccccaaggacccagcagactgtgttctggctacaaggtgatcactgccaccaggtactaccattaaagataccttcttctcagcaaatctatgataaaaaatataagtaacagaagaagaaataactgttatttgtcaagtgacaagcttttaatgtcagaatggctcacctaaagcgactagtaaaattacacattaaaagacattaccataaaaagttctggaagcttggtgcagtaatttttttctttataatagttttggttttaatgcaaagagaagtaagtgttcaatattccaaagaggaatcaaggatggaaaggaacatgaaaaacaaaaacaagatgttggatttaatgctagaagctgtaaacaatattaaggatgccatgccaaaaatgcaaataggagcacctgtcaggcaaaacatt

SEQ ID NO: 33801 - DNA, 570 bp, Homo sapiens
actggctatcgcggctcatagtatgtaatcgtttcctaaaaagtcctatttttcttttcctttgctcctgttgtcccatattagggtttaataaacttgctgtcctgttcttagggtcaattgcaagcaatattttatcaaaccaaattctgcttttttaactttatgacttctataggctccctacagacacttcaagtaaagctaatgaattctctttttactattagatcttgtatttctgtgagctattaaaactagctgttatataacaacaaattaaatgctgttgattttcttgtttttaggggttccttcaggagtcacaagtactattgggttggaaaatctgggagaataatagtttacttactgatgaaactgctgtattatcattcattaagctggagcagatcacagtttgagggtactaccattaaagataccttcttctcagcaaatctatgataaaaaatataagtaacagaagaagaaataactgttatttgtcaagtgacaagcttttaatgtcagaatggctcacctaaagcgactagtaaaattacacat

SEQ ID NO: 33802 - DNA, 5399 bp, Homo sapiens
gttggctggagagtttgtgaaaagttgtgagccgagcaggaggaagtagggagagaggagttgggctgtgccggaggccgaggaccgagagggctcaggtgacccctggaaagcctgggtggctggaaaggagcctagcgcctgcatgaaaggaagaacctgctgggaagtacctgagctcgagctgtgggttccgccgcccttcccctgcgtggtggcttggtggccgcgtctgcgcctcagccctgagaatccggatggcggtgaggtggacttgggcaggcaagagctgcctgctgctggcgtttttaacagtggcctatatcttcgtggagctcttggtctctacttttcatgcctccgcaggagccggccgtgccagggagctggggtcaagaaggctctcagacctccagaaaaatacggaggatttgtctcgaccgctttataagaagccccctgcagattcccgtgcacttggggagtgggggaaagccagcaaactccagctcaacgaggatgaactgaagcagcaagaagaactcattgagagatacgccatcaatatttacctcagtgacaggatttccctgcatcgacacatagaggataaaagaatgtatgagtgtaagtcccagaagttcaactataggacacttcctaccacctctgttatcattgctttctataacgaagcctggtcgactttgctccgtaccattcacagtgttttagaaacttctcctgcagttcttttgaaagagatcatcttggtggatgacttgagtgacagagtttatttgaagacacaacttgaaacttacatcagcaatcttgatagagtacgcttgattaggaccaataagcgagaggggctggttagggcccgtctgattggggccactttcgccactggggacgtcctcactttcctggattgtcactgtgagtgtaattccggttggctggaaccgcttttggaaaggattgggagagatgaaacagcagttgtgtgtcctgttatagacacaattgattggaatacttttgaattctatatgcagataggggagcccatgattggtgggtttgactggcgtttaacatttcagtggcattctgtccccaaacaggaaagggacaggcggatatcaagaattgaccccatcagatcacctaccatggctggaggactgtttgctgtcagcaagaaatattttcagtaccttggaacgtatgacacaggaatggaagtgtggggaggtgaaaaccttgagctgtcttttagggtgtggcagtgtggtggcaaattggagatccacccgtgttcccacgtgggccatgtgttccccaagcgggcaccatatgctcgccccaatttcctacagaatactgctcgggcagcagaagtttggatggatgaatacaaagagcacttctacaatagaaaccctccagcaagaaaagaagcttatggtgatatttctgaaagaaaattactacgagagcggttgagatgcaagagctttgactggtatttgaaaaacgtttttcctaatttacatgttccagaggatagaccaggctggcatggggctattcgcagtagagggatctcgtctgaatgtttagattataattctcctgacaacaaccccacaggtgctaacctttcactgtttggatgccatggtcaaggaggcaatcaattctttgaatatacttcaaacaaagaaataaggtttaattctgtgacagagttatgtgcagaggtacctgagcaaaaaaattatgtgggaatgcaaaattgtcccaaagatgggttccctgtaccagcaaacattatttggcattttaaagaagatggaactatttttcacccacactcaggactgtgtcttagtgcttatcggacaccggagggccgacctgatgtacaaatgagaacttgtgatgctctagataaaaatcaaatttggagttttgagaaatagagcacaacagcactttcgtcatgagctgacagtagtgtcaagaaagtcaaagagccttaagagcctcagtgaagattgtattttattttatcaaaagccacctagcagtcatctgtggagcactggaaagctggggttcattttggtatatcacactgaaactgggtacccagagtgctgctgtttaatatttcacaatgccttacttattggttgttttatataagagttttgtcaatatggtctcttcttaaaagaagttgactatgaattgaaacacacaaaacatttaagtgccagacttaatattaaagaatgtaaaggtccaagtaaaatgaggtatgatttatgttgatgtgtaagttcaccgcacatcccactttttaacaaaactcatgaatgtgcagtttgagccattgctattttgattacatagaatttgtatttcttttttagccagcacattaaattttagattttattttttaatctaatttttttctaatcaaaaagaaaattgagcttaaggcaaaaggcctggttttagagatatgtgtaattggaagagggcatttgtttgagtgtgagtttggaggcctttttaacatgcagacatacccatatttaaatgaaatggggagatatttacattccgtactttgtaaacttgagctattggacttcactgatgtatatattaatacctcagattcctctgattttgtaagctgtcttctctgtgaacgtgtttgtgtgtgtagggcattttctgattgcacttccttaagttatgaatgtactagaaagggactcatccagaatactatgcctccctttgttaatgcttaatcatttaaagtaaacacaattgaagcctctctgaagttaaacccaactatgtttattaaaatgtgtgaaactgaaagtgggctaggttctaccaaggctgtggaactctcctacgagttctgctgatcaggaaatttaagaatttatcttaaaaatgcaaggaaaaaagactgccttggcaattgtgaatggtgctttcaatctcctagcaccgagcctggcacttaggcagctttcagtaagtgggtgaatgaatgactgaatgaatgaatgaatggctcagctgaggaatgtaactttggtcaagttattatgatgtgtttgggcttagttttctcattggtaaaatgtgggtgctggattggatcttaaagatcccttccagctctgaaatgctgattgtacagtatattcttcccagattgactcactgtgcaatctttacaatactttttatcttttcacttttgacataggtaatgttgttgagcagttgagcaatgttcagtccagttgtgaagctggagaagagaaatgggttttaaaaattaagtgaggggaggccgggtgcggtggctcacgcatgtaatcccagcactttgggaggccaaggcaggtggatcacgaggtcaggagatccagaccatcctggctaacatggtgaaacctcgtctctactaaaaatacaaaaaattagccagctgtggtggcgggcgcctgtagtcccagctactcaggaggctgaggcaggagaatggcgtgaacctgtgaggcagagcttacagtgagccgagatcgtgccactgcactccagcctgggcgacagagcaagactctgtctcaaaaaaaaaaaataataataaaataagtgagctgaactcacctgaagtggtttacttctgtgggttaagaagttctagtcagtgttcatagtcgtttcgttttgataattgttgaaccaattttgtttttaaaacctttagactctgaaagtaatattttgactaagaatgtaaatatttccaaactaaattactcgggaagtaaacgctttttttaaaagtatttttactggttttataccaatattatatgcagaaatcacaggatgaatttagaattaaatctcaattagttcactttggcctagatttatgaaaaatgcatgcctcgtaaagagtccactgtattcacgagtaaagttgcttttagtgttcacttgatgacttggagagtaggaattttgcaaaatctgaatttaaggaaattctttaggataaccatttcaaaaaataaaattgctatgcaatcttgaatattttctcttttgcctcgtaaaatgaaaatgcattcacagtttctgtaaattatttagcagccttaaagtttatcaaaaaattgtccagattccacgtgcagcatgcttggccctgcatttaatttaagaaggattaataataatgctctgaatttttcgaaagggattctcctaaacccacccacttctcttgcccaggctgctttttaaaaatatttttttattttttacttatttttaaattttctctttttatttatttttggttttcttgttagccacctgttatatgggagaacgaaaattgttatattttgaaagtacttattacattatttttattttagtatcttgatgctcctgtcaaaagggaaatgaggcttttaaaaataaagtaccttaattctttattgactttttgccctaaattgctaggtgtgacccagcaatcttttaggaagagattttacagtggtgctttatttatatcaataatccagtatagttaggctgttcattcctcataatagagtacataacagaaaagtgggactttcacattttcatatttaggcacgttccaatttaattccaaaaatactctgtaattctacatctaaaaaaaccgattccctaattcgaatttattggtaccaaagctctctttggctatagacaattaagagttgaccttttaagttaatgtatatgcttaaaaacagttttaggaaaatatttggtagacaaagagtttcaactttaaatgttcactatgtcatttagtgtccaactttacggataggttgactatctaaataggcatttttagtcattaaaaaaaatctagtcaccaggaggatccctatgactcaaaataacttgtttgtaaaagaaaatttgtttacttacccattagtaagttcctgcatattcattataagatggcaaatcaaacttttctaggatgaagacagcttatttttaagttgtatagtcttagttggtttagggtctcaattttaattaataaaatacttggtttttatttgcttgtccttttgaattcctgttttaataattttaaaatgagcacaaagaacgttgaagttcagattaatctcttctgaatgatgtttttttcctctgtgatgagttgtttctgacttttttccttttgtatttgtaatgttgattaagatgtaaaataaaaagtgtgcctgattatttttgcaaataga

SEQ ID NO: 33803 - DNA, 4520 bp, Homo sapiens
ccaggctggtccctcctgccttcgctctctgctggtcgcggtggcctgtagctcctccctcggtaggacccccctccaccttggcgcttacgagatgaatgaggagcccagacctctggaacttggagggttgttcagattcccaggctgacaaaaaggagaaacagcttttacttgcatccagggccaatcatcgcagacccagacgtctgcagagggctgaggccccagcttgtggccaccacaacgtatcaagctatctccagggttgggctcaggactcagagctgacgcagctggggtgccccttggttctggaggatgaggctcctccgcagacgccacatgcccctgcgcctggccatggtgggctgcgcctttgtgctcttcctcttcctcctgcatagggatgtgagcagcagagaggaggccacagagaagccgtggctgaagtccctggtgagccggaaggatcacgtcctggacctcatgctggaggccatgaacaaccttagagattcaatgcccaagctccaaatcagggctccagaagcccagcagactctgttctccataaaccagtcctgcctccctgggttctataccccagctgaactgaagcccttctgggaacggccaccacaggaccccaatgcccctggggcagatggaaaagcatttcagaagagcaagtggacccccctggagacccaggaaaaggaagaaggctataagaagcactgtttcaatgcctttgccagcgaccggatctccctgcagaggtccctggggccagacacccgaccacctgagtgtgtggaccagaagttccggcgctgccccccactggccaccaccagcgtgatcattgtgttccacaacgaagcctggtccacactgctgcgaacagtgtacagcgtcctacacaccacccctgccatcttgctcaaggagatcatactggtggatgatgccagcacagaggagcacctaaaggagaagctggagcagtacgtgaagcagctgcaggtggtgagggtggtgcggcaggaggagcggaaggggctgatcaccgcccggctgctgggggccagcgtggcacaggcggaggtgctcacgttcctggatgcccactgtgagtgcttccacggctggctggagcccctcctggctcgaatcgctgaggacaagacagtggtggtgagcccagacatcgtcaccatcgaccttaatacttttgagttcgccaagcccgtccagaggggcagagtccatagccgaggcaactttgactggagcctgaccttcggctgggaaacacttcctccacatgagaagcagaggcgcaaggatgaaacctaccccatcaaatccccgacgtttgctggtggcctcttctccatctccaagtcctactttgagcacatcggtacctatgataatcagatggagatctggggaggggagaacgtggaaatgtccttccgggtgtggcagtgtgggggccagctggagatcatcccctgctctgtcgtaggccatgtgttccggaccaagagcccccacaccttccccaagggcactagtgtcattgctcgcaatcaagtgcgcctggcagaggtctggatggacagctacaagaagattttctataggagaaatctgcaggcagcaaagatggcccaagagaaatccttcggtgacatttcggaacgactgcagctgagggaacaactgcactgtcacaacttttcctggtacctgcacaatgtctacccagagatgtttgttcctgacctgacgcccaccttctatggtgccatcaagaacctcggcaccaaccaatgcctggatgtgggtgagaacaaccgcggggggaagcccctcatcatgtactcctgccacggccttggcggcaaccagtactttgagtacacaactcagagggaccttcgccacaacatcgcaaagcagctgtgtctacatgtcagcaagggtgctctgggccttgggagctgtcacttcactggcaagaatagccaggtccccaaggacgaggaatgggaattggcccaggatcagctcatcaggaactcaggatctggtacctgcctgacatcccaggacaaaaagccagccatggccccctgcaatcccagtgacccccatcagttgtggctctttgtctaggacccagatcatccccagagagagcccccacaagctcctcaggaaacaggattgctgatgtctgggaacctgatcaccagcttctctggaggccgtaaagatggatttctaaacccactgggtggcaaggcaggaccttcctaatccttgcaacaacattgggcccattttctttccttcacaccgatggaagagaccattaggacatatatttagcctagcgttttcctgttctagaaatagaggctcccaaagtagggaaggcagctgggggagggttcagggcagcaatgctgagttcaagaaaagtacttcaggctgggcacagtggctcatgcctgaaatcctagcactttgggaagacaatgtgggagaatggcttgagcccaggagttcaagaccggcctgagcaacatagtgaggatcccatctctacgcccaccctccccccggcaaaaaaaaaaagctgggtatggtggcttatgcctgtagtcgcagctactcagaaggctgaggtgggaggattgcttgttccccggaggttgaagctacagtgagccttgattgtgtcactgcactccagcctgggcaacaggtaagactctgtctcaaaaaaaaacaaaaaagaagaagaaaagtacttctacagccatgtcctattccttgatcatccaaagcacctgcagagtccagtgaaatgatatattctggctgggcacagtggctcacacctgtaatcctagcactttgggaggccaaggcaggtggatcacctgaggtcagaagtttgaaaccagcctggactacatggtgaaactccatctctactaaaagtacaaaaattagctgggcatgatggcacgcacctgcagtcccagctacttgggaggctgaggcaggagaatcactcgaacccaggaggcagaggttgcagtgagccaagacagcaccattgcaccccagcctgagcaacaagagcgaaactccatctcaggaaaaaaaaaaaaaaaaaaagtatattctaacagacagatcagaggtctaagagatcctcccttgctattattacctgaagtctgtagaactgtttacagatatctccttgacaggtgtcctttatcttactttatctgtacagtaatcctgtgagaaagacaggacagaaaccactgtgcctattttacagatacgaaaactgagacacaggtaaaggggcttgtctgtagtcccatagctagcagatggctggagccaagactgaggctcgttcttcaatgctgagccagggctccttccgctgcaccacaagaacgctagaccactcgccaccagccttctcattccctcttcctccattctaatcatttctagctggctggcctccacagagcataggaaaacagccagggccgggcacggtggctcatgcctgtaatctcaacactctgggaggccgagccgggtggataacctgaggtcaggaattcgagaccagcctggccaacatggtaaaaccccatctctactaaaaatataaaaattagccaggcatggtggcgcacacctgtaatcccagctactcaagaggctgaggcaggagaattgcttaaatctgggaggcggaagttgcagtgagccaagatcgcgccactgaactccagcctaggcaacaagagcaaaactccatctccaaaaaaaagaaaggaaaaacagggccaggtagccattgtggagagagcacacttaggaatcctgggatgttagtgttaaaagaaagctcctggagccagtgattctcaggtttgtcccagaacccttttttctaagccccatataaaaggtagattaaaaaaacaaagtagcatgagtgaaattgagagagggacaggtaatgccttccagcccctaacttctaacaatctggaagcacaacgtgaaaatcacgtagcccaaccctatcattttcatattatgaaactgagtccaggtaagtgaatctgtccaaggtcacccagcaaggtatcagtagccctgagggtaaggactctgataaggctcgggagggtcctggaaagcctgaggcggcaggaagagtgtgcagagttgagcgtgtctggaaggctgatccactgctgggcccacatcaaagcccccatggggagcagacccgactgcacatggctcttttgctggaagaagagcatggctgcgcagaggactaaaatttcatctgggaaggcttcttttgactgtcagtagcaggatgtcaccagatgagggtgctatgggaccacagctgtctttgttcccattgcaactcaaccctgcgg

SEQ ID NO: 33804 - DNA, 4556 bp, Homo sapiens
aacaggccctgctgtgagggaccacgaggcagtgccaggatgaaagagttggagtaacctaggtgattctgagtgaatcagtcaggaggccttcctggagggggctgaggccccagcttgtggccaccacaacgtatcaagctatctccagggttgggctcaggactcagagctgacgcagctggggtgccccttggttctggaggatgaggctcctccgcagacgccacatgcccctgcgcctggccatggtgggctgcgcctttgtgctcttcctcttcctcctgcatagggatgtgagcagcagagaggaggccacagagaagccgtggctgaagtccctggtgagccggaaggatcacgtcctggacctcatgctggaggccatgaacaaccttagagattcaatgcccaagctccaaatcagggctccagaagcccagcagactctgttctccataaaccagtcctgcctccctgggttctataccccagctgaactgaagcccttctgggaacggccaccacaggaccccaatgcccctggggcagatggaaaagcatttcagaagagcaagtggacccccctggagacccaggaaaaggaagaaggctataagaagcactgtttcaatgcctttgccagcgaccggatctccctgcagaggtccctggggccagacacccgaccacctgagtgtgtggaccagaagttccggcgctgccccccactggccaccaccagcgtgatcattgtgttccacaacgaagcctggtccacactgctgcgaacagtgtacagcgtcctacacaccacccctgccatcttgctcaaggagatcatactggtggatgatgccagcacagaggagcacctaaaggagaagctggagcagtacgtgaagcagctgcaggtggtgagggtggtgcggcaggaggagcggaaggggctgatcaccgcccggctgctgggggccagcgtggcacaggcggaggtgctcacgttcctggatgcccactgtgagtgcttccacggctggctggagcccctcctggctcgaatcgctgaggacaagacagtggtggtgagcccagacatcgtcaccatcgaccttaatacttttgagttcgccaagcccgtccagaggggcagagtccatagccgaggcaactttgactggagcctgaccttcggctgggaaacacttcctccacatgagaagcagaggcgcaaggatgaaacctaccccatcaaatccccgacgtttgctggtggcctcttctccatctccaagtcctactttgagcacatcggtacctatgataatcagatggagatctggggaggggagaacgtggaaatgtccttccgggtgtggcagtgtgggggccagctggagatcatcccctgctctgtcgtaggccatgtgttccggaccaagagcccccacaccttccccaagggcactagtgtcattgctcgcaatcaagtgcgcctggcagaggtctggatggacagctacaagaagattttctataggagaaatctgcaggcagcaaagatggcccaagagaaatccttcggtgacatttcggaacgactgcagctgagggaacaactgcactgtcacaacttttcctggtacctgcacaatgtctacccagagatgtttgttcctgacctgacgcccaccttctatggtgccatcaagaacctcggcaccaaccaatgcctggatgtgggtgagaacaaccgcggggggaagcccctcatcatgtactcctgccacggccttggcggcaaccagtactttgagtacacaactcagagggaccttcgccacaacatcgcaaagcagctgtgtctacatgtcagcaagggtgctctgggccttgggagctgtcacttcactggcaagaatagccaggtccccaaggacgaggaatgggaattggcccaggatcagctcatcaggaactcaggatctggtacctgcctgacatcccaggacaaaaagccagccatggccccctgcaatcccagtgacccccatcagttgtggctctttgtctaggacccagatcatccccagagagagcccccacaagctcctcaggaaacaggattgctgatgtctgggaacctgatcaccagcttctctggaggccgtaaagatggatttctaaacccactgggtggcaaggcaggaccttcctaatccttgcaacaacattgggcccattttctttccttcacaccgatggaagagaccattaggacatatatttagcctagcgttttcctgttctagaaatagaggctcccaaagtagggaaggcagctgggggagggttcagggcagcaatgctgagttcaagaaaagtacttcaggctgggcacagtggctcatgcctgaaatcctagcactttgggaagacaatgtgggagaatggcttgagcccaggagttcaagaccggcctgagcaacatagtgaggatcccatctctacgcccaccctccccccggcaaaaaaaaaaagctgggtatggtggcttatgcctgtagtcgcagctactcagaaggctgaggtgggaggattgcttgttccccggaggttgaagctacagtgagccttgattgtgtcactgcactccagcctgggcaacaggtaagactctgtctcaaaaaaaaacaaaaaagaagaagaaaagtacttctacagccatgtcctattccttgatcatccaaagcacctgcagagtccagtgaaatgatatattctggctgggcacagtggctcacacctgtaatcctagcactttgggaggccaaggcaggtggatcacctgaggtcagaagtttgaaaccagcctggactacatggtgaaactccatctctactaaaagtacaaaaattagctgggcatgatggcacgcacctgcagtcccagctacttgggaggctgaggcaggagaatcactcgaacccaggaggcagaggttgcagtgagccaagacagcaccattgcaccccagcctgagcaacaagagcgaaactccatctcaggaaaaaaaaaaaaaaaaaaagtatattctaacagacagatcagaggtctaagagatcctcccttgctattattacctgaagtctgtagaactgtttacagatatctccttgacaggtgtcctttatcttactttatctgtacagtaatcctgtgagaaagacaggacagaaaccactgtgcctattttacagatacgaaaactgagacacaggtaaaggggcttgtctgtagtcccatagctagcagatggctggagccaagactgaggctcgttcttcaatgctgagccagggctccttccgctgcaccacaagaacgctagaccactcgccaccagccttctcattccctcttcctccattctaatcatttctagctggctggcctccacagagcataggaaaacagccagggccgggcacggtggctcatgcctgtaatctcaacactctgggaggccgagccgggtggataacctgaggtcaggaattcgagaccagcctggccaacatggtaaaaccccatctctactaaaaatataaaaattagccaggcatggtggcgcacacctgtaatcccagctactcaagaggctgaggcaggagaattgcttaaatctgggaggcggaagttgcagtgagccaagatcgcgccactgaactccagcctaggcaacaagagcaaaactccatctccaaaaaaaagaaaggaaaaacagggccaggtagccattgtggagagagcacacttaggaatcctgggatgttagtgttaaaagaaagctcctggagccagtgattctcaggtttgtcccagaacccttttttctaagccccatataaaaggtagattaaaaaaacaaagtagcatgagtgaaattgagagagggacaggtaatgccttccagcccctaacttctaacaatctggaagcacaacgtgaaaatcacgtagcccaaccctatcattttcatattatgaaactgagtccaggtaagtgaatctgtccaaggtcacccagcaaggtatcagtagccctgagggtaaggactctgataaggctcgggagggtcctggaaagcctgaggcggcaggaagagtgtgcagagttgagcgtgtctggaaggctgatccactgctgggcccacatcaaagcccccatggggagcagacccgactgcacatggctcttttgctggaagaagagcatggctgcgcagaggactaaaatttcatctgggaaggcttcttttgactgtcagtagcaggatgtcaccagatgagggtgctatgggaccacagctgtctttgttcccattgcaactcaaccctgcgggaggccgcctacatccctgagagccttctggagcctacagaggagacattggccagccaaaaggaaaggagtggccagggtacgacctggagtagggaagggaaaaagttcccggaaagaagagaattggatgagaggtctcagtggaaat

SEQ ID NO: 33805 - DNA, 2543 bp, Homo sapiens
aaacccgggagccaccccgcggcgcggctgcggctttgcctcggcgcgacagggaaaataaaagaagcaaaaacaggccctgctgtgagggaccacgaggcagtgccaggatgaaagagttggagtaacctaggtgattctgagtgaatcagtcaggaggccttcctggagggggctgaggccccagcttgtggccaccacaacgtatcaagctatctccagggttgggctcaggactcagagctgacgcagctggggtgccccttggttctggaggatgaggctcctccgcagacgccacatgcccctgcgcctggccatggtgggctgcgcctttgtgctcttcctcttcctcctggtgagccggaaggatcacgtcctggacctcatgctggaggccatgaacaaccttagagattcaatgcccaagctccaaatcagggctccagaagcccagcagactctgttctccataaaccagtcctgcctccctgggttctataccccagctgaactgaagcccttctgggaacggccaccacaggaccccaatgcccctggggcagatggaaaagcatttcagaagagcaagtggacccccctggagacccaggaaaaggaagaaggctataagaagcactgtttcaatgcctttgccagcgaccggatctccctgcagaggtccctggggccagacacccgaccacctgagtgtgtggaccagaagttccggcgctgccccccactggccaccaccagcgtgatcattgtgttccacaacgaagcctggtccacactgctgcgaacagtgtacagcgtcctacacaccacccctgccatcttgctcaaggagatcatactggtggatgatgccagcacagaggagcacctaaaggagaagctggagcagtacgtgaagcagctgcaggtggtgagggtggtgcggcaggaggagcggaaggggctgatcaccgcccggctgctgggggccagcgtggcacaggcggaggtgctcacgttcctggatgcccactgtgagtgcttccacggctggctggagcccctcctggctcgaatcgctgaggacaagacagtggtggtgagcccagacatcgtcaccatcgaccttaatacttttgagttcgccaagcccgtccagaggggcagagtccatagccgaggcaactttgactggagcctgaccttcggctgggaaacacttcctccacatgagaagcagaggcgcaaggatgaaacctaccccatcaaatccccgacgtttgctggtggcctcttctccatctccaagtcctactttgagcacatcggtacctatgataatcagatggagatctggggaggggagaacgtggaaatgtccttccgggtgtggcagtgtgggggccagctggagatcatcccctgctctgtcgtaggccatgtgttccggaccaagagcccccacaccttccccaagggcactagtgtcattgctcgcaatcaagtgcgcctggcagaggtctggatggacagctacaagaagattttctataggagaaatctgcaggcagcaaagatggcccaagagaaatccttcggtgacatttcggaacgactgcagctgagggaacaactgcactgtcacaacttttcctggtacctgcacaatgtctacccagagatgtttgttcctgacctgacgcccaccttctatggtgccatcaagaacctcggcaccaaccaatgcctggatgtgggtgagaacaaccgcggggggaagcccctcatcatgtactcctgccacggccttggcggcaaccagtactttgagtacacaactcagagggaccttcgccacaacatcgcaaagcagctgtgtctacatgtcagcaagggtgctctgggccttgggagctgtcacttcactggcaagaatagccaggtccccaaggacgaggaatgggaattggcccaggatcagctcatcaggaactcaggatctggtacctgcctgacatcccaggacaaaaagccagccatggccccctgcaatcccagtgacccccatcagttgtggctctttgtctaggacccagatcatccccagagagagcccccacaagctcctcaggaaacaggattgctgatgtctgggaacctgatcaccagcttctctggaggccgtaaagatggatttctaaacccactgggtggcaaggcaggaccttcctaatccttgcaacaacattgggcccattttctttccttcacaccgatggaagagaccattaggacatatatttagcctagcgttttcctgttctagaaatagaggctcccaaagtagggaaggcagctgggggagggttcagggcagcaatgctgagttcaagaaaagtacttcaggctgggcacagtggctcatgcctgaaatcctagcactttgggaagacaatgtgggagaatggcttgagcccaggagttcaagaccggcctgagcaacatagtgaggatcccatctctacgcccaccctccccccggc

SEQ ID NO: 33806 - DNA, 4307 bp, Homo sapiens
agagccggaggagggggaaggagggaggggagagcggtggcggcggctgcgccgggctgtgagtctctcgccgccggaggaagatgaggctgaagattgggttcatcttacgcagtttgctggtggtgggaagcttcctggggctagtggtcctctggtcttccctgaccccgcggccggacgacccaagcccgctgagcaggatgagggaagacagagatgtcaatgaccccatgcccaaccgaggcggcaatggactagctcctggggaggacagattcaaacctgtggtaccatggcctcatgttgaaggagtagaagtggacttagagtctattagaagaataaacaaggccaaaaatgaacaagagcaccatgctggaggagattcccagaaagatatcatgcagaggcagtatctcacatttaagcctcagacattcacctaccatgatcctgtgcttcgcccagggatcctcggtaactttgaacccaaagaacctgagcctcctggagtggttggtggccctggagagaaagccaagccattggttttgggaccagaattcaaacaagcaattcaagccagcattaaagagtttggatttaacatggtggcaagtgacatgatctcactggaccgcagcgtcaatgacttacgccaagaagaatgcaagtattggcattatgatgaaaacttgctcacttcgagcgttgtcattgtcttccataatgaaggatggtcaaccctcatgagaacagtccacagtgtaattaaaaggactccaaggaaatatttagcagaaattgtgttaattgacgatttcagtaataaagaacacttaaaagaaaaactggatgaatatattaagctgtggaatggcctagtgaaggtatttcgaaatgaaagaagggaaggtttaattcaagcacgaagtattggtgctcagaaggctaaacttggacaggttttgatataccttgatgcccactgtgaggtggcagttaactggtatgcaccacttgtagctcccatatctaaggacagaaccatttgcactgtgccgcttatagatgtcataaatggcaacacatatgaaattataccccaagggggtggtgatgaagatgggtatgcccgaggagcatgggattggagtatgctctggaaacgggtgcctctgacccctcaagagaagagactgagaaagacaaaaactgaaccgtatcggtccccagccatggctgggggattatttgccattgaacgagagttcttctttgaattgggtctctatgatccaggtctccagatttggggtggtgaaaactttgagatctcatacaagatatggcagtgtggtggcaaattattatttgttccttgttctcgtgttggacatatctaccgtcttgagggctggcaaggaaatcctccgcccatttatgttgggtcttctccaactctgaagaattatgttagagttgtggaggtttggtgggatgaatataaagactacttctatgctagtcgtcctgaatcgcaggcattaccatatggggatatatcggagctgaaaaaatttcgagaagatcacaactgcaaaagttttaagtggttcatggaagaaatagcttatgatatcacctcacactaccctttgccacccaaaaatgttgactggggagaaatcagaggcttcgaaactgcttactgcattgatagcatgggaaaaacaaatggaggctttgttgaactaggaccctgccacaggatgggagggaatcagcttttcagaatcaatgaagcaaatcaactcatgcagtatgaccagtgtttgacaaagggagctgatggatcaaaagttatgattacacactgtaatctaaatgaatttaaggaatggcagtacttcaagaacctgcacagatttactcatattccttcaggaaagtgtttagatcgctcagaggtcctgcatcaagtattcatctccaattgtgactccagtaaaacgactcaaaaatgggaaatgaataacatccatagtgtttagagagaaaaaaataaaccaataacctacctactgacaagtaaatttatacaggactgaaaaccgcctgaaacctgctgcaactattgttattaactctgtatagctccaaacctggaacctcctgatcagtttgaaggacattgataaactgtgattttacaataacattatcatctgcagttactgtttacaagactgcttttaccttaaactttgtagatgtttacatctttttgttgtgttttaagatgatgttggtaatttgtgcctttagctctgttttattagacagagttaaagcatgttgtcttctttgggattacactcaggggtctgaaaggcagtttgatttttatttttaacacacttgaaaaaaggttggagtagccagactttcatatataacttggtgattatcaacctgttgtgtctttatttaattttacatctttttgaagcactgccacaggttattagccaaggtggccttccttcacagtcatgctgcttttttgaaaggtgaatttcaacacatttagtgcctctttcatttctcagtatatatttcaagagcttgtgatgaaatctataggatggtaatgatggacttgtcacctgtatggggaatacttttactactcagaaatgaatttatgtgctgccatttgctataaagttgaactttgtatggcttgaaaaagaaatgacaatatggaacatcccaaggctgtcccatagggttggaagttgtgtagcattcactcccttacctactggcattcccagtgccctctgtccatacctacttctaggattgcaaaggagtcttccaactagagaaaaattgtccactgacatttgggatttacttttctccaatacctgccaatacagaaaactattatcagttgttattgttatcccttgaaagcgagggtgacaaaaacaacaaaacaccgttataaacacatcaaaggttcattctgactgaggtaagactttccaagcccttgttagattaggccttataaaacttgtgtgcattataacctaagctgtgcaacctgtgaagccaagagtgaactgatgtttcatttatattttcatccaaatgacattatctgcacgtttttaaaatttaaaaacaaaggactatttaaaaatacagtttattaacaaacgtgaactactttctgttacattaggtgttccctagtgtttcttaatttctttttagaaagtgtatttttattagtatttttccggtgaacagaagatttgtttggatttaaacatttactaagacagtacctattaggaaaaccaaatattgcaaatggtcaattcgattttaatttctcaaaagatactctgttatccagaagattaaaatgcctacattgagtgcttaaaaaaaaaaaaacaactgtgatgatgtgagcagaatggcaagtaagttaagcatttttgatcctgtaatcatggtatcattacaatgaaaggaattcacaaactactgccagaggaagtttgttttttaatttaagagggaaatataacctataaatttgtttcttccaagcttagctcttaaatttggagactcaaagttaaacatcctcaacagagttttatttataattttgaattgtcaatttgtattttgctactgatctgtgatcaaccattttaactttcatctctagggatgtttaacatttataattgcaaaataaaccaactataaaaaaagaaactaagagagaattggtactttaattacttgtgtgtttgcaaataggctccattttccatgttgagtagattataaccttattaactatgcataggcctaagaaaggtggcaatgaactgtgcatgtaaattttaaatgggtactttgtgcaattcgttaaaagaagatactctatgaatatgattctatatattgaaatcagaaaacctaccaaacaaaaacatcagaagctgctgccataatgactattttctactgtaggctgctttggaaataattcccatatccttgctttgtaagttggtaatatcactatgcatttctacacattttataaatttgatttatgcagattttgatacactgtatgtttctgtagaaattgtataaatattcaaaattttattaggataaatttgagaaacttacgtatatcttaattctgggttgcttgttttttaggtgacaaaaataaaatattgtattttaattca

SEQ ID NO: 33807 - DNA, 1657 bp, Homo sapiens
aaaacttgctcacttcgagcgttgtcattgtcttccataatgaaggatggtcaaccctcatgagaacagtccacagtgtaattaaaaggactccaaggaaatatttagcagaaattgtgttaattgacgatttcagtaataaagaacacttaaaagaaaaactggatgaatatattaagctgtggaatggcctagtgaaggtatttcgaaatgaaagaagggaaggtttaattcaagcacgaagtattggtgctcagaaggctaaacttggacaggttttgatataccttgatgcccactgtgaggtggcagttaactggtatgcaccacttgtagctcccatatctaaggacagaactacatgtactgtgcctctaatagattacatagatgggaatgattattccattgaaccacagcaaggtggggatgaagatggttttgccagaggggcctgggactggagtttactatggaaacgtattcctctaagccacaaggaaaaggccaaaagaaaacataaaactgaaccttatcggtccccagccatggctgggggattatttgccattgaacgagagttcttctttgaattgggtctctatgatccaggtctccagatttggggtggtaaaactttgagatctcatacaagatatggcagtgtggtggcaaattattatttgttccttgttctcgtgttggacatatctaccgtcttgagggctggcaaggaaatcctccgcccatttatgttgggtcttctccaactctgaagaattatgttagagttgtggaggtttggtgggatgaatataaagactacttctatgctagtcgtcctgaatcgcaggcattaccatatggggatatatcggagctgaaaaaatttcgagaagatcacaactgcaaaagttttaagtggttcatggaagaaatagcttatgatatcacctcacactaccctttgccacccaaaaatgttgactggggagaaatcagaggcttcgaaactgcttactgcattgatagcatgggaaaaacaaatggaggctttgttgaactaggaccctgccacaggatgggagggaatcagcttttcagaatcaatgaagcaaatcaactcatgcagtatgaccagtgtttgacaaagggagctgatggatcaaaagttatgattacacactgtaatctaaatgaatttaaggaatggcagtacttcaagaacctgcacagatttactcatattccttcaggaaagtgtttagatcgctcagaggtcctgcatcaagtattcatctccaattgtgactccagtaaaacgactcaaaaatgggaaatgaataacatccatagtgtttagagagaaaaaaataaaccaataacctacctactgacaagtaaatttatacaggactgaaaaccgcctgaaacctgctgcaactattgttattaactctgtatagctccaaacctggaacctcctgatcagtttgaaggacattgataaactgtgattttacaataacattatcatctgcagttactgtttacaagactgcttttaccttaaactttgtagatgtttacatctttttgttgtgttttaagatgatgttggtaatttgtgcctttagctctgttttattagacagag

SEQ ID NO: 33808 - DNA, 2380 bp, Homo sapiens
gggagtgggtttcaggaggagccaagatgtttgattatactcctctgcttcaagggagtgttatctccctgagcaacctgtggaaagccgctgagcaacctgtggaaagccgctgagcggttatcctctcggggcataaagacaaagaaggcaataaggagactttgctcctcagaggccacccgtggcttcccatgggtgtctcacacaggggagaccaactcaactggcacctagaactctctttcccacaaaagctaggctggttctgattcttaacctgctccagcagtgacacactcagtcccacagggagtggacgacccccaggaagaagatgatgttttggaggaaactccccaaagccctcttcattgggctgactctggccattgctgtcaatctccttctggtattttctagcaaggggactttacaaaacctgtttacgggtggtctccacagggagcttcctttacatctgaataaacgctacggggcagtgataaagagactctcccacttggaggtggaattgcaggatctgaaagaaagtatgaaattagctctgaggcaacaagaaaatgtgaacagcacactgaagagggcgaaagatgaagtacgccctcttctaaaggcaatggaaaccaaggtgaatgagacaaagaagcacaaaacccaaatgaaactcttcccacactcacagcttttcaggcaatggggcgaggatctttctgaggcccagcagaaggcggcccaggacctcttccggaagtttggttacaacgcgtacctcagcaaccagctgcctctcaatcgcaccatccccgacacgcgagactacagatgtcttcggaagacatatccttcccaactcccatccctcagtgtcattctcatattcgtgaatgaagctctgtccattatacaacgggccatcaccagtatcatcaaccggacgccctctcgattgttgaaggaaatcatcttggtggatgatttcagctcaaatggagaactaaaggtacacttggatgagaagattaagctttacaaccagaagtatccaggactactgaaaataatacggcatcctgaaaggaaaggtcttgctcaagcccgcaacactggctgggaagctgccacagcagacgtggtcgccatcttggatgctcacattgaagtcaatgttgggtgggcagagccaatcttggctcggattcaggaggaccgcactgtgattgtgtctcctgtgtttgacaacattcgttttgacaccttcaaactggataagtatgaactggcagttgatgggtttaactgggaactctggtgccgctacgatgcactgccacaagcctggattgatctgcatgatgtcactgccccagtgaagagtccttcaatcatgggcatcctggctgctaacaggcacttcctgggagagatcgggtctctggatggtggaatgctcatctatggaggagagaacgtggagcttagcctgagggtgtggcagtgtggagggaaggtcgagattttgccctgttcccggattgcccacctagagagacaccacaagccctacgccttggatctcaccgctgccttgaagcgcaatgctctgcgagtggccgaaatctggatggatgagcacaaacacatggtctacttggcctggaacatacctctccagaactctggaatagattttggagacgtttcttccagaatggcactccgggaaaaactgaaatgtaaaacttttgactggtacctgaaaaatgtttatccactcttgaagccactccacaccatcgtgggctatggaagaatgaaaaacctattggatgaaaatgtctgcttggatcagggacccgttccaggcaacacccccatcatgtattactgccatgaattcagctcacagaatgtctactatcacctaactggggagctctatgtgggacaactgattgcagaggccagtgctagtgatcgctgcctgacagaccctggcaaggcggagaagcccaccttagaaccatgctccaaggcagctaagaatagactgcatatatattgggattttaaaccgggaggagctgtcataaacagagataccaagcggtgtctggagatgaagaaggatcttttgggtagccacgtgcttgtgctccagacctgtagcacgcaagtgtgggaaatccagcacactgtcagagactggggtcagaccaacagccagtgatcctcagatggtgctggatctgggtcatcaattcttgcaagtggaatggcttctactcctaacactcccagcttctttctcaatgagaaagaaagcatgtgtatgtctgtttatggcgacttcaggtgg

SEQ ID NO: 33809 - DNA, 995 bp, Homo sapiens
gggacctagctcgggaccggcctggagatggagttcgactgcgagggcctgagacggctgcttggcaagtacaagttcagggacctaactgtggaagaactaaggaatgtaaatgtatttttcccacatttcaaatattccatggacacctatgtttttaaagatagttctcagaaagacctgctgaattttactggcacaattcctgtgatgtatcagggtaatacatataacataccaattcgtttctggattttggattctcaccctttcgctccccctatttgcttcttgaagccaactgcaaatatgggaatcttagtcggaaaacatgtggatgctcaaggcagaatatatttgccctatctccaaaactggagccatcctaaatctgtcattgttggattaattaaagaaatgattgccaagtttcaagaggaacttcccatgtattctctatcatcatctgatgaggcacggcaggtagacttgctagcctatattgcaaaaatcactgaaggtgtttcagatacaaattcaaagagctgggcaaatcatgagaataaaacagtcaataaaattactgtggttggaggtggagaactcggtattgcctgcacattagcaatttcagcaaaggtggagtctcgctctgttacccaggctggagtgtagtggtacaatcttggctcactacagcctccgcctcctgggttcaagcgattctcctgcctcagcctccagagtagctgggactacaggcatgcgccacgacgcccagctaatttttgtatttttagcagagacagggttttgccatgttggccaggctggtctcgaacttctgacctcaagtgatccacctgccctggcctcccaaagtgctgggattacaagtgtgagccaccgtacctggcctgctattacctcttaattagaatttgagttgtattcagtcttttgtcactaaataaatgcttctataaacatttcaa

SEQ ID NO: 33810 - DNA, 2030 bp, Homo sapiens
ctgggacctagctcgggaccggcctggagatggagttcgactgcgagggcctgagacggctgcttggcaagtacaagttcagggacctaactgtggaagaactaaggaatgtaaatgtatttttcccacatttcaaatattccatggacacctatgtttttaaagatagttctcagaaagacctgctgaattttactggcacaattcctgtgatgtatcagggtaatacatataacataccaattcgtttctggattttggattctcaccctttcgctccccctatttgcttcttgaagccaactgcaaatatgggaatcttagtcggaaaacatgtggatgctcaaggcagaatatatttgccctatctccaaaactggagccatcctaaatctgtcattgttggattaattaaagaaatgattgccaagtttcaagaggaacttcccatgtattctctatcatcatctgatgaggcacggcaggtagacttgctagcctatattgcaaaaatcactgaaggtgtttcagatacaaattcaaagagctgggcaaatcatgagaataaaacagtcaataaaattactgtggttggaggtggagaactcggtattgcctgcacattagcaatttcagcaaagggtattgcagacaggcttgtcctcttagacctctcagaagggactaaaggagccacgatggaccttgaaatcttcaaccttcctaatgtggagatcagcaaagatttgtctgcctctgctcattccaaggtggtgatcttcacagtcaactctttgggtagttctcagtcgtaccttgatgtggtacagagcaatgtggatatgttcagagcccttgtcccagctctgggacattatagtcaacacagtgtcctgctcgttgcatctcaaccagtggaaatcatgacctatgtaacatggaaactgagtacatttcctgcaaatcgagtgatcggaattggatgtaatctggattcacagagattacagtatattattacaaatgttttgaaggcacagacttcaggcaaagaagtatgggttattggcgagcaaggagaagacaaagtgctcacatggagtggccaagaagaagtagtgagtcatacctctcaagtgcagctgtccaacagagccatggaactgctaagagtaaaaggtcaaagatcctggtctgttggactatcagtagctgacatggttgacagtattgtaaacaataagaagaaagtgcattctgtatcagctttagcaaagggatattatgatataaatagtgaagtgtttttaagtttgccttgcatccttggaaccaatggagtatctgaagttatcaaaaccacactgaaagaagatacagttactgagaaactccaaagcagtgcatcctcaatccacagtctccaacaacagttaaaactttgattctcaaatgcaatttgagaggctggacttctacctaaagggaaaagtcatttaattttacctatatataggtttgaggatttctgtatcctgctacttacttttacaaactgcttggttaaagtagagggtttcttgattagctttgtgatgtaaatccttaaggagttatacaaggaggggaaaaattaattttatttggggttcttgagatatctatgctgttctttaaatctacagcaggggtaaacattcatctgcagtgtgcatcaatttaaatcatatatcctaaactaaaagcacaattcatacttcgggaatattttataagtaatatatctttaaaagaaaattaccctttgacttttataatcaacataagttccaggcccagtatggatttacaaaatctgtgtcagttgtacattcacaggatccacagcttaagttactaatgtttcttgtgtaaaatcctgttggtagtaatagtaaagcattgtatttcccttcttcaaattaattacctaccaaaaaatggaaaagaattttacatgcactttaaaatagtaaaatggaaagtgaatt

SEQ ID NO: 33811 - DNA, 1492 bp, Homo sapiens
agcggcttccgtcctgcagcaagtccggaagaaggtccgggggctggagtcctgggacctagctcgggaccggcctggagatggagttcgactgcgagggcctgagacggctgcttggcaagtttttaaagatagttctcagaaagacctgctgaattttactggcacaattcctgtgatgtatcagggtaatacatataacataccaattcgtttctggattttggattctcaccctttcgctccccctatttgcttcttgaagccaactgcaaatatgggaatcttagtcggaaaacatgtggatgctcaaggcagaatatatttgccctatctccaaaactggagccattttggagatgaagtctcattctgttgcccaagctggagtatagtggtgcaaccataactcactgcatctgaaactcctgggctcaagtaatactcctgcctcaacaaaggtgtttcagatacaaattcaaagagctgggcaaatcatgagaataaaacagtcaataaaattactgtggttggaggtggagaactcggtattgcctgcacattagcaatttcagcaaagggtattgcagacaggcttgtcctcttagacctctcagaagggactaaaggagccacgatggaccttgaaatcttcaaccttcctaatgtggagatcagcaaagatttgtctgcctctgctcattccaaggtggtgatcttcacagtcaactctttgggtagttctcagtcgtaccttgatgtggtacagagcaatgtggatatgttcagagcccttgtcccagctctgggacattatagtcaacacagtgtcctgctcgttgcatctcaaccagtggaaatcatgacctatgtaacatggaaactgagtacatttcctgcaaatcgagtgatcggaattggatgtaatctggattcacagagattacagtatattattacaaatgttttgaaggcacagacttcaggcaaagaagtatgggttattggcgagcaaggagaagacaaagtgctcacatggagtggccaagaagaagtagtgagtcatacctctcaagtgcagctgtccaacagagccatggaactgctaagagtaaaaggtcaaagatcctggtctgttggactatcagtagctgacatggttgacagtattgtaaacaataagaagaaagtgcattctgtatcagctttagcaaagggatattatgatataaatagtgaagtgtttttaagtttgccttgcatccttggaaccaatggagtatctgaagttatcaaaaccacactgaaagaagatacagttactgagaaactccaaagcagtgcatcctcaatccacagtctccaacaacagttaaaactttgattctcaaatgcaatttgagaggctggacttctacctaaagggaaaagtcatttaattttacctatatataggtttgaggatttctgtatcctgctacttacttttaca

SEQ ID NO: 33812 - DNA, 2503 bp, Homo sapiens
agtttggtcctcagcggcttccgtcctgcagcaagtccggaagaaggtccgggggctggagtcctgggacctagctcgggaccggcctggagatggagttcgactgcgagggcctgagacggctgcttggcaagtacaagttcagggacctaactgtggaagaactaaggaatgtaaatgtatttttcccacatttcaaatattccatggacacctatgtttttaaagatagttctcagaaagacctgctgaattttactggcacaattcctgtgatgtatcagggtaatacatataacataccaattcgtttctggattttggattctcaccctttcgctccccctatttgcttcttgaagccaactgcaaatatgggaatcttagtcggaaaacatgtggatgctcaaggcagaatatatttgccctatctccaaaactggagccatcctaaatctgtcattgttggattaattaaagaaatgattgccaagtttcaagaggaacttcccatgtattctctatcatcatctgatgaggcacggcaggtagacttgctagcctatattgcaaaaatcactgaaggtgtttcagatacaaattcaaagagctgggcaaatcatgagaataaaacagtcaataaaattactgtggttggaggtggagaactcggtattgcctgcacattagcaatttcagcaaagggtattgcagacaggcttgtcctcttagacctctcagaagggactaaaggagccacgatggaccttgaaatcttcaaccttcctaatgtggagatcagcaaagatttgtctgcctctgctcattccaaggtggtgatcttcacagtcaactctttgggtagttctcagtcgtaccttgatgtggtacagagcaatgtggatatgttcagagcccttgtcccagctctgggacattatagtcaacacagtgtcctgctcgttgcatctcaaccagtggaaatcatgacctatgtaacatggaaactgagtacatttcctgcaaatcgagtgatcggaattggatgtaatctggattcacagagattacagtatattattacaaatgttttgaaggcacagacttcaggcaaagaagtatgggttattggcgagcaaggagaagacaaagtgctcacatggagtggccaagaagaagtagtgagtcatacctctcaagtgcagctgtccaacagggatattatgatataaatagtgaagtgtttttaagtttgccttgcatccttggaaccaatggagtatctgaagttatcaaaaccacactgaaagaagatacagttactgagaaactccaaagcagtgcatcctcaatccacagtctccaacaacagttaaaactttgattctcaaatgcaatttgagaggctggacttctacctaaagggaaaagtcatttaattttacctatatataggtttgaggatttctgtatcctgctacttacttttacaaactgcttggttaaagtagagggtttcttgattagctttgtgatgtaaatccttaaggagttatacaaggaggggaaaaattaattttatttggggttcttgagatatctatgctgttctttaaatctacagcaggggtaaacattcatctgcagtgtgcatcaatttaaatcatatatcctaaactaaaagcacaattcatacttcgggaatattttataagtaatatatctttaaaagaaaattaccctttgacttttataatcaacataagttccaggcccagtatggatttacaaaatctgtgtcagttgtacattcacaggatccacagcttaagttactaatgtttcttgtgtaaaatcctgttggtagtaatagtaaagcattgtatttcccttcttcaaattaattacctaccaaaaaatggaaaagaattttacatgcactttaaaatagtaaaatggaaagtgaatttttaaaatatatgcattaaaagtttactttaatttccagtgggacttcctttatgaaattttccataacctcttcctggagtattacaagatctccaacatctcataaactaattgtgatattagtggaaccataagcaaatatatatttttagtggaaatagattatgaatgaaagccaagcaccttactttaaagccaaaatatgagattttcattaaaaacattggtcataatagggagaggttttttatttgttctgagcaaatcctttaacctctcctgatgatacagttcagagtacacacactttggtgatggatcaagagcaatattttcttatgtgaaagatagcttattattactattgtgacatacaactaatagtaacagttaacatcaacacttcatatataccaggcagcatgataagcactttattattttactgaatcctcacaacagaccactgaggtagggactattgccatcatcattttataaaaggaaattgaggtttagtcctcaagaagtc

SEQ ID NO: 33813 - DNA, 1848 bp, Homo sapiens
aagaaggtccgggggctggagtcctgggacctagctcgggaccggcctggagatggagttcgactgcgagggcctgagacggctgcttggcaagtacaagttcagggacctaactgtggaagaactaaggaatgtaaatgtatttttcccacatttcaaatattccatggacacctatggtaatacatataacataccaattcgtttctggattttggattctcaccctttcgctccccctatttgcttcttgaagccaactgcaaatatgggaatcttagtcggaaaacatgtggatgctcaaggcagaatatatttgccctatctccaaaactggagccatcctaaatctgtcattgttggattaattaaagaaatgattgccaagtttcaagaggaacttcccatgtattctctatcatcatctgatgaggcacggcaggtagacttgctagcctatattgcaaaaatcactgaaggtgtttcagatacaaattcaaagagctgggcaaatcatgagaataaaacagtcaataaaattactgtggttggaggtggagaactcggtattgcctgcacattagcaatttcagcaaagggtattgcagacaggcttgtcctcttagacctctcagaagggactaaaggagccacgatggaccttgaaatcttcaaccttcctaatgtggagatcagcaaagatttgtctgcctctgctcattccaaggtggtgatcttcacagtcaactctttgggtagttctcagtcgtaccttgatgtggtacagagcaatgtggatatgttcagagcccttgtcccagctctgggacattatagtcaacacagtgtcctgctcgttgcatctcaaccagtggaaatcatgacctatgtaacatggaaactgagtacatttcctgcaaatcgagtgatcggaattggatgtaatctggattcacagagattacagtatattattacaaatgttttgaaggcacagacttcaggcaaagaagtatgggttattggcgagcaaggagaagacaaagtgctcacatggagtggccaagaagaagtagtgagtcatacctctcaagtgcagctgtccaacagagccatggaactgctaagagtaaaaggtcaaagatcctggtctgttggactatcagtagctgacatggttgacagtattgtaaacaataagaagaaagtgcattctgtatcagctttagcaaagggatattatgatataaatagtgaagtgtttttaagtttgccttgcatccttggaaccaatggagtatctgaagttatcaaaaccacactgaaagaagatacagttactgagaaactccaaagcagtgcatcctcaatccacagtctccaacaacagttaaaactttgattctcaaatgcaatttgagaggctggacttctacctaaagggaaaagtcatttaattttacctatatataggtttgaggatttctgtatcctgctacttacttttacaaactgcttggttaaagtagagggtttcttgattagctttgtgatgtaaatccttaaggagttatacaaggaggggaaaaattaattttatttggggttcttgagatatctatgctgttctttaaatctacagcaggggtaaacattcatctgcagtgtgcatcaatttaaatcatatatcctaaactaaaagcacaattcatacttcgggaatattttataagtaatatatctttaaaagaaaattaccctttgacttttataatcaacataagttccaggcccagtatggatttacaaaatctgtgtcagttgtacattcacaggatccacagctta

SEQ ID NO: 33814 - DNA, 994 bp, Homo sapiens
agcattgtgggagctcctcggtcggtgccggtcggtggctgcctattgcggcctgcggtgatcaacgaggcccggggagcgcgtccccagtctgcgcgccggtcctgcggcagctggcccaagacccggagccgaaaggaagtgttggagcctgaggtcgctccgcgccgctaggaggacgctgtgcctggcctgggacctccgctcccgcccaccgccctggagccgctgagggacgtccacgtgggcctgtccccgccgagccgcggccctgtccgcctggcgctgctctcgggccactacctctactaccactacggctgcgacggcctggacgaccgcggctggggctgcggctaccgcactctgcagacgctgtgctcgtggccagagggccagcccgcgggcgtacctggactggccgccgtacaggcggccctggaggacatgggcgacaagccccccggcttccggggctcccgggactggatcggctgcgtggaggccagcctctgcctcgctcacttcggagggccccagggacgcctctgccacgtaccccggggagtggggctgcacggggagctggagaggctttactcgcacttcgcagggggtgggggcccagtcatggttgggggggacgcagatgccaggtccaaggccttgctgggagtctgcgtagggtcaggcacggaagcctatgtcctggtattggaccctcactactggggcactccaaaaagccccagtgaactacaggctgctgggtgggtgggctggcaagaggtgagtgcagcctttgaccccaactccttctacaacctgtgcttgaccagccttagctcccaacagcagcagcgcaccttggactgaggacgaagttacagaactgagattctcgggtcccagacacgcacctatgtacctcccactggtgtccctgcaaagcctggcgcttttgacatcaataataaaagtggcagggctgagc

SEQ ID NO: 33815 - DNA, 1630 bp, Homo sapiens
agttgtagttggtccgcccgggccccgcccctgggccgtgcggtgacaccacttcagggccggcccccggaacttttgggcaggcgtcagcgcccgtgtcaccgccacgtcgcggacatggtgatttcagaaagtatggatatactcttcagaataagaggaggccttgatttggcttttcagctagctactcctaatgaaatttttctcaagaaggcactgaaacatgtgttgagtgacctgtcaactaagctgtcttcaaacgcccttgtgttcagaatttgccacagttcagtgtatatatggcctagcagtgacataaacaccattcctggagaactgactgatgcttctgcttgtaagaacatactgcgctttattcaatttgagccagaagaagatataaaaagaaaattcatgagaaagaaggacaaaaagttatcagacatgcatcaaatagtaaatatagatcttatgctggaaatgtcaacctccctggcagctgtaacgcccatcattgaaagggaaagcggaggacaccattatgttaatatgactttacctgtcgatgcagttatatctgttgctccagaagaaacatggggaaaagttcgtaaactcctggttgatgcaattcataatcaactaactgacatggaaaaatgtattttgaaatatatgaaaggaacatctattgtggtccctgaaccactgcactttttattaccagggaaaaaaaatcttgtaacaatttcatatccttcaggaataccagatggccagctgcaggcctataggaaggagttacatgatcttttcaatctgcctcacgacagaccctatttcaaaaggtctaatgcttatcactttccagatgagccatacaaagatggttacattagaaatccacatacttaccttaatccacctaacatggagactggtatgatttatgtggtccagggcatatatggctatcatcattatatgcaggatcgcatagatgacaatggctggggctgtgcttatcgatctctgcagactatctgctcttggttcaaacatcagggatacacagagaggtccattccaacacacagagaaattcagcaggctctagtcgatgccggggacaaaccagcaacatttgtcggatcgcggcaatggattggatctattgaggtgcagctggtactaaaccaattgatcggtataacgtcaaaaatcctgtttgtcagccaaggttcagaaattgcctctcaaggacgggaactggctaatcatttccaaagtgaaggaactccagttatgatcgggggaggagttttggcccacacaatactaggagttgcatggaatgagattacagggcagataaagtttctgattctagatccacattataccggtgctgaagacctgcaagttattttggaaaagggctggtgcggatggaagggcccagatttttggaacaaggatgcatactataacttatgtcttcctcagcgaccaaatatgatttaaaatatcttggagtcaaagactgcagtagagtggtattataaatttgtgaataaagaatcagtttaatttttcacattaaatcctggttctagtttgacgattt

SEQ ID NO: 33816 - DNA, 3140 bp, Homo sapiens
gggaaccatcagcgcctcctgtccacggagctccaggtctacaatggcagcggccgccagccccgcgttccttctgtgcctcccgcttctgcacctgctgtctggctggtcccgggcaggatgggtcgacacacactgtctttgctatgacttcatcatcactcctaagtccagacctgaaccacagtggtgtgaagttcaaggcctggtggatgaaaggccttttcttcactatgactgtgttaaccacaaggccaaagcctttgcttctctggggaagaaagtcaatgtcacaaaaacctgggaagaacaaactgaaacactaagagacgtggtggatttccttaaagggcaactgcttgacattcaagtggagaatttaatacccattgagcccctcaccctgcaggccaggatgtcttgtgagcatgaagcccatggacacggcagaggatcttggcagttcctcttcaatggacagaagttcctcctctttgactcaaacaacagaaagtggacagcacttcatcctggagccaagaagatgacagagaagtgggagaagaacagggatgtgaccatgttcttccagaagatttcactgggggattgtaagatgtggcttgaagaatttttgatgtactgggaacaaatgctggatccaacaaaaccaccctctctggccccaggcacaacccaacccaaggccatggccaccaccctcagtccctggagccttctcatcatcttcctctgcttcattctagctggcagatgaggagagttgtttagagtgacaggtggaaagtgatatcaagaagcctctgttagcctggtctgggtcctgctctcccttcagggaggccgcctgtctactcaccactgtgcctttctggaaagcaggagttcaagccttagcaagcccagaggcccccagcagacgatgaggacattgtcggctcaacatctcaggccactcattaccttcgctcatgatcccagcagccatttttcttaacaccttctgccactttctgtcggtgctaatggatggaactcctgcacaagttttaactgaacaagaaatcccagcaaaaggcatttttttttctacttctttgattgtagaaaagcagacacttctctgaaacatgaccttattcttccaaacagtatcgctagtaaaatagcatgctggacttcagacctcagggatccttttgatgcactgaccaggaattgtgataatccttttcatttttatggctttttacagtttctcattctgtcaaccatattgaagtgaagtggcatagtcttcactcactgtaatctccagctcctgggctcaagtgatcctctagactcagcctctagaatagctgggactacaggcacatgccaccaggactggcaaactgttttatttttaggtagaggtagggtcttcctatgttgcccaggatggtcttcaaatcttggtctcgagcaatgctaccaccttggcctcccaatgctctgggattacagacatgaaccacagtgcctgttgtagaaatttttaattatttaatatgaaaatattacattcatgattattttatttagtaaataaaataatagagagcccagaaatcaacctgcacacctaccgccatctaatcttcaatagaaatgggcaatgtgggaaagactccctattcgaaaattagtgctggaatatctggccaaccatatgcagaagaatgaaactgaacccctacttctccccatatatgtaaaataattcaatatggatgaaagatttaaatataagtactaaaactgtaaaaatcctggaatataacctaagaaataccaatgtggacatagggcctggcaaagatttcatgaagaagacactaaaaacaattgcaacaaaaacagaaattgacaaatggggcctcattaaactaaagagcttctgcacagaaaaagaaactagcaacacagtaaacagacagcctgtagaatggggaaaactatttgcaaactctgcatctgatgaaggtccaatatccagaatctacaaggaacttaaacaattcaacaagcaagaagaaaaaacccaattaaaattgggcaaaggcatgaacagacacttttcaaaagaagacctacaattggccaacaaacatgaaaaaatgctcagtatcactaatcatcagataagtgcaaatcaaaactgcaatgagttaccatctcttaccagtcacaaagtcagagatggtggtgaggctgcagagcaaaagaaacagacactgttggtgggaaagcaaacttgttcagccactatggaaagcagtttggagatttctccaagaacttaaaatagaactaccattcaatcccgcaatcccactactcgggatatacccacaggaaaagaattcattttatcaaaaagacacctgcaccaatatgttcattacagtgctattctcaccagcaaggacagagaatcaatctaagtgcccaacaacagtaaattcaatgaaaaaaaatgtggtacatagatacgatggaaaactatgcagccatgaaacacaagaaaatcatgtccttttcagcaacatggatgcaactagaggctattatcctaagcaacctaatgcaagaacagaaaaccacatactgcatcttcccattggaaagtggcagctaaacattaaattcgcatgaaccacagatgctggagatcaccagaccggggagagaagaggggcacctgggctgaaaaacacacctgttgggtatcatgcttactgtctgggcgatgggatcattgggacaccaagcctcagcttctcaaattctacccatgtaacaaacctgtatatgtaccttgtattatataggttgaaattaaagatgaataaataaaataaaatgacacaaggccaaaaacaaatgggtttaactgaccagagcgagagaactctgcactatgaacccaaacccagctcaaaaagataaaatctagtcatttaagataatcataagttgtatgatgataattgtataaaaatttgtatgatgataattgtataataattatacatgaaagtgccaaaaccctacaattaaacactgtataatgg

SEQ ID NO: 33817 - DNA, 1621 bp, Homo sapiens
gggaaccatcagcgcctcctgtccacggagctccaggtctacaatggcagcggccgccagccccgcgttccttctgtgcctcccgcttctgcacctgctgtctggctggtcccgggcaggatgggtcgacacacactgtctttgctatgacttcatcatcactcctaagtccagacctgaaccacagtggtgtgaagttcaaggcctggtggatgaaaggccttttcttcactatgactgtgttaaccacaaggccaaagcctttgcttctctggggaagaaagtcaatgtcacaaaaacctgggaagaacaaactgaaacactaagagacgtggtggatttccttaaagggcaactgcttgacattcaagtggagaatttaatacccattgagcccctcaccctgcaggccaggatgtcttgtgagcatgaagcccatggacacggcagaggatcttggcagttcctcttcaatggacagaagttcctcctctttgactcaaacaacagaaagtggacagcacttcatcctggagccaagaagatgacagagaagtgggagaagaacagggatgtgaccatgttcttccagaagatttcactgggggattgtaagatgtggcttgaagaatttttgatgtactgggaacaaatgctggatccaacaaaaccaccctctctggccccaggcacaacccaacccaaggccatggccaccaccctcagtccctggagccttctcatcatcttcctctgcttcattctagctggcagatgagtggaaagtgatatcaagaagcctctgttagcctggtctgggtcctgctctcccttcagggaggccgcctgtctactcaccactgtgcctttctggaaagcaggagttcaagccttagcaagcccagaggcccccagcagacgatgaggacattgtcggctcaacatctcaggccactcattaccttcgctcatgatcccagcagccatttttcttaacaccttctgccactttctgtcggtgctaatggatggaactcctgcacaagttttaactgaacaagaaatcccagcaaaaggcatttttttttctacttctttgattgtagaaaagcagacacttctctgaaacatgaccttattcttccaaacagtatcgctagtaaaatagcatgctggacttcagacctcagggatccttttgatgcactgaccaggaattgtgataatccttttcatttttatggctttttacagtttctcattctgtcaaccatattgaagtgaagtggcatagtcttcactcactgtaatctccagctcctgggctcaagtgatcctctagactcagcctctagaatagctgggactacaggcacatgccaccaggactggcaaactgttttatttttaggtagaggtagggtcttcctatgttgcccaggatggtcttcaaatcttggtctcgagcaatgctaccaccttggcctcccaatgctctgggattacagacatgaaccacagtgcctgttgtagaaatttttaattatttaatatgaaaatattacattcatgattattttatttagtaaataaaataatagagagcccagaaatcaacctg

SEQ ID NO: 33818 - DNA, 1349 bp, Homo sapiens
aaaaccttgaggtgattcatcttccaggctctccttccatcaagtctctcatccctagcgctctgggtccttaatggcagcagccgccgctaccaagatccttctgtgcctcccgcttctgctcctgctgtccggctggtcccgggctgggcgagccgaccctcactctctttgctatgacatcaccgtcatccctaagttcagacctggaccacggtggtgtgcggttcaaggccaggtggatgaaaagacttttcttcactatgactgtggcaacaagacagtcacacctgtcagtcccctggggaagaaactaaatgtcacaacggcctggaaagcacagaacccagtactgagagaggtggtggacatacttacagagcaactgcgtgacattcagctggagaattacacacccaaggaacccctcaccctgcaggcaaggatgtcttgtgagcagaaagctgaaggacacagcagtggatcttggcagttcagtttcgatgggcagatcttcctcctctttgactcagagaagagaatgtggacaacggttcatcctggagccagaaagatgaaagaaaagtgggagaatgacaaggttgtggccatgtccttccattacttctcaatgggagactgtataggatggcttgaggacttcttgatgggcatggacagcaccctggagccaagtgcaggagcaccactcgccatgtcctcaggcacaacccaactcagggccacagccaccaccctcatcctttgctgcctcctcatcatcctcccctgcttcatcctccctggcatctgaggagagtcctttagagtgacaggttaaagctgataccaaaaggctcctgtgagcacggtcttgatcaaactcgcccttctgtctggccagctgcccacgacctacggtgtatgtccagtggcctccagcagatcatgatgacatcatggacccaatagctcattcactgccttgattccttttgccaacaattttaccagcagttatacctaacatattatgcaattttctcttggtgctacctgatggaattcctgcacttaaagttctggctgactaaacaagatatatcattttctttcttctctttttgtttggaaaatcaagtacttctttgaatgatgatctctttcttgcaaatgatattgtcagtaaaataatcacgttagacttcagacctctggggattctttccgtgtcctgaaagagaatttttaaattatttaataagaaaaaatttatattaatgattgtttcctttagtaatttattgttctgtactgatatttaaataaagagttctatttcccaaaaa

SEQ ID NO: 33819 - DNA, 949 bp, Homo sapiens
atacgctggtctccacatcgactgcgccttgtgtcccgggcgctcctggtctacaatggcagcggccgccagccccgcgatccttccgcgcctcgcgattcttccgtacctgctattcgactggtccgggacggggcgggccgacgctcactctctctggtataacttcaccatcattcatttgcccagacatgggcaacagtggtgtgaggtccagagccaggtggatcagaagaattttctctcctatgactgtggcagtgacaaggtcttatctatgggtcacctagaagagcagctgtatgccacagatgcctggggaaaacaactggaaatgctgagagaggtggggcagaggctcagactggaactggctgacactgagctggaggatttcacacccagtggacccctcacgctgcaggtcaggatgtcttgtgagtgtgaagccgatggatacatccgtggatcttggcagttcagcttcgatggacggaagttcctcctctttgactcaaacaacagaaagtggacagtggttcacgctggcttagggacttcctgatgcacaggaagaagaggctggaacccacagcaccacccaccatggccccaggcttagctcaacccaaagccatagccaccaccctcagtccctggagcttcctcatcatcctctgcttcatcctccctggcatctgagaagagtcatttagagtgacaggtggaaggtgatatcaagaagcctctgttagcctggtctggttcctgctctcccttcagggaggccgcctgtctactcaccactgtgcctttctggaaagcaggagttcaagccttagcaagcccagaggcccccagcagatgatgaggacattgtcggctcaacatctcaggccactcattaccttcgctcatgatcccagcagccatttttcttttttttttt

SEQ ID NO: 33820 - DNA, 966 bp, Homo sapiens
ccttgtgtcccgggcgctcctggtctacaatggcagcggccgccagccccgcgatccttccgcgcctcgcgattcttccgtacctgctattcgactggtccgggacggggcgggccgacgctcactctctctggtataacttcaccatcattcatttgcccagacatgggcaacagtggtgtgaggtccagagccaggtggatcagaagaattttctctcctatgactgtggcagtgacaaggtcttatctatgggtcacctagaagagcagctgtatgccacagatgcctggggaaaacaactggaaatgctgagagaggtggggcagaggctcagactggaactggctgacactgagctggaggatttcacacccagtggacccctcacgctgcaggtcaggatgtcttgtgagtgtgaagccgatggatacatccgtggatcttggcagttcagcttcgatggacggaagttcctcctctttgactcaaacaacagaaagtggacagtggttcacgctggagccaggcggatgaaagagaagtgggagaaggatagcggactgaccaccttcttcaagatggtctcaatgagagactgcaagagctggcttagggacttcctgatgcacaggaagaagaggctggaacccacagcaccacccaccatggccccaggcttagctcaacccaaagccatagccaccaccctcagtccctggagcttcctcatcatcctctgcttcatcctccctggcatctgagtggaaggtgatatcaagaagcctctgttagcctggtctggttcctgctctcccttcagggaggccgcctgtctactcaccactgtgcctttctggaaagcaggagttcaagccttagcaagcccagaggcccccagcagatgatgaggacattgtcggctcaacatctcaggccactcattaccttcgctcatgatcccag

SEQ ID NO: 33821 - DNA, 1598 bp, Homo sapiens
atacgctggtctccacatcgactgcgccttgtgtcccgggcgctcctggtctacaatggcagcggccgccagccccgcgatccttccgcgcctcgcgattcttccgtacctgctattcgactggtccgggacggggcgggccgaagagcagctgtatgccacagatgcctggggaaaacaactggaaatgctgagagaggtggggcagaggctcagactggaactggctgacactgagctggaggatttcacacccagtggacccctcacgctgcaggtcaggatgtcttgtgagtgtgaagccgatggatacatccgtggatcttggcagttcagcttcgatggacggaagttcctcctctttgactcaaacaacagaaagtggacagtggttcacgctggagccaggcggatgaaagagaagtgggagaagagtcatttagagtgacaggtggaaggtgatatcaagaagcctctgttagcctggtctggttcctgctctcccttcagggaggccgcctgtctactcaccactgtgcctttctggaaagcaggagttcaagccttagcaagcccagaggcccccagcagatgatgaggacattgtcggctcaacatctcaggccactcattaccttcgctcatgatcccagcagccatttttctttttttttttttgtttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcacccgccaccgcgcccggctaattttttgtatttttagtagagacagggtttcaccttgttagccaggatggtctcgatctcctgacctcatgatccacctgcctcggcctcccagagtgctgggattacaggcgtgagccaccgcgcccggccagccatttttcttaacaccttctgccactttctctcggtgctaatggatggaattcctgcacaagttttaactgaacaagaaatcccagcaaaaggcattttctttctacttctttgattgtggaaaagcagacatttctctgaagcatgaccttattcttcgaaacggtattgctagtaaaatagcatgcaggacttcagacctcagggatcctttccatgcactgaccaagaattgtattaatcctttttatcattatagtttttttacattttctcattctgtcaaccatattggagtgaagtggcatagtcatcactcactgtaatctccaactcctgggctcaagtgatcctctagactcagcctctagagtagctgggactacaggcgcatgccaccatgcctggcaaattgttttatatttaggtagagattgggtcttcctatgttgcgcaggtaataaaactgtgaaaatcctggaatataagctaagaaataccaatgtggacatagggcctggcaaagatttcatgaagaagacactaaaaacaattgtaacaaaaacaaaaattgacaaatgggacctcattaaactaaagagcttctgcacag

SEQ ID NO: 33822 - DNA, 735 bp, Homo sapiens
atggcagcggccgccagccccgcgatccttccgcgcctcgcgattcttccgtacctgctattcgactggtccgggacggggcgggccgacgctcactctctctggtataacttcaccatcattcatttgcccagacatgggcaacagtggtgtgaggtccagagccaggtggatcagaagaattttctctcctatgactgtggcagtgacaaggtcttatctatgggtcacctagaagagcagctgtatgccacagatgcctggggaaaacaactggaaatgctgagagaggtggggcagaggctcagactggaactggctgacactgagctggaggatttcacacccagtggacccctcacgctgcaggtcaggatgtcttgtgagtgtgaagccgatggatacatccgtggatcttggcagttcagcttcgatggacggaagttcctcctctttgactcaaacaacagaaagtggacagtggttcacgctggagccaggcggatgaaagagaagtgggagaaggatagcggactgaccaccttcttcaagatggtctcaatgagagactgcaagagctggcttagggacttcctgatgcacaggaagaagaggctggaacccacagcaccacccaccatggccccaggcttagctcaacccaaagccatagccaccaccctcagtccctggagcttcctcatcatcctctgcttcatcctccctggcatctga

SEQ ID NO: 33823 - DNA, 1582 bp, Homo sapiens
gccatgaaggtgaagaagggcggcggtggggccgggacggcgacggagtccgctccggggccctcgggccagagcgtggcccccataccacagccgcctgcggaatccgaatctgggtccgagtcggagccggacgcaggcccagggcccaggccggggccgctgcagaggaagcagccgatcgggccggaggacgtgctggggctgcagcggatcaccggtgactacctctgctcccctgaggagaatatctacaagatcgactttgtcaggtttaagattcgggacatggactcaggcactgtcctctttgaaatcaagaagcccccagtctcagaacggttgcccatcaaccggcgggacctggaccccaatgctgggcgctttgtccgctaccagttcacgcctgccttcctccgcctgaggcaggtgggagccacggtggagttcacagtgggagacaagcctgtcaacaacttccgcatgatcgagaggcactacttccgcaaccagctactcaaaagcttcgacttccactttggcttctgcatccccagcagcaagaacacctgcgagcacatttacgacttcccccctctctccgaggagctgagtgcgcgggcagggtcttctgggagtggggaagtgggggcgtctagagactgagctgcgggagggagagggacttgtgggtctgatcccatttctccccaccctggggctcttctgtgtctgccaccattcccatatcatccgtagagaaagaggctggggatatttcaggctgtttggctgtccctgtaccccagtcctgaagcccctgcagtggcgggactcaagctcctgacctttgcccggcctggctgggcctctcttgcagtcagcgagatgatccgccacccgtatgagacccagtctgacagcttctacttcgtggatgaccggctggtgatgcacaataaagcagactattcctacagcgggacaccctgaccccacggctgccctgaccccaggaggctccagttctgggctgggagctgtgacctccccaacgctcacccctcaaccccaagtcctctgcttggggagttctccaggagctccggaccctgagtcaatgttgggaggaagggtacctggtgtccccagtcaagcccatgaagcccatgcggcctgctacatggggtggggtcgtagggaggctgtttgcctccacgtctaggaaggcctgtgagaggagcagtcaggacttccggacaacttagctgggccctacttgggcccaagtttcagaatagtgttcccctatcaaggctgtgactagatcaggcagggatccattccctgtcccctgcccactaccttcaggccatttagagttgtaaatttacaaagatccacggtgggctccagctgccaagccacccaagggagtctgggccctaggcctagccccatccctccccatgaggggccaagacactgcctaaggtgtgggagggactggctgagattgcagcccatggtaggagctggaccaactgtatatagttttcaataaactttttccttttctgtt

SEQ ID NO: 33824 - DNA, 1397 bp, Homo sapiens
ggctgcggatgctcccacttcccccggctccagccggcgcaggcagcggcggcagcagcaggcgagcctcggccccgcaaggccatgaaggtgaagaagggcggcggtggggccgggacggcgacggagtccgctccggggccctcgggccagagcgtggcccccataccacagccgcctgcggaatccgaatctgggtccgagtcggagccggacgcaggcccagggcccaggccggggccgctgcagaggaagcagccgatcgggccggaggacgtgctggggctgcagcggatcaccggtgactacctctgctcccctgaggagaatatctacaagatcgactttgtcaggtttaagattcgggacatggactcaggcactgtcctctttgaaatcaagaagcccccagtctcagaacggttgcccatcaaccggcgggacctggaccccaatgctgggcgctttgtccgctaccagttcacgcctgccttcctccgcctgaggcaggtgggagccacggtggagttcacagtgggagacaagcctgtcaacaacttccgcatgatcgagaggcactacttccgcaaccagctactcaaaagcttcgacttccactttggcttctgcatccccagcagcaagaacacctgcgagcacatttacgacttcccccctctctccgaggagctgatcagcgagatgatccgccacccgtatgagacccagtctgacagcttctacttcgtggatgaccggctggtgatgcacaataaagcagactattcctacagcgggacaccctgaccccacggctgccctgaccccaggaggctccagttctgggctgggagctgtgacctccccaacgctcacccctcaaccccaagtcctctgcttggggagttctccaggagctccggaccctgagtcaatgttgggaggaagggtacctggtgtccccagtcaagcccatgaagcccatgcggcctgctacatggggtggggtcgtagggaggctgtttgcctccacgtctaggaaggcctgtgagaggagcagtcaggacttccggacaacttagctgggccctacttgggcccaagtttcagaatagtgttcccctatcaaggctgtgactagatcaggcagggatccattccctgtcccctgcccactaccttcaggccatttagagttgtaaatttacaaagatccacggtgggctccagctgccaagccacccaagggagtctgggccctaggcctagccccatccctccccatgaggggccaagacactgcctaaggtgtgggagggactggctgagattgcagcccatggtaggagctggaccaactgtatatagttttcaataaactttttccttttctgttc

SEQ ID NO: 33825 - DNA, 676 bp, Homo sapiens
gccggcgcaggcagcggcggcagcagcaggcgagcctcggccccgcaaggccatgaaggtgaagaagggcggcggtggggccgggacggcgacggagtccgctccggggccctcgggccagagcgtggcccccataccacagccgcctgcggaatccgaatctgggtccgagtcggagccggacgcaggcccagggcccaggccggggccgctgcagaggaagcagccgatcgggccggaggacgtgctggggctgcagcggatcaccggtggggcccgtccccttttcccagcgtggaggtttaagattcgggacatggactcaggcactgtcctctttgaaatcaagaagcccccagtctcagaacggttgcccatcaaccggcgggacctggaccccaatgctgggcgctttgtccgctaccagttcacgcctgccttcctccgcctgaggcaggtgggagccacggtggagttcacagtgggagacaagcctgtcaacaacttccgcatgatcgagaggcactacttccgcaaccagctactcaaaagcttcgacttccactttggcttctgcatccccagcagcaagaacacctgcgagcacatttacgacttcccccctctctccgaggagctgagtgcgcgggcagggtcttctgggagtggggaagtg

SEQ ID NO: 33826 - DNA, 9837 bp, Homo sapiens
ctgtctctcctctgtgtctctctcaaaaaagccaagtttgatggtgcccaagagaaattcaacacgtacgtgaccctgaaagtgcagaatgtcaagagcacgaccatcgcggtgcggggcagccagcccagctgggagcaggatttcatgttcgagattaaccgtctggatttgggactgacggtggaggtgtggaataagggtctcatctgggacacaatggtgggcactgtgtggatcccactgaggaccatccgccagtccaatgaggagggccctggagagtggctgacgctggactcccaggtcatcatggcagacagtgagatctgtggcaccaaggaccccaccttccaccgcatcctcctggacacgcgctttgagctacccttagacattcctgaagaggaggctcgctactgggccaagaagctggagcagctcaatgctatgcgggaccaggatgaatattcgttccaagatgagcaagacaagcctctgcctgtccccagcaaccagtgctgcaactggaattattttggctggggtgagcagcacaacgatgaccccgacagtgcagtggatgatcgtgacagtgactaccgcagtgaaacgagcaacagcatcccgccgccctattatactacgtcacaacccaacgcctcagtccaccaatattctgttcgcccaccacccctgggctcccgggagtcctacagtgactccatgcacagttacgaggagttctctgagccacaagccctcagccccacgggtagcagccgctatgcctcttccggggagctgagccagggaagctctcagctgagcgaggacttcgaccctgacgagcacagcctgcagggctccgacatggaggatgagcgggaccgggactcctaccactcctgccacagctcggtcagctaccacaaagactcgcctcgctgggaccaggatgaggaagagctggaggaggacctggaggacttcctggaggaggaggagctgcctgaagatgaggaggagctggaggaggaggaggaggaggtgcctgacgatttgggcagctatgcccagcgtgaagacgtagctgtggctgagcccaaagacttcaaacgcatcagcctcccgccagctgccccagggaaggaggacaaggccccagtggcacccaccgaggcccccgacatggccaaggtggcccccaagccagccacgcccgacaaggtgcctgcagctgagcagatccctgaggctgagccacccaaggacgaggagagtttcaggccgagagaggatgaggaaggccaggaggggcaggactccatgtccagggccaaggccaactggctgcgtgccttcaacaaggtgcggatgcagctgcaggaggcccggggagaaggagagatgtctaaatccctatggttcaaaggcggcccagggggcggtctcatcatcatcgacagcatgccagacatccgcaagaggaaacctatcccactcgtgagcgacttggccatgtccctggtccagtccaggaaagcgggcatcacctcggccttggcctccagcacgttgaacaacgaggagctgaaaaaccacgtttacaagaagaccctgcaagccttaatctaccccatctcgtgcacgacgccacacaacttcgaagtgtggacggccaccacgcccacctactgctacgagtgcgaggggctgctgtggggcatcgcgaggcagggcatgcgctgcaccgagtgcggtgtcaagtgccacgagaagtgccaggacctgctcaacgccgactgcctgcagcgggctgcggagaagagctccaagcacggggcggaggaccggacacagaacatcatcatggtgctcaaggaccgcatgaagatccgggagcgcaacaagcccgagatcttcgagctcatccaggagatcttcgcggtgaccaagacggcgcacacgcagcagatgaaggcggtcaagcagagcgtgctggacggcacgtccaagtggtccgccaagatcagcatcaccgtggtctgcgcccagggcttgcaggcaaaggacaagacaggatccagtgacccctatgtcaccgtccaggtcgggaagaccaagaaacggacaaaaaccatctatgggaacctcaacccggtgtgggaggagaatttccactttgaatgtcacaattcctccgaccgcatcaaggtgcgcgtctgggacgaggatgacgacatcaaatcccgcgtgaaacagaggttcaagagggaatctgacgatttcctggggcagacgatcattgaggtgcggacgctcagcggcgagatggacgtgtggtacaacctggacaagcgaactgacaaatctgccgtgtcgggtgccatccggctccacatcagtgtggagatcaaaggcgaggagaaggtggccccgtaccatgtccagtacacctgtctgcatgagaacctgttccacttcgtgaccgacgtgcagaacaatggggtcgtgaagatcccagatgccaagggtgacgatgcctggaaggtttactacgatgagacagcccaggagattgtggacgagtttgccatgcgctacggcgtcgagtccatctaccaagccatgacccactttgcctgcctctcctccaagtatatgtgcccaggggtgcctgccgtcatgagcaccctgctcgccaacatcaatgcctactacgcacacaccaccgcctccaccaacgtgtctgcctccgaccgcttcgccgcctccaactttgggaaagagcgcttcgtgaaactcctggaccagctgcataactccctgcggattgacctctccatgtaccggaataacttcccagccagcagcccggagagactccaggacctcaaatccactgtggaccttctcaccagcatcaccttctttcggatgaaggtacaagaactccagagcccgccccgagccagccaggtggtaaaggactgtgtgaaagcctgccttaattctacctacgagtacatcttcaataactgccatgaactgtacagccgggagtaccagacagacccggccaagaagggggaagttctcccagaggaacaggggcccagcatcaagaacctcgacttctggtccaagctgattaccctcatagtgtccatcattgaggaagacaagaattcctacactccctgcctcaaccagtttccccaggagctgaatgtgggtaaaatcagcgctgaagtgatgtggaatctgtttgcccaagacatgaagtacgccatggaggagcacgacaagcatcgtctatgcaagagtgccgactacatgaacctccacttcaaggtgaaatggctctacaatgagtatgtgacggaacttcccgccttcaaggaccgcgtgcctgagtaccctgcatggtttgaacccttcgtcatccagtggctggatgagaatgaggaggtgtcccgggatttcctgcacggtgccctggagcgagacaagaaggatgggttccagcagacctcagagcatgccctattctcctgctccgtggtggatgttttctcccaactcaaccagagctttgaaatcatcaagaaactcgagtgtcccgaccctcagatcgtggggcactacatgaggcgctttgccaagaccatcagtaatgtgctcctccagtatgcagacatcatctccaaggactttgcctcctactgctccaaggagaaggagaaagtgccctgcattctcatgaataacactcaacagctacgagttcagctggagaagatgttcgaagccatgggaggaaaggagctggatgctgaagccagtgacatcctgaaggagcttcaggtgaaactcaataacgtcttggatgagctcagccgggtgtttgctaccagcttccagccgcacattgaagagtgtgtcaaacagatgggtgacatccttagccaggttaagggcacaggcaatgtgccagccagtgcctgcagcagcgtggcccaggacgcggacaatgtgttgcagcccatcatggacctgctggacagcaacctgaccctctttgccaaaatctgtgagaagactgtgctgaagcgagtgctgaaggagctgtggaagctggttatgaacaccatggagaaaaccatcgtcctgccgcccctcactgaccagacgctgcaggggaacctcttgagaaaacatggcaagggattagaaaagggcagggtgaaattgccaagccactcagacggaacccagatgatcttcaatgcagccaaggagctgggtcagctgtccaaactcaaggatcacatggtacgagaagaagccaagagcttgaccccaaagcagtgcgcggttgttgagttggccctggacaccatcaagcaatatttccacgcgggtggcgtgggcctcaagaagaccttcctggagaagagcccggacctgcaatccttgcgctatgccctgtcgctctacacgcaggccaccgacctgctaatcaagacctttgtacagacgcaatcggcccagggcttgggtgtagaagaccctgtgggtgaagtctctgtccatgttgagctgttcactcatccaggaactggggaacacaaggtcacagtgaaagtggtggctgccaatgacctcaagtggcagacttctggcatcttccggccgttcatcgaggtcaacatcattgggccccagctcagcgacaagaaacgcaagtttgcgaccaaatccaagaacaatagctgggctcccaagtacaatgagagcttccagttcacgctgagcgccgacgcgggtcccgagtgctatgagctgcaggtgtgcgtcaaggactactgcttcgcgcgcgaggaccgcacggtggggctggccgtgctgcagctgcgtgagctggcccagcgcgggagcgccgcctgctggctgccgctcggccgccgcatccacatggacgacacgggcctcacggtgctgcgaatcctctcgcagcgcagcaacgacgaggtggccaaggagttcgtgaagctcaagtcggacacgcgctccgccgaggagggcggtgccgcgcctgcgccttagcgcgggcggtcggccgagcggcactgcgcctgcgcggagggcgctgggcggggagggacggggcttgcgccttggtgggacctccccaggggcggggctcggggggctccacgccaagggtgggctgcgcctacgcccttgactcagctttcccttttggggaattaggaatggaggatgccccgccctctcgggaggccacgcccaagggcgcgacgaaggaaggagccacatccccaacttgaggccacgcccccagcacctagggggcattttgagctgggatgggggaaacctcgtccctatggaggaggccacatcccggggctctggtaccgggaggcaccacctcatgtcccctggaaaagccataagatgggacccagacccctgggaccccagaccaattgccaagtatggaaatctcagctccctcgagggggggccctgggcaaggggtagggctctctggagcgcccctctaggtggcctggggactggagggaccaggatgctggttggagggccccggaataccggagtccctttagatatttgtgcaaaaaataaatggggggaggggggaggatgggatttcaaaagcacatgcgcccttgggcgcccaaaccctgggggccgaggggacggctctggttccccacgctgcccctacttccctttgggagtttgcctctccctctcccccaacaaacccagtcctcatatcatagagttcaacacacccatttgacagatggcaaaactgaggcttaaagagctgcttgagacttggccaaggttccaggtgccataccctctgtgcccctcccttaggcctgtgtgccccatggaagggtgggctgagatcgggatgacctgacacagctccctattgctgctaattccccctcggcctcctccaaggggtgggaattccaggccaagacccctacttcgcctttccttctccggctgccaagcaggacctttgccctcagccctttctcctgggatctccatgggggatgccatgagggcctcccaccacaaaagagaatttgggatcccctggtcccaggtttctccatcccttcttccttttccagaattttccaaataggaaagaacagaaggagaccagaaactctaggggggagaaagagaatgagagaaagagaatgagagagagagaaacacaaacacagtgacacagtgagagcttagtctccaagagcctattcattgattcaaacacccaagccacaggatacctcagatggccctcttgccagctggaagctctttctccaatgagcaaagttacagtgacctggctggagttacctggtgcacataggaccttaggggaaagttcagcgtggactacacttgctctgggatctgcttttccacatgtgtgtatggcacgcctttttctgctggattgggaaggacaagattttgctgtgctagggagaaatgaaaacggggtgagctgagtagctgggtttctggaggatagaacatcagatggggaggctttccgaggtgaagaatgagagggaaccacttactagagagaaaagagctccaggcctggggaacagcacgtgcgaaggccaggagagaagaactgttgaaacaacgagaagggtggcacggctggagctgagccagcaagggggatcgtgaggagccttggggttggggagatctgcagaagcatcagaccaggcagggcctcgtacgcagtcctgaggagttttacttttattctaagacagttggggagctccaggagctgttttaagttggggagagactggattccagcctgcaaaagctgttttgtgaagactaaaaccagtgaggagaggtggaggtgctttggggacactgaaatggattcttggaaagattctgaaggctgtgttgaaaagacacctatagctgtggggacatgactataatcccagcatttggggagaccgaggctggcagatcacttaaggtcaggagtttgagaccagcctggccaacatggcgaaaccccatctctgctaaaaatacaaaaattagctgggtgcagtggtgcatgcctgtagtcccagctactcaggagactgaggcgggagaattgtttgaaccctggaggcagaggttgtagtgagtcgtgatcacacaactgcactccagcctgggcaacagaacaatactccattccctcccctctaccccaccaaaaaaaaaaaaaaatcctgcccttagatgagctctagggctgctgagtacagttgtcccagttgcacagtgcccaagggtttggcattgctaagaaggccacgtgcaaatcctagatattgagtgttgtatgtttgtgacgttggtttcccgacatgtgaatggcccaagtgtctggaagaagtggcgccactttctaatttgcttggagatgttgcatgtcccttaaattcagacaggtgcaggtaactggaggttctgaaccaaaggttaaaatgcaaattctcatacagggttgggaagttgtagccagggataagcttatgtgactgttatatggactgaggagcagatgtgaatttcgaaccatgacatggctgagggtaggggtcgggtggatggatgattcagggttgtaacccatagagcccaaaggggaagtgatctgtgacctggggtgagggtgatctggaagatttttggatggctggaaagaaatggggaagtcgagctgcctgagagagccaagttatttcccaaaagattccttaggagtctttctgttcaagacctccgtgtgtgtgtgtgtgtgtttagggttccccagcaatggcccaggcatgtgaaggaaacaagcttcttcagggaatatttgttgaatgagttttcctgactcccaggctagaactgtttttgcaatttccaccctcttttctttcccccagagaactcctattcgtccttcaaaacccatcacggaaacccctcttggagaaaaccctccttccttcccctcaggactttcccagccaccgtctctcctccagtccagcctgatgccatgggactgggggtttctctgtccagctctgtttctcccagactggggtctgaggactctcaggacccccaactttacctagcacaggctgggcacaagtgggtgacagggagtctacgcctagtggaattatgtattggggcagggtcagtgtgagaatacacatccgcatgcatgtctgtccatgtctgtccgtaccaaccttccccttccacacggacctgggcacataggaggtgtctgagcctgacacatgggacagagagtggacatggctgagacacggacagagaaaagacaaggagtccagggggctgaaagccttttgaaatcaggaagttcctgtattggcagaacaaagcccagagaggagcagggctttcctcaacgccacccagcaagtggacacagagcccggccttggatgacacctccagggttctgaaccctggacctcgctttatgcaaggagctggccccacatttccatgaatcggggaaacagcacaagaaggttggcctgtggcagggcaagggttaaaggggtgacattgagggatgcctcagagtcaaagtcccctgaccaagaggaatagagtagaaaacacagagacagagggtgagatcacgccccgatgaggacggagagagacagagatggagagagacatagaggtggaaatatacagagaaagataaatgcagagaccaaggcagggagtgtcgggggaagtaaagagggtgtcctgaagaaagaaggatctgttcactcttaccagtctgtcctcgaatgatttgcataaaatgaggaggtgcctgtccacacccccaattcctctctcaggccccagagcctgagacctcaccatgcccccatcagagatgcaaaaaactaaacacccaactagaaatccttgggacctctctcggctgggatctcagagcctttctgtcccctacccctaccccatgtgctgtcgattttgcagatggggacaacctggggcctcccggaactctgccaccctggggaagttgggggagggccttagtcccggatcacaaccccgtctgctccccagaatcctttcctaagaatcgttgaggaccaaagttgtctttgctgacacgtgttgcttttctctttgccttttattgtttcagagaaaaatcaagttgactgtgtcaagtaacaccccaccccttacccccgtccagccatagtggctctctggagacacaggtcacaggcggagggtcccctgatcatccccaaccacacagccagggggacttgacccctgtccacccctgtctcgtgctccctcagacccccacaaaccggccaagcagtccggggaggcttcccctccacacaactcttagcatgtgattgcagatgtgaaatcaaaacgttgtttgttttttgttttgttttgattctaccccgtcggtccagtgtctgcacagacgccttcatttctctgtaaatatgtgacttggaacaaatgtttaacacaaacgagaagtggtcatgaatgcatggtgttgagatgttttgcactattctgactttttggtctctgtaaaaatattttattaacagcagacattaaaaaaagaaaaaccacacacagccttgg

SEQ ID NO: 33827 - DNA, 10101 bp, Homo sapiens
atgggtggcgggggcacgtgcaccatttcagtgcaggtgagggtctgcacaggaggaaacctgcttgggggccgccgtcgccccttgtccccctgcaacgaggaggtgtggggcgaggcgccccttcccggagccaggccctttaacgcccccccagcccgcagcgcccccgccccatcaggcgtccctgggctccgcctgcccgccccgcatcagcgccacagccggcccggccgcctccggcccacctgcgagctcggagacatgtctctgctttgcgttggagtcaaaaaagccaagtttgatggtgcccaagagaaattcaacacgtacgtgaccctgaaagtgcagaatgtcaagagcacgaccatcgcggtgcggggcagccagcccagctgggagcaggatttcatgttcgagattaaccgtctggatttgggactgacggtggaggtgtggaataagggtctcatctgggacacaatggtgggcactgtgtggatcccactgaggaccatccgccagtccaatgaggagggccctggagagtggctgacgctggactcccaggtcatcatggcagacagtgagatctgtggcaccaaggaccccaccttccaccgcatcctcctggacacgcgctttgagctacccttagacattcctgaagaggaggctcgctactgggccaagaagctggagcagctcaatgctatgcgggaccaggatgaatattcgttccaagatgagcaagacaagcctctgcctgtccccagcaaccagtgctgcaactggaattattttggctggggtgagcagcacaacgatgaccccgacagtgcagtggatgatcgtgacagtgactaccgcagtgaaacgagcaacagcatcccgccgccctattatactacgtcacaacccaacgcctcagtccaccaatattctgttcgcccaccacccctgggctcccgggagtcctacagtgactccatgcacagttacgaggagttctctgagccacaagccctcagccccacgggtagcagccgctatgcctcttccggggagctgagccagggaagctctcagctgagcgaggacttcgaccctgacgagcacagcctgcagggctccgacatggaggatgagcgggaccgggactcctaccactcctgccacagctcggtcagctaccacaaagactcgcctcgctgggaccaggatgaggaagagctggaggaggacctggaggacttcctggaggaggaggagctgcctgaagatgaggaggagctggaggaggaggaggaggaggtgcctgacgatttgggcagctatgcccagcgtgaagacgtagctgtggctgagcccaaagacttcaaacgcatcagcctcccgccagctgccccagggaaggaggacaaggccccagtggcacccaccgaggcccccgacatggccaaggtggcccccaagccagccacgcccgacaaggtgcctgcagctgagcagatccctgaggctgagccacccaaggacgaggagagtttcaggccgagagaggatgaggaaggccaggaggggcaggactccatgtccagggccaaggccaactggctgcgtgccttcaacaaggtgcggatgcagctgcaggaggcccggggagaaggagagatgtctaaatccctatggttcaaaggcggcccagggggcggtctcatcatcatcgacagcatgccagacatccgcaagaggaaacctatcccactcgtgagcgacttggccatgtccctggtccagtccaggaaagcgggcatcacctcggccttggcctccagcacgttgaacaacgaggagctgaaaaaccacgtttacaagaagaccctgcaagccttaatctaccccatctcgtgcacgacgccacacaacttcgaagtgtggacggccaccacgcccacctactgctacgagtgcgaggggctgctgtggggcatcgcgaggcagggcatgcgctgcaccgagtgcggtgtcaagtgccacgagaagtgccaggacctgctcaacgccgactgcctgcagcgggctgcggagaagagctccaagcacggggcggaggaccggacacagaacatcatcatggtgctcaaggaccgcatgaagatccgggagcgcaacaagcccgagatcttcgagctcatccaggagatcttcgcggtgaccaagacggcgcacacgcagcagatgaaggcggtcaagcagagcgtgctggacggcacgtccaagtggtccgccaagatcagcatcaccgtggtctgcgcccagggcttgcaggcaaaggacaagacaggatccagtgacccctatgtcaccgtccaggtcgggaagaccaagaaacggacaaaaaccatctatgggaacctcaacccggtgtgggaggagaatttccactttgaatgtcacaattcctccgaccgcatcaaggtgcgcgtctgggacgaggatgacgacatcaaatcccgcgtgaaacagaggttcaagagggaatctgacgatttcctggggcagacgatcattgaggtgcggacgctcagcggcgagatggacgtgtggtacaacctggacaagcgaactgacaaatctgccgtgtcgggtgccatccggctccacatcagtgtggagatcaaaggcgaggagaaggtggccccgtaccatgtccagtacacctgtctgcatgagaacctgttccacttcgtgaccgacgtgcagaacaatggggtcgtgaagatcccagatgccaagggtgacgatgcctggaaggtttactacgatgagacagcccaggagattgtggacgagtttgccatgcgctacggcgtcgagtccatctaccaagccatgacccactttgcctgcctctcctccaagtatatgtgcccaggggtgcctgccgtcatgagcaccctgctcgccaacatcaatgcctactacgcacacaccaccgcctccaccaacgtgtctgcctccgaccgcttcgccgcctccaactttgggaaagagcgcttcgtgaaactcctggaccagctgcataactccctgcggattgacctctccatgtaccggaataacttcccagccagcagcccggagagactccaggacctcaaatccactgtggaccttctcaccagcatcaccttctttcggatgaaggtacaagaactccagagcccgccccgagccagccaggtggtaaaggactgtgtgaaagcctgccttaattctacctacgagtacatcttcaataactgccatgaactgtacagccgggagtaccagacagacccggccaagaagggggaagttctcccagaggaacaggggcccagcatcaagaacctcgacttctggtccaagctgattaccctcatagtgtccatcattgaggaagacaagaattcctacactccctgcctcaaccagtttccccaggagctgaatgtgggtaaaatcagcgctgaagtgatgtggaatctgtttgcccaagacatgaagtacgccatggaggagcacgacaagcatcgtctatgcaagagtgccgactacatgaacctccacttcaaggtgaaatggctctacaatgagtatgtgacggaacttcccgccttcaaggaccgcgtgcctgagtaccctgcatggtttgaacccttcgtcatccagtggctggatgagaatgaggaggtgtcccgggatttcctgcacggtgccctggagcgagacaagaaggatgggttccagcagacctcagagcatgccctattctcctgctccgtggtggatgttttctcccaactcaaccagagctttgaaatcatcaagaaactcgagtgtcccgaccctcagatcgtggggcactacatgaggcgctttgccaagaccatcagtaatgtgctcctccagtatgcagacatcatctccaaggactttgcctcctactgctccaaggagaaggagaaagtgccctgcattctcatgaataacactcaacagctacgagttcagctggagaagatgttcgaagccatgggaggaaaggagctggatgctgaagccagtgacatcctgaaggagcttcaggtgaaactcaataacgtcttggatgagctcagccgggtgtttgctaccagcttccagccgcacattgaagagtgtgtcaaacagatgggtgacatccttagccaggttaagggcacaggcaatgtgccagccagtgcctgcagcagcgtggcccaggacgcggacaatgtgttgcagcccatcatggacctgctggacagcaacctgaccctctttgccaaaatctgtgagaagactgtgctgaagcgagtgctgaaggagctgtggaagctggttatgaacaccatggagaaaaccatcgtcctgccgcccctcactgaccagacgatgatcgggaacctcttgagaaaacatggcaagggattagaaaagggcagggtgaaattgccaagccactcagacggaacccagatgatcttcaatgcagccaaggagctgggtcagctgtccaaactcaaggatcacatggtacgagaagaagccaagagcttgaccccaaagcagtgcgcggttgttgagttggccctggacaccatcaagcaatatttccacgcgggtggcgtgggcctcaagaagaccttcctggagaagagcccggacctgcaatccttgcgctatgccctgtcgctctacacgcaggccaccgacctgctaatcaagacctttgtacagacgcaatcggcccagggcttgggtgtagaagaccctgtgggtgaagtctctgtccatgttgagctgttcactcatccaggaactggggaacacaaggtcacagtgaaagtggtggctgccaatgacctcaagtggcagacttctggcatcttccggccgttcatcgaggtcaacatcattgggccccagctcagcgacaagaaacgcaagtttgcgaccaaatccaagaacaatagctgggctcccaagtacaatgagagcttccagttcacgctgagcgccgacgcgggtcccgagtgctatgagctgcaggtgtgcgtcaaggactactgcttcgcgcgcgaggaccgcacggtggggctggccgtgctgcagctgcgtgagctggcccagcgcgggagcgccgcctgctggctgccgctcggccgccgcatccacatggacgacacgggcctcacggtgctgcgaatcctctcgcagcgcagcaacgacgaggtggccaaggagttcgtgaagctcaagtcggacacgcgctccgccgaggagggcggtgccgcgcctgcgccttagcgcgggcggtcggccgagcggcactgcgcctgcgcggagggcgctgggcggggagggacggggcttgcgccttggtgggacctccccaggggcggggctcggggggctccacgccaagggtgggctgcgcctacgcccttgactcagctttcccttttggggaattaggaatggaggatgccccgccctctcgggaggccacgcccaagggcgcgacgaaggaaggagccacatccccaacttgaggccacgcccccagcacctagggggcattttgagctgggatgggggaaacctcgtccctatggaggaggccacatcccggggctctggtaccgggaggcaccacctcatgtcccctggaaaagccataagatgggacccagacccctgggaccccagaccaattgccaagtatggaaatctcagctccctcgagggggggccctgggcaaggggtagggctctctggagcgcccctctaggtggcctggggactggagggaccaggatgctggttggagggccccggaataccggagtccctttagatatttgtgcaaaaaataaatggggggaggggggaggatgggatttcaaaagcacatgcgcccttgggcgcccaaaccctgggggccgaggggacggctctggttccccacgctgcccctacttccctttgggagtttgcctctccctctcccccaacaaacccagtcctcatatcatagagttcaacacacccatttgacagatggcaaaactgaggcttaaagagctgcttgagacttggccaaggttccaggtgccataccctctgtgcccctcccttaggcctgtgtgccccatggaagggtgggctgagatcgggatgacctgacacagctccctattgctgctaattccccctcggcctcctccaaggggtgggaattccaggccaagacccctacttcgcctttccttctccggctgccaagcaggacctttgccctcagccctttctcctgggatctccatgggggatgccatgagggcctcccaccacaaaagagaatttgggatcccctggtcccaggtttctccatcccttcttccttttccagaattttccaaataggaaagaacagaaggagaccagaaactctaggggggagaaagagaatgagagaaagagaatgagagagagagaaacacaaacacagtgacacagtgagagcttagtctccaagagcctattcattgattcaaacacccaagccacaggatacctcagatggccctcttgccagctggaagctctttctccaatgagcaaagttacagtgacctggctggagttacctggtgcacataggaccttaggggaaagttcagcgtggactacacttgctctgggatctgcttttccacatgtgtgtatggcacgcctttttctgctggattgggaaggacaagattttgctgtgctagggagaaatgaaaacggggtgagctgagtagctgggtttctggaggatagaacatcagatggggaggctttccgaggtgaagaatgagagggaaccacttactagagagaaaagagctccaggcctggggaacagcacgtgcgaaggccaggagagaagaactgttgaaacaacgagaagggtggcacggctggagctgagccagcaagggggatcgtgaggagccttggggttggggagatctgcagaagcatcagaccaggcagggcctcgtacgcagtcctgaggagttttacttttattctaagacagttggggagctccaggagctgttttaagttggggagagactggattccagcctgcaaaagctgttttgtgaagactaaaaccagtgaggagaggtggaggtgctttggggacactgaaatggattcttggaaagattctgaaggctgtgttgaaaagacacctatagctgtggggacatgactataatcccagcatttggggagaccgaggctggcagatcacttaaggtcaggagtttgagaccagcctggccaacatggcgaaaccccatctctgctaaaaatacaaaaattagctgggtgcagtggtgcatgcctgtagtcccagctactcaggagactgaggcgggagaattgtttgaaccctggaggcagaggttgtagtgagtcgtgatcacacaactgcactccagcctgggcaacagaacaatactccattccctcccctctaccccaccaaaaaaaaaaaaaaatcctgcccttagatgagctctagggctgctgagtacagttgtcccagttgcacagtgcccaagggtttggcattgctaagaaggccacgtgcaaatcctagatattgagtgttgtatgtttgtgacgttggtttcccgacatgtgaatggcccaagtgtctggaagaagtggcgccactttctaatttgcttggagatgttgcatgtcccttaaattcagacaggtgcaggtaactggaggttctgaaccaaaggttaaaatgcaaattctcatacagggttgggaagttgtagccagggataagcttatgtgactgttatatggactgaggagcagatgtgaatttcgaaccatgacatggctgagggtaggggtcgggtggatggatgattcagggttgtaacccatagagcccaaaggggaagtgatctgtgacctggggtgagggtgatctggaagatttttggatggctggaaagaaatggggaagtcgagctgcctgagagagccaagttatttcccaaaagattccttaggagtctttctgttcaagacctccgtgtgtgtgtgtgtgtgtttagggttccccagcaatggcccaggcatgtgaaggaaacaagcttcttcagggaatatttgttgaatgagttttcctgactcccaggctagaactgtttttgcaatttccaccctcttttctttcccccagagaactcctattcgtccttcaaaacccatcacggaaacccctcttggagaaaaccctccttccttcccctcaggactttcccagccaccgtctctcctccagtccagcctgatgccatgggactgggggtttctctgtccagctctgtttctcccagactggggtctgaggactctcaggacccccaactttacctagcacaggctgggcacaagtgggtgacagggagtctacgcctagtggaattatgtattggggcagggtcagtgtgagaatacacatccgcatgcatgtctgtccatgtctgtccgtaccaaccttccccttccacacggacctgggcacataggaggtgtctgagcctgacacatgggacagagagtggacatggctgagacacggacagagaaaagacaaggagtccagggggctgaaagccttttgaaatcaggaagttcctgtattggcagaacaaagcccagagaggagcagggctttcctcaacgccacccagcaagtggacacagagcccggccttggatgacacctccagggttctgaaccctggacctcgctttatgcaaggagctggccccacatttccatgaatcggggaaacagcacaagaaggttggcctgtggcagggcaagggttaaaggggtgacattgagggatgcctcagagtcaaagtcccctgaccaagaggaatagagtagaaaacacagagacagagggtgagatcacgccccgatgaggacggagagagacagagatggagagagacatagaggtggaaatatacagagaaagataaatgcagagaccaaggcagggagtgtcgggggaagtaaagagggtgtcctgaagaaagaaggatctgttcactcttaccagtctgtcctcgaatgatttgcataaaatgaggaggtgcctgtccacacccccaattcctctctcaggccccagagcctgagacctcaccatgcccccatcagagatgcaaaaaactaaacacccaactagaaatccttgggacctctctcggctgggatctcagagcctttctgtcccctacccctaccccatgtgctgtcgattttgcagatggggacaacctggggcctcccggaactctgccaccctggggaagttgggggagggccttagtcccggatcacaaccccgtctgctccccagaatcctttcctaagaatcgttgaggaccaaagttgtctttgctgacacgtgttgcttttctctttgccttttattgtttcagagaaaaatcaagttgactgtgtcaagtaacaccccaccccttacccccgtccagccatagtggctctctggagacacaggtcacaggcggagggtcccctgatcatccccaaccacacagccagggggacttgacccctgtccacccctgtctcgtgctccctcagacccccacaaaccggccaagcagtccggggaggcttcccctccacacaactcttagcatgtgattgcagatgtgaaatcaaaacgttgtttgttttttgttttgttttgattctaccccgtcggtccagtgtctgcacagacgccttcatttctctgtaaatatgtgacttggaacaaatgtttaacacaaacgagaagtggtcatgaatgcatggtgttgagatgttttgcactattctgactttttggtctctgtaaaaatattttattaacagcagacattaaaaaaagaaaaaccacacacagccttgg

SEQ ID NO: 33828 - DNA, 9838 bp, Homo sapiens
atgtctctgctttgcgttggagtcaaaaaagccaagtttgatggtgcccaagagaaattcaacacgtacgtgaccctgaaagtgcagaatgtcaagagcacgaccatcgcggtgcggggcagccagcccagctgggagcaggatttcatgttcgagattaaccgtctggatttgggactgacggtggaggtgtggaataagggtctcatctgggacacaatggtgggcactgtgtggatcccactgaggaccatccgccagtccaatgaggagggccctggagagtggctgacgctggactcccaggtcatcatggcagacagtgagatctgtggcaccaaggaccccaccttccaccgcatcctcctggacacgcgctttgagctacccttagacattcctgaagaggaggctcgctactgggccaagaagctggagcagctcaatgctatgcgggaccaggatgaatattcgttccaagatgagcaagacaagcctctgcctgtccccagcaaccagtgctgcaactggaattattttggctggggtgagcagcacaacgatgaccccgacagtgcagtggatgatcgtgacagtgactaccgcagtgaaacgagcaacagcatcccgccgccctattatactacgtcacaacccaacgcctcagtccaccaatattctgttcgcccaccacccctgggctcccgggagtcctacagtgactccatgcacagttacgaggagttctctgagccacaagccctcagccccacgggtagcagccgctatgcctcttccggggagctgagccagggaagctctcagctgagcgaggacttcgaccctgacgagcacagcctgcagggctccgacatggaggatgagcgggaccgggactcctaccactcctgccacagctcggtcagctaccacaaagactcgcctcgctgggaccaggatgaggaagagctggaggaggacctggaggacttcctggaggaggaggagctgcctgaagatgaggaggagctggaggaggaggaggaggaggtgcctgacgatttgggcagctatgcccagcgtgaagacgtagctgtggctgagcccaaagacttcaaacgcatcagcctcccgccagctgccccagggaaggaggacaaggccccagtggcacccaccgaggcccccgacatggccaaggtggcccccaagccagccacgcccgacaaggtgcctgcagctgagcagatccctgaggctgagccacccaaggacgaggagagtttcaggccgagagaggatgaggaaggccaggaggggcaggactccatgtccagggccaaggccaactggctgcgtgccttcaacaaggtgcggatgcagctgcaggaggcccggggagaaggagagatgtctaaatccctatggttcaaaggcggcccagggggcggtctcatcatcatcgacagcatgccagacatccgcaagaggaaacctatcccactcgtgagcgacttggccatgtccctggtccagtccaggaaagcgggcatcacctcggccttggcctccagcacgttgaacaacgaggagctgaaaaaccacgtttacaagaagaccctgcaagccttaatctaccccatctcgtgcacgacgccacacaacttcgaagtgtggacggccaccacgcccacctactgctacgagtgcgaggggctgctgtggggcatcgcgaggcagggcatgcgctgcaccgagtgcggtgtcaagtgccacgagaagtgccaggacctgctcaacgccgactgcctgcagcgggctgcggagaagagctccaagcacggggcggaggaccggacacagaacatcatcatggtgctcaaggaccgcatgaagatccgggagcgcaacaagcccgagatcttcgagctcatccaggagatcttcgcggtgaccaagacggcgcacacgcagcagatgaaggcggtcaagcagagcgtgctggacggcacgtccaagtggtccgccaagatcagcatcaccgtggtctgcgcccagggcttgcaggcaaaggacaagacaggatccagtgacccctatgtcaccgtccaggtcgggaagaccaagaaacggacaaaaaccatctatgggaacctcaacccggtgtgggaggagaatttccactttgaatgtcacaattcctccgaccgcatcaaggtgcgcgtctgggacgaggatgacgacatcaaatcccgcgtgaaacagaggttcaagagggaatctgacgatttcctggggcagacgatcattgaggtgcggacgctcagcggcgagatggacgtgtggtacaacctggacaagcgaactgacaaatctgccgtgtcgggtgccatccggctccacatcagtgtggagatcaaaggcgaggagaaggtggccccgtaccatgtccagtacacctgtctgcatgagaacctgttccacttcgtgaccgacgtgcagaacaatggggtcgtgaagatcccagatgccaagggtgacgatgcctggaaggtttactacgatgagacagcccaggagattgtggacgagtttgccatgcgctacggcgtcgagtccatctaccaagccatgacccactttgcctgcctctcctccaagtatatgtgcccaggggtgcctgccgtcatgagcaccctgctcgccaacatcaatgcctactacgcacacaccaccgcctccaccaacgtgtctgcctccgaccgcttcgccgcctccaactttgggaaagagcgcttcgtgaaactcctggaccagctgcataactccctgcggattgacctctccatgtaccggaataacttcccagccagcagcccggagagactccaggacctcaaatccactgtggaccttctcaccagcatcaccttctttcggatgaaggtacaagaactccagagcccgccccgagccagccaggtggtaaaggactgtgtgaaagcctgccttaattctacctacgagtacatcttcaataactgccatgaactgtacagccgggagtaccagacagacccggccaagaagggggaagttctcccagaggaacaggggcccagcatcaagaacctcgacttctggtccaagctgattaccctcatagtgtccatcattgaggaagacaagaattcctacactccctgcctcaaccagtttccccaggagctgaatgtgggtaaaatcagcgctgaagtgatgtggaatctgtttgcccaagacatgaagtacgccatggaggagcacgacaagcatcgtctatgcaagagtgccgactacatgaacctccacttcaaggtgaaatggctctacaatgagtatgtgacggaacttcccgccttcaaggaccgcgtgcctgagtaccctgcatggtttgaacccttcgtcatccagtggctggatgagaatgaggaggtgtcccgggatttcctgcacggtgccctggagcgagacaagaaggatgggttccagcagacctcagagcatgccctattctcctgctccgtggtggatgttttctcccaactcaaccagagctttgaaatcatcaagaaactcgagtgtcccgaccctcagatcgtggggcactacatgaggcgctttgccaagaccatcagtaatgtgctcctccagtatgcagacatcatctccaaggactttgcctcctactgctccaaggagaaggagaaagtgccctgcattctcatgaataacactcaacagctacgagttcagctggagaagatgttcgaagccatgggaggaaaggagctggatgctgaagccagtgacatcctgaaggagcttcaggtgaaactcaataacgtcttggatgagctcagccgggtgtttgctaccagcttccagccgcacattgaagagtgtgtcaaacagatgggtgacatccttagccaggttaagggcacaggcaatgtgccagccagtgcctgcagcagcgtggcccaggacgcggacaatgtgttgcagcccatcatggacctgctggacagcaacctgaccctctttgccaaaatctgtgagaagactgtgctgaagcgagtgctgaaggagctgtggaagctggttatgaacaccatggagaaaaccatcgtcctgccgcccctcactgaccagacgatgatcgggaacctcttgagaaaacatggcaagggattagaaaagggcagggtgaaattgccaagccactcagacggaacccagatgatcttcaatgcagccaaggagctgggtcagctgtccaaactcaaggatcacatggtacgagaagaagccaagagcttgaccccaaagcagtgcgcggttgttgagttggccctggacaccatcaagcaatatttccacgcgggtggcgtgggcctcaagaagaccttcctggagaagagcccggacctgcaatccttgcgctatgccctgtcgctctacacgcaggccaccgacctgctaatcaagacctttgtacagacgcaatcggcccagggcttgggtgtagaagaccctgtgggtgaagtctctgtccatgttgagctgttcactcatccaggaactggggaacacaaggtcacagtgaaagtggtggctgccaatgacctcaagtggcagacttctggcatcttccggccgttcatcgaggtcaacatcattgggccccagctcagcgacaagaaacgcaagtttgcgaccaaatccaagaacaatagctgggctcccaagtacaatgagagcttccagttcacgctgagcgccgacgcgggtcccgagtgctatgagctgcaggtgtgcgtcaaggactactgcttcgcgcgcgaggaccgcacggtggggctggccgtgctgcagctgcgtgagctggcccagcgcgggagcgccgcctgctggctgccgctcggccgccgcatccacatggacgacacgggcctcacggtgctgcgaatcctctcgcagcgcagcaacgacgaggtggccaaggagttcgtgaagctcaagtcggacacgcgctccgccgaggagggcggtgccgcgcctgcgccttagcgcgggcggtcggccgagcggcactgcgcctgcgcggagggcgctgggcggggagggacggggcttgcgccttggtgggacctccccaggggcggggctcggggggctccacgccaagggtgggctgcgcctacgcccttgactcagctttcccttttggggaattaggaatggaggatgccccgccctctcgggaggccacgcccaagggcgcgacgaaggaaggagccacatccccaacttgaggccacgcccccagcacctagggggcattttgagctgggatgggggaaacctcgtccctatggaggaggccacatcccggggctctggtaccgggaggcaccacctcatgtcccctggaaaagccataagatgggacccagacccctgggaccccagaccaattgccaagtatggaaatctcagctccctcgagggggggccctgggcaaggggtagggctctctggagcgcccctctaggtggcctggggactggagggaccaggatgctggttggagggccccggaataccggagtccctttagatatttgtgcaaaaaataaatggggggaggggggaggatgggatttcaaaagcacatgcgcccttgggcgcccaaaccctgggggccgaggggacggctctggttccccacgctgcccctacttccctttgggagtttgcctctccctctcccccaacaaacccagtcctcatatcatagagttcaacacacccatttgacagatggcaaaactgaggcttaaagagctgcttgagacttggccaaggttccaggtgccataccctctgtgcccctcccttaggcctgtgtgccccatggaagggtgggctgagatcgggatgacctgacacagctccctattgctgctaattccccctcggcctcctccaaggggtgggaattccaggccaagacccctacttcgcctttccttctccggctgccaagcaggacctttgccctcagccctttctcctgggatctccatgggggatgccatgagggcctcccaccacaaaagagaatttgggatcccctggtcccaggtttctccatcccttcttccttttccagaattttccaaataggaaagaacagaaggagaccagaaactctaggggggagaaagagaatgagagaaagagaatgagagagagagaaacacaaacacagtgacacagtgagagcttagtctccaagagcctattcattgattcaaacacccaagccacaggatacctcagatggccctcttgccagctggaagctctttctccaatgagcaaagttacagtgacctggctggagttacctggtgcacataggaccttaggggaaagttcagcgtggactacacttgctctgggatctgcttttccacatgtgtgtatggcacgcctttttctgctggattgggaaggacaagattttgctgtgctagggagaaatgaaaacggggtgagctgagtagctgggtttctggaggatagaacatcagatggggaggctttccgaggtgaagaatgagagggaaccacttactagagagaaaagagctccaggcctggggaacagcacgtgcgaaggccaggagagaagaactgttgaaacaacgagaagggtggcacggctggagctgagccagcaagggggatcgtgaggagccttggggttggggagatctgcagaagcatcagaccaggcagggcctcgtacgcagtcctgaggagttttacttttattctaagacagttggggagctccaggagctgttttaagttggggagagactggattccagcctgcaaaagctgttttgtgaagactaaaaccagtgaggagaggtggaggtgctttggggacactgaaatggattcttggaaagattctgaaggctgtgttgaaaagacacctatagctgtggggacatgactataatcccagcatttggggagaccgaggctggcagatcacttaaggtcaggagtttgagaccagcctggccaacatggcgaaaccccatctctgctaaaaatacaaaaattagctgggtgcagtggtgcatgcctgtagtcccagctactcaggagactgaggcgggagaattgtttgaaccctggaggcagaggttgtagtgagtcgtgatcacacaactgcactccagcctgggcaacagaacaatactccattccctcccctctaccccaccaaaaaaaaaaaaaaatcctgcccttagatgagctctagggctgctgagtacagttgtcccagttgcacagtgcccaagggtttggcattgctaagaaggccacgtgcaaatcctagatattgagtgttgtatgtttgtgacgttggtttcccgacatgtgaatggcccaagtgtctggaagaagtggcgccactttctaatttgcttggagatgttgcatgtcccttaaattcagacaggtgcaggtaactggaggttctgaaccaaaggttaaaatgcaaattctcatacagggttgggaagttgtagccagggataagcttatgtgactgttatatggactgaggagcagatgtgaatttcgaaccatgacatggctgagggtaggggtcgggtggatggatgattcagggttgtaacccatagagcccaaaggggaagtgatctgtgacctggggtgagggtgatctggaagatttttggatggctggaaagaaatggggaagtcgagctgcctgagagagccaagttatttcccaaaagattccttaggagtctttctgttcaagacctccgtgtgtgtgtgtgtgtgtttagggttccccagcaatggcccaggcatgtgaaggaaacaagcttcttcagggaatatttgttgaatgagttttcctgactcccaggctagaactgtttttgcaatttccaccctcttttctttcccccagagaactcctattcgtccttcaaaacccatcacggaaacccctcttggagaaaaccctccttccttcccctcaggactttcccagccaccgtctctcctccagtccagcctgatgccatgggactgggggtttctctgtccagctctgtttctcccagactggggtctgaggactctcaggacccccaactttacctagcacaggctgggcacaagtgggtgacagggagtctacgcctagtggaattatgtattggggcagggtcagtgtgagaatacacatccgcatgcatgtctgtccatgtctgtccgtaccaaccttccccttccacacggacctgggcacataggaggtgtctgagcctgacacatgggacagagagtggacatggctgagacacggacagagaaaagacaaggagtccagggggctgaaagccttttgaaatcaggaagttcctgtattggcagaacaaagcccagagaggagcagggctttcctcaacgccacccagcaagtggacacagagcccggccttggatgacacctccagggttctgaaccctggacctcgctttatgcaaggagctggccccacatttccatgaatcggggaaacagcacaagaaggttggcctgtggcagggcaagggttaaaggggtgacattgagggatgcctcagagtcaaagtcccctgaccaagaggaatagagtagaaaacacagagacagagggtgagatcacgccccgatgaggacggagagagacagagatggagagagacatagaggtggaaatatacagagaaagataaatgcagagaccaaggcagggagtgtcgggggaagtaaagagggtgtcctgaagaaagaaggatctgttcactcttaccagtctgtcctcgaatgatttgcataaaatgaggaggtgcctgtccacacccccaattcctctctcaggccccagagcctgagacctcaccatgcccccatcagagatgcaaaaaactaaacacccaactagaaatccttgggacctctctcggctgggatctcagagcctttctgtcccctacccctaccccatgtgctgtcgattttgcagatggggacaacctggggcctcccggaactctgccaccctggggaagttgggggagggccttagtcccggatcacaaccccgtctgctccccagaatcctttcctaagaatcgttgaggaccaaagttgtctttgctgacacgtgttgcttttctctttgccttttattgtttcagagaaaaatcaagttgactgtgtcaagtaacaccccaccccttacccccgtccagccatagtggctctctggagacacaggtcacaggcggagggtcccctgatcatccccaaccacacagccagggggacttgacccctgtccacccctgtctcgtgctccctcagacccccacaaaccggccaagcagtccggggaggcttcccctccacacaactcttagcatgtgattgcagatgtgaaatcaaaacgttgtttgttttttgttttgttttgattctaccccgtcggtccagtgtctgcacagacgccttcatttctctgtaaatatgtgacttggaacaaatgtttaacacaaacgagaagtggtcatgaatgcatggtgttgagatgttttgcactattctgactttttggtctctgtaaaaatattttattaacagcagacattaaaaaaagaaaaaccacacacagccttgga

SEQ ID NO: 33829 - DNA, 4389 bp, Homo sapiens
gttcagcccagcctgggcacagcacatggatggggcaggatgctgcccgcctgttctgggcccccccgccccctgctgagagcgttgtccccttcccagggcctctgtaggagggtggggcggggccaggcctgcccacggggtccaccttctgctccagccagaggagggtcctgtagggatcccagctggggaaggtgcagggggcctgggagactgcctctccgaagcggtgaaaccctcacccttccgtccctcccagccaccctccctaaaacttcccctgacagagggtggcagccccaggctctttgcataatcctgtggcttcgctgtcttcacccagcaccagcggacagggaagggcagagaaggccaccatggcgacactcctctcccatccgcagcagcgccctcccttcttgcgccaggccatcaagataaggcgccgcagagtcagagatctacaggatcccccgccccaaatggccccggagatccagcctccatcccaccacttctcccccgagcagcgggccctgctctacgaggacgcactctacactgtcttgcaccgcctgggtcatcctgagcccaaccatgtgacggaggcctctgagctgctgcgatacctgcaggaggccttccacgtggagcccgaggagcaccagcagacactgcagcgggtcagggagcttgagaagccaatattttgtctgaaggcaacagtgaaacaggccaagggcattctgggcaaagatgtcagtgggttcagcgacccctactgcctgctgggcattgagcagggggtaggtgtgccagggggcagccccgggtcccggcatcggcagaaggctgtggtgaggcacaccatccccgaggaggagacccaccgcacgcaggtcatcacccagacactcaaccccgtctgggacgagaccttcatcctggagtttgaggacatcaccaatgcgagctttcatctggacatgtgggacctggacactgtggagtctgtccgacagaagcttggggagctcacggatctgcatgggcttcgcaggatctttaaagaggcccggaaggacaaaggccaggacgactttctggggaacgtggttctgaggctgcaggacctgcgctgccgagaggaccagtggtaccccctggaaccccgcactgagacctacccagaccgaggccagtgccacctccagttccaactcatccataagcggagagccacttcggccagccgctcgcagccgagctacaccgtgcacctccacctcctgcagcagcttgtgtcccacgaggtcacccagcacgaggcgggaagcacctcctgggacgggtcgctgagtccccaggctgccaccgtcctctttctgcacgccacacagaaggacctatccgacttccaccagtccatggcgcagtggctggcctacagccgcctctaccagagcctggagttccccagcagctgcctcctgcaccccatcaccagcatcgagtaccagtggatccagggtcggctcaaggcagaacagcaggaggagctggccgcctcattcagctccctgctgacctacggcctctccctcatccggaggttccgctctgtcttccccctctctgtctcggactccccagcccggctgcagtctcttctcagggtcctggtacagatgtgcaagatgaaggcctttggagaactgtgccccaacaccgccccattgccccagctggtgactgaggccctgcagactggcaccactgaatggttccacctgaagcagcagcaccatcaacccatggtgcagggcatcccggaggcaggcaaggccttgctgggcctggtacaggatgtcattggcgacctgcaccagtgccagcgcacatgggacaagatcttccacaataccctcaagatccacctcttctccatggctttccgggagctgcagtggctggtggccaagcgggtgcaggaccacacgacggttgtgggtgatgtagtgtccccagagatgggcgagagtctgttccagctctacatcagcctcaaggagctctgccagctgcgcatgagctcctcagagagggatggagtcctggccctggataatttccaccgctggttccagccggccatcccctcctggctgcagaagacgtacaacgaggccctggcgcgggtgcagcgcgctgtgcagatggatgagctggtgcccctgggtgaactgaccaagcacagcacatcagcggtggatctatccacctgctttgcccagatcagccacactgcccggcagctggactggccagacccagaggaggccttcatgattaccgtcaagtttgtggaggacacctgtcgcctggccctggtgtactgcagccttataaaggcccgggcccgcgagctctcttcaggccagaaggaccaaggccaggcagccaacatgctgtgtgtggtggtgaatgacatggagcagctgcggctggtgatcggcaagttgcccgcccagctggcatgggaggccctggagcagcgggtaggggccgtgctggagcaggggcagctgcagaacacgctgcatgcccagctgcagagcgcgctggccgggctgggccatgagatccgcactggcgtccgcaccctggccgagcagttggaggtgggcatcgccaagcacatccagaaactggtgggcgtcagggagtctgtcctgcctgaggatgccattctgcccctgatgaagttcctggaggtggagctttgctacatgaacaccaacttggtgcaggagaacttcagcagcctcctgaccctgctctggacccacacactcacagtgctggtggaggcggccgcctcccagcgcagctcatccctggcttccaacaggctgaagattgccctgcagaacctggagatctgcttccacgctgagggctgtggcctgccacccaaggccctgcacactgccaccttccaggctctgcagagggacctggagctgcaggcggcctccagccgggaactcatccggaagtacttctgcagccgaatccagcagcaggcagaaaccacctctgaggagctgggggctgtgacagtcaaggcctcctaccgcgcctctgagcagaagctgcgtgtggagctgctcagcgcctccagcctgctgcccctggactccaatggctccagcgacccctttgtccagctgaccttggagcccaggcatgagttccctgagctggccgcccgggagacccagaagcacaagaaggaccttcacccattgtttgatgagacctttgaattcctggtgcctgctgagccgtgccgcaaggctggggcatgcctcctgctcaccgtgctggactacgacacgctgggggccgacgacctggaaggcgaggccttcctgccgctgcgtgaggtgcccgggctgagtggctctgaggagcctggtgaggtgcctcagacccgcctgcccctcacgtaccccgcacccaacggggacccaatcctgcagctgctggagggccggaagggtgaccgagaagcccaggtctttgtgaggctgcggcggcaccgggccaagcaggcctcccagcatgccttgcggccggcaccgtagccgtagaggtttgcggtggggctgggtccccggtggggacttgcaagggctttcctgtagggtctggggcttccccgccacatcgcggccctccagcctggcctaacacttggggagccccagcatgcggagtgcccagagtgcagacctcccctgcctcccatggtgatgggggctcagcagcgacatctctactcccgcctccctgcctccagccctggctgcaatgtctctaccacatcccagcaccagggggagcaaaccctgcccctgcccgcctctcagaaaagctgctgtggtgggcaggggattgggccatctgtctcctggccctggcccatctgcctcctggccttcctgttccagccactggggtgggggccaggttcactgggaccagggctacaggcacagagtctcctggaaaagggagaggggaccctgccaaagatgaggctccagctgccctggggggagggtggtggccattactagagggggcctgggtcctctccccaggggctgccagcatccaggccaggaagcctggagccaagaaccttctggctctgagggagcaagagctggcaggcggcagggctggcacagacagacggaagcagaaaggacagtttggctgctgtgtctgctgcgcacgccccctccccggacagcacctgccacctagaaactttcttagcaaaaaaattaataaaaacaaatccattgtcctctt

SEQ ID NO: 33830 - DNA, 3809 bp, Homo sapiens
gttcagcccagcctgggcacagcacatggatggggcaggatgctgcccgcctgttctgggcccccccgccccctgctgagagcgttgtccccttcccagggcctctgtaggagggtggggcggggccaggcctgcccacggggtccaccttctgctccagccagaggagggtcctgtagggatcccagctggggaaggtgcagggggcctgggagactgcctctccgaagcggtgaaaccctcacccttccgtccctcccagccaccctccctaaaacttcccctgacagagggtggcagccccaggctctttgcataatcctgtggcttcgctgtcttcacccagcaccagcggacagggaagggcagagaaggccaccatggcgacactcctctcccatccgcagcagcgccctcccttcttgcgccaggccatcaagataaggcgccgcagagtcagagatctacaggatcccccgccccaaatggccccggagatccagcctccatcccaccacttctcccccgagcagcgggccctgctctacgaggacgcactctacactgtcttgcaccgcctgggtcatcctgagcccaaccatgtgacggaggcctctgagctgctgcgatacctgcaggaggccttccacgtggagcccgaggagcaccagcagacactgcagcgggtcagggagcttgagaagccaatattttgtctgaaggcaacagtgaaacaggccaagggcattctgggcaaagatgtcagtgggttcagcgacccctactgcctgctgggcattgagcagggggtaggtgtgccagggggcagccccgggtcccggcatcggcagaaggctgtggtgaggcacaccatccccgaggaggagacccaccgcacgcaggtcatcacccagacactcaaccccgtctgggacgagaccttcatcctggagtttgaggacatcaccaatgcgagctttcatctggacatgtgggacctggacactgtggagtctgtccgacagaagcttggggagctcacggatctgcatgggcttcgcaggatctttaaagaggcccggaaggacaaaggccaggacgactttctggggaacgtggttctgaggctgcaggacctgcgctgccgagaggaccagtggtaccccctggaaccccgcactgagacctacccagaccgaggccagtgccacctccagttccaactcatccataagcggagagccacttcggccagccgctcgcagccgagctacaccgtgcacctccacctcctgcagcagcttgtgtcccacgaggtcacccagcacgaggcgggaagcacctcctgggacgggtcgctgagtccccaggctgccaccgtcctctttctgcacgccacacagaaggacctatccgacttccaccagtccatggcgcagtggctggcctacagccgcctctaccagagcctggagttccccagcagctgcctcctgcaccccatcaccagcatcgagtaccagtggatccagggtcggctcaaggcagaacagcaggaggagctggccgcctcattcagctccctgctgacctacggcctctccctcatccggaggttccgctctgtcttccccctctctgtctcggactccccagcccggctgcagtctcttctcagggtcctggtacagatgtgcaagatgaaggcctttggagaactgtgccccaacaccgccccattgccccagctggtgactgaggccctgcagactggcaccactgaatggttccacctgaagcagcagcaccatcaacccatggtgcagggcatcccggaggcaggcaaggccttgctgggcctggtacaggatgtcattggcgacctgcaccagtgccagcgcacatgggacaagatcttccacaataccctcaagatccacctcttctccatggctttccgggagctgcagtggctggtggccaagcgggtgcaggaccacacgacggttgtgggtgatgtagtgtccccagagatgggcgagagtctgttccagctctacatcagcctcaaggagctctgccagctgcgcatgagctcctcagagagggatggagtcctggccctggataatttccaccgctggttccagccggccatcccctcctggctgcagaagacgtacaacgaggccctggcgcgggtgcagcgcgctgtgcagatggatgagctggtgcccctgggtgaactgaccaagcacagcacatcagcggtggatctatccacctgctttgcccagatcagccacactgcccggcagctggactggccagacccagaggaggccttcatgattaccgtcaagtttgtggaggacacctgtcgcctggccctggtgtactgcagccttataaaggcccgggcccgcgagctctcttcaggccagaaggaccaaggccaggcagccaacatgctgtgtgtggtggtgaatgacatggagcagctgcggctggtgatcggcaagttgcccgcccagctggcatgggaggccctggagcagcgggtaggggccgtgctggagcaggggcagctgcagaacacgctgcatgcccagctgcagagcgcgctggccgggctgggccatgagatccgcactggcgtccgcaccctggccgagcagttggaggtgggcatcgccaagcacatccagaaactggtgggcgtcagggagtctgtcctgcctgaggatgccattctgcccctgatgaagttcctggaggtggagctttgctacatgaacaccaacttggtgcaggagaacttcagcagcctcctgaccctgctctggacccacacactcacagtgctggtggaggcggccgcctcccagcgcagctcatccctggcttccaacaggctgaagattgccctgcagaacctggagatctgcttccacgctgagggctgtggcctgccacccaaggccctgcacactgccaccttccaggctctgcagagggacctggagctgcaggcggcctccagccgggaactcatccggaagtacttctgcagccgaatccagcagcaggcagaaaccacctctgaggagctgggggctgtgacagtcaaggcctcctaccgcgcctctgagcagaagctgcgtgtggagctgctcagcgcctccagcctgctgcccctggactccaatggctccagcgacccctttgtccagctgaccttggagcccaggcatgagttccctgagctggccgcccgggagacccagaagcacaagaaggaccttcacccattgtttgatgagacctttgaattcctggtgcctgctgagccgtgccgcaaggctggggcatgcctcctgctcaccgtgctggactacgacacgctgggggccgacgacctggaaggcgaggccttcctgccgctgcgtgaggtgcccgggctgagtggctctgaggagcctggtgaggtgcctcagacccgcctgcccctcacgtaccccgcacccaacggggacccaatcctgcagctgctggagggccggaagggtgaccgagaagcccaggtctttgtgaggctgcggcggcaccgggccaagcaggggattgggccatctgtctcctggccctggcccatctgcctcctggccttcctgttccagccactggggtgggggccaggttcactgggaccagggctacaggcacagagtctcctggaaaagggagaggggaccctgccaaagatgaggctccagctgccctggggggagggtggtggccattactag

SEQ ID NO: 33831 - DNA, 3215 bp, Homo sapiens
gttcagcccagcctgggcacagcacatggatggggcaggatgctgcccgcctgttctgggcccccccgccccctgctgagagcgttgtccccttcccagggcctctgtaggagggtggggcggggccaggcctgcccacggggtccaccttctgctccagccagaggagggtcctgtagggatcccagctggggaaggtgcagggggcctgggagactgcctctccgaagcggtgaaaccctcacccttccgtccctcccagccaccctccctaaaacttcccctgacagagggtggcagccccaggctctttgcataatcctgtggcttcgctgtcttcacccagcaccagcggacagggaagggcagagaaggccaccatggcgacactcctctcccatccgcagcagcgccctcccttcttgcgccaggccatcaagataaggcgccgcagagtcagagatctacaggatcccccgccccaaatggccccggagatccagcctccatcccaccacttctcccccgagcagcgggccctgctctacgaggacgcactctacactgtcttgcaccgcctgggtcatcctgagcccaaccatgtgacggaggcctctgagctgctgcgatacctgcaggaggccttccacgtggagcccgaggagcaccagcagacactgcagcgggtcagggagcttgagaagccaatattttgtctgaaggcaacagtgaaacaggccaagggcattctgggcaaagatgtcagtgggttcagcgacccctactgcctgctgggcattgagcagggggtaggtgtgccagggggcagccccgggtcccggcatcggcagaaggctgtggtgaggcacaccatccccgaggaggagacccaccgcacgcaggtcatcacccagacactcaaccccgtctgggacgagaccttcatcctggagtttgaggacatcaccaatgcgagctttcatctggacatgtgggacctggacactgtggagtctgtccgacagaagcttggggagctcacggatctgcatgggcttcgcaggatctttaaagaggcccggaaggacaaaggccaggacgactttctggggaacgtggttctgaggctgcaggacctgcgctgccgagaggaccagtggtaccccctggaaccccgcactgagacctacccagaccgaggccagtgccacctccagttccaactcatccataagcggagagccacttcggccagccgctcgcagccgagctacaccgtgcacctccacctcctgcagcagcttgtgtcccacgaggtcacccagcacgaggcgggaagcacctcctgggacgggtcgctgagtccccaggctgccaccgtcctctttctgcacgccacacagaaggacctatccgacttccaccagtccatggcgcagtggctggcctacagccgcctctaccagagcctggagttccccagcagctgcctcctgcaccccatcaccagcatcgagtaccagtggatccagggtcggctcaaggcagaacagcaggaggagctggccgcctcattcagctccctgctgacctacggcctctccctcatccggaggttccgctctgtcttccccctctctgtctcggactccccagcccggctgcagtctcttctcagggtcctggtacagatgtgcaagatgaaggcctttggagaactgtgccccaacaccgccccattgccccagctggtgactgaggccctgcagactggcaccactgaatggttccacctgaagcagcagcaccatcaacccatggtgcagggcatcccggaggcaggcaaggccttgctgggcctggtacaggatgtcattggcgacctgcaccagtgccagcgcacatgggacaagatcttccacaataccctcaagatccacctcttctccatggctttccgggagctgcagtggctggtggccaagcgggtgcaggaccacacgacggttgtgggtgatgtagtgtccccagagatgggcgagagtctgttccagctctacatcagcctcaaggagctctgccagctgcgcatgagctcctcagagagggatggagtcctggccctggataatttccaccgctggttccagccggccatcccctcctggctgcagaagacgtacaacgaggccctggcgcgggtgcagcgcgctgtgcagatggatgagctggtgcccctgggtgaactgaccaagcacagcacatcagcggtggatctatccacctgctttgcccagatcagccacactgcccggcagctggactggccagacccagaggaggccttcatgattaccgtcaagtttgtggaggacacctgtcgcctggccctggtgtactgcagccttataaaggcccgggcccgcgagctctcttcaggccagaaggaccaaggccaggcagccaacatgctgtgtgtggtggtgaatgacatggagcagctgcggctggtgatcggcaagttgcccgcccagctggcatgggaggccctggagcagcgggtaggggccgtgctggagcaggggcagctgcagaacacgctgcatgcccagctgcagagcgcgctggccgggctgggccatgagatccgcactggcgtccgcaccctggccgagcagttggaggtgggcatcgccaagcacatccagaaactggtgggcgtcagggagtctgtcctgcctgaggatgccattctgcccctgatgaagttcctggaggtggagctttgctacatgaacaccaacttggtgcaggagaacttcagcagcctcctgaccctgctctggacccacacactcacagtgctggtggaggcggccgcctcccagcgcagctcatccctggcttccaacaggctgaagattgccctgcagaacctggagatctgcttccacgctgagggctgtggcctgccacccaagaccctgcccctgcccgcctctcagaaaagctgctgtggtgggcaggggattgggccatctgtctcctggccctggcccatctgcctcctggccttcctgttccagccactggggtgggggccaggttcactgggaccagggctacaggcacagagtctcctggaaaagggagaggggaccctgccaaagatgaggctccagctgccctggggggagggtggtggccattactag

SEQ ID NO: 33832 - DNA, 4002 bp, Homo sapiens
acttaacaaccgaagtaacccgcaatgcggaagggcgaggggattgcgagtcaccgagtttcccgcgcggcttgagtcacggcctagaaagagagatgttggggttcccaggaccaggacagaggtggtagtgaactctcatgggcatccagagaaggtcaggccccttgctgacaggcctatctgtggggctactgctgctcttcagctgggtgacccttgtccagccaacctctctctcagctctggtccaccaccctcacttgtgccagaccacccgggatgtccatggccgtcactaccctggtttcttttgccctcgtctgtctgattctccagaggaagcctactgctgccacctgcaggctgcagggggctcctgctgcacccgggctgaatttgaggccctgtaccaagtcaatctgtccgctcttccgcccccgcccatcctcaggggcccaggcccgctcctagtgctgggcctctacaacctactggttgtgaccctgatgaccgtagacctcgtgcacttctgctgcggtcggggccggagtctgggctggagccaccgcaggcctccctctgggtcctccgccgcgagctccctgcaggtctctgcggggacagcttaggtgcgcccggagcttgcctgcacctgcgatccagagccaagcgccccgcccctgcccgggcgcgctccctccttagccctgcccctctctgaccccacctccgacgcaagagtggggcggggcagctgccggtggcgtcccgaacccagactcgccccgccccagagactgcgcctgcgcgggcacgagacaacctctccgcgatgactgccagctcagtggagcagctgcggaaggagggcaatgagctgttcaaatgtggagactacgggggcgccctggcggcctacactcaggccctgggtctggacgcgacgccccaggaccaggccgttctgcaccggaaccgggccgcctgccacctcaagctggaagattacgacaaagcagaaacagaggcatccaaagccattgaaaaggatggtggggatgtcaaagcactctaccggcggagccaagccctagagaagctgggccgcctggaccaggctgtccttgacctgcagagatgtgtgagcttggagcccaagaacaaagttttccaggaggccttgcggaacatcgggggccagattcaggagaaggtgcgatacatgtcctcgacggatgccaaagtggaacagatgtttcagatactgttggacccagaagagaagggcactgagaaaaagcaaaaggcttctcagaacctggtggtgctggccagggaggatgctggagcggagaagatcttccggagtaatggggttcagctcttgcaacgtttactggacatgggagagactgacctcatgctggcggctctgcgtacgctggttggcatttgctctgagcatcagtcacggacagtggcaaccctgagcatactgggaactcggcgagtagtctccatcctgggcgtggaaagccaggctgtgtccctggctgcctgccacctgctgcaggttatgtttgatgccctcaaggaaggtgtcaaaaaaggcttccgaggcaaagaaggtgccatcattgtggatcctgcccgggagctgaaggtcctcatcagtaacctcttagatctgctgacagaggtgggggtctctggccaaggccgagacaatgccctgaccctcctgattaaagcggtgccccggaagtctctcaaggaccccaacaacagcctcaccctctgggtcatcgaccaaggtctgaaaaagattttggaagtggggggctctctacaggaccctcctggggagctcgcagtgaccgcaaacagccgcatgagcgcctctattctcctcagcaagctctttgatgacctcaagtgtgatgcggagagggagaatttccacagactttgtgaaaactacatcaagagctggtttgagggccaagggctggccgggaagctacgggccatccagacggtgtcctgcctcctgcagggcccatgtgacgctggcaaccgggccttggagctgagcggtgtcatggagagtgtgattgctctgtgtgcctctgagcaggaggaggagcagctggtggccgtggaggctctgatccatgcagccggcaaggctaagcgggcctcattcatcactgccaatggtgtctcgctgctgaaggacctatataagtgcagcgagaaggacagcatccgcatccgggcgctagtgggactctgtaagctcggttcggctggagggactgacttcagcatgaagcagtttgctgaaggctccactctcaaactggctaagcagtgtcgaaagtggctgtgcaatgaccagatcgacgcaggcactcggcgctgggcagtggagggcctggcttacctgacctttgatgccgacgtgaaggaagagtttgtggaggatgcggctgctctgaaagctctgttccagctcagcaggttggaggagaggtcagtgctctttgcggtggcctcagcgctggtgaactgcaccaacagctatgactacgaggagcccgaccccaagatggtggagctggccaagtatgccaagcagcatgtgcccgagcagcaccccaaggacaagccaagcttcgtgcgggctcgggtgaagaagctgctggcagcgggtgtggtgtcggccatggtgtgcatggtgaagacggagagccctgtgctgaccagttcctgcagagagctgctctccagggtcttcttggctttagtggaagaggtagaggaccgaggcactgtggttgcccagggaggcggcagggcgctgatcccgctggccctggaaggcacggacgtggggcagacaaaggcagcccaggcccttgccaagctcaccatcacctccaacccggagatgaccttccctggcgagcggatctatgaggtggtccggcccctcgtctccctgttgcacctcaactgctcaggcctgcagaacttcgaggcgctcatggccctaacaaacctggctgggatcagcgagaggctccggcagaagatcctgaaggagaaggctgtgcccatgatagaaggctacatgtttgaggagcatgagatgatccgccgggcagccacggagtgcatgtgtaacttggccatgagcaaggaggtgcaggacctcttcgaagcccagggcaatgaccgactgaagctgctggtgctgtacagtggagaggatgatgagctgctacagcgggcagctgccgggggcttggccatgcttacctccatgcggcccacgctctgcagccgcattccccaagtgaccacacactggctggagatcctgcaggccctgcttctgagctccaaccaggagctgcagcaccggggtgctgtggtggtgctgaacatggtggaggcctcgagggagattgccagcaccctgatggagagtgagatgatggagatcttgtcagtgctagctaagggtgaccacagccctgtcacaagggctgctgcagcctgcctggacaaagcagtggaatatgggcttatccaacccaaccaagatggagagtgagggggttgtccctgggcccaaggctcatgcacacgctacctattgtggcacggagagtaaggacggaagcagctttggctggtggtggctggcatgcccaatactcttgcccatcctcgcttgctgccctaggatgtcctctgttctgagtcagcggccacgttcagtcacacagccctgcttggccagcactgcctgcagcctcactcagaggggccctttttctgtactactgtagtcagctgggaatggggaaggtgcatcccaacacagcctgtggatcctggggcatctggaagggcgcacacatcagcagcctcaccagctgtgagcctgctatcaggcctgcccctccaataaaagtgtgtagaactcca

SEQ ID NO: 33833 - DNA, 3252 bp, Homo sapiens
agagactgcgcctgcgcgggcacgagacaacctctccgcgatgactgtgagtggtccagggacccccgagccccggccggccacccccggggccagctcagtggagcagctgcggaaggagggcaatgagctgttcaaatgtggagactacgggggcgccctggcggcctacactcaggccctgggtctggacgcgacgccccaggaccaggccgttctgcaccggaaccgggccgcctgccacctcaagctggaagattacgacaaagcagaaacagaggcatccaaagccattgaaaaggatggtggggatgtcaaagcactctaccggcggagccaagccctagagaagctgggccgcctggaccaggctgtccttgacctgcagagatgtgtgagcttggagcccaagaacaaagttttccaggaggccttgcggaacatcgggggccagattcaggagaaggtgcgatacatgtcctcgacggatgccaaagtggaacagatgtttcagatactgttggacccagaagagaagggcactgagaaaaagcaaaaggcttctcagaacctggtggtgctggccagggaggatgctggagcggagaagatcttccggagtaatggggttcagctcttgcaacgtttactggacatgggagagactgacctcatgctggcggctctgcgtacgctggttggcatttgctctgagcatcagtcacggacagtggcaaccctgagcatactgggaactcggcgagtagtctccatcctgggcgtggaaagccaggctgtgtccctggctgcctgccacctgctgcaggttatgtttgatgccctcaaggaaggtgtcaaaaaaggcttccgaggcaaagaaggtgccatcattgtggatcctgcccgggagctgaaggtcctcatcagtaacctcttagatctgctgacagaggtgggggtctctggccaaggccgagacaatgccctgaccctcctgattaaagcggtgccccggaagtctctcaaggaccccaacaacagcctcaccctctgggtcatcgaccaaggtctgaaaaagattttggaagtggggggctctctacaggaccctcctggggagctcgcagtgaccgcaaacagccgcatgagcgcctctattctcctcagcaagctctttgatgacctcaagtgtgatgcggagagggagaatttccacagactttgtgaaaactacatcaagagctggtttgagggccaagggctggccgggaagctacgggccatccagacggtgtcctgcctcctgcagggcccatgtgacgctggcaaccgggccttggagctgagcggtgtcatggagagtgtgattgctctgtgtgcctctgagcaggaggaggagcagctggtggccgtggaggctctgatccatgcagccggcaaggctaagcgggcctcattcatcactgccaatggtgtctcgctgctgaaggacctatataagtgcagcgagaaggacagcatccgcatccgggcgctagtgggactctgtaagctcggttcggctggagggactgacttcagcatgaagcagtttgctgaaggctccactctcaaactggctaagcagtgtcgaaagtggctgtgcaatgaccagatcgacgcaggcactcggcgctgggcagtggagggcctggcttacctgacctttgatgccgacgtgaaggaagagtttgtggaggatgcggctgctctgaaagctctgttccagctcagcaggttggaggagaggtcagtgctctttgcggtggcctcagcgctggtgaactgcaccaacagctatgactacgaggagcccgaccccaagatggtggagctggccaagtatgccaagcagcatgtgcccgagcagcaccccaaggacaagccaagcttcgtgcgggctcgggtgaagaagctgctggcagcgggtgtggtgtcggccatggtgtgcatggtgaagacggagagccctgtgctgaccagttcctgcagagagctgctctccagggtcttcttggctttagtggaagaggtagaggaccgaggcactgtggttgcccagggaggcggcagggcgctgatcccgctggccctggaaggcacggacgtggggcagacaaaggcagcccaggcccttgccaagctcaccatcacctccaacccggagatgaccttccctggcgagcggatctatgaggtggtccggcccctcgtctccctgttgcacctcaactgctcaggcctgcagaacttcgaggcgctcatggccctaacaaacctggctgggatcagcgagaggctccggcagaagatcctgaaggagaaggctgtgcccatgatagaaggctacatgtttgaggagcatgagatgatccgccgggcagccacggagtgcatgtgtaacttggccatgagcaaggaggtgcaggacctcttcgaagcccagggcaatgaccgactgaagctgctggtgctgtacagtggagaggatgatgagctgctacagcgggcagctgccgggggcttggccatgcttacctccatgcggcccacgctctgcagccgcattccccaagtgaccacacactggctggagatcctgcaggccctgcttctgagctccaaccaggagctgcagcaccggggtgctgtggtggtgctgaacatggtggaggcctcgagggagattgccagcaccctgatggagagtgagatgatggagatcttgtcagtgctagctaagggtgaccacagccctgtcacaagggctgctgcagcctgcctggacaaagcagtggaatatgggcttatccaacccaaccaagatggagagtgagggggttgtccctgggcccaaggctcatgcacacgctacctattgtggcacggagagtaaggacggaagcagctttggctggtggtggctggcatgcccaatactcttgcccatcctcgcttgctgccctaggatgtcctctgttctgagtcagcggccacgttcagtcacacagccctgcttggccagcactgcctgcagcctcactcagaggggccctttttctgtactactgtagtcagctgggaatggggaaggtgcatcccaacacagcctgtggatcctggggcatctggaagggcgcacacatcagcagcctcaccagctgtgagcctgctatcaggcctgcccctccaataaaagtgtgtagaactcca

SEQ ID NO: 33834 - DNA, 3419 bp, Homo sapiens
atggccggaacatctgaacgttcattgatctcatcgatttctcaacccaaagccatcgagtgctttgaggtgaagaaaaaggctttccttacccacggcagataccacggcagtggcgccacgccgccaaagaccaaagaccccaaaccagaaacgttctgtggtcagacagggctgcccaccatggaggtccgcattaatgtctcaaggcagcaggtcgagaaggtgttcgggctggaggaatactggtgccagtgcgtggcatggagctcctcgggcaccaccaagagtcagaaggcctacatccgcatagcctatttgcgcaagaacttcgagcaggagccgctggccaaggaggtgtccctggagcagggcatcgtgctgccctgccgtccaccggagggcatccctccagccgaggtggagtggctccggaacgaggacctggtggacccgtccctggaccccaatgtatacatcacgcgggagcacagcctggtggtgcgacaggcccgccttgctgacacggccaactacacctgcgtggccaagaacatcgtggcacgtcgccgcagcgcctccgctgctgtcatcgtctacgtggacggcagctggagcccgtggagcaagtggtcggcctgtgggctggactgcacccactggcggagccgtgagtgctctgacccagcaccccgcaacggaggggaggagtgccagggcactgacctggacacccgcaactgtaccagtgacctctgtgtacacactgcttctggccctgaggacgtggccctctatgtgggcctcatcgccgtggccgtctgcctggtcctgctgctgcttgtcctcatcctcgtttattgccggaagaaggaggggctggactcagatgtggctgactcgtccattctcacctcaggcttccagcccgtcagcatcaagcccagcaaagcagacaacccccatctgctcaccatccagccggacctcagcaccaccaccaccacctaccagggcagtctctgtccccggcaggatgggcccagccccaagttccagctcaccaatgggcacctgctcagccccctgggtggcggccgccacacactgcaccacagctctcccacctctgaggccgaggagttcgtctcccgcctctccacccagaactacttccgctccctgccccgaggcaccagcaacatgacctatgggaccttcaacttcctcgggggccggctgatgatccctaatacaggaatcagcctcctcatccccccagatgccataccccgagggaagatctatgagatctacctcacgctgcacaagccggaagacgtgaggttgcccctagctggctgtcagaccctgctgagtcccatcgttagctgtggaccccctggcgtcctgctcacccggccagtcatcctggctatggaccactgtggggagcccagccctgacagctggagcctgcgcctcaaaaagcagtcgtgcgagggcagctgggaggatgtgctgcacctgggcgaggaggcgccctcccacctctactactgccagctggaggccagtgcctgctacgtcttcaccgagcagctgggccgctttgccctggtgggagaggccctcagcgtggctgccgccaagcgcctcaagctgcttctgtttgcgccggtggcctgcacctccctcgagtacaacatccgggtctactgcctgcatgacacccacgatgcactcaaggaggtggtgcagctggagaagcagctggggggacagctgatccaggagccacgggtcctgcacttcaaggacagttaccacaacctgcgcctatccatccacgatgtgcccagctccctgtggaagagtaagctccttgtcagctaccaggagatccccttttatcacatctggaatggcacgcagcggtacttgcactgcaccttcaccctggagcgtgtcagccccagcactagtgacctggcctgcaagctgtgggtgtggcaggtggagggcgacgggcagagcttcagcatcaacttcaacatcaccaaggacacaaggtttgctgagctgctggctctggagagtgaagcgggggtcccagccctggtgggccccagtgccttcaagatccccttcctcattcggcagaagataatttccagcctggacccaccctgtaggcggggtgccgactggcggactctggcccagaaactccacctggacagccatctcagcttctttgcctccaagcccagccccacagccatgatcctcaacctgtgggaggcgcggcacttccccaacggcaacctcagccagctggctgcagcagtggctggactgggccagccagacgctggcctcttcacagtgtcggaggctgagtgctgaggccggccaggcccgacacctacactctcaccagctttggcacccaccaaggacaggcagaagccggacaggggcccttccccacaccggggagagctgctcggacaggccccctcccggccgaagctgtcccttaatgctggtccttcagaccctgcccgaactcccacctctccatggcctgcctagccaggctggcactgccactcacactcggccccagggcccaggagggacagtgcctggagcctgggccaggcccagcccatctgtgtgtgtgtatgtgcgtgtgatgctacctctcctcccgtccctctccaggggccccgcatacacacggccatgcacgcacacactgggcctgggccagggccccagagctcctgcctgagctggaccttatgcaaacatttctgtgcctgctgggtaggggcacgtctgaggggccctgctccaagcctgcaggaccgagggccacagccggacagggggtagcccctggattcaggcacacgaccaccacacgagcacgtgccacgcatgcctcgtgtgctcatctcacacacacccccctcccgggtcacgcagacaccccccaaccacacacatctcatgctgtacacctgaggctgctcacgtctcacgcccagtgttggtgcacatttgcctctcacatgctgccctctccacccacccagggacaccccacggctcctccctgcccctgcccctcccccagccttgaggtgccctgcccggcggggcctgtgaatatgcaatgggagtcccaggctgtacagtggtgagtgtgtgtgtggcgtggcgtgcccgtccccagggctggctggtgccccacgcggggcctgtcatgtgaagctcgtgtcctgactttgtcttaagtgcattcacgcacttactcttggccttatgtacacagccttgcccggccgccggggcacataggggttttatcgggcgtgaatgtaaataaattatatatatatattgct

SEQ ID NO: 33835 - DNA, 3812 bp, Homo sapiens
accggcccgctctccggctgcgggctccgcggcgcggctggctcggtgcgcggcgcggctggcgctgcgctccgccccggctgcattgctgcgctcccgtgcccaagggagccacgcgccgcgtgcgcccggcagccggccgcccggaggcagcgcagtccgctggcatgggccccgggggcgccccgagctggggctccgggctgaggcgctaaagccgccctcccgcccgcggggccccgcgcccggcccgcccgcctgcccgcccgcggccatggccgtccggcccggcctgtggccagcgctcctgggcatagtcctcgccgcttggctccgcggctcgggtgcccagcagagtgccaccgtggccaacccagtgcctggtgccaacccggacctgcttccccacttcctggtggagcccgaggatgtgtacatcgtcaagaacaagccagtgctgcttgtgtgcaaggccgtgcccgccacgcagatcttcttcaagtgcaacggggagtgggtgcgccaggtggaccacgtgatcgagcgcagcacagacgggagcagtgggctgcccaccatggaggtccgcattaatgtctcaaggcagcaggtcgagaaggtgttcgggctggaggaatactggtgccagtgcgtggcatggagctcctcgggcaccaccaagagtcagaaggcctacatccgcatagcctatttgcgcaagaacttcgagcaggagccgctggccaaggaggtgtccctggagcagggcatcgtgctgccctgccgtccaccggagggcatccctccagccgaggtggagtggctccggaacgaggacctggtggacccgtccctggaccccaatgtatacatcacgcgggagcacagcctggtggtgcgacaggcccgccttgctgacacggccaactacacctgcgtggccaagaacatcgtggcacgtcgccgcagcgcctccgctgctgtcatcgtctacgtggacggcagctggagcccgtggagcaagtggtcggcctgtgggctggactgcacccactggcggagccgtgagtgctctgacccagcaccccgcaacggaggggaggagtgccagggcactgacctggacacccgcaactgtaccagtgacctctgtgtacacactgcttctggccctgaggacgtggccctctatgtgggcctcatcgccgtggccgtctgcctggtcctgctgctgcttgtcctcatcctcgtttattgccggaagaaggaggggctggactcagatgtggctgactcgtccattctcacctcaggcttccagcccgtcagcatcaagcccagcaaagcagacaacccccatctgctcaccatccagccggacctcagcaccaccaccaccacctaccagggcagtctctgtccccggcaggatgggcccagccccaagttccagctcaccaatgggcacctgctcagccccctgggtggcggccgccacacactgcaccacagctctcccacctctgaggccgaggagttcgtctcccgcctctccacccagaactacttccgctccctgccccgaggcaccagcaacatgacctatgggaccttcaacttcctcgggggccggctgatgatccctaatacaggaatcagcctcctcatccccccagatgccataccccgagggaagatctatgagatctacctcacgctgcacaagccggaagacgtgaggttgcccctagctggctgtcagaccctgctgagtcccatcgttagctgtggaccccctggcgtcctgctcacccggccagtcatcctggctatggaccactgtggggagcccagccctgacagctggagcctgcgcctcaaaaagcagtcgtgcgagggcagctgggaggatgtgctgcacctgggcgaggaggcgccctcccacctctactactgccagctggaggccagtgcctgctacgtcttcaccgagcagctgggccgctttgccctggtgggagaggccctcagcgtggctgccgccaagcgcctcaagctgcttctgtttgcgccggtggcctgcacctccctcgagtacaacatccgggtctactgcctgcatgacacccacgatgcactcaaggaggtggtgcagctggagaagcagctggggggacagctgatccaggagccacgggtcctgcacttcaaggacagttaccacaacctgcgcctatccatccacgatgtgcccagctccctgtggaagagtaagctccttgtcagctaccaggagatccccttttatcacatctggaatggcacgcagcggtacttgcactgcaccttcaccctggagcgtgtcagccccagcactagtgacctggcctgcaagctgtgggtgtggcaggtggagggcgacgggcagagcttcagcatcaacttcaacatcaccaaggacacaaggtttgctgagctgctggctctggagagtgaagcgggggtcccagccctggtgggccccagtgccttcaagatccccttcctcattcggcagaagataatttccagcctggacccaccctgtaggcggggtgccgactggcggactctggcccagaaactccacctggacagccatctcagcttctttgcctccaagcccagccccacagccatgatcctcaacctgtgggaggcgcggcacttccccaacggcaacctcagccagctggctgcagcagtggctggactgggccagccagacgctggcctcttcacagtgtcggaggctgagtgctgaggccggccaggcccgacacctacactctcaccagctttggcacccaccaaggacaggcagaagccggacaggggcccttccccacaccggggagagctgctcggacaggccccctcccggccgaagctgtcccttaatgctggtccttcagaccctgcccgaactcccacctctccatggcctgcctagccaggctggcactgccactcacactcggccccagggcccaggagggacagtgcctggagcctgggccaggcccagcccatctgtgtgtgtgtatgtgcgtgtgatgctacctctcctcccgtccctctccaggggccccgcatacacacggccatgcacgcacacactgggcctgggccagggccccagagctcctgcctgagctggaccttatgcaaacatttctgtgcctgctgggtaggggcacgtctgaggggccctgctccaagcctgcaggaccgagggccacagccggacagggggtagcccctggattcaggcacacgaccaccacacgagcacgtgccacgcatgcctcgtgtgctcatctcacacacacccccctcccgggtcacgcagacaccccccaaccacacacatctcatgctgtacacctgaggctgctcacgtctcacgcccagtgttggtgcacatttgcctctcacatgctgccctctccacccacccagggacaccccacggctcctccctgcccctgcccctcccccagccttgaggtgccctgcccggcggggcctgtgaatatgcaatgggagtcccaggctgtacagtggtgagtgtgtgtgtggcgtggcgtgcccgtccccagggctggctggtgccccacgcggggcctgtcatgtgaagctcgtgtcctgactttgtcttaagtgcattcacgcacttactcttggccttatgtacacagccttgcccggccgccggggcacataggggttttatcgggcgtgaatgtaaataaattatatatatatattgc

SEQ ID NO: 33836 - DNA, 6841 bp, Homo sapiens
attgtggcaggcggctggggccggctagggcgccggagccgcacgcagccgcggggctccgagaggcgcgcactggggctgggactgcgcggcgccgccgctgcgagcgccactgagcggtcgcgcaacttcggaggcacagcgccggagccaggcgagcgctcagagacccggagccagaggggcgcgccggagcctcgttcgagagccggcgccaggcacccaccgcgctccgagtgccaggcggccctccgcgcagcgtggcttccgctgcccccacggaaggcacgggctggcgctgccgggcgccggggaggacggcgaggaggaggcggcggcggcggagacggcggcggcgagactggggccagggagacagccctgggggagaggcgcccgaaccaggccgcgggagcatgggggcccggagcggagctcggggcgcgctgctgctggcactgctgctctgctgggacccgaggctgagccaagcaggcactgattctggcagcgaggtgctccctgactccttcccgtcagcgccagcagagccgctgccctacttcctgcaggagccacaggacgcctacattgtgaagaacaagcctgtggagctccgctgccgcgccttccccgccacacagatctacttcaagtgcaacggcgagtgggtcagccagaacgaccacgtcacacaggaaggcctggatgaggccaccggcctgcgggtgcgcgaggtgcagatcgaggtgtcgcggcagcaggtggaggagctctttgggctggaggattactggtgccagtgcgtggcctggagctccgcgggcaccaccaagagtcgccgagcctacgtccgcatcgcctacctgcgcaagaacttcgatcaggagcctctgggcaaggaggtgcccctggaccatgaggttctcctgcagtgccgcccgccggagggggtgcctgtggccgaggtggaatggctcaagaatgaggatgtcatcgaccccacccaggacaccaacttcctgctcaccatcgaccacaacctcatcatccgccaggcccgcctgtcggacactgccaactatacctgcgtggccaagaacatcgtggccaaacgccggagcaccactgccaccgtcatcgtctacgtgaatggcggctggtccagctgggcagagtggtcaccctgctccaaccgctgtggccgaggctggcagaagcgcacccggacctgcaccaaccccgctccactcaacggaggggccttctgcgagggccaggcattccagaagaccgcctgcaccaccatctgcccagtcgatggggcgtggacggagtggagcaagtggtcagcctgcagcactgagtgtgcccactggcgtagccgcgagtgcatggcgcccccaccccagaacggaggccgtgactgcagcgggacgctgctcgactctaagaactgcacagatgggctgtgcatgcaaaataagaaaactctaagcgaccccaacagccacctgctggaggcctcaggggatgcggcgctgtatgcggggctcgtggtggccatcttcgtggtcgtggcaatcctcatggcggtgggggtggtggtgtaccgccgcaactgccgtgacttcgacacagacatcactgactcatctgctgccctgactggtggtttccaccccgtcaactttaagacggcaaggcccagcaacccgcagctcctacacccctctgtgcctcctgacctgacagccagcgccggcatctaccgcggacccgtgtatgccctgcaggactccaccgacaaaatccccatgaccaactctcctctgctggaccccttacccagccttaaggtcaaggtctacagctccagcaccacgggctctgggccaggcctggcagatggggctgacctgctgggggtcttgccgcctggcacataccctagcgatttcgcccgggacacccacttcctgcacctgcgcagcgccagcctcggttcccagcagctcttgggcctgccccgagacccagggagcagcgtcagcggcacctttggctgcctgggtgggaggctcagcatccccggcacaggggtcagcttgctggtgcccaatggagccattccccagggcaagttctacgagatgtatctactcatcaacaaggcagaaagtaccctcccgctttcagaagggacccagacagtattgagcccctcggtgacctgtggacccacaggcctcctgctgtgccgccccgtcatcctcaccatgccccactgtgccgaagtcagtgcccgtgactggatctttcagctcaagacccaggcccaccagggccactgggaggaggtggtgaccctggatgaggagaccctgaacacaccctgctactgccagctggagcccagggcctgtcacatcctgctggaccagctgggcacctacgtgttcacgggcgagtcctattcccgctcagcagtcaagcggctccagctggccgtcttcgcccccgccctctgcacctccctggagtacagcctccgggtctactgcctggaggacacgcctgtagcactgaaggaggtgctggagctggagcggactctgggcggatacttggtggaggagccgaaaccgctaatgttcaaggacagttaccacaacctgcgcctctccctccatgacctcccccatgcccattggaggagcaagctgctggccaaataccaggagatccccttctatcacatttggagtggcagccagaaggccctccactgcactttcaccctggagaggcacagcttggcctccacagagctcacctgcaagatctgcgtgcggcaagtggaaggggagggccagatattccagctgcataccactctggcagagacacctgctggctccctggacactctctgctctgcccctggcagcactgtcaccacccagctgggaccttatgccttcaagatcccactgtccatccgccagaagatatgcaacagcctagatgcccccaactcacggggcaatgactggcggatgttagcacagaagctctctatggaccggtacctgaattactttgccaccaaagcgagccccacgggtgtgatcctggacctctgggaagctctgcagcaggacgatggggacctcaacagcctggcgagtgccttggaggagatgggcaagagtgagatgctggtggctgtggccaccgacggggactgctgagcctcctgggacagcgggctggcagggactggcaggaggcaggtgcagggaggcctggggcagcctcctgatggggatgtttggcctctgcttcctcccagttcacagccagagttgcctctcctcctcctcttccccaacccccagaccatgaccagccttagaaaatccatgtactctgttgttagagggcccagagttccttctccacccccgctctctctctcttggcctgagatctctgtgcaggaaccaagatggggctgaagcctctggaggcagttggttgggggcgggcaggcaggaggccctccctccacccccccaccctcagcccggcaacttctgggttccatgggttttagttccgttctcgttttcttcctccgttattgatttctcctttctccctaagcccccttctgcttccacgcccttttcctctttgaagagtcaagtacaattcagacaaactgctttctcctgtccaaaagcaaaaaggcaaaggaaagaaagaaagcttcagaccgctagtaaggctcaaagaagaagaaaaacaccaaaaccacaagggaaaagaaaaacccagtttcttaggaaacgcaaacgatttattatccagattatttggataagtcctttttaagaaaaaaaaagaaaatgaaaaacaacacaaaaaaaatagaaaactcttttcttgagtgtggatgagaatgggcacgctcacacttctggccaggagtgaatgtgcctgtgtgtgtgtgtgtgtgtgtgtgtgtgtgtgtacatgtacgcgtgtgcattgaggagagagagactgaacagagagtactttgctgctaacgaatccatcttggactaaattctgacaaggcctcagtttccccagttgtgcagggagtaggtcagacagggttttcactgtctagatttagctggttagattttcctctaaaatcttaagcagatgctgaatccataaagccaaggagtgctgagggctggagtgggtgggccctccctcccacagccccagggagatacatctggactcctgggaatctggattaagaaagttgggatgaaagaggaggactgctcaggccagttgtgagccagggagaatgttccagtctggttttggtctggtggctcctagaaagggatgtggcccagaagtgggactcaaacagagagatgaagtaggggaggggagtcctccacgggcatctctctcctggcggctggatagctttaccctagggtggggccagccctgacaccctcatcccctcctcagcccagcagcctctagagcagcgtggtgctctcttgatggccaggaatccagaatctgcccttccccaaccttggtttctccttctgtaaagcagagtgatggctgagaagtcctctctagctgcagaagcctgagcttcccggtgtcagtcagctctgcaacgtgggagccttggaggcgggtggcctggctgtgcttcatatgcccaggagtggagaaggaggctgagaagctggtttcccagctctgatctccacaggcacctcctataaccctcctctcacccaccccgctacggtctgagagatctgaaataacctttcccagtgggcagggttgccagggttgaggggacagcacataccacccccacccaacctgttcgaggggccctgcatggcacgggatgagtccctgccctgtgcagctgcctggcagtggctgggacaaggatcttgcagccagcacagaggcctcttcaaaggcctctccctcttggcactccaggcaaggcaggtgcccgcttccccaacacctccaggcagtgaccctagggcatgccccagcaggtctccgagcagccactgggacccgtctcagcacatcctggcctttgaaagtctgatatcctgagaggagggcaggttttagggccgcagttccagccagcgtccccagcctggcttccctgccatggactcagtagctcgtggggcttcttaccacccaccagccccgctggggtgcggcctggctgtgggcaaaggaggacttgcctggagatttgagagaagattccttctaccagggctgctgaggggccaggcctgcatcaggggctaggctctggctgggcccggaggctgagactaaggctttcgaccctggtgcctccatgtggatgctgcctcagacaaaggcagtgagccttccctgccaaagtgcccatcccatgggctcggcctcactggtcactgttagcccatgaacacgtgtgggcctcggtcacgtggctttgagggcagtctgaccaggctagaccacacgtgccgtgacagggggtgccattcccctcgcaggctctaatgtgcccacatgtagcctggcagtccaaagaccaagaatcaacttgcaaatctgccattaaactgctgtgcgacttcaggcatatcactgccttctctgggcttcagtgtccttttcatacctagaagtctgcggtctgaggctctttgggttcagacacactgttctaggcttctgtaggggaccttgtgatctgccgtgcccctcctccctgttcttttctgtcctccccaccccaccctcagaagctgcttgctctgcccccaggacaggagcttgacggatgaagtgcagccagccacccaggtgccatttccagtctgacttccagaaatgtgcaccatgtcctagagcacagacccattggctggagcctcctgggagggttcaaaccatcagctctatgagaaatgcccagaaaggctttgccgactccatccgtctgtggaggctgcctgcctccggggtgggatgggtggtttctcctccaattcagacccaagaggtagcccccgagggcatgtacctggtgggaagcagctcaggtacccttgggggttgcagggcccttacgcaggtatttctctctctctcctctctggggtgcgtgtgtgcgtgcgcgtgtgcgtgcctatgcttttctctgtgggcacatcaggatgcccctcggagagcatgtgcacgtgtccccacctgagcgagcgtgtgtgtgtgctcctctgcgtcccaggtttggacgtctagggtttggtgtgcctgtcttctgccctccctgagcccacagggtcagtcaatgtatcttctacgtgcctctccctctgccttctctcacagtgcccccggctccagagctcaggggtaggggttctcctgagggtgcaggggatccttctcatctcctggaccctccagggcactctggtccctattccccagctcctaggcagctgagccgggtcccttaggggaggtgaccaggagctttggtgcagggagctcttggtggggcaaagggctggacccctgccaggtctgtggacatggttatatgcccgggagaggggggtgcagggccccagggatggcccccaatcccacctctgtttattctgtaaactgcaacctataaataacctttagcattcctattgtaacaaaattaatttttatgaaataaattatatttcctagtctaataaaa

SEQ ID NO: 33837 - DNA, 6451 bp, Homo sapiens
gagactggggccagggagacagccctgggggagaggcgcccgaaccaggccgcgggagcatgggggcccggagcggagctcggggcgcgctgctgctggcactgctgctctgctgggacccgaggctgagccaagcaggcactgattctggcagcgaggtgctccctgactccttcccgtcagcgccagcagagccgctgccctacttcctgcaggagccacaggacgcctacattgtgaagaacaagcctgtggagctccgctgccgcgccttccccgccacacagatctacttcaagtgcaacggcgagtgggtcagccagaacgaccacgtcacacaggaaggcctggatgaggccaccggcctgcgggtgcgcgaggtgcagatcgaggtgtcgcggcagcaggtggaggagctctttgggctggaggattactggtgccagtgcgtggcctggagctccgcgggcaccaccaagagtcgccgagcctacgtccgcatcgcctacctgcgcaagaacttcgatcaggagcctctgggcaaggaggtgcccctggaccatgaggttctcctgcagtgccgcccgccggagggggtgcctgtggccgaggtggaatggctcaagaatgaggatgtcatcgaccccacccaggacaccaacttcctgctcaccatcgaccacaacctcatcatccgccaggcccgcctgtcggacactgccaactatacctgcgtggccaagaacatcgtggccaaacgccggagcaccactgccaccgtcatcgtctacgtgaatggcggctggtccagctgggcagagtggtcaccctgctccaaccgctgtggccgaggctggcagaagcgcacccggacctgcaccaaccccgctccactcaacggaggggccttctgcgagggccaggcattccagaagaccgcctgcaccaccatctgcccagtcgatggggcgtggacggagtggagcaagtggtcagcctgcagcactgagtgtgcccactggcgtagccgcgagtgcatggcgcccccaccccagaacggaggccgtgactgcagcgggacgctgctcgactctaagaactgcacagatgggctgtgcatgcaaatgctggaggcctcaggggatgcggcgctgtatgcggggctcgtggtggccatcttcgtggtcgtggcaatcctcatggcggtgggggtggtggtgtaccgccgcaactgccgtgacttcgacacagacatcactgactcatctgctgccctgactggtggtttccaccccgtcaactttaagacggcaaggcccagcaacccgcagctcctacacccctctgtgcctcctgacctgacagccagcgccggcatctaccgcggacccgtgtatgccctgcaggactccaccgacaaaatccccatgaccaactctcctctgctggaccccttacccagccttaaggtcaaggtctacagctccagcaccacgggctctgggccaggcctggcagatggggctgacctgctgggggtcttgccgcctggcacataccctagcgatttcgcccgggacacccacttcctgcacctgcgcagcgccagcctcggttcccagcagctcttgggcctgccccgagacccagggagcagcgtcagcggcacctttggctgcctgggtgggaggctcagcatccccggcacaggggtcagcttgctggtgcccaatggagccattccccagggcaagttctacgagatgtatctactcatcaacaaggcagaaagtaccctcccgctttcagaagggacccagacagtattgagcccctcggtgacctgtggacccacaggcctcctgctgtgccgccccgtcatcctcaccatgccccactgtgccgaagtcagtgcccgtgactggatctttcagctcaagacccaggcccaccagggccactgggaggaggtggtgaccctggatgaggagaccctgaacacaccctgctactgccagctggagcccagggcctgtcacatcctgctggaccagctgggcacctacgtgttcacgggcgagtcctattcccgctcagcagtcaagcggctccagctggccgtcttcgcccccgccctctgcacctccctggagtacagcctccgggtctactgcctggaggacacgcctgtagcactgaaggaggtgctggagctggagcggactctgggcggatacttggtggaggagccgaaaccgctaatgttcaaggacagttaccacaacctgcgcctctccctccatgacctcccccatgcccattggaggagcaagctgctggccaaataccaggagatccccttctatcacatttggagtggcagccagaaggccctccactgcactttcaccctggagaggcacagcttggcctccacagagctcacctgcaagatctgcgtgcggcaagtggaaggggagggccagatattccagctgcataccactctggcagagacacctgctggctccctggacactctctgctctgcccctggcagcactgtcaccacccagctgggaccttatgccttcaagatcccactgtccatccgccagaagatatgcaacagcctagatgcccccaactcacggggcaatgactggcggatgttagcacagaagctctctatggaccggtacctgaattactttgccaccaaagcgagccccacgggtgtgatcctggacctctgggaagctctgcagcaggacgatggggacctcaacagcctggcgagtgccttggaggagatgggcaagagtgagatgctggtggctgtggccaccgacggggactgctgagcctcctgggacagcgggctggcagggactggcaggaggcaggtgcagggaggcctggggcagcctcctgatggggatgtttggcctctgcttcctcccagttcacagccagagttgcctctcctcctcctcttccccaacccccagaccatgaccagccttagaaaatccatgtactctgttgttagagggcccagagttccttctccacccccgctctctctctcttggcctgagatctctgtgcaggaaccaagatggggctgaagcctctggaggcagttggttgggggcgggcaggcaggaggccctccctccacccccccaccctcagcccggcaacttctgggttccatgggttttagttccgttctcgttttcttcctccgttattgatttctcctttctccctaagcccccttctgcttccacgcccttttcctctttgaagagtcaagtacaattcagacaaactgctttctcctgtccaaaagcaaaaaggcaaaggaaagaaagaaagcttcagaccgctagtaaggctcaaagaagaagaaaaacaccaaaaccacaagggaaaagaaaaacccagtttcttaggaaacgcaaacgatttattatccagattatttggataagtcctttttaagaaaaaaaaagaaaatgaaaaacaacacaaaaaaaatagaaaactcttttcttgagtgtggatgagaatgggcacgctcacacttctggccaggagtgaatgtgcctgtgtgtgtgtgtgtgtgtgtgtgtgtgtgtgtacatgtacgcgtgtgcattgaggagagagagactgaacagagagtactttgctgctaacgaatccatcttggactaaattctgacaaggcctcagtttccccagttgtgcagggagtaggtcagacagggttttcactgtctagatttagctggttagattttcctctaaaatcttaagcagatgctgaatccataaagccaaggagtgctgagggctggagtgggtgggccctccctcccacagccccagggagatacatctggactcctgggaatctggattaagaaagttgggatgaaagaggaggactgctcaggccagttgtgagccagggagaatgttccagtctggttttggtctggtggctcctagaaagggatgtggcccagaagtgggactcaaacagagagatgaagtaggggaggggagtcctccacgggcatctctctcctggcggctggatagctttaccctagggtggggccagccctgacaccctcatcccctcctcagcccagcagcctctagagcagcgtggtgctctcttgatggccaggaatccagaatctgcccttccccaaccttggtttctccttctgtaaagcagagtgatggctgagaagtcctctctagctgcagaagcctgagcttcccggtgtcagtcagctctgcaacgtgggagccttggaggcgggtggcctggctgtgcttcatatgcccaggagtggagaaggaggctgagaagctggtttcccagctctgatctccacaggcacctcctataaccctcctctcacccaccccgctacggtctgagagatctgaaataacctttcccagtgggcagggttgccagggttgaggggacagcacataccacccccacccaacctgttcgaggggccctgcatggcacgggatgagtccctgccctgtgcagctgcctggcagtggctgggacaaggatcttgcagccagcacagaggcctcttcaaaggcctctccctcttggcactccaggcaaggcaggtgcccgcttccccaacacctccaggcagtgaccctagggcatgccccagcaggtctccgagcagccactgggacccgtctcagcacatcctggcctttgaaagtctgatatcctgagaggagggcaggttttagggccgcagttccagccagcgtccccagcctggcttccctgccatggactcagtagctcgtggggcttcttaccacccaccagccccgctggggtgcggcctggctgtgggcaaaggaggacttgcctggagatttgagagaagattccttctaccagggctgctgaggggccaggcctgcatcaggggctaggctctggctgggcccggaggctgagactaaggctttcgaccctggtgcctccatgtggatgctgcctcagacaaaggcagtgagccttccctgccaaagtgcccatcccatgggctcggcctcactggtcactgttagcccatgaacacgtgtgggcctcggtcacgtggctttgagggcagtctgaccaggctagaccacacgtgccgtgacagggggtgccattcccctcgcaggctctaatgtgcccacatgtagcctggcagtccaaagaccaagaatcaacttgcaaatctgccattaaactgctgtgcgacttcaggcatatcactgccttctctgggcttcagtgtccttttcatacctagaagtctgcggtctgaggctctttgggttcagacacactgttctaggcttctgtaggggaccttgtgatctgccgtgcccctcctccctgttcttttctgtcctccccaccccaccctcagaagctgcttgctctgcccccaggacaggagcttgacggatgaagtgcagccagccacccaggtgccatttccagtctgacttccagaaatgtgcaccatgtcctagagcacagacccattggctggagcctcctgggagggttcaaaccatcagctctatgagaaatgcccagaaaggctttgccgactccatccgtctgtggaggctgcctgcctccggggtgggatgggtggtttctcctccaattcagacccaagaggtagcccccgagggcatgtacctggtgggaagcagctcaggtacccttgggggttgcagggcccttacgcaggtatttctctctctctcctctctggggtgcgtgtgtgcgtgcgcgtgtgcgtgcctatgcttttctctgtgggcacatcaggatgcccctcggagagcatgtgcacgtgtccccacctgagcgagcgtgtgtgtgtgctcctctgcgtcccaggtttggacgtctagggtttggtgtgcctgtcttctgccctccctgagcccacagggtcagtcaatgtatcttctacgtgcctctccctctgccttctctcacagtgcccccggctccagagctcaggggtaggggttctcctgagggtgcaggggatccttctcatctcctggaccctccagggcactctggtccctattccccagctcctaggcagctgagccgggtcccttaggggaggtgaccaggagctttggtgcagggagctcttggtggggcaaagggctggacccctgccaggtctgtggacatggttatatgcccgggagaggggggtgcagggccccagggatggcccccaatcccacctctgtttattctgtaaactgcaacctataaataacctttagcattcctattgtaacaaaattaatttttatgaaataaattatatttcctagtctaataaaa

SEQ ID NO: 33838 - DNA, 3017 bp, Homo sapiens
gatgatgacttttttcatgaactcccagaaacttttccttctgatccacctgagcctctgccacatttccttattgagcctgaagaagcttatattgtgaagaataagcccgtgaacctgtactgtaaagcaagccctgccacccagatctatttcaagtgtaatagtgaatgggttcatcagaaggaccacatagtagatgaaagagtagatgaaacttccggtctcattgtccgggaagtgagcattgagatttcgcgccagcaagtggaagaactctttggacctgaagattactggtgccagtgtgtggcctggagctccgcgggtaccacaaagagccggaaggcgtatgtgcgcattgcatatctacggaagacatttgagcaggaacccctaggaaaggaagtgtctttggaacaggaagtcttactccagtgtcgaccacctgaagggatcccagtggctgaggtggaatggttgaaaaatgaagacataattgatcccgttgaagatcggaatttttatattactattgatcacaacctcatcataaagcaggcccgactctctgatactgcaaattacacctgtgttgccaaaaacattgttgccaagaggaaaagtacaactgccactgtcatagtctatgtcaacggtggctggtccacctggacggagtggtctgtgtgtaacagccgctgtggacgagggtatcagaaacgtacaaggacttgtaccaacccggcaccactcaatgggggtgccttctgtgaagggcagagtgtgcagaaaatagcctgtactacgttatgcccagtggatggcaggtggacgccatggagcaagtggtctacttgtggaactgagtgcacccactggcgcaggagggagtgcacggcgccagcccccaagaatggaggcaaggactgcgacggcctcgtcttgcaatccaagaactgcactgatgggctttgcatgcagactgctcctgattcagatgatgttgctctctatgttgggattgtgatagcagtgatcgtttgcctggcgatctctgtagttgtggccttgtttgtgtatcggaagaatcatcgtgactttgagtcagatattattgactcttcggcactcaatgggggctttcagcctgtgaacatcaaggcagcaagacaagatctgctggctgtacccccagacctcacgtcagctgcagccatgtacagaggacctgtctatgccctgcatgacgtctcagacaaaatcccaatgaccaactctccaattctggatccactgcccaacctgaaaatcaaagtgtacaacacctcaggtgctgtcaccccccaagatgacctctctgagtttacgtccaagctgtcccctcagatgacccagtcgttgttggagaatgaagccctcagcctgaagaaccagagtctagcaaggcagactgatccatcctgtaccgcatttggcagcttcaactcgctgggaggtcaccttattgttcccaattcaggagtcagcttgctgattcccgctggggccattccccaagggagagtctacgaaatgtatgtgactgtacacaggaaagaaactatgaggccacccatggatgactctcagacacttttgacccctgtggtgagctgtgggcccccaggagctctgctcacccgcccagtcgtcctcactatgcatcactgcgcagaccccaataccgaggactggaaaatactgctcaagaaccaggcagcacagggacagtgggaggatgtggtggtggtcggggaggaaaacttcaccaccccctgctacattcagctggatgcagaggcctgccacatcctcacagagaacctcagcacctacgccctggtaggacattccaccaccaaagcggctgcgaagcgcctcaagctggccatctttgggcccctgtgctgctcctcgctggagtacagcatccgagtctactgtctggatgacacccaggatgccctgaaggaaattttacatcttgagagacagatgggaggacagctcctagaagaacctaaggctcttcattttaaaggcagcacccacaacctgcgcctgtcaattcacgatatcgcccattccctctggaagagcaaattgctggctaaatatcaggaaattccattttaccatgtttggagtggatctcaaagaaacctgcactgcaccttcactctggaaagatttagcctgaacacagtggagctggtttgcaaactctgtgtgcggcaggtggaaggagaagggcagatcttccagctcaactgcaccgtgtcagaggaacctactggcatcgatttgccgctgctggatcctgcgaacaccatcaccacggtcacggggcccagtgctttcagcatccctctccctatccggcagaagctctgtagcagcctggatgccccccagacgagaggccatgactggaggatgctggcccataagctgaacctggacaggtacttgaattactttgccaccaaatccagcccaactggcgtaatcctggatctttgggaagcacagaacttcccagatggaaacctgagcatgctggcagctgtcttggaagaaatgggaagacatgaaacggtggtgtccttagcagcagaagggcagtattaaccaccatgctggaaggggaaatgaaggacaaaaatgcacagggagtctgtggccgtccaggtgaatcacagctgaggaggaaatccagatgagaccaatgcacttcacaggcaagactgcagcaggagccagaaggaaaacagatacaactgcccatgtacatgcccactttactcggacatcatcacgggagttaagaaaaattgtgtaaatttgtaccttgaatttagctatcaacctaattttcctcttagttgggctgtatgctgtgtggtacaggatcttacagtttcctaggaaacgctttttattgctatccagatatatggataaactttcttaac

SEQ ID NO: 33839 - DNA, 9875 bp, Homo sapiens
cagacttcggcgtgcggcggagctgcggctgctcctgctgctggggggagcggcggaggtggccgccttgcgcctccctggacttcccaagtgggggcagagcagtcgctcgcgggagacgtcagttagaaggcattgggaaagagggaccttcaaactcctcctcggcgtctcctctcctcccccttttggcccctgcctttggagaaagtggagtgtggcgcttggttgtcgttatttcttcggactgcttcgcggtgcacggattcagcttctgcccagtggggctttcagctgtttgcgcgtctctctgtccccctcccctccccccggcacacctctgtctacgatgaggaaaggtctgcgggcgacagcggcccgctgcggactgggactgggatacttgctgcaaatgctcgtgctacctgccctggccctgctcagcgccagcggcactggctccgccgcccaagatgatgacttttttcatgaactcccagaaacttttccttctgatccacctgagcctctgccacatttccttattgagcctgaagaagcttatattgtgaagaataagcccgtgaacctgtactgtaaagcaagccctgccacccagatctatttcaagtgtaatagtgaatgggttcatcagaaggaccacatagtagatgaaagagtagatgaaacttccggtctcattgtccgggaagtgagcattgagatttcgcgccagcaagtggaagaactctttggacctgaagattactggtgccagtgtgtggcctggagctccgcgggtaccacaaagagccggaaggcgtatgtgcgcattgcatatctacggaagacatttgagcaggaacccctaggaaaggaagtgtctttggaacaggaagtcttactccagtgtcgaccacctgaagggatcccagtggctgaggtggaatggttgaaaaatgaagacataattgatcccgttgaagatcggaatttttatattactattgatcacaacctcatcataaagcaggcccgactctctgatactgcaaattacacctgtgttgccaaaaacattgttgccaagaggaaaagtacaactgccactgtcatagtctatgtcaacggtggctggtccacctggacggagtggtctgtgtgtaacagccgctgtggacgagggtatcagaaacgtacaaggacttgtaccaacccggcaccactcaatgggggtgccttctgtgaagggcagagtgtgcagaaaatagcctgtactacgttatgcccagtggatggcaggtggacgccatggagcaagtggtctacttgtggaactgagtgcacccactggcgcaggagggagtgcacggcgccagcccccaagaatggaggcaaggactgcgacggcctcgtcttgcaatccaagaactgcactgatgggctttgcatgcagactgctcctgattcagatgatgttgctctctatgttgggattgtgatagcagtgatcgtttgcctggcgatctctgtagttgtggccttgtttgtgtatcggaagaatcatcgtgactttgagtcagatattattgactcttcggcactcaatgggggctttcagcctgtgaacatcaaggcagcaagacaagatctgctggctgtacccccagacctcacgtcagctgcagccatgtacagaggacctgtctatgccctgcatgacgtctcagacaaaatcccaatgaccaactctccaattctggatccactgcccaacctgaaaatcaaagtgtacaacacctcaggtgctgtcaccccccaagatgacctctctgagtttacgtccaagctgtcccctcagatgacccagtcgttgttggagaatgaagccctcagcctgaagaaccagagtctagcaaggcagactgatccatcctgtaccgcatttggcagcttcaactcgctgggaggtcaccttattgttcccaattcaggagtcagcttgctgattcccgctggggccattccccaagggagagtctacgaaatgtatgtgactgtacacaggaaagaaactatgaggccacccatggatgactctcagacacttttgacccctgtggtgagctgtgggcccccaggagctctgctcacccgcccagtcgtcctcactatgcatcactgcgcagaccccaataccgaggactggaaaatactgctcaagaaccaggcagcacagggacagtgggaggatgtggtggtggtcggggaggaaaacttcaccaccccctgctacattcagctggatgcagaggcctgccacatcctcacagagaacctcagcacctacgccctggtaggacattccaccaccaaagcggctgcgaagcgcctcaagctggccatctttgggcccctgtgctgctcctcgctggagtacagcatccgagtctactgtctggatgacacccaggatgccctgaaggaaattttacatcttgagagacagatgggaggacagctcctagaagaacctaaggctcttcattttaaaggcagcacccacaacctgcgcctgtcaattcacgatatcgcccattccctctggaagagcaaattgctggctaaatatcaggaaattccattttaccatgtttggagtggatctcaaagaaacctgcactgcaccttcactctggaaagatttagcctgaacacagtggagctggtttgcaaactctgtgtgcggcaggtggaaggagaagggcagatcttccagctcaactgcaccgtgtcagaggaacctactggcatcgatttgccgctgctggatcctgcgaacaccatcaccacggtcacggggcccagtgctttcagcatccctctccctatccggcagaagctctgtagcagcctggatgccccccagacgagaggccatgactggaggatgctggcccataagctgaacctggacaggtacttgaattactttgccaccaaatccagcccaactggcgtaatcctggatctttgggaagcacagaacttcccagatggaaacctgagcatgctggcagctgtcttggaagaaatgggaagacatgaaacggtggtgtccttagcagcagaagggcagtattaaccaccatgctggaaggggaaatgaaggacaaaaatgcacagggagtctgtggccgtccaggtgaatcacagctgaggaggaaatccagatgagaccaatgcacttcacaggcaagactgcagcaggagccagaaggaaaacagatacaactgcccatgtacatgcccactttactcggacatcatcacgggagttaagaaaaattgtgtaaatttgtaccttgaatttagctatcaacctaattttcctcttagttgggctgtatgctgtgtggtacaggatcttacagtttcctaggaaacgctttttattgctatccagatatatggataaactttcttaacaaacccaatttctacaaatgttgtttacatcaaattggacagggatgcagacactgtccatggctcgttctatttttgttcaaatcatttgaagttgaagctgtggacggtttgttgtgtctatttcagattagtaatttacagagaaatcacagacttttgctacaaatcgtgtgcatcaagtgtctcagataatcctcccatcagtgttctgtttctagaacttgtagaaccagtgttactgtttgtatcagggaagtggagaatctaagtgtaaaaaagaaataactaagactcctattccttggagggacccttctggtgccctttgggaataaagctgtagcactgcagggaagacagtgattcatgttcaaccccacaaacaagcatttttttcacaacatgtgtgtttgtttgtaatatgcaatatgaagtgtttttttttaaaggtattattattatttacaggtattctggtaaaatgatttttttaaatttctatttttgttagcagtgctgtttgttagtatttggttattgactagacctgtcccaccttttcacctatcaaggtgggtgtggtcatcagtttaattcaacatgcatcacttccttgaccttttacctttcccttattccaccccagaaaggtgattgataaatgctgaatggctttgtcagtctgttccttcagcttgctcaggcagggtctttctttctcctctgaggagtcttaaggagacgtgttctctattaagttcacttaatattgccgttgtgtggccccacgtcgactccctatggtgctctactctagaggcagtgtggttggaggaatggactctaaactggagatcaagaaaccagttctcattgtgggtctgtcactgtcttgttgcgccaccttgagaaagtcatttaaccacacgacctcagtgtcctcactagaaagtgaaagggtgggattagatcatctccaagttctgaaatgctcaacttccaccgtgatgcctccagtctcattcatcagtctgaagaccacaatggactctgacctggatcatcatttaaaaatcatcagctggtcttttgcccaggctatgttacgcctttcaagtagttctgacaaggaagatgattattctaaccagcattatgatgttgtttgtttggcctgagtcgctctgcatcattgcattatgctgttcactgagagatgacatccctttattatcattttcttagcctctcttgggatgcccctgcccccagccttcctgactggttgcaaattctgttttttattattgtcttggcatcttgatatctagaccactcctacaagtttatctggcagtaggaacttggtgcatttttttctacgctacacccccccacccttaatctttctttgctgtcataatattcagtagcatttataaaagctgtctagttagctctttaaaaacttttgtcctgcaaaatgtttgttagtcaacacactactttgtgtaaacaactattatgtttccttgggaccatcacaagctctttaacaaacacaaggactcaattcattcagcaggtggggattaaagaatcaaagcccagtagcaaaaccaaaactgaagaacaagcagacatgtgtatgaatcggaacctttagaacatgactgtggtttacttttaggctggaggcacacaagttgctgaacagacttgaattatacatgtgcttccatctttccatgtttccgctcctattttggtagcatcttgagattccttgatgcctccgccatcctcatccctgaggaactgctgataccttgctatggaacctcttctttctttcatgctttttattccgtatcttctgttttggacatacatacatatattctataaaatctctctcagcccaccccctgcattaggatttccatatttaaaatatttgtacactgactggggaagggagagattgcactataaacaagttcagtggatgtttgtagcaatgagtaaaactgtattctaaattaaaaatcaaatatatatacacgcagttatacacacacattttttaaaaggaggaggaggaaagagagctattgtccattcctacattttgaaataaacttgtcaagattacgcatcagtaccagggttgtggaatcatctatggaaatcaagaactagaatctgaactgaatggtcaaagaaacttctatgcctagtgaaaactagaggggagcaactatgtagctatgaacatgaatcaattccataactgttactaaaaacttattttgactaaaaagtcaccaacacagaactattgaacacaaacaggaattgtttgtcttactgaagtcactgagaacccttggggttcacttcagatgcttttttggttcaacttcccaccaccagaaaagggaaaagtgattgatttcgtgtgtgaggtactcatctgtcagaacccttaatgtttcctattaagtgaatgacaacttccatacatacactatttataccaaataattttcactacaaattctgatttccttctcctttggagtaaagtaatagctgttagattgctttcaaacttagaaggtccagatataacagttcatttcataggaagccacttcatcaaccattctatgtgatacatcctgcttctttctacaccgctggagaggcagtttggctggtttcatttggatagaaaaaactatcatttgtgcatgctgccatctagtggtgtacaacacaatctaacctgagtttaatattcactagaatgtgtttgacgaagggaatgaaaacctgtagagttcaaggacctttatgacaaacagatgtagggaaattttcacttcaaatttataattttcttattctcacttttttttcatttgcatcactcatctcaatattaggtcactgtgagcccagtacatcaactcattcatacacaacatatcttcagttgcttcttgtaacagaactatgtaaaatctatataaaacagtctttgaagagttgtcatttttaacacttatggttttcattggggtttgtatactttaaatctccttttagttccttaatatttatctttggaaatgtaagaagtatctgcttagaaagaaataagtcttatatatgcgaatggaatactatgtctagggaagagaaaattggggttgttaatcaaagggaagaaagcagcttcttttctgctgaatttgggaatccaaaggcagaggtttcatcctgtttttattttcttcttatcacactctttcaagtttccttaatgtatctggaaggaatagaagttggattcagaattgataactggcatggtgatgacaaacctgtgtaacaccaaggttctcacagctaacagctgtttcacaaacggcatcttccaaatgaacagtcacctctgctatgcagaaaacccccatcctgctgtgagcaagttaggctcttcaagaactggacaacttttgggtgaggtgttcaatatcaaactgcataatcattagccattttcatatatactattttatagatttaagtctctcaactatcaaaaagtagagcgattttcaggagaaaaaagtcgtggggactgagttcaggacaccctgaaactatgcgaccagtaatttttttaaggtattttttcctacaagtaaggtatctgaaaagtcaacgttttgagggtggaatcaagacttttcacttctcctggcaaagagcaacaaggctcttgtctcgtgtccttctgtgtgtctctgtcaggatcacagcagctgtgctcttggtctgcttactcctctgtaatccacgtatgcagaagggagttaataaggtgatcaccatctccccagaattcaaaggtctttgcctctataaggtctgcccctatggggccaggaaaatataaacctatataaggacttgcaagagagcataaagaaggtagaaaaggtttacttgttgggttttcaagccttcaagttgaatgagtcttagcttttgctgggcagttgttctggacaagtcatcagtttcatgtggagaactcagtgtaagcccaaggctaatgaatgagaggggtcccatggaaacacagctgaaatgaaatgggactttatccatcttctttgagaatggaagagcttttgtgaagcagtacatcattgctcaagataatggttgataagcattagattttatagatctaataaggaaaatattttattatctcaagttaacaaaacatttttttacctctcgagtgcctcataggaccaactattactctttggcttttatttttctttttgtattatttttatatattctttaaccttgctgagctagtattgactgaaatctttagaactttgcctctgggcaatgaagtaatgtttctctaccctaagatatctatttgtataatctctggctgtaatgatcactttggaagatttcctttgcatctctaattatttctttttaatggaataaggcataagggggaataaatatattgtaaccaatgttatgtaaacccatatccatacaggccaggaaagccaaatgaagtcatttccagaattctagtgtgaaaaacctatttttgaaaagtggggagatggctttgtgtagaactgggtgggttttctctgcagactaagtctagccatgagcttccagatcctttagttttatcagccttgtgcttaccccattttcataaatgctactttaacagccagtcttcataagtcatggttcctaggttttcctgtcacctcattgtattcatctgtggtaggatattaacgggctcattcaaccaaatgtaatgtgtgcctcagacctatttagcatggttggggggcatcagcaggacaaaccaacaggtactccgcaagtgtactggcacagcaagcccaccaattattagcagctcttcatcagcctgctgtctactcagacgcttgcctactgaagggacctgtccagagatcttctggaatcccaggttgggaatctctgcagaatgtcgtgacagttgtggcccaactagcttctgagtagaaacaaggaagctaccctgagatatagtcagctgcccacctgccatagtatttgctactgaatgccagccttttaacataccatttcagatttgtccttcaacaaaaatataaattgcaagtcataccatttaagggtcttttacaaatatgtctaaattgtgtgtcatttttaagttccaaaggtctactggactaagtactatcagaccagctgtagaacctgatggcgctgatccggggtggaataaccctcagtactggtgtgtagaagatgaattgtaggcaggttttgctgatcagcagcctaaggattgatgggctctcttttggcctctgatcctgagcactatggaggcagcatcagagaatggggacctgagctacataggttctcaatgttaaaacaactctgttcggagtgacatataagagcaagaaatctacagctggtgtaaaatacctttgccttttctatcccgaaagtaacaaatggcatctgtacatgtaggggtaaaaactcagatgtctactcctccaggccatggacaagaaaaagtacagcagtcagaacagtggaacaagtgatttgcattctcttcttcacgctttcctagatctgccattggtagcgcagccctcgccctccagacataatgcatcgagcccagttgcagggaacatcactgtgtgtgtgtgatgtcatggtgttatatgtgttgagtttaatgttgagctgaagcaagttggtgaccttcctctttgctctttgtaaagaagacaccaatgtttgtcagagaaaaatccccagcagtcgtgttgaagaggcagtgtcatccacctactgtcccctttggaacagttcaactgcagaaaggtcggattgaggttttgtgctttgtcgtttttcttttttaaacaaaacatgacaaccttggcttttccgatatggaacacttttgttgttgtggagttccctcttgctgtatcttctatgcaattccttttctaaaaaaaccccccggcagaggcagagtgccctccggatatctgtccggcgccttgctgagtggtggaggtgagggataccagctccgggtgtgcctcttttctctccctggctgccaatcctgattttccctgcagtccccttggtttgtaaattgcctgcatttattctgtcagccaacatgtacaaaatgtaagaaagaatttttaaacaggtaataaattatatttataagcaacaaa

SEQ ID NO: 33840 - DNA, 5293 bp, Homo sapiens
gaggcccgggcgccgcggctcttttgtttctccgttggggccgagcccgggccctagttggagccggagtcggagtcggagtcggatccggattcggattagcagcccgggaagagtgccgtggcacaggcgccggagggagcgcgaccctcggaccccgcctggcccgcggggctgggacccggccccggcctgcccgatggggcgcgcggccccggagatgcgccctcgcccggccccgcgcccccggccccgcgcccccggcccgcccgccccggcccgcgcctccgcctgagtcccccgcgccttggcccgccaccccccgccccgcgcccccggcccgcctgcgccatggagcccggccgcggcggcacagagaccgtgggcaagttcgagttctcccgcaaggacctgatcggccacggcgccttcgcggtggtcttcaagggccgccaccgcgagaagcacgatttggaggtcgccgtcaagtgcattaacaagaagaacctcgccaagtctcagacgctgctggggaaggaaatcaaaatcctgaaggaactgaaacatgaaaacatcgtggccctgtacgacttccaggaaatggctaattctgtctacctggttatggagtactgcaacggtggggacctggccgactacctgcacgccatgcgcacgctgagcgaggacaccatcaggctcttcctgcagcagatcgcgggcgccatgcggcttctgcacagcaaaggcatcatccaccgcgacctgaaaccgcagaacatcctgctgtccaaccccgccggccgccgcgccaaccccaacagcatccgcgtcaagatcgctgacttcggcttcgcgcggtacctccagagcaacatgatggcggccacactctgcggctcccccatgtacatggcccccgaggtcatcatgtcccagcactacgacgggaaggcggacctgtggagcatcggcaccatcgtctaccagtgcctgacggggaaggcgcccttccaggccagcagcccccaggacctgcgcctgttctacgagaagaacaagacgttggtccccaccatcccccgggagacctcggccccgctgcggcagctgctcctggccctactgcaacgcaaccacaaggaccgcatggacttcgatgagttttttcatcaccctttcctcgatgccagcccctcggtcaggaaatccccacccgtgcctgtgccctcgtacccaagctcggggtccggcagcagctccagcagcagctccacctcccacctggcctccccgccgtccctgggcgagatgcagcagctgcagaagaccctggcctccccggctgacaccgctggcttcctgcacagctcccgggactctggtggcagcaaggactcttcctgtgacacagacgacttcgtcatggtccccgcgcagtttccaggtgacctggtggctgaggcgcccagtgccaaacccccgccagacagcctgatgtgcagtgggagctcactggtggcctctgcgggcttggagagccacggccggaccccatctccatccccaccctgcagcagctcccccagtccctcaggccgggctggcccgttctccagcagcaggtgcggcgcctctgtccccatcccagtccccacgcaggtgcagaactaccagcgcattgagcgaaacctgcagtcacccacccagttccaaacacctcggtcctctgccatccgcaggtcaggcagcaccagccccctgggctttgcaagggccagcccctcgccccctgcccacgctgagcatggaggcgtcctggccaggaagatgtctctgggtggaggccggccctacacgccatctcctcaagttggaaccatccctgagcggccaggctggagcgggacgccctccccacagggagctgagatgcggggtggcaggtcccctcgtccaggctcctctgcacccgagcactctccccgcacttccgggctgggctgccgcctgcacagcgcccccaacctgtctgacttgcacgtcgtccgccccaagctgcccaaaccccccacggaccccctgggagctgtgttcagcccaccacaggccagccctccccagccgtcccacggcctgcagtcctgccggaacctgcggggctcacccaagctgcccgacttcctgcagcgaaaccccctgccccccatcctgggctcccccaccaaggctgtgccctcctttgacttcccgaagacccccagctcccagaacctgctggccctcctagcccggcagggcgtggtgatgacgccccctcgaaaccggacgctgcccgacctctcggaggtgggacccttccatggtcagccgttgggccctggcctgcggccaggcgaggaccccaagggcccctttggccggtctttcagcaccagccgcctcactgacctgctccttaaggcggcgtttgggacacaagccccggacccgggcagcacggagagcctgcaggagaagcccatggagatcgcaccctcagctggctttggagggagcctgcacccaggagcccgtgctgggggcaccagcagcccttccccggtggtcttcaccgtgggctctcccccgagcgggagcacgcccccccagggcccccgcaccaggatgttctcagcgggccccactggctctgccagctcttctgcccgccacctggtgcctgggccctgcagcgaggccccagcccctgagctccctgctccaggacacggctgcagctttgccgaccccattactgcgaacctggagggggctgtgaccttcgaggcccccgacctccctgaggagaccctcatggagcaagagcacacggagatcctgcgtggcctgcgcttcacgctgctgttcgtgcagcacgtcctggagatcgcagccctgaagggcagcgccagtgaggcggcggggggccctgagtaccagctgcaggagagtgtggtggccgaccagatcagcctgctgagccgagaatggggcttcgcggaacagctggtgctgtacctgaaggtggccgagctactgtcctccggcctgcaaagtgccatcgaccagatccgggccggcaagctctgcctgtcgtccactgtgaagcaggtggtgcgcaggctgaatgagctgtacaaggccagcgtggtgtcctgccagggcctgagcctgcggctgcagcgcttcttcctggacaagcagcggctcctggaccgcattcacagcatcactgccgagaggctcatcttcagccacgctgtgcagatggtgcagtcggctgccctggacgagatgttccagcaccgtgagggctgcgtcccacgctaccacaaggccctgctgctcctggaggggctgcagcacatgctctcggaccaggccgacatcgagaacgtcaccaagtgcaagctgtgcattgagcggagactctcggcgctgctgactggcatctgtgcctgacctttctggcctggctgggccccccgtcctgccgagccctgcagagtgggctctgtgtgctggctggactcctcgggacaagcccatggcgctgatcgctggtgctgagccctgccctgggccccacggacagtcagcctgccggcctccctgcagctcacggggcagaaccagcacatctggagccacacagcttggggggtgtctcccatcttttacaggtggggatcacagaatttctgcccctccagctgcctggctcagcaggcgtgggtgccaccaccctctagccccagggcagccccggaggacaggcaagggcctgagaccactgccgactcaaagccaaagcgagctcctgcttagggaaggtcagcaggcactgtgcccaggaagagcctgcggcctcggcgtcccccagtctccaggagcctctccctccgagatacccacccagctttgtcaatcacccaagcactttatgcatatagagacagaacctggacctcaccagggactgctgggcagcgattcctggcagtggcctggtgtttgtacatacacatatgcagacacatgccagggccccccaagcccgagcaccggaccacgttgctgcccaggtctggacctcagcgggagaactggctccggggggagtggggccctgcgctagaggcagaggcagttctttgttcaagcgttcctctggggaccggcagcagaggcaccgtgttctctcagccctggatacgtcttgtaatctttcacactttattcctaaaacgtgtcttatttttatgcagctcattttttctttaaaggagaaaacttgtaggtgtttaagaattggttttgggagggcgaggactgggccaggttagaggcagatggcacaggggcgtgtggcgggcgggtgaggctgctttgcacacctgtgttggtggctgtcccctgccgcccctccctgtggcagcagcaggacaggtgtgtgcccagcaccctccctacctgggcctggaagcagatgaggggaatacttcatgcaaagaaaaaagtaacatgtgcaaaagctccccgtccagctttgacagtcagttttgatgtcagctcctcggcagggtaggcctgatgacagccctgtccctccctgcctctgccttgcccaaggccacggagggcatctgcagagaggcctgccttccggattccaggcgggcatgccctgcaaaccccgcctgggcctcccttggtctgcccagccctcgattagccctgcctgaatcagtagatacttgaacgagtccccagtctgcgggaggcagtggtggggccatggacccatgcggggggttccagggtcacacgccacataacagacaaaaatacacacacgtgtgtttttctttgcaatacttgaaatattgccactgtgcttggacttagaagaagaaaatccccgtgacttcttcctcatcaccttgatggctttattctcaccttgtggggcatgtttgtatttattgcttcatggccgactggaatcctgagtcctgggaagctggcactgcggggatcttgcccggtgtcctggtcctcttgcttccgtcgcggccgcatgtgcgtgtgtccaagcaggtcctgggcgcctcaactgctgcccctggttgaatgttctcttgatagtgctggaccctttgtctattttaaagcgaattttgtgtgatttcctgccctttgcgttatattgtataataccaacgtaaggaaataaacctttggaattgtt

SEQ ID NO: 33841 - DNA, 1631 bp, Homo sapiens
agaatgcaaagaaatggatcagctagccgagggttggagaagaccaggctgaggctgtgtcgggaagccaggattccagaatcagcattcctcactggcctcacaagggaaagctgggaagcccggtgctggtgtgcaaaggacactcgtgaagtggtagccataaagtgtgtagccaagaaaagtctgaacaaggcatcggtggagaacctcctcacggagattgagatcctcaagggcattcgacatccccacattgtgcagctgaaagactttcagtgggacagtgacaatatctacctcatcatggagttttgcgcagggggcgacctgtctcgcttcatccatacccgcaggattctgcctgagaaggtggcgcgtgtcttcatgcagcaattagctagcgccctgcaattcctgcatgaacggaatatctctcacctggatctgaagccacagaacattctactgagctccttggagaagccccacctaaaactggcagactttggtttcgcacaacacatgtccccgtgggatgagaagcacgtgctccgtggctcccccctctacatggcccccgagatggtgtgccagcggcagtatgacgcccgcgtggacctctggtccatgggggtcatcctgtatgaagccctcttcgggcagcccccctttgcctccaggtcgttctcggagctggaagagaagatccgtagcaaccgggtcatcgagctccccttgcggcccctgctctcccgagactgccgggacctactgcagcggctcctggagcgggaccccagccgtcgcatctccttccaggacttttttgcgcacccctgggtggacctggagcacatgcccagtggggagagtctggggcgagcaaccgccctggtggtgcaggctgtgaagaaagaccaggagggggattcagcagctgccttatcactctactgcaaggctctggacttctttgtacctgccctgcactatgaagtggatgcccagcggaaggaggcaattaaggcaaaggtggggcagtacgtgtcccgggctgaggagctcaaggccatcgtctcctcttccaatcaggccctgctgaggcaggggacctctgcccgagacctgctcagagagatggcccgggacaagccacgcctcctagctgccctggaagtggcttcagctgccatggccaaggaggaggccgccggcggggagcaggatgccctggacctgtaccagcacagcctgggggagctactgctgttgctggcagcggagcccccgggccggaggcgggagctgcttcacactgaggttcagaacctcatggcccgagctgaatacttgaaggagcaggtcaagatgagggaatctcgctgggaagctgacaccctggacaaagagggactgtcggaatctgttcgtagctcttgcacccttcagtgaccctagaagaatgattggacagtgctgagacccccatatcccagagtccccagcctccctcaggttactctgcaccccacagatggtttgatggctgtgctgtatactggaggggagggcaggactctgggagaacagcacttctttcatgagacctttgttactcggtggttact

SEQ ID NO: 33842 - DNA, 2635 bp, Homo sapiens
cggcgctgggggcagcgtggagccacccagtgctcggcccgccccgcaacccgccggaaccgccgcccgcagcgaggaagcgcccgcgcgggcgcaggcggccggaatggcggggcccggctggggtcccccgcgcctggacggcttcatcctcaccgagcgcctgggcagcggcacgtacgccacggtgtacaaggcctacgccaagaaggacactcgtgaagtggtagccataaagtgtgtagccaagaaaagtctgaacaaggcatcggtggagaacctcctcacggagattgagatcctcaagggcattcgacatccccacattgtgcagctgaaagactttcagtgggacagtgacaatatctacctcatcatggagttttgcgcagggggcgacctgtctcgcttcatccatacccgcaggattctgcctgagaaggtggcgcgtgtcttcatgcagcaattagctagcgccctgcaattcctgcatgaacggaatatctctcacctggatctgaagccacagaacattctactgagctccttggagaagccccacctaaaactggcagactttggtttcgcacaacacatgtccccgtgggatgagaagcacgtgctccgtggctcccccctctacatggcccccgagatggtgtgccagcggcagtatgacgcccgcgtggacctctggtccatgggggtcatcctgtatgaagccctcttcgggcagcccccctttgcctccaggtcgttctcggagctggaagagaagatccgtagcaaccgggtcatcgagctccccttgcggcccctgctctcccgagactgccgggacctactgcagcggctcctggagcgggaccccagccgtcgcatctccttccaggacttttttgcgcacccctgggtggacctggagcacatgcccagtggggagagtctggggcgagcaaccgccctggtggtgcaggctgtgaagaaagaccaggagggggattcagcagctgccttatcactctactgcaaggctctggacttctttgtacctgccctgcactatgaagtggatgcccagcggaaggaggcaattaaggcaaaggtggggcagtacgtgtcccgggctgaggagctcaaggccatcgtctcctcttccaatcaggccctgctgaggcaggggacctctgcccgagacctgctcagagagatggcccgggacaagccacgcctcctagctgccctggaagtggcttcagctgccatggccaaggaggaggccgccggcggggagcaggatgccctggacctgtaccagcacagcctgggggagctactgctgttgctggcagcggagcccccgggccggaggcgggagctgcttcacactgaggttcagaacctcatggcccgagctgaatacttgaaggagcaggtcaagatgagggaatctcgctgggaagctgacaccctggacaaagagggactgtcggaatctgttcgtagctcttgcacccttcagtgaccctagaagaatgattggacagatgtgagccatctggagcagaggggcactaacccaggctgacgccaagaatgaagtggcccactgcagccctggcgagcaggcttcttggatggacagtgctgagacccccatatcccagagtccccagcctccctcaggttactctgcaccccacagatggtttgatggctgtgctgtatactggaggggagggcaggactctgggagaacagcacttctttcatgagacctttgttactcggtggttactgggtcctgtgcctgtccgttttggggcatgcagccctctatcatttttggctccgagaagagggcaaggggcccccgcagggtacttctgtgcttgccctcgccctgccagcaggcagctgtgcccctggcctgcccttcccgggaccccttattccaactcagctcctctttgcactggaatggggcactccaacacccctcagggaccaccctccccacagtatgcactcagccccacagaacccaccagtctttctgggaactcacacctgcccgccatcttggtactttaggttaatccctcaagcatgaaagctggatcttttggggtttaagaagcccaagccttgttcctgccctggcctagggagcactcaggagggttccttggtcctcatctctcccacctccgttccctctgggccccacactagccacagcgcgggccttgtgctggagtttgagcctgggacagggagagggaggcttggagacagtctgacccagtgccctctaggccacccacttctaggcctgccctgccgccgtggagccctgggcaagctctttcccctttctgggcctgggtctccccatctcttcaatggggctgataccttcacagcccacagcatgggcacttatgaggacaaagtgaatttaacctggaaaagaatgtatttgagagtttcttttaaataatcagcgggtgttggtgatttgtagcccttctgcccttaaatgcttccttgggcaagagctgtctgtcctccctgcaggaggctgagtgtaaagagtatcattcattgtttctctattaaattattttctcta

SEQ ID NO: 33843 - DNA, 10702 bp, Homo sapiens
gggtcctgcagtaggactcccgggagccaccattatggtgaagaggaagagctccgagggccaggagcaggacggcggccgcggcatccccctgcccatccagaccttcctgtggcggcaaaccagtgcatttttgaggcccaaactggggaagcaatatgaagcttcttgtgtgtcctttgagcgagtgttggtagaaaacaagctgcatggcctctctccagctctctctgaagccatccagagcatttccagatgggaactggtgcaagctgctttgcctcatgtcctccactgcactgcaaccctgctttcaaaccgaaacaagctaggccaccaggataaattgggtgttgctgagacaaagctccttcacactctacactggatgcttctggaggccccccaggactgcaacaatgagcggtttgggggtacagaccgaggctccagctggggtggaagcagcagtgctttcatccaccaggttgaaaaccagggttctccagggcagccttgccaaagcagctctaatgacgaagaagagaacaaccgaagaaagatcttccagaactccatggctactgtggagctcttcgtgtttctgtttgctcccctggtacacaggatcaaggaatctgacctcaccttccgtctggccagtgggcttgttatatggcagcccatgtgggaacacagacagcccggagtctctggctttaccgcactggtgaagcccatcaggaacatcattacagctaagagaagttctcctatcaacagtcaaagccggacctgtgaatcaccaaatcaagatgcaagacacttagagggactccaggtggtttgtgaaacattccagtctgattccatctcacccaaggccaccatttcaggctgtcaccgaggaaactcctttgatggaagtctgtcctcccaaacttcccaggaaagaggcccatcacattccagggcctctcttgtgatacctccgtgccaaaggtcccgctatgccacctactttgacgttgctgttctgcgctgcctacttcagccccattggtctgaggaaggcactcagtggtctctgatgtactatctacaaaggctgcgacacatgttggaagagaagccagaaaagcctccggagccagatattcctctcctgcccagacccaggagtagctccatggtggcagcagctccctcactagtgaacacccacaaaacccaagatctcaccatgaagtgtaacgaggaggaaaaatctcttagctctgaggccttttccaaggtttcactgaccaatctgcgtagatctgcagtcccagatctttcttcagacctgggcatgaatatttttaaaaagttcaagagccgcaaagaagaccgagagaggaaaggctccattccattccaccacacaggcaagaggaggccacggagaatgggagtgcccttcctgcttcacgaggaccacctggatgtgtcccccacgcgcagcacattctcctttggaagtttctctgggctgggagaagacaggcgaggaattgagaaaggaggctggcaaaccaccattttagggaaattgacccggcgaggcagttcagatgcagccactgagatggagagtctgagcgccaggcattcccactcccatcacaccctggtaagcgacctgccggacccctccaacagccatggagaaaacaccgtcaaggaagtgcgatctcagatctccaccatcacagttgcgaccttcaataccactttggcgtcattcaacgtaggctatgcagactttttcaatgagcatatgaggaaactctgcaaccaggtgcctatcccggagatgccacatgaacctctggcatgtgctaacctacctcgaagcctcacagactcctgcataaactacagctacctagaggacacagaacatattgacgggaccaataactttgtccacaagaatggaatgcttgatctttctgtagttctgaaggctgtttatcttgtccttaatcatgacatcagctctcgtatctgtgacgtggcgctaaacattgtggaatgcttgcttcaacttggtgtggtgccctgtgtagaaaagaatagaaagaagagtgaaaacaaggaaaatgagaccttggaaaagaggccaagtgagggagctttccaattcaaaggagtatctggaagttccacctgtggattcggaggccctgctgttagtggagctggagatggtggaggagaagaaggaggaggtggagatggaggaggtggaggaggtgatggaggaggaggtggaggaggtggaggcggcccttatgagaagaatgataagaaccaagagaaggatgaaagtacacctgtaagcaaccataggcttgctctaacaatgctcatcaaaatagtgaagtctttgggatgtgcctatggttgtggtgaaggacaccgagggctctctggagatcgtctgagacaccaggcccagaactgcctcactaagctatacaagctagataagatgcagttccgacaaaccatgagggactatgtgaacaaggactctctcaataatgtagtggacttcttgcatgctttgctaggattttgtatggagccggtcactgacaacaaggctgggtttggaaataacttcaccacagtggacaacaaatccacagcccaaaatgtggaaggcattatcgtcagcgccatgtttaaatccctcatcacacgctgcgcttcaaccacacatgaattgcacagccctgagaatctgggactgtattgtgacattcgtcagctggtccagtttatcaaagaggctcatgggaatgtcttcaggagagtggccctcagcgctctgcttgacagtgccgagaagttagcaccagggaaaaaggtggaggagaatgaacaggaatctaagcctgcaggcagtaaaaggtcagaggcgggaagcattgtggataaaggccaggtatcctctgcacctgaggaatgtcgcagcttcatgtctggtcgcccctcacagactccagagcacgatgaacaaatgcaaggagccaacttggggcggaaagatttctggcgtaagatgttcaagtcccagagtgcagcaagtgacaccagcagccagtctgaacaggacacttcagaatgcacgactgcccactcagggaccacctctgaccgacgtgcccgctcacgatcccgcagaatttccctccgaaagaagcttaaactccccataggtaaaaggaactggctgaagagatcatccctctcaggcctggcagatggtgtggaggacctcctggacattagctctgtggaccgactctctttcatcaggcaaagctccaaggtcaaattcactagtgctgtgaagctttctgaaggtgggccaggaagtggcatggaaaatggaagagatgaagaggagaatttcttcaagcgtcttggttgccacagttttgatgatcatctctctcccaaccaagatggtggaaaaagcaaaaacgtggtgaatcttggagcaatccgacaaggcatgaaacgcttccaatttctgttaaactgctgtgagccagggacaattcctgatgcctccatcctagcagctgccttggatctagaagcccctgtggtggccagagcagccttgttcctggaatgtgctcgttttgttcaccgctgcaaccgtggcaactggccagagtggatgaaagggcaccacgtgaacatcaccaagaaaggactttcccggggacgctctcccattgtgggcaacaagcgaaaccagaagctgcagtggaatgcagccaagctcttctaccaatggggagacgcaattggcgtccgattgaatgagctgtgccacggggaaagtgagagcccagccaacctgctgggtctcatttacgatgaagagaccaagaggagacttagaaaggaggatgaggaggaagactttttagatgacagtactgtgaacccctctaaatgcggttgcccctttgccttgaagatggcagcatgtcagcttcttctggagattaccaccttcctgcgagagaccttttcttgcctgcccagacctcgcactgagcctctggtggacttggagagctgcagacttcgtttggatcccgagttggaccggcacagatatgagaggaagatcagctttgctggggtcctggacgaaaatgaagactcaaaagattctctccacagcagcagccacactctcaaatcagatgcaggagtcgaggagaagaaagaagggagtccttggagtgcaagcgagcccagcattgagccagagggaatgagtaatgccggcgcggaggagaattaccacagaaacatgtcgtggcttcatgtgatgatcttgctgtgcaatcagcagagtttcatctgcactcacgttgactactgccatccccactgctacctgcaccacagccgctcctgtgcccgactggtcagagccatcaagctactctatggagacagtgtggactccctgagggaaagcagcaacatcagcagtgtggctctccggggcaagaaacagaaagaatgctcagataagtcatgcctgaggacaccttctctaaagaagagagtttcagatgccaatctggaaggaaaaaaagattccggaatgctgaagtacatcagacttcaggtgatgagcttgtcgcctgctcccttatctctgttaatcaaggcagcaccaattctgacagaggagatgtacggagacatccagccagctgcctgggagctcctgctcagcatggatgagcacatggcaggggcagcagctgccatgttcctgctgtgtgcagtgaaggtgcctgaggccgtgtccgacatgctgatgtcagagttccaccacccggagactgtgcagaggctgaacgctgtcctcaagttccacacgctctggaggtttcgctatcaggtctggccccggatggaggaaggggcacagcagatttttaagattccgcctcccagtatcaatttcacccttccctcgccggtgcttggaatgccatccgtcccaatgtttgacccaccgtgggttcctcagtgcagcgggagtgtccaggaccccattaatgaagaccagtctaaatccttttcagcccgggctgtgtcccgctcccatcaaagggcagaacacatcttaaagaacttgcagcaggaggaagaaaagaaacgacttggtagagaagccagcctcatcactgccatccccatcacccaggaggcttgctatgagcccacatgcacgcccaactcagaaccggaagaagaagtagaagaagtcaccaatctggcatcccgtcgactgtctgtgagtccatcctgcacctccagcacttcccacaggaattattccttccgccgcgggtcagtctggtcagtgcgttcagccgtcagtgctgaagatgaggaacataccactgaacacacgccgaaccaccatgtgcctcagcccccacaagcagtgttcccagcatgcatctgtgcagcagtacttcccattgttcatctgatggaggatggtgaggtgcgggaagatggagtagcagtgagtgctgtggctcaacaagtcttatggaactgtctaattgaagatccatcaacggttcttcgacattttctggaaaaactgaccatcagcaatagacaagatgagttaatgtacatgctgcgcaaacttctcttgaatattggagactttcctgctcagacatctcacatcctattcaactatttggtaggattaatcatgtactttgtgcggaccccctgcgagtgggggatggatgccatttcagccaccctgacattcctgtgggaggtggtgggttacgtggagggcctcttcttcaaggatctcaagcagacgatgaagaaggagcagtgtgaggtgaagctcctggtgaccgcttcaatgccaggtactaaaaccttggtagttcatggacagaatgagtgcgatatcccaacccagttaccagtccatgaagacactcaatttgaagccctgttgaaggagtgtctggagttttttaatatcccagaatcccagtcaacacattattttcttatggataaacgatggaaccttatccactacaataagacctatgttcgagatatttatcctttccggaggtcagtatctccccagctgaatcttgtacatatgcatccagagaagggacaggagctcattcagaaacaggtgttcacccgaaagctggaagaagtagggcgggtgttgtttctcatctccctaacccagaagatccccacagcccacaaacagtcccacgtctccatgcttcaggaagacctcctccgcctgccctcattccctcgtagtgctattgatgctgagttttcactcttcagtgatcctcaagctggaaaggaactgtttggcctcgacactcttcagaaaagcttgtggatccagctgctggaggaaatgttcctgggcatgccgagcgagtttccatggggagacgaaatcatgcttttcctcaacgtttttaacggggctctgatcctccacccggaagacagtgccctgctcaggcagtatgctgccaccgtcatcaacaccgcggtgcacttcaaccacctcttctctctcagcggctaccagtggattctccccaccatgctgcaggtgtactccgactatgaaagcaatccccagctgcgtcaagccatcgaatttgcctgtcaccagttctatattctacaccggaagccctttgtgctccagctgtttgctagtgtggcccctctcctggaatttcctgatgctgccaataatgggcccagcaaaggtgtgtcagctcagtgcctgtttgacttgctgcagtccctagagggagagaccaccgacatattagacatcttagagctggtcaaagctgagaagcctctcaagtcattagatttctgctatggaaacgaagatctgacattttctatcagtgaagccattaagctctgtgtcactgtggtggcgtatgctcccgaatcattcagaagtcttcagatgctgatggtcttagaagccttagttccatgttacctacaaaagctaaagaggcagacatcacaggtggagacagtacctgctgcccgagaggagattgcggccactgctgctcttgcgacgtccctacaggcccttttgtacagtgtagaggtcctcaccaggcccatgacagccccacagatgagcaggtgtgaccaaggtcataagggaaccaccacagccaatcacaccatgtcgtctggggtgaacaccaggtaccaggaacaaggagccaaactgcactttatcagggaaaaccttcatttactggaggaagggcaaggcattcccagagaggaactggatgaacgaattgctcgggaagagttcagaagaccccgggagtccttactgaatatttgcactgagttctataagcactgtgggccacggctgaagatcttgcaaaatctggctggggagcctcgggtcattgccttggaactgctggatgtgaagtctcacatgaggttggcagaaattgcacactcccttctgaagctggcaccatatgacactcagacaatggagagtcgtgggcttcggcgctacatcatggagatgctacccattactgactggacagctgaggcagtgaggccggccctcatcctcattttaaaaagattggatagaatgttcaacaaaattcataagatgcctactttgaggcgacaggttgagtgggagcctgccagcaatttgattgaaggggtttgtttgacacttcagaggcagccaatcatatccttcctgcctcaccttaggtcactgatcaatgtctgtgtcaatctggtgatgggagtggtaggaccttccagtgttgctgatggattaccccttcttcatctcagcccttatctctcaccacctctgcccttcagcacagctgttgtccggcttgtagcattgcagatacaggctttaaaagaagattttcctttaagccatgtgatctccccattcaccaatcaagagcgaagggaggggatgcttttaaatctgctcatcccatttgtgctcacagtaggatctggaagcaaagatagcccatggctggagcagcctgaggtgcagctgctgctgcagacagtcatcaatgtactcctcccaccgcggatcatcagcacatccaggagcaagaacttcatgttagagagctccccagcccactgctccacccctggggatgcggggaaagacttgcgcagggaagggctggctgagtccaccagccaagcagcatacttggcgctgaaggtgattctcgtctgctttgagaggcagctcggaagccagtggtactggctgagcctccaggtgaaggagatggctctgcggaaggtgggaggcctggccctttgggatttcctcgacttcatcgtgcggacccgaatacccatctttgtgcttttgcgccctttcatccagtgcaagctgctggcccaaccagcagagaatcatgaagagctttccgcccggcaacatattgccgaccagctggagcggcgcttcataccacgccctttgtgtaagagctcgctcattgctgagttcaacagtgaactaaaaattctaaaagaggcagttcatagtggatcagcctaccaaggcaagacatccatcagtaccgtgggcacctccacctctgcttaccgcctgagcttggccaccatgtcccgctctaacacgggcacgggcactgtctgggagcaggacagtgagccatcccagcaggcttcgcaggacaccctgagtcggactgatgaggaagatgaggaaaatgactctataagcatgcccagcgtggtaagtgaacaagaagcttacctcctgagtgccattggaaggaggcgattctccagccatgtctccagcatgtctgtacctcaggctgaggtgggcatgctacccagccagagggtggcaagtatacagagtgaacctggtcaacagaacctccttgttcagcagccgctggggaggaagaggggcctgaggcagctaagacgtcctctactatcacgtcagaaaactcagactgaacccagaaatcgccaaggggctcggctgtcaaccactcgcaggagcattcaacctaaaacgaagccgtctgcggatcagaaacgatctgtgaccttcattgaggctcagccagagccagcagctgccccaacagatgcgcttcctgcaacaggccaactacagggctgtagcccagccccttctaggaaaccagaagcaatggacgaaccagtcctcacatcttctcccgccatagttgttgcggatctccacagcgtgtctcccaagcagagtgagaacttccccactgaagaaggagaaaaggaggaggacacagaagcacaaggtgctactgcacacagtccactctctgcccaactctctgaccctgatgacttcacaggcctcgagacatccagcctcctacagcatggagacactgtccttcatatcagtgaggaaaatggcatggagaacccgctactatctagtcagttcacctttactcccactgagctggggaaaacggatgcagtattagatgagtctcatgtttaattctgtatcttgtaagctctgcaggtatagagaagacatgaaagtgatctctctactacaagttcaatacttttgcttgaaaaagattaattacaaaatagcactttacttctaatgggtggcacaaatctgaataggttttgctgccaatacacatgatgtttcataaacatcttaaaagtcaatggctaaaaggatttagttgtgtgaaaatcacaaaaccagggaggaataaggggaaagagccatttcactgcacattgtttatgattcaagaagccttcagcagttaaaaatatatactattcattgctgctttcatagaaatattaacaaatgatatgatctaaaaatagaatgcaattttttgagattactcacattatacatctcatgcaaatatttatttttatagtttaaaaaatatcaattcaggttggctatacaagtagcaatttacataaaaaaataattaataggaaaaatattactttggggagactaaataacaagcctgcagccatttttgttttgagtaacaatacagccatttagaagaagaaaaaaatactatatagagagctgtggacttttagatatttatttttcaactatcattttcattgcatgttgtaaatcaaaatgcagatggcataagatcatcccatttcataatctatcacattagaatattacagaatattctagaaatcatcagaaataattctgaattaagaacctaaacagcctatacaattataaaaactaaatgtatatataatcacttaaaagagatggtattcctattcctagccctgactacatcaataccaagattagaagctattggaaaatgtgattagtaatacttttccttatagtatcctgtgcctgccctggagggcatattttcagatattaaggttagtgttgttagaatcggtttaataaaataacattttc

SEQ ID NO: 33844 - DNA, 13562 bp, Homo sapiens
agcagcgggaggaggcggcggcggcggctagcgaggagacagagctgggtcctgcagtaggactcccgggagccaccattatggtgaagaggaagagctccgagggccaggagcaggacggcggccgcggcatccccctgcccatccagaccttcctgtggcggcaaaccagtgcatttttgaggcccaaactggggaagcaatatgaagcttcttgtgtgtcctttgagcgagtgttggtagaaaacaagctgcatggcctctctccagctctctctgaagccatccagagcatttccagatgggaactggtgcaagctgctttgcctcatgtcctccactgcactgcaaccctgctttcaaaccgaaacaagctaggccaccaggataaattgggtgttgctgagacaaagctccttcacactctacactggatgcttctggaggccccccaggactgcaacaatgagcggtttgggggtacagaccgaggctccagctggggtggaagcagcagtgctttcatccaccaggttgaaaaccagggttctccagggcagccttgccaaagcagctctaatgacgaagaagagaacaaccgaagaaagatcttccagaactccatggctactgtggagctcttcgtgtttctgtttgctcccctggtacacaggatcaaggaatctgacctcaccttccgtctggccagtgggcttgttatatggcagcccatgtgggaacacagacagcccggagtctctggctttaccgcactggtgaagcccatcaggaacatcattacagctaagagaagttctcctatcaacagtcaaagccggacctgtgaatcaccaaatcaagatgcaagacacttagagggactccaggtggtttgtgaaacattccagtctgattccatctcacccaaggccaccatttcaggctgtcaccgaggaaactcctttgatggaagtctgtcctcccaaacttcccaggaaagaggcccatcacattccagggcctctcttgtgatacctccgtgccaaaggtcccgctatgccacctactttgacgttgctgttctgcgctgcctacttcagccccattggtctgaggaaggcactcagtggtctctgatgtactatctacaaaggctgcgacacatgttggaagagaagccagaaaagcctccggagccagatattcctctcctgcccagacccaggagtagctccatggtggcagcagctccctcactagtgaacacccacaaaacccaagatctcaccatgaagtgtaacgaggaggaaaaatctcttagctctgaggccttttccaaggtttcactgaccaatctgcgtagatctgcagtcccagatctttcttcagacctgggcatgaatatttttaaaaagttcaagagccgcaaagaagaccgagagaggaaaggctccattccattccaccacacaggcaagaggaggccacggagaatgggagtgcccttcctgcttcacgaggaccacctggatgtgtcccccacgcgcagcacattctcctttggaagtttctctgggctgggagaagacaggcgaggaattgagaaaggaggctggcaaaccaccattttagggaaattgacccggcgaggcagttcagatgcagccactgagatggagagtctgagcgccaggcattcccactcccatcacaccctggtaagcgacctgccggacccctccaacagccatggagaaaacaccgtcaaggaagtgcgatctcagatctccaccatcacagttgcgaccttcaataccactttggcgtcattcaacgtaggctatgcagactttttcaatgagcatatgaggaaactctgcaaccaggtgcctatcccggagatgccacatgaacctctggcatgtgctaacctacctcgaagcctcacagactcctgcataaactacagctacctagaggacacagaacatattgacgggaccaataactttgtccacaagaatggaatgcttgatctttctgtagttctgaaggctgtttatcttgtccttaatcatgacatcagctctcgtatctgtgacgtggcgctaaacattgtggaatgcttgcttcaacttggtgtggtgccctgtgtagaaaagaatagaaagaagagtgaaaacaaggaaaatgagaccttggaaaagaggccaagtgagggagctttccaattcaaaggagtatctggaagttccacctgtggattcggaggccctgctgttagtggagctggagatggtggaggagaagaaggaggaggtggagatggaggaggtggaggaggtgatggaggaggaggtggaggaggtggaggcggcccttatgagaagaatgataagaaccaagagaaggatgaaagtacacctgtaagcaaccataggcttgctctaacaatgctcatcaaaatagtgaagtctttgggatgtgcctatggttgtggtgaaggacaccgagggctctctggagatcgtctgagacaccaggtattccgagagaatgcccagaactgcctcactaagctatacaagctagataagatgcagttccgacaaaccatgagggactatgtgaacaaggactctctcaataatgtagtggacttcttgcatgctttgctaggattttgtatggagccggtcactgacaacaaggctgggtttggaaataacttcaccacagtggacaacaaatccacagcccaaaatgtggaaggcattatcgtcagcgccatgtttaaatccctcatcacacgctgcgcttcaaccacacatgaattgcacagccctgagaatctgggactgtattgtgacattcgtcagctggtccagtttatcaaagaggctcatgggaatgtcttcaggagagtggccctcagcgctctgcttgacagtgccgagaagttagcaccagggaaaaaggtggaggagaatgaacaggaatctaagcctgcaggcagtaaaaggtcagaggcgggaagcattgtggataaaggccaggtatcctctgcacctgaggaatgtcgcagcttcatgtctggtcgcccctcacagactccagagcacgatgaacaaatgcaaggagccaacttggggcggaaagatttctggcgtaagatgttcaagtcccagagtgcagcaagtgacaccagcagccagtctgaacaggacacttcagaatgcacgactgcccactcagggaccacctctgaccgacgtgcccgctcacgatcccgcagaatttccctccgaaagaagcttaaactccccataggtaaaaggaactggctgaagagatcatccctctcaggcctggcagatggtgtggaggacctcctggacattagctctgtggaccgactctctttcatcaggcaaagctccaaggtcaaattcactagtgctgtgaagctttctgaaggtgggccaggaagtggcatggaaaatggaagagatgaagaggagaatttcttcaagcgtcttggttgccacagttttgatgatcatctctctcccaaccaagatggtggaaaaagcaaaaacgtggtgaatcttggagcaatccgacaaggcatgaaacgcttccaatttctgttaaactgctgtgagccagggacaattcctgatgcctccatcctagcagctgccttggatctagaagcccctgtggtggccagagcagccttgttcctggaatgtgctcgttttgttcaccgctgcaaccgtggcaactggccagagtggatgaaagggcaccacgtgaacatcaccaagaaaggactttcccggggacgctctcccattgtgggcaacaagcgaaaccagaagctgcagtggaatgcagccaagctcttctaccaatggggagacgcaattggcgtccgattgaatgagctgtgccacggggaaagtgagagcccagccaacctgctgggtctcatttacgatgaagagaccaagaggagacttagaaaggaggatgaggaggaagactttttagatgacagtactgtgaacccctctaaatgcggttgcccctttgccttgaagatggcagcatgtcagcttcttctggagattaccaccttcctgcgagagaccttttcttgcctgcccagacctcgcactgagcctctggtggacttggagagctgcagacttcgtttggatcccgagttggaccggcacagatatgagaggaagatcagctttgctggggtcctggacgaaaatgaagactcaaaagattctctccacagcagcagccacactctcaaatcagatgcaggagtcgaggagaagaaagaagggagtccttggagtgcaagcgagcccagcattgagccagagggaatgagtaatgccggcgcggaggagaattaccacagaaacatgtcgtggcttcatgtgatgatcttgctgtgcaatcagcagagtttcatctgcactcacgttgactactgccatccccactgctacctgcaccacagccgctcctgtgcccgactggtcagagccatcaagctactctatggagacagtgtggactccctgagggaaagcagcaacatcagcagtgtggctctccggggcaagaaacagaaagaatgctcagataagtcatgcctgaggacaccttctctaaagaagagagtttcagatgccaatctggaaggaaaaaaagattccggaatgctgaagtacatcagacttcaggtgatgagcttgtcgcctgctcccttatctctgttaatcaaggcagcaccaattctgacagaggagatgtacggagacatccagccagctgcctgggagctcctgctcagcatggatgagcacatggcaggggcagcagctgccatgttcctgctgtgtgcagtgaaggtgcctgaggccgtgtccgacatgctgatgtcagagttccaccacccggagactgtgcagaggctgaacgctgtcctcaagttccacacgctctggaggtttcgctatcaggtctggccccggatggaggaaggggcacagcagatttttaagattccgcctcccagtatcaatttcacccttccctcgccggtgcttggaatgccatccgtcccaatgtttgacccaccgtgggttcctcagtgcagcgggagtgtccaggaccccattaatgaagaccagtctaaatccttttcagcccgggctgtgtcccgctcccatcaaagggcagaacacatcttaaagaacttgcagcaggaggaagaaaagaaacgacttggtagagaagccagcctcatcactgccatccccatcacccaggaggcttgctatgagcccacatgcacgcccaactcagaaccggaagaagaagtagaagaagtcaccaatctggcatcccgtcgactgtctgtgagtccatcctgcacctccagcacttcccacaggaattattccttccgccgcgggtcagtctggtcagtgcgttcagccgtcagtgctgaagatgaggaacataccactgaacacacgccgaaccaccatgtgcctcagcccccacaagcagtgttcccagcatgcatctgtgcagcagtacttcccattgttcatctgatggaggatggtgaggtgcgggaagatggagtagcagtgagtgctgtggctcaacaagtcttatggaactgtctaattgaagatccatcaacggttcttcgacattttctggaaaaactgaccatcagcaatagacaagatgagttaatgtacatgctgcgcaaacttctcttgaatattggagactttcctgctcagacatctcacatcctattcaactatttggtaggattaatcatgtactttgtgcggaccccctgcgagtgggggatggatgccatttcagccaccctgacattcctgtgggaggtggtgggttacgtggagggcctcttcttcaaggatctcaagcagacgatgaagaaggagcagtgtgaggtgaagctcctggtgaccgcttcaatgccaggtactaaaaccttggtagttcatggacagaatgagtgcgatatcccaacccagttaccagtccatgaagacactcaatttgaagccctgttgaaggagtgtctggagttttttaatatcccagaatcccagtcaacacattattttcttatggataaacgatggaaccttatccactacaataagacctatgttcgagatatttatcctttccggaggtcagtatctccccagctgaatcttgtacatatgcatccagagaagggacaggagctcattcagaaacaggtgttcacccgaaagctggaagaagtagggcgggtgttgtttctcatctccctaacccagaagatccccacagcccacaaacagtcccacgtctccatgcttcaggaagacctcctccgcctgccctcattccctcgtagtgctattgatgctgagttttcactcttcagtgatcctcaagctggaaaggaactgtttggcctcgacactcttcagaaaagcttgtggatccagctgctggaggaaatgttcctgggcatgccgagcgagtttccatggggagacgaaatcatgcttttcctcaacgtttttaacggggctctgatcctccacccggaagacagtgccctgctcaggcagtatgctgccaccgtcatcaacaccgcggtgcacttcaaccacctcttctctctcagcggctaccagtggattctccccaccatgctgcaggtgtactccgactatgaaagcaatccccagctgcgtcaagccatcgaatttgcctgtcaccagttctatattctacaccggaagccctttgtgctccagctgtttgctagtgtggcccctctcctggaatttcctgatgctgccaataatgggcccagcaaaggtgtgtcagctcagtgcctgtttgacttgctgcagtccctagagggagagaccaccgacatattagacatcttagagctggtcaaagctgagaagcctctcaagtcattagatttctgctatggaaacgaagatctgacattttctatcagtgaagccattaagctctgtgtcactgtggtggcgtatgctcccgaatcattcagaagtcttcagatgctgatggtcttagaagccttagttccatgttacctacaaaagctaaagaggcagacatcacaggtggagacagtacctgctgcccgagaggagattgcggccactgctgctcttgcgacgtccctacaggcccttttgtacagtgtagaggtcctcaccaggcccatgacagccccacagatgagcaggtgtgaccaaggtcataagggaaccaccacagccaatcacaccatgtcgtctggggtgaacaccaggtaccaggaacaaggagccaaactgcactttatcagggaaaaccttcatttactggaggaagggcaaggcattcccagagaggaactggatgaacgaattgctcgggaagagttcagaagaccccgggagtccttactgaatatttgcactgagttctataagcactgtgggccacggctgaagatcttgcaaaatctggctggggagcctcgggtcattgccttggaactgctggatgtgaagtctcacatgaggttggcagaaattgcacactcccttctgaagctggcaccatatgacactcagacaatggagagtcgtgggcttcggcgctacatcatggagatgctacccattactgactggacagctgaggcagtgaggccggccctcatcctcattttaaaaagattggatagaatgttcaacaaaattcataagatgcctactttgaggcgacaggttgagtgggagcctgccagcaatttgattgaaggggtttgtttgacacttcagaggcagccaatcatatccttcctgcctcaccttaggtcactgatcaatgtctgtgtcaatctggtgatgggagtggtaggaccttccagtgttgctgatggattaccccttcttcatctcagcccttatctctcaccacctctgcccttcagcacagctgttgtccggcttgtagcattgcagatacaggctttaaaagaagattttcctttaagccatgtgatctccccattcaccaatcaagagcgaagggaggggatgcttttaaatctgctcatcccatttgtgctcacagtaggatctggaagcaaagatagcccatggctggagcagcctgaggtgcagctgctgctgcagacagtcatcaatgtactcctcccaccgcggatcatcagcacatccaggagcaagaacttcatgttagagagctccccagcccactgctccacccctggggatgcggggaaagacttgcgcagggaagggctggctgagtccaccagccaagcagcatacttggcgctgaaggtgattctcgtctgctttgagaggcagctcggaagccagtggtactggctgagcctccaggtgaaggagatggctctgcggaaggtgggaggcctggccctttgggatttcctcgacttcatcgtgcggacccgaatacccatctttgtgcttttgcgccctttcatccagtgcaagctgctggcccaaccagcagagaatcatgaagagctttccgcccggcaacatattgccgaccagctggagcggcgcttcataccacgccctttgtgtaagagctcgctcattgctgagttcaacagtgaactaaaaattctaaaagaggcagttcatagtggatcagcctaccaaggcaagacatccatcagtaccgtgggcacctccacctctgcttaccgcctgagcttggccaccatgtcccgctctaacacgggcacgggcactgtctgggagcaggacagtgagccatcccagcaggcttcgcaggacaccctgagtcggactgatgaggaagatgaggaaaatgactctataagcatgcccagcgtggtaagtgaacaagaagcttacctcctgagtgccattggaaggaggcgattctccagccatgtctccagcatgtctgtacctcaggctgaggtgggcatgctacccagccagagtgaacctaatgtcctcgatgactcccagggcctggccgccgagggcagcctctctagggtggcaagtatacagagtgaacctggtcaacagaacctccttgttcagcagccgctggggaggaagaggggcctgaggcagctaagacgtcctctactatcacgtcagaaaactcagactgaacccagaaatcgccaaggggctcggctgtcaaccactcgcaggagcattcaacctaaaacgaagccgtctgcggatcagaaacgatctgtgaccttcattgaggctcagccagagccagcagctgccccaacagatgcgcttcctgcaacaggccaactacagggctgtagcccagccccttctaggaaaccagaagcaatggacgaaccagtcctcacatcttctcccgccatagttgttgcggatctccacagcgtgtctcccaagcagagtgagaacttccccactgaagaaggagaaaaggaggaggacacagaagcacaaggtgctactgcacacagtccactctctgcccaactctctgaccctgatgacttcacaggcctcgagacatccagcctcctacagcatggagacactgtccttcatatcagtgaggaaaatggcatggagaacccgctactatctagtcagttcacctttactcccactgagctggggaaaacggatgcagtattagatgagtctcatgtttaattctgtatcttgtaagctctgcaggtatagagaagacatgaaagtgatctctctactacaagttcaatacttttgcttgaaaaagattaattacaaaatagcactttacttctaatgggtggcacaaatctgaataggttttgctgccaatacacatgatgtttcataaacatcttaaaagtcaatggctaaaaggatttagttgtgtgaaaatcacaaaaccagggaggaataaggggaaagagccatttcactgcacattgtttatgattcaagaagccttcagcagttaaaaatatatactattcattgctgctttcatagaaatattaacaaatgatatgatctaaaaatagaatgcaattttttgagattactcacattatacatctcatgcaaatatttatttttatagtttaaaaaatatcaattcaggttggctatacaagtagcaatttacataaaaaaataattaataggaaaaatattactttggggagactaaataacaagcctgcagccatttttgttttgagtaacaatacagccatttagaagaagaaaaaaatactatatagagagctgtggacttttagatatttatttttcaactatcattttcattgcatgttgtaaatcaaaatgcagatggcataagatcatcccatttcataatctatcacattagaatattacagaatattctagaaatcatcagaaataattctgaattaagaacctaaacagcctatacaattataaaaactaaatgtatatataatcacttaaaagagatggtattcctattcctagccctgactacatcaataccaagattagaagctattggaaaatgtgattagtaatacttttccttatagtatcctgtgcctgccctggagggcatattttcagatattaaggttagtgttgttagaatcggtttaataaaataacattttcctaatagaaacaatattcttatgatacttggaacatctaagtttataaggaaaaatgtataaagtaagcaatttcttcatagacacctccagtttatatattttgcaaataggcctttaacttgaagttcaattacttcaagaaaagtgtaacacttagaaggcttgtgaggccaacacctagtgtgttactgatcctatggtagggctgtgcatcacgtggttcacaattgaatttcaaaattttaacagtttacattagaaaactgttacctaacaaccaagcatatacaaactcatatacatacttaaattggtacggtggtgtatgtgtgcgtgcgtgtgtgtgtgtatgtgttgtagtcctcaagatgaagttaaatatagactttaattaccctgcaatgaatttaaaacacattctgtatgcttaaactttgagtgcgttggctgtgaaatgtatacatatataaagaggatacctactaaacccaccttaatcataaaggaaaattattttttgttagaattgcttattaaataggcatactttatactgtggtttataatttcaaatataacttggggttatggtcctattcactaagagaatgaaagatatccatgagttaaaagaacaaaactaaaaatttcagatctaacaattgaaagaaaattgaggcagtaaatgacctcttttactcttttatgttttacaatattatcatgttatttacagttaatgctgaaataattctcaagtgcaggaatataaatgttaagtggttttatgattccaagctgatatatttcacctgttaaaaattatgctgctaaattagcattagaggccttatgtttggtaattacaagtgtctgggctattggcgcgtctctatatatgtgtgtgctttgttccagtttcttcaaattatctatgtataattgtatgaaatatttaaatagcaaagaagtcaaagaagattgttaaatattcaacaagaatcataaatacctttatatgtattttaaaagtattgggctgttctgaacatgattatgctggtctgtctgtcttttagcctgactccttcactcttgtgtgtgaagtctattagcaactttcaataagctaagcaatgttgtaacttgcaaaaaagcctccactctgagaaacagggccttatagagtaggaatgttttcatactgggactactgaaattttgcagatgtgtgcatctgttccatttaaggtgcccttaaatgtgttgaatgtaatgtgttgaatgtttatgtgtaatggctaaagtatctatatgtatgtgcataaaactgtcacaagatgtattctcaggaatactgttacctggagtttgaaaggaataactattaaaaaaaaaagttggggaagattagaaaaaagctcaagataaatgttcaaaatattattaagtacatgactaaaagctaattactacatatgataaatgcagtgttggtaatagtagatcatttcttaagccatgatacttaatgatatttatcttattcagaggaaaaacaaaaaaggtacccacttcccatgtagaaaaaattagactcagcaaagaggttgcttcttctgaaattagcttttgagagaccttggaataaaccatgtgttatccatgatagtatgactcagatccaattaaaacagtttaaattctggatataggatctcctatagcaaaacattttactttcatttttcagtatttgctgctttctagaattctattagataagctatgtcatttttctgaaaaagaaactgagttattgagtgtattaagacaaggcactgagaactacagtgtcaaaatcaaagggcataaatgggcatggcagtgctggtggaaaaatctgtggtactggtgatctggttagggcctgttgcacaggctgggagtaactggtttgctgtttcaagcctccaagagtaccttaaacaaggtgatagctcctctcttctttagcattatattcctttagtcaacaaagaactttctccactctgctgcccagctctgagagtatctgagatgagaataggatgtgtgtggaggggcttttagggaagaaagggtcataaatgaatagaagtacagtctgaaacatgaattaaatatccttcctcaagttataaaggatactttaatagaacacagtctccagaattcgctgctatcacaccaagtcatgctgttgccctgtgacctcacacttcccattccatggccttgtcttggcagggagtaaaaaatcccacttctttttactttagtgggtctcaactgcagcatttcagaaacaaattttgatttgacactcaggagaataaaaacaagttgagggcagaatgtatttggaaaagcttaagacaaatttactgatattattttatgatcatttaggattacagatcaatttacctccataaatctttgaattgtcactgtgaccacaggatgaaaatcctttattagccattttataggttaaaacaaaaaattgactacacagccgacttccctcagataactatgaagtctattatgagtactgaatgaccaaagaacatggaaaaaatgcatatgaataaatactgaaatgtttatgaaagatatttatgaaagatattaagacttctgtgtttaggtatgcacatatgataaaataaatctaaaaacattaaagatg

SEQ ID NO: 33845 - DNA, 2033 bp, Homo sapiens
actaatgctaatgagaatggttcaaatactatgttaaacactggggatgtaaactaaggtcctggtcttcaagattatcacggttcaatgcaagaggcacataagaaaataactatgatacaaagttgttggcagaaattgcacactcccttctgaagctggcaccatatgacactcagacaatggagagtcgtgggcttcggcgctacatcatggagatgctacccattactgactggacagctgaggcagtgaggccggccctcatcctcattttaaaaagattggatagaatgttcaacaaaattcataagatgcctactttgaggcgacaggttgagtgggagcctgccagcaatttgattgaaggggtttgtttgacacttcagaggcagccaatcatatccttcctgcctcaccttaggtcactgatcaatgtctgtgtcaatctggtgatgggagtggtaggaccttccagtgttgctgatggattaccccttcttcatctcagcccttatctctcaccacctctgcccttcagcacagctgttgtccggcttgtagcattgcagatacaggctttaaaagaagattttcctttaagccatgtgatctccccattcaccaatcaagagcgaagggaggggatgcttttaaatctgctcatcccatttgtgctcacagtaggatctggaagcaaagatagcccatggctggagcagcctgaggtgcagctgctgctgcagacagtcatcaatgtactcctcccaccgcggatcatcagcacatccaggagcaagaacttcatgttagagagctccccagcccactgctccacccctggggatgcggggaaagacttgcgcagggaagggctggctgagtccaccagccaagcagcatacttggcgctgaaggtgattctcgtctgctttgagaggcagctcggaagccagtggtactggctgagcctccaggtgaaggagatggctctgcggaaggtgggaggcctggccctttgggatttcctcgacttcatcgtgcggacccgaatacccatctttgtgcttttgcgccctttcatccagtgcaagctgctggcccaaccagcagagaatcatgaagagctttccgcccggcaacatattgccgaccagctggagcggcgcttcataccacgccctttgtgtaagagctcgctcattgctgagttcaacagtgaactaaaaattctaaaagaggcagttcatagtggatcagcctaccaaggcaagacatccatcagtaccgtgggcacctccacctctgcttaccgcctgagcttggccaccatgtcccgctctaacacgggcacgggcactgtctgggagcaggacagtgagccatcccagcaggcttcgcaggacaccctgagtcggactgatgaggaagatgaggaaaatgactctataagcatgcccagcgtggtaagtgaacaagaagcttacctcctgagtgccattggaaggaggcgattctccagccatgtctccagcatgtctgtacctcaggctgaggtgggcatgctacccagccagaggtaaacagctatggttatactgtactctgcatttgggggcaaagttagaaattctgaaaatacactcctgttattctacaaagacagaaagagaagcaagcaatggtaatgtttttagatagatcattccacaaaggatttgtcaactaggttcctgcaggcaacactttgcagttttctaagccaagctagtagaagggatcccaatttccaagtattgtctctccttaaaaattttccatagacacatggtcttctttctgttgtcaaatggcattcttgtatttcagatttatcattagctaagctaatgatgggtacttggcaagagtttggaccatctttatgtttttggtaaagtttaggcttctgatatattattagtattcagttgtaggtagtgacacttaaccaagcagaaaaggatctatgccactgagtgtgaccttgggca

SEQ ID NO: 33846 - DNA, 2116 bp, Homo sapiens
attaacgagtgacagtcttaatgactaacacacctctaacatttcacctctagctcagatgagagagagaatgggacttcttggtactgattgtttttcccatgcctcaattggtttcttttagggagctacaaatttacgtgttcactggtgattgatcttttcatccagcacaatggacagaagtctaaggaacgtccttgtggtttcctttgggttcctgcttctctttacagcctatggaggtctgcagagcctgcagagcagcctgtacagcgaggagggcctgggtgtcacagcgctcagcaccctctatggaggcatgctcctgtcctccatgttcctcccaccgctcctcatcgagaggctgggctgcaaggggaccatcatcctctccatgtgtggctacgtggccttctccgtgggcaacttcttcgccagctggtacactttgatccccacctccatactgctgggactcggggccgccccgctgtggtctgcacagtgcacatacctcacgatcacgggaaacacacatgcagagaaggcgggaaagcgtggcaaagacatggtgaaccagtattttggcatcttcttcctcatattccagtcatccggtgtgtggggcaacttgatctcatcgctggtatttggccagactcccagccaagagacccttccagaagagcagctcacgtcctgtggggccagtgactgcctgatggccaccacaaccaccaacagcacccagaggccctcccagcagctggtctacaccctcctgggcatctacactgggagtggtgtcctggctgtcctgatgatagctgcgttcctccaacccatacgagatgttcagcgggaaagtgaaggagagaagaaatcagtacctttctggtccactttactgtcgactttcaagctatatagagataaacgtctgtgcctcttaattctgctgccgctgtacagtggattgcagcaaggattcctctccagcgaatacacaaggtcctatgtcacctgcaccctgggcatccagttcgtcggctacgtgatgatctgcttctcggccactgacgcgctgtgctccgtgttgtatggaaaggtctcgcagtacacgggcagggctgtgctgtacgtgctgggcgcggtgacccacgtgtcctgcatgattgccctactgctgtggagacctcgtgctgaccatctggcagtgttcttcgtattctctggcctgtggggcgtggcagatgccgtctggcagacacaaaacaatgctctctacggcgttctgtttgagaagagcaaggaagctgccttcgccaattaccgcctgtgggaggccctgggcttcgtcattgccttcgggtacagcatgtttttgtgcgtgcacgtcaagctctacattctgctgggggtcctgagcctgaccatggtggcgtatgggcttgtggagtgcgtggagtccaagaacccgatcagaccccacgctccaggacaggtcaaccaggcagaggatgaagaaatacaaacaaaaatgtgagagcagtgaggtccgaggaggatgaactcagaaagcaccagccagagaattttcttagaagatgcctcaggacatagagcggctcctcatcaccatctcagcacaatttggccattctgaagagatcatgttatttcactcttcatgtattttttttctattctaacaaatttttcgtccaccatcttaacagagatcaagtgtatacatgaaggtatcagttcatttaattttagatgcaaaagaaaaaggtctaacgtacaatcagccaattagaatttgcctgaaatcatagactcaccctagttttattgctgtagttgtttttaagaattggaagcctgcttaaaaaatgtagttgagccccataattttacaaatgggcgaacttttaaacttctaactctacttggatcaaaacctcatacattttacaaaggggtcctgacaagtcagctgactcaacctcacagagtcagggggtgacaaagccagactggggctcaggattcctgaaacgtgtggggtctgcgtttctaaataaagacggttatttaatggacttac

SEQ ID NO: 33847 - DNA, 1810 bp, Homo sapiens
ggtgattgatcttttcatccagcacaatggacagaagtctaaggaacgtccttgtggtttcctttgggttcctgcttctctttacagcctatggaggtctgcagagcctgcagagcagcctgtacagcgaggagggcctgggtgtcacagcgctcagcaccctctatggaggcatgctcctgtcctccatgttcctcccaccgctcctcatcgagaggctgggctgcaaggggaccatcatcctctccatgtgtggctacgtggccttctccgtgggcaacttcttcgccagctggtacactttgatccccacctccatactgctgggactcggggccgccccgctgtggtctgcacagtgcacatacctcacgatcacgggaaacacacatgcagagaaggcgggaaagcgtggcaaagacatggtgaaccagtattttggcatcttcttcctcatattccagtcatccggtgtgtggggcaacttgatctcatcgctggtatttggccagactcccagccaagggagtggtgtcctggctgtcctgatgatagctgcgttcctccaacccatacgagatgttcagcgggaaagtgaaggagagaagaaatcagtacctttctggtccactttactgtcgactttcaagctatatagagataaacgtctgtgcctcttaattctgctgccgctgtacagtggattgcagcaaggattcctctccagcgaatacacaaggtcctatgtcacctgcaccctgggcatccagttcgtcggctacgtgatgatctgcttctcggccactgacgcgctgtgctccgtgttgtatggaaaggtctcgcagtacacgggcagggctgtgctgtacgtgctgggcgcggtgacccacgtgtcctgcatgattgccctactgctgtggagacctcgtgctgaccatctggcagtgttcttcgtattctctggcctgtggggcgtggcagatgccgtctggcagacacaaaacaatgctctctacggcgttctgtttgagaagagcaaggaagctgccttcgccaattaccgcctgtgggaggccctgggcttcgtcattgccttcgggtacagcatgtttttgtgcgtgcacgtcaagctctacattctgctgggggtcctgagcctgaccatggtggcgtatgggcttgtggagtgcgtggagtccaagaacccgatcagaccccacgctccaggacaggtcaaccaggcagaggatgaagaaatacaaacaaaaatgtgagagcagtgaggtccgaggaggatgaactcagaaagcaccagccagagaattttcttagaagatgcctcaggacatagagcggctcctcatcaccatctcagcacaatttggccattctgaagagatcatgttatttcactcttcatgtattttttttctattctaacaaatttttcgtccaccatcttaacagagatcaagtgtatacatgaaggtatcagttcatttaattttagatgcaaaagaaaaaggtctaacgtacaatcagccaattagaatttgcctgaaatcatagactcaccctagttttattgctgtagttgtttttaagaattggaagcctgcttaaaaaatgtagttgagccccataattttacaaatgggcgaacttttaaacttctaactctacttggatcaaaacctcatacattttacaaaggggtcctgacaagtcagctgactcaacctcacagagtcagggggtgacaaagccagactggggctcaggattcctgaaacgtgtggggtctgcgttt

SEQ ID NO: 33848 - DNA, 775 bp, Homo sapiens
gagggccagagttaagacagagcttaagacagagaacctcaacaggaggcctgaaggaaagcacctgggagtcattaggcagcaagggagggaattgcaattctgggcggggctcagctgtgcagagtttagcaaggtctccaggtgcttctgctgagggccagagttaagaaagagcgagaacctcatcaggaggactgaaggaaaggagccaggctgcagccctctgcctgcccttccgtgccatcatctccaggattaatgaaagggccattcaggaaacagcacagggagctacaaatttacgtgttcactggtgattgatcttttcatccagcacaatggacagaagtctaaggaacgtccttgtggtttcctttgggttcctgcttctctttacagcctatggaggtctgcagagcctgcagagcagcctgtacagcgaggagggcctgggtgtcacagcgctcagcaccctctatggaggcatgctcctgtcctccatgttcctcccaccgctcctcatcgagaggctgggctgcaaggggaccatcatcctctccatgtgtggctacgtggccttctccgtgggcaacttcttcgccagctggtacactttgatccccacctccatactgctgggactcggggccgccccgctgtggtctgcacagtgcacatacctcacgatcacgggaaacacacatgcagagaaggcgggaaagcgtggcaaagacatggtgaaccagtattttggcatcttcttcctcatatt

SEQ ID NO: 33849 - DNA, 2313 bp, Homo sapiens
gtcccggccgccgggaggaagtggccgggcggtcgcagggactccggggcgaccgccgcgagtccgcagtagttcgggccatggaggcggagccgccgctctacccgatggcgggggctgcggggccgcagggcgacgaggacctgctcggggtcccggacgggcccgaggccccgctggacgagctggtgggcgcgtaccccaactacaacgaggaggaggaggagcgccgctactaccgccgcaagcgcctgggcgtgctcaagaacgtgctggctgccagcgccgggggcatgctcacctacggcgtctacctgggcctcctgcagatgcagctgatcctgcactacgacgagacctaccgcgaggtgaagtatggcaacatggggctgcccgacatcgacagcaaaatgctgatgggcatcaacgtgactcccatcgccgccctgctctacacacctgtgctcatcaggttttttggaacgaagtggatgatgttcctcgctgtgggcatctacgccctctttgtctccaccaactactgggagcgctactacacgcttgtgccctcggctgtggccctgggcatggccatcgtgcctctttgggcttccatgggcaactacatcaccaggatggcgcagaagtaccatgagtactcccactacaaggagcaggatgggcaggggatgaagcagcggcctccgcggggctcccacgcgccctatctcctggtcttccaagccatcttctacagcttcttccatctgagcttcgcctgcgcccagctgcccatgatttatttcctgaaccactacctgtatgacctgaaccacacgctgtacaatgtgcagagctgcggcaccaacagccacgggatcctcagcggcttcaacaagacggttctgcggacgctcccgcggagcggaaacctcattgtggtggagagcgtgctcatggcagtgttcctggccatgctgctggtgctgggtttgtgcggagccgcttaccggcccacggaggagatcgatctgcgcagcgtgggctggggcaacatcttccagctgcccttcaagcacgtgcgtgactaccgcctgcgccacctcgtgcctttctttatctacagcggcttcgaggtgctctttgcctgcactggtatcgccttgggctatggcgtgtgctcggtggggctggagcggctggcttacctcctcgtggcttacagcctgggcgcctcagccgcctcactcctgggcctgctgggcctgtggctgccacgcccggtgcccctggtggccggagcaggggtgcacctgctgctcaccttcatcctctttttctgggcccctgtgcctcgggtcctgcaacacagctggatcctctatgtggcagctgccctttggggtgtgggcagtgccctgaacaagactggactcagcacactcctgggaatcttgtacgaagacaaggagagacaggacttcatcttcaccatctaccactggtggcaggctgtggccatcttcaccgtgtacctgggctcgagcctgcacatgaaggctaagctggcggtgctgctggtgacgctggtggcggccgcggtctcctacctgcggatggagcagaagctgcgccggggcgtggccccgcgccagccccgcatcccgcggccccagcacaaggtgcgcggttaccgctacttggaggaggacaactcggacgagagcgacgcggagggcgagcatggggacggcgcggaggaggaggcgccgcccgcagggcccaggcctggccccgagcccgctggactcggccgccggccctgcccgtacgaacaggcgcaggggggagacgggccggaggagcagtgaggggccgcctggtccccggactcagcctccctcctcgccggcctcagtttaccacgtctgaggtcggggggaccccctccgagtcccgcgctgtcttcaaaggcccctgtctcccctcccccacgttggggacgcccctcccagagcccaggtcacctccgggcttccgcagccccctccaaggcggagtggagccttgggaacccctcggccaagcacaggggttcgaaaatacagctgaaaccccgcgggcccttagcacgcgccccagcgccggagcacggtcagggtcttcttgcgacccggcccgctccagatccccacagctctcggccgcggacccgggccgcgtgtgagcgcactttgcacctcctatccccagggtccgccgagagccacgattttttacagaaaatgagcaataaagagattttgtactgtc

SEQ ID NO: 33850 - DNA, 1462 bp, Homo sapiens
agagcaagggaaaggaacttcctccaccttcggggctggagcccttttcctctgcatctccagtctctgagtgaagatggggggcctgacagcctcggacgtacacccgaccctgggggtccagctcttctcagctggaatagcggcgtgcttggcggacgtgatcaccttcccgctggacacggccaaagtccggctccaggtccaaggtgaatgcccgacgtccagtgttattaggtataaaggtgtcctgggaacaatcaccgctgtggtaaaaacagaagggcggatgaaactctacagcgggctgcctgcggggcttcagcggcaaatcagctccgcctctctcaggatcggcctctacgacacggtccaggagttcctcaccgcagggaaagaaacagcacctagtttaggaagcaagattttagctggtctaacgactggaggagtggcagtattcattgggcaacccacagaggtcgtgaaagtcagacttcaagcacagagccatctccacggaatcaaacctcgctacacggggacttataatgcgtacagaataatagcaacaaccgaaggcttgacgggtctttggaaagggactactcccaatctgatgagaagtgtcatcatcaattgtacagagctagtaacatatgatctaatgaaggaggcctttgtgaaaaacaacatattagcagatgacgtcccctgccacttggtgtcggctcttatcgctggattttgcgcaacagctatgtcctccccggtggatgtagtaaaaaccagatttattaattctccaccaggacagtacaaaagtgtgcccaactgtgcaatgaaagtgttcactaacgaaggaccaacggctttcttcaaggggttggtaccttccttcttgcgacttggatcctggaacgtcattatgtttgtgtgctttgaacaactgaaacgagaactgtcaaagtcaaggcagactatggactgtgccacataatcagcttcaagaaaatgatgtaacataccagtgggaatcttgctgactggatcataaaaacaaacaaaacttattcacttattttaacctaaaaagataaaggaattttggcagagaattttggacttttttatataaaaaagaggaaaattaatgcctatttcatataactttttttttttctcagtgtcttaagaaggggaaagcaaaacattcagcatataccctggcaaatgtaatgcagataagctactgcatttgaccatttctggagtgcaattgtgtgaatgaatgtgaagaactttaacatgttttaattacaattccaactggtggaaaagaaactgagtgaaatgcagtttatatttataaatacttaaaaatgaagttattaaaaatattagtttttattaaccacagttgtcagttaatatattcaataaagtattgctaatacctttt

SEQ ID NO: 33851 - DNA, 2113 bp, Homo sapiens
agccgcgcgctcgctcgcaggagggtgggtagtttgcccagcgtaggggggctgggcccataaaagaggaagtgcacttaagacacggccccgctggacgctgttagaaaccgtcctggctgggaaggcaagaggtgtgtgactggacaagacttgtttctggcggtcagtcttgccatcctcacagaggttggcggcccgagagagtgtgaggcagaggcggggagtggcaagggagtgaccatctcggggaacgaaggagtaaacgcggtgatgggacgcacggaaacgggagtggagaaagtcatggagagaaccctaggcggggcggtccccgcggaaaggcggctgctccagggtctccgcacccaagtaggagctggcaggcccggccccgccccgcaggccccaccccgggccccgcccccgaggcttaagccgcgccgccgcctgcgcggagccccactgcgaagcccagctgcgcgcgccttgggattgactgtccacgctcgcccggctcgtccgacgcgccctccgccagccgacagacacagccgcacgcactgccgtgttctccctgcggctcggacacatagtatgaccattaggtgtttcgtctcccacccattttctatggaaaaccaaggggatcgggccatgatagccactggcagctttgaagaacgggacacctttagagaagcttgatcttggaggcctcaccgtgagaccttacaaagccggattccggcagagttcctctatctcgtcttgttgctgattaaaggtgcccctgtctccagtttttctccatctcctgggacgtagcaggaaatcagcatcatggttgggttcaaggccacagatgtgccccctactgccactgtgaagtttcttggggctggcacagctgcctgcatcgcagatctcatcacctttcctctggatactgctaaagtccggttacagatccaaggagaaagtcaggggccagtgcgcgctacagccagcgcccagtaccgcggtgtgatgggcaccattctgaccatggtgcgtactgagggcccccgaagcctctacaatgggctggttgccggcctgcagcgccaaatgagctttgcctctgtccgcatcggcctgtatgattctgtcaaacagttctacaccaagggctctgagcatgccagcattgggagccgcctcctagcaggcagcaccacaggtgccctggctgtggctgtggcccagcccacggatgtggtaaaggtccgattccaagctcaggcccgggctggaggtggtcggagataccaaagcaccgtcaatgcctacaagaccattgcccgagaggaagggttccggggcctctggaaagggacctctcccaatgttgctcgtaatgccattgtcaactgtgctgagctggtgacctatgacctcatcaaggatgccctcctgaaagccaacctcatgacagatgacctcccttgccacttcacttctgcctttggggcaggcttctgcaccactgtcatcgcctcccctgtagacgtggtcaagacgagatacatgaactctgccctgggccagtacagtagcgctggccactgtgcccttaccatgctccagaaggaggggccccgagccttctacaaagggttcatgccctcctttctccgcttgggttcctggaacgtggtgatgttcgtcacctatgagcagctgaaacgagccctcatggctgcctgcacttcccgagaggctcccttctgagcctctcctgctgctgacctgatcacctctggctttgtctctagccgggccatgctttccttttcttccttctttctcttccctccttcccttctctccttccctctttccccacctcttccttccgctcctttacctaccaccttccctctttctacattctcatctactcattgtctcagtgctggtggagttgacatttgacagtgtgggaggcctcgtaccagccaggatcccaagcgtcccgtcccttggaaagttcagccagaatcttcgtcctgcccccgacagcccagcctagcccacttgtcatccataaagcaagctcaaccttggcgtc

SEQ ID NO: 33852 - DNA, 464 bp, Homo sapiens
gggcagcagctgggtcttattcttctctggccttcacaacatcctgcaacccagctcaaggtcaggaatgtgacagactcatgtcatcatatctctgatgcccagagaagggataccatttgcctgagccttctcagtactgtttaatcagcctgtgagaactttccttgtgaaaggccctgtctgtgcctggggctgataaaacagcaagaacgaactgaggagctgggcagcagtgcaaagcaaatactaccagctttggtgcctattccggcagagttcctctatctcgtcttgttgctgattaaaggtgcccctgtctccagtttttctccatctcctgggacgtagcaggaaatcagcatcatggttgggttcaaggccacagatgtgccccctactgccactgtgaagtttcttggggctggcacagctgcctgcatcgcagatctcatcacctttcc

SEQ ID NO: 33853 - DNA, 2623 bp, Homo sapiens
atatttagcacatagtaggcacaaagaaatgacattattattaagagacctgggagagctgtgcccagcctatcgtgggaggccttgacctttggactcaaaagtggcagcaggtccacccccccatacacccttgtcaccaaggaagcgtccacagcttaaaggagctatattaaagcaccccaagtcaagaggactgaaccagatctggaactcactcacctcccctctcacctcactgccctcaccagccagcctcttgtcaagtgatcaggctgtcaaccaacttctctaggataaggtttcaggtcagcccgtgtgtataagaccagtgccaagccagaagcagcagagacaacagtgaatgacaaggaggggccatccaatccctgctgccacctcctgggatggagccctagggagcccctgtgctgcccctgccgtggcaggactcacagccccaccgctgcactgaagcccagggctgtggagcagcctctctccttggacctcctctcggccctaaagggactgggcagagccttccaggactatggttggactgaagccttcagacgtgcctcccaccatggctgtgaagttcctgggggcaggcacagcagcctgttttgctgacctcgttacctttccactggacacagccaaggtccgcctgcagatccagggggagaaccaggcggtccagacggcccggctcgtgcagtaccgtggcgtgctgggcaccatcctgaccatggtgcggactgagggtccctgcagcccctacaatgggctggtggccggcctgcagcgccagatgagcttcgcctccatccgcatcggcctctatgactccgtcaagcaggtgtacacccccaaaggcgcggacaactccagcctcactacccggattttggccggctgcaccacaggagccatggcggtgacctgtgcccagcccacagatgtggtgaaggtccgatttcaggccagcatacacctcgggccatccaggagcgacagaaaatacagcgggactatggacgcctacagaaccatcgccagggaggaaggagtcaggggcctgtggaaaggaactttgcccaacatcatgaggaatgctatcgtcaactgtgctgaggtggtgacctacgacatcctcaaggagaagctgctggactaccacctgctcactgacaacttcccctgccactttgtctctgcctttggagccggcttctgtgccacagtggtggcctccccggtggacgtggtgaagacccggtatatgaactcacctccaggccagtacttcagccccctcgactgtatgataaagatggtggcccaggagggccccacagccttctacaagggatttacaccctcctttttgcgtttgggatcctggaacgtggtgatgttcgtaacctatgagcagctgaaacgggccctgatgaaagtccagatgttacgggaatcaccgttttgaacaagacaagaaggccactggtagctaacgtgtccgaaaccagttaagaatggaagaaaacggtgcatccacgcacacatggacacagacccacacatgtttacagaactgttgtttacttgttgctgattcaagaaacagaagtagaagaggaggagggattctggtcttcactgccatgcctcaagaacacctttgttttgcactgacaagatggaaaataaattatattaatttttgaaacccattaggcatgcctaatatttaggcaagagaaaataaaccaagatagatccatttggacaaaatggaaggttggagacgtgtatccccgtgaaatctggttagataatgaatgataagcaggaaggatggcaagcacgggacaggaggggcccacaatggagtgggagatcagccacggagcctggagggatgccacccagcaacacagagctggcgactgcagctgcaccatcacacatgcatcatcagcctatttgtaatatgtctgccacagagagtcctttgggattctaggaaacccaaggaacaagagaaaaaactagagcctgtgctaaagaagccctgctgggcccatgtgaggctggggctcgtaaatattccctgacgacactgaagaatcaagagggcagcccccactttcctacaaaatggagggagccatcccttccctgtccacctcaccaggggtgctatgacatgcaagtgagaagctgggcatgaacgcactttataaaagcaaaagctctgtgtaaatctaactacaaggacaatgccttgggagagattttgtcgggacagagaggagttgccagggaagaaggtttgaaagatacggttgtctagaggtgagaccaaaggatccagagacttggggaccagaggtgacagtggatgacgtgaagccacaggagccccacccccatgcagcctcttccccaccccccccaccacgtgctcaatcatgagtacctcaaaggattgttgggcttgggggaaaagaggtggattcctgggcaagaacctaaagtagcaggactcggaattctcgggaaattattatgactcaataaaagaattcacaccttaggtgtgggagtaagaaca

SEQ ID NO: 33854 - DNA, 2112 bp, Homo sapiens
gaaccagatctggaactcactcacctcccctctcacctcactgccctcaccagccagcctcttgtcaagtgatcaggctgtcaaccaacttctctaggataaggtttcaggtcagcccgtgtgtataagaccagtgccaagccagaagcagcagagacaacagtgaatgacaaggaggggccatccaatccctgctgccacctcctgggatggagccctagggagcccctgtgctgcccctgccgtggcaggactcacagccccaccgctgcactgaagcccagggctgtggagcagcctctctccttggacctcctctcggccctaaagggactgggcagagccttccaggactatggttggactgaagccttcagacgtgcctcccaccatggctgtgaagttcctgggggcaggcacagcagcctgttttgctgacctcgttacctttccactggacacagccaaggtccgcctgcagatccagggggagaaccaggcggtccagacggcccggctcgtgcagtaccgtggcgtgctgggcaccatcctgaccatggtgcggactgagggtccctgcagcccctacaatgggctggtggccggcctgcagcgccagatgagcttcgcctccatccgcatcggcctctatgactccgtcaagcaggtgtacacccccaaaggcgcggacaacaacttcccctgccactttgtctctgcctttggagccggcttctgtgccacagtggtggcctccccggtggacgtggtgaagacccggtatatgaactcacctccaggccagtacttcagccccctcgactgtatgataaagatggtggcccaggagggccccacagccttctacaagggatttacaccctcctttttgcgtttgggatcctggaacgtggtgatgttcgtaacctatgagcagctgaaacgggccctgatgaaagtccagatgttacgggaatcaccgttttgaacaagacaagaaggccactggtagctaacgtgtccgaaaccagttaagaatggaagaaaacggtgcatccacgcacacatggacacagacccacacatgtttacagaactgttgtttacttgttgctgattcaagaaacagaagtagaagaggaggagggattctggtcttcactgccatgcctcaagaacacctttgttttgcactgacaagatggaaaataaattatattaatttttgaaacccattaggcatgcctaatatttaggcaagagaaaataaaccaagatagatccatttggacaaaatggaaggttggagacgtgtatccccgtgaaatctggttagataatgaatgataagcaggaaggatggcaagcacgggacaggaggggcccacaatggagtgggagatcagccacggagcctggagggatgccacccagcaacacagagctggcgactgcagctgcaccatcacacatgcatcatcagcctatttgtaatatgtctgccacagagagtcctttgggattctaggaaacccaaggaacaagagaaaaaactagagcctgtgctaaagaagccctgctgggcccatgtgaggctggggctcgtaaatattccctgacgacactgaagaatcaagagggcagcccccactttcctacaaaatggagggagccatcccttccctgtccacctcaccaggggtgctatgacatgcaagtgagaagctgggcatgaacgcactttataaaagcaaaagctctgtgtaaatctaactacaaggacaatgccttgggagagattttgtcgggacagagaggagttgccagggaagaaggtttgaaagatacggttgtctagaggtgagaccaaaggatccagagacttggggaccagaggtgacagtggatgacgtgaagccacaggagccccacccccatgcagcctcttccccaccccccccaccacgtgctcaatcatgagtacctcaaaggattgttgggcttgggggaaaagaggtggattcctgggcaagaacctaaagtagcaggactcggaattctcgggaaattattatgactcaataaaagaattcacaccttaggtgtgggagt

SEQ ID NO: 33855 - DNA, 1406 bp, Homo sapiens
agagacaacagtgaatgacaaggaggggccatccaatccctgctgccacctcctgggatggagccctagggagcccctgtgctgcccctgccgtggcaggactcacagccccaccgctgcactgaagcccagggctgtggagcagcctctctccttggacctcctctcggccctaaagggactgggcagagccttccaggactatggttggactgaagccttcagacgtgcctcccaccatggctgtgaagttcctgggggcaggcacagcagcctgttttgctgacctcgttacctttccactggacacagccaaggtccgcctgcagatccagggggagaaccaggcggtccagacggcccggctcgtgcagtaccgtggcgtgctgggcaccatcctgaccatggtgcggactgagggtccctgcagcccctacaatgggctggtggccggcctgcagcgccagatgagcttcgcctccatccgcatcggcctctatgactccgtcaagcaggtgtacacccccaaaggcgcggacaactccagcctcactacccggattttggccggctgcaccacaggagccatggcggtgacctgtgcccagcccacagatgtggtgaaggtccgatttcaggccagcatacacctcgggccatccaggagcgacagaaaatacagcgggactatggacgcctacagaaccatcgccagggaggaaggagtcaggggcctgtggaaaggaactttgcccaacatcatgaggaatgctatcgtcaactgtgctgaggtggtgacctacgacatcctcaaggagaagctgctggactaccacctgctcactgacaacttcccctgccactttgtctctgcctttggagccggcttctgtgccacagtggtggcctccccggtggacgtggtgaagacccggtatatgaactcacctccaggccagtacttcagccccctcgactgtatgataaagatggtggcccaggagggccccacagccttctacaaggggtgagcctcctcctgcctccagcactccctcccagagaacaggggcttctttcttttcgaatgtggctaccgtgggtcaacctgggatgtagcggtgaagagtacagatgtaaatgccacaaagaagaagtttaaaaaaccatgcaagtaaaagaaaaaaagtgaaccatacctgatggggagggttagggaagcctgactgagaacaaacactccaggaataggtaaaagtactgcctgtctccagaggaagttagcaatcctgagacctcctggacctcctgccatggccattgagcaccacactgaccatggccagtgccttcctcactgtctccacacgctccacgttttcttgcacttactgctccctctgcgt

SEQ ID NO: 33856 - DNA, 551 bp, Homo sapiens
attcaagggataggaacgtgacctgtttttataggccaaattcatgcagcttaagtatggcaccacccaggcttctccctttctaaagcccctcctgggtaaggaagagttcctgggagccaggccagacatcactccatcagccttctctggcctgtctcctgcagccccaccgctgcactgaagcccagggctgtggagcagcctctctccttggacctcctctcggccctaaagggactgggcagagccttccaggactatggttggactgaagccttcagacgtgcctcccaccatggctgtgaagttcctgggggcaggcacagcagcctgttttgctgacctcgttacctttccactggacacagccaaggtccgcctgcagatccagggggagaaccaggcggtccagacggcccggctcgtgcagtaccgtggcgtgctgggcaccatcctgaccatggtgcggactgagggtccctgcagcccctacaatgggctggtggccggcctgcagcgccagatgagcttcgcctccatccgcatcg

SEQ ID NO: 33857 - DNA, 1157 bp, Homo sapiens
cgccccagccccgggatgctgctccggccccgcaggccgcccccgctcgcgccccccgcgccgccctcgcccgccagccccgaccccgagccgcggacacccggagacgccccggggaccccgccccggaggcccgcctcgcccagcgcgctgggggaactcgggttgccggtgtccccgggctcggcgcagcgcacgccctggagcgcccgggagacggagctgctgctggggacgctgctgcaaccggccgtgtggcgcgcgctgctcctggaccgccgccaggccctgcccacctaccgccgcgtgtcggccgcgctggcccagcagcaggtgcgccgcacccccgcgcagtgccgccgccgctacaagttccttaaagacaagtttcgcgaggcgcacggccagccgcccgggcccttcgacgagcagatccggaagctcatggggctgctgggcgacaacgggcgcaaacggcctcgccgccgctccccggggtccgggcgcccccagcgcgcccgccgcccggtccccaacgcgcacgcgccggctcccagcgaaccagacgccaccccgctgcccaccgcccgcgaccgcgacgcggaccccacctggacgctccgcttcagcccgtccccaccgaagtctgcggacgcctcccccgcccccggctccccgccagctcccgccccgaccgccctcgccacctgcatccccgaggaccgcgcgcccgtccgcggccccgggtccccgccgccacccccggcccgcgaagaccccgactcgccgcccggccgccccgaggactgcgcgccccctccggccgcgcccccgtcgctgaacaccgccctgctgcagaccctggggcacctgggcgacatcgcgaacatcctgggcccgctgcgcgaccagctgctgaccttgaaccagcacgtggagcagctgcgcggcgccttcgaccagacagtgtccctggccgtgggcttcattctgggcagcgcggccgccgagcgaggggtcctcagggacccgtgccagtgagtcccggctgcggccagtctcccctctccaggccgaggcccctccgccctgacccctcctgctgccttcccacccccgttcttgggtatgttcaataaaaggattgttttcctaga

SEQ ID NO: 33858 - DNA, 5344 bp, Homo sapiens
cacggcgacggcggcggtggcggcagttcctgctctaggctgcgagcggctggcggcttcgaggggagctgaggcgcggaggggctcggcggcagcggcggcggctcggcactgttacctctcggtccggctggcgccggggcgcgcggtttggtcctttccgggcgcgcgggggcgacagcggcagcgacccgaggcctgcggcctaggcctcagcgcggcggcgggctcgagtgcagcgcggaaccggcccgagggccctacccggaggcaccatgagcgtggaggcgtacgggcccagctcgcagactctcactttcctggacacggaggaggccgagctgcttggcgccgacacacagggctccgagttcgagttcaccgactttactcttcctagccagacgcagacgccccccggcggccccggcggcccgggcggtggcggcgcgggaggcccgggcggcgcgggcgcgggcgctgcggcgggacagctcgacgcgcaggttgggcccgaaggcatcctgcagaacggggctgtggacgacagtgtagccaagaccagccagttgttggctgagttgaacttcgaggaagatgaagaagacacctattacacgaaggacctccccatacacgcctgcagttactgtggaatacacgatcctgcctgcgtggtttactgtaataccagcaagaagtggttctgcaacggacgtggaaatacttctggcagccacattgtaaatcaccttgtgagggcaaaatgcaaagaggtgaccctgcacaaggacgggcccctgggggagacagtcctggagtgctacaactgcggctgtcgcaacgtcttcctcctcggcttcatcccggccaaagctgactcagtggtggtgctgctgtgcaggcagccctgtgccagccagagcagcctcaaggacatcaactgggacagctcgcagtggcagccgctgatccaggaccgctgcttcctgtcctggctggtcaagatcccctccgagcaggagcagctgcgggcacgccagatcacggcacagcagatcaacaagctggaggagctgtggaaggaaaacccttctgccacgctggaggacctggagaagccgggggtggacgaggagccgcagcatgtcctcctgcggtacgaggacgcctaccagtaccagaacatattcgggcccctggtcaagctggaggccgactacgacaagaagctgaaggagtcccagactcaagataacatcactgtcaggtgggacctgggccttaacaagaagagaatcgcctacttcactttgcccaagactgactctgacatgcggctcatgcagggggatgagatatgcctgcggtacaaaggggaccttgcgcccctgtggaaagggatcggccacgtcatcaaggtccctgataattatggcgatgagatcgccattgagctgcggagcagcgtgggtgcacctgtggaggtgactcacaacttccaggtggattttgtgtggaagtcgacctcctttgacaggatgcagagcgcattgaaaacgtttgccgtggatgagacctcggtgtctggctacatctaccacaagctgttgggccacgaggtggaggacgtaatcatcaagtgccagctgcccaagcgcttcacggcgcagggcctccccgacctcaaccactcccaggtttatgccgtgaagactgtgctgcaaagaccactgagcctgatccagggcccgccaggcacggggaagacggtgacgtcggccaccatcgtctaccacctggcccggcaaggcaacgggccggtgctggtgtgtgctccgagcaacatcgccgtggaccagctaacggagaagatccaccagacggggctaaaggtcgtgcgcctctgcgccaagagccgtgaggccatcgactccccggtgtcttttctggccctgcacaaccagatcaggaacatggacagcatgcctgagctgcagaagctgcagcagctgaaagacgagactggggagctgtcgtctgccgacgagaagcggtaccgggccttgaagcgcaccgcagagagagagctgctgatgaacgcagatgtcatctgctgcacatgtgtgggcgccggtgacccgaggctggccaagatgcagttccgctccattttaatcgacgaaagcacccaggccaccgagccggagtgcatggttcccgtggtcctcggggccaagcagctgatccttgtaggcgaccactgccagctgggcccagtggtgatgtgcaagaaggcggccaaggccgggctgtcacagtcgctcttcgagcgcctggtggtgctgggcatccggcccatccgcctgcaggtccagtaccggatgcaccctgcactcagcgccttcccatccaacatcttctacgagggctccctccagaatggtgtcactgcagcggatcgtgtgaagaagggatttgacttccagtggccccaacccgataaaccgatgttcttctacgtgacccagggccaagaggagattgccagctcgggcacctcctacctgaacaggaccgaggctgcgaacgtggagaagatcaccacgaagttgctgaaggcaggcgccaagccggaccagattggcatcatcacgccctacgagggccagcgctcctacctggtgcagtacatgcagttcagcggctccctgcacaccaagctctaccaggaggtggagatcgccagtgtggacgcctttcagggacgcgagaaggacttcatcatcctgtcctgtgtgcgggccaacgagcaccaaggcattggctttttaaatgaccccaggcgtctgaacgtggccctgaccagagcaaggtatggcgtcatcattgtgggcaacccgaaggcactatcaaagcagccgctctggaaccacctgctgaactactataaggagcagaaggtgctggtggaggggccgctcaacaacctgcgtgagagcctcatgcagttcagcaagccacggaagctggtcaacactatcaacccgggagcccgcttcatgaccacagccatgtatgatgcccgggaggccatcatcccaggctccgtctatgatcggagcagccagggccggccttccagcatgtacttccagacccatgaccagattggcatgatcagtgccggccctagccacgtggctgccatgaacattcccatccccttcaacctggtcatgccacccatgccaccgcctggctattttggacaagccaacgggcctgctgcagggcgaggcaccccgaaaggcaagactggtcgtgggggacgccagaagaaccgctttgggcttcctggacccagccagactaacctccccaacagccaagccagccaggatgtggcgtcacagcccttctctcagggcgccctgacgcagggctacatctccatgagccagccttcccagatgagccagcccggcctctcccagccggagctgtcccaggacagttaccttggtgacgagtttaaatcacaaatcgacgtggcgctctcacaggactccacgtaccagggagagcgggcttaccagcatggcggggtgacggggctgtcccagtattaaaaggtggcggcggaagagctaagcaacgtggcttagtccatcagcatcttattctgggtaataaaaaataaaaataaacggatacctgttttccactgctaaaactgaagcaccactgtgtgagcaacaggaagggagagcgcacgagggagaggagccgaggccgagcgccccctgctggcccgcggcggcgaggagcagagggagcggaggaggggccggcccgcgggagccgcggccaccaggaggccccgctccgtcccatcggggctgcggccagggcggagggaggaagaccctcatctcagagtagccctttcctctgttcttttatttctttttctctttgattgaaaggggactacgtcttagcaggaaaaaaaacttcgcatttctgtgcccgagcaggctccttgcaaagacagcagcgtgcggggcagagccccgggagggcgcgtctgtccacgcctaccggacgcgccgaggtcgcgctgcctgtgttctccgagggccttcatttaaagaaaataagggtgttttgggtttttctctttgtttttttcaagattcttttaaaggagtactgaagaatactttcctaagtttgtctgtaaaatcttagcggtggacctgggagatttgagaagcttccagaaacagtttaaacaagccagcgctactggagaagaggagcaacacctgtgccgcggccggaggagttttgttgttggttttagcttccagtggcttctttctgcggggcatcaggctgctggggtagccgcccgccgagcctggaagctgctcgttctccgctggactcagaagccaagctgcttcccgcctagactcggcgcagggccccgcaccggtgaggaaggtgcttttggccccattgcgaggggccttggccaggactggccctgtggccaggaggcgagaaggtggctgttcccggattgacggctttttcccgggggcctttggaagatttggtggaaggacaagagggcctgtccctgtccccgtccccaggaggtaccgacagtccctgtgctggttagacacggagcgctgcacaccgaaagcccaaattgggagctctgcctgccggcaactttgctgatggggtgattgctgcttctggggggtaaggaaacaagttacagaaattaccgcgttctgtgtgaagggactgagggtgtggtgtcattggcagagggtcattttaggagagctgccccagcccctcgaacgcctggcttggggtgtcattctgcctggcggccaggcctccagcttcccctgccccgggcctggggctgtcactggccctgatccgaacacctccagattccggcttctacatgggacagacggggacgcacaggccaccttccttctggcagggactcttatttattcccattgctctagggctttcggtttccccttcttccggtaggccgcgtagaggcatgcaccgggtaggtttccgcggtgaccccgcggcggcctgagggacgctccctgccccatcccggctgttgggctgggccgctttgcctctgcttcgccctgtgctgtgttctccagctttgtagcagcagccttgacaaacccaggcgcactgtaccaaggcaatgtaacttttgattttcggtcaatttaagttcttttgtcaccaaatattaataaacagttttgacttc

SEQ ID NO: 33859 - DNA, 1740 bp, Homo sapiens
atgccagctgagcgtaaaaagccagcaagtatggaagaaaaagactctttaccaaacaacaaggaaaaagactgcagtgaaaggcggacagtgagcagcaaggagaggccaaaagacgatatcaagctcactgccaagaaggaggtcagcaaggcccctgaagaatcaaagaaaaaagaagaggaagaaaaaaagaaacatcaagaggaagagagaaagaagcaagaagagcaggccaaacgtcagcaagaagaagaagcagctgctcagatgaaagaaaaagaagaatccattcagcttcatcaggaagcttgggaacgacatcatttaagaaaggaacttcgtagcaaaaaccaaaatgctccggacagccgaccagaggaaaacttcttcagccgcctcgactcaagtttgaagaaaaatactgcttttgtcaagaaactaaaaactattacagaacaacagagagactccttgtcccatgattttaatggcctaaatttaagcaaatacattgcagaagctgtagcttccatcgtggaagcaaaactaaaaatctctgatgtgaactgtgctgtgcacctctgctctctctttcaccagcgttatgctgactttgccccatcacttcttcaggtctggaaaaaacattttgaagcaaggaaagaggagaaaacacctaacatcaccaagttaagaactgatttgcgttttattgcagaattgacaatagttgggattttcactgacaaggaaggtctttccttaatctatgaacagctaaaaaatattattaatgctgatcgggagtcccacactcatgtctctgtagtgattagtttctgtcgacattgtggagatgatattgctggacttgtaccaaggaaagtaaagagtgctgcagagaagtttaatttgagttttcctcctagtgagataattagtccagagaaacaacagcccttccagaatcttttaaaagagtactttacgtctttgaccaaacacctgaaaagggaccacagggagctccagaatactgagagacaaaacaggcgcattctacattctaaaggggagctcagtgaagatagacataaacagtatgaggaatttgctatgtcttaccagaagctgctggcaaattctcaatccttagcagaccttttggatgaaaatatgccagatcttcctcaagacaaaccaacaccagaagaacatgggcctggaattgatatattcacacctggtaaacctggagaatatgacttggaaggtggtatatgggaagatgaagatgctcggaatttttatgagaacctcattgatttgaaggcttttgtcccagccatcttgtttaaagacaatgaaaaaagttgtcagaataaagagtccaacaaagatgataccaaagaggcaaaagaatctaaggagaataaggaggtatcaagtcccgatgatttggaacttgagttggagaatctagaaattaatgatgacaccttagaattagagggtggagatgaagctgaagatcttacaaagaaacttcttgatgaacaagaacaagaagatgaggaagccagcactggatctcatctcaagctcatagtagatgctttcctacagcagttacccaactgtgtcaaccgagatctgatagacaaggcggaaaaggccttttgtaatggaaatctcgcgagggttaatcttctcttgagaatggcagtcaagaaatga

SEQ ID NO: 33860 - DNA, 5569 bp, Homo sapiens
gctgaaatactgacattgaatattatatgaaatagtgaactgccatctttcatggttgtcaaatgctagggttaaagctgactcaaaatgttcacagatatattctgaagtatttacaattaaatgacatattgttttggagttgatagtggctgaatctgagtgatgggtacgtggaggttccttatattatgctctctacttttgtctgggcttggatttttccttataaaaagtaaaaaacaagtacttagacataggcctaactaataatgataggatgtggaatgtgatgaataacttattttgtaacagaaatagtattcattttacctgcctttatttactcttttacaattgccaagttgcattaatatgttctgtttaaaaaaatagtgtgatatcattttaaaaagtcactgcatctatggtactgacattctttccctcttacagattgtcctgggtcacataatgccagctgagcgtaaaaagccagcaagtatggaagaaaaagactctttaccaaacaacaaggaaaaagactgcagtgaaaggcggacagtgagcagcaaggagaggccaaaagacgatatcaagctcactgccaagaaggaggtcagcaaggcccctgaagacaagaagaagagactggaagatgataagagaaaaaaggaagacaaggaacgcaagaaaaaagacgaagaaaaggtgaaggcagaggaagaatcaaagaaaaaagaagaggaagaaaaaaagaaacatcaagaggaagagagaaagaagcaagaagagcaggccaaacgtcagcaagaagaagaagcagctgctcagatgaaagaaaaagaagaatccattcagcttcatcaggaagcttgggaacgacatcatttaagaaaggaacttcgtagcaaaaaccaaaatgctccggacagccgaccagaggaaaacttcttcagccgcctcgactcaagtttgaagaaaaatactgcttttgtcaagaaactaaaaactattacagaacaacagagagactccttgtcccatgattttaatggcctaaatttaagcaaatacattgcagaagctgtagcttccatcgtggaagcaaaactaaaaatctctgatgtgaactgtgctgtgcacctctgctctctctttcaccagcgttatgctgactttgccccatcacttcttcaggtctggaaaaaacattttgaagcaaggaaagaggagaaaacacctaacatcaccaagttaagaactgatttgcgttttattgcagaattgacaatagttgggattttcactgacaaggaaggtctttccttaatctatgaacagctaaaaaatattattaatgctgatcgggagtcccacactcatgtctctgtagtgattagtttctgtcgacattgtggagatgatattgctggacttgtaccaaggaaagtaaagagtgctgcagagaagtttaatttgagttttcctcctagtgagataattagtccagagaaacaacagcccttccagaatcttttaaaagagtactttacgtctttgaccaaacacctgaaaagggaccacagggagctccagaatactgagagacaaaacaggcgcattctacattctaaaggggagctcagtgaagatagacataaacagtatgaggaatttgctatgtcttaccagaagctgctggcaaattctcaatccttagcagaccttttggatgaaaatatgccagatcttcctcaagacaaaccaacaccagaagaacatgggcctggaattgatatattcacacctggtaaacctggagaatatgacttggaaggtggtatatgggaagatgaagatgctcggaatttttatgagaacctcattgatttgaaggcttttgtcccagccatcttgtttaaagacaatgaaaaaagttgtcagaataaagagtccaacaaagatgataccaaagaggcaaaagaatctaaggagaataaggaggtatcaagtcccgatgatttggaacttgagttggagaatctagaaattaatgatgacaccttagaattagagggtggagatgaagctgaagatcttacaaagaaacttcttgatgaacaagaacaagaagatgaggaagccagcactggatctcatctcaagctcatagtagatgctttcctacagcagttacccaactgtgtcaaccgagatctgatagacaaggcagcaatggatttttgcatgaacatgaacacaaaagcaaacaggaagaagttggtacgggcactcttcatagttcctagacaaaggttggatttgctaccattttatgcaagattggttgctacattgcatccctgcatgtctgatgtagcagaggatctttgttccatgctgaggggggatttcagatttcatgtacggaaaaaggaccagatcaatattgaaacaaagaataaaactgttcgttttataggagaactaactaagtttaagatgttcaccaaaaatgacacactgcattgtttaaagatgcttctgtcagacttctctcatcaccatattgaaatggcatgcaccctgctggagacatgtggacggtttcttttcagatctccagaatctcacctgaggaccagtgtacttttggagcaaatgatgagaaagaagcaagcaatgcatcttgatgcgagatacgtcacaatggtagagaatgcatattactactgcaacccacctccagctgaaaaaaccgtgaaaaagaaacgtcctcctctccaggaatatgtccggaaacttttgtacaaggatctctctaaggttaccaccgagaaggttttgagacagatgcgaaagctgccctggcaggaccaagaagtgaaagactatgttatttgttgtatgataaacatctggaatgtgaaatataatagtattcattgtgtagccaacctcttagcaggactagtgctctaccaagaggatgttgggatccacgttgtggatggagtgttagaagatattcgattaggaatggaggttaatcaacctaaatttaatcagaggcgcatcagcagtgccaagttcttaggagaactttacaattaccgaatggtggaatcagctgttattttcagaactctgtattcttttacctcatttggtgttaatcctgatggctctccaagttccctggacccacctgagcatcttttcagaattagactcgtatgcactattctggacacatgtggccagtactttgacagaggttccagtaaacgaaaacttgattgtttccttgtatattttcagcgttatgtttggtggaagaaaagtttggaggtttggacaaaagaccatccatttcctattgatatagattacatgatcagtgatacactagaactgctaagaccaaagatcaaactctgtaattctctggaagaatccatcaggcaggtacaagacttggaacgagaattcttaataaaactaggcctagtaaatgacaaagactcaaaagattctatgacagaaggagaaaatcttgaagaggatgaagaagaagaagaaggtggggctgaaacagaagaacaatctggaaatgaaagtgaagtaaatgagccagaagaagaggagggttctgataatgatgatgatgagggagaagaagaggaggaagagaatacagattaccttacagattccaataaggaaaatgaaaccgatgaagagaatactgaggtaatgattaaaggcggtggacttaagcatgtaccttgtgtagaagatgaggacttcattcaagctctggataaaatgatgctagaaaatctacagcaacgaagtggtgaatctgttaaagtgcaccaactagatgttgccattcctttgcatctcaaaagccagctgaggaaagggcccccactgggaggtggggaaggagaggctgagtctgcagacacaatgccgtttgtcatgttaacaagaaaaggcaataaacagcagtttaagatccttaatgtacccatgtcctctcaacttgctgcaaatcactggaaccagcaacaggcagaacaagaagagaggatgagaatgaaaaagctcacactagatatcaatgaacggcaagaacaagaagattatcaagaaatgttgcagtctcttgcacagcgcccagctccagcaaacaccaatcgtgagaggcggcctcgctaccaacatccgaagggagcacctaatgcagatctaatctttaagactggtgggaggagacgttgatccagcagcacgtgtcatttcattaggtcctgtatctgatgttgtggttagtggagtcctccagcaattgaatgagagcagtggacacatctcagcaggtcggtctagagagttgcgaatctaaacctgggacaggctggggccaggaggcagaaacaccagcctctgccaacaccggaacaagccgacgcttccagacaaggcggaaaaggccttttgtaatggaaatctcgcgagggttaatcttctcttgagaatggcagtcaagaaatgagatggttcacttgactactgagcagttacaccaaggagagcgtgaaggagatgattgagccagagaagaaacgggttgtgatggtaatggtgtgggggaaatgaacttgagctttaaacttgatttgagtttcagtgtctctgaattgaacatcccacgttggaagaagatacatttgggggctccaggactacagtagaaaagtatagagcaagcaggaaaatcttctagtaaaacttacatgcaggacaacaaaatgatgaaagatatccaaataccagataatccaccaggaaggcttttgtttaggaatttgtttcaagaggaacaagggatgagggagaaaaatccgttttatccatcagagtcagtgctataaaattgcctattaaggtaaaagaaaaatgtggagactattttactatacagagagcattaattcagatggcttagaaaagtgataccagcccaagaacagggatctaggtgagcccattgtaagtatcattgaaaacaaaacatgcccgtcaacatgtcacagaaaacgaacgaaggacaacaagaagtggatgagaatattttgttgaccttcatgggtttacagcctctgtctctaaacaaagtatggaaacaagtagagcttttattttgcttttgtttttgttttgtttttttttttgttttcccccactaaatagaaatgagggtccttagtctgtttctgacaatctgttaatttcttaggacagctgtctttggtttgctttccagcaggcgtagtatatttagtcggagagcacatctgtatgcgacaacttgattacatctttttttctagctattttgcattttttcttttaccatgtttcagtttctgcatgtagatttaaataaaaaacaaaacttgtaaagttgtaacatttcacatggaaatgctgcccaatcttcaccagcttcagaaatctgacctttgccgatgctgcaataaagtgttgtaattta

SEQ ID NO: 33861 - DNA, 5193 bp, Homo sapiens
gtggggggaggggaggggagagcccgagcgctggagttggtgctgggaaacccggggctaatgttgacaacaggctcgagattgtcctgggtcacataatgccagctgagcgtaaaaagccagcaagtatggaagaaaaagactctttaccaaacaacaaggaaaaagactgcagtgaaaggcggacagtgagcagcaaggagaggccaaaagacgatatcaagctcactgccaagaaggaggtcagcaaggcccctgaagacaagaagaagagactggaagatgataagagaaaaaaggaagacaaggaacgcaagaaaaaagacgaagaaaaggtgaaggcagaggaagaatcaaagaaaaaagaagaggaagaaaaaaagaaacatcaagaggaagagagaaagaagcaagaagagcaggccaaacgtcagcaagaagaagaagcagctgctcagatgaaagaaaaagaagaatccattcagcttcatcaggaagcttgggaacgacatcatttaagaaaggaacttcgtagcaaaaaccaaaatgctccggacagccgaccagaggaaaacttcttcagccgcctcgactcaagtttgaagaaaaatactgcttttgtcaagaaactaaaaactattacagaacaacagagagactccttgtcccatgattttaatggcctaaatttaagcaaatacattgcagaagctgtagcttccatcgtggaagcaaaactaaaaatctctgatgtgaactgtgctgtgcacctctgctctctctttcaccagcgttatgctgactttgccccatcacttcttcaggtctggaaaaaacattttgaagcaaggaaagaggagaaaacacctaacatcaccaagttaagaactgatttgcgttttattgcagaattgacaatagttgggattttcactgacaaggaaggtctttccttaatctatgaacagctaaaaaatattattaatgctgatcgggagtcccacactcatgtctctgtagtgattagtttctgtcgacattgtggagatgatattgctggacttgtaccaaggaaagtaaagagtgctgcagagaagtttaatttgagttttcctcctagtgagataattagtccagagaaacaacagcccttccagaatcttttaaaagagtactttacgtctttgaccaaacacctgaaaagggaccacagggagctccagaatactgagagacaaaacaggcgcattctacattctaaaggggagctcagtgaagatagacataaacagtatgaggaatttgctatgtcttaccagaagctgctggcaaattctcaatccttagcagaccttttggatgaaaatatgccagatcttcctcaagacaaaccaacaccagaagaacatgggcctggaattgatatattcacacctggtaaacctggagaatatgacttggaaggtggtatatgggaagatgaagatgctcggaatttttatgagaacctcattgatttgaaggcttttgtcccagccatcttgtttaaagacaatgaaaaaagttgtcagaataaagagtccaacaaagatgataccaaagaggcaaaagaatctaaggagaataaggaggtatcaagtcccgatgatttggaacttgagttggagaatctagaaattaatgatgacaccttagaattagagggtggagatgaagctgaagatcttacaaagaaacttcttgatgaacaagaacaagaagatgaggaagccagcactggatctcatctcaagctcatagtagatgctttcctacagcagttacccaactgtgtcaaccgagatctgatagacaaggcagcaatggatttttgcatgaacatgaacacaaaagcaaacaggaagaagttggtacgggcactcttcatagttcctagacaaaggttggatttgctaccattttatgcaagattggttgctacattgcatccctgcatgtctgatgtagcagaggatctttgttccatgctgaggggggatttcagatttcatgtacggaaaaaggaccagatcaatattgaaacaaagaataaaactgttcgttttataggagaactaactaagtttaagatgttcaccaaaaatgacacactgcattgtttaaagatgcttctgtcagacttctctcatcaccatattgaaatggcatgcaccctgctggagacatgtggacggtttcttttcagatctccagaatctcacctgaggaccagtgtacttttggagcaaatgatgagaaagaagcaagcaatgcatcttgatgcgagatacgtcacaatggtagagaatgcatattactactgcaacccacctccagctgaaaaaaccgtgaaaaagaaacgtcctcctctccaggaatatgtccggaaacttttgtacaaggatctctctaaggttaccaccgagaaggttttgagacagatgcgaaagctgccctggcaggaccaagaagtgaaagactatgttatttgttgtatgataaacatctggaatgtgaaatataatagtattcattgtgtagccaacctcttagcaggactagtgctctaccaagaggatgttgggatccacgttgtggatggagtgttagaagatattcgattaggaatggaggttaatcaacctaaatttaatcagaggcgcatcagcagtgccaagttcttaggagaactttacaattaccgaatggtggaatcagctgttattttcagaactctgtattcttttacctcatttggtgttaatcctgatggctctccaagttccctggacccacctgagcatcttttcagaattagactcgtatgcactattctggacacatgtggccagtactttgacagaggttccagtaaacgaaaacttgattgtttccttgtatattttcagcgttatgtttggtggaagaaaagtttggaggtttggacaaaagaccatccatttcctattgatatagattacatgatcagtgatacactagaactgctaagaccaaagatcaaactctgtaattctctggaagaatccatcaggcaggtacaagacttggaacgagaattcttaataaaactaggcctagtaaatgacaaagactcaaaagattctatgacagaaggagaaaatcttgaagaggatgaagaagaagaagaaggtggggctgaaacagaagaacaatctggaaatgaaagtgaagtaaatgagccagaagaagaggagggttctgataatgatgatgatgagggagaagaagaggaggaagagaatacagattaccttacagattccaataaggaaaatgaaaccgatgaagagaatactgaggtaatgattaaaggcggtggacttaagcatgtaccttgtgtagaagatgaggacttcattcaagctctggataaaatgatgctagaaaatctacagcaacgaagtggtgaatctgttaaagtgcaccaactagatgttgccattcctttgcatctcaaaagccagctgaggaaagggcccccactgggaggtggggaaggagaggctgagtctgcagacacaatgccgtttgtcatgttaacaagaaaaggcaataaacagcagtttaagatccttaatgtacccatgtcctctcaacttgctgcaaatcactggaaccagcaacaggcagaacaagaagagaggatgagaatgaaaaagctcacactagatatcaatgaacggcaagaacaagaagattatcaagaaatgttgcagtctcttgcacagcgcccagctccagcaaacaccaatcgtgagaggcggcctcgctaccaacatccgaagggagcacctaatgcagatctaatctttaagactggtgggaggagacgttgatccagcagcacgtgtcatttcattaggtcctgtatctgatgttgtggttagtggagtcctccagcaattgaatgagagcagtggacacatctcagcaggtcggtctagagagttgcgaatctaaacctgggacaggctggggccaggaggcagaaacaccagcctctgccaacaccggaacaagccgacgcttccagacaaggcggaaaaggccttttgtaatggaaatctcgcgagggttaatcttctcttgagaatggcagtcaagaaatgagatggttcacttgactactgagcagttacaccaaggagagcgtgaaggagatgattgagccagagaagaaacgggttgtgatggtaatggtgtgggggaaatgaacttgagctttaaacttgatttgagtttcagtgtctctgaattgaacatcccacgttggaagaagatacatttgggggctccaggactacagtagaaaagtatagagcaagcaggaaaatcttctagtaaaacttacatgcaggacaacaaaatgatgaaagatatccaaataccagataatccaccaggaaggcttttgtttaggaatttgtttcaagaggaacaagggatgagggagaaaaatccgttttatccatcagagtcagtgctataaaattgcctattaaggtaaaagaaaaatgtggagactattttactatacagagagcattaattcagatggcttagaaaagtgataccagcccaagaacagggatctaggtgagcccattgtaagtatcattgaaaacaaaacatgcccgtcaacatgtcacagaaaacgaacgaaggacaacaagaagtggatgagaatattttgttgaccttcatgggtttacagcctctgtctctaaacaaagtatggaaacaagtagagcttttattttgcttttgtttttgttttgtttttttttttgttttcccccactaaatagaaatgagggtccttagtctgtttctgacaatctgttaatttcttaggacagctgtctttggtttgctttccagcaggcgtagtatatttagtcggagagcacatctgtatgcgacaacttgattacatctttttttctagctattttgcattttttcttttaccatgtttcagtttctgcatgtagatttaaataaaaaacaaaacttgtaaagttgtaacatttcacatggaaatgctgcccaatcttcaccagcttcagaaatctgacctttgccgatgctgcaataaagtgttgtaattta

SEQ ID NO: 33862 - DNA, 1935 bp, Homo sapiens
cccaactgtgtcaaccgagatctgatagacaaggcagcaatggatttttgcatgaacatgaacacaaaagcaaacaggaagaagttggtacgggcactcttcatagttcctagacaaaggttggatttgctaccattttatgcaagattggttgctacattgcatccctgcatgtctgatgtagcagaggatctttgttccatgctgaggggggatttcagatttcatgtacggaaaaaggaccagatcaatattgaaacaaagaataaaactgttcgttttataggagaactaactaagtttaagatgttcaccaaaaatgacacactgcattgtttaaagatgcttctgtcagacttctctcatcaccatattgaaatggcatgcaccctgctggagacatgtggacggtttcttttcagatctccagaatctcacctgaggaccagtgtacttttggagcaaatgatgagaaagaagcaagcaatgcatcttgatgcgagatacgtcacaatggtagagaatgcatattactactgcaacccacctccagctgaaaaaaccgtgaaaaagaaacgtcctcctctccaggaatatgtccggaaacttttgtacaaggatctctctaaggttaccaccgagaaggttttgagacagatgcgaaagctgccctggcaggaccaagaagtgaaagactatgttatttgttgtatgataaacatctggaatgtgaaatataatagtattcattgtgtagccaacctcttagcaggactagtgctctaccaagaggatgttgggatccacgttgtggatggagtgttagaagatattcgattaggaatggaggttaatcaacctaaatttaatcagaggcgcatcagcagtgccaagttcttaggagaactttacaattaccgaatggtggaatcagctgttattttcagaactctgtattcttttacctcatttggtgttaatcctgatggctctccaagttccctggacccacctgagcatcttttcagaattagactcgtatgcactattctggacacatgtggccagtactttgacagaggttccagtaaacgaaaacttgattgtttccttgtatattttcagcgttatgtttggtggaagaaaagtttggaggtttggacaaaagaccatccatttcctattgatatagattacatgatcagtgatacactagaactgctaagaccaaagatcaaactctgtaattctctggaagaatccatcaggcaggtacaagacttggaacgagaattcttaataaaactaggcctagtaaatgacaaagactcaaaagattctatgacagaaggagaaaatcttgaagaggatgaagaagaagaagaaggtggggctgaaacagaagaacaatctggaaatgaaagtgaagtaaatgagccagaagaagaggagggttctgataatgatgatgatgagggagaagaagaggaggaagagaatacagattaccttacagattccaataaggaaaatgaaaccgatgaagagaatactgaggtaatgattaaaggcggtggacttaagcatgtaccttgtgtagaagatgaggacttcattcaagctctggataaaatgatgctagaaaatctacagcaacgaagtggtgaatctgttaaagtgcaccaactagatgttgccattcctttgcatctcaaaagccagctgaggaaagggcccccactgggaggtggggaaggagaggctgagtctgcagacacaatgccgtttgtcatgttaacaagaaaaggcaataaacagcagtttaagatccttaatgtacccatgtcctctcaacttgctgcaaatcactggaaccagcaacaggcagaaagaagagaggatgagaatgaaaaagctcacactagatatcaatga

SEQ ID NO: 33863 - DNA, 2840 bp, Homo sapiens
gtggggggaggggaggggagagcccgagcgctggagttggtgctgggaaacccggggctaatgttgacaacaggctcgagattgtcctgggtcacataatgccagctgagcgtaaaaagccagcaagtatggaagaaaaagactctttaccaaacaacaaggaaaaagactgcagtgaaaggcggacagtgagcagcaaggagaggccaaaagacgatatcaagctcactgccaagaaggaggtcagcaaggcccctgaagaatcaaagaaaaaagaagaggaagaaaaaaagaaacatcaagaggaagagagaaagaagcaagaagagcaggccaaacgtcagcaagaagaagaagcagctgctcagatgaaagaaaaagaagaatccattcagcttcatcaggaagcttgggaacgacatcatttaagaaaggaacttcgtagcaaaaaccaaaatgctccggacagccgaccagaggaaaacttcttcagccgcctcgactcaagtttgaagaaaaatactgcttttgtcaagaaactaaaaactattacagaacaacagagagactccttgtcccatgattttaatggcctaaatttaagcaaatacattgcagaagctgtagcttccatcgtggaagcaaaactaaaaatctctgatgtgaactgtgctgtgcacctctgctctctctttcaccagcgttatgctgactttgccccatcacttcttcaggtctggaaaaaacattttgaagcaaggaaagaggagaaaacacctaacatcaccaagttaagaactgatttgcgttttattgcagaattgacaatagttgggattttcactgacaaggaaggtctttccttaatctatgaacagctaaaaaatattattaatgctgatcgggagtcccacactcatgtctctgtagtgattagtttctgtcgacattgtggagatgatattgctggacttgtaccaaggaaagtaaagagtgctgcagagaagtttaatttgagttttcctcctagtgagataattagtccagagaaacaacagcccttccagaatcttttaaaagagtactttacgtctttgaccaaacacctgaaaagggaccacagggagctccagaatactgagagacaaaacaggcgcattctacattctaaaggggagctcagtgaagatagacataaacagtatgaggaatttgctatgtcttaccagaagctgctggcaaattctcaatccttagcagaccttttggatgaaaatatgccagatcttcctcaagacaaaccaacaccagaagaacatgggcctggaattgatatattcacacctggtaaacctggagaatatgacttggaaggtggtatatgggaagatgaagatgctcggaatttttatgagaacctcattgatttgaaggcttttgtcccagccatcttgtttaaagacaatgaaaaaagttgtcagaataaagagtccaacaaagatgataccaaagaggcaaaagaatctaaggagaataaggaggtatcaagtcccgatgatttggaacttgagttggagaatctagaaattaatgatgacaccttagaattagagggtggagatgaagctgaagatcttacaaagaaacttcttgatgaacaagaacaagaagatgaggaagccagcactggatctcatctcaagctcatagtagatgctttcctacagcagttacccaactgtgtcaaccgagatctgatagacaaggcggaaaaggccttttgtaatggaaatctcgcgagggttaatcttctcttgagaatggcagtcaagaaatgagatggttcacttgactactgagcagttacaccaaggagagcgtgaaggagatgattgagccagagaagaaacgggttgtgatggtaatggtgtgggggaaatgaacttgagctttaaacttgatttgagtttcagtgtctctgaattgaacatcccacgttggaagaagatacatttgggggctccaggactacagtagaaaagtatagagcaagcaggaaaatcttctagtaaaacttacatgcaggacaacaaaatgatgaaagatatccaaataccagataatccaccaggaaggcttttgtttaggaatttgtttcaagaggaacaagggatgagggagaaaaatccgttttatccatcagagtcagtgctataaaattgcctattaaggtaaaagaaaaatgtggagactattttactatacagagagcattaattcagatggcttagaaaagtgataccagcccaagaacagggatctaggtgagcccattgtaagtatcattgaaaacaaaacatgcccgtcaacatgtcacagaaaacgaacgaaggacaacaagaagtggatgagaatattttgttgaccttcatgggtttacagcctctgtctctaaacaaagtatggaaacaagtagagcttttattttgcttttgtttttgttttgtttttttttttgttttcccccactaaatagaaatgagggtccttagtctgtttctgacaatctgttaatttcttaggacagctgtctttggtttgctttccagcaggcgtagtatatttagtcggagagcacatctgtatgcgacaacttgattacatctttttttctagctattttgcattttttcttttaccatgtttcagtttctgcatgtagatttaaataaaaaacaaaacttgtaaagttgtaacatttcacatggaaatgctgcccaatcttcaccagcttcagaaatctgacctttgccgatgctgcaataaagtgttgtaattta

SEQ ID NO: 33864 - DNA, 5223 bp, Homo sapiens
gcatgccgcagggaagacgatcaggactgtttttaatcgggcagtcgcgcggatggccttttccctctcgcctccttccgccccgcccccactctcagcccggccgcgctgattgtcctgggtcacataatgccagctgagcgtaaaaagccagcaagtatggaagaaaaagactctttaccaaacaacaaggaaaaagactgcagtgaaaggcggacagtgagcagcaaggagaggccaaaagacgatatcaagctcactgccaagaaggaggtcagcaaggcccctgaagacaagaagaagagactggaagatgataagagaaaaaaggaagacaaggaacgcaagaaaaaagacgaagaaaaggtgaaggcagaggaagaatcaaagaaaaaagaagaggaagaaaaaaagaaacatcaagaggaagagagaaagaagcaagaagagcaggccaaacgtcagcaagaagaagaagcagctgctcagatgaaagaaaaagaagaatccattcagcttcatcaggaagcttgggaacgacatcatttaagaaaggaacttcgtagcaaaaaccaaaatgctccggacagccgaccagaggaaaacttcttcagccgcctcgactcaagtttgaagaaaaatactgcttttgtcaagaaactaaaaactattacagaacaacagagagactccttgtcccatgattttaatggcctaaatttaagcaaatacattgcagaagctgtagcttccatcgtggaagcaaaactaaaaatctctgatgtgaactgtgctgtgcacctctgctctctctttcaccagcgttatgctgactttgccccatcacttcttcaggtctggaaaaaacattttgaagcaaggaaagaggagaaaacacctaacatcaccaagttaagaactgatttgcgttttattgcagaattgacaatagttgggattttcactgacaaggaaggtctttccttaatctatgaacagctaaaaaatattattaatgctgatcgggagtcccacactcatgtctctgtagtgattagtttctgtcgacattgtggagatgatattgctggacttgtaccaaggaaagtaaagagtgctgcagagaagtttaatttgagttttcctcctagtgagataattagtccagagaaacaacagcccttccagaatcttttaaaagagtactttacgtctttgaccaaacacctgaaaagggaccacagggagctccagaatactgagagacaaaacaggcgcattctacattctaaaggggagctcagtgaagatagacataaacagtatgaggaatttgctatgtcttaccagaagctgctggcaaattctcaatccttagcagaccttttggatgaaaatatgccagatcttcctcaagacaaaccaacaccagaagaacatgggcctggaattgatatattcacacctggtaaacctggagaatatgacttggaaggtggtatatgggaagatgaagatgctcggaatttttatgagaacctcattgatttgaaggcttttgtcccagccatcttgtttaaagacaatgaaaaaagttgtcagaataaagagtccaacaaagatgataccaaagaggcaaaagaatctaaggagaataaggaggtatcaagtcccgatgatttggaacttgagttggagaatctagaaattaatgatgacaccttagaattagagggtggagatgaagctgaagatcttacaaagaaacttcttgatgaacaagaacaagaagatgaggaagccagcactggatctcatctcaagctcatagtagatgctttcctacagcagttacccaactgtgtcaaccgagatctgatagacaaggcagcaatggatttttgcatgaacatgaacacaaaagcaaacaggaagaagttggtacgggcactcttcatagttcctagacaaaggttggatttgctaccattttatgcaagattggttgctacattgcatccctgcatgtctgatgtagcagaggatctttgttccatgctgaggggggatttcagatttcatgtacggaaaaaggaccagatcaatattgaaacaaagaataaaactgttcgttttataggagaactaactaagtttaagatgttcaccaaaaatgacacactgcattgtttaaagatgcttctgtcagacttctctcatcaccatattgaaatggcatgcaccctgctggagacatgtggacggtttcttttcagatctccagaatctcacctgaggaccagtgtacttttggagcaaatgatgagaaagaagcaagcaatgcatcttgatgcgagatacgtcacaatggtagagaatgcatattactactgcaacccacctccagctgaaaaaaccgtgaaaaagaaacgtcctcctctccaggaatatgtccggaaacttttgtacaaggatctctctaaggttaccaccgagaaggttttgagacagatgcgaaagctgccctggcaggaccaagaagtgaaagactatgttatttgttgtatgataaacatctggaatgtgaaatataatagtattcattgtgtagccaacctcttagcaggactagtgctctaccaagaggatgttgggatccacgttgtggatggagtgttagaagatattcgattaggaatggaggttaatcaacctaaatttaatcagaggcgcatcagcagtgccaagttcttaggagaactttacaattaccgaatggtggaatcagctgttattttcagaactctgtattcttttacctcatttggtgttaatcctgatggctctccaagttccctggacccacctgagcatcttttcagaattagactcgtatgcactattctggacacatgtggccagtactttgacagaggttccagtaaacgaaaacttgattgtttccttgtatattttcagcgttatgtttggtggaagaaaagtttggaggtttggacaaaagaccatccatttcctattgatatagattacatgatcagtgatacactagaactgctaagaccaaagatcaaactctgtaattctctggaagaatccatcaggcaggtacaagacttggaacgagaattcttaataaaactaggcctagtaaatgacaaagactcaaaagattctatgacagaaggagaaaatcttgaagaggatgaagaagaagaagaaggtggggctgaaacagaagaacaatctggaaatgaaagtgaagtaaatgagccagaagaagaggagggttctgataatgatgatgatgagggagaagaagaggaggaagagaatacagattaccttacagattccaataaggaaaatgaaaccgatgaagagaatactgaggtaatgattaaaggcggtggacttaagcatgtaccttgtgtagaagatgaggacttcattcaagctctggataaaatgatgctagaaaatctacagcaacgaagtggtgaatctgttaaagtgcaccaactagatgttgccattcctttgcatctcaaaagccagctgaggaaagggcccccactgggaggtggggaaggagaggctgagtctgcagacacaatgccgtttgtcatgttaacaagaaaaggcaataaacagcagtttaagatccttaatgtacccatgtcctctcaacttgctgcaaatcactggaaccagcaacaggcagaacaagaagagaggatgagaatgaaaaagctcacactagatatcaatgaacggcaagaacaagaagattatcaagaaatgttgcagtctcttgcacagcgcccagctccagcaaacaccaatcgtgagaggcggcctcgctaccaacatccgaagggagcacctaatgcagatctaatctttaagactggtgggaggagacgttgatccagcagcacgtgtcatttcattaggtcctgtatctgatgttgtggttagtggagtcctccagcaattgaatgagagcagtggacacatctcagcaggtcggtctagagagttgcgaatctaaacctgggacaggctggggccaggaggcagaaacaccagcctctgccaacaccggaacaagccgacgcttccagacaaggcggaaaaggccttttgtaatggaaatctcgcgagggttaatcttctcttgagaatggcagtcaagaaatgagatggttcacttgactactgagcagttacaccaaggagagcgtgaaggagatgattgagccagagaagaaacgggttgtgatggtaatggtgtgggggaaatgaacttgagctttaaacttgatttgagtttcagtgtctctgaattgaacatcccacgttggaagaagatacatttgggggctccaggactacagtagaaaagtatagagcaagcaggaaaatcttctagtaaaacttacatgcaggacaacaaaatgatgaaagatatccaaataccagataatccaccaggaaggcttttgtttaggaatttgtttcaagaggaacaagggatgagggagaaaaatccgttttatccatcagagtcagtgctataaaattgcctattaaggtaaaagaaaaatgtggagactattttactatacagagagcattaattcagatggcttagaaaagtgataccagcccaagaacagggatctaggtgagcccattgtaagtatcattgaaaacaaaacatgcccgtcaacatgtcacagaaaacgaacgaaggacaacaagaagtggatgagaatattttgttgaccttcatgggtttacagcctctgtctctaaacaaagtatggaaacaagtagagcttttattttgcttttgtttttgttttgtttttttttttgttttcccccactaaatagaaatgagggtccttagtctgtttctgacaatctgttaatttcttaggacagctgtctttggtttgctttccagcaggcgtagtatatttagtcggagagcacatctgtatgcgacaacttgattacatctttttttctagctattttgcattttttcttttaccatgtttcagtttctgcatgtagatttaaataaaaaacaaaacttgtaaagttgtaacatttcacatggaaatgctgcccaatcttcaccagcttcagaaatctgacctttgccgatgctgcaataaagtgttgtaattt

SEQ ID NO: 33865 - DNA, 2235 bp, Homo sapiens
ggagagtgcggcatgcgctcggaaaaggagggggccggaggccttcgggcggccgttgccgcgcggggcccgagcgggagggagaagctgtcggccctagaagtgcagttccaccgcgactcgcagcagcaggaggctgagacgccgccaacttcgtcctccggttgcgggggcggtgcgggcaaacctcgcgaggagaagaggacggccctgagcaaggtggtcatccgccgcctgcctccgggcctcaccaaggagcagctggaggagcagctgcgcccgctgccagcacacgactacttcgagttcttcgccgccgacctgagtctttatcctcatctctactcaagagcatacattaattttaggaatcctgatgacatccttctttttagagatcgttttgatggatatatcttccttgacagcaaagatccagaatataagaagtttttagaaacctactgtgtggaggaagagaagaccagtgccaaccctgagactctgctgggggagatggaggcgaagacaagagagctcattgctagaagaaccacacctcttttggaatatattaaaaatagaaaattagaaaagcagagaattcgagaagagaagcgagaagaacggaggaggagagagttagaaaagaaacgtttgcgggaagaggaaaaaagaagaagaagagaagaagaaagatgcaaaaaaaaagagacagataaacagaagaaaattgcagagaaagaagtaaggattaagcttcttaagaaaccagaaaagggagaggaaccaaccacagagaaaccaaaagaaagaggagaggagattgatactggaggtggcaagcaggaatcctgtgcccccggtgcagtcgtaaaagccaggcccatggaaggctcgctggaggagccccaggagacgtcacacagcggcagtgataaagagcacagggatgtggagagatctcaagaacaagaatctgaagcacaaagataccatgtggatgacggcaggaggcacagagctcaccacgagcctgaacggctttccagaaggagtgaggatgagcagagatgggggaaaggacctggccaagacagagggaagaaggggagccaggacagcggggctccgggggaggccatggagagactgggaagagcgcagaggtgtgacgacagtccagcacccagaaaagagcgactggcaaacaaggaccggccagccttgcagctgtatgatccaggagctcgcttccgagcgcgagagtgtggcggaaacaggaggatctgcaaggcagaaggttcggggactggtcctgagaagagggaagaggcagagtgagtcactgcacgcacctggcctccatggacgagcaagggcatcccagaaacgtgtaaatgaccccgagtgtgactgggaaggagaacttattccttaccaggaaactggaagctaaaaatacagagggtgacgtagaaacacgcagaaaccattctaaagaaagtagtgatcttgtattaaattgagcagaattctcacagattttaccattcctgttataaactagtatttgttgtttagccaaaacagaaaatgatttccactggacagtagaaaaatatgtgtaaaatagggaagaaagttagtattggatcagtgtgagtcctgaagcactttcagtgctgtgagaacgacatccactttgggtttcattcgtttgtaagcagaggagctgtcagtcactcgtgcttctcggtggcctctgagccatggtgtcgagtgaagagtagttcttgtttgttacaacctttgtgagtcagccatgcccgcaaagcgtgctgtgttttagtcctggtaggaatatttatcagagttcacactatataaaacccaacagcttcaactattgccctttcaacagttttgccactgaccggatagaaacggtttcagtctctggatggatgtgtttgtggtttgtaaccattacggtttaaaccatggtttaagaatttgcccaaataacagaaattttgttcgggaagggataaactagatatagcatacagagcctgtttttgagttttagatactttatttgtaaataacttaaaatagctttctgaaaccgtgcattctgtagtttcttcctttcagtgaaattgctaaatgtcaatgtatttttggcactgcgattttaaccatttattaaataaaaattttgttaaagaa

SEQ ID NO: 33866 - DNA, 2378 bp, Homo sapiens
agctctcgcgaggtttcgtcgggggctggcggctgcggctcggcggagagtgcggcatgcgctcggaaaaggagggggccggaggccttcgggcggccgttgccgcgcggggcccgagcgggagggagaagctgtcggccctagaagtgcagttccaccgcgactcgcagcagcaggaggctgagacgccgccaacttcgtcctccggttgcgggggcggtgcgggcaaacctcgcgaggagaagaggacggccctgagcaaggtggtcatccgccgcctgcctccgggcctcaccaaggagcagctggaggagcagctgcgcccgctgccagcacacgactacttcgagttcttcgccgccgacctgagtctttatcctcatctctactcaagagcatacattaattttaggaatcctgatgacatccttctttttagagatcgttttgatggatatatcttccttgacagcaaaggcctagaatatcctgcagtggtagagtttgctccattccagaagatagccaaaaagaagctgagaaaaaaagatgccaagactggaagcatcgaagatgatccagaatataagaagtttttagaaacctactgtgtggaggaagagaagaccagtgccaaccctgagactctgctgggggagatggaggcgaagacaagagagctcattgctagaagaaccacacctcttttggaatatattaaaaatagaaaattagaaaagcagagaattcgagaagagaagcgagaagaacggaggaggagagagttagaaaagaaacgtttgcgggaagaggaaaaaagaagaagaagagaagaagaaagatgcaaaaaaaaagagacagataaacagaagaaaattgcagagaaagaagtaaggattaagcttcttaagaaaccagaaaagggagaggaaccaaccacagagaaaccaaaagaaagaggagaggagattgatactggaggtggcaagcaggaatcctgtgcccccggtgcagtcgtaaaagccaggcccatggaaggctcgctggaggagccccaggagacgtcacacagcggcagtgataaagagcacagggatgtggagagatctcaagaacaagaatctgaagcacaaagataccatgtggatgacggcaggaggcacagagctcaccacgagcctgaacggctttccagaaggagtgaggatgagcagagatgggggaaaggacctggccaagacagagggaagaaggggagccaggacagcggggctccgggggaggccatggagagactgggaagagcgcagaggtgtgacgacagtccagcacccagaaaagagcgactggcaaacaaggaccggccagccttgcagctgtatgatccaggagctcgcttccgagcgcgagagtgtggcggaaacaggaggatctgcaaggcagaaggttcggggactggtcctgagaagagggaagaggcagagtgagtcactgcacgcacctggcctccatggacgagcaagggcatcccagaaacgtgtaaatgaccccgagtgtgactgggaaggagaacttattccttaccaggaaactggaagctaaaaatacagagggtgacgtagaaacacgcagaaaccattctaaagaaagtagtgatcttgtattaaattgagcagaattctcacagattttaccattcctgttataaactagtatttgttgtttagccaaaacagaaaatgatttccactggacagtagaaaaatatgtgtaaaatagggaagaaagttagtattggatcagtgtgagtcctgaagcactttcagtgctgtgagaacgacatccactttgggtttcattcgtttgtaagcagaggagctgtcagtcactcgtgcttctcggtggcctctgagccatggtgtcgagtgaagagtagttcttgtttgttacaacctttgtgagtcagccatgcccgcaaagcgtgctgtgttttagtcctggtaggaatatttatcagagttcacactatataaaacccaacagcttcaactattgccctttcaacagttttgccactgaccggatagaaacggtttcagtctctggatggatgtgtttgtggtttgtaaccattacggtttaaaccatggtttaagaatttgcccaaataacagaaattttgttcgggaagggataaactagatatagcatacagagcctgtttttgagttttagatactttatttgtaaataacttaaaatagctttctgaaaccgtgcattctgtagtttcttcctttcagtgaaattgctaaatgtcaatgtatttttggcactgcgattttaaccatttattaaataaaaattttgttaaagaa

SEQ ID NO: 33867 - DNA, 1464 bp, Homo sapiens
ggaaaaggagggggccggaggccttcgggcggccgttgccgcgcggggcccgagcgggagggagaagctgtcggccctagaagtgcagttccaccgcgactcgcagcagcaggaggctgagacgccgccaacttcgtcctccggttgcgggggcggtgcgggcaaacctcgcgaggagaagaggacggccctgagcaaggtggtcatccgccgcctgcctccgggcctcaccaaggagcagctggaggagcagctgcgcccgctgccagcacacgactacttcgagttcttcgccgccgacctgagtctttatcctcatctctactcaagagcatacattaattttaggaatcctgatgacatccttctttttagagatcgttttgatggatatatcttccttgacagcaaaggcctagaatatcctgcagtggtagagtttgctccattccagaagatagccaaaaagaagctgagaaaaaaagatgccaagactggaagcatcgaagatgatccagaatataagaagtttttagaaacctactgtgtggaggaagagaagaccagtgccaaccctgagactctgctgggggagatggaggcgaagacaagagagctcattgctagaagaaccacacctcttttggaatatattaaaaatagaaaattagaaaagcagagaattcgagaagagaagcgagaagaacggaggaggagagagttagaaaagaaacgtttgcgggaagaggaaaaaagaagaagaagagaagaagaaagatgcaaaaaaaaagagacagataaacagaagaaaattgcagagaaagaagtaaggattaagcttcttaagaaaccagaaaagggagaggaaccaaccacagagaaaccaaaagaaagaggagaggagattgatactggaggtggcaagcaggaatcctgtgcccccggtgcagtcgtaaaagccaggcccatggaaggctcgctggaggagccccaggagacgtcacacagcggcagtgataaagagcacagggatgtggagagatctcaagaacaagaatctgaagcacccagaaaagagcgactggcaaacaaggaccggccagccttgcagctgtatgatccaggagctcgcttccgagcgcgagagtgtggcggaaacaggaggatctgcaaggcagaaggttcggggactggtcctgagaagagggaagaggcagagtgagtcactgcacgcacctggcctccatggacgagcaagggcatcccagaaacgtgtaaatgaccccgagtgtgactgggaaggagaacttattccttaccaggaaactggaagctaaaaatacagagggtgacgtagaaacacgcagaaaccattctaaagaaagtagtgatcttgtattaaattgagcagaattctcacagattttaccattcctgttataaactagtatttgttgtttagcc

SEQ ID NO: 33868 - DNA, 2378 bp, Homo sapiens
gcttcccgggagccgtttgtgcccggggtaaccccgttccggccaagccgcttcagcgggggacgtagccatgaaggaagagaaggagcacaggcctaaggagaagcgagtaaccctgttaacccccgccggggccacaggcagcggtggtgggacctcgggggacagctccaagggggaagataagcaggatcgcaacaaggagaagaaagaagcgctgagcaaggtggtaattcgaagattacctcccactttgaccaaggagcagcttcaggaacatcttcaacctatgcctgagcatgattattttgagtttttttctaatgatacgagtttgtatcctcatatgtatgccagagcatacatcaactttaaaaaccaagaggacattattttgttcagggatcgctttgatggttatgtattccttgacaataaaggtcaggaatatcccgctatagtagaatttgcaccttttcaaaaagctgcaaaaaagaagactaagaaaagagataccaaagtcgggactatcgatgatgatccagaatatagaaagtttttggaaagttatgccacagataatgagaaaatgacatctactccagagacactgctagaggaaatagaagcaaaaaatagagaattaatagctaaaaagacaaccccacttttgagcttcctgaaaaacaagcagagaatgagagaagaaaagagagaagaaaggaggaggagagaaatagaaagaaaaagacaaagagaagaagagaggaggaaatggaaagaagaagagaaacgaaaaaggaaagatatagaaaagctaaagaagatagacagaattccagaaagggacaaattaaaggatgaaccaaagattaaggtacacaggtttctgttacaagctgtgaatcagaaaaatctgctcaagaagccagaaaaaggagatgaaaaagaattggacaaaagagaaaaagccaagaaattggacaaagagaatctcagtgatgaaagagccagtgggcaaagttgtacattgcccaagcgttctgatagcgaacttaaagatgaaaaaccaaagagacctgaagatgagagcggcagagactatagggagagggaacgggaatatgaacgagatcaggagcgcatacttcgagaaagagagaggctgaagcggcaagaagaagagcgccgtaggcagaaggagcgctatgagaaagagaagacttttaagagaaaagaagaagaaatgaaaaaagagaaagacacacttcgggataaaggaaagaaggctgaaagtacagaatcaataggcagctcagaaaaaactgaaaagaaagaagaagtggtcaagagagatcgaataagaaacaaggatcgtccagcgatgcagctttaccaaccaggagctcgaagccgaaatcgactctgtccccctgatgacagcaccaagtctggagattcagcagcagaaaggaagcaggaaagtggtattagccatagaaaagaaggaggagaggagtgataagtccagatggccttaggtgtcctgactgtctaggcagccaaagagcacacgttaagcaatccagaggtgccttcagggcaaagaatagagagaaagggagccgctgtgctggtggggtacactgcagaggagtaagtcttgtgtcaaagcaggaatctgatcagaggttcagaattggaagtacaatttcattgcttttgcaatttctacaaattaattttaaagtgtcagaaaaaggtgacggcaaggacatgcattgcaatttgcagggggaattgtcaagtgaggacttcatcacatatgacacgagagaaaagtaagagctggttctaaaatcaaaagctgttgttcatcctgaattgaattttctgaatttgggtggagcagagtcgctttgaagccttgttccgatctaattctattgtattgttgatgataagtgttgacattgggtagtgtagaagcaacaagcatgtccttgtagtacaggtacagtgaaggatagaacacactttcgttgatacaaaaatttaaatagttatgttacttctgtatccagtgtcctaaagttttaggattagttttagttttttgtttgcttatatgagcttagcgtaaagaatatttttaaacttcgtgttttgtcatcagcatcttttctattaagaggtaaaatgtagtccttgtttgactcttgacaatccagtgtgtttgatcttaggtctcatgatctgagtgcataccctctccaggaaggaaactgcaccagtgtctattcctgttaaatagcaacttttagtctcagcttgtttcgttttgatgtcaataaatagtaacagcattcaagtgtgaa
